United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 59

SEQ ID NO: 2100302 - RNA, 23 nt, Staphylococcus aureus subsp. aureus MW2
agaaagcgucuuuuuauacuuga

SEQ ID NO: 2100303 - RNA, 17 nt, Staphylococcus aureus subsp. aureus MW2
agaaagugcgguuauuu

SEQ ID NO: 2100304 - RNA, 21 nt, Staphylococcus aureus subsp. aureus MW2
agaaauaacgauaccuuuaau

SEQ ID NO: 2100305 - RNA, 15 nt, Staphylococcus aureus subsp. aureus MW2
acuugaugaaacuga

SEQ ID NO: 2100306 - RNA, 16 nt, Staphylococcus aureus subsp. aureus MW2
acuugaugaaacugau

SEQ ID NO: 2100307 - RNA, 13 nt, Staphylococcus aureus subsp. aureus MW2
acuugauauuaua

SEQ ID NO: 2100308 - RNA, 20 nt, Staphylococcus aureus subsp. aureus MW2
acuugauauuauauaaaagu

SEQ ID NO: 2100309 - RNA, 16 nt, Staphylococcus aureus subsp. aureus MW2
acuuuugauuuugaau

SEQ ID NO: 2100310 - RNA, 18 nt, Staphylococcus aureus subsp. aureus MW2
acuugauuuucuaaagcu

SEQ ID NO: 2100311 - RNA, 23 nt, Staphylococcus aureus subsp. aureus MW2
acuuuuuaaacguacauuuuuau

SEQ ID NO: 2100312 - RNA, 12 nt, Staphylococcus aureus subsp. aureus MW2
acuuuuuaaagg

SEQ ID NO: 2100313 - RNA, 19 nt, Staphylococcus aureus subsp. aureus MW2
agaaaaagugauaauuaaa

SEQ ID NO: 2100314 - RNA, 14 nt, Staphylococcus aureus subsp. aureus MW2
agaaaaauaugauu

SEQ ID NO: 2100315 - RNA, 17 nt, Staphylococcus aureus subsp. aureus MW2
agaaaacauaaauacaa

SEQ ID NO: 2100316 - RNA, 18 nt, Staphylococcus aureus subsp. aureus MW2
acuuuuuauaucaaaauc

SEQ ID NO: 2100317 - RNA, 11 nt, Staphylococcus aureus subsp. aureus MW2
agaaacacuuu

SEQ ID NO: 2100318 - RNA, 16 nt, Staphylococcus aureus subsp. aureus MW2
agaaacagcaguaaga

SEQ ID NO: 2100319 - RNA, 23 nt, Staphylococcus aureus subsp. aureus MW2
agaaaaguuacuuacgccaauca

SEQ ID NO: 2100320 - RNA, 21 nt, Staphylococcus aureus subsp. aureus MW2
agaaaagcagucgaacaauga

SEQ ID NO: 2100321 - RNA, 15 nt, Staphylococcus aureus subsp. aureus MW2
agaagcugacgaaaa

SEQ ID NO: 2100322 - RNA, 19 nt, Staphylococcus aureus subsp. aureus MW2
agaagcugacgaaaaguca

SEQ ID NO: 2100323 - RNA, 13 nt, Staphylococcus aureus subsp. aureus MW2
agaagcuggcgga

SEQ ID NO: 2100324 - RNA, 16 nt, Staphylococcus aureus subsp. aureus MW2
agaagcuggcggaaag

SEQ ID NO: 2100325 - RNA, 19 nt, Staphylococcus aureus subsp. aureus MW2
agaagcuggcggaaaguca

SEQ ID NO: 2100326 - RNA, 15 nt, Staphylococcus aureus subsp. aureus MW2
agaagcuuucuggaa

SEQ ID NO: 2100327 - RNA, 23 nt, Staphylococcus aureus subsp. aureus MW2
agaacuaagaugugcaucccgaa

SEQ ID NO: 2100328 - RNA, 14 nt, Staphylococcus aureus subsp. aureus MW2
agaacuaauguaaa

SEQ ID NO: 2100329 - RNA, 19 nt, Staphylococcus aureus subsp. aureus MW2
agaacuaucgauacuaaac

SEQ ID NO: 2100330 - RNA, 23 nt, Staphylococcus aureus subsp. aureus MW2
agaaccuauauuaagcauuuguc

SEQ ID NO: 2100331 - RNA, 15 nt, Staphylococcus aureus subsp. aureus MW2
agaacguucuaaggu

SEQ ID NO: 2100332 - RNA, 14 nt, Staphylococcus aureus subsp. aureus MW2
agaacaagaauuau

SEQ ID NO: 2100333 - RNA, 15 nt, Staphylococcus aureus subsp. aureus MW2
agaacaauaauugau

SEQ ID NO: 2100334 - RNA, 17 nt, Staphylococcus aureus subsp. aureus MW2
agaacagauauacuacu

SEQ ID NO: 2100335 - RNA, 20 nt, Staphylococcus aureus subsp. aureus MW2
agaacaucaucauguuuauu

SEQ ID NO: 2100336 - RNA, 21 nt, Staphylococcus aureus subsp. aureus MW2
agaacaucaucauguuuauua

SEQ ID NO: 2100337 - RNA, 13 nt, Staphylococcus aureus subsp. aureus MW2
agaaauauaguaa

SEQ ID NO: 2100338 - RNA, 21 nt, Staphylococcus aureus subsp. aureus MW2
agaaauauaguaacagacuuu

SEQ ID NO: 2100339 - RNA, 12 nt, Staphylococcus aureus subsp. aureus MW2
aaaacaauaaua

SEQ ID NO: 2100340 - RNA, 15 nt, Staphylococcus aureus subsp. aureus MW2
aaaacaauaauaaua

SEQ ID NO: 2100341 - RNA, 13 nt, Staphylococcus aureus subsp. aureus MW2
aaaacaaugauua

SEQ ID NO: 2100342 - RNA, 21 nt, Staphylococcus aureus subsp. aureus MW2
agaaauucuacagacaaugca

SEQ ID NO: 2100343 - RNA, 18 nt, Staphylococcus aureus subsp. aureus MW2
agaaauuagaaccaucau

SEQ ID NO: 2100344 - RNA, 17 nt, Staphylococcus aureus subsp. aureus MW2
aaaacaaugauuaaaau

SEQ ID NO: 2100345 - RNA, 15 nt, Staphylococcus aureus subsp. aureus MW2
agacaccuucaauau

SEQ ID NO: 2100346 - RNA, 20 nt, Staphylococcus aureus subsp. aureus MW2
agacaccuucaauaucugua

SEQ ID NO: 2100347 - RNA, 20 nt, Staphylococcus aureus subsp. aureus MW2
agacaauaaugcacgcgugc

SEQ ID NO: 2100348 - RNA, 12 nt, Staphylococcus aureus subsp. aureus MW2
agacaaugcaag

SEQ ID NO: 2100349 - RNA, 17 nt, Staphylococcus aureus subsp. aureus MW2
agacaaugcaaguuggg

SEQ ID NO: 2100350 - RNA, 14 nt, Staphylococcus aureus subsp. aureus MW2
agacaaaaaaugaa

SEQ ID NO: 2100351 - RNA, 12 nt, Staphylococcus aureus subsp. aureus MW2
agaauuaacaac

SEQ ID NO: 2100352 - RNA, 15 nt, Staphylococcus aureus subsp. aureus MW2
agaauuaacaacaaa

SEQ ID NO: 2100353 - RNA, 20 nt, Staphylococcus aureus subsp. aureus MW2
agaauuaacaacaaauauaa

SEQ ID NO: 2100354 - RNA, 17 nt, Staphylococcus aureus subsp. aureus MW2
agaaugucgauauuucu

SEQ ID NO: 2100355 - RNA, 16 nt, Staphylococcus aureus subsp. aureus MW2
agaaugaauaauucca

SEQ ID NO: 2100356 - RNA, 19 nt, Staphylococcus aureus subsp. aureus MW2
agaaugacaccuaauacca

SEQ ID NO: 2100357 - RNA, 20 nt, Staphylococcus aureus subsp. aureus MW2
agaauccuaugccaaauaac

SEQ ID NO: 2100358 - RNA, 19 nt, Staphylococcus aureus subsp. aureus MW2
agaauccuaugccaaauaa

SEQ ID NO: 2100359 - RNA, 13 nt, Staphylococcus aureus subsp. aureus MW2
agaaguauuauga

SEQ ID NO: 2100360 - RNA, 17 nt, Staphylococcus aureus subsp. aureus MW2
agaccuucaauaucuuc

SEQ ID NO: 2100361 - RNA, 19 nt, Staphylococcus aureus subsp. aureus MW2
agacguaaguguaaaugaa

SEQ ID NO: 2100362 - RNA, 12 nt, Staphylococcus aureus subsp. aureus MW2
aaaacauaccug

SEQ ID NO: 2100363 - RNA, 16 nt, Staphylococcus aureus subsp. aureus MW2
aaaacauaaucauugu

SEQ ID NO: 2100364 - RNA, 15 nt, Staphylococcus aureus subsp. aureus MW2
agacauccacagaau

SEQ ID NO: 2100365 - RNA, 21 nt, Staphylococcus aureus subsp. aureus MW2
agacauugaaaggaacauuuc

SEQ ID NO: 2100366 - RNA, 14 nt, Staphylococcus aureus subsp. aureus MW2
agacauuacauuua

SEQ ID NO: 2100367 - RNA, 23 nt, Staphylococcus aureus subsp. aureus MW2
agacauuguuaaacuaagagggu

SEQ ID NO: 2100368 - RNA, 14 nt, Staphylococcus aureus subsp. aureus MW2
agacauaaaaaaag

SEQ ID NO: 2100369 - RNA, 16 nt, Staphylococcus aureus subsp. aureus MW2
agacauaaaaaaagag

SEQ ID NO: 2100370 - RNA, 19 nt, Staphylococcus aureus subsp. aureus MW2
agacagguuacuuuuuuaa

SEQ ID NO: 2100371 - RNA, 12 nt, Staphylococcus aureus subsp. aureus MW2
agacauaaauau

SEQ ID NO: 2100372 - RNA, 14 nt, Staphylococcus aureus subsp. aureus MW2
agacauaagcaaag

SEQ ID NO: 2100373 - RNA, 15 nt, Staphylococcus aureus subsp. aureus MW2
agacauaagcaaaga

SEQ ID NO: 2100374 - RNA, 16 nt, Staphylococcus aureus subsp. aureus MW2
agacauaagcaaagau

SEQ ID NO: 2100375 - RNA, 22 nt, Staphylococcus aureus subsp. aureus MW2
agacauaaauuuuuauccaagu

SEQ ID NO: 2100376 - RNA, 22 nt, Staphylococcus aureus subsp. aureus MW2
agacauauagcggugucaauau

SEQ ID NO: 2100377 - RNA, 12 nt, Staphylococcus aureus subsp. aureus MW2
agaccaaauauu

SEQ ID NO: 2100378 - RNA, 17 nt, Staphylococcus aureus subsp. aureus MW2
agacauuucuucaauuu

SEQ ID NO: 2100379 - RNA, 19 nt, Staphylococcus aureus subsp. aureus MW2
aaaacauucccuuaauaau

SEQ ID NO: 2100380 - RNA, 20 nt, Staphylococcus aureus subsp. aureus MW2
aaaacauucccuuaauaaua

SEQ ID NO: 2100381 - RNA, 16 nt, Staphylococcus aureus subsp. aureus MW2
agagcauaguuuucau

SEQ ID NO: 2100382 - RNA, 13 nt, Staphylococcus aureus subsp. aureus MW2
agagaugggcuaa

SEQ ID NO: 2100383 - RNA, 16 nt, Staphylococcus aureus subsp. aureus MW2
agagauguauaaaacu

SEQ ID NO: 2100384 - RNA, 23 nt, Staphylococcus aureus subsp. aureus MW2
agagaugggcuaagguuguucua

SEQ ID NO: 2100385 - RNA, 21 nt, Staphylococcus aureus subsp. aureus MW2
agacuaaaaaacuaacuuuau

SEQ ID NO: 2100386 - RNA, 17 nt, Staphylococcus aureus subsp. aureus MW2
agacuaaaaugaaugaa

SEQ ID NO: 2100387 - RNA, 19 nt, Staphylococcus aureus subsp. aureus MW2
agaggucuccaauacuuuu

SEQ ID NO: 2100388 - RNA, 15 nt, Staphylococcus aureus subsp. aureus MW2
agaggggaacaaugg

SEQ ID NO: 2100389 - RNA, 18 nt, Staphylococcus aureus subsp. aureus MW2
agaguaaaguuaaaagcu

SEQ ID NO: 2100390 - RNA, 13 nt, Staphylococcus aureus subsp. aureus MW2
aaaacauuuugug

SEQ ID NO: 2100391 - RNA, 21 nt, Staphylococcus aureus subsp. aureus MW2
aaaacauuggcgaggccccaa

SEQ ID NO: 2100392 - RNA, 22 nt, Staphylococcus aureus subsp. aureus MW2
aaaacauuggcgaggccccaac

SEQ ID NO: 2100393 - RNA, 16 nt, Staphylococcus aureus subsp. aureus MW2
aaaaccaaaauacuga

SEQ ID NO: 2100394 - RNA, 22 nt, Staphylococcus aureus subsp. aureus MW2
agaggaacaguggaauacagau

SEQ ID NO: 2100395 - RNA, 17 nt, Staphylococcus aureus subsp. aureus MW2
agagcuuuuaguaaaua

SEQ ID NO: 2100396 - RNA, 22 nt, Staphylococcus aureus subsp. aureus MW2
agagcuuuuaguaaauaauuua

SEQ ID NO: 2100397 - RNA, 19 nt, Staphylococcus aureus subsp. aureus MW2
agaggauagacaacugcaa

SEQ ID NO: 2100398 - RNA, 19 nt, Staphylococcus aureus subsp. aureus MW2
agauaucauuuuauccaaa

SEQ ID NO: 2100399 - RNA, 15 nt, Staphylococcus aureus subsp. aureus MW2
agauaucauaauauu

SEQ ID NO: 2100400 - RNA, 15 nt, Staphylococcus aureus subsp. aureus MW2
agauauauuugaaag

SEQ ID NO: 2100401 - RNA, 22 nt, Staphylococcus aureus subsp. aureus MW2
agauccaccguuaaaauauaug

SEQ ID NO: 2100402 - RNA, 20 nt, Staphylococcus aureus subsp. aureus MW2
agauacugguuaguaaaauu

SEQ ID NO: 2100403 - RNA, 18 nt, Staphylococcus aureus subsp. aureus MW2
agauacguugauguaauu

SEQ ID NO: 2100404 - RNA, 16 nt, Staphylococcus aureus subsp. aureus MW2
agauacuucuuuagca

SEQ ID NO: 2100405 - RNA, 23 nt, Staphylococcus aureus subsp. aureus MW2
agauaaguaguggauaaucacaa

SEQ ID NO: 2100406 - RNA, 13 nt, Staphylococcus aureus subsp. aureus MW2
agaguuaauaaaa

SEQ ID NO: 2100407 - RNA, 15 nt, Staphylococcus aureus subsp. aureus MW2
agauaaacaagccaa

SEQ ID NO: 2100408 - RNA, 21 nt, Staphylococcus aureus subsp. aureus MW2
agauaaauaaaaggcauucuu

SEQ ID NO: 2100409 - RNA, 12 nt, Staphylococcus aureus subsp. aureus MW2
agauaaaucauc

SEQ ID NO: 2100410 - RNA, 14 nt, Staphylococcus aureus subsp. aureus MW2
agauaaaucaucau

SEQ ID NO: 2100411 - RNA, 22 nt, Staphylococcus aureus subsp. aureus MW2
agaugaaugccuaauuuuguga

SEQ ID NO: 2100412 - RNA, 22 nt, Staphylococcus aureus subsp. aureus MW2
agaugacugaaccaauccaaua

SEQ ID NO: 2100413 - RNA, 13 nt, Staphylococcus aureus subsp. aureus MW2
agaugagaaagua

SEQ ID NO: 2100414 - RNA, 13 nt, Staphylococcus aureus subsp. aureus MW2
agaugcauaaaaa

SEQ ID NO: 2100415 - RNA, 15 nt, Staphylococcus aureus subsp. aureus MW2
aaaaccgaaaauacc

SEQ ID NO: 2100416 - RNA, 18 nt, Staphylococcus aureus subsp. aureus MW2
aaaaccgaggaaauccuu

SEQ ID NO: 2100417 - RNA, 21 nt, Staphylococcus aureus subsp. aureus MW2
agaugucacuguuaaagaugu

SEQ ID NO: 2100418 - RNA, 22 nt, Staphylococcus aureus subsp. aureus MW2
agauggacaguuuuuauauuaa

SEQ ID NO: 2100419 - RNA, 12 nt, Staphylococcus aureus subsp. aureus MW2
agauucaccuaa

SEQ ID NO: 2100420 - RNA, 14 nt, Staphylococcus aureus subsp. aureus MW2
agauucauauuuau

SEQ ID NO: 2100421 - RNA, 17 nt, Staphylococcus aureus subsp. aureus MW2
agaugugcgugguuuau

SEQ ID NO: 2100422 - RNA, 15 nt, Staphylococcus aureus subsp. aureus MW2
agauuaccuacaaua

SEQ ID NO: 2100423 - RNA, 16 nt, Staphylococcus aureus subsp. aureus MW2
agauugauauaaauua

SEQ ID NO: 2100424 - RNA, 21 nt, Staphylococcus aureus subsp. aureus MW2
agauugauauaaauuaucaga

SEQ ID NO: 2100425 - RNA, 18 nt, Staphylococcus aureus subsp. aureus MW2
agauugauaucccuaaca

SEQ ID NO: 2100426 - RNA, 15 nt, Staphylococcus aureus subsp. aureus MW2
agauuccuguaacaa

SEQ ID NO: 2100427 - RNA, 13 nt, Staphylococcus aureus subsp. aureus MW2
agauuuaacaaua

SEQ ID NO: 2100428 - RNA, 17 nt, Staphylococcus aureus subsp. aureus MW2
agauuuaacaauauaua

SEQ ID NO: 2100429 - RNA, 21 nt, Staphylococcus aureus subsp. aureus MW2
agauugcuuuuucguuaaaug

SEQ ID NO: 2100430 - RNA, 13 nt, Staphylococcus aureus subsp. aureus MW2
agauuugaaauuu

SEQ ID NO: 2100431 - RNA, 11 nt, Staphylococcus aureus subsp. aureus MW2
agauuucucag

SEQ ID NO: 2100432 - RNA, 16 nt, Staphylococcus aureus subsp. aureus MW2
agauuuguauuuugcg

SEQ ID NO: 2100433 - RNA, 14 nt, Staphylococcus aureus subsp. aureus MW2
agauuugaaauuua

SEQ ID NO: 2100434 - RNA, 19 nt, Staphylococcus aureus subsp. aureus MW2
agauuuuaugcuuuacuug

SEQ ID NO: 2100435 - RNA, 15 nt, Staphylococcus aureus subsp. aureus MW2
agauuuuauuaaauc

SEQ ID NO: 2100436 - RNA, 14 nt, Staphylococcus aureus subsp. aureus MW2
agauuuuauauaaa

SEQ ID NO: 2100437 - RNA, 20 nt, Staphylococcus aureus subsp. aureus MW2
agauuuuaauaaauuagcca

SEQ ID NO: 2100438 - RNA, 16 nt, Staphylococcus aureus subsp. aureus MW2
agcaaaugcacuguau

SEQ ID NO: 2100439 - RNA, 19 nt, Staphylococcus aureus subsp. aureus MW2
agcaaaugcuuaagaaauu

SEQ ID NO: 2100440 - RNA, 15 nt, Staphylococcus aureus subsp. aureus MW2
agcaaauaaaaucau

SEQ ID NO: 2100441 - RNA, 16 nt, Staphylococcus aureus subsp. aureus MW2
agcaaauugauuaaau

SEQ ID NO: 2100442 - RNA, 22 nt, Staphylococcus aureus subsp. aureus MW2
agcaaaauuauguaaaaaauau

SEQ ID NO: 2100443 - RNA, 16 nt, Staphylococcus aureus subsp. aureus MW2
agcaaagacaaaagca

SEQ ID NO: 2100444 - RNA, 17 nt, Staphylococcus aureus subsp. aureus MW2
agcaaaaauauuuaaac

SEQ ID NO: 2100445 - RNA, 15 nt, Staphylococcus aureus subsp. aureus MW2
agcaaaagaugaaaa

SEQ ID NO: 2100446 - RNA, 13 nt, Staphylococcus aureus subsp. aureus MW2
agcaaaagaugaa

SEQ ID NO: 2100447 - RNA, 17 nt, Staphylococcus aureus subsp. aureus MW2
agcccgcaaaucgccuc

SEQ ID NO: 2100448 - RNA, 19 nt, Staphylococcus aureus subsp. aureus MW2
agccccuuuuaaauucuua

SEQ ID NO: 2100449 - RNA, 18 nt, Staphylococcus aureus subsp. aureus MW2
agccccuuacaaccuuug

SEQ ID NO: 2100450 - RNA, 16 nt, Staphylococcus aureus subsp. aureus MW2
agcaugacuguaagua

SEQ ID NO: 2100451 - RNA, 18 nt, Staphylococcus aureus subsp. aureus MW2
agcaugcuuugagcaaua

SEQ ID NO: 2100452 - RNA, 20 nt, Staphylococcus aureus subsp. aureus MW2
agcaugcuuugagcaauaau

SEQ ID NO: 2100453 - RNA, 17 nt, Staphylococcus aureus subsp. aureus MW2
agccaagauaaaucauc

SEQ ID NO: 2100454 - RNA, 13 nt, Staphylococcus aureus subsp. aureus MW2
agcaccuaaaaua

SEQ ID NO: 2100455 - RNA, 20 nt, Staphylococcus aureus subsp. aureus MW2
agcacuauaacaagguguuc

SEQ ID NO: 2100456 - RNA, 17 nt, Staphylococcus aureus subsp. aureus MW2
agcacuaucuuuugcuu

SEQ ID NO: 2100457 - RNA, 13 nt, Staphylococcus aureus subsp. aureus MW2
agcacuauuuuua

SEQ ID NO: 2100458 - RNA, 20 nt, Staphylococcus aureus subsp. aureus MW2
agcaugaaucgcauuuaaau

SEQ ID NO: 2100459 - RNA, 21 nt, Staphylococcus aureus subsp. aureus MW2
agcaucguaaaaaacaaaaaa

SEQ ID NO: 2100460 - RNA, 19 nt, Staphylococcus aureus subsp. aureus MW2
agcaucguaaaaaacaaaa

SEQ ID NO: 2100461 - RNA, 20 nt, Staphylococcus aureus subsp. aureus MW2
agcaucgggaucuaauuuuu

SEQ ID NO: 2100462 - RNA, 12 nt, Staphylococcus aureus subsp. aureus MW2
agcaguaagaua

SEQ ID NO: 2100463 - RNA, 21 nt, Staphylococcus aureus subsp. aureus MW2
agcgccuaugugaugguaaau

SEQ ID NO: 2100464 - RNA, 17 nt, Staphylococcus aureus subsp. aureus MW2
agcgcaccaauuaucaa

SEQ ID NO: 2100465 - RNA, 19 nt, Staphylococcus aureus subsp. aureus MW2
agcggccgugguaugauuu

SEQ ID NO: 2100466 - RNA, 19 nt, Staphylococcus aureus subsp. aureus MW2
agcucaugaaucagaugau

SEQ ID NO: 2100467 - RNA, 17 nt, Staphylococcus aureus subsp. aureus MW2
agcuaucuucagauucc

SEQ ID NO: 2100468 - RNA, 12 nt, Staphylococcus aureus subsp. aureus MW2
agcuauaaaagu

SEQ ID NO: 2100469 - RNA, 14 nt, Staphylococcus aureus subsp. aureus MW2
agcuauauuuuuuu

SEQ ID NO: 2100470 - RNA, 18 nt, Staphylococcus aureus subsp. aureus MW2
agcuauaaaaguacuuua

SEQ ID NO: 2100471 - RNA, 19 nt, Staphylococcus aureus subsp. aureus MW2
agcucaauaaauuaugaaa

SEQ ID NO: 2100472 - RNA, 18 nt, Staphylococcus aureus subsp. aureus MW2
agcuaacucuuuguauaa

SEQ ID NO: 2100473 - RNA, 16 nt, Staphylococcus aureus subsp. aureus MW2
agcuaaccacaucauu

SEQ ID NO: 2100474 - RNA, 14 nt, Staphylococcus aureus subsp. aureus MW2
agcguuuuuauuac

SEQ ID NO: 2100475 - RNA, 15 nt, Staphylococcus aureus subsp. aureus MW2
agcuacaauuaaagu

SEQ ID NO: 2100476 - RNA, 21 nt, Staphylococcus aureus subsp. aureus MW2
agcuaauuucuaauacauacu

SEQ ID NO: 2100477 - RNA, 18 nt, Staphylococcus aureus subsp. aureus MW2
agcuaaugcaacuaaaac

SEQ ID NO: 2100478 - RNA, 16 nt, Staphylococcus aureus subsp. aureus MW2
agcuaauaucaauaau

SEQ ID NO: 2100479 - RNA, 15 nt, Staphylococcus aureus subsp. aureus MW2
agcuaacauaccuaa

SEQ ID NO: 2100480 - RNA, 13 nt, Staphylococcus aureus subsp. aureus MW2
agcuaaguuaaau

SEQ ID NO: 2100481 - RNA, 16 nt, Staphylococcus aureus subsp. aureus MW2
agcuagcaaucccauu

SEQ ID NO: 2100482 - RNA, 13 nt, Staphylococcus aureus subsp. aureus MW2
agguuuauauauc

SEQ ID NO: 2100483 - RNA, 19 nt, Staphylococcus aureus subsp. aureus MW2
agguuguucuauacauucc

SEQ ID NO: 2100484 - RNA, 18 nt, Staphylococcus aureus subsp. aureus MW2
agguuuguaagacaacaa

SEQ ID NO: 2100485 - RNA, 20 nt, Staphylococcus aureus subsp. aureus MW2
aguaaaaucuuuaacauuug

SEQ ID NO: 2100486 - RNA, 17 nt, Staphylococcus aureus subsp. aureus MW2
aguaaacgagacaucau

SEQ ID NO: 2100487 - RNA, 14 nt, Staphylococcus aureus subsp. aureus MW2
aguaaaauaaaaaa

SEQ ID NO: 2100488 - RNA, 15 nt, Staphylococcus aureus subsp. aureus MW2
aguaaaauaaaaaau

SEQ ID NO: 2100489 - RNA, 18 nt, Staphylococcus aureus subsp. aureus MW2
agguggagauuuaacaau

SEQ ID NO: 2100490 - RNA, 17 nt, Staphylococcus aureus subsp. aureus MW2
aguaacagacuuuguua

SEQ ID NO: 2100491 - RNA, 18 nt, Staphylococcus aureus subsp. aureus MW2
aguaaccacaacaaugaa

SEQ ID NO: 2100492 - RNA, 21 nt, Staphylococcus aureus subsp. aureus MW2
aguaauaaaagucgauaaaua

SEQ ID NO: 2100493 - RNA, 22 nt, Staphylococcus aureus subsp. aureus MW2
aguaauaaaagucgauaaauau

SEQ ID NO: 2100494 - RNA, 15 nt, Staphylococcus aureus subsp. aureus MW2
aguaauaacaucuaa

SEQ ID NO: 2100495 - RNA, 15 nt, Staphylococcus aureus subsp. aureus MW2
aguaaguaaaauaaa

SEQ ID NO: 2100496 - RNA, 23 nt, Staphylococcus aureus subsp. aureus MW2
aguacauuuauuuucaauaaaua

SEQ ID NO: 2100497 - RNA, 14 nt, Staphylococcus aureus subsp. aureus MW2
aguaauuuuacaaa

SEQ ID NO: 2100498 - RNA, 19 nt, Staphylococcus aureus subsp. aureus MW2
aguaauuuuacaaaaugau

SEQ ID NO: 2100499 - RNA, 13 nt, Staphylococcus aureus subsp. aureus MW2
aguaauuucucua

SEQ ID NO: 2100500 - RNA, 15 nt, Staphylococcus aureus subsp. aureus MW2
aguaauuuuuaaaca

SEQ ID NO: 2100501 - RNA, 18 nt, Staphylococcus aureus subsp. aureus MW2
aguaauuuuuaaacaaaa

SEQ ID NO: 2100502 - RNA, 23 nt, Staphylococcus aureus subsp. aureus MW2
aguaaucugcaaaugccucuuuu

SEQ ID NO: 2100503 - RNA, 16 nt, Staphylococcus aureus subsp. aureus MW2
aguaaucaagcaaugc

SEQ ID NO: 2100504 - RNA, 22 nt, Staphylococcus aureus subsp. aureus MW2
aguaauccccgaagcacagaaa

SEQ ID NO: 2100505 - RNA, 19 nt, Staphylococcus aureus subsp. aureus MW2
aguaauccccgaagcacag

SEQ ID NO: 2100506 - RNA, 14 nt, Staphylococcus aureus subsp. aureus MW2
aguauucauuuucu

SEQ ID NO: 2100507 - RNA, 16 nt, Staphylococcus aureus subsp. aureus MW2
aguauucaaaaaaaua

SEQ ID NO: 2100508 - RNA, 21 nt, Staphylococcus aureus subsp. aureus MW2
aguauugccguuauuuucaau

SEQ ID NO: 2100509 - RNA, 18 nt, Staphylococcus aureus subsp. aureus MW2
aguauuuaauguuuuagu

SEQ ID NO: 2100510 - RNA, 22 nt, Staphylococcus aureus subsp. aureus MW2
aguauuguuuuauauuuaaacu

SEQ ID NO: 2100511 - RNA, 18 nt, Staphylococcus aureus subsp. aureus MW2
aguauuugccuuuugaau

SEQ ID NO: 2100512 - RNA, 20 nt, Staphylococcus aureus subsp. aureus MW2
aguauuugaaguauuuuccu

SEQ ID NO: 2100513 - RNA, 23 nt, Staphylococcus aureus subsp. aureus MW2
aguauuaacgcuuauacuauaua

SEQ ID NO: 2100514 - RNA, 15 nt, Staphylococcus aureus subsp. aureus MW2
aguauuaugauugcu

SEQ ID NO: 2100515 - RNA, 22 nt, Staphylococcus aureus subsp. aureus MW2
aguaucauuguguccauaaaua

SEQ ID NO: 2100516 - RNA, 16 nt, Staphylococcus aureus subsp. aureus MW2
aguauccuuuauaaau

SEQ ID NO: 2100517 - RNA, 22 nt, Staphylococcus aureus subsp. aureus MW2
aguauccuuuauaaauaaacau

SEQ ID NO: 2100518 - RNA, 14 nt, Staphylococcus aureus subsp. aureus MW2
aguauaaaugcagc

SEQ ID NO: 2100519 - RNA, 13 nt, Staphylococcus aureus subsp. aureus MW2
aguauaaauaaaa

SEQ ID NO: 2100520 - RNA, 19 nt, Staphylococcus aureus subsp. aureus MW2
aguauaaauaucauaaaug

SEQ ID NO: 2100521 - RNA, 16 nt, Staphylococcus aureus subsp. aureus MW2
aguauaaucagcaaug

SEQ ID NO: 2100522 - RNA, 16 nt, Staphylococcus aureus subsp. aureus MW2
aguauaauuuucuguc

SEQ ID NO: 2100523 - RNA, 21 nt, Staphylococcus aureus subsp. aureus MW2
aguauagcgcagcaaaugcuu

SEQ ID NO: 2100524 - RNA, 17 nt, Staphylococcus aureus subsp. aureus MW2
aguauauaucaaauaca

SEQ ID NO: 2100525 - RNA, 13 nt, Staphylococcus aureus subsp. aureus MW2
aguauauaugacu

SEQ ID NO: 2100526 - RNA, 13 nt, Staphylococcus aureus subsp. aureus MW2
aguauauuuuaac

SEQ ID NO: 2100527 - RNA, 15 nt, Staphylococcus aureus subsp. aureus MW2
aguauauuuuaacaa

SEQ ID NO: 2100528 - RNA, 16 nt, Staphylococcus aureus subsp. aureus MW2
aguacccagaaugcga

SEQ ID NO: 2100529 - RNA, 17 nt, Staphylococcus aureus subsp. aureus MW2
aguagcucaaaacaauu

SEQ ID NO: 2100530 - RNA, 15 nt, Staphylococcus aureus subsp. aureus MW2
aguagcucaaaacaa

SEQ ID NO: 2100531 - RNA, 20 nt, Staphylococcus aureus subsp. aureus MW2
aguaggguauugaaauaaua

SEQ ID NO: 2100532 - RNA, 13 nt, Staphylococcus aureus subsp. aureus MW2
aguaguauuaucu

SEQ ID NO: 2100533 - RNA, 14 nt, Staphylococcus aureus subsp. aureus MW2
aguauaaauaaaaa

SEQ ID NO: 2100534 - RNA, 20 nt, Staphylococcus aureus subsp. aureus MW2
aguauaaauaaaaauacaua

SEQ ID NO: 2100535 - RNA, 16 nt, Staphylococcus aureus subsp. aureus MW2
aguauaaacguccaaa

SEQ ID NO: 2100536 - RNA, 20 nt, Staphylococcus aureus subsp. aureus MW2
aguauaaaccgccaacuaau

SEQ ID NO: 2100537 - RNA, 21 nt, Staphylococcus aureus subsp. aureus MW2
aggggccccaacacagagaau

SEQ ID NO: 2100538 - RNA, 16 nt, Staphylococcus aureus subsp. aureus MW2
aggggccccaacacag

SEQ ID NO: 2100539 - RNA, 12 nt, Staphylococcus aureus subsp. aureus MW2
aggggccccaac

SEQ ID NO: 2100540 - RNA, 17 nt, Staphylococcus aureus subsp. aureus MW2
agggcuccuacuccaua

SEQ ID NO: 2100541 - RNA, 11 nt, Staphylococcus aureus subsp. aureus MW2
agggccccaac

SEQ ID NO: 2100542 - RNA, 18 nt, Staphylococcus aureus subsp. aureus MW2
agggccccaacacagaag

SEQ ID NO: 2100543 - RNA, 22 nt, Staphylococcus aureus subsp. aureus MW2
agggcauugagauuggaagggc

SEQ ID NO: 2100544 - RNA, 14 nt, Staphylococcus aureus subsp. aureus MW2
agggcauugauuca

SEQ ID NO: 2100545 - RNA, 14 nt, Staphylococcus aureus subsp. aureus MW2
aggugauuauauau

SEQ ID NO: 2100546 - RNA, 22 nt, Staphylococcus aureus subsp. aureus MW2
agguauagcaaguuuauaaauu

SEQ ID NO: 2100547 - RNA, 15 nt, Staphylococcus aureus subsp. aureus MW2
agguauacacaaauu

SEQ ID NO: 2100548 - RNA, 17 nt, Staphylococcus aureus subsp. aureus MW2
agguaugaaauaacaau

SEQ ID NO: 2100549 - RNA, 15 nt, Staphylococcus aureus subsp. aureus MW2
agguaauuuaacauu

SEQ ID NO: 2100550 - RNA, 18 nt, Staphylococcus aureus subsp. aureus MW2
agguacauaaauaccugg

SEQ ID NO: 2100551 - RNA, 15 nt, Staphylococcus aureus subsp. aureus MW2
agguaagugcucaaa

SEQ ID NO: 2100552 - RNA, 18 nt, Staphylococcus aureus subsp. aureus MW2
agguaacugcuuuggagu

SEQ ID NO: 2100553 - RNA, 23 nt, Staphylococcus aureus subsp. aureus MW2
aggcgcuccuacuuuucaacuuu

SEQ ID NO: 2100554 - RNA, 18 nt, Staphylococcus aureus subsp. aureus MW2
aggcccauaaauuacuug

SEQ ID NO: 2100555 - RNA, 16 nt, Staphylococcus aureus subsp. aureus MW2
aggcccauaaauuacu

SEQ ID NO: 2100556 - RNA, 16 nt, Staphylococcus aureus subsp. aureus MW2
aggcauucuuccaaca

SEQ ID NO: 2100557 - RNA, 15 nt, Staphylococcus aureus subsp. aureus MW2
aggcaucucacaauc

SEQ ID NO: 2100558 - RNA, 20 nt, Staphylococcus aureus subsp. aureus MW2
aggauuuccucgguuuuauu

SEQ ID NO: 2100559 - RNA, 20 nt, Staphylococcus aureus subsp. aureus MW2
aggauuuccggaacaauacc

SEQ ID NO: 2100560 - RNA, 20 nt, Staphylococcus aureus subsp. aureus MW2
aggauucgauugguuuaaaa

SEQ ID NO: 2100561 - RNA, 21 nt, Staphylococcus aureus subsp. aureus MW2
aggauucgauugguuuaaaaa

SEQ ID NO: 2100562 - RNA, 20 nt, Staphylococcus aureus subsp. aureus MW2
aggauuauagguauaagaau

SEQ ID NO: 2100563 - RNA, 22 nt, Staphylococcus aureus subsp. aureus MW2
agcugccaaaaugguuaaaauc

SEQ ID NO: 2100564 - RNA, 18 nt, Staphylococcus aureus subsp. aureus MW2
agcugucaacuugucuac

SEQ ID NO: 2100565 - RNA, 15 nt, Staphylococcus aureus subsp. aureus MW2
agcuucuaaguaaua

SEQ ID NO: 2100566 - RNA, 19 nt, Staphylococcus aureus subsp. aureus MW2
agcuucuauguuggggccc

SEQ ID NO: 2100567 - RNA, 21 nt, Staphylococcus aureus subsp. aureus MW2
agcuucuauguuggggccccg

SEQ ID NO: 2100568 - RNA, 22 nt, Staphylococcus aureus subsp. aureus MW2
agcuucuauguuggggccccgc

SEQ ID NO: 2100569 - RNA, 13 nt, Staphylococcus aureus subsp. aureus MW2
agcuuaauuuuau

SEQ ID NO: 2100570 - RNA, 12 nt, Staphylococcus aureus subsp. aureus MW2
agcuuaaugcau

SEQ ID NO: 2100571 - RNA, 19 nt, Staphylococcus aureus subsp. aureus MW2
agcuuaauuuuauuauuaa

SEQ ID NO: 2100572 - RNA, 15 nt, Staphylococcus aureus subsp. aureus MW2
agcuuacaauaaugu

SEQ ID NO: 2100573 - RNA, 18 nt, Staphylococcus aureus subsp. aureus MW2
agcuuacaauaaugugca

SEQ ID NO: 2100574 - RNA, 18 nt, Staphylococcus aureus subsp. aureus MW2
agcuuacuucauauaagu

SEQ ID NO: 2100575 - RNA, 13 nt, Staphylococcus aureus subsp. aureus MW2
agcuucauauuua

SEQ ID NO: 2100576 - RNA, 20 nt, Staphylococcus aureus subsp. aureus MW2
agcuuaucaacgauuuuguc

SEQ ID NO: 2100577 - RNA, 20 nt, Staphylococcus aureus subsp. aureus MW2
agcuugggacagaaaacaaa

SEQ ID NO: 2100578 - RNA, 17 nt, Staphylococcus aureus subsp. aureus MW2
agcuugccuacuuuuuu

SEQ ID NO: 2100579 - RNA, 17 nt, Staphylococcus aureus subsp. aureus MW2
agcuuguaaaucacgau

SEQ ID NO: 2100580 - RNA, 17 nt, Staphylococcus aureus subsp. aureus MW2
agcuuguucaauacuuu

SEQ ID NO: 2100581 - RNA, 14 nt, Staphylococcus aureus subsp. aureus MW2
agcuucuacuuuug

SEQ ID NO: 2100582 - RNA, 22 nt, Staphylococcus aureus subsp. aureus MW2
agcuugauuuaacaaccucuga

SEQ ID NO: 2100583 - RNA, 19 nt, Staphylococcus aureus subsp. aureus MW2
aggacacauuuacuuaaga

SEQ ID NO: 2100584 - RNA, 18 nt, Staphylococcus aureus subsp. aureus MW2
aggaaauccgcauaaauu

SEQ ID NO: 2100585 - RNA, 15 nt, Staphylococcus aureus subsp. aureus MW2
aggaaauaaaaaaua

SEQ ID NO: 2100586 - RNA, 22 nt, Staphylococcus aureus subsp. aureus MW2
aggaaauacguggcucuaaaaa

SEQ ID NO: 2100587 - RNA, 13 nt, Staphylococcus aureus subsp. aureus MW2
agcuuuucuugaa

SEQ ID NO: 2100588 - RNA, 14 nt, Staphylococcus aureus subsp. aureus MW2
agcuuuucuaaugc

SEQ ID NO: 2100589 - RNA, 22 nt, Staphylococcus aureus subsp. aureus MW2
aggaacaguggaauacagauga

SEQ ID NO: 2100590 - RNA, 15 nt, Staphylococcus aureus subsp. aureus MW2
auaacauaagaaaaa

SEQ ID NO: 2100591 - RNA, 16 nt, Staphylococcus aureus subsp. aureus MW2
auaacauaagaaaaag

SEQ ID NO: 2100592 - RNA, 20 nt, Staphylococcus aureus subsp. aureus MW2
auaacauaagaaaaagcagu

SEQ ID NO: 2100593 - RNA, 20 nt, Staphylococcus aureus subsp. aureus MW2
auaacauuggcaaacgaaua

SEQ ID NO: 2100594 - RNA, 23 nt, Staphylococcus aureus subsp. aureus MW2
auaacauuggcaaacgaauauuc

SEQ ID NO: 2100595 - RNA, 22 nt, Staphylococcus aureus subsp. aureus MW2
auaacauucuucaaaaaauaau

SEQ ID NO: 2100596 - RNA, 23 nt, Staphylococcus aureus subsp. aureus MW2
auaacauucuucaaaaaauaaua

SEQ ID NO: 2100597 - RNA, 15 nt, Staphylococcus aureus subsp. aureus MW2
auaaccaaguaauuc

SEQ ID NO: 2100598 - RNA, 16 nt, Staphylococcus aureus subsp. aureus MW2
auaaccaaguaauucu

SEQ ID NO: 2100599 - RNA, 17 nt, Staphylococcus aureus subsp. aureus MW2
auaacaccaauuaaauc

SEQ ID NO: 2100600 - RNA, 14 nt, Staphylococcus aureus subsp. aureus MW2
auaacaccaauuaa

SEQ ID NO: 2100601 - RNA, 21 nt, Staphylococcus aureus subsp. aureus MW2
auaacacaucaugacauuaau

SEQ ID NO: 2100602 - RNA, 17 nt, Staphylococcus aureus subsp. aureus MW2
auaaauccaaugaugaa

SEQ ID NO: 2100603 - RNA, 18 nt, Staphylococcus aureus subsp. aureus MW2
auaaauuuuuaguuaaag

SEQ ID NO: 2100604 - RNA, 17 nt, Staphylococcus aureus subsp. aureus MW2
auaaauuuugaauuaca

SEQ ID NO: 2100605 - RNA, 19 nt, Staphylococcus aureus subsp. aureus MW2
auaaaucuaauacuuucaa

SEQ ID NO: 2100606 - RNA, 14 nt, Staphylococcus aureus subsp. aureus MW2
auaaaucuaauacu

SEQ ID NO: 2100607 - RNA, 22 nt, Staphylococcus aureus subsp. aureus MW2
auaacaaugcagcuguauuuaa

SEQ ID NO: 2100608 - RNA, 18 nt, Staphylococcus aureus subsp. aureus MW2
auaacaauuuuaaaucuu

SEQ ID NO: 2100609 - RNA, 14 nt, Staphylococcus aureus subsp. aureus MW2
auaacaagaaguaa

SEQ ID NO: 2100610 - RNA, 22 nt, Staphylococcus aureus subsp. aureus MW2
auaacaauagugacuuuuauaa

SEQ ID NO: 2100611 - RNA, 18 nt, Staphylococcus aureus subsp. aureus MW2
auaacaaaauuaaauaug

SEQ ID NO: 2100612 - RNA, 12 nt, Staphylococcus aureus subsp. aureus MW2
auaacaaacauu

SEQ ID NO: 2100613 - RNA, 14 nt, Staphylococcus aureus subsp. aureus MW2
auaacaaacauuaa

SEQ ID NO: 2100614 - RNA, 16 nt, Staphylococcus aureus subsp. aureus MW2
auaacgucauauguuu

SEQ ID NO: 2100615 - RNA, 22 nt, Staphylococcus aureus subsp. aureus MW2
auaacguguuugcucaaaaugg

SEQ ID NO: 2100616 - RNA, 14 nt, Staphylococcus aureus subsp. aureus MW2
auaacgugcuuuuu

SEQ ID NO: 2100617 - RNA, 18 nt, Staphylococcus aureus subsp. aureus MW2
auaacgcuuuaaaucauu

SEQ ID NO: 2100618 - RNA, 13 nt, Staphylococcus aureus subsp. aureus MW2
auaaccuuuaaaa

SEQ ID NO: 2100619 - RNA, 14 nt, Staphylococcus aureus subsp. aureus MW2
auaaccuguaauug

SEQ ID NO: 2100620 - RNA, 23 nt, Staphylococcus aureus subsp. aureus MW2
auaaccuguuuuuauuuguuuau

SEQ ID NO: 2100621 - RNA, 19 nt, Staphylococcus aureus subsp. aureus MW2
auaacuguagcuccuaaag

SEQ ID NO: 2100622 - RNA, 15 nt, Staphylococcus aureus subsp. aureus MW2
auaacuguaaaacau

SEQ ID NO: 2100623 - RNA, 15 nt, Staphylococcus aureus subsp. aureus MW2
auaacugauaauacu

SEQ ID NO: 2100624 - RNA, 15 nt, Staphylococcus aureus subsp. aureus MW2
auaacucuucuaagu

SEQ ID NO: 2100625 - RNA, 16 nt, Staphylococcus aureus subsp. aureus MW2
auaacucuaaauauaa

SEQ ID NO: 2100626 - RNA, 15 nt, Staphylococcus aureus subsp. aureus MW2
auaacgugcuuuuuu

SEQ ID NO: 2100627 - RNA, 17 nt, Staphylococcus aureus subsp. aureus MW2
auaaccauguaaaauua

SEQ ID NO: 2100628 - RNA, 18 nt, Staphylococcus aureus subsp. aureus MW2
auaacccauuuucaaaac

SEQ ID NO: 2100629 - RNA, 16 nt, Staphylococcus aureus subsp. aureus MW2
auaacccauuuucaaa

SEQ ID NO: 2100630 - RNA, 16 nt, Staphylococcus aureus subsp. aureus MW2
auaaccgcuacaauua

SEQ ID NO: 2100631 - RNA, 23 nt, Staphylococcus aureus subsp. aureus MW2
auaaaccgauuguuucaccagcu

SEQ ID NO: 2100632 - RNA, 21 nt, Staphylococcus aureus subsp. aureus MW2
auaaaccgauuguuucaccag

SEQ ID NO: 2100633 - RNA, 20 nt, Staphylococcus aureus subsp. aureus MW2
auaaacgacgcaagugacuu

SEQ ID NO: 2100634 - RNA, 13 nt, Staphylococcus aureus subsp. aureus MW2
auaaagauucaau

SEQ ID NO: 2100635 - RNA, 14 nt, Staphylococcus aureus subsp. aureus MW2
auaaagauucaauu

SEQ ID NO: 2100636 - RNA, 18 nt, Staphylococcus aureus subsp. aureus MW2
auaaaggucuauauauau

SEQ ID NO: 2100637 - RNA, 17 nt, Staphylococcus aureus subsp. aureus MW2
auaaauaucaauaauuc

SEQ ID NO: 2100638 - RNA, 21 nt, Staphylococcus aureus subsp. aureus MW2
auaaauaccgucuucucuauc

SEQ ID NO: 2100639 - RNA, 17 nt, Staphylococcus aureus subsp. aureus MW2
auaaauagauaauauau

SEQ ID NO: 2100640 - RNA, 16 nt, Staphylococcus aureus subsp. aureus MW2
auaaauaggucacuuu

SEQ ID NO: 2100641 - RNA, 20 nt, Staphylococcus aureus subsp. aureus MW2
auaaauaggucacuuuuaau

SEQ ID NO: 2100642 - RNA, 15 nt, Staphylococcus aureus subsp. aureus MW2
auaaauauuaagcgu

SEQ ID NO: 2100643 - RNA, 16 nt, Staphylococcus aureus subsp. aureus MW2
auaaauauuaaauuca

SEQ ID NO: 2100644 - RNA, 20 nt, Staphylococcus aureus subsp. aureus MW2
auaaauaugauguuaaaaaa

SEQ ID NO: 2100645 - RNA, 12 nt, Staphylococcus aureus subsp. aureus MW2
auaaauauuaaa

SEQ ID NO: 2100646 - RNA, 22 nt, Staphylococcus aureus subsp. aureus MW2
auaaauaacuucguuuuaauaa

SEQ ID NO: 2100647 - RNA, 22 nt, Staphylococcus aureus subsp. aureus MW2
auaaauaagcaaucauaauacu

SEQ ID NO: 2100648 - RNA, 21 nt, Staphylococcus aureus subsp. aureus MW2
auaaauaauuucggauuaucu

SEQ ID NO: 2100649 - RNA, 20 nt, Staphylococcus aureus subsp. aureus MW2
auaaauaacacgauuugguu

SEQ ID NO: 2100650 - RNA, 20 nt, Staphylococcus aureus subsp. aureus MW2
auaaaguccaauacaauuua

SEQ ID NO: 2100651 - RNA, 16 nt, Staphylococcus aureus subsp. aureus MW2
auaaagucauacuuau

SEQ ID NO: 2100652 - RNA, 15 nt, Staphylococcus aureus subsp. aureus MW2
auaaagucauauggu

SEQ ID NO: 2100653 - RNA, 15 nt, Staphylococcus aureus subsp. aureus MW2
auaaaauuuuuuuca

SEQ ID NO: 2100654 - RNA, 16 nt, Staphylococcus aureus subsp. aureus MW2
auaaaauuuuuuucau

SEQ ID NO: 2100655 - RNA, 22 nt, Staphylococcus aureus subsp. aureus MW2
auaaaauuucugcuucuuuuaa

SEQ ID NO: 2100656 - RNA, 13 nt, Staphylococcus aureus subsp. aureus MW2
auaaaauuuugaa

SEQ ID NO: 2100657 - RNA, 13 nt, Staphylococcus aureus subsp. aureus MW2
auaaacaauaacu

SEQ ID NO: 2100658 - RNA, 23 nt, Staphylococcus aureus subsp. aureus MW2
auaaaccaaaucggaauaaaaua

SEQ ID NO: 2100659 - RNA, 22 nt, Staphylococcus aureus subsp. aureus MW2
auaaaaugcauagcucuucuuu

SEQ ID NO: 2100660 - RNA, 18 nt, Staphylococcus aureus subsp. aureus MW2
auaaaaugcuacaauuuc

SEQ ID NO: 2100661 - RNA, 13 nt, Staphylococcus aureus subsp. aureus MW2
auaaaauuaaaac

SEQ ID NO: 2100662 - RNA, 22 nt, Staphylococcus aureus subsp. aureus MW2
auaaaauaaucgguaauuacuu

SEQ ID NO: 2100663 - RNA, 12 nt, Staphylococcus aureus subsp. aureus MW2
auaaaauaaaua

SEQ ID NO: 2100664 - RNA, 15 nt, Staphylococcus aureus subsp. aureus MW2
aguuuuauuuauaaa

SEQ ID NO: 2100665 - RNA, 13 nt, Staphylococcus aureus subsp. aureus MW2
aguuuuauaagaa

SEQ ID NO: 2100666 - RNA, 16 nt, Staphylococcus aureus subsp. aureus MW2
aguuuuacugagggau

SEQ ID NO: 2100667 - RNA, 23 nt, Staphylococcus aureus subsp. aureus MW2
auaaaauaccagaugaaccaaaa

SEQ ID NO: 2100668 - RNA, 18 nt, Staphylococcus aureus subsp. aureus MW2
auaaaaucauuaauaauu

SEQ ID NO: 2100669 - RNA, 20 nt, Staphylococcus aureus subsp. aureus MW2
auaaaaucaucuuaacaauu

SEQ ID NO: 2100670 - RNA, 22 nt, Staphylococcus aureus subsp. aureus MW2
auaaaauccuaagcaucguaaa

SEQ ID NO: 2100671 - RNA, 15 nt, Staphylococcus aureus subsp. aureus MW2
auaaaaugaauaauu

SEQ ID NO: 2100672 - RNA, 17 nt, Staphylococcus aureus subsp. aureus MW2
auaauaaaacuugugau

SEQ ID NO: 2100673 - RNA, 19 nt, Staphylococcus aureus subsp. aureus MW2
auaaguuuuugaauaucua

SEQ ID NO: 2100674 - RNA, 13 nt, Staphylococcus aureus subsp. aureus MW2
auaauaaaucacg

SEQ ID NO: 2100675 - RNA, 23 nt, Staphylococcus aureus subsp. aureus MW2
auaauaaauagacugccaauaaa

SEQ ID NO: 2100676 - RNA, 18 nt, Staphylococcus aureus subsp. aureus MW2
auaauaacuggcaaauca

SEQ ID NO: 2100677 - RNA, 14 nt, Staphylococcus aureus subsp. aureus MW2
auaauaccaauugc

SEQ ID NO: 2100678 - RNA, 19 nt, Staphylococcus aureus subsp. aureus MW2
auaauaccuucaauugaca

SEQ ID NO: 2100679 - RNA, 20 nt, Staphylococcus aureus subsp. aureus MW2
auaauaagagguauagcaag

SEQ ID NO: 2100680 - RNA, 16 nt, Staphylococcus aureus subsp. aureus MW2
auaauaaucuuuaaca

SEQ ID NO: 2100681 - RNA, 13 nt, Staphylococcus aureus subsp. aureus MW2
auaaguuaaaauu

SEQ ID NO: 2100682 - RNA, 17 nt, Staphylococcus aureus subsp. aureus MW2
auaaguuaaaaauguaa

SEQ ID NO: 2100683 - RNA, 15 nt, Staphylococcus aureus subsp. aureus MW2
auaaguuaauguaau

SEQ ID NO: 2100684 - RNA, 13 nt, Staphylococcus aureus subsp. aureus MW2
auaaguuaaaaau

SEQ ID NO: 2100685 - RNA, 17 nt, Staphylococcus aureus subsp. aureus MW2
auaagaauuuaaaaggg

SEQ ID NO: 2100686 - RNA, 15 nt, Staphylococcus aureus subsp. aureus MW2
auaagucuauuaugu

SEQ ID NO: 2100687 - RNA, 20 nt, Staphylococcus aureus subsp. aureus MW2
auaagaauuaacaacaaaua

SEQ ID NO: 2100688 - RNA, 19 nt, Staphylococcus aureus subsp. aureus MW2
auaagucuuaacaaauuaa

SEQ ID NO: 2100689 - RNA, 11 nt, Staphylococcus aureus subsp. aureus MW2
auaagaaucag

SEQ ID NO: 2100690 - RNA, 18 nt, Staphylococcus aureus subsp. aureus MW2
auaagaagguguuugauu

SEQ ID NO: 2100691 - RNA, 19 nt, Staphylococcus aureus subsp. aureus MW2
auaagaagguguuugauuu

SEQ ID NO: 2100692 - RNA, 19 nt, Staphylococcus aureus subsp. aureus MW2
auaaucuuuuuuacuaaaa

SEQ ID NO: 2100693 - RNA, 17 nt, Staphylococcus aureus subsp. aureus MW2
auaaucuuuuuuacuaa

SEQ ID NO: 2100694 - RNA, 16 nt, Staphylococcus aureus subsp. aureus MW2
auaaucuuuuuuacua

SEQ ID NO: 2100695 - RNA, 17 nt, Staphylococcus aureus subsp. aureus MW2
auaaucuuuauuaauaa

SEQ ID NO: 2100696 - RNA, 15 nt, Staphylococcus aureus subsp. aureus MW2
auaaugaauaguaau

SEQ ID NO: 2100697 - RNA, 17 nt, Staphylococcus aureus subsp. aureus MW2
auaaugacgagaauuaa

SEQ ID NO: 2100698 - RNA, 15 nt, Staphylococcus aureus subsp. aureus MW2
auaaugacuauaaca

SEQ ID NO: 2100699 - RNA, 15 nt, Staphylococcus aureus subsp. aureus MW2
auaaugacugacacu

SEQ ID NO: 2100700 - RNA, 14 nt, Staphylococcus aureus subsp. aureus MW2
auaaugauaaauua

SEQ ID NO: 2100701 - RNA, 14 nt, Staphylococcus aureus subsp. aureus MW2
auaaugauuaaaaa

SEQ ID NO: 2100702 - RNA, 22 nt, Staphylococcus aureus subsp. aureus MW2
auaaugauuaaaaaucaaagag

SEQ ID NO: 2100703 - RNA, 15 nt, Staphylococcus aureus subsp. aureus MW2
auaaugauuuaauuu

SEQ ID NO: 2100704 - RNA, 19 nt, Staphylococcus aureus subsp. aureus MW2
auaaucucuucaauuuauu

SEQ ID NO: 2100705 - RNA, 19 nt, Staphylococcus aureus subsp. aureus MW2
auaaucuuacugcuuuuuu

SEQ ID NO: 2100706 - RNA, 16 nt, Staphylococcus aureus subsp. aureus MW2
auaaucgaacagaaaa

SEQ ID NO: 2100707 - RNA, 21 nt, Staphylococcus aureus subsp. aureus MW2
auaaucacuuggcgacauuug

SEQ ID NO: 2100708 - RNA, 15 nt, Staphylococcus aureus subsp. aureus MW2
auaaucauaaaaauc

SEQ ID NO: 2100709 - RNA, 13 nt, Staphylococcus aureus subsp. aureus MW2
auaauauaaauaa

SEQ ID NO: 2100710 - RNA, 21 nt, Staphylococcus aureus subsp. aureus MW2
auaauauaaaacgauaagaau

SEQ ID NO: 2100711 - RNA, 15 nt, Staphylococcus aureus subsp. aureus MW2
auaauauaaaacgau

SEQ ID NO: 2100712 - RNA, 21 nt, Staphylococcus aureus subsp. aureus MW2
auaauaguuuacggggugcuu

SEQ ID NO: 2100713 - RNA, 17 nt, Staphylococcus aureus subsp. aureus MW2
auaauaggcuagauaau

SEQ ID NO: 2100714 - RNA, 20 nt, Staphylococcus aureus subsp. aureus MW2
auaauaggcuagauaauaau

SEQ ID NO: 2100715 - RNA, 16 nt, Staphylococcus aureus subsp. aureus MW2
auaauauaaauaaaag

SEQ ID NO: 2100716 - RNA, 18 nt, Staphylococcus aureus subsp. aureus MW2
auaauauauacaaauaaa

SEQ ID NO: 2100717 - RNA, 13 nt, Staphylococcus aureus subsp. aureus MW2
auaauauauuaaa

SEQ ID NO: 2100718 - RNA, 19 nt, Staphylococcus aureus subsp. aureus MW2
auaauuguccaugccuuau

SEQ ID NO: 2100719 - RNA, 14 nt, Staphylococcus aureus subsp. aureus MW2
auaauuguugcauu

SEQ ID NO: 2100720 - RNA, 13 nt, Staphylococcus aureus subsp. aureus MW2
auaauuggaauaa

SEQ ID NO: 2100721 - RNA, 15 nt, Staphylococcus aureus subsp. aureus MW2
auaauugcauuacua

SEQ ID NO: 2100722 - RNA, 22 nt, Staphylococcus aureus subsp. aureus MW2
auaauugcauagcuaaauaaau

SEQ ID NO: 2100723 - RNA, 20 nt, Staphylococcus aureus subsp. aureus MW2
auaauugcauagcuaaauaa

SEQ ID NO: 2100724 - RNA, 23 nt, Staphylococcus aureus subsp. aureus MW2
auaauuuaaaggcauaauaacca

SEQ ID NO: 2100725 - RNA, 16 nt, Staphylococcus aureus subsp. aureus MW2
auaauuuaaauuaaaa

SEQ ID NO: 2100726 - RNA, 23 nt, Staphylococcus aureus subsp. aureus MW2
auaauuuaauguugcaaaauuaa

SEQ ID NO: 2100727 - RNA, 16 nt, Staphylococcus aureus subsp. aureus MW2
auaauuuaauugguuu

SEQ ID NO: 2100728 - RNA, 12 nt, Staphylococcus aureus subsp. aureus MW2
auaauuuaauuu

SEQ ID NO: 2100729 - RNA, 15 nt, Staphylococcus aureus subsp. aureus MW2
auaauuucaauuugg

SEQ ID NO: 2100730 - RNA, 20 nt, Staphylococcus aureus subsp. aureus MW2
auaaugguugaauaacacua

SEQ ID NO: 2100731 - RNA, 15 nt, Staphylococcus aureus subsp. aureus MW2
auaauguaaaaugau

SEQ ID NO: 2100732 - RNA, 19 nt, Staphylococcus aureus subsp. aureus MW2
auaaugguucucugucaaa

SEQ ID NO: 2100733 - RNA, 15 nt, Staphylococcus aureus subsp. aureus MW2
auaaugguuucaaaa

SEQ ID NO: 2100734 - RNA, 15 nt, Staphylococcus aureus subsp. aureus MW2
auaauguacauguau

SEQ ID NO: 2100735 - RNA, 13 nt, Staphylococcus aureus subsp. aureus MW2
auaauguacacuu

SEQ ID NO: 2100736 - RNA, 18 nt, Staphylococcus aureus subsp. aureus MW2
auaauguacauguauaaa

SEQ ID NO: 2100737 - RNA, 16 nt, Staphylococcus aureus subsp. aureus MW2
auaauguauaaaacag

SEQ ID NO: 2100738 - RNA, 19 nt, Staphylococcus aureus subsp. aureus MW2
auaauugagaaaaagguua

SEQ ID NO: 2100739 - RNA, 18 nt, Staphylococcus aureus subsp. aureus MW2
auaauucuuuuagaauuc

SEQ ID NO: 2100740 - RNA, 14 nt, Staphylococcus aureus subsp. aureus MW2
auaauugaaaaucu

SEQ ID NO: 2100741 - RNA, 21 nt, Staphylococcus aureus subsp. aureus MW2
auaauuuuucuucuuuuuuau

SEQ ID NO: 2100742 - RNA, 22 nt, Staphylococcus aureus subsp. aureus MW2
auaauuuuuaacagcgugaaua

SEQ ID NO: 2100743 - RNA, 20 nt, Staphylococcus aureus subsp. aureus MW2
auaauuuucuguccaaaaag

SEQ ID NO: 2100744 - RNA, 21 nt, Staphylococcus aureus subsp. aureus MW2
auacaaaagaggcgccacaac

SEQ ID NO: 2100745 - RNA, 15 nt, Staphylococcus aureus subsp. aureus MW2
auaauuucuaaaucu

SEQ ID NO: 2100746 - RNA, 16 nt, Staphylococcus aureus subsp. aureus MW2
auaauuucuaaaucua

SEQ ID NO: 2100747 - RNA, 16 nt, Staphylococcus aureus subsp. aureus MW2
auaauuuguaauuccu

SEQ ID NO: 2100748 - RNA, 15 nt, Staphylococcus aureus subsp. aureus MW2
auaauuuguauuaua

SEQ ID NO: 2100749 - RNA, 16 nt, Staphylococcus aureus subsp. aureus MW2
auaauuucuucuucug

SEQ ID NO: 2100750 - RNA, 18 nt, Staphylococcus aureus subsp. aureus MW2
auaauuuuaaaaauaaaa

SEQ ID NO: 2100751 - RNA, 14 nt, Staphylococcus aureus subsp. aureus MW2
auaauuuuaaaaau

SEQ ID NO: 2100752 - RNA, 12 nt, Staphylococcus aureus subsp. aureus MW2
auaauuuuaaaa

SEQ ID NO: 2100753 - RNA, 22 nt, Staphylococcus aureus subsp. aureus MW2
auacacuaucauuaucaaauaa

SEQ ID NO: 2100754 - RNA, 17 nt, Staphylococcus aureus subsp. aureus MW2
auacacguacaaaauaa

SEQ ID NO: 2100755 - RNA, 22 nt, Staphylococcus aureus subsp. aureus MW2
auacacugcacaucauaauaaa

SEQ ID NO: 2100756 - RNA, 14 nt, Staphylococcus aureus subsp. aureus MW2
auacaccaauauuu

SEQ ID NO: 2100757 - RNA, 18 nt, Staphylococcus aureus subsp. aureus MW2
auacaccaauauuuuucg

SEQ ID NO: 2100758 - RNA, 14 nt, Staphylococcus aureus subsp. aureus MW2
auacacuugcuaaa

SEQ ID NO: 2100759 - RNA, 18 nt, Staphylococcus aureus subsp. aureus MW2
auacacuugcuaaaacua

SEQ ID NO: 2100760 - RNA, 20 nt, Staphylococcus aureus subsp. aureus MW2
auacacuugguuaucauuau

SEQ ID NO: 2100761 - RNA, 20 nt, Staphylococcus aureus subsp. aureus MW2
auacagaacuuuaauaauga

SEQ ID NO: 2100762 - RNA, 19 nt, Staphylococcus aureus subsp. aureus MW2
auacagaucucaauccaau

SEQ ID NO: 2100763 - RNA, 22 nt, Staphylococcus aureus subsp. aureus MW2
auacaauaugugauaaauagaa

SEQ ID NO: 2100764 - RNA, 14 nt, Staphylococcus aureus subsp. aureus MW2
auacaauguauuuu

SEQ ID NO: 2100765 - RNA, 15 nt, Staphylococcus aureus subsp. aureus MW2
auacaauguauuuug

SEQ ID NO: 2100766 - RNA, 21 nt, Staphylococcus aureus subsp. aureus MW2
auacaauuauggauaaaauuu

SEQ ID NO: 2100767 - RNA, 22 nt, Staphylococcus aureus subsp. aureus MW2
auacaauuauggauaaaauuua

SEQ ID NO: 2100768 - RNA, 13 nt, Staphylococcus aureus subsp. aureus MW2
auacaauuuuacc

SEQ ID NO: 2100769 - RNA, 13 nt, Staphylococcus aureus subsp. aureus MW2
auacaauuuaggu

SEQ ID NO: 2100770 - RNA, 12 nt, Staphylococcus aureus subsp. aureus MW2
auacaauuuuuu

SEQ ID NO: 2100771 - RNA, 13 nt, Staphylococcus aureus subsp. aureus MW2
auacaauuuuuug

SEQ ID NO: 2100772 - RNA, 13 nt, Staphylococcus aureus subsp. aureus MW2
auacacaaauuuu

SEQ ID NO: 2100773 - RNA, 17 nt, Staphylococcus aureus subsp. aureus MW2
auacacagauuacucug

SEQ ID NO: 2100774 - RNA, 14 nt, Staphylococcus aureus subsp. aureus MW2
auacaaauuuauau

SEQ ID NO: 2100775 - RNA, 13 nt, Staphylococcus aureus subsp. aureus MW2
auacaaauuuuuu

SEQ ID NO: 2100776 - RNA, 12 nt, Staphylococcus aureus subsp. aureus MW2
auacaaauugau

SEQ ID NO: 2100777 - RNA, 19 nt, Staphylococcus aureus subsp. aureus MW2
agucucuuuacggauugcu

SEQ ID NO: 2100778 - RNA, 23 nt, Staphylococcus aureus subsp. aureus MW2
agucuggaacaauaaucaauguu

SEQ ID NO: 2100779 - RNA, 18 nt, Staphylococcus aureus subsp. aureus MW2
agucuuuacucuacacuc

SEQ ID NO: 2100780 - RNA, 14 nt, Staphylococcus aureus subsp. aureus MW2
agucuuucaacaaa

SEQ ID NO: 2100781 - RNA, 18 nt, Staphylococcus aureus subsp. aureus MW2
agugaaaacuucucuauc

SEQ ID NO: 2100782 - RNA, 17 nt, Staphylococcus aureus subsp. aureus MW2
agucucuaaaacuuuuu

SEQ ID NO: 2100783 - RNA, 15 nt, Staphylococcus aureus subsp. aureus MW2
agucucguaauaaug

SEQ ID NO: 2100784 - RNA, 18 nt, Staphylococcus aureus subsp. aureus MW2
agucggggccccaacaca

SEQ ID NO: 2100785 - RNA, 13 nt, Staphylococcus aureus subsp. aureus MW2
agucggggcccca

SEQ ID NO: 2100786 - RNA, 17 nt, Staphylococcus aureus subsp. aureus MW2
agucggggccccaacac

SEQ ID NO: 2100787 - RNA, 18 nt, Staphylococcus aureus subsp. aureus MW2
agucgauaaauaugaugu

SEQ ID NO: 2100788 - RNA, 13 nt, Staphylococcus aureus subsp. aureus MW2
aguauuuucucua

SEQ ID NO: 2100789 - RNA, 14 nt, Staphylococcus aureus subsp. aureus MW2
aguauuuuuugcca

SEQ ID NO: 2100790 - RNA, 21 nt, Staphylococcus aureus subsp. aureus MW2
agucaaacacugccaauauaa

SEQ ID NO: 2100791 - RNA, 21 nt, Staphylococcus aureus subsp. aureus MW2
agugaaucuucuaauuaagaa

SEQ ID NO: 2100792 - RNA, 22 nt, Staphylococcus aureus subsp. aureus MW2
agugaaucuaaacuauaauaau

SEQ ID NO: 2100793 - RNA, 20 nt, Staphylococcus aureus subsp. aureus MW2
agugaaucgucuacauuuag

SEQ ID NO: 2100794 - RNA, 14 nt, Staphylococcus aureus subsp. aureus MW2
agugauuuaaaaaa

SEQ ID NO: 2100795 - RNA, 20 nt, Staphylococcus aureus subsp. aureus MW2
agugauuuaaaaaaauuaau

SEQ ID NO: 2100796 - RNA, 12 nt, Staphylococcus aureus subsp. aureus MW2
agugauuuaaaa

SEQ ID NO: 2100797 - RNA, 14 nt, Staphylococcus aureus subsp. aureus MW2
agugaugaaaaaga

SEQ ID NO: 2100798 - RNA, 21 nt, Staphylococcus aureus subsp. aureus MW2
agugaugaaaaagaguuaaua

SEQ ID NO: 2100799 - RNA, 21 nt, Staphylococcus aureus subsp. aureus MW2
agugcauuuuuuauuuuacuu

SEQ ID NO: 2100800 - RNA, 22 nt, Staphylococcus aureus subsp. aureus MW2
agugcaauaacaccaauugaau

SEQ ID NO: 2100801 - RNA, 15 nt, Staphylococcus aureus subsp. aureus MW2
agugcuucaacuuca

SEQ ID NO: 2100802 - RNA, 17 nt, Staphylococcus aureus subsp. aureus MW2
agugguaaaaaguuuaa

SEQ ID NO: 2100803 - RNA, 20 nt, Staphylococcus aureus subsp. aureus MW2
agugguaaaaaguuuaaagu

SEQ ID NO: 2100804 - RNA, 14 nt, Staphylococcus aureus subsp. aureus MW2
aguggcauuuaaaa

SEQ ID NO: 2100805 - RNA, 16 nt, Staphylococcus aureus subsp. aureus MW2
aguggcauuuaaaaau

SEQ ID NO: 2100806 - RNA, 22 nt, Staphylococcus aureus subsp. aureus MW2
aguggccuuuuaaacaaauaaa

SEQ ID NO: 2100807 - RNA, 14 nt, Staphylococcus aureus subsp. aureus MW2
aguguauauaguag

SEQ ID NO: 2100808 - RNA, 21 nt, Staphylococcus aureus subsp. aureus MW2
aguguauauaguaggagugaa

SEQ ID NO: 2100809 - RNA, 16 nt, Staphylococcus aureus subsp. aureus MW2
agugccguccauuucc

SEQ ID NO: 2100810 - RNA, 23 nt, Staphylococcus aureus subsp. aureus MW2
agugcgaauucaacgaaagugau

SEQ ID NO: 2100811 - RNA, 14 nt, Staphylococcus aureus subsp. aureus MW2
aguuguguaauaaa

SEQ ID NO: 2100812 - RNA, 15 nt, Staphylococcus aureus subsp. aureus MW2
aguuguuaggggcuc

SEQ ID NO: 2100813 - RNA, 15 nt, Staphylococcus aureus subsp. aureus MW2
aguuguuaggggcuu

SEQ ID NO: 2100814 - RNA, 15 nt, Staphylococcus aureus subsp. aureus MW2
aguuguugcaacuug

SEQ ID NO: 2100815 - RNA, 16 nt, Staphylococcus aureus subsp. aureus MW2
aguuguugauuuaaaa

SEQ ID NO: 2100816 - RNA, 14 nt, Staphylococcus aureus subsp. aureus MW2
aguuguugcuuugg

SEQ ID NO: 2100817 - RNA, 18 nt, Staphylococcus aureus subsp. aureus MW2
aguugucaucuaauuaca

SEQ ID NO: 2100818 - RNA, 16 nt, Staphylococcus aureus subsp. aureus MW2
aguugcccgauuuuaa

SEQ ID NO: 2100819 - RNA, 22 nt, Staphylococcus aureus subsp. aureus MW2
aguugcauaaucaauuucaccu

SEQ ID NO: 2100820 - RNA, 19 nt, Staphylococcus aureus subsp. aureus MW2
aguuguacuacuugauucu

SEQ ID NO: 2100821 - RNA, 23 nt, Staphylococcus aureus subsp. aureus MW2
aguuuagauucacuguauaaaua

SEQ ID NO: 2100822 - RNA, 19 nt, Staphylococcus aureus subsp. aureus MW2
aguuucaaucgcauuuugu

SEQ ID NO: 2100823 - RNA, 11 nt, Staphylococcus aureus subsp. aureus MW2
aguuuaaaaau

SEQ ID NO: 2100824 - RNA, 14 nt, Staphylococcus aureus subsp. aureus MW2
aguuguuucuccag

SEQ ID NO: 2100825 - RNA, 21 nt, Staphylococcus aureus subsp. aureus MW2
aguuguuucuccaguuuuugg

SEQ ID NO: 2100826 - RNA, 21 nt, Staphylococcus aureus subsp. aureus MW2
aguuuaaucguauuagccaau

SEQ ID NO: 2100827 - RNA, 15 nt, Staphylococcus aureus subsp. aureus MW2
aguuugaucauuuac

SEQ ID NO: 2100828 - RNA, 20 nt, Staphylococcus aureus subsp. aureus MW2
aguuuccauaaauaaaaugc

SEQ ID NO: 2100829 - RNA, 22 nt, Staphylococcus aureus subsp. aureus MW2
aguuucaucaaguauaaauguu

SEQ ID NO: 2100830 - RNA, 23 nt, Staphylococcus aureus subsp. aureus MW2
aguuucaucuucaacuuucucua

SEQ ID NO: 2100831 - RNA, 18 nt, Staphylococcus aureus subsp. aureus MW2
aguuucaucuucaacuuu

SEQ ID NO: 2100832 - RNA, 18 nt, Staphylococcus aureus subsp. aureus MW2
aguuucaucgaagauguu

SEQ ID NO: 2100833 - RNA, 22 nt, Staphylococcus aureus subsp. aureus MW2
aguuucugacuuuuaaaaaaca

SEQ ID NO: 2100834 - RNA, 22 nt, Staphylococcus aureus subsp. aureus MW2
aguugauuuaagauuuaauaaa

SEQ ID NO: 2100835 - RNA, 21 nt, Staphylococcus aureus subsp. aureus MW2
aguugauugcaugacagcaaa

SEQ ID NO: 2100836 - RNA, 12 nt, Staphylococcus aureus subsp. aureus MW2
aguugauaaugu

SEQ ID NO: 2100837 - RNA, 18 nt, Staphylococcus aureus subsp. aureus MW2
aguucggaugagaaaugu

SEQ ID NO: 2100838 - RNA, 15 nt, Staphylococcus aureus subsp. aureus MW2
aguucuauauaauuu

SEQ ID NO: 2100839 - RNA, 19 nt, Staphylococcus aureus subsp. aureus MW2
aguguaugcauauaagaua

SEQ ID NO: 2100840 - RNA, 14 nt, Staphylococcus aureus subsp. aureus MW2
aguguauucauuuu

SEQ ID NO: 2100841 - RNA, 19 nt, Staphylococcus aureus subsp. aureus MW2
aguguauucauuuuaaauu

SEQ ID NO: 2100842 - RNA, 12 nt, Staphylococcus aureus subsp. aureus MW2
aguuaauuaugu

SEQ ID NO: 2100843 - RNA, 17 nt, Staphylococcus aureus subsp. aureus MW2
aguuaauuauuuagauu

SEQ ID NO: 2100844 - RNA, 15 nt, Staphylococcus aureus subsp. aureus MW2
aguuaauguaaaguu

SEQ ID NO: 2100845 - RNA, 15 nt, Staphylococcus aureus subsp. aureus MW2
aguuacuuacgccaa

SEQ ID NO: 2100846 - RNA, 21 nt, Staphylococcus aureus subsp. aureus MW2
aguuacuuacgccaaucacaa

SEQ ID NO: 2100847 - RNA, 19 nt, Staphylococcus aureus subsp. aureus MW2
aguuacuauauuuauuagu

SEQ ID NO: 2100848 - RNA, 17 nt, Staphylococcus aureus subsp. aureus MW2
aguuaccuacuacauuc

SEQ ID NO: 2100849 - RNA, 20 nt, Staphylococcus aureus subsp. aureus MW2
aguuaccucgaguuuauucg

SEQ ID NO: 2100850 - RNA, 17 nt, Staphylococcus aureus subsp. aureus MW2
aguuaccuuugccaaca

SEQ ID NO: 2100851 - RNA, 21 nt, Staphylococcus aureus subsp. aureus MW2
aguuaccuuugccaacaccau

SEQ ID NO: 2100852 - RNA, 13 nt, Staphylococcus aureus subsp. aureus MW2
aguuauuaagcca

SEQ ID NO: 2100853 - RNA, 19 nt, Staphylococcus aureus subsp. aureus MW2
aguuaugaagggaaaaaau

SEQ ID NO: 2100854 - RNA, 18 nt, Staphylococcus aureus subsp. aureus MW2
aguuagaagaugauuauu

SEQ ID NO: 2100855 - RNA, 21 nt, Staphylococcus aureus subsp. aureus MW2
aguucaccguaaucuuuuaac

SEQ ID NO: 2100856 - RNA, 13 nt, Staphylococcus aureus subsp. aureus MW2
aguucacaugaau

SEQ ID NO: 2100857 - RNA, 20 nt, Staphylococcus aureus subsp. aureus MW2
aucuuuguaaccuaaaaaca

SEQ ID NO: 2100858 - RNA, 22 nt, Staphylococcus aureus subsp. aureus MW2
aucuuuguuuucaaacuuuuca

SEQ ID NO: 2100859 - RNA, 14 nt, Staphylococcus aureus subsp. aureus MW2
aucuuuauuuuuua

SEQ ID NO: 2100860 - RNA, 19 nt, Staphylococcus aureus subsp. aureus MW2
aucuuuauuuuuuaucauu

SEQ ID NO: 2100861 - RNA, 13 nt, Staphylococcus aureus subsp. aureus MW2
aucuuucacaauu

SEQ ID NO: 2100862 - RNA, 12 nt, Staphylococcus aureus subsp. aureus MW2
aucuuuuagcuu

SEQ ID NO: 2100863 - RNA, 23 nt, Staphylococcus aureus subsp. aureus MW2
aucuuuuacuaaaugaauugcuu

SEQ ID NO: 2100864 - RNA, 14 nt, Staphylococcus aureus subsp. aureus MW2
aucuuuuaaauuua

SEQ ID NO: 2100865 - RNA, 18 nt, Staphylococcus aureus subsp. aureus MW2
aucuuuuacuaaaugaau

SEQ ID NO: 2100866 - RNA, 23 nt, Staphylococcus aureus subsp. aureus MW2
augaaaaagauucggaaaauaug

SEQ ID NO: 2100867 - RNA, 20 nt, Staphylococcus aureus subsp. aureus MW2
augaaaaagaguuaauaaaa

SEQ ID NO: 2100868 - RNA, 16 nt, Staphylococcus aureus subsp. aureus MW2
augaaaacagguggaa

SEQ ID NO: 2100869 - RNA, 18 nt, Staphylococcus aureus subsp. aureus MW2
augaaaacuuaaaaauga

SEQ ID NO: 2100870 - RNA, 21 nt, Staphylococcus aureus subsp. aureus MW2
augaaagucuuuaaccaaaau

SEQ ID NO: 2100871 - RNA, 11 nt, Staphylococcus aureus subsp. aureus MW2
augaaaaguga

SEQ ID NO: 2100872 - RNA, 16 nt, Staphylococcus aureus subsp. aureus MW2
augaaaagagauuuuu

SEQ ID NO: 2100873 - RNA, 23 nt, Staphylococcus aureus subsp. aureus MW2
augaaaagagauuuuuuugaaaa

SEQ ID NO: 2100874 - RNA, 16 nt, Staphylococcus aureus subsp. aureus MW2
augaaauuguguugaa

SEQ ID NO: 2100875 - RNA, 16 nt, Staphylococcus aureus subsp. aureus MW2
augaaauuagauuuua

SEQ ID NO: 2100876 - RNA, 21 nt, Staphylococcus aureus subsp. aureus MW2
augaaccagcuaaccaaauaa

SEQ ID NO: 2100877 - RNA, 22 nt, Staphylococcus aureus subsp. aureus MW2
augaaccagcuaaccaaauaau

SEQ ID NO: 2100878 - RNA, 14 nt, Staphylococcus aureus subsp. aureus MW2
augaagcauuuuau

SEQ ID NO: 2100879 - RNA, 23 nt, Staphylococcus aureus subsp. aureus MW2
augaacgaaucuauaacgauaga

SEQ ID NO: 2100880 - RNA, 14 nt, Staphylococcus aureus subsp. aureus MW2
augaacucacaaca

SEQ ID NO: 2100881 - RNA, 20 nt, Staphylococcus aureus subsp. aureus MW2
augaaucgauauaaugaagu

SEQ ID NO: 2100882 - RNA, 22 nt, Staphylococcus aureus subsp. aureus MW2
augaauccugugacucaaugau

SEQ ID NO: 2100883 - RNA, 19 nt, Staphylococcus aureus subsp. aureus MW2
augaaucccauaaugacua

SEQ ID NO: 2100884 - RNA, 15 nt, Staphylococcus aureus subsp. aureus MW2
augaauccaaauauu

SEQ ID NO: 2100885 - RNA, 17 nt, Staphylococcus aureus subsp. aureus MW2
augaauccaaauauuaa

SEQ ID NO: 2100886 - RNA, 19 nt, Staphylococcus aureus subsp. aureus MW2
augaaggcuuuuuguuuug

SEQ ID NO: 2100887 - RNA, 16 nt, Staphylococcus aureus subsp. aureus MW2
augaaguugguuuaga

SEQ ID NO: 2100888 - RNA, 21 nt, Staphylococcus aureus subsp. aureus MW2
augaaguggauagcugcauaa

SEQ ID NO: 2100889 - RNA, 18 nt, Staphylococcus aureus subsp. aureus MW2
augaagugggauaugaau

SEQ ID NO: 2100890 - RNA, 14 nt, Staphylococcus aureus subsp. aureus MW2
augaauuuuauaaa

SEQ ID NO: 2100891 - RNA, 18 nt, Staphylococcus aureus subsp. aureus MW2
augaauuuuauaaauuaa

SEQ ID NO: 2100892 - RNA, 14 nt, Staphylococcus aureus subsp. aureus MW2
augaauuuucauca

SEQ ID NO: 2100893 - RNA, 15 nt, Staphylococcus aureus subsp. aureus MW2
augaauuuucaucau

SEQ ID NO: 2100894 - RNA, 16 nt, Staphylococcus aureus subsp. aureus MW2
augaauuuuaauauau

SEQ ID NO: 2100895 - RNA, 19 nt, Staphylococcus aureus subsp. aureus MW2
augaauuuagcaucaaaaa

SEQ ID NO: 2100896 - RNA, 14 nt, Staphylococcus aureus subsp. aureus MW2
augacuauuuucca

SEQ ID NO: 2100897 - RNA, 23 nt, Staphylococcus aureus subsp. aureus MW2
augacugagaaaaauauuucuaa

SEQ ID NO: 2100898 - RNA, 18 nt, Staphylococcus aureus subsp. aureus MW2
augacugagaaaaauauu

SEQ ID NO: 2100899 - RNA, 16 nt, Staphylococcus aureus subsp. aureus MW2
augacauggaaaauau

SEQ ID NO: 2100900 - RNA, 19 nt, Staphylococcus aureus subsp. aureus MW2
augacauggaaaauauauu

SEQ ID NO: 2100901 - RNA, 20 nt, Staphylococcus aureus subsp. aureus MW2
augacauggaaaauauauua

SEQ ID NO: 2100902 - RNA, 13 nt, Staphylococcus aureus subsp. aureus MW2
augacaucaauau

SEQ ID NO: 2100903 - RNA, 17 nt, Staphylococcus aureus subsp. aureus MW2
augagucuuuuugauua

SEQ ID NO: 2100904 - RNA, 20 nt, Staphylococcus aureus subsp. aureus MW2
augauaaccaaucaucgcaa

SEQ ID NO: 2100905 - RNA, 19 nt, Staphylococcus aureus subsp. aureus MW2
augauaaccauuaugauua

SEQ ID NO: 2100906 - RNA, 17 nt, Staphylococcus aureus subsp. aureus MW2
augaguugaagcuaauu

SEQ ID NO: 2100907 - RNA, 20 nt, Staphylococcus aureus subsp. aureus MW2
augaguuguucagauuugua

SEQ ID NO: 2100908 - RNA, 18 nt, Staphylococcus aureus subsp. aureus MW2
augaguugaacaacuaug

SEQ ID NO: 2100909 - RNA, 21 nt, Staphylococcus aureus subsp. aureus MW2
augauaauuaauuaaaagccc

SEQ ID NO: 2100910 - RNA, 20 nt, Staphylococcus aureus subsp. aureus MW2
augauacauuauuaaauaga

SEQ ID NO: 2100911 - RNA, 12 nt, Staphylococcus aureus subsp. aureus MW2
augauacauuau

SEQ ID NO: 2100912 - RNA, 19 nt, Staphylococcus aureus subsp. aureus MW2
augauacgcuuuuuaaaaa

SEQ ID NO: 2100913 - RNA, 18 nt, Staphylococcus aureus subsp. aureus MW2
augauacgcuuuuuaaaa

SEQ ID NO: 2100914 - RNA, 16 nt, Staphylococcus aureus subsp. aureus MW2
augauacucaauaaaa

SEQ ID NO: 2100915 - RNA, 18 nt, Staphylococcus aureus subsp. aureus MW2
augauacgugguuuuauu

SEQ ID NO: 2100916 - RNA, 16 nt, Staphylococcus aureus subsp. aureus MW2
augauagaauacuaaa

SEQ ID NO: 2100917 - RNA, 16 nt, Staphylococcus aureus subsp. aureus MW2
augauauccaaagcuu

SEQ ID NO: 2100918 - RNA, 13 nt, Staphylococcus aureus subsp. aureus MW2
augauauauguaa

SEQ ID NO: 2100919 - RNA, 14 nt, Staphylococcus aureus subsp. aureus MW2
augauauauuacau

SEQ ID NO: 2100920 - RNA, 16 nt, Staphylococcus aureus subsp. aureus MW2
augauauaaccgcaua

SEQ ID NO: 2100921 - RNA, 19 nt, Staphylococcus aureus subsp. aureus MW2
augauagcgugauuuuuca

SEQ ID NO: 2100922 - RNA, 16 nt, Staphylococcus aureus subsp. aureus MW2
augauauugaaagugu

SEQ ID NO: 2100923 - RNA, 14 nt, Staphylococcus aureus subsp. aureus MW2
augauauucauaua

SEQ ID NO: 2100924 - RNA, 23 nt, Staphylococcus aureus subsp. aureus MW2
augauauugauuugauucauuac

SEQ ID NO: 2100925 - RNA, 16 nt, Staphylococcus aureus subsp. aureus MW2
augauauuaacuguac

SEQ ID NO: 2100926 - RNA, 16 nt, Staphylococcus aureus subsp. aureus MW2
augauauuacauauaa

SEQ ID NO: 2100927 - RNA, 22 nt, Staphylococcus aureus subsp. aureus MW2
augauauuuucgcaaaauuauu

SEQ ID NO: 2100928 - RNA, 21 nt, Staphylococcus aureus subsp. aureus MW2
augauauuuucgcaaaauuua

SEQ ID NO: 2100929 - RNA, 16 nt, Staphylococcus aureus subsp. aureus MW2
augauauuuaacgaaa

SEQ ID NO: 2100930 - RNA, 19 nt, Staphylococcus aureus subsp. aureus MW2
aucugaaaauaucacugaa

SEQ ID NO: 2100931 - RNA, 18 nt, Staphylococcus aureus subsp. aureus MW2
aucucugcuuuaauauaa

SEQ ID NO: 2100932 - RNA, 17 nt, Staphylococcus aureus subsp. aureus MW2
aucucugcuuuaauaua

SEQ ID NO: 2100933 - RNA, 11 nt, Staphylococcus aureus subsp. aureus MW2
aucucugaaaa

SEQ ID NO: 2100934 - RNA, 19 nt, Staphylococcus aureus subsp. aureus MW2
aucucauacuauacaaugu

SEQ ID NO: 2100935 - RNA, 20 nt, Staphylococcus aureus subsp. aureus MW2
aucucauacuauacaaugua

SEQ ID NO: 2100936 - RNA, 21 nt, Staphylococcus aureus subsp. aureus MW2
aucucauacuauacaauguau

SEQ ID NO: 2100937 - RNA, 19 nt, Staphylococcus aureus subsp. aureus MW2
aucuacagagaaucaauua

SEQ ID NO: 2100938 - RNA, 18 nt, Staphylococcus aureus subsp. aureus MW2
aucuacagagaaucaauu

SEQ ID NO: 2100939 - RNA, 15 nt, Staphylococcus aureus subsp. aureus MW2
aucuagaugaaauug

SEQ ID NO: 2100940 - RNA, 13 nt, Staphylococcus aureus subsp. aureus MW2
aucuaauuuuucc

SEQ ID NO: 2100941 - RNA, 14 nt, Staphylococcus aureus subsp. aureus MW2
aucuaauuuuucca

SEQ ID NO: 2100942 - RNA, 14 nt, Staphylococcus aureus subsp. aureus MW2
aucguauugaaaau

SEQ ID NO: 2100943 - RNA, 22 nt, Staphylococcus aureus subsp. aureus MW2
aucguauugcucgccucaaaug

SEQ ID NO: 2100944 - RNA, 14 nt, Staphylococcus aureus subsp. aureus MW2
aucgucauauuaau

SEQ ID NO: 2100945 - RNA, 18 nt, Staphylococcus aureus subsp. aureus MW2
aucgucauauuaauauuu

SEQ ID NO: 2100946 - RNA, 22 nt, Staphylococcus aureus subsp. aureus MW2
aucgucauauuaauauuuuuug

SEQ ID NO: 2100947 - RNA, 14 nt, Staphylococcus aureus subsp. aureus MW2
aucucauaauaauu

SEQ ID NO: 2100948 - RNA, 14 nt, Staphylococcus aureus subsp. aureus MW2
aucuauauuuaauu

SEQ ID NO: 2100949 - RNA, 13 nt, Staphylococcus aureus subsp. aureus MW2
aucuaucuugugc

SEQ ID NO: 2100950 - RNA, 15 nt, Staphylococcus aureus subsp. aureus MW2
aucuauaaauuauuu

SEQ ID NO: 2100951 - RNA, 19 nt, Staphylococcus aureus subsp. aureus MW2
aucuauaaauuauuuuuga

SEQ ID NO: 2100952 - RNA, 13 nt, Staphylococcus aureus subsp. aureus MW2
aucuauaaauacu

SEQ ID NO: 2100953 - RNA, 13 nt, Staphylococcus aureus subsp. aureus MW2
aucuauaaauggc

SEQ ID NO: 2100954 - RNA, 14 nt, Staphylococcus aureus subsp. aureus MW2
aucuaguacaccuc

SEQ ID NO: 2100955 - RNA, 17 nt, Staphylococcus aureus subsp. aureus MW2
aucuauaagauuucuca

SEQ ID NO: 2100956 - RNA, 13 nt, Staphylococcus aureus subsp. aureus MW2
aucuauacuuuau

SEQ ID NO: 2100957 - RNA, 12 nt, Staphylococcus aureus subsp. aureus MW2
aucuauaugcau

SEQ ID NO: 2100958 - RNA, 14 nt, Staphylococcus aureus subsp. aureus MW2
aucuauaaaaagaa

SEQ ID NO: 2100959 - RNA, 19 nt, Staphylococcus aureus subsp. aureus MW2
aucuagccugaaauagaaa

SEQ ID NO: 2100960 - RNA, 21 nt, Staphylococcus aureus subsp. aureus MW2
aucuagccugaaauagaaaug

SEQ ID NO: 2100961 - RNA, 18 nt, Staphylococcus aureus subsp. aureus MW2
aucuucaauauuuaaauu

SEQ ID NO: 2100962 - RNA, 14 nt, Staphylococcus aureus subsp. aureus MW2
aucuuaagucauca

SEQ ID NO: 2100963 - RNA, 19 nt, Staphylococcus aureus subsp. aureus MW2
aucuuaaucagcuauaaaa

SEQ ID NO: 2100964 - RNA, 18 nt, Staphylococcus aureus subsp. aureus MW2
aucuuaacaauuuuaauu

SEQ ID NO: 2100965 - RNA, 22 nt, Staphylococcus aureus subsp. aureus MW2
aucuuaacaauuuuaauuuuuc

SEQ ID NO: 2100966 - RNA, 23 nt, Staphylococcus aureus subsp. aureus MW2
aucuuaacaauuuuaauuuuuca

SEQ ID NO: 2100967 - RNA, 12 nt, Staphylococcus aureus subsp. aureus MW2
aucuuaaugcua

SEQ ID NO: 2100968 - RNA, 19 nt, Staphylococcus aureus subsp. aureus MW2
aucuuacauugauaaaaua

SEQ ID NO: 2100969 - RNA, 20 nt, Staphylococcus aureus subsp. aureus MW2
aucuuaggugucaucgcuuu

SEQ ID NO: 2100970 - RNA, 19 nt, Staphylococcus aureus subsp. aureus MW2
aucuuagacgcuguuuuaa

SEQ ID NO: 2100971 - RNA, 22 nt, Staphylococcus aureus subsp. aureus MW2
aucuuagacgcuguuuuaaauu

SEQ ID NO: 2100972 - RNA, 16 nt, Staphylococcus aureus subsp. aureus MW2
aucuuacuacuuaauu

SEQ ID NO: 2100973 - RNA, 22 nt, Staphylococcus aureus subsp. aureus MW2
aucuucaagugccauuuuuaaa

SEQ ID NO: 2100974 - RNA, 22 nt, Staphylococcus aureus subsp. aureus MW2
aucuucaacauaacucaaauau

SEQ ID NO: 2100975 - RNA, 22 nt, Staphylococcus aureus subsp. aureus MW2
aucuuauaacaaaaauugcuau

SEQ ID NO: 2100976 - RNA, 13 nt, Staphylococcus aureus subsp. aureus MW2
aucuuaucaagaa

SEQ ID NO: 2100977 - RNA, 22 nt, Staphylococcus aureus subsp. aureus MW2
aucuuaugauacuuugaaagaa

SEQ ID NO: 2100978 - RNA, 18 nt, Staphylococcus aureus subsp. aureus MW2
aucugacauuucaucaau

SEQ ID NO: 2100979 - RNA, 14 nt, Staphylococcus aureus subsp. aureus MW2
aucuguaucaaagu

SEQ ID NO: 2100980 - RNA, 14 nt, Staphylococcus aureus subsp. aureus MW2
aucuguuuguuguu

SEQ ID NO: 2100981 - RNA, 16 nt, Staphylococcus aureus subsp. aureus MW2
aucuguagaaacacuu

SEQ ID NO: 2100982 - RNA, 19 nt, Staphylococcus aureus subsp. aureus MW2
aucuguaccguauuuuaau

SEQ ID NO: 2100983 - RNA, 14 nt, Staphylococcus aureus subsp. aureus MW2
aucuguaacauaaa

SEQ ID NO: 2100984 - RNA, 18 nt, Staphylococcus aureus subsp. aureus MW2
aucuguaacauaaacaau

SEQ ID NO: 2100985 - RNA, 20 nt, Staphylococcus aureus subsp. aureus MW2
aucauuaguuuuuaaaauua

SEQ ID NO: 2100986 - RNA, 14 nt, Staphylococcus aureus subsp. aureus MW2
aucauuaucaaaua

SEQ ID NO: 2100987 - RNA, 16 nt, Staphylococcus aureus subsp. aureus MW2
aucauuaguuuuuaaa

SEQ ID NO: 2100988 - RNA, 14 nt, Staphylococcus aureus subsp. aureus MW2
aucauuucaaauaa

SEQ ID NO: 2100989 - RNA, 12 nt, Staphylococcus aureus subsp. aureus MW2
aucauuucuguc

SEQ ID NO: 2100990 - RNA, 12 nt, Staphylococcus aureus subsp. aureus MW2
aucauuuguguu

SEQ ID NO: 2100991 - RNA, 16 nt, Staphylococcus aureus subsp. aureus MW2
aucauuucaaauaaga

SEQ ID NO: 2100992 - RNA, 18 nt, Staphylococcus aureus subsp. aureus MW2
aucauuuacuuuagaaac

SEQ ID NO: 2100993 - RNA, 16 nt, Staphylococcus aureus subsp. aureus MW2
aucauucauuugcaaa

SEQ ID NO: 2100994 - RNA, 20 nt, Staphylococcus aureus subsp. aureus MW2
aucauucccugcagcaauca

SEQ ID NO: 2100995 - RNA, 21 nt, Staphylococcus aureus subsp. aureus MW2
aucauucccugcagcaaucac

SEQ ID NO: 2100996 - RNA, 23 nt, Staphylococcus aureus subsp. aureus MW2
aucauuguguccauaaauauuaa

SEQ ID NO: 2100997 - RNA, 15 nt, Staphylococcus aureus subsp. aureus MW2
aucauuguuuuaaau

SEQ ID NO: 2100998 - RNA, 13 nt, Staphylococcus aureus subsp. aureus MW2
aaaacuuguaaau

SEQ ID NO: 2100999 - RNA, 18 nt, Staphylococcus aureus subsp. aureus MW2
aaaacuuguuguuauuua

SEQ ID NO: 2101000 - RNA, 17 nt, Staphylococcus aureus subsp. aureus MW2
aaaacuugugaauuuuc

SEQ ID NO: 2101001 - RNA, 20 nt, Staphylococcus aureus subsp. aureus MW2
aucauuaguguagaaaauag

SEQ ID NO: 2101002 - RNA, 14 nt, Staphylococcus aureus subsp. aureus MW2
aaaacuuaaaauau

SEQ ID NO: 2101003 - RNA, 18 nt, Staphylococcus aureus subsp. aureus MW2
aucauuaagaaaaggcuc

SEQ ID NO: 2101004 - RNA, 15 nt, Staphylococcus aureus subsp. aureus MW2
aucauuaauaauuaa

SEQ ID NO: 2101005 - RNA, 15 nt, Staphylococcus aureus subsp. aureus MW2
aucauguuuauuagc

SEQ ID NO: 2101006 - RNA, 11 nt, Staphylococcus aureus subsp. aureus MW2
aucauuaaaau

SEQ ID NO: 2101007 - RNA, 12 nt, Staphylococcus aureus subsp. aureus MW2
aucauuaaaauc

SEQ ID NO: 2101008 - RNA, 22 nt, Staphylococcus aureus subsp. aureus MW2
aucauuaaauugcuugaaauua

SEQ ID NO: 2101009 - RNA, 14 nt, Staphylococcus aureus subsp. aureus MW2
aaaacuacauuugg

SEQ ID NO: 2101010 - RNA, 14 nt, Staphylococcus aureus subsp. aureus MW2
auccaccaaauaca

SEQ ID NO: 2101011 - RNA, 16 nt, Staphylococcus aureus subsp. aureus MW2
auccaagugacaacau

SEQ ID NO: 2101012 - RNA, 13 nt, Staphylococcus aureus subsp. aureus MW2
auccaauauacaa

SEQ ID NO: 2101013 - RNA, 21 nt, Staphylococcus aureus subsp. aureus MW2
auccaaggauguuauaaaaug

SEQ ID NO: 2101014 - RNA, 14 nt, Staphylococcus aureus subsp. aureus MW2
aucauuuuuucaau

SEQ ID NO: 2101015 - RNA, 15 nt, Staphylococcus aureus subsp. aureus MW2
aucauuuuuucaaua

SEQ ID NO: 2101016 - RNA, 16 nt, Staphylococcus aureus subsp. aureus MW2
aucauuuucuugauuu

SEQ ID NO: 2101017 - RNA, 18 nt, Staphylococcus aureus subsp. aureus MW2
aucauuuuuaauuuugac

SEQ ID NO: 2101018 - RNA, 18 nt, Staphylococcus aureus subsp. aureus MW2
aucauuuguguuuuuaau

SEQ ID NO: 2101019 - RNA, 15 nt, Staphylococcus aureus subsp. aureus MW2
aucauuuucaauacu

SEQ ID NO: 2101020 - RNA, 22 nt, Staphylococcus aureus subsp. aureus MW2
aucauuuguguuuuuaauguuu

SEQ ID NO: 2101021 - RNA, 16 nt, Staphylococcus aureus subsp. aureus MW2
auccaccuaaaaagua

SEQ ID NO: 2101022 - RNA, 20 nt, Staphylococcus aureus subsp. aureus MW2
auccauucuuuuucaaaaua

SEQ ID NO: 2101023 - RNA, 17 nt, Staphylococcus aureus subsp. aureus MW2
auccccgagcaauucuu

SEQ ID NO: 2101024 - RNA, 14 nt, Staphylococcus aureus subsp. aureus MW2
aucccggaauauua

SEQ ID NO: 2101025 - RNA, 15 nt, Staphylococcus aureus subsp. aureus MW2
auccgaaaauugcua

SEQ ID NO: 2101026 - RNA, 19 nt, Staphylococcus aureus subsp. aureus MW2
auccgaaaauugcuaaaaa

SEQ ID NO: 2101027 - RNA, 16 nt, Staphylococcus aureus subsp. aureus MW2
aucccucuaucaaauu

SEQ ID NO: 2101028 - RNA, 17 nt, Staphylococcus aureus subsp. aureus MW2
aucggaauaaaauaaau

SEQ ID NO: 2101029 - RNA, 14 nt, Staphylococcus aureus subsp. aureus MW2
aucggacagcugaa

SEQ ID NO: 2101030 - RNA, 16 nt, Staphylococcus aureus subsp. aureus MW2
aucgcuugcuucuuuc

SEQ ID NO: 2101031 - RNA, 14 nt, Staphylococcus aureus subsp. aureus MW2
aucgcuugcuucuu

SEQ ID NO: 2101032 - RNA, 15 nt, Staphylococcus aureus subsp. aureus MW2
aucgcuaauacuuua

SEQ ID NO: 2101033 - RNA, 15 nt, Staphylococcus aureus subsp. aureus MW2
aucguaaaaaacaaa

SEQ ID NO: 2101034 - RNA, 14 nt, Staphylococcus aureus subsp. aureus MW2
aucguaaaaaacaa

SEQ ID NO: 2101035 - RNA, 21 nt, Staphylococcus aureus subsp. aureus MW2
aucguagcaccagcacaucaa

SEQ ID NO: 2101036 - RNA, 15 nt, Staphylococcus aureus subsp. aureus MW2
aucgguaauuacuug

SEQ ID NO: 2101037 - RNA, 16 nt, Staphylococcus aureus subsp. aureus MW2
aucgggaucuaauuuu

SEQ ID NO: 2101038 - RNA, 15 nt, Staphylococcus aureus subsp. aureus MW2
auccuuuaaaucauu

SEQ ID NO: 2101039 - RNA, 19 nt, Staphylococcus aureus subsp. aureus MW2
aucgaagauguuaaacugu

SEQ ID NO: 2101040 - RNA, 15 nt, Staphylococcus aureus subsp. aureus MW2
auccugccaauauau

SEQ ID NO: 2101041 - RNA, 17 nt, Staphylococcus aureus subsp. aureus MW2
auccugccaauauauuc

SEQ ID NO: 2101042 - RNA, 18 nt, Staphylococcus aureus subsp. aureus MW2
aucgauauagcauaaaau

SEQ ID NO: 2101043 - RNA, 20 nt, Staphylococcus aureus subsp. aureus MW2
aucgaguuugaaauaaucua

SEQ ID NO: 2101044 - RNA, 21 nt, Staphylococcus aureus subsp. aureus MW2
aucgauaaauguauuaaacau

SEQ ID NO: 2101045 - RNA, 16 nt, Staphylococcus aureus subsp. aureus MW2
aucgauacuaauaucu

SEQ ID NO: 2101046 - RNA, 15 nt, Staphylococcus aureus subsp. aureus MW2
aucgccaaucuauug

SEQ ID NO: 2101047 - RNA, 23 nt, Staphylococcus aureus subsp. aureus MW2
aucgacuaauuuuucuuucaggc

SEQ ID NO: 2101048 - RNA, 20 nt, Staphylococcus aureus subsp. aureus MW2
aucgaauaacuguuuaucau

SEQ ID NO: 2101049 - RNA, 19 nt, Staphylococcus aureus subsp. aureus MW2
auacgauaauaacuagaac

SEQ ID NO: 2101050 - RNA, 17 nt, Staphylococcus aureus subsp. aureus MW2
auacgagcuuugcucau

SEQ ID NO: 2101051 - RNA, 14 nt, Staphylococcus aureus subsp. aureus MW2
auacgcaaaccaau

SEQ ID NO: 2101052 - RNA, 22 nt, Staphylococcus aureus subsp. aureus MW2
auacgcaaucauuguaaaugau

SEQ ID NO: 2101053 - RNA, 18 nt, Staphylococcus aureus subsp. aureus MW2
auacgccuaaauauuuac

SEQ ID NO: 2101054 - RNA, 15 nt, Staphylococcus aureus subsp. aureus MW2
auaccuuuaauaucu

SEQ ID NO: 2101055 - RNA, 16 nt, Staphylococcus aureus subsp. aureus MW2
auaccuuuaauaucua

SEQ ID NO: 2101056 - RNA, 21 nt, Staphylococcus aureus subsp. aureus MW2
auaccuuuaauaucuaauucu

SEQ ID NO: 2101057 - RNA, 14 nt, Staphylococcus aureus subsp. aureus MW2
auaccuuuaauauc

SEQ ID NO: 2101058 - RNA, 12 nt, Staphylococcus aureus subsp. aureus MW2
auaccuuuaaau

SEQ ID NO: 2101059 - RNA, 14 nt, Staphylococcus aureus subsp. aureus MW2
auaccuuuuucuaa

SEQ ID NO: 2101060 - RNA, 21 nt, Staphylococcus aureus subsp. aureus MW2
auaccuuuuaauuuaguuaua

SEQ ID NO: 2101061 - RNA, 14 nt, Staphylococcus aureus subsp. aureus MW2
auacgaauuaaaau

SEQ ID NO: 2101062 - RNA, 15 nt, Staphylococcus aureus subsp. aureus MW2
auacgagaauaugau

SEQ ID NO: 2101063 - RNA, 15 nt, Staphylococcus aureus subsp. aureus MW2
auacgaguguuuuaa

SEQ ID NO: 2101064 - RNA, 20 nt, Staphylococcus aureus subsp. aureus MW2
auaccuauuggcauuagcuu

SEQ ID NO: 2101065 - RNA, 15 nt, Staphylococcus aureus subsp. aureus MW2
auaccuauuccuauu

SEQ ID NO: 2101066 - RNA, 21 nt, Staphylococcus aureus subsp. aureus MW2
auaccuguccaaauaaauaua

SEQ ID NO: 2101067 - RNA, 13 nt, Staphylococcus aureus subsp. aureus MW2
auacuucuuguuc

SEQ ID NO: 2101068 - RNA, 16 nt, Staphylococcus aureus subsp. aureus MW2
auacuucuuuagcaaa

SEQ ID NO: 2101069 - RNA, 21 nt, Staphylococcus aureus subsp. aureus MW2
auacuucuuuagcaaaacgca

SEQ ID NO: 2101070 - RNA, 19 nt, Staphylococcus aureus subsp. aureus MW2
auacuugccuucaaauucu

SEQ ID NO: 2101071 - RNA, 16 nt, Staphylococcus aureus subsp. aureus MW2
auacuuucaaacaaau

SEQ ID NO: 2101072 - RNA, 20 nt, Staphylococcus aureus subsp. aureus MW2
auacuucaaacguuauguac

SEQ ID NO: 2101073 - RNA, 19 nt, Staphylococcus aureus subsp. aureus MW2
auacuucuauuuuauaaua

SEQ ID NO: 2101074 - RNA, 14 nt, Staphylococcus aureus subsp. aureus MW2
auacuuaauuuaaa

SEQ ID NO: 2101075 - RNA, 15 nt, Staphylococcus aureus subsp. aureus MW2
auacuuaauuuaaau

SEQ ID NO: 2101076 - RNA, 16 nt, Staphylococcus aureus subsp. aureus MW2
auacugccauauguuu

SEQ ID NO: 2101077 - RNA, 19 nt, Staphylococcus aureus subsp. aureus MW2
auacugcucuuuauauaua

SEQ ID NO: 2101078 - RNA, 22 nt, Staphylococcus aureus subsp. aureus MW2
auacucgguacuucgcccuucc

SEQ ID NO: 2101079 - RNA, 13 nt, Staphylococcus aureus subsp. aureus MW2
auacucaauaaaa

SEQ ID NO: 2101080 - RNA, 17 nt, Staphylococcus aureus subsp. aureus MW2
auacuauaugaaaagag

SEQ ID NO: 2101081 - RNA, 13 nt, Staphylococcus aureus subsp. aureus MW2
auacuauaaauaa

SEQ ID NO: 2101082 - RNA, 18 nt, Staphylococcus aureus subsp. aureus MW2
auacuauaaauaaaaaua

SEQ ID NO: 2101083 - RNA, 17 nt, Staphylococcus aureus subsp. aureus MW2
auacuacuguugacauu

SEQ ID NO: 2101084 - RNA, 21 nt, Staphylococcus aureus subsp. aureus MW2
auacuacuguugacauuugac

SEQ ID NO: 2101085 - RNA, 14 nt, Staphylococcus aureus subsp. aureus MW2
auacuauacaaugu

SEQ ID NO: 2101086 - RNA, 14 nt, Staphylococcus aureus subsp. aureus MW2
auacuauacugaug

SEQ ID NO: 2101087 - RNA, 16 nt, Staphylococcus aureus subsp. aureus MW2
auacuauauaauaauu

SEQ ID NO: 2101088 - RNA, 16 nt, Staphylococcus aureus subsp. aureus MW2
auacuagcaauucaca

SEQ ID NO: 2101089 - RNA, 20 nt, Staphylococcus aureus subsp. aureus MW2
auacgcgcuucaucaaugga

SEQ ID NO: 2101090 - RNA, 23 nt, Staphylococcus aureus subsp. aureus MW2
auacgcgcuucaucaauggaucu

SEQ ID NO: 2101091 - RNA, 21 nt, Staphylococcus aureus subsp. aureus MW2
auagcaaauugauuaaauaaa

SEQ ID NO: 2101092 - RNA, 17 nt, Staphylococcus aureus subsp. aureus MW2
auagcaaugaauuaaua

SEQ ID NO: 2101093 - RNA, 21 nt, Staphylococcus aureus subsp. aureus MW2
auagcaccguaacauauguac

SEQ ID NO: 2101094 - RNA, 13 nt, Staphylococcus aureus subsp. aureus MW2
auagcauuucuuu

SEQ ID NO: 2101095 - RNA, 19 nt, Staphylococcus aureus subsp. aureus MW2
auagcauaaaauuucugcu

SEQ ID NO: 2101096 - RNA, 22 nt, Staphylococcus aureus subsp. aureus MW2
auagcauaaaauuucugcuucu

SEQ ID NO: 2101097 - RNA, 15 nt, Staphylococcus aureus subsp. aureus MW2
auagcacuacaucaa

SEQ ID NO: 2101098 - RNA, 22 nt, Staphylococcus aureus subsp. aureus MW2
auagcgauuuuaaagaaaaguu

SEQ ID NO: 2101099 - RNA, 22 nt, Staphylococcus aureus subsp. aureus MW2
auagcauuucuuuauuagaaug

SEQ ID NO: 2101100 - RNA, 17 nt, Staphylococcus aureus subsp. aureus MW2
auagauuauauuaucau

SEQ ID NO: 2101101 - RNA, 15 nt, Staphylococcus aureus subsp. aureus MW2
auagauugaaaaaau

SEQ ID NO: 2101102 - RNA, 13 nt, Staphylococcus aureus subsp. aureus MW2
auagauugaaaaa

SEQ ID NO: 2101103 - RNA, 21 nt, Staphylococcus aureus subsp. aureus MW2
auagcaaaauuauguaaaaaa

SEQ ID NO: 2101104 - RNA, 16 nt, Staphylococcus aureus subsp. aureus MW2
auagauuuuucagcug

SEQ ID NO: 2101105 - RNA, 23 nt, Staphylococcus aureus subsp. aureus MW2
auagauuuaucaccuuuaggcaa

SEQ ID NO: 2101106 - RNA, 15 nt, Staphylococcus aureus subsp. aureus MW2
auagauaucauuuua

SEQ ID NO: 2101107 - RNA, 14 nt, Staphylococcus aureus subsp. aureus MW2
auagaaaaaacaag

SEQ ID NO: 2101108 - RNA, 18 nt, Staphylococcus aureus subsp. aureus MW2
auagaaaaauuucaaaaa

SEQ ID NO: 2101109 - RNA, 13 nt, Staphylococcus aureus subsp. aureus MW2
auacuuuuuaaau

SEQ ID NO: 2101110 - RNA, 14 nt, Staphylococcus aureus subsp. aureus MW2
auacuuuuuauaua

SEQ ID NO: 2101111 - RNA, 22 nt, Staphylococcus aureus subsp. aureus MW2
auagaguaguucggaugagaaa

SEQ ID NO: 2101112 - RNA, 14 nt, Staphylococcus aureus subsp. aureus MW2
auagagaacagcag

SEQ ID NO: 2101113 - RNA, 21 nt, Staphylococcus aureus subsp. aureus MW2
auagaaaaugaguacaacaua

SEQ ID NO: 2101114 - RNA, 22 nt, Staphylococcus aureus subsp. aureus MW2
auagacuaauuaucuucaucau

SEQ ID NO: 2101115 - RNA, 14 nt, Staphylococcus aureus subsp. aureus MW2
auaguucuauauaa

SEQ ID NO: 2101116 - RNA, 18 nt, Staphylococcus aureus subsp. aureus MW2
auaguuucuucuauuaua

SEQ ID NO: 2101117 - RNA, 18 nt, Staphylococcus aureus subsp. aureus MW2
auaguuugagaaaauuaa

SEQ ID NO: 2101118 - RNA, 15 nt, Staphylococcus aureus subsp. aureus MW2
auaguuuucuucacu

SEQ ID NO: 2101119 - RNA, 15 nt, Staphylococcus aureus subsp. aureus MW2
auaguuuuauaagaa

SEQ ID NO: 2101120 - RNA, 22 nt, Staphylococcus aureus subsp. aureus MW2
auauaaaaagucccgcuuaaaa

SEQ ID NO: 2101121 - RNA, 21 nt, Staphylococcus aureus subsp. aureus MW2
auauaaaaagaagaucccuca

SEQ ID NO: 2101122 - RNA, 23 nt, Staphylococcus aureus subsp. aureus MW2
auauaaaaaccccuguugaacuu

SEQ ID NO: 2101123 - RNA, 13 nt, Staphylococcus aureus subsp. aureus MW2
auauaaaaacugu

SEQ ID NO: 2101124 - RNA, 19 nt, Staphylococcus aureus subsp. aureus MW2
auagucuucggcuuuguaa

SEQ ID NO: 2101125 - RNA, 17 nt, Staphylococcus aureus subsp. aureus MW2
auagcuccuccaaagcu

SEQ ID NO: 2101126 - RNA, 14 nt, Staphylococcus aureus subsp. aureus MW2
auagcuacaauuaa

SEQ ID NO: 2101127 - RNA, 13 nt, Staphylococcus aureus subsp. aureus MW2
auagcuaaauaaa

SEQ ID NO: 2101128 - RNA, 18 nt, Staphylococcus aureus subsp. aureus MW2
auagcuauuacuauaaaa

SEQ ID NO: 2101129 - RNA, 15 nt, Staphylococcus aureus subsp. aureus MW2
auauaauuauuaaac

SEQ ID NO: 2101130 - RNA, 23 nt, Staphylococcus aureus subsp. aureus MW2
auauaauucgucuguuucauaua

SEQ ID NO: 2101131 - RNA, 19 nt, Staphylococcus aureus subsp. aureus MW2
auauaccuugauucauuuc

SEQ ID NO: 2101132 - RNA, 19 nt, Staphylococcus aureus subsp. aureus MW2
auauaaggcgcucucuuuu

SEQ ID NO: 2101133 - RNA, 15 nt, Staphylococcus aureus subsp. aureus MW2
auauaaugauuuaau

SEQ ID NO: 2101134 - RNA, 22 nt, Staphylococcus aureus subsp. aureus MW2
auauaauguauaaaacagaauu

SEQ ID NO: 2101135 - RNA, 14 nt, Staphylococcus aureus subsp. aureus MW2
auauaaugguugaa

SEQ ID NO: 2101136 - RNA, 14 nt, Staphylococcus aureus subsp. aureus MW2
auauaauuaaacau

SEQ ID NO: 2101137 - RNA, 17 nt, Staphylococcus aureus subsp. aureus MW2
auauaauuaauuuugua

SEQ ID NO: 2101138 - RNA, 19 nt, Staphylococcus aureus subsp. aureus MW2
auauaaugguucuaaaaua

SEQ ID NO: 2101139 - RNA, 19 nt, Staphylococcus aureus subsp. aureus MW2
auauaauggcacugcaauc

SEQ ID NO: 2101140 - RNA, 21 nt, Staphylococcus aureus subsp. aureus MW2
auauaaaggaauagcuacaau

SEQ ID NO: 2101141 - RNA, 17 nt, Staphylococcus aureus subsp. aureus MW2
auauaaaggaauagcua

SEQ ID NO: 2101142 - RNA, 14 nt, Staphylococcus aureus subsp. aureus MW2
auauaauagaaaua

SEQ ID NO: 2101143 - RNA, 16 nt, Staphylococcus aureus subsp. aureus MW2
auauaaguauaaugau

SEQ ID NO: 2101144 - RNA, 14 nt, Staphylococcus aureus subsp. aureus MW2
auauaauaaaaaca

SEQ ID NO: 2101145 - RNA, 19 nt, Staphylococcus aureus subsp. aureus MW2
auauaucuagccugaaaua

SEQ ID NO: 2101146 - RNA, 18 nt, Staphylococcus aureus subsp. aureus MW2
auauauccugccaauaua

SEQ ID NO: 2101147 - RNA, 22 nt, Staphylococcus aureus subsp. aureus MW2
auauagaagauauaacauguau

SEQ ID NO: 2101148 - RNA, 13 nt, Staphylococcus aureus subsp. aureus MW2
auauaucacaaca

SEQ ID NO: 2101149 - RNA, 11 nt, Staphylococcus aureus subsp. aureus MW2
auauauauucg

SEQ ID NO: 2101150 - RNA, 14 nt, Staphylococcus aureus subsp. aureus MW2
auauauauuuaaau

SEQ ID NO: 2101151 - RNA, 14 nt, Staphylococcus aureus subsp. aureus MW2
auauagagaaaagg

SEQ ID NO: 2101152 - RNA, 19 nt, Staphylococcus aureus subsp. aureus MW2
auauagagccgugaaagaa

SEQ ID NO: 2101153 - RNA, 13 nt, Staphylococcus aureus subsp. aureus MW2
auauauagauuaa

SEQ ID NO: 2101154 - RNA, 19 nt, Staphylococcus aureus subsp. aureus MW2
auauacuugaagcaucgau

SEQ ID NO: 2101155 - RNA, 23 nt, Staphylococcus aureus subsp. aureus MW2
auauagaaaaugaguacaacaua

SEQ ID NO: 2101156 - RNA, 14 nt, Staphylococcus aureus subsp. aureus MW2
auauagaaggggac

SEQ ID NO: 2101157 - RNA, 17 nt, Staphylococcus aureus subsp. aureus MW2
auauacuuuuuaaauga

SEQ ID NO: 2101158 - RNA, 12 nt, Staphylococcus aureus subsp. aureus MW2
auauacuugaag

SEQ ID NO: 2101159 - RNA, 14 nt, Staphylococcus aureus subsp. aureus MW2
auauacuagcaauu

SEQ ID NO: 2101160 - RNA, 20 nt, Staphylococcus aureus subsp. aureus MW2
auauacguugauuaacacau

SEQ ID NO: 2101161 - RNA, 16 nt, Staphylococcus aureus subsp. aureus MW2
auauacgacaaucaca

SEQ ID NO: 2101162 - RNA, 20 nt, Staphylococcus aureus subsp. aureus MW2
auauacgacauuuuuagaca

SEQ ID NO: 2101163 - RNA, 17 nt, Staphylococcus aureus subsp. aureus MW2
auauacgagacauuucu

SEQ ID NO: 2101164 - RNA, 16 nt, Staphylococcus aureus subsp. aureus MW2
auauacgaauccucau

SEQ ID NO: 2101165 - RNA, 12 nt, Staphylococcus aureus subsp. aureus MW2
auauauuuuguu

SEQ ID NO: 2101166 - RNA, 12 nt, Staphylococcus aureus subsp. aureus MW2
auauauuugaaa

SEQ ID NO: 2101167 - RNA, 21 nt, Staphylococcus aureus subsp. aureus MW2
auaucaaaaaauauguuuaau

SEQ ID NO: 2101168 - RNA, 15 nt, Staphylococcus aureus subsp. aureus MW2
auaucagcuuuuuca

SEQ ID NO: 2101169 - RNA, 17 nt, Staphylococcus aureus subsp. aureus MW2
auaucaaaauauaaaau

SEQ ID NO: 2101170 - RNA, 17 nt, Staphylococcus aureus subsp. aureus MW2
auauccauuaugaugua

SEQ ID NO: 2101171 - RNA, 17 nt, Staphylococcus aureus subsp. aureus MW2
auaucaucucuaugucu

SEQ ID NO: 2101172 - RNA, 17 nt, Staphylococcus aureus subsp. aureus MW2
auauccaguuaauuauu

SEQ ID NO: 2101173 - RNA, 17 nt, Staphylococcus aureus subsp. aureus MW2
auaucaugcaaaacuaa

SEQ ID NO: 2101174 - RNA, 14 nt, Staphylococcus aureus subsp. aureus MW2
auaucauauuacuu

SEQ ID NO: 2101175 - RNA, 14 nt, Staphylococcus aureus subsp. aureus MW2
auaucaucucuaug

SEQ ID NO: 2101176 - RNA, 15 nt, Staphylococcus aureus subsp. aureus MW2
auaucaucauuuaaa

SEQ ID NO: 2101177 - RNA, 14 nt, Staphylococcus aureus subsp. aureus MW2
auaucgauaaaugu

SEQ ID NO: 2101178 - RNA, 21 nt, Staphylococcus aureus subsp. aureus MW2
auauccgaaaauugcuaaaaa

SEQ ID NO: 2101179 - RNA, 22 nt, Staphylococcus aureus subsp. aureus MW2
auauccgaaaauugcuaaaaaa

SEQ ID NO: 2101180 - RNA, 17 nt, Staphylococcus aureus subsp. aureus MW2
auauccauucuuuuuca

SEQ ID NO: 2101181 - RNA, 17 nt, Staphylococcus aureus subsp. aureus MW2
auaucgcgcaucaaaaa

SEQ ID NO: 2101182 - RNA, 14 nt, Staphylococcus aureus subsp. aureus MW2
auaucucaagauau

SEQ ID NO: 2101183 - RNA, 16 nt, Staphylococcus aureus subsp. aureus MW2
auaucuaaugcaacuu

SEQ ID NO: 2101184 - RNA, 17 nt, Staphylococcus aureus subsp. aureus MW2
auaucuacagagaauca

SEQ ID NO: 2101185 - RNA, 14 nt, Staphylococcus aureus subsp. aureus MW2
auaucuacagagaa

SEQ ID NO: 2101186 - RNA, 18 nt, Staphylococcus aureus subsp. aureus MW2
auaucuaauucguaauuu

SEQ ID NO: 2101187 - RNA, 19 nt, Staphylococcus aureus subsp. aureus MW2
auaucuuaaguacauaaau

SEQ ID NO: 2101188 - RNA, 15 nt, Staphylococcus aureus subsp. aureus MW2
auaucuguauaucca

SEQ ID NO: 2101189 - RNA, 17 nt, Staphylococcus aureus subsp. aureus MW2
auaucuguauauccauu

SEQ ID NO: 2101190 - RNA, 17 nt, Staphylococcus aureus subsp. aureus MW2
auaucuuaaagaauuaa

SEQ ID NO: 2101191 - RNA, 18 nt, Staphylococcus aureus subsp. aureus MW2
auaucuuaaguacauaaa

SEQ ID NO: 2101192 - RNA, 15 nt, Staphylococcus aureus subsp. aureus MW2
auaucuuuauuugau

SEQ ID NO: 2101193 - RNA, 17 nt, Staphylococcus aureus subsp. aureus MW2
auaucuuuuaauguuuu

SEQ ID NO: 2101194 - RNA, 21 nt, Staphylococcus aureus subsp. aureus MW2
auaugaagcguuuuuauuaca

SEQ ID NO: 2101195 - RNA, 13 nt, Staphylococcus aureus subsp. aureus MW2
auaugaacaaaaa

SEQ ID NO: 2101196 - RNA, 12 nt, Staphylococcus aureus subsp. aureus MW2
auaugaaaagag

SEQ ID NO: 2101197 - RNA, 14 nt, Staphylococcus aureus subsp. aureus MW2
auaugaaaagagaa

SEQ ID NO: 2101198 - RNA, 21 nt, Staphylococcus aureus subsp. aureus MW2
auaucuuaugauacuuugaaa

SEQ ID NO: 2101199 - RNA, 17 nt, Staphylococcus aureus subsp. aureus MW2
auaucuuauaacaaaaa

SEQ ID NO: 2101200 - RNA, 19 nt, Staphylococcus aureus subsp. aureus MW2
auaugauaaccaaaccauu

SEQ ID NO: 2101201 - RNA, 12 nt, Staphylococcus aureus subsp. aureus MW2
auaugauaacca

SEQ ID NO: 2101202 - RNA, 17 nt, Staphylococcus aureus subsp. aureus MW2
auaugaucuaacaucau

SEQ ID NO: 2101203 - RNA, 20 nt, Staphylococcus aureus subsp. aureus MW2
auaugacuuuuuauuaguau

SEQ ID NO: 2101204 - RNA, 16 nt, Staphylococcus aureus subsp. aureus MW2
auaugacuuuauuucu

SEQ ID NO: 2101205 - RNA, 16 nt, Staphylococcus aureus subsp. aureus MW2
auaugacuuuagcauu

SEQ ID NO: 2101206 - RNA, 17 nt, Staphylococcus aureus subsp. aureus MW2
auaugacgcgugaauua

SEQ ID NO: 2101207 - RNA, 16 nt, Staphylococcus aureus subsp. aureus MW2
auaugacacauacacc

SEQ ID NO: 2101208 - RNA, 13 nt, Staphylococcus aureus subsp. aureus MW2
auaugaauuuuau

SEQ ID NO: 2101209 - RNA, 23 nt, Staphylococcus aureus subsp. aureus MW2
auaugaauuuagaugcauaaaaa

SEQ ID NO: 2101210 - RNA, 18 nt, Staphylococcus aureus subsp. aureus MW2
auaugaauggcauuuaau

SEQ ID NO: 2101211 - RNA, 21 nt, Staphylococcus aureus subsp. aureus MW2
auaugaauggcauuuaauacu

SEQ ID NO: 2101212 - RNA, 14 nt, Staphylococcus aureus subsp. aureus MW2
auaugaauaaccau

SEQ ID NO: 2101213 - RNA, 16 nt, Staphylococcus aureus subsp. aureus MW2
auaugaauaaugcaau

SEQ ID NO: 2101214 - RNA, 21 nt, Staphylococcus aureus subsp. aureus MW2
aucaucaccauacuaaaacau

SEQ ID NO: 2101215 - RNA, 21 nt, Staphylococcus aureus subsp. aureus MW2
aucaucacuguagauucaaau

SEQ ID NO: 2101216 - RNA, 13 nt, Staphylococcus aureus subsp. aureus MW2
aucaucacacaua

SEQ ID NO: 2101217 - RNA, 16 nt, Staphylococcus aureus subsp. aureus MW2
aucaucaaaauuuaau

SEQ ID NO: 2101218 - RNA, 12 nt, Staphylococcus aureus subsp. aureus MW2
aucauaucauac

SEQ ID NO: 2101219 - RNA, 21 nt, Staphylococcus aureus subsp. aureus MW2
aucauauuugaauacuuuauu

SEQ ID NO: 2101220 - RNA, 15 nt, Staphylococcus aureus subsp. aureus MW2
aucauauucaaaaua

SEQ ID NO: 2101221 - RNA, 19 nt, Staphylococcus aureus subsp. aureus MW2
aaaacuaaagguauucuau

SEQ ID NO: 2101222 - RNA, 14 nt, Staphylococcus aureus subsp. aureus MW2
aaaacuaaagggac

SEQ ID NO: 2101223 - RNA, 12 nt, Staphylococcus aureus subsp. aureus MW2
aaaacguuuaau

SEQ ID NO: 2101224 - RNA, 17 nt, Staphylococcus aureus subsp. aureus MW2
aucaucgccagcauuac

SEQ ID NO: 2101225 - RNA, 18 nt, Staphylococcus aureus subsp. aureus MW2
aaaacguugaguauuacu

SEQ ID NO: 2101226 - RNA, 18 nt, Staphylococcus aureus subsp. aureus MW2
aucaucgcaaaaacauaa

SEQ ID NO: 2101227 - RNA, 14 nt, Staphylococcus aureus subsp. aureus MW2
aucaucgaacauga

SEQ ID NO: 2101228 - RNA, 13 nt, Staphylococcus aureus subsp. aureus MW2
aucagcuuuucuu

SEQ ID NO: 2101229 - RNA, 14 nt, Staphylococcus aureus subsp. aureus MW2
aucagcuuuucuuc

SEQ ID NO: 2101230 - RNA, 17 nt, Staphylococcus aureus subsp. aureus MW2
aucaguuuuugaauauu

SEQ ID NO: 2101231 - RNA, 19 nt, Staphylococcus aureus subsp. aureus MW2
aucagugugauuuuggaac

SEQ ID NO: 2101232 - RNA, 23 nt, Staphylococcus aureus subsp. aureus MW2
aucaguuaggaugaaaaagugga

SEQ ID NO: 2101233 - RNA, 15 nt, Staphylococcus aureus subsp. aureus MW2
aucagugugauuuug

SEQ ID NO: 2101234 - RNA, 12 nt, Staphylococcus aureus subsp. aureus MW2
aucauaaauaua

SEQ ID NO: 2101235 - RNA, 13 nt, Staphylococcus aureus subsp. aureus MW2
aucauaaauauaa

SEQ ID NO: 2101236 - RNA, 12 nt, Staphylococcus aureus subsp. aureus MW2
aucauaaauauu

SEQ ID NO: 2101237 - RNA, 24 nt, Staphylococcus aureus subsp. aureus MW2
aucauaaauauuuucugcgauaua

SEQ ID NO: 2101238 - RNA, 17 nt, Staphylococcus aureus subsp. aureus MW2
aucauaaauauuuucug

SEQ ID NO: 2101239 - RNA, 18 nt, Staphylococcus aureus subsp. aureus MW2
aucauaacuuaacucuau

SEQ ID NO: 2101240 - RNA, 16 nt, Staphylococcus aureus subsp. aureus MW2
aucauagcauuaagau

SEQ ID NO: 2101241 - RNA, 23 nt, Staphylococcus aureus subsp. aureus MW2
aucauauaaugguugaauaacac

SEQ ID NO: 2101242 - RNA, 16 nt, Staphylococcus aureus subsp. aureus MW2
aucauauauucauuga

SEQ ID NO: 2101243 - RNA, 21 nt, Staphylococcus aureus subsp. aureus MW2
aucauauauaccuugaacaua

SEQ ID NO: 2101244 - RNA, 22 nt, Staphylococcus aureus subsp. aureus MW2
aucagcauuaaucguauuuuua

SEQ ID NO: 2101245 - RNA, 21 nt, Staphylococcus aureus subsp. aureus MW2
aucacuuuaggguucauugcu

SEQ ID NO: 2101246 - RNA, 17 nt, Staphylococcus aureus subsp. aureus MW2
aucacuucugaaaauaa

SEQ ID NO: 2101247 - RNA, 18 nt, Staphylococcus aureus subsp. aureus MW2
aucacuucugaaaauaac

SEQ ID NO: 2101248 - RNA, 23 nt, Staphylococcus aureus subsp. aureus MW2
aucacgauuuucaaguaaugaua

SEQ ID NO: 2101249 - RNA, 22 nt, Staphylococcus aureus subsp. aureus MW2
aucacgccauaaucuucauuaa

SEQ ID NO: 2101250 - RNA, 15 nt, Staphylococcus aureus subsp. aureus MW2
aucacgaucuuuaaa

SEQ ID NO: 2101251 - RNA, 21 nt, Staphylococcus aureus subsp. aureus MW2
aucaauuaacacucagauuuu

SEQ ID NO: 2101252 - RNA, 13 nt, Staphylococcus aureus subsp. aureus MW2
aucaauuagccaa

SEQ ID NO: 2101253 - RNA, 17 nt, Staphylococcus aureus subsp. aureus MW2
aucaacagcuucaaaau

SEQ ID NO: 2101254 - RNA, 12 nt, Staphylococcus aureus subsp. aureus MW2
aucaacacacac

SEQ ID NO: 2101255 - RNA, 13 nt, Staphylococcus aureus subsp. aureus MW2
aucaacaauauaa

SEQ ID NO: 2101256 - RNA, 15 nt, Staphylococcus aureus subsp. aureus MW2
aucaacaauauaaaa

SEQ ID NO: 2101257 - RNA, 15 nt, Staphylococcus aureus subsp. aureus MW2
aucaaacaacaucac

SEQ ID NO: 2101258 - RNA, 12 nt, Staphylococcus aureus subsp. aureus MW2
aucaaaauuuaa

SEQ ID NO: 2101259 - RNA, 12 nt, Staphylococcus aureus subsp. aureus MW2
aucaaaauauaa

SEQ ID NO: 2101260 - RNA, 14 nt, Staphylococcus aureus subsp. aureus MW2
aucaagaaauguua

SEQ ID NO: 2101261 - RNA, 13 nt, Staphylococcus aureus subsp. aureus MW2
aucaagaaauguu

SEQ ID NO: 2101262 - RNA, 18 nt, Staphylococcus aureus subsp. aureus MW2
aucaacuuuaaucaaaaa

SEQ ID NO: 2101263 - RNA, 19 nt, Staphylococcus aureus subsp. aureus MW2
aucaacuuuuuguuaauuu

SEQ ID NO: 2101264 - RNA, 15 nt, Staphylococcus aureus subsp. aureus MW2
aucaagacauuuuaa

SEQ ID NO: 2101265 - RNA, 13 nt, Staphylococcus aureus subsp. aureus MW2
aucaagaauauaa

SEQ ID NO: 2101266 - RNA, 14 nt, Staphylococcus aureus subsp. aureus MW2
aucaagaauauaaa

SEQ ID NO: 2101267 - RNA, 19 nt, Staphylococcus aureus subsp. aureus MW2
aucaagaauauaaaugauu

SEQ ID NO: 2101268 - RNA, 23 nt, Staphylococcus aureus subsp. aureus MW2
aucaagacucccuuuuuaaaaua

SEQ ID NO: 2101269 - RNA, 17 nt, Staphylococcus aureus subsp. aureus MW2
aucaacgccauauuuau

SEQ ID NO: 2101270 - RNA, 20 nt, Staphylococcus aureus subsp. aureus MW2
aucaacgagucauaaauaua

SEQ ID NO: 2101271 - RNA, 18 nt, Staphylococcus aureus subsp. aureus MW2
aucaaccuguucuuuauu

SEQ ID NO: 2101272 - RNA, 20 nt, Staphylococcus aureus subsp. aureus MW2
aucaaccuuugcuaaaucaa

SEQ ID NO: 2101273 - RNA, 17 nt, Staphylococcus aureus subsp. aureus MW2
aucaauccaucaauacc

SEQ ID NO: 2101274 - RNA, 14 nt, Staphylococcus aureus subsp. aureus MW2
aucaauaguuuaua

SEQ ID NO: 2101275 - RNA, 20 nt, Staphylococcus aureus subsp. aureus MW2
aucaauaguuuauaauuuaa

SEQ ID NO: 2101276 - RNA, 17 nt, Staphylococcus aureus subsp. aureus MW2
aucaauaucaaauuugg

SEQ ID NO: 2101277 - RNA, 19 nt, Staphylococcus aureus subsp. aureus MW2
aucaauaugaccuuuaugu

SEQ ID NO: 2101278 - RNA, 17 nt, Staphylococcus aureus subsp. aureus MW2
aucaaucgcuuuagcaa

SEQ ID NO: 2101279 - RNA, 15 nt, Staphylococcus aureus subsp. aureus MW2
aucaaguugauaaug

SEQ ID NO: 2101280 - RNA, 16 nt, Staphylococcus aureus subsp. aureus MW2
aucaagcuagcaucau

SEQ ID NO: 2101281 - RNA, 17 nt, Staphylococcus aureus subsp. aureus MW2
aucaaguaguuaucuaa

SEQ ID NO: 2101282 - RNA, 12 nt, Staphylococcus aureus subsp. aureus MW2
auauuuaaacua

SEQ ID NO: 2101283 - RNA, 21 nt, Staphylococcus aureus subsp. aureus MW2
auauuuaaaucaauauucucu

SEQ ID NO: 2101284 - RNA, 18 nt, Staphylococcus aureus subsp. aureus MW2
auauuuaaaugcuuucaa

SEQ ID NO: 2101285 - RNA, 18 nt, Staphylococcus aureus subsp. aureus MW2
auauuguuauacauauau

SEQ ID NO: 2101286 - RNA, 16 nt, Staphylococcus aureus subsp. aureus MW2
auauuuaaaaaacaaa

SEQ ID NO: 2101287 - RNA, 16 nt, Staphylococcus aureus subsp. aureus MW2
auauuuauuuuaaauu

SEQ ID NO: 2101288 - RNA, 18 nt, Staphylococcus aureus subsp. aureus MW2
auauuuauuuuaaauuuu

SEQ ID NO: 2101289 - RNA, 18 nt, Staphylococcus aureus subsp. aureus MW2
auauuucaacuuuuuaau

SEQ ID NO: 2101290 - RNA, 14 nt, Staphylococcus aureus subsp. aureus MW2
auauuuauuuuaua

SEQ ID NO: 2101291 - RNA, 17 nt, Staphylococcus aureus subsp. aureus MW2
auauuucccuaugaaau

SEQ ID NO: 2101292 - RNA, 13 nt, Staphylococcus aureus subsp. aureus MW2
auauuguauuuua

SEQ ID NO: 2101293 - RNA, 15 nt, Staphylococcus aureus subsp. aureus MW2
auauuguaaucacua

SEQ ID NO: 2101294 - RNA, 13 nt, Staphylococcus aureus subsp. aureus MW2
auauuguuaauuc

SEQ ID NO: 2101295 - RNA, 22 nt, Staphylococcus aureus subsp. aureus MW2
auauuggcaguguuugacugaa

SEQ ID NO: 2101296 - RNA, 22 nt, Staphylococcus aureus subsp. aureus MW2
auauuggcaguaguugacugaa

SEQ ID NO: 2101297 - RNA, 11 nt, Staphylococcus aureus subsp. aureus MW2
auauuuucuua

SEQ ID NO: 2101298 - RNA, 14 nt, Staphylococcus aureus subsp. aureus MW2
auauuuucugcgau

SEQ ID NO: 2101299 - RNA, 19 nt, Staphylococcus aureus subsp. aureus MW2
auauuuucgcaaaauuuau

SEQ ID NO: 2101300 - RNA, 17 nt, Staphylococcus aureus subsp. aureus MW2
auauuuuaaaaaguaau

SEQ ID NO: 2101301 - RNA, 12 nt, Staphylococcus aureus subsp. aureus MW2
auauuuuaaaaa

SEQ ID NO: 2101302 - RNA, 22 nt, Staphylococcus aureus subsp. aureus MW2
auauuuuauuuaaaaauagccu

SEQ ID NO: 2101303 - RNA, 20 nt, Staphylococcus aureus subsp. aureus MW2
auauuugauaacaaaaugau

SEQ ID NO: 2101304 - RNA, 13 nt, Staphylococcus aureus subsp. aureus MW2
auauuuuauuaua

SEQ ID NO: 2101305 - RNA, 14 nt, Staphylococcus aureus subsp. aureus MW2
auauuuuauuauaa

SEQ ID NO: 2101306 - RNA, 14 nt, Staphylococcus aureus subsp. aureus MW2
auauuuuauuuaaa

SEQ ID NO: 2101307 - RNA, 16 nt, Staphylococcus aureus subsp. aureus MW2
auauuugauaacaaaa

SEQ ID NO: 2101308 - RNA, 15 nt, Staphylococcus aureus subsp. aureus MW2
auauuugauccauau

SEQ ID NO: 2101309 - RNA, 17 nt, Staphylococcus aureus subsp. aureus MW2
auaugauugcaaauuau

SEQ ID NO: 2101310 - RNA, 17 nt, Staphylococcus aureus subsp. aureus MW2
auaugauguuaaaaaau

SEQ ID NO: 2101311 - RNA, 15 nt, Staphylococcus aureus subsp. aureus MW2
auaugauugaaugaa

SEQ ID NO: 2101312 - RNA, 12 nt, Staphylococcus aureus subsp. aureus MW2
auaugauuuaaa

SEQ ID NO: 2101313 - RNA, 17 nt, Staphylococcus aureus subsp. aureus MW2
auaugcaacuuauaaua

SEQ ID NO: 2101314 - RNA, 19 nt, Staphylococcus aureus subsp. aureus MW2
auauucaacuuauuauuua

SEQ ID NO: 2101315 - RNA, 14 nt, Staphylococcus aureus subsp. aureus MW2
auauucaacuuauu

SEQ ID NO: 2101316 - RNA, 16 nt, Staphylococcus aureus subsp. aureus MW2
auauucaguauaugua

SEQ ID NO: 2101317 - RNA, 21 nt, Staphylococcus aureus subsp. aureus MW2
auauucaccuacaacaccaau

SEQ ID NO: 2101318 - RNA, 20 nt, Staphylococcus aureus subsp. aureus MW2
auauucaccuacaacaccaa

SEQ ID NO: 2101319 - RNA, 20 nt, Staphylococcus aureus subsp. aureus MW2
auauuccacgcucacauuaa

SEQ ID NO: 2101320 - RNA, 19 nt, Staphylococcus aureus subsp. aureus MW2
auauugagacuauuauaau

SEQ ID NO: 2101321 - RNA, 16 nt, Staphylococcus aureus subsp. aureus MW2
auauugaauugaaaaa

SEQ ID NO: 2101322 - RNA, 18 nt, Staphylococcus aureus subsp. aureus MW2
auauugaauugaaaaauu

SEQ ID NO: 2101323 - RNA, 20 nt, Staphylococcus aureus subsp. aureus MW2
auauugaauaaaaaaacacg

SEQ ID NO: 2101324 - RNA, 19 nt, Staphylococcus aureus subsp. aureus MW2
auauugaaaguguaugcau

SEQ ID NO: 2101325 - RNA, 17 nt, Staphylococcus aureus subsp. aureus MW2
auauugaaaacacguau

SEQ ID NO: 2101326 - RNA, 22 nt, Staphylococcus aureus subsp. aureus MW2
auauugaaaugagcuuaaguua

SEQ ID NO: 2101327 - RNA, 14 nt, Staphylococcus aureus subsp. aureus MW2
auauugaaaacacg

SEQ ID NO: 2101328 - RNA, 22 nt, Staphylococcus aureus subsp. aureus MW2
auauugcaaaaauaauaugaau

SEQ ID NO: 2101329 - RNA, 14 nt, Staphylococcus aureus subsp. aureus MW2
auauugcguuuaau

SEQ ID NO: 2101330 - RNA, 16 nt, Staphylococcus aureus subsp. aureus MW2
auauugcgaaaaauaa

SEQ ID NO: 2101331 - RNA, 12 nt, Staphylococcus aureus subsp. aureus MW2
auuacaaacaua

SEQ ID NO: 2101332 - RNA, 14 nt, Staphylococcus aureus subsp. aureus MW2
auuacaaacauaau

SEQ ID NO: 2101333 - RNA, 16 nt, Staphylococcus aureus subsp. aureus MW2
auuaauuuuucaaaug

SEQ ID NO: 2101334 - RNA, 17 nt, Staphylococcus aureus subsp. aureus MW2
auuaauuuuucaaaugu

SEQ ID NO: 2101335 - RNA, 15 nt, Staphylococcus aureus subsp. aureus MW2
auuacaaguuacauu

SEQ ID NO: 2101336 - RNA, 20 nt, Staphylococcus aureus subsp. aureus MW2
auuacaaccaacaauugguu

SEQ ID NO: 2101337 - RNA, 20 nt, Staphylococcus aureus subsp. aureus MW2
auuacacccuuuaaauuuaa

SEQ ID NO: 2101338 - RNA, 13 nt, Staphylococcus aureus subsp. aureus MW2
auuaccauaaauu

SEQ ID NO: 2101339 - RNA, 19 nt, Staphylococcus aureus subsp. aureus MW2
auuacccacaucuuuuuaa

SEQ ID NO: 2101340 - RNA, 15 nt, Staphylococcus aureus subsp. aureus MW2
auuaccauauaaagc

SEQ ID NO: 2101341 - RNA, 13 nt, Staphylococcus aureus subsp. aureus MW2
auuaccauauaaa

SEQ ID NO: 2101342 - RNA, 22 nt, Staphylococcus aureus subsp. aureus MW2
auuacacuacgcugaugaauga

SEQ ID NO: 2101343 - RNA, 13 nt, Staphylococcus aureus subsp. aureus MW2
auuacacuuuaaa

SEQ ID NO: 2101344 - RNA, 15 nt, Staphylococcus aureus subsp. aureus MW2
auuacacuuuaaaua

SEQ ID NO: 2101345 - RNA, 18 nt, Staphylococcus aureus subsp. aureus MW2
auuacacuuuaaauacau

SEQ ID NO: 2101346 - RNA, 20 nt, Staphylococcus aureus subsp. aureus MW2
auuacagcguacuaaagaau

SEQ ID NO: 2101347 - RNA, 17 nt, Staphylococcus aureus subsp. aureus MW2
auuaauuaucuuaaguc

SEQ ID NO: 2101348 - RNA, 22 nt, Staphylococcus aureus subsp. aureus MW2
auuaauuauaaguagugauuuu

SEQ ID NO: 2101349 - RNA, 12 nt, Staphylococcus aureus subsp. aureus MW2
auuaauuaacaa

SEQ ID NO: 2101350 - RNA, 23 nt, Staphylococcus aureus subsp. aureus MW2
auuaaugucacauguaccacauu

SEQ ID NO: 2101351 - RNA, 17 nt, Staphylococcus aureus subsp. aureus MW2
auuaauggcaacuaaga

SEQ ID NO: 2101352 - RNA, 18 nt, Staphylococcus aureus subsp. aureus MW2
auuaauggcaacuaagau

SEQ ID NO: 2101353 - RNA, 15 nt, Staphylococcus aureus subsp. aureus MW2
auuaauuaaaagccc

SEQ ID NO: 2101354 - RNA, 19 nt, Staphylococcus aureus subsp. aureus MW2
auuaauuuuguaauuagga

SEQ ID NO: 2101355 - RNA, 20 nt, Staphylococcus aureus subsp. aureus MW2
auuaauuuucucaaacuauc

SEQ ID NO: 2101356 - RNA, 17 nt, Staphylococcus aureus subsp. aureus MW2
auuaauuuauaauuucu

SEQ ID NO: 2101357 - RNA, 17 nt, Staphylococcus aureus subsp. aureus MW2
auuaauuggauuaaaua

SEQ ID NO: 2101358 - RNA, 20 nt, Staphylococcus aureus subsp. aureus MW2
auuaauuuaaaaaugauaga

SEQ ID NO: 2101359 - RNA, 17 nt, Staphylococcus aureus subsp. aureus MW2
auuaauucuucuucagu

SEQ ID NO: 2101360 - RNA, 15 nt, Staphylococcus aureus subsp. aureus MW2
auuaauucuuugaaa

SEQ ID NO: 2101361 - RNA, 16 nt, Staphylococcus aureus subsp. aureus MW2
auuaauucuuugaaaa

SEQ ID NO: 2101362 - RNA, 17 nt, Staphylococcus aureus subsp. aureus MW2
auuaauugaaaaaccaa

SEQ ID NO: 2101363 - RNA, 20 nt, Staphylococcus aureus subsp. aureus MW2
auuaauuaucauaaauauaa

SEQ ID NO: 2101364 - RNA, 15 nt, Staphylococcus aureus subsp. aureus MW2
auuaauucugauuau

SEQ ID NO: 2101365 - RNA, 16 nt, Staphylococcus aureus subsp. aureus MW2
auuaauccgucuuuuu

SEQ ID NO: 2101366 - RNA, 17 nt, Staphylococcus aureus subsp. aureus MW2
auuaauccacaaauaac

SEQ ID NO: 2101367 - RNA, 14 nt, Staphylococcus aureus subsp. aureus MW2
auuaaucguauuuu

SEQ ID NO: 2101368 - RNA, 17 nt, Staphylococcus aureus subsp. aureus MW2
auuaaucguauuuuuaa

SEQ ID NO: 2101369 - RNA, 16 nt, Staphylococcus aureus subsp. aureus MW2
aaaagcagcaguaaga

SEQ ID NO: 2101370 - RNA, 17 nt, Staphylococcus aureus subsp. aureus MW2
aaaagcaggcaagcuau

SEQ ID NO: 2101371 - RNA, 23 nt, Staphylococcus aureus subsp. aureus MW2
aaaagcaugauacucaauaaaau

SEQ ID NO: 2101372 - RNA, 16 nt, Staphylococcus aureus subsp. aureus MW2
auuaagugcaauaaca

SEQ ID NO: 2101373 - RNA, 20 nt, Staphylococcus aureus subsp. aureus MW2
auuaaguguauauaguagga

SEQ ID NO: 2101374 - RNA, 15 nt, Staphylococcus aureus subsp. aureus MW2
auuaaccauuucuuu

SEQ ID NO: 2101375 - RNA, 22 nt, Staphylococcus aureus subsp. aureus MW2
auuaaccauuucuuuuuucaau

SEQ ID NO: 2101376 - RNA, 15 nt, Staphylococcus aureus subsp. aureus MW2
auuaaguauaucuuu

SEQ ID NO: 2101377 - RNA, 22 nt, Staphylococcus aureus subsp. aureus MW2
auuaacacauucuuauuugaaa

SEQ ID NO: 2101378 - RNA, 15 nt, Staphylococcus aureus subsp. aureus MW2
auuaacauaauaaua

SEQ ID NO: 2101379 - RNA, 15 nt, Staphylococcus aureus subsp. aureus MW2
auuaaaauaauuaaa

SEQ ID NO: 2101380 - RNA, 21 nt, Staphylococcus aureus subsp. aureus MW2
auuaaaaugauaucugacauu

SEQ ID NO: 2101381 - RNA, 12 nt, Staphylococcus aureus subsp. aureus MW2
auuaaaauagag

SEQ ID NO: 2101382 - RNA, 18 nt, Staphylococcus aureus subsp. aureus MW2
auuaaaauguuaauaaug

SEQ ID NO: 2101383 - RNA, 18 nt, Staphylococcus aureus subsp. aureus MW2
auuaaaauuaaauaauga

SEQ ID NO: 2101384 - RNA, 18 nt, Staphylococcus aureus subsp. aureus MW2
auuaaacaaaacuuaaaa

SEQ ID NO: 2101385 - RNA, 22 nt, Staphylococcus aureus subsp. aureus MW2
auuaaacaaguugauaacuauu

SEQ ID NO: 2101386 - RNA, 16 nt, Staphylococcus aureus subsp. aureus MW2
auuaaacauauuuuuu

SEQ ID NO: 2101387 - RNA, 16 nt, Staphylococcus aureus subsp. aureus MW2
auuaaacauuuagauu

SEQ ID NO: 2101388 - RNA, 21 nt, Staphylococcus aureus subsp. aureus MW2
auguuuuuuaaguacaacagu

SEQ ID NO: 2101389 - RNA, 15 nt, Staphylococcus aureus subsp. aureus MW2
auuaaaaaacaaaac

SEQ ID NO: 2101390 - RNA, 15 nt, Staphylococcus aureus subsp. aureus MW2
auguuuuuuaaguac

SEQ ID NO: 2101391 - RNA, 14 nt, Staphylococcus aureus subsp. aureus MW2
auuaaaaaacaaaa

SEQ ID NO: 2101392 - RNA, 21 nt, Staphylococcus aureus subsp. aureus MW2
auguuuuuaacagcuuuuucu

SEQ ID NO: 2101393 - RNA, 18 nt, Staphylococcus aureus subsp. aureus MW2
auguuucuucaauugucu

SEQ ID NO: 2101394 - RNA, 22 nt, Staphylococcus aureus subsp. aureus MW2
auguuucuucaauuuaauguau

SEQ ID NO: 2101395 - RNA, 14 nt, Staphylococcus aureus subsp. aureus MW2
auguuucuagauau

SEQ ID NO: 2101396 - RNA, 17 nt, Staphylococcus aureus subsp. aureus MW2
auguuugaagaccuucu

SEQ ID NO: 2101397 - RNA, 15 nt, Staphylococcus aureus subsp. aureus MW2
auuaaagugaauauu

SEQ ID NO: 2101398 - RNA, 17 nt, Staphylococcus aureus subsp. aureus MW2
auuaaaguguuucaaca

SEQ ID NO: 2101399 - RNA, 10 nt, Staphylococcus aureus subsp. aureus MW2
auuaaacugc

SEQ ID NO: 2101400 - RNA, 23 nt, Staphylococcus aureus subsp. aureus MW2
auuaaaccuacaacgaagaaucc

SEQ ID NO: 2101401 - RNA, 20 nt, Staphylococcus aureus subsp. aureus MW2
auuaaaccuaaucugccgug

SEQ ID NO: 2101402 - RNA, 17 nt, Staphylococcus aureus subsp. aureus MW2
auuaaacgcaauuaacc

SEQ ID NO: 2101403 - RNA, 17 nt, Staphylococcus aureus subsp. aureus MW2
auuaaauagcuuuacuu

SEQ ID NO: 2101404 - RNA, 14 nt, Staphylococcus aureus subsp. aureus MW2
auuaaauauacuuu

SEQ ID NO: 2101405 - RNA, 21 nt, Staphylococcus aureus subsp. aureus MW2
auuaaaguguuucaacauauu

SEQ ID NO: 2101406 - RNA, 16 nt, Staphylococcus aureus subsp. aureus MW2
auuaaaguuaaagacu

SEQ ID NO: 2101407 - RNA, 15 nt, Staphylococcus aureus subsp. aureus MW2
auuaaaguugauuuu

SEQ ID NO: 2101408 - RNA, 16 nt, Staphylococcus aureus subsp. aureus MW2
auuaaaguugauuuug

SEQ ID NO: 2101409 - RNA, 16 nt, Staphylococcus aureus subsp. aureus MW2
auuaaauucaaaucug

SEQ ID NO: 2101410 - RNA, 19 nt, Staphylococcus aureus subsp. aureus MW2
auuaaauuuacaaaaacua

SEQ ID NO: 2101411 - RNA, 19 nt, Staphylococcus aureus subsp. aureus MW2
auuaaauuuuguauaaccu

SEQ ID NO: 2101412 - RNA, 16 nt, Staphylococcus aureus subsp. aureus MW2
auguucagaacuacaa

SEQ ID NO: 2101413 - RNA, 15 nt, Staphylococcus aureus subsp. aureus MW2
auguucaauauuuuc

SEQ ID NO: 2101414 - RNA, 23 nt, Staphylococcus aureus subsp. aureus MW2
auguccaucuuuuauuaaagaaa

SEQ ID NO: 2101415 - RNA, 15 nt, Staphylococcus aureus subsp. aureus MW2
auguccugaauguuc

SEQ ID NO: 2101416 - RNA, 20 nt, Staphylococcus aureus subsp. aureus MW2
auguuggaaaaggucaaaaa

SEQ ID NO: 2101417 - RNA, 18 nt, Staphylococcus aureus subsp. aureus MW2
auguugguucaucaaaca

SEQ ID NO: 2101418 - RNA, 18 nt, Staphylococcus aureus subsp. aureus MW2
auguugucacuuggauuc

SEQ ID NO: 2101419 - RNA, 13 nt, Staphylococcus aureus subsp. aureus MW2
auguuggggcccc

SEQ ID NO: 2101420 - RNA, 23 nt, Staphylococcus aureus subsp. aureus MW2
auguuggcauaaccuguuuuuau

SEQ ID NO: 2101421 - RNA, 12 nt, Staphylococcus aureus subsp. aureus MW2
auguuuccauuu

SEQ ID NO: 2101422 - RNA, 17 nt, Staphylococcus aureus subsp. aureus MW2
auguuucagaacugcca

SEQ ID NO: 2101423 - RNA, 13 nt, Staphylococcus aureus subsp. aureus MW2
auguuuccauuua

SEQ ID NO: 2101424 - RNA, 20 nt, Staphylococcus aureus subsp. aureus MW2
auguuuauuagcuuuuucaa

SEQ ID NO: 2101425 - RNA, 19 nt, Staphylococcus aureus subsp. aureus MW2
auguuuauauugcaaaaau

SEQ ID NO: 2101426 - RNA, 18 nt, Staphylococcus aureus subsp. aureus MW2
auguuuaacuaaaccauu

SEQ ID NO: 2101427 - RNA, 15 nt, Staphylococcus aureus subsp. aureus MW2
auguuuaaacauuuu

SEQ ID NO: 2101428 - RNA, 16 nt, Staphylococcus aureus subsp. aureus MW2
auguuuaaaaaacuac

SEQ ID NO: 2101429 - RNA, 13 nt, Staphylococcus aureus subsp. aureus MW2
auguuuaaaaaac

SEQ ID NO: 2101430 - RNA, 20 nt, Staphylococcus aureus subsp. aureus MW2
auguugguucaucaaacaac

SEQ ID NO: 2101431 - RNA, 16 nt, Staphylococcus aureus subsp. aureus MW2
auuauaaugauuuuua

SEQ ID NO: 2101432 - RNA, 18 nt, Staphylococcus aureus subsp. aureus MW2
auuauacaauaugugaua

SEQ ID NO: 2101433 - RNA, 17 nt, Staphylococcus aureus subsp. aureus MW2
auuauacugcucuuuau

SEQ ID NO: 2101434 - RNA, 21 nt, Staphylococcus aureus subsp. aureus MW2
auuauacuuuacauuucucgu

SEQ ID NO: 2101435 - RNA, 20 nt, Staphylococcus aureus subsp. aureus MW2
auuauaaguagugauuuuuu

SEQ ID NO: 2101436 - RNA, 16 nt, Staphylococcus aureus subsp. aureus MW2
auuauaauaaauagac

SEQ ID NO: 2101437 - RNA, 14 nt, Staphylococcus aureus subsp. aureus MW2
auuauaauuguuca

SEQ ID NO: 2101438 - RNA, 17 nt, Staphylococcus aureus subsp. aureus MW2
auuauaauuguaaugcu

SEQ ID NO: 2101439 - RNA, 18 nt, Staphylococcus aureus subsp. aureus MW2
auuauaacgugcuuuuuu

SEQ ID NO: 2101440 - RNA, 18 nt, Staphylococcus aureus subsp. aureus MW2
auuauaauaaauagacug

SEQ ID NO: 2101441 - RNA, 13 nt, Staphylococcus aureus subsp. aureus MW2
auuauaaaugauu

SEQ ID NO: 2101442 - RNA, 12 nt, Staphylococcus aureus subsp. aureus MW2
auuauaaauaca

SEQ ID NO: 2101443 - RNA, 21 nt, Staphylococcus aureus subsp. aureus MW2
auuaguuuuuguuuacagaug

SEQ ID NO: 2101444 - RNA, 21 nt, Staphylococcus aureus subsp. aureus MW2
auuaguuuuuaaaauuaucaa

SEQ ID NO: 2101445 - RNA, 16 nt, Staphylococcus aureus subsp. aureus MW2
auuaguuugaucauuu

SEQ ID NO: 2101446 - RNA, 12 nt, Staphylococcus aureus subsp. aureus MW2
auuaguaaauau

SEQ ID NO: 2101447 - RNA, 15 nt, Staphylococcus aureus subsp. aureus MW2
auuaguaaauauagu

SEQ ID NO: 2101448 - RNA, 14 nt, Staphylococcus aureus subsp. aureus MW2
auuagguaauacuu

SEQ ID NO: 2101449 - RNA, 21 nt, Staphylococcus aureus subsp. aureus MW2
auuacgcugucucauuaaugu

SEQ ID NO: 2101450 - RNA, 22 nt, Staphylococcus aureus subsp. aureus MW2
auuagcgaaaaccucuguuuug

SEQ ID NO: 2101451 - RNA, 21 nt, Staphylococcus aureus subsp. aureus MW2
auuagcgcaccaauuaucaac

SEQ ID NO: 2101452 - RNA, 18 nt, Staphylococcus aureus subsp. aureus MW2
aaaagcuguaguuucaac

SEQ ID NO: 2101453 - RNA, 19 nt, Staphylococcus aureus subsp. aureus MW2
auuagcuuuuucaacuaau

SEQ ID NO: 2101454 - RNA, 23 nt, Staphylococcus aureus subsp. aureus MW2
auuaggaauccaauuucucuaug

SEQ ID NO: 2101455 - RNA, 21 nt, Staphylococcus aureus subsp. aureus MW2
auuaggaaugacauuuaaaga

SEQ ID NO: 2101456 - RNA, 22 nt, Staphylococcus aureus subsp. aureus MW2
auuaucaacuuuauaaccuaaa

SEQ ID NO: 2101457 - RNA, 21 nt, Staphylococcus aureus subsp. aureus MW2
auuauauuuuucuucaguuaa

SEQ ID NO: 2101458 - RNA, 20 nt, Staphylococcus aureus subsp. aureus MW2
auuauagacauaagcaaaga

SEQ ID NO: 2101459 - RNA, 19 nt, Staphylococcus aureus subsp. aureus MW2
auuaucauaugaacaauua

SEQ ID NO: 2101460 - RNA, 14 nt, Staphylococcus aureus subsp. aureus MW2
auuauccuacugcu

SEQ ID NO: 2101461 - RNA, 16 nt, Staphylococcus aureus subsp. aureus MW2
auuaucuguaauuaau

SEQ ID NO: 2101462 - RNA, 15 nt, Staphylococcus aureus subsp. aureus MW2
auuauuauaauaaau

SEQ ID NO: 2101463 - RNA, 19 nt, Staphylococcus aureus subsp. aureus MW2
auuauuaugccuuugauuu

SEQ ID NO: 2101464 - RNA, 20 nt, Staphylococcus aureus subsp. aureus MW2
auuauuauguguauauuauu

SEQ ID NO: 2101465 - RNA, 15 nt, Staphylococcus aureus subsp. aureus MW2
auuauuaguuuugaa

SEQ ID NO: 2101466 - RNA, 13 nt, Staphylococcus aureus subsp. aureus MW2
auuauuauucuaa

SEQ ID NO: 2101467 - RNA, 20 nt, Staphylococcus aureus subsp. aureus MW2
auuauuauucuaacuuugua

SEQ ID NO: 2101468 - RNA, 18 nt, Staphylococcus aureus subsp. aureus MW2
auuauucaaguaaaacau

SEQ ID NO: 2101469 - RNA, 18 nt, Staphylococcus aureus subsp. aureus MW2
auuaucuuuguaaauuuu

SEQ ID NO: 2101470 - RNA, 20 nt, Staphylococcus aureus subsp. aureus MW2
auuaucuuaagucaucaauc

SEQ ID NO: 2101471 - RNA, 18 nt, Staphylococcus aureus subsp. aureus MW2
auuaucuuaagucaucaa

SEQ ID NO: 2101472 - RNA, 22 nt, Staphylococcus aureus subsp. aureus MW2
auuaucuguaauuaauccaucu

SEQ ID NO: 2101473 - RNA, 12 nt, Staphylococcus aureus subsp. aureus MW2
auuaucuuuacg

SEQ ID NO: 2101474 - RNA, 13 nt, Staphylococcus aureus subsp. aureus MW2
auuaucuuuaaau

SEQ ID NO: 2101475 - RNA, 14 nt, Staphylococcus aureus subsp. aureus MW2
auuaucuuuaaauu

SEQ ID NO: 2101476 - RNA, 22 nt, Staphylococcus aureus subsp. aureus MW2
auuaucuuuaaauuacaauuaa

SEQ ID NO: 2101477 - RNA, 15 nt, Staphylococcus aureus subsp. aureus MW2
auuaugauuaauccu

SEQ ID NO: 2101478 - RNA, 17 nt, Staphylococcus aureus subsp. aureus MW2
auuaugauuauuuuucu

SEQ ID NO: 2101479 - RNA, 13 nt, Staphylococcus aureus subsp. aureus MW2
auuaugcauaugu

SEQ ID NO: 2101480 - RNA, 22 nt, Staphylococcus aureus subsp. aureus MW2
auuaugauacgcuuuuuaaaaa

SEQ ID NO: 2101481 - RNA, 13 nt, Staphylococcus aureus subsp. aureus MW2
auuaugaacagau

SEQ ID NO: 2101482 - RNA, 18 nt, Staphylococcus aureus subsp. aureus MW2
auuaugaacaugaaauua

SEQ ID NO: 2101483 - RNA, 16 nt, Staphylococcus aureus subsp. aureus MW2
auuaugacaagagacu

SEQ ID NO: 2101484 - RNA, 13 nt, Staphylococcus aureus subsp. aureus MW2
auucaauuuaguu

SEQ ID NO: 2101485 - RNA, 14 nt, Staphylococcus aureus subsp. aureus MW2
auucaauugcuaaa

SEQ ID NO: 2101486 - RNA, 18 nt, Staphylococcus aureus subsp. aureus MW2
auucaccagguuuuuuau

SEQ ID NO: 2101487 - RNA, 16 nt, Staphylococcus aureus subsp. aureus MW2
auucacauuauuuaaa

SEQ ID NO: 2101488 - RNA, 17 nt, Staphylococcus aureus subsp. aureus MW2
auucaaugauuuuuaaa

SEQ ID NO: 2101489 - RNA, 16 nt, Staphylococcus aureus subsp. aureus MW2
auucaaugauuuuuaa

SEQ ID NO: 2101490 - RNA, 18 nt, Staphylococcus aureus subsp. aureus MW2
auucaaugauuuuuaaaa

SEQ ID NO: 2101491 - RNA, 17 nt, Staphylococcus aureus subsp. aureus MW2
auucaauguaauuuuca

SEQ ID NO: 2101492 - RNA, 23 nt, Staphylococcus aureus subsp. aureus MW2
auucaauguuuaauuuucuaaag

SEQ ID NO: 2101493 - RNA, 18 nt, Staphylococcus aureus subsp. aureus MW2
auucaauugauuacacca

SEQ ID NO: 2101494 - RNA, 14 nt, Staphylococcus aureus subsp. aureus MW2
auucaauucuguga

SEQ ID NO: 2101495 - RNA, 18 nt, Staphylococcus aureus subsp. aureus MW2
auuauugaaacuaauaau

SEQ ID NO: 2101496 - RNA, 22 nt, Staphylococcus aureus subsp. aureus MW2
auuauugaaaucgauacuaaua

SEQ ID NO: 2101497 - RNA, 12 nt, Staphylococcus aureus subsp. aureus MW2
auuauugaaacu

SEQ ID NO: 2101498 - RNA, 16 nt, Staphylococcus aureus subsp. aureus MW2
auuauucuuuauauuu

SEQ ID NO: 2101499 - RNA, 11 nt, Staphylococcus aureus subsp. aureus MW2
auuauucuuuc

SEQ ID NO: 2101500 - RNA, 18 nt, Staphylococcus aureus subsp. aureus MW2
auuauucuuucauagaaa

SEQ ID NO: 2101501 - RNA, 14 nt, Staphylococcus aureus subsp. aureus MW2
auuauucguuucuu

SEQ ID NO: 2101502 - RNA, 21 nt, Staphylococcus aureus subsp. aureus MW2
auuauucucucauuuguauag

SEQ ID NO: 2101503 - RNA, 17 nt, Staphylococcus aureus subsp. aureus MW2
auucaaauauaaauaaa

SEQ ID NO: 2101504 - RNA, 18 nt, Staphylococcus aureus subsp. aureus MW2
auucaaauauaaauaaaa

SEQ ID NO: 2101505 - RNA, 24 nt, Staphylococcus aureus subsp. aureus MW2
auucaaauguuuacugucaucuuu

SEQ ID NO: 2101506 - RNA, 19 nt, Staphylococcus aureus subsp. aureus MW2
auuauucuuuaauuaaauc

SEQ ID NO: 2101507 - RNA, 21 nt, Staphylococcus aureus subsp. aureus MW2
auucaauacgaaguguuauaa

SEQ ID NO: 2101508 - RNA, 17 nt, Staphylococcus aureus subsp. aureus MW2
auucaaccuuaauagga

SEQ ID NO: 2101509 - RNA, 17 nt, Staphylococcus aureus subsp. aureus MW2
auucaaccaauuauuaa

SEQ ID NO: 2101510 - RNA, 17 nt, Staphylococcus aureus subsp. aureus MW2
auucagucaguaaaaau

SEQ ID NO: 2101511 - RNA, 16 nt, Staphylococcus aureus subsp. aureus MW2
auucagaugaauaaug

SEQ ID NO: 2101512 - RNA, 19 nt, Staphylococcus aureus subsp. aureus MW2
auggcaucuggcaaauugc

SEQ ID NO: 2101513 - RNA, 18 nt, Staphylococcus aureus subsp. aureus MW2
auggcauuuaauacuaau

SEQ ID NO: 2101514 - RNA, 15 nt, Staphylococcus aureus subsp. aureus MW2
auggauuuauugggu

SEQ ID NO: 2101515 - RNA, 17 nt, Staphylococcus aureus subsp. aureus MW2
auggcaaucuauauaaa

SEQ ID NO: 2101516 - RNA, 17 nt, Staphylococcus aureus subsp. aureus MW2
augcugauaauuuuucu

SEQ ID NO: 2101517 - RNA, 22 nt, Staphylococcus aureus subsp. aureus MW2
auggcuuagguuuaauuuuaaa

SEQ ID NO: 2101518 - RNA, 19 nt, Staphylococcus aureus subsp. aureus MW2
auggcuuaaaucaaauggu

SEQ ID NO: 2101519 - RNA, 16 nt, Staphylococcus aureus subsp. aureus MW2
augggaauuuagggaa

SEQ ID NO: 2101520 - RNA, 21 nt, Staphylococcus aureus subsp. aureus MW2
auggguaaggugauugaacaa

SEQ ID NO: 2101521 - RNA, 17 nt, Staphylococcus aureus subsp. aureus MW2
auggguaaucuuuagga

SEQ ID NO: 2101522 - RNA, 12 nt, Staphylococcus aureus subsp. aureus MW2
augggccccaac

SEQ ID NO: 2101523 - RNA, 15 nt, Staphylococcus aureus subsp. aureus MW2
augguuucauaaacu

SEQ ID NO: 2101524 - RNA, 22 nt, Staphylococcus aureus subsp. aureus MW2
auggugaacuguuaaacucaua

SEQ ID NO: 2101525 - RNA, 17 nt, Staphylococcus aureus subsp. aureus MW2
augguuuaucuuuuuca

SEQ ID NO: 2101526 - RNA, 12 nt, Staphylococcus aureus subsp. aureus MW2
auguaauuauuu

SEQ ID NO: 2101527 - RNA, 22 nt, Staphylococcus aureus subsp. aureus MW2
auguaauuauugcaucauaauu

SEQ ID NO: 2101528 - RNA, 15 nt, Staphylococcus aureus subsp. aureus MW2
auguaauacaaaaga

SEQ ID NO: 2101529 - RNA, 16 nt, Staphylococcus aureus subsp. aureus MW2
auguaauuauuuuucu

SEQ ID NO: 2101530 - RNA, 23 nt, Staphylococcus aureus subsp. aureus MW2
auguacguuuuuuuaaauacaua

SEQ ID NO: 2101531 - RNA, 15 nt, Staphylococcus aureus subsp. aureus MW2
auguacuaccuacuu

SEQ ID NO: 2101532 - RNA, 21 nt, Staphylococcus aureus subsp. aureus MW2
auguauaugaauuuuauaaau

SEQ ID NO: 2101533 - RNA, 15 nt, Staphylococcus aureus subsp. aureus MW2
auguauaucuuuauu

SEQ ID NO: 2101534 - RNA, 22 nt, Staphylococcus aureus subsp. aureus MW2
auguauaauacaugauauaaau

SEQ ID NO: 2101535 - RNA, 19 nt, Staphylococcus aureus subsp. aureus MW2
auguauaaaacagaauuuc

SEQ ID NO: 2101536 - RNA, 22 nt, Staphylococcus aureus subsp. aureus MW2
auguagugaaagucguuguuga

SEQ ID NO: 2101537 - RNA, 17 nt, Staphylococcus aureus subsp. aureus MW2
aaaagauauaaacauuu

SEQ ID NO: 2101538 - RNA, 18 nt, Staphylococcus aureus subsp. aureus MW2
augucaguuuugaagaau

SEQ ID NO: 2101539 - RNA, 16 nt, Staphylococcus aureus subsp. aureus MW2
augucauagccuauuu

SEQ ID NO: 2101540 - RNA, 21 nt, Staphylococcus aureus subsp. aureus MW2
augucauagccuauuuaaaag

SEQ ID NO: 2101541 - RNA, 12 nt, Staphylococcus aureus subsp. aureus MW2
auguauuuuuca

SEQ ID NO: 2101542 - RNA, 17 nt, Staphylococcus aureus subsp. aureus MW2
auguauuuuuauuuaua

SEQ ID NO: 2101543 - RNA, 22 nt, Staphylococcus aureus subsp. aureus MW2
auguauguuuuaucaauauuag

SEQ ID NO: 2101544 - RNA, 17 nt, Staphylococcus aureus subsp. aureus MW2
auguauucuuagauauu

SEQ ID NO: 2101545 - RNA, 16 nt, Staphylococcus aureus subsp. aureus MW2
augucacauaugacuu

SEQ ID NO: 2101546 - RNA, 23 nt, Staphylococcus aureus subsp. aureus MW2
augucacauguaccacauuuucc

SEQ ID NO: 2101547 - RNA, 14 nt, Staphylococcus aureus subsp. aureus MW2
augucacauaugac

SEQ ID NO: 2101548 - RNA, 15 nt, Staphylococcus aureus subsp. aureus MW2
augcgauugaugcgu

SEQ ID NO: 2101549 - RNA, 22 nt, Staphylococcus aureus subsp. aureus MW2
augcgauucucauuuacuugau

SEQ ID NO: 2101550 - RNA, 15 nt, Staphylococcus aureus subsp. aureus MW2
augcgcaaugaaaac

SEQ ID NO: 2101551 - RNA, 15 nt, Staphylococcus aureus subsp. aureus MW2
augcguaucaauauu

SEQ ID NO: 2101552 - RNA, 20 nt, Staphylococcus aureus subsp. aureus MW2
augcguaucgagagauuaug

SEQ ID NO: 2101553 - RNA, 20 nt, Staphylococcus aureus subsp. aureus MW2
augcgucguagauugauucu

SEQ ID NO: 2101554 - RNA, 16 nt, Staphylococcus aureus subsp. aureus MW2
augcuaauuuaacugc

SEQ ID NO: 2101555 - RNA, 14 nt, Staphylococcus aureus subsp. aureus MW2
augcuacaucaaua

SEQ ID NO: 2101556 - RNA, 16 nt, Staphylococcus aureus subsp. aureus MW2
augcuacaucaauauu

SEQ ID NO: 2101557 - RNA, 16 nt, Staphylococcus aureus subsp. aureus MW2
aaaagacuacaaguua

SEQ ID NO: 2101558 - RNA, 20 nt, Staphylococcus aureus subsp. aureus MW2
aaaagacuacaaguuauuau

SEQ ID NO: 2101559 - RNA, 12 nt, Staphylococcus aureus subsp. aureus MW2
aaaagacagaaa

SEQ ID NO: 2101560 - RNA, 13 nt, Staphylococcus aureus subsp. aureus MW2
aaaagacaaucuc

SEQ ID NO: 2101561 - RNA, 18 nt, Staphylococcus aureus subsp. aureus MW2
augcuagaaaguaaugcu

SEQ ID NO: 2101562 - RNA, 23 nt, Staphylococcus aureus subsp. aureus MW2
augcuagaaaguaaugcuuuacu

SEQ ID NO: 2101563 - RNA, 19 nt, Staphylococcus aureus subsp. aureus MW2
augcuagcuuucuuuuuca

SEQ ID NO: 2101564 - RNA, 22 nt, Staphylococcus aureus subsp. aureus MW2
aaaagagaaacaaaacaaaaaa

SEQ ID NO: 2101565 - RNA, 20 nt, Staphylococcus aureus subsp. aureus MW2
aaaagagggaccuuacuacu

SEQ ID NO: 2101566 - RNA, 19 nt, Staphylococcus aureus subsp. aureus MW2
augcuauauccaguuaauu

SEQ ID NO: 2101567 - RNA, 13 nt, Staphylococcus aureus subsp. aureus MW2
aaaagaguacauu

SEQ ID NO: 2101568 - RNA, 16 nt, Staphylococcus aureus subsp. aureus MW2
aaaagaguuaauaaaa

SEQ ID NO: 2101569 - RNA, 17 nt, Staphylococcus aureus subsp. aureus MW2
aaaagaguuaauaaaau

SEQ ID NO: 2101570 - RNA, 23 nt, Staphylococcus aureus subsp. aureus MW2
augcuagcuuucuuuuucaucuu

SEQ ID NO: 2101571 - RNA, 14 nt, Staphylococcus aureus subsp. aureus MW2
augcucaaugcauu

SEQ ID NO: 2101572 - RNA, 22 nt, Staphylococcus aureus subsp. aureus MW2
augcucaucuacuuaaaauaag

SEQ ID NO: 2101573 - RNA, 21 nt, Staphylococcus aureus subsp. aureus MW2
augcacuuuauuaaaaauccu

SEQ ID NO: 2101574 - RNA, 14 nt, Staphylococcus aureus subsp. aureus MW2
augcacuuuuuaua

SEQ ID NO: 2101575 - RNA, 21 nt, Staphylococcus aureus subsp. aureus MW2
augcacgcgugccaacaucuu

SEQ ID NO: 2101576 - RNA, 21 nt, Staphylococcus aureus subsp. aureus MW2
augcaccuuuacaacauacau

SEQ ID NO: 2101577 - RNA, 17 nt, Staphylococcus aureus subsp. aureus MW2
augcaucaacuauuuac

SEQ ID NO: 2101578 - RNA, 13 nt, Staphylococcus aureus subsp. aureus MW2
augcauauaagau

SEQ ID NO: 2101579 - RNA, 13 nt, Staphylococcus aureus subsp. aureus MW2
augcaucgguauc

SEQ ID NO: 2101580 - RNA, 23 nt, Staphylococcus aureus subsp. aureus MW2
augcaucgguaucgaauguuuca

SEQ ID NO: 2101581 - RNA, 16 nt, Staphylococcus aureus subsp. aureus MW2
augcauauucaucaua

SEQ ID NO: 2101582 - RNA, 18 nt, Staphylococcus aureus subsp. aureus MW2
augcaguuuuaauuaaac

SEQ ID NO: 2101583 - RNA, 13 nt, Staphylococcus aureus subsp. aureus MW2
augcauaaaaaaa

SEQ ID NO: 2101584 - RNA, 21 nt, Staphylococcus aureus subsp. aureus MW2
augcauaauuaggauuaacau

SEQ ID NO: 2101585 - RNA, 15 nt, Staphylococcus aureus subsp. aureus MW2
augcauaauauauua

SEQ ID NO: 2101586 - RNA, 18 nt, Staphylococcus aureus subsp. aureus MW2
augcauaauauauuaaaa

SEQ ID NO: 2101587 - RNA, 20 nt, Staphylococcus aureus subsp. aureus MW2
augcauaauauauuaaaaau

SEQ ID NO: 2101588 - RNA, 15 nt, Staphylococcus aureus subsp. aureus MW2
augcaguaaaaccaa

SEQ ID NO: 2101589 - RNA, 18 nt, Staphylococcus aureus subsp. aureus MW2
augccagaugcaaugaua

SEQ ID NO: 2101590 - RNA, 15 nt, Staphylococcus aureus subsp. aureus MW2
augcaugugaaauua

SEQ ID NO: 2101591 - RNA, 12 nt, Staphylococcus aureus subsp. aureus MW2
augccaaauaac

SEQ ID NO: 2101592 - RNA, 23 nt, Staphylococcus aureus subsp. aureus MW2
augccaaauaacguuaauauaau

SEQ ID NO: 2101593 - RNA, 19 nt, Staphylococcus aureus subsp. aureus MW2
augccagcuucuaacaaau

SEQ ID NO: 2101594 - RNA, 23 nt, Staphylococcus aureus subsp. aureus MW2
augcccgauaaaaccaccuacca

SEQ ID NO: 2101595 - RNA, 20 nt, Staphylococcus aureus subsp. aureus MW2
augcccuagguuuauauauc

SEQ ID NO: 2101596 - RNA, 22 nt, Staphylococcus aureus subsp. aureus MW2
augccggucaaagcgaauagaa

SEQ ID NO: 2101597 - RNA, 22 nt, Staphylococcus aureus subsp. aureus MW2
auuuagaugcauaaaaaaagaa

SEQ ID NO: 2101598 - RNA, 15 nt, Staphylococcus aureus subsp. aureus MW2
auuuagauucuuuuc

SEQ ID NO: 2101599 - RNA, 17 nt, Staphylococcus aureus subsp. aureus MW2
auuuagauuuauaacga

SEQ ID NO: 2101600 - RNA, 19 nt, Staphylococcus aureus subsp. aureus MW2
auuuagauuucauaauguu

SEQ ID NO: 2101601 - RNA, 18 nt, Staphylococcus aureus subsp. aureus MW2
auuuagauaaaaaauacu

SEQ ID NO: 2101602 - RNA, 20 nt, Staphylococcus aureus subsp. aureus MW2
auuuagauaaaaaauacuaa

SEQ ID NO: 2101603 - RNA, 17 nt, Staphylococcus aureus subsp. aureus MW2
auuuagaugcauaaaaa

SEQ ID NO: 2101604 - RNA, 20 nt, Staphylococcus aureus subsp. aureus MW2
auuuagaugcauaaaaaaag

SEQ ID NO: 2101605 - RNA, 17 nt, Staphylococcus aureus subsp. aureus MW2
auuuagaugauucuuau

SEQ ID NO: 2101606 - RNA, 19 nt, Staphylococcus aureus subsp. aureus MW2
auuuagcaucaaaaauaaa

SEQ ID NO: 2101607 - RNA, 23 nt, Staphylococcus aureus subsp. aureus MW2
auuuagcauacauuaagcuaugc

SEQ ID NO: 2101608 - RNA, 18 nt, Staphylococcus aureus subsp. aureus MW2
auuuagcaaauauuucug

SEQ ID NO: 2101609 - RNA, 20 nt, Staphylococcus aureus subsp. aureus MW2
auuuagacuuggauaaaaau

SEQ ID NO: 2101610 - RNA, 15 nt, Staphylococcus aureus subsp. aureus MW2
auuuacuugauuaga

SEQ ID NO: 2101611 - RNA, 16 nt, Staphylococcus aureus subsp. aureus MW2
auuuacuuuagaaaca

SEQ ID NO: 2101612 - RNA, 21 nt, Staphylococcus aureus subsp. aureus MW2
auuuaccucuugauaaaauaa

SEQ ID NO: 2101613 - RNA, 18 nt, Staphylococcus aureus subsp. aureus MW2
auuuaccgucuuaugaua

SEQ ID NO: 2101614 - RNA, 18 nt, Staphylococcus aureus subsp. aureus MW2
auuuacuccuuacaauaa

SEQ ID NO: 2101615 - RNA, 11 nt, Staphylococcus aureus subsp. aureus MW2
auuuacucuaa

SEQ ID NO: 2101616 - RNA, 19 nt, Staphylococcus aureus subsp. aureus MW2
auuuaccaguuugaucaua

SEQ ID NO: 2101617 - RNA, 19 nt, Staphylococcus aureus subsp. aureus MW2
auuuacccauuacauuugg

SEQ ID NO: 2101618 - RNA, 21 nt, Staphylococcus aureus subsp. aureus MW2
auuuacaauguuaucuugcuu

SEQ ID NO: 2101619 - RNA, 12 nt, Staphylococcus aureus subsp. aureus MW2
auuuacaaaaac

SEQ ID NO: 2101620 - RNA, 15 nt, Staphylococcus aureus subsp. aureus MW2
auuuacaaaaacuau

SEQ ID NO: 2101621 - RNA, 14 nt, Staphylococcus aureus subsp. aureus MW2
auugucuuauaaga

SEQ ID NO: 2101622 - RNA, 12 nt, Staphylococcus aureus subsp. aureus MW2
auugucaucaug

SEQ ID NO: 2101623 - RNA, 15 nt, Staphylococcus aureus subsp. aureus MW2
auuguggaauuaauu

SEQ ID NO: 2101624 - RNA, 21 nt, Staphylococcus aureus subsp. aureus MW2
auuuaaaacaaugauuaaaau

SEQ ID NO: 2101625 - RNA, 22 nt, Staphylococcus aureus subsp. aureus MW2
auuuaaaacaaugauuaaaauu

SEQ ID NO: 2101626 - RNA, 14 nt, Staphylococcus aureus subsp. aureus MW2
auuuaaaauauaaa

SEQ ID NO: 2101627 - RNA, 12 nt, Staphylococcus aureus subsp. aureus MW2
auuuaaaagaaa

SEQ ID NO: 2101628 - RNA, 16 nt, Staphylococcus aureus subsp. aureus MW2
auuguuuguagaauuu

SEQ ID NO: 2101629 - RNA, 19 nt, Staphylococcus aureus subsp. aureus MW2
auuguuuuggcuuugagug

SEQ ID NO: 2101630 - RNA, 13 nt, Staphylococcus aureus subsp. aureus MW2
auuguuuuuaaaa

SEQ ID NO: 2101631 - RNA, 19 nt, Staphylococcus aureus subsp. aureus MW2
auuguuuugagauauuugu

SEQ ID NO: 2101632 - RNA, 13 nt, Staphylococcus aureus subsp. aureus MW2
auuuaaaaaaugc

SEQ ID NO: 2101633 - RNA, 16 nt, Staphylococcus aureus subsp. aureus MW2
auuuaaaaaaauuaau

SEQ ID NO: 2101634 - RNA, 21 nt, Staphylococcus aureus subsp. aureus MW2
auuuaaaaucgggcaacugag

SEQ ID NO: 2101635 - RNA, 17 nt, Staphylococcus aureus subsp. aureus MW2
auuuaacucaacuuaaa

SEQ ID NO: 2101636 - RNA, 16 nt, Staphylococcus aureus subsp. aureus MW2
auuuaaacauccaauu

SEQ ID NO: 2101637 - RNA, 21 nt, Staphylococcus aureus subsp. aureus MW2
auuuaacgucuaccucuagga

SEQ ID NO: 2101638 - RNA, 13 nt, Staphylococcus aureus subsp. aureus MW2
auuuaaaaugauu

SEQ ID NO: 2101639 - RNA, 19 nt, Staphylococcus aureus subsp. aureus MW2
auuuaaaaugcuuguucaa

SEQ ID NO: 2101640 - RNA, 13 nt, Staphylococcus aureus subsp. aureus MW2
auuuaaaauuauu

SEQ ID NO: 2101641 - RNA, 17 nt, Staphylococcus aureus subsp. aureus MW2
auuuaaaauauuauuuu

SEQ ID NO: 2101642 - RNA, 20 nt, Staphylococcus aureus subsp. aureus MW2
auuuaacucaacuuaaauau

SEQ ID NO: 2101643 - RNA, 16 nt, Staphylococcus aureus subsp. aureus MW2
auuuaagaaacgucuu

SEQ ID NO: 2101644 - RNA, 23 nt, Staphylococcus aureus subsp. aureus MW2
auuuaagaaugcgaagauuuuua

SEQ ID NO: 2101645 - RNA, 14 nt, Staphylococcus aureus subsp. aureus MW2
auuuaagauuuaau

SEQ ID NO: 2101646 - RNA, 23 nt, Staphylococcus aureus subsp. aureus MW2
auuuaaggauaaugguuucaaaa

SEQ ID NO: 2101647 - RNA, 18 nt, Staphylococcus aureus subsp. aureus MW2
auuuaauuuguuauacca

SEQ ID NO: 2101648 - RNA, 18 nt, Staphylococcus aureus subsp. aureus MW2
auuuaauuuuaauaacca

SEQ ID NO: 2101649 - RNA, 17 nt, Staphylococcus aureus subsp. aureus MW2
auuuaauuuuauuuugu

SEQ ID NO: 2101650 - RNA, 18 nt, Staphylococcus aureus subsp. aureus MW2
auuuaauuuuauuuugug

SEQ ID NO: 2101651 - RNA, 18 nt, Staphylococcus aureus subsp. aureus MW2
auuuaauucugguuuaau

SEQ ID NO: 2101652 - RNA, 23 nt, Staphylococcus aureus subsp. aureus MW2
auuuaaucuauuaacugaccuaa

SEQ ID NO: 2101653 - RNA, 19 nt, Staphylococcus aureus subsp. aureus MW2
auuuaaucguaacauauca

SEQ ID NO: 2101654 - RNA, 15 nt, Staphylococcus aureus subsp. aureus MW2
auuuaauauuguuaa

SEQ ID NO: 2101655 - RNA, 14 nt, Staphylococcus aureus subsp. aureus MW2
auuuaaguucuucu

SEQ ID NO: 2101656 - RNA, 19 nt, Staphylococcus aureus subsp. aureus MW2
auuggaaucaucuuuuuga

SEQ ID NO: 2101657 - RNA, 20 nt, Staphylococcus aureus subsp. aureus MW2
auuggaaucaucuuuuugaa

SEQ ID NO: 2101658 - RNA, 23 nt, Staphylococcus aureus subsp. aureus MW2
auuggauuacuuccauugcuucu

SEQ ID NO: 2101659 - RNA, 20 nt, Staphylococcus aureus subsp. aureus MW2
auuggauuaucgaauuagau

SEQ ID NO: 2101660 - RNA, 16 nt, Staphylococcus aureus subsp. aureus MW2
auuguaucuugucauu

SEQ ID NO: 2101661 - RNA, 15 nt, Staphylococcus aureus subsp. aureus MW2
auuguaugaauaaua

SEQ ID NO: 2101662 - RNA, 18 nt, Staphylococcus aureus subsp. aureus MW2
auuguauuaaucaaauau

SEQ ID NO: 2101663 - RNA, 17 nt, Staphylococcus aureus subsp. aureus MW2
auuguauauguguguug

SEQ ID NO: 2101664 - RNA, 15 nt, Staphylococcus aureus subsp. aureus MW2
aaaaguaaguaaaau

SEQ ID NO: 2101665 - RNA, 13 nt, Staphylococcus aureus subsp. aureus MW2
auuguauuuuaau

SEQ ID NO: 2101666 - RNA, 16 nt, Staphylococcus aureus subsp. aureus MW2
auugucaauuuaaagu

SEQ ID NO: 2101667 - RNA, 22 nt, Staphylococcus aureus subsp. aureus MW2
aaaaguaaaaucuuuaacauuu

SEQ ID NO: 2101668 - RNA, 17 nt, Staphylococcus aureus subsp. aureus MW2
aaaaguaaguaaaauaa

SEQ ID NO: 2101669 - RNA, 22 nt, Staphylococcus aureus subsp. aureus MW2
auugcuauaagaacuaaugguu

SEQ ID NO: 2101670 - RNA, 22 nt, Staphylococcus aureus subsp. aureus MW2
auugcuauauuaguauaauuua

SEQ ID NO: 2101671 - RNA, 17 nt, Staphylococcus aureus subsp. aureus MW2
auugcucuaagcauuca

SEQ ID NO: 2101672 - RNA, 17 nt, Staphylococcus aureus subsp. aureus MW2
auugcuuguucuuucuu

SEQ ID NO: 2101673 - RNA, 18 nt, Staphylococcus aureus subsp. aureus MW2
auugcuuuacuaauuccg

SEQ ID NO: 2101674 - RNA, 16 nt, Staphylococcus aureus subsp. aureus MW2
auugcuuuagaaaguc

SEQ ID NO: 2101675 - RNA, 12 nt, Staphylococcus aureus subsp. aureus MW2
auugauagucac

SEQ ID NO: 2101676 - RNA, 22 nt, Staphylococcus aureus subsp. aureus MW2
auugauaugguuagaaaaaaau

SEQ ID NO: 2101677 - RNA, 16 nt, Staphylococcus aureus subsp. aureus MW2
auugauauuaauauau

SEQ ID NO: 2101678 - RNA, 17 nt, Staphylococcus aureus subsp. aureus MW2
auugauauuaauauauu

SEQ ID NO: 2101679 - RNA, 15 nt, Staphylococcus aureus subsp. aureus MW2
auugauuaaauaaau

SEQ ID NO: 2101680 - RNA, 23 nt, Staphylococcus aureus subsp. aureus MW2
auugauagcaccguaacauaugu

SEQ ID NO: 2101681 - RNA, 15 nt, Staphylococcus aureus subsp. aureus MW2
auugauaaauuuuua

SEQ ID NO: 2101682 - RNA, 16 nt, Staphylococcus aureus subsp. aureus MW2
auugauucuagugaaa

SEQ ID NO: 2101683 - RNA, 19 nt, Staphylococcus aureus subsp. aureus MW2
auugauucuagugaaauac

SEQ ID NO: 2101684 - RNA, 21 nt, Staphylococcus aureus subsp. aureus MW2
auugauuauucuuuaauuaaa

SEQ ID NO: 2101685 - RNA, 21 nt, Staphylococcus aureus subsp. aureus MW2
auugauuucuguaccaaauuu

SEQ ID NO: 2101686 - RNA, 22 nt, Staphylococcus aureus subsp. aureus MW2
auugauuugggcgcuuuuuaau

SEQ ID NO: 2101687 - RNA, 14 nt, Staphylococcus aureus subsp. aureus MW2
auugaauuaagaaa

SEQ ID NO: 2101688 - RNA, 13 nt, Staphylococcus aureus subsp. aureus MW2
auugaacuucuuu

SEQ ID NO: 2101689 - RNA, 15 nt, Staphylococcus aureus subsp. aureus MW2
auugaauaaaaaaac

SEQ ID NO: 2101690 - RNA, 20 nt, Staphylococcus aureus subsp. aureus MW2
auugaaugaaguaggcugaa

SEQ ID NO: 2101691 - RNA, 21 nt, Staphylococcus aureus subsp. aureus MW2
auugaauuguagauccaauuc

SEQ ID NO: 2101692 - RNA, 13 nt, Staphylococcus aureus subsp. aureus MW2
auugaauaugugu

SEQ ID NO: 2101693 - RNA, 13 nt, Staphylococcus aureus subsp. aureus MW2
auugaaucaaaua

SEQ ID NO: 2101694 - RNA, 18 nt, Staphylococcus aureus subsp. aureus MW2
auugacuuacauuuuaau

SEQ ID NO: 2101695 - RNA, 22 nt, Staphylococcus aureus subsp. aureus MW2
auugacucgaccuuuauaugaa

SEQ ID NO: 2101696 - RNA, 21 nt, Staphylococcus aureus subsp. aureus MW2
auugagaauauuaagauguau

SEQ ID NO: 2101697 - RNA, 22 nt, Staphylococcus aureus subsp. aureus MW2
auugaguguaugcauauaagau

SEQ ID NO: 2101698 - RNA, 14 nt, Staphylococcus aureus subsp. aureus MW2
auugaguuguugca

SEQ ID NO: 2101699 - RNA, 14 nt, Staphylococcus aureus subsp. aureus MW2
auucucauuuacuu

SEQ ID NO: 2101700 - RNA, 22 nt, Staphylococcus aureus subsp. aureus MW2
auucuccaacucuaacagcuua

SEQ ID NO: 2101701 - RNA, 19 nt, Staphylococcus aureus subsp. aureus MW2
auucuagcaucgauguuau

SEQ ID NO: 2101702 - RNA, 16 nt, Staphylococcus aureus subsp. aureus MW2
auucuagugaaauacc

SEQ ID NO: 2101703 - RNA, 19 nt, Staphylococcus aureus subsp. aureus MW2
auucugugagguaaaacua

SEQ ID NO: 2101704 - RNA, 22 nt, Staphylococcus aureus subsp. aureus MW2
auugaacaauaauaugccaaag

SEQ ID NO: 2101705 - RNA, 21 nt, Staphylococcus aureus subsp. aureus MW2
auugaaauuauccuacugcug

SEQ ID NO: 2101706 - RNA, 14 nt, Staphylococcus aureus subsp. aureus MW2
auugaaaugagcuu

SEQ ID NO: 2101707 - RNA, 15 nt, Staphylococcus aureus subsp. aureus MW2
auugaaaugauagau

SEQ ID NO: 2101708 - RNA, 21 nt, Staphylococcus aureus subsp. aureus MW2
auugaaaucgucuuacugcug

SEQ ID NO: 2101709 - RNA, 18 nt, Staphylococcus aureus subsp. aureus MW2
auugaaauaauauaaaaa

SEQ ID NO: 2101710 - RNA, 17 nt, Staphylococcus aureus subsp. aureus MW2
auucuuuuucaaaauac

SEQ ID NO: 2101711 - RNA, 18 nt, Staphylococcus aureus subsp. aureus MW2
auucuuuuucaaaauacg

SEQ ID NO: 2101712 - RNA, 13 nt, Staphylococcus aureus subsp. aureus MW2
auugaaagauauu

SEQ ID NO: 2101713 - RNA, 15 nt, Staphylococcus aureus subsp. aureus MW2
auugaaagauauuuc

SEQ ID NO: 2101714 - RNA, 18 nt, Staphylococcus aureus subsp. aureus MW2
auugaaagauauuucugu

SEQ ID NO: 2101715 - RNA, 19 nt, Staphylococcus aureus subsp. aureus MW2
auugaaagauauuucuguu

SEQ ID NO: 2101716 - RNA, 19 nt, Staphylococcus aureus subsp. aureus MW2
auucuuugagguguggugu

SEQ ID NO: 2101717 - RNA, 18 nt, Staphylococcus aureus subsp. aureus MW2
auucuuucuuuuuuacau

SEQ ID NO: 2101718 - RNA, 17 nt, Staphylococcus aureus subsp. aureus MW2
auucuucaguuuguugg

SEQ ID NO: 2101719 - RNA, 14 nt, Staphylococcus aureus subsp. aureus MW2
auucuucaccaacu

SEQ ID NO: 2101720 - RNA, 18 nt, Staphylococcus aureus subsp. aureus MW2
auucuucaccaguuugug

SEQ ID NO: 2101721 - RNA, 22 nt, Staphylococcus aureus subsp. aureus MW2
auucuucaauuucauuuuugau

SEQ ID NO: 2101722 - RNA, 14 nt, Staphylococcus aureus subsp. aureus MW2
auucuucaaaaaau

SEQ ID NO: 2101723 - RNA, 12 nt, Staphylococcus aureus subsp. aureus MW2
auucuucaaaaa

SEQ ID NO: 2101724 - RNA, 20 nt, Staphylococcus aureus subsp. aureus MW2
auucuucaaccauuuguucu

SEQ ID NO: 2101725 - RNA, 15 nt, Staphylococcus aureus subsp. aureus MW2
auucuuaucuuuaau

SEQ ID NO: 2101726 - RNA, 14 nt, Staphylococcus aureus subsp. aureus MW2
auucuaaaacggaa

SEQ ID NO: 2101727 - RNA, 21 nt, Staphylococcus aureus subsp. aureus MW2
auucuaaaaaauuaaaaauuu

SEQ ID NO: 2101728 - RNA, 15 nt, Staphylococcus aureus subsp. aureus MW2
auucguuucuuuauu

SEQ ID NO: 2101729 - RNA, 15 nt, Staphylococcus aureus subsp. aureus MW2
auucgccuaaauggu

SEQ ID NO: 2101730 - RNA, 17 nt, Staphylococcus aureus subsp. aureus MW2
auucguugauuuagcau

SEQ ID NO: 2101731 - RNA, 23 nt, Staphylococcus aureus subsp. aureus MW2
auucguugauuuagcauacauua

SEQ ID NO: 2101732 - RNA, 18 nt, Staphylococcus aureus subsp. aureus MW2
auucgaacuaucaauaua

SEQ ID NO: 2101733 - RNA, 18 nt, Staphylococcus aureus subsp. aureus MW2
auucgaugacuuuuuaau

SEQ ID NO: 2101734 - RNA, 18 nt, Staphylococcus aureus subsp. aureus MW2
auucgauugguuuaaaaa

SEQ ID NO: 2101735 - RNA, 22 nt, Staphylococcus aureus subsp. aureus MW2
auucgauugguuuaaaaaguca

SEQ ID NO: 2101736 - RNA, 16 nt, Staphylococcus aureus subsp. aureus MW2
auucgcaccacuggcc

SEQ ID NO: 2101737 - RNA, 21 nt, Staphylococcus aureus subsp. aureus MW2
auuccgagaauuauuauucua

SEQ ID NO: 2101738 - RNA, 21 nt, Staphylococcus aureus subsp. aureus MW2
auucauacacugcacaucaua

SEQ ID NO: 2101739 - RNA, 20 nt, Staphylococcus aureus subsp. aureus MW2
auucauacacugcacaucau

SEQ ID NO: 2101740 - RNA, 22 nt, Staphylococcus aureus subsp. aureus MW2
auucauaauuuguugauaguaa

SEQ ID NO: 2101741 - RNA, 15 nt, Staphylococcus aureus subsp. aureus MW2
auucauaaaauuuaa

SEQ ID NO: 2101742 - RNA, 20 nt, Staphylococcus aureus subsp. aureus MW2
auucauaaaugacugaauua

SEQ ID NO: 2101743 - RNA, 14 nt, Staphylococcus aureus subsp. aureus MW2
auucauaaaugcuu

SEQ ID NO: 2101744 - RNA, 23 nt, Staphylococcus aureus subsp. aureus MW2
auucauaacaacaucaaaacccc

SEQ ID NO: 2101745 - RNA, 12 nt, Staphylococcus aureus subsp. aureus MW2
auucauaauauc

SEQ ID NO: 2101746 - RNA, 15 nt, Staphylococcus aureus subsp. aureus MW2
auuccccauuuaucu

SEQ ID NO: 2101747 - RNA, 23 nt, Staphylococcus aureus subsp. aureus MW2
auucccaccggacaauguagaua

SEQ ID NO: 2101748 - RNA, 20 nt, Staphylococcus aureus subsp. aureus MW2
auuuucuugccaucaauuuc

SEQ ID NO: 2101749 - RNA, 21 nt, Staphylococcus aureus subsp. aureus MW2
auuuucuuuuuuuauggauuu

SEQ ID NO: 2101750 - RNA, 11 nt, Staphylococcus aureus subsp. aureus MW2
auuuugaagaa

SEQ ID NO: 2101751 - RNA, 15 nt, Staphylococcus aureus subsp. aureus MW2
auuuugaagaagugc

SEQ ID NO: 2101752 - RNA, 21 nt, Staphylococcus aureus subsp. aureus MW2
auuuugauuuaccuucaucuu

SEQ ID NO: 2101753 - RNA, 18 nt, Staphylococcus aureus subsp. aureus MW2
auuuugauauuuuucacg

SEQ ID NO: 2101754 - RNA, 15 nt, Staphylococcus aureus subsp. aureus MW2
auuuugauauaaaaa

SEQ ID NO: 2101755 - RNA, 22 nt, Staphylococcus aureus subsp. aureus MW2
auuuugagucguagauacuacc

SEQ ID NO: 2101756 - RNA, 14 nt, Staphylococcus aureus subsp. aureus MW2
auuuugaguauuug

SEQ ID NO: 2101757 - RNA, 22 nt, Staphylococcus aureus subsp. aureus MW2
auuuugagcuaaccacaucauu

SEQ ID NO: 2101758 - RNA, 13 nt, Staphylococcus aureus subsp. aureus MW2
auuuugagaaaau

SEQ ID NO: 2101759 - RNA, 23 nt, Staphylococcus aureus subsp. aureus MW2
auuuuguauuuuucaaauaaaga

SEQ ID NO: 2101760 - RNA, 17 nt, Staphylococcus aureus subsp. aureus MW2
auuuuguauuuuucaaa

SEQ ID NO: 2101761 - RNA, 15 nt, Staphylococcus aureus subsp. aureus MW2
auuuuguauuuuuca

SEQ ID NO: 2101762 - RNA, 19 nt, Staphylococcus aureus subsp. aureus MW2
auuuuuagacauuaaaaaa

SEQ ID NO: 2101763 - RNA, 15 nt, Staphylococcus aureus subsp. aureus MW2
auuuuuagacauuaa

SEQ ID NO: 2101764 - RNA, 21 nt, Staphylococcus aureus subsp. aureus MW2
auuuugcugccaaaaaguauu

SEQ ID NO: 2101765 - RNA, 14 nt, Staphylococcus aureus subsp. aureus MW2
auuuugccauaugu

SEQ ID NO: 2101766 - RNA, 21 nt, Staphylococcus aureus subsp. aureus MW2
auuuugcgaaaauaucauuuc

SEQ ID NO: 2101767 - RNA, 15 nt, Staphylococcus aureus subsp. aureus MW2
auuuuguaaccugau

SEQ ID NO: 2101768 - RNA, 12 nt, Staphylococcus aureus subsp. aureus MW2
auuuuaaaucuu

SEQ ID NO: 2101769 - RNA, 15 nt, Staphylococcus aureus subsp. aureus MW2
auuuuaugaaucgaa

SEQ ID NO: 2101770 - RNA, 20 nt, Staphylococcus aureus subsp. aureus MW2
auuuuaaauauugauauaaa

SEQ ID NO: 2101771 - RNA, 17 nt, Staphylococcus aureus subsp. aureus MW2
auuuuaaauaaaaugca

SEQ ID NO: 2101772 - RNA, 14 nt, Staphylococcus aureus subsp. aureus MW2
auuuuaaacaugaa

SEQ ID NO: 2101773 - RNA, 22 nt, Staphylococcus aureus subsp. aureus MW2
auuuuaaacaugaacaaucaga

SEQ ID NO: 2101774 - RNA, 17 nt, Staphylococcus aureus subsp. aureus MW2
auuuguuguuauauaaa

SEQ ID NO: 2101775 - RNA, 15 nt, Staphylococcus aureus subsp. aureus MW2
auuuuaugauuugau

SEQ ID NO: 2101776 - RNA, 12 nt, Staphylococcus aureus subsp. aureus MW2
auuuuaugauuu

SEQ ID NO: 2101777 - RNA, 20 nt, Staphylococcus aureus subsp. aureus MW2
auuuuauggugcuaaaaaau

SEQ ID NO: 2101778 - RNA, 22 nt, Staphylococcus aureus subsp. aureus MW2
auuuuauggugcuaaaaaauuu

SEQ ID NO: 2101779 - RNA, 21 nt, Staphylococcus aureus subsp. aureus MW2
auuuuauuagguaauacuuuu

SEQ ID NO: 2101780 - RNA, 15 nt, Staphylococcus aureus subsp. aureus MW2
auuuuauuuaaaaau

SEQ ID NO: 2101781 - RNA, 14 nt, Staphylococcus aureus subsp. aureus MW2
auuuucuguccaaa

SEQ ID NO: 2101782 - RNA, 14 nt, Staphylococcus aureus subsp. aureus MW2
auuuucauuuuucu

SEQ ID NO: 2101783 - RNA, 13 nt, Staphylococcus aureus subsp. aureus MW2
auuuucauuuuag

SEQ ID NO: 2101784 - RNA, 21 nt, Staphylococcus aureus subsp. aureus MW2
caaaaacauaaucauugugua

SEQ ID NO: 2101785 - RNA, 21 nt, Staphylococcus aureus subsp. aureus MW2
caaaaauagauugaaaaaaua

SEQ ID NO: 2101786 - RNA, 14 nt, Staphylococcus aureus subsp. aureus MW2
caaaaauaaaaccg

SEQ ID NO: 2101787 - RNA, 22 nt, Staphylococcus aureus subsp. aureus MW2
caaaaauagucggggccccaac

SEQ ID NO: 2101788 - RNA, 14 nt, Staphylococcus aureus subsp. aureus MW2
caaaaauaaaaaug

SEQ ID NO: 2101789 - RNA, 14 nt, Staphylococcus aureus subsp. aureus MW2
caaaaauaaaaacu

SEQ ID NO: 2101790 - RNA, 18 nt, Staphylococcus aureus subsp. aureus MW2
caaaaauaaaaacuucua

SEQ ID NO: 2101791 - RNA, 14 nt, Staphylococcus aureus subsp. aureus MW2
caaaacaaaaaaua

SEQ ID NO: 2101792 - RNA, 13 nt, Staphylococcus aureus subsp. aureus MW2
caaaaauuguaaa

SEQ ID NO: 2101793 - RNA, 19 nt, Staphylococcus aureus subsp. aureus MW2
caaaacaauuuaaaaagca

SEQ ID NO: 2101794 - RNA, 20 nt, Staphylococcus aureus subsp. aureus MW2
caaaacaauuuaaaaagcag

SEQ ID NO: 2101795 - RNA, 21 nt, Staphylococcus aureus subsp. aureus MW2
caaaacaauuuaaaaagcagu

SEQ ID NO: 2101796 - RNA, 21 nt, Staphylococcus aureus subsp. aureus MW2
auuuuuuucguaacauuuaaa

SEQ ID NO: 2101797 - RNA, 23 nt, Staphylococcus aureus subsp. aureus MW2
auuuuuuucguaacauuuaaaaa

SEQ ID NO: 2101798 - RNA, 13 nt, Staphylococcus aureus subsp. aureus MW2
auuuuuuugaaaa

SEQ ID NO: 2101799 - RNA, 12 nt, Staphylococcus aureus subsp. aureus MW2
auuuuuuuaugu

SEQ ID NO: 2101800 - RNA, 16 nt, Staphylococcus aureus subsp. aureus MW2
auuuuuuuauguuaua

SEQ ID NO: 2101801 - RNA, 18 nt, Staphylococcus aureus subsp. aureus MW2
auuuuuuucacuaauuuc

SEQ ID NO: 2101802 - RNA, 15 nt, Staphylococcus aureus subsp. aureus MW2
auuuuuuuauauuuu

SEQ ID NO: 2101803 - RNA, 19 nt, Staphylococcus aureus subsp. aureus MW2
auuuuuuuaauguuauaaa

SEQ ID NO: 2101804 - RNA, 17 nt, Staphylococcus aureus subsp. aureus MW2
auuuuuuuacaagaaca

SEQ ID NO: 2101805 - RNA, 13 nt, Staphylococcus aureus subsp. aureus MW2
auuuuuuuagaag

SEQ ID NO: 2101806 - RNA, 22 nt, Staphylococcus aureus subsp. aureus MW2
auuuuuuuggugcuuuuuuaag

SEQ ID NO: 2101807 - RNA, 21 nt, Staphylococcus aureus subsp. aureus MW2
auuuuuuuguugguuuuuaaa

SEQ ID NO: 2101808 - RNA, 22 nt, Staphylococcus aureus subsp. aureus MW2
auuuuuuuguugguuuuuaaaa

SEQ ID NO: 2101809 - RNA, 23 nt, Staphylococcus aureus subsp. aureus MW2
auuuuuuuguugguuuuuaaaag

SEQ ID NO: 2101810 - RNA, 20 nt, Staphylococcus aureus subsp. aureus MW2
caaaaaaccgaacaucugaa

SEQ ID NO: 2101811 - RNA, 23 nt, Staphylococcus aureus subsp. aureus MW2
caaaaaagagcucaagacauuac

SEQ ID NO: 2101812 - RNA, 23 nt, Staphylococcus aureus subsp. aureus MW2
auuuuuuaaaugcgaaguauaaa

SEQ ID NO: 2101813 - RNA, 16 nt, Staphylococcus aureus subsp. aureus MW2
auuuuuugcaaaauuu

SEQ ID NO: 2101814 - RNA, 19 nt, Staphylococcus aureus subsp. aureus MW2
auuuuuauagauaaggcua

SEQ ID NO: 2101815 - RNA, 13 nt, Staphylococcus aureus subsp. aureus MW2
auuuuuaguuaaa

SEQ ID NO: 2101816 - RNA, 21 nt, Staphylococcus aureus subsp. aureus MW2
auuuguagcuugaauaauaua

SEQ ID NO: 2101817 - RNA, 22 nt, Staphylococcus aureus subsp. aureus MW2
auuuguagcuugaauaauauau

SEQ ID NO: 2101818 - RNA, 17 nt, Staphylococcus aureus subsp. aureus MW2
auuuguauagauuguau

SEQ ID NO: 2101819 - RNA, 19 nt, Staphylococcus aureus subsp. aureus MW2
auuugucauaauagauaau

SEQ ID NO: 2101820 - RNA, 14 nt, Staphylococcus aureus subsp. aureus MW2
auuuguaauacaag

SEQ ID NO: 2101821 - RNA, 14 nt, Staphylococcus aureus subsp. aureus MW2
auuuguauuuaaaa

SEQ ID NO: 2101822 - RNA, 19 nt, Staphylococcus aureus subsp. aureus MW2
auuuguguauaaaugucau

SEQ ID NO: 2101823 - RNA, 14 nt, Staphylococcus aureus subsp. aureus MW2
auuuguuaaauuca

SEQ ID NO: 2101824 - RNA, 16 nt, Staphylococcus aureus subsp. aureus MW2
auuuguguauaaaugu

SEQ ID NO: 2101825 - RNA, 13 nt, Staphylococcus aureus subsp. aureus MW2
auuuguugauagu

SEQ ID NO: 2101826 - RNA, 20 nt, Staphylococcus aureus subsp. aureus MW2
auuuguuauaccaguauuuu

SEQ ID NO: 2101827 - RNA, 19 nt, Staphylococcus aureus subsp. aureus MW2
auuuguuaauuuaauaauu

SEQ ID NO: 2101828 - RNA, 21 nt, Staphylococcus aureus subsp. aureus MW2
auuuggaugguaaguauaauu

SEQ ID NO: 2101829 - RNA, 21 nt, Staphylococcus aureus subsp. aureus MW2
auuugcuguuaauaaaucauu

SEQ ID NO: 2101830 - RNA, 20 nt, Staphylococcus aureus subsp. aureus MW2
auuugcucgugaaaagcagu

SEQ ID NO: 2101831 - RNA, 20 nt, Staphylococcus aureus subsp. aureus MW2
auuugcugaaugaagcauuu

SEQ ID NO: 2101832 - RNA, 21 nt, Staphylococcus aureus subsp. aureus MW2
auuugcugaaugaagcauuuu

SEQ ID NO: 2101833 - RNA, 15 nt, Staphylococcus aureus subsp. aureus MW2
auuuguaaauauuuu

SEQ ID NO: 2101834 - RNA, 24 nt, Staphylococcus aureus subsp. aureus MW2
auuuguaauuccucuggaacuuua

SEQ ID NO: 2101835 - RNA, 13 nt, Staphylococcus aureus subsp. aureus MW2
auuuguaauacaa

SEQ ID NO: 2101836 - RNA, 16 nt, Staphylococcus aureus subsp. aureus MW2
auuuguaaccccauuu

SEQ ID NO: 2101837 - RNA, 20 nt, Staphylococcus aureus subsp. aureus MW2
auuuguaaccccauuuuaaa

SEQ ID NO: 2101838 - RNA, 21 nt, Staphylococcus aureus subsp. aureus MW2
auuuguaaccccauuuuaaag

SEQ ID NO: 2101839 - RNA, 16 nt, Staphylococcus aureus subsp. aureus MW2
auuuggguaauguuuu

SEQ ID NO: 2101840 - RNA, 23 nt, Staphylococcus aureus subsp. aureus MW2
auuugguggagaaccauauuuac

SEQ ID NO: 2101841 - RNA, 20 nt, Staphylococcus aureus subsp. aureus MW2
auuugggucguuagaugaau

SEQ ID NO: 2101842 - RNA, 18 nt, Staphylococcus aureus subsp. aureus MW2
auuugaauaccuacagau

SEQ ID NO: 2101843 - RNA, 22 nt, Staphylococcus aureus subsp. aureus MW2
auuugaauaccuacagauuuua

SEQ ID NO: 2101844 - RNA, 12 nt, Staphylococcus aureus subsp. aureus MW2
auuugaauacuu

SEQ ID NO: 2101845 - RNA, 10 nt, Staphylococcus aureus subsp. aureus MW2
auuucuuuuu

SEQ ID NO: 2101846 - RNA, 13 nt, Staphylococcus aureus subsp. aureus MW2
auuucuuuuuaaa

SEQ ID NO: 2101847 - RNA, 22 nt, Staphylococcus aureus subsp. aureus MW2
auuugaauugacuuacauuuua

SEQ ID NO: 2101848 - RNA, 13 nt, Staphylococcus aureus subsp. aureus MW2
auuucuuuucauu

SEQ ID NO: 2101849 - RNA, 22 nt, Staphylococcus aureus subsp. aureus MW2
auuucuugugcgguaaccauuu

SEQ ID NO: 2101850 - RNA, 14 nt, Staphylococcus aureus subsp. aureus MW2
auuugauuuaaaaa

SEQ ID NO: 2101851 - RNA, 21 nt, Staphylococcus aureus subsp. aureus MW2
auuugauuuggguaauguuuu

SEQ ID NO: 2101852 - RNA, 13 nt, Staphylococcus aureus subsp. aureus MW2
auuugauuuuagg

SEQ ID NO: 2101853 - RNA, 14 nt, Staphylococcus aureus subsp. aureus MW2
auuugauuuauauu

SEQ ID NO: 2101854 - RNA, 15 nt, Staphylococcus aureus subsp. aureus MW2
auuugccaaaaguua

SEQ ID NO: 2101855 - RNA, 21 nt, Staphylococcus aureus subsp. aureus MW2
auuugcagaacguucuaaggu

SEQ ID NO: 2101856 - RNA, 21 nt, Staphylococcus aureus subsp. aureus MW2
auuugcgauuucuucugcuaa

SEQ ID NO: 2101857 - RNA, 17 nt, Staphylococcus aureus subsp. aureus MW2
auuugcgauuucuucug

SEQ ID NO: 2101858 - RNA, 21 nt, Staphylococcus aureus subsp. aureus MW2
auuugccccgccauucauaaa

SEQ ID NO: 2101859 - RNA, 17 nt, Staphylococcus aureus subsp. aureus MW2
auuuaguaucuauacaa

SEQ ID NO: 2101860 - RNA, 15 nt, Staphylococcus aureus subsp. aureus MW2
auuuagucauuacaa

SEQ ID NO: 2101861 - RNA, 18 nt, Staphylococcus aureus subsp. aureus MW2
auuuagucauuacaaauc

SEQ ID NO: 2101862 - RNA, 13 nt, Staphylococcus aureus subsp. aureus MW2
auuuaguuaaaua

SEQ ID NO: 2101863 - RNA, 17 nt, Staphylococcus aureus subsp. aureus MW2
auuuaguuggacaaauu

SEQ ID NO: 2101864 - RNA, 16 nt, Staphylococcus aureus subsp. aureus MW2
auuuaguauaaauaaa

SEQ ID NO: 2101865 - RNA, 17 nt, Staphylococcus aureus subsp. aureus MW2
auuuaguacauagaccu

SEQ ID NO: 2101866 - RNA, 14 nt, Staphylococcus aureus subsp. aureus MW2
auuuaguacauaug

SEQ ID NO: 2101867 - RNA, 15 nt, Staphylococcus aureus subsp. aureus MW2
auuuagguuaauuaa

SEQ ID NO: 2101868 - RNA, 19 nt, Staphylococcus aureus subsp. aureus MW2
auuuagguuaauuaaacaa

SEQ ID NO: 2101869 - RNA, 23 nt, Staphylococcus aureus subsp. aureus MW2
auuuaggaguauccugauuuaau

SEQ ID NO: 2101870 - RNA, 15 nt, Staphylococcus aureus subsp. aureus MW2
auuuauaaacaauaa

SEQ ID NO: 2101871 - RNA, 19 nt, Staphylococcus aureus subsp. aureus MW2
auuuauaaacaauuacaaa

SEQ ID NO: 2101872 - RNA, 16 nt, Staphylococcus aureus subsp. aureus MW2
auuuauaaauguuuca

SEQ ID NO: 2101873 - RNA, 17 nt, Staphylococcus aureus subsp. aureus MW2
auuucaaauauaaaaaa

SEQ ID NO: 2101874 - RNA, 19 nt, Staphylococcus aureus subsp. aureus MW2
auuucaaaucaauaccaac

SEQ ID NO: 2101875 - RNA, 18 nt, Staphylococcus aureus subsp. aureus MW2
auuucaaauguaauuggu

SEQ ID NO: 2101876 - RNA, 15 nt, Staphylococcus aureus subsp. aureus MW2
auuucaaaugugaaa

SEQ ID NO: 2101877 - RNA, 16 nt, Staphylococcus aureus subsp. aureus MW2
auuucacuuuaacuuc

SEQ ID NO: 2101878 - RNA, 14 nt, Staphylococcus aureus subsp. aureus MW2
auuucagaaauaca

SEQ ID NO: 2101879 - RNA, 23 nt, Staphylococcus aureus subsp. aureus MW2
auuucagcaccgacaauuauaau

SEQ ID NO: 2101880 - RNA, 15 nt, Staphylococcus aureus subsp. aureus MW2
auuucaguucaucau

SEQ ID NO: 2101881 - RNA, 16 nt, Staphylococcus aureus subsp. aureus MW2
auuucauuaauuuuuu

SEQ ID NO: 2101882 - RNA, 17 nt, Staphylococcus aureus subsp. aureus MW2
auuucauuaauuuuuuc

SEQ ID NO: 2101883 - RNA, 17 nt, Staphylococcus aureus subsp. aureus MW2
auuucauaguguuugua

SEQ ID NO: 2101884 - RNA, 18 nt, Staphylococcus aureus subsp. aureus MW2
auuucauagggaaauauu

SEQ ID NO: 2101885 - RNA, 13 nt, Staphylococcus aureus subsp. aureus MW2
auuucaucaauaa

SEQ ID NO: 2101886 - RNA, 13 nt, Staphylococcus aureus subsp. aureus MW2
auuucaucaaauc

SEQ ID NO: 2101887 - RNA, 21 nt, Staphylococcus aureus subsp. aureus MW2
auuuccuauuaggauccaauu

SEQ ID NO: 2101888 - RNA, 16 nt, Staphylococcus aureus subsp. aureus MW2
auuuccucgguuuuau

SEQ ID NO: 2101889 - RNA, 18 nt, Staphylococcus aureus subsp. aureus MW2
auuuccuuuagcaaaaau

SEQ ID NO: 2101890 - RNA, 12 nt, Staphylococcus aureus subsp. aureus MW2
auuucauuugac

SEQ ID NO: 2101891 - RNA, 13 nt, Staphylococcus aureus subsp. aureus MW2
auuuccacuuuga

SEQ ID NO: 2101892 - RNA, 20 nt, Staphylococcus aureus subsp. aureus MW2
auuucgauaccuaaaauacc

SEQ ID NO: 2101893 - RNA, 18 nt, Staphylococcus aureus subsp. aureus MW2
auuucgagauucaauauu

SEQ ID NO: 2101894 - RNA, 17 nt, Staphylococcus aureus subsp. aureus MW2
auuucuaauacauacug

SEQ ID NO: 2101895 - RNA, 13 nt, Staphylococcus aureus subsp. aureus MW2
auuucgauuuuca

SEQ ID NO: 2101896 - RNA, 15 nt, Staphylococcus aureus subsp. aureus MW2
auuucuaucaaauaa

SEQ ID NO: 2101897 - RNA, 20 nt, Staphylococcus aureus subsp. aureus MW2
auuucuauaucuauuuauca

SEQ ID NO: 2101898 - RNA, 15 nt, Staphylococcus aureus subsp. aureus MW2
auuucuauaucuauu

SEQ ID NO: 2101899 - RNA, 14 nt, Staphylococcus aureus subsp. aureus MW2
auuucuaucaaaua

SEQ ID NO: 2101900 - RNA, 16 nt, Staphylococcus aureus subsp. aureus MW2
auuucuaugaaaaaaa

SEQ ID NO: 2101901 - RNA, 13 nt, Staphylococcus aureus subsp. aureus MW2
auuucuauuuaaa

SEQ ID NO: 2101902 - RNA, 18 nt, Staphylococcus aureus subsp. aureus MW2
auuucucacugcuguucu

SEQ ID NO: 2101903 - RNA, 17 nt, Staphylococcus aureus subsp. aureus MW2
auuucuacagacaaugc

SEQ ID NO: 2101904 - RNA, 20 nt, Staphylococcus aureus subsp. aureus MW2
auuucuaauuuaguaucuau

SEQ ID NO: 2101905 - RNA, 12 nt, Staphylococcus aureus subsp. aureus MW2
cacaaaugaaug

SEQ ID NO: 2101906 - RNA, 16 nt, Staphylococcus aureus subsp. aureus MW2
cacaaaguauuugaag

SEQ ID NO: 2101907 - RNA, 21 nt, Staphylococcus aureus subsp. aureus MW2
cacaacaaucacgauuaaugu

SEQ ID NO: 2101908 - RNA, 14 nt, Staphylococcus aureus subsp. aureus MW2
cacaacaaugaauc

SEQ ID NO: 2101909 - RNA, 14 nt, Staphylococcus aureus subsp. aureus MW2
cacaacacauaaau

SEQ ID NO: 2101910 - RNA, 20 nt, Staphylococcus aureus subsp. aureus MW2
cacaaugccuuuaaagcaca

SEQ ID NO: 2101911 - RNA, 17 nt, Staphylococcus aureus subsp. aureus MW2
cacaacacauaaauuaa

SEQ ID NO: 2101912 - RNA, 15 nt, Staphylococcus aureus subsp. aureus MW2
cacaauuguauaaug

SEQ ID NO: 2101913 - RNA, 18 nt, Staphylococcus aureus subsp. aureus MW2
cacagacguuuuugaauc

SEQ ID NO: 2101914 - RNA, 14 nt, Staphylococcus aureus subsp. aureus MW2
cacaguacaaauaa

SEQ ID NO: 2101915 - RNA, 21 nt, Staphylococcus aureus subsp. aureus MW2
caauuuuuucaugauuuacua

SEQ ID NO: 2101916 - RNA, 15 nt, Staphylococcus aureus subsp. aureus MW2
caauuuuuucaucuu

SEQ ID NO: 2101917 - RNA, 14 nt, Staphylococcus aureus subsp. aureus MW2
cacaaaaaugaaga

SEQ ID NO: 2101918 - RNA, 19 nt, Staphylococcus aureus subsp. aureus MW2
cacaaagauauguuuauau

SEQ ID NO: 2101919 - RNA, 12 nt, Staphylococcus aureus subsp. aureus MW2
caauuuaaauaa

SEQ ID NO: 2101920 - RNA, 13 nt, Staphylococcus aureus subsp. aureus MW2
caauuuaaauaag

SEQ ID NO: 2101921 - RNA, 17 nt, Staphylococcus aureus subsp. aureus MW2
caauuuauaaugauuaa

SEQ ID NO: 2101922 - RNA, 15 nt, Staphylococcus aureus subsp. aureus MW2
caauuuuaucugaau

SEQ ID NO: 2101923 - RNA, 15 nt, Staphylococcus aureus subsp. aureus MW2
caauuuuagacuaca

SEQ ID NO: 2101924 - RNA, 23 nt, Staphylococcus aureus subsp. aureus MW2
caauuuuaccuucgcauacuuuu

SEQ ID NO: 2101925 - RNA, 13 nt, Staphylococcus aureus subsp. aureus MW2
caauuuuaccaug

SEQ ID NO: 2101926 - RNA, 22 nt, Staphylococcus aureus subsp. aureus MW2
caauuuguccuucgcuaugacc

SEQ ID NO: 2101927 - RNA, 23 nt, Staphylococcus aureus subsp. aureus MW2
caauuuuuaaaaaccuagggaua

SEQ ID NO: 2101928 - RNA, 15 nt, Staphylococcus aureus subsp. aureus MW2
caauuuuuaaaaacc

SEQ ID NO: 2101929 - RNA, 16 nt, Staphylococcus aureus subsp. aureus MW2
caauguuuaauuuucu

SEQ ID NO: 2101930 - RNA, 17 nt, Staphylococcus aureus subsp. aureus MW2
caauguuuaauuuucua

SEQ ID NO: 2101931 - RNA, 17 nt, Staphylococcus aureus subsp. aureus MW2
caauuaaugauaaaccg

SEQ ID NO: 2101932 - RNA, 16 nt, Staphylococcus aureus subsp. aureus MW2
caauuaaugcaucagu

SEQ ID NO: 2101933 - RNA, 19 nt, Staphylococcus aureus subsp. aureus MW2
caauuauugaaaacaaaaa

SEQ ID NO: 2101934 - RNA, 17 nt, Staphylococcus aureus subsp. aureus MW2
caauuaucaacauaaua

SEQ ID NO: 2101935 - RNA, 18 nt, Staphylococcus aureus subsp. aureus MW2
caauuaucaacauaauau

SEQ ID NO: 2101936 - RNA, 18 nt, Staphylococcus aureus subsp. aureus MW2
caauuauuauugcuguga

SEQ ID NO: 2101937 - RNA, 17 nt, Staphylococcus aureus subsp. aureus MW2
caauuauaaaugauuaa

SEQ ID NO: 2101938 - RNA, 23 nt, Staphylococcus aureus subsp. aureus MW2
caauucaauguaucaccuaauug

SEQ ID NO: 2101939 - RNA, 16 nt, Staphylococcus aureus subsp. aureus MW2
caauucacuuauacau

SEQ ID NO: 2101940 - RNA, 22 nt, Staphylococcus aureus subsp. aureus MW2
caauucauuaauaggauuauua

SEQ ID NO: 2101941 - RNA, 13 nt, Staphylococcus aureus subsp. aureus MW2
caauucauaagaa

SEQ ID NO: 2101942 - RNA, 15 nt, Staphylococcus aureus subsp. aureus MW2
caauucauaagaaaa

SEQ ID NO: 2101943 - RNA, 13 nt, Staphylococcus aureus subsp. aureus MW2
cacaugaauuuua

SEQ ID NO: 2101944 - RNA, 21 nt, Staphylococcus aureus subsp. aureus MW2
cacaucuuuagcuauuuaaaa

SEQ ID NO: 2101945 - RNA, 19 nt, Staphylococcus aureus subsp. aureus MW2
cacaguuucaucuucaacu

SEQ ID NO: 2101946 - RNA, 12 nt, Staphylococcus aureus subsp. aureus MW2
cacauaaaucaa

SEQ ID NO: 2101947 - RNA, 18 nt, Staphylococcus aureus subsp. aureus MW2
cacauuuacuuaagaacu

SEQ ID NO: 2101948 - RNA, 23 nt, Staphylococcus aureus subsp. aureus MW2
cacauguacguuuuuuuaaauac

SEQ ID NO: 2101949 - RNA, 12 nt, Staphylococcus aureus subsp. aureus MW2
cacaugugaaau

SEQ ID NO: 2101950 - RNA, 23 nt, Staphylococcus aureus subsp. aureus MW2
cacauugcaacgucccaacaaca

SEQ ID NO: 2101951 - RNA, 19 nt, Staphylococcus aureus subsp. aureus MW2
caccaauuaggauucgauu

SEQ ID NO: 2101952 - RNA, 16 nt, Staphylococcus aureus subsp. aureus MW2
caccaauuaucaacau

SEQ ID NO: 2101953 - RNA, 17 nt, Staphylococcus aureus subsp. aureus MW2
caccauacuaaaacaug

SEQ ID NO: 2101954 - RNA, 16 nt, Staphylococcus aureus subsp. aureus MW2
caccauacuaaaacau

SEQ ID NO: 2101955 - RNA, 12 nt, Staphylococcus aureus subsp. aureus MW2
aaaauaaaaaau

SEQ ID NO: 2101956 - RNA, 20 nt, Staphylococcus aureus subsp. aureus MW2
caccagcucguuuuuugauu

SEQ ID NO: 2101957 - RNA, 13 nt, Staphylococcus aureus subsp. aureus MW2
aaaaguuuaaagu

SEQ ID NO: 2101958 - RNA, 20 nt, Staphylococcus aureus subsp. aureus MW2
aaaaguuaggcgacuuaacu

SEQ ID NO: 2101959 - RNA, 16 nt, Staphylococcus aureus subsp. aureus MW2
caccagaacaauucaa

SEQ ID NO: 2101960 - RNA, 18 nt, Staphylococcus aureus subsp. aureus MW2
caccauuuacuucauaag

SEQ ID NO: 2101961 - RNA, 19 nt, Staphylococcus aureus subsp. aureus MW2
caccauuuacuucauaagu

SEQ ID NO: 2101962 - RNA, 21 nt, Staphylococcus aureus subsp. aureus MW2
cacccaauaauugcugucacu

SEQ ID NO: 2101963 - RNA, 14 nt, Staphylococcus aureus subsp. aureus MW2
caccccuucucuaa

SEQ ID NO: 2101964 - RNA, 18 nt, Staphylococcus aureus subsp. aureus MW2
caccucuaaguucaccua

SEQ ID NO: 2101965 - RNA, 17 nt, Staphylococcus aureus subsp. aureus MW2
caccucuaaguucaccu

SEQ ID NO: 2101966 - RNA, 20 nt, Staphylococcus aureus subsp. aureus MW2
caccugcaauuuguaauaca

SEQ ID NO: 2101967 - RNA, 15 nt, Staphylococcus aureus subsp. aureus MW2
caccugcagcauccu

SEQ ID NO: 2101968 - RNA, 22 nt, Staphylococcus aureus subsp. aureus MW2
caccguggaauuuaccauuuuc

SEQ ID NO: 2101969 - RNA, 19 nt, Staphylococcus aureus subsp. aureus MW2
aaaauaacugcuaauuuuu

SEQ ID NO: 2101970 - RNA, 15 nt, Staphylococcus aureus subsp. aureus MW2
aaaauaaguguuguu

SEQ ID NO: 2101971 - RNA, 23 nt, Staphylococcus aureus subsp. aureus MW2
cacgauauaacauuaaaaugaua

SEQ ID NO: 2101972 - RNA, 21 nt, Staphylococcus aureus subsp. aureus MW2
caccuuuaucuguaucaaagu

SEQ ID NO: 2101973 - RNA, 18 nt, Staphylococcus aureus subsp. aureus MW2
caccuuuauuaccagcuu

SEQ ID NO: 2101974 - RNA, 12 nt, Staphylococcus aureus subsp. aureus MW2
caccuuuaggaa

SEQ ID NO: 2101975 - RNA, 19 nt, Staphylococcus aureus subsp. aureus MW2
aaaauacucccuucaacau

SEQ ID NO: 2101976 - RNA, 16 nt, Staphylococcus aureus subsp. aureus MW2
aaaauacuguuuucau

SEQ ID NO: 2101977 - RNA, 18 nt, Staphylococcus aureus subsp. aureus MW2
aaaauacuguuuucauuu

SEQ ID NO: 2101978 - RNA, 19 nt, Staphylococcus aureus subsp. aureus MW2
caccuuuuuuaacuuuaac

SEQ ID NO: 2101979 - RNA, 18 nt, Staphylococcus aureus subsp. aureus MW2
aaaauaucaauuuauuau

SEQ ID NO: 2101980 - RNA, 15 nt, Staphylococcus aureus subsp. aureus MW2
aaaauauagcuauua

SEQ ID NO: 2101981 - RNA, 20 nt, Staphylococcus aureus subsp. aureus MW2
aaaauaucaaaauauaaaau

SEQ ID NO: 2101982 - RNA, 14 nt, Staphylococcus aureus subsp. aureus MW2
aaaauauauuauaa

SEQ ID NO: 2101983 - RNA, 16 nt, Staphylococcus aureus subsp. aureus MW2
aaaauauauuauaaaa

SEQ ID NO: 2101984 - RNA, 17 nt, Staphylococcus aureus subsp. aureus MW2
aaaauauauuauaaaaa

SEQ ID NO: 2101985 - RNA, 19 nt, Staphylococcus aureus subsp. aureus MW2
aaaauauauuauaaaaaua

SEQ ID NO: 2101986 - RNA, 13 nt, Staphylococcus aureus subsp. aureus MW2
cacggucccaaga

SEQ ID NO: 2101987 - RNA, 15 nt, Staphylococcus aureus subsp. aureus MW2
aaaauagcuauuaaa

SEQ ID NO: 2101988 - RNA, 15 nt, Staphylococcus aureus subsp. aureus MW2
cacguacaaaauaau

SEQ ID NO: 2101989 - RNA, 12 nt, Staphylococcus aureus subsp. aureus MW2
cacguaaaauau

SEQ ID NO: 2101990 - RNA, 17 nt, Staphylococcus aureus subsp. aureus MW2
caaaauugaacuuugua

SEQ ID NO: 2101991 - RNA, 16 nt, Staphylococcus aureus subsp. aureus MW2
caaaaugaugaaaauc

SEQ ID NO: 2101992 - RNA, 12 nt, Staphylococcus aureus subsp. aureus MW2
caaaauugucuc

SEQ ID NO: 2101993 - RNA, 17 nt, Staphylococcus aureus subsp. aureus MW2
caaaauuugaaauauac

SEQ ID NO: 2101994 - RNA, 23 nt, Staphylococcus aureus subsp. aureus MW2
caaaauuugaaauauaccaacca

SEQ ID NO: 2101995 - RNA, 18 nt, Staphylococcus aureus subsp. aureus MW2
caaaauuuugacuauucu

SEQ ID NO: 2101996 - RNA, 15 nt, Staphylococcus aureus subsp. aureus MW2
caaaauuuugcaaaa

SEQ ID NO: 2101997 - RNA, 24 nt, Staphylococcus aureus subsp. aureus MW2
caaacacaguacaaauaacaaaca

SEQ ID NO: 2101998 - RNA, 15 nt, Staphylococcus aureus subsp. aureus MW2
caaaaugauugguaa

SEQ ID NO: 2101999 - RNA, 22 nt, Staphylococcus aureus subsp. aureus MW2
caaaaccgcuauaaaauuuuga

SEQ ID NO: 2102000 - RNA, 20 nt, Staphylococcus aureus subsp. aureus MW2
caaaaccgcuauaaaauuuu

SEQ ID NO: 2102001 - RNA, 14 nt, Staphylococcus aureus subsp. aureus MW2
caaaaccaaaugaa

SEQ ID NO: 2102002 - RNA, 21 nt, Staphylococcus aureus subsp. aureus MW2
caaaaucaccuuuuuuaacuu

SEQ ID NO: 2102003 - RNA, 17 nt, Staphylococcus aureus subsp. aureus MW2
caaacgcguuauagaua

SEQ ID NO: 2102004 - RNA, 13 nt, Staphylococcus aureus subsp. aureus MW2
caaacauaaucau

SEQ ID NO: 2102005 - RNA, 14 nt, Staphylococcus aureus subsp. aureus MW2
caaacauagagaau

SEQ ID NO: 2102006 - RNA, 17 nt, Staphylococcus aureus subsp. aureus MW2
caaacauagagaauuuc

SEQ ID NO: 2102007 - RNA, 23 nt, Staphylococcus aureus subsp. aureus MW2
caaagguuuacuauuaaaggaaa

SEQ ID NO: 2102008 - RNA, 20 nt, Staphylococcus aureus subsp. aureus MW2
caaagcuuguaaucauacca

SEQ ID NO: 2102009 - RNA, 22 nt, Staphylococcus aureus subsp. aureus MW2
caaaguaacauaugcaaguaua

SEQ ID NO: 2102010 - RNA, 19 nt, Staphylococcus aureus subsp. aureus MW2
caaaguuuauacuuaauau

SEQ ID NO: 2102011 - RNA, 18 nt, Staphylococcus aureus subsp. aureus MW2
caaauaaaaaaaccguua

SEQ ID NO: 2102012 - RNA, 19 nt, Staphylococcus aureus subsp. aureus MW2
caaauaaacacaucuaugu

SEQ ID NO: 2102013 - RNA, 17 nt, Staphylococcus aureus subsp. aureus MW2
caaauaaacacaucuau

SEQ ID NO: 2102014 - RNA, 19 nt, Staphylococcus aureus subsp. aureus MW2
caaauaaaacgcuucauau

SEQ ID NO: 2102015 - RNA, 12 nt, Staphylococcus aureus subsp. aureus MW2
caaauaaaauca

SEQ ID NO: 2102016 - RNA, 13 nt, Staphylococcus aureus subsp. aureus MW2
caaauaauauaaa

SEQ ID NO: 2102017 - RNA, 18 nt, Staphylococcus aureus subsp. aureus MW2
caaauaaggaauguauuu

SEQ ID NO: 2102018 - RNA, 20 nt, Staphylococcus aureus subsp. aureus MW2
caaauaaggaauguauuuuu

SEQ ID NO: 2102019 - RNA, 15 nt, Staphylococcus aureus subsp. aureus MW2
caaauaaauuuugac

SEQ ID NO: 2102020 - RNA, 15 nt, Staphylococcus aureus subsp. aureus MW2
caaauaacaaacauu

SEQ ID NO: 2102021 - RNA, 15 nt, Staphylococcus aureus subsp. aureus MW2
caaauaaauguccga

SEQ ID NO: 2102022 - RNA, 18 nt, Staphylococcus aureus subsp. aureus MW2
caaauaaaucaaacuuuu

SEQ ID NO: 2102023 - RNA, 18 nt, Staphylococcus aureus subsp. aureus MW2
caaauacuaguaauaaua

SEQ ID NO: 2102024 - RNA, 15 nt, Staphylococcus aureus subsp. aureus MW2
caaauacaucaauuu

SEQ ID NO: 2102025 - RNA, 17 nt, Staphylococcus aureus subsp. aureus MW2
caaauacaucaauuucu

SEQ ID NO: 2102026 - RNA, 18 nt, Staphylococcus aureus subsp. aureus MW2
caaauacaguuaucaccg

SEQ ID NO: 2102027 - RNA, 17 nt, Staphylococcus aureus subsp. aureus MW2
caaagaggcuuuaaaau

SEQ ID NO: 2102028 - RNA, 17 nt, Staphylococcus aureus subsp. aureus MW2
caaagauacaccaauau

SEQ ID NO: 2102029 - RNA, 16 nt, Staphylococcus aureus subsp. aureus MW2
caaagcuugauuuaac

SEQ ID NO: 2102030 - RNA, 19 nt, Staphylococcus aureus subsp. aureus MW2
caaagcaucuaauccccaa

SEQ ID NO: 2102031 - RNA, 18 nt, Staphylococcus aureus subsp. aureus MW2
caaauagcgauuuuaaag

SEQ ID NO: 2102032 - RNA, 16 nt, Staphylococcus aureus subsp. aureus MW2
caaauuacaaauuauc

SEQ ID NO: 2102033 - RNA, 10 nt, Staphylococcus aureus subsp. aureus MW2
caaaugcuua

SEQ ID NO: 2102034 - RNA, 18 nt, Staphylococcus aureus subsp. aureus MW2
caaaugcuuaauaaaauc

SEQ ID NO: 2102035 - RNA, 23 nt, Staphylococcus aureus subsp. aureus MW2
caaauuauaauuguaaugcuucu

SEQ ID NO: 2102036 - RNA, 18 nt, Staphylococcus aureus subsp. aureus MW2
caaauuagauaaaacaaa

SEQ ID NO: 2102037 - RNA, 20 nt, Staphylococcus aureus subsp. aureus MW2
caaauuacacccuuuaaauu

SEQ ID NO: 2102038 - RNA, 16 nt, Staphylococcus aureus subsp. aureus MW2
caaauugccuuucauu

SEQ ID NO: 2102039 - RNA, 17 nt, Staphylococcus aureus subsp. aureus MW2
caaauugccuuucauuu

SEQ ID NO: 2102040 - RNA, 21 nt, Staphylococcus aureus subsp. aureus MW2
caaauugcaauggcaaccuuu

SEQ ID NO: 2102041 - RNA, 13 nt, Staphylococcus aureus subsp. aureus MW2
caaauugcaaugg

SEQ ID NO: 2102042 - RNA, 17 nt, Staphylococcus aureus subsp. aureus MW2
caaauugacgcauuaau

SEQ ID NO: 2102043 - RNA, 15 nt, Staphylococcus aureus subsp. aureus MW2
caaauugaaauuauc

SEQ ID NO: 2102044 - RNA, 12 nt, Staphylococcus aureus subsp. aureus MW2
caaauucaaauu

SEQ ID NO: 2102045 - RNA, 22 nt, Staphylococcus aureus subsp. aureus MW2
caaauuuugaguauuugccuuu

SEQ ID NO: 2102046 - RNA, 15 nt, Staphylococcus aureus subsp. aureus MW2
caacaauaaaucuuu

SEQ ID NO: 2102047 - RNA, 16 nt, Staphylococcus aureus subsp. aureus MW2
caacaauauaaaagca

SEQ ID NO: 2102048 - RNA, 15 nt, Staphylococcus aureus subsp. aureus MW2
caacaacuaagauau

SEQ ID NO: 2102049 - RNA, 19 nt, Staphylococcus aureus subsp. aureus MW2
caacaacuaagauauauug

SEQ ID NO: 2102050 - RNA, 12 nt, Staphylococcus aureus subsp. aureus MW2
caacaauuugca

SEQ ID NO: 2102051 - RNA, 13 nt, Staphylococcus aureus subsp. aureus MW2
caacacagagaau

SEQ ID NO: 2102052 - RNA, 19 nt, Staphylococcus aureus subsp. aureus MW2
caacacagagaauuucgaa

SEQ ID NO: 2102053 - RNA, 13 nt, Staphylococcus aureus subsp. aureus MW2
caacacagaagcu

SEQ ID NO: 2102054 - RNA, 17 nt, Staphylococcus aureus subsp. aureus MW2
caacacagaagcuggcg

SEQ ID NO: 2102055 - RNA, 10 nt, Staphylococcus aureus subsp. aureus MW2
caacacagag

SEQ ID NO: 2102056 - RNA, 10 nt, Staphylococcus aureus subsp. aureus MW2
caacacagaa

SEQ ID NO: 2102057 - RNA, 22 nt, Staphylococcus aureus subsp. aureus MW2
caacaauugguuguuucaauuc

SEQ ID NO: 2102058 - RNA, 17 nt, Staphylococcus aureus subsp. aureus MW2
caacacguuuuaagcca

SEQ ID NO: 2102059 - RNA, 22 nt, Staphylococcus aureus subsp. aureus MW2
caaccuguucuuuauuuaaagg

SEQ ID NO: 2102060 - RNA, 17 nt, Staphylococcus aureus subsp. aureus MW2
caaccugugauaaaaau

SEQ ID NO: 2102061 - RNA, 18 nt, Staphylococcus aureus subsp. aureus MW2
caaccugugauaaaaauc

SEQ ID NO: 2102062 - RNA, 16 nt, Staphylococcus aureus subsp. aureus MW2
caaccuuugcuaaauc

SEQ ID NO: 2102063 - RNA, 17 nt, Staphylococcus aureus subsp. aureus MW2
caaccuuugcuaaauca

SEQ ID NO: 2102064 - RNA, 14 nt, Staphylococcus aureus subsp. aureus MW2
caacaucaaaaccc

SEQ ID NO: 2102065 - RNA, 15 nt, Staphylococcus aureus subsp. aureus MW2
caacauauaaaucau

SEQ ID NO: 2102066 - RNA, 12 nt, Staphylococcus aureus subsp. aureus MW2
caacauaucaua

SEQ ID NO: 2102067 - RNA, 13 nt, Staphylococcus aureus subsp. aureus MW2
caacauagaagcu

SEQ ID NO: 2102068 - RNA, 13 nt, Staphylococcus aureus subsp. aureus MW2
caaccaaaaccaa

SEQ ID NO: 2102069 - RNA, 13 nt, Staphylococcus aureus subsp. aureus MW2
caauauucucuuu

SEQ ID NO: 2102070 - RNA, 14 nt, Staphylococcus aureus subsp. aureus MW2
caauauucucuuua

SEQ ID NO: 2102071 - RNA, 20 nt, Staphylococcus aureus subsp. aureus MW2
caauauuuauauuaaauacu

SEQ ID NO: 2102072 - RNA, 21 nt, Staphylococcus aureus subsp. aureus MW2
caauauugucuucauuaacau

SEQ ID NO: 2102073 - RNA, 20 nt, Staphylococcus aureus subsp. aureus MW2
caaucaucgcaaaaacauaa

SEQ ID NO: 2102074 - RNA, 18 nt, Staphylococcus aureus subsp. aureus MW2
caaucauuguaaaugauc

SEQ ID NO: 2102075 - RNA, 17 nt, Staphylococcus aureus subsp. aureus MW2
caaugauaccuuuaaau

SEQ ID NO: 2102076 - RNA, 22 nt, Staphylococcus aureus subsp. aureus MW2
caaugaugggaaaucaguaaua

SEQ ID NO: 2102077 - RNA, 15 nt, Staphylococcus aureus subsp. aureus MW2
caaugauuuuuaaaa

SEQ ID NO: 2102078 - RNA, 12 nt, Staphylococcus aureus subsp. aureus MW2
caaucuuuuuaa

SEQ ID NO: 2102079 - RNA, 19 nt, Staphylococcus aureus subsp. aureus MW2
caaugcaaguuggcggggc

SEQ ID NO: 2102080 - RNA, 14 nt, Staphylococcus aureus subsp. aureus MW2
caaugcaaguuggg

SEQ ID NO: 2102081 - RNA, 20 nt, Staphylococcus aureus subsp. aureus MW2
caaugcauaaaaccuucaau

SEQ ID NO: 2102082 - RNA, 20 nt, Staphylococcus aureus subsp. aureus MW2
caaugccacaucauagcacu

SEQ ID NO: 2102083 - RNA, 18 nt, Staphylococcus aureus subsp. aureus MW2
caaguaacucaagugauu

SEQ ID NO: 2102084 - RNA, 13 nt, Staphylococcus aureus subsp. aureus MW2
caaguaaauguuu

SEQ ID NO: 2102085 - RNA, 14 nt, Staphylococcus aureus subsp. aureus MW2
caaguaauucuuua

SEQ ID NO: 2102086 - RNA, 16 nt, Staphylococcus aureus subsp. aureus MW2
caaguaauucuuuacc

SEQ ID NO: 2102087 - RNA, 14 nt, Staphylococcus aureus subsp. aureus MW2
caauaaaucuuucc

SEQ ID NO: 2102088 - RNA, 15 nt, Staphylococcus aureus subsp. aureus MW2
caauaaauuaugaaa

SEQ ID NO: 2102089 - RNA, 15 nt, Staphylococcus aureus subsp. aureus MW2
caauaaauuuuauau

SEQ ID NO: 2102090 - RNA, 14 nt, Staphylococcus aureus subsp. aureus MW2
caauaaauuuuuaa

SEQ ID NO: 2102091 - RNA, 23 nt, Staphylococcus aureus subsp. aureus MW2
caauaaauuucaagguauacaca

SEQ ID NO: 2102092 - RNA, 22 nt, Staphylococcus aureus subsp. aureus MW2
caaguugcugaauaaaauauau

SEQ ID NO: 2102093 - RNA, 22 nt, Staphylococcus aureus subsp. aureus MW2
caaguuggcggggcccaaacau

SEQ ID NO: 2102094 - RNA, 17 nt, Staphylococcus aureus subsp. aureus MW2
caaguuggcggggcccc

SEQ ID NO: 2102095 - RNA, 19 nt, Staphylococcus aureus subsp. aureus MW2
caaguugcugaauaaaaua

SEQ ID NO: 2102096 - RNA, 17 nt, Staphylococcus aureus subsp. aureus MW2
caaguugcacauuauaa

SEQ ID NO: 2102097 - RNA, 13 nt, Staphylococcus aureus subsp. aureus MW2
caaguuuaaaaua

SEQ ID NO: 2102098 - RNA, 15 nt, Staphylococcus aureus subsp. aureus MW2
caaguuuaaaauacg

SEQ ID NO: 2102099 - RNA, 22 nt, Staphylococcus aureus subsp. aureus MW2
caaguuggggaugggccccaac

SEQ ID NO: 2102100 - RNA, 19 nt, Staphylococcus aureus subsp. aureus MW2
caauaacagcuacaaauaa

SEQ ID NO: 2102101 - RNA, 20 nt, Staphylococcus aureus subsp. aureus MW2
caauaacagcuacaaauaau

SEQ ID NO: 2102102 - RNA, 15 nt, Staphylococcus aureus subsp. aureus MW2
caauaauugaugaaa

SEQ ID NO: 2102103 - RNA, 18 nt, Staphylococcus aureus subsp. aureus MW2
caauaaugugcaaguugg

SEQ ID NO: 2102104 - RNA, 19 nt, Staphylococcus aureus subsp. aureus MW2
caauaaugugcaaguuggc

SEQ ID NO: 2102105 - RNA, 22 nt, Staphylococcus aureus subsp. aureus MW2
caauaaugugcaaguuggcggg

SEQ ID NO: 2102106 - RNA, 12 nt, Staphylococcus aureus subsp. aureus MW2
caauauuacuuu

SEQ ID NO: 2102107 - RNA, 13 nt, Staphylococcus aureus subsp. aureus MW2
caauauuaaaaua

SEQ ID NO: 2102108 - RNA, 13 nt, Staphylococcus aureus subsp. aureus MW2
caauauuaaaauu

SEQ ID NO: 2102109 - RNA, 21 nt, Staphylococcus aureus subsp. aureus MW2
caauauguggcgcucuuauaa

SEQ ID NO: 2102110 - RNA, 21 nt, Staphylococcus aureus subsp. aureus MW2
caauauaauauauacaaauaa

SEQ ID NO: 2102111 - RNA, 21 nt, Staphylococcus aureus subsp. aureus MW2
caauauguaacaaacaagcua

SEQ ID NO: 2102112 - RNA, 15 nt, Staphylococcus aureus subsp. aureus MW2
caauauaacauugca

SEQ ID NO: 2102113 - RNA, 17 nt, Staphylococcus aureus subsp. aureus MW2
caauagguacaacuaaa

SEQ ID NO: 2102114 - RNA, 14 nt, Staphylococcus aureus subsp. aureus MW2
caauauaaaagcac

SEQ ID NO: 2102115 - RNA, 15 nt, Staphylococcus aureus subsp. aureus MW2
caauauaaaagcacu

SEQ ID NO: 2102116 - RNA, 17 nt, Staphylococcus aureus subsp. aureus MW2
caauauaaaagcacuau

SEQ ID NO: 2102117 - RNA, 19 nt, Staphylococcus aureus subsp. aureus MW2
caauauaaaagcacuauuu

SEQ ID NO: 2102118 - RNA, 16 nt, Staphylococcus aureus subsp. aureus MW2
caauaguauaaauauc

SEQ ID NO: 2102119 - RNA, 17 nt, Staphylococcus aureus subsp. aureus MW2
caauaccauaauuaaau

SEQ ID NO: 2102120 - RNA, 16 nt, Staphylococcus aureus subsp. aureus MW2
caauaccgaauaauuu

SEQ ID NO: 2102121 - RNA, 21 nt, Staphylococcus aureus subsp. aureus MW2
caauacuacuguugacauuug

SEQ ID NO: 2102122 - RNA, 13 nt, Staphylococcus aureus subsp. aureus MW2
caauacuuuuuau

SEQ ID NO: 2102123 - RNA, 13 nt, Staphylococcus aureus subsp. aureus MW2
caagcaaucuuag

SEQ ID NO: 2102124 - RNA, 15 nt, Staphylococcus aureus subsp. aureus MW2
caagagguuuuauuu

SEQ ID NO: 2102125 - RNA, 21 nt, Staphylococcus aureus subsp. aureus MW2
caagagguaaaucuguuuaaa

SEQ ID NO: 2102126 - RNA, 22 nt, Staphylococcus aureus subsp. aureus MW2
caagagccuuguuggcuuuuuu

SEQ ID NO: 2102127 - RNA, 21 nt, Staphylococcus aureus subsp. aureus MW2
caagcuuugcugcuuuuccau

SEQ ID NO: 2102128 - RNA, 13 nt, Staphylococcus aureus subsp. aureus MW2
caacuugucuacc

SEQ ID NO: 2102129 - RNA, 15 nt, Staphylococcus aureus subsp. aureus MW2
caacuuuacgauaaa

SEQ ID NO: 2102130 - RNA, 17 nt, Staphylococcus aureus subsp. aureus MW2
caacuuuacgauaaaua

SEQ ID NO: 2102131 - RNA, 21 nt, Staphylococcus aureus subsp. aureus MW2
caacuuuauaaccuaaagcug

SEQ ID NO: 2102132 - RNA, 22 nt, Staphylococcus aureus subsp. aureus MW2
caacuuuaaucaaaaagacuca

SEQ ID NO: 2102133 - RNA, 21 nt, Staphylococcus aureus subsp. aureus MW2
caacuuuagcauauucgcuua

SEQ ID NO: 2102134 - RNA, 18 nt, Staphylococcus aureus subsp. aureus MW2
caacuuaauacgauaaua

SEQ ID NO: 2102135 - RNA, 23 nt, Staphylococcus aureus subsp. aureus MW2
caacuucuucuccguauuuaccu

SEQ ID NO: 2102136 - RNA, 19 nt, Staphylococcus aureus subsp. aureus MW2
caacuugcacauuauugua

SEQ ID NO: 2102137 - RNA, 21 nt, Staphylococcus aureus subsp. aureus MW2
caacuugcacauuauuguaac

SEQ ID NO: 2102138 - RNA, 12 nt, Staphylococcus aureus subsp. aureus MW2
caacuucuuuug

SEQ ID NO: 2102139 - RNA, 22 nt, Staphylococcus aureus subsp. aureus MW2
caacuuuuuaauaauacuucua

SEQ ID NO: 2102140 - RNA, 12 nt, Staphylococcus aureus subsp. aureus MW2
caacuuucucua

SEQ ID NO: 2102141 - RNA, 19 nt, Staphylococcus aureus subsp. aureus MW2
caacuuuuuuaacuuuaac

SEQ ID NO: 2102142 - RNA, 19 nt, Staphylococcus aureus subsp. aureus MW2
caagaaacaauucauuaau

SEQ ID NO: 2102143 - RNA, 20 nt, Staphylococcus aureus subsp. aureus MW2
caagaaacaauucauuaaua

SEQ ID NO: 2102144 - RNA, 12 nt, Staphylococcus aureus subsp. aureus MW2
caagaaaacuaa

SEQ ID NO: 2102145 - RNA, 14 nt, Staphylococcus aureus subsp. aureus MW2
caagaacuuuaaaa

SEQ ID NO: 2102146 - RNA, 17 nt, Staphylococcus aureus subsp. aureus MW2
caagacucccuuuuuaa

SEQ ID NO: 2102147 - RNA, 14 nt, Staphylococcus aureus subsp. aureus MW2
caagacgaacauca

SEQ ID NO: 2102148 - RNA, 14 nt, Staphylococcus aureus subsp. aureus MW2
caacuaaauuuucu

SEQ ID NO: 2102149 - RNA, 21 nt, Staphylococcus aureus subsp. aureus MW2
caacuaaguugacuauauaau

SEQ ID NO: 2102150 - RNA, 17 nt, Staphylococcus aureus subsp. aureus MW2
caacuaauaacaaauag

SEQ ID NO: 2102151 - RNA, 20 nt, Staphylococcus aureus subsp. aureus MW2
caacuaauuuaaagcaucau

SEQ ID NO: 2102152 - RNA, 21 nt, Staphylococcus aureus subsp. aureus MW2
caacuacugcuaaaauaaaau

SEQ ID NO: 2102153 - RNA, 17 nt, Staphylococcus aureus subsp. aureus MW2
caacugaucauuuucau

SEQ ID NO: 2102154 - RNA, 19 nt, Staphylococcus aureus subsp. aureus MW2
caacugauaauugaugugc

SEQ ID NO: 2102155 - RNA, 16 nt, Staphylococcus aureus subsp. aureus MW2
caacugaugaaaaggu

SEQ ID NO: 2102156 - RNA, 14 nt, Staphylococcus aureus subsp. aureus MW2
caacugcauauaaa

SEQ ID NO: 2102157 - RNA, 19 nt, Staphylococcus aureus subsp. aureus MW2
caacugcauauaaagucau

SEQ ID NO: 2102158 - RNA, 21 nt, Staphylococcus aureus subsp. aureus MW2
caacuuaaauaucgacaaauu

SEQ ID NO: 2102159 - RNA, 22 nt, Staphylococcus aureus subsp. aureus MW2
caacuuaauaaccauguaaaau

SEQ ID NO: 2102160 - RNA, 20 nt, Staphylococcus aureus subsp. aureus MW2
caacuguaaaugaaauggua

SEQ ID NO: 2102161 - RNA, 12 nt, Staphylococcus aureus subsp. aureus MW2
cagcgaaauuug

SEQ ID NO: 2102162 - RNA, 16 nt, Staphylococcus aureus subsp. aureus MW2
cagcaguaagauauuu

SEQ ID NO: 2102163 - RNA, 19 nt, Staphylococcus aureus subsp. aureus MW2
cagcagugaaguuaacuau

SEQ ID NO: 2102164 - RNA, 16 nt, Staphylococcus aureus subsp. aureus MW2
cagcaguugcacaaau

SEQ ID NO: 2102165 - RNA, 13 nt, Staphylococcus aureus subsp. aureus MW2
cagcauacaauaa

SEQ ID NO: 2102166 - RNA, 15 nt, Staphylococcus aureus subsp. aureus MW2
cagcauacaauaaug

SEQ ID NO: 2102167 - RNA, 17 nt, Staphylococcus aureus subsp. aureus MW2
cagcauugggacauaaa

SEQ ID NO: 2102168 - RNA, 12 nt, Staphylococcus aureus subsp. aureus MW2
cagcauuuaagu

SEQ ID NO: 2102169 - RNA, 20 nt, Staphylococcus aureus subsp. aureus MW2
cagcauuaaucguauuuuua

SEQ ID NO: 2102170 - RNA, 17 nt, Staphylococcus aureus subsp. aureus MW2
aaaauggcaucuggcaa

SEQ ID NO: 2102171 - RNA, 18 nt, Staphylococcus aureus subsp. aureus MW2
cagauaagaauauuuaag

SEQ ID NO: 2102172 - RNA, 16 nt, Staphylococcus aureus subsp. aureus MW2
cagauaagaauauuua

SEQ ID NO: 2102173 - RNA, 16 nt, Staphylococcus aureus subsp. aureus MW2
cagaugaaccaaaaaa

SEQ ID NO: 2102174 - RNA, 12 nt, Staphylococcus aureus subsp. aureus MW2
aaaaucuuuacu

SEQ ID NO: 2102175 - RNA, 13 nt, Staphylococcus aureus subsp. aureus MW2
cagauuuuauuaa

SEQ ID NO: 2102176 - RNA, 22 nt, Staphylococcus aureus subsp. aureus MW2
aaaaugaagucuuucaacaaaa

SEQ ID NO: 2102177 - RNA, 16 nt, Staphylococcus aureus subsp. aureus MW2
aaaaugaauaauuacu

SEQ ID NO: 2102178 - RNA, 19 nt, Staphylococcus aureus subsp. aureus MW2
cagauugugacaauuuaaa

SEQ ID NO: 2102179 - RNA, 18 nt, Staphylococcus aureus subsp. aureus MW2
cagauuuauauuccauuu

SEQ ID NO: 2102180 - RNA, 21 nt, Staphylococcus aureus subsp. aureus MW2
cagauuuuaaaaauucauaau

SEQ ID NO: 2102181 - RNA, 15 nt, Staphylococcus aureus subsp. aureus MW2
cagauuuuaaaaauu

SEQ ID NO: 2102182 - RNA, 22 nt, Staphylococcus aureus subsp. aureus MW2
cagauucaaacguuuucacuuc

SEQ ID NO: 2102183 - RNA, 23 nt, Staphylococcus aureus subsp. aureus MW2
cagauguugguucaucaaacaac

SEQ ID NO: 2102184 - RNA, 19 nt, Staphylococcus aureus subsp. aureus MW2
aaaaucugaguauuguuau

SEQ ID NO: 2102185 - RNA, 19 nt, Staphylococcus aureus subsp. aureus MW2
aaaaucaguugcuucauaa

SEQ ID NO: 2102186 - RNA, 23 nt, Staphylococcus aureus subsp. aureus MW2
aaaaucaguugcuucauaaaugu

SEQ ID NO: 2102187 - RNA, 23 nt, Staphylococcus aureus subsp. aureus MW2
aaaaucauuaauaauuaaacaaa

SEQ ID NO: 2102188 - RNA, 16 nt, Staphylococcus aureus subsp. aureus MW2
cagagaauuucgaaaa

SEQ ID NO: 2102189 - RNA, 19 nt, Staphylococcus aureus subsp. aureus MW2
cagagaauuucgaaaagaa

SEQ ID NO: 2102190 - RNA, 15 nt, Staphylococcus aureus subsp. aureus MW2
aaaaucaacuuuucu

SEQ ID NO: 2102191 - RNA, 12 nt, Staphylococcus aureus subsp. aureus MW2
aaaaucaaagag

SEQ ID NO: 2102192 - RNA, 14 nt, Staphylococcus aureus subsp. aureus MW2
aaaaucaaagaggc

SEQ ID NO: 2102193 - RNA, 21 nt, Staphylococcus aureus subsp. aureus MW2
aaaaucaaagaggcuuuaaaa

SEQ ID NO: 2102194 - RNA, 15 nt, Staphylococcus aureus subsp. aureus MW2
aaaauauuuuauuau

SEQ ID NO: 2102195 - RNA, 17 nt, Staphylococcus aureus subsp. aureus MW2
aaaauauuuuauuauaa

SEQ ID NO: 2102196 - RNA, 20 nt, Staphylococcus aureus subsp. aureus MW2
aaaauauuuuauuauaauau

SEQ ID NO: 2102197 - RNA, 22 nt, Staphylococcus aureus subsp. aureus MW2
aaaauauuuuauuauaauaucg

SEQ ID NO: 2102198 - RNA, 15 nt, Staphylococcus aureus subsp. aureus MW2
cagaauuucaucaaa

SEQ ID NO: 2102199 - RNA, 22 nt, Staphylococcus aureus subsp. aureus MW2
cagaauuauuugauuauguaaa

SEQ ID NO: 2102200 - RNA, 23 nt, Staphylococcus aureus subsp. aureus MW2
cagaauuauuugauuauguaaau

SEQ ID NO: 2102201 - RNA, 17 nt, Staphylococcus aureus subsp. aureus MW2
cagacaaugcaaguugg

SEQ ID NO: 2102202 - RNA, 18 nt, Staphylococcus aureus subsp. aureus MW2
cagacaaugcaaguuggg

SEQ ID NO: 2102203 - RNA, 15 nt, Staphylococcus aureus subsp. aureus MW2
cagaaauuuaauauu

SEQ ID NO: 2102204 - RNA, 16 nt, Staphylococcus aureus subsp. aureus MW2
cacuuuuuauacauua

SEQ ID NO: 2102205 - RNA, 14 nt, Staphylococcus aureus subsp. aureus MW2
cagaaaugauauuu

SEQ ID NO: 2102206 - RNA, 20 nt, Staphylococcus aureus subsp. aureus MW2
cacuuuuugacauauuuuuu

SEQ ID NO: 2102207 - RNA, 15 nt, Staphylococcus aureus subsp. aureus MW2
cacuuucuacucuaa

SEQ ID NO: 2102208 - RNA, 20 nt, Staphylococcus aureus subsp. aureus MW2
cacuuucuacucuaauuaca

SEQ ID NO: 2102209 - RNA, 18 nt, Staphylococcus aureus subsp. aureus MW2
cacuuucaaugacaucua

SEQ ID NO: 2102210 - RNA, 18 nt, Staphylococcus aureus subsp. aureus MW2
aaaauuuauucaaaucau

SEQ ID NO: 2102211 - RNA, 14 nt, Staphylococcus aureus subsp. aureus MW2
cagcucguuuuuug

SEQ ID NO: 2102212 - RNA, 17 nt, Staphylococcus aureus subsp. aureus MW2
aaaauugcuaaaaaaau

SEQ ID NO: 2102213 - RNA, 17 nt, Staphylococcus aureus subsp. aureus MW2
aaaauugcuauauuagu

SEQ ID NO: 2102214 - RNA, 15 nt, Staphylococcus aureus subsp. aureus MW2
aaaauugcuaaaaaa

SEQ ID NO: 2102215 - RNA, 17 nt, Staphylococcus aureus subsp. aureus MW2
aaaauuguaagucgaaa

SEQ ID NO: 2102216 - RNA, 16 nt, Staphylococcus aureus subsp. aureus MW2
aaaauuguauuauuau

SEQ ID NO: 2102217 - RNA, 23 nt, Staphylococcus aureus subsp. aureus MW2
aaaauugguuuggauaaaaugau

SEQ ID NO: 2102218 - RNA, 16 nt, Staphylococcus aureus subsp. aureus MW2
cagcuacaaauaauga

SEQ ID NO: 2102219 - RNA, 13 nt, Staphylococcus aureus subsp. aureus MW2
cagcuaauugucg

SEQ ID NO: 2102220 - RNA, 14 nt, Staphylococcus aureus subsp. aureus MW2
cagcuguauuuaau

SEQ ID NO: 2102221 - RNA, 17 nt, Staphylococcus aureus subsp. aureus MW2
cagcuguauuuaauaaa

SEQ ID NO: 2102222 - RNA, 19 nt, Staphylococcus aureus subsp. aureus MW2
cagcucuuaaaucacuagc

SEQ ID NO: 2102223 - RNA, 12 nt, Staphylococcus aureus subsp. aureus MW2
cagcuucauuaa

SEQ ID NO: 2102224 - RNA, 12 nt, Staphylococcus aureus subsp. aureus MW2
cagcuucaacac

SEQ ID NO: 2102225 - RNA, 14 nt, Staphylococcus aureus subsp. aureus MW2
cagcuuacaauaau

SEQ ID NO: 2102226 - RNA, 16 nt, Staphylococcus aureus subsp. aureus MW2
cagcuuacaauaaugu

SEQ ID NO: 2102227 - RNA, 17 nt, Staphylococcus aureus subsp. aureus MW2
cagcuuacaauaaugug

SEQ ID NO: 2102228 - RNA, 12 nt, Staphylococcus aureus subsp. aureus MW2
cagcuuuuucua

SEQ ID NO: 2102229 - RNA, 22 nt, Staphylococcus aureus subsp. aureus MW2
aaaauuugaaauauaccaacca

SEQ ID NO: 2102230 - RNA, 14 nt, Staphylococcus aureus subsp. aureus MW2
aaaauuuguaauuu

SEQ ID NO: 2102231 - RNA, 13 nt, Staphylococcus aureus subsp. aureus MW2
caggaauagaugu

SEQ ID NO: 2102232 - RNA, 14 nt, Staphylococcus aureus subsp. aureus MW2
aaaauuuugaagaa

SEQ ID NO: 2102233 - RNA, 16 nt, Staphylococcus aureus subsp. aureus MW2
aaaauuuuuaaaaaaa

SEQ ID NO: 2102234 - RNA, 19 nt, Staphylococcus aureus subsp. aureus MW2
aaaauuuuuaaaaaaauaa

SEQ ID NO: 2102235 - RNA, 14 nt, Staphylococcus aureus subsp. aureus MW2
aaaauuuugcaaaa

SEQ ID NO: 2102236 - RNA, 19 nt, Staphylococcus aureus subsp. aureus MW2
caggcuggaacauuaaguu

SEQ ID NO: 2102237 - RNA, 18 nt, Staphylococcus aureus subsp. aureus MW2
cagugaaguuaacuauaa

SEQ ID NO: 2102238 - RNA, 15 nt, Staphylococcus aureus subsp. aureus MW2
cagugaaguuaacua

SEQ ID NO: 2102239 - RNA, 22 nt, Staphylococcus aureus subsp. aureus MW2
cagugaaucuaaacuauaauaa

SEQ ID NO: 2102240 - RNA, 14 nt, Staphylococcus aureus subsp. aureus MW2
cagucuucauguuc

SEQ ID NO: 2102241 - RNA, 15 nt, Staphylococcus aureus subsp. aureus MW2
cagugacuagaggau

SEQ ID NO: 2102242 - RNA, 15 nt, Staphylococcus aureus subsp. aureus MW2
cagucucuaaaacuu

SEQ ID NO: 2102243 - RNA, 21 nt, Staphylococcus aureus subsp. aureus MW2
cagucaaugacuuaacaucuu

SEQ ID NO: 2102244 - RNA, 18 nt, Staphylococcus aureus subsp. aureus MW2
cagucaauuuuuucaucu

SEQ ID NO: 2102245 - RNA, 17 nt, Staphylococcus aureus subsp. aureus MW2
cagucaacuacugucaa

SEQ ID NO: 2102246 - RNA, 23 nt, Staphylococcus aureus subsp. aureus MW2
caguauuugccuuuugaauaauu

SEQ ID NO: 2102247 - RNA, 17 nt, Staphylococcus aureus subsp. aureus MW2
cagucauuugauuuaaa

SEQ ID NO: 2102248 - RNA, 13 nt, Staphylococcus aureus subsp. aureus MW2
cagucauucacau

SEQ ID NO: 2102249 - RNA, 15 nt, Staphylococcus aureus subsp. aureus MW2
cagucaucaucauga

SEQ ID NO: 2102250 - RNA, 15 nt, Staphylococcus aureus subsp. aureus MW2
cagucaguaaaaaua

SEQ ID NO: 2102251 - RNA, 16 nt, Staphylococcus aureus subsp. aureus MW2
cagucaguaaaaauac

SEQ ID NO: 2102252 - RNA, 20 nt, Staphylococcus aureus subsp. aureus MW2
caguauauuuuaacaaugaa

SEQ ID NO: 2102253 - RNA, 18 nt, Staphylococcus aureus subsp. aureus MW2
caguauauaucaaauaca

SEQ ID NO: 2102254 - RNA, 17 nt, Staphylococcus aureus subsp. aureus MW2
caguauauaucaaauac

SEQ ID NO: 2102255 - RNA, 15 nt, Staphylococcus aureus subsp. aureus MW2
caguauauaucaaau

SEQ ID NO: 2102256 - RNA, 15 nt, Staphylococcus aureus subsp. aureus MW2
caguauaauuuucug

SEQ ID NO: 2102257 - RNA, 21 nt, Staphylococcus aureus subsp. aureus MW2
caguaguugacuguaaaacaa

SEQ ID NO: 2102258 - RNA, 22 nt, Staphylococcus aureus subsp. aureus MW2
caguaguugacuguaaaacaau

SEQ ID NO: 2102259 - RNA, 15 nt, Staphylococcus aureus subsp. aureus MW2
caguaggauaauuuc

SEQ ID NO: 2102260 - RNA, 18 nt, Staphylococcus aureus subsp. aureus MW2
cagguuaucacaacagua

SEQ ID NO: 2102261 - RNA, 16 nt, Staphylococcus aureus subsp. aureus MW2
cagguuacuuuuuuaa

SEQ ID NO: 2102262 - RNA, 13 nt, Staphylococcus aureus subsp. aureus MW2
cagguuaacauuu

SEQ ID NO: 2102263 - RNA, 21 nt, Staphylococcus aureus subsp. aureus MW2
aaacaacaaucaaauuacaaa

SEQ ID NO: 2102264 - RNA, 19 nt, Staphylococcus aureus subsp. aureus MW2
aaacaaagguuuguaagac

SEQ ID NO: 2102265 - RNA, 13 nt, Staphylococcus aureus subsp. aureus MW2
aaacaaauaaaug

SEQ ID NO: 2102266 - RNA, 16 nt, Staphylococcus aureus subsp. aureus MW2
aaacaacuucugaaac

SEQ ID NO: 2102267 - RNA, 20 nt, Staphylococcus aureus subsp. aureus MW2
aaacaacuucugaaacgccu

SEQ ID NO: 2102268 - RNA, 15 nt, Staphylococcus aureus subsp. aureus MW2
caguaaucaaaguau

SEQ ID NO: 2102269 - RNA, 16 nt, Staphylococcus aureus subsp. aureus MW2
caguaaucaaaguauc

SEQ ID NO: 2102270 - RNA, 19 nt, Staphylococcus aureus subsp. aureus MW2
caguaaucaugcauucuau

SEQ ID NO: 2102271 - RNA, 11 nt, Staphylococcus aureus subsp. aureus MW2
caguaauaaug

SEQ ID NO: 2102272 - RNA, 15 nt, Staphylococcus aureus subsp. aureus MW2
caguaauucuuaaaa

SEQ ID NO: 2102273 - RNA, 22 nt, Staphylococcus aureus subsp. aureus MW2
caguaauuuuuaaacaaaaaua

SEQ ID NO: 2102274 - RNA, 21 nt, Staphylococcus aureus subsp. aureus MW2
caguacaauccugaagagaaa

SEQ ID NO: 2102275 - RNA, 14 nt, Staphylococcus aureus subsp. aureus MW2
caguacaaauaaca

SEQ ID NO: 2102276 - RNA, 21 nt, Staphylococcus aureus subsp. aureus MW2
caguaagaugauuucaaaugu

SEQ ID NO: 2102277 - RNA, 14 nt, Staphylococcus aureus subsp. aureus MW2
caguaagauuauuu

SEQ ID NO: 2102278 - RNA, 21 nt, Staphylococcus aureus subsp. aureus MW2
caguaagauuauuuucaauua

SEQ ID NO: 2102279 - RNA, 20 nt, Staphylococcus aureus subsp. aureus MW2
cauuuucuacgaauacuaaa

SEQ ID NO: 2102280 - RNA, 18 nt, Staphylococcus aureus subsp. aureus MW2
cauugauaaauuuuuagu

SEQ ID NO: 2102281 - RNA, 22 nt, Staphylococcus aureus subsp. aureus MW2
cauugagcaucuugucuaguuc

SEQ ID NO: 2102282 - RNA, 20 nt, Staphylococcus aureus subsp. aureus MW2
cauugauaguuuuauaauuc

SEQ ID NO: 2102283 - RNA, 13 nt, Staphylococcus aureus subsp. aureus MW2
cauugauaaaaua

SEQ ID NO: 2102284 - RNA, 20 nt, Staphylococcus aureus subsp. aureus MW2
cauuuugcccaugucaugaa

SEQ ID NO: 2102285 - RNA, 20 nt, Staphylococcus aureus subsp. aureus MW2
cauuuuggcaaaagcuuuua

SEQ ID NO: 2102286 - RNA, 16 nt, Staphylococcus aureus subsp. aureus MW2
cauuuugguacaaaaa

SEQ ID NO: 2102287 - RNA, 19 nt, Staphylococcus aureus subsp. aureus MW2
cauuuuuaaauuacuauau

SEQ ID NO: 2102288 - RNA, 16 nt, Staphylococcus aureus subsp. aureus MW2
cauuuuuauaaauuuu

SEQ ID NO: 2102289 - RNA, 14 nt, Staphylococcus aureus subsp. aureus MW2
cauuuuuaguuaga

SEQ ID NO: 2102290 - RNA, 16 nt, Staphylococcus aureus subsp. aureus MW2
cauuuuuagacauuaa

SEQ ID NO: 2102291 - RNA, 22 nt, Staphylococcus aureus subsp. aureus MW2
cauuuuucgccaaaaacuuuau

SEQ ID NO: 2102292 - RNA, 20 nt, Staphylococcus aureus subsp. aureus MW2
cauuuuuauuuaacacuuca

SEQ ID NO: 2102293 - RNA, 20 nt, Staphylococcus aureus subsp. aureus MW2
cauuuuuuuccaagcaucau

SEQ ID NO: 2102294 - RNA, 12 nt, Staphylococcus aureus subsp. aureus MW2
cauuuuuuucaa

SEQ ID NO: 2102295 - RNA, 16 nt, Staphylococcus aureus subsp. aureus MW2
cauuuuuucauuauua

SEQ ID NO: 2102296 - RNA, 17 nt, Staphylococcus aureus subsp. aureus MW2
cauuuuugauuuuaaua

SEQ ID NO: 2102297 - RNA, 18 nt, Staphylococcus aureus subsp. aureus MW2
ccaaaaugguuaaaaucg

SEQ ID NO: 2102298 - RNA, 16 nt, Staphylococcus aureus subsp. aureus MW2
ccaaaacauuuuguga

SEQ ID NO: 2102299 - RNA, 20 nt, Staphylococcus aureus subsp. aureus MW2
ccaaagaaacggaaaugacu

SEQ ID NO: 2102300 - RNA, 15 nt, Staphylococcus aureus subsp. aureus MW2
ccaaaccauuaauaa

SEQ ID NO: 2102301 - RNA, 13 nt, Staphylococcus aureus subsp. aureus MW2
ccaacuuuuuuaa

SEQ ID NO: 2102302 - RNA, 21 nt, Staphylococcus aureus subsp. aureus MW2
ccaacuaaaucaccauuuuuu

SEQ ID NO: 2102303 - RNA, 21 nt, Staphylococcus aureus subsp. aureus MW2
ccaaagaaagcuaauaucaau

SEQ ID NO: 2102304 - RNA, 21 nt, Staphylococcus aureus subsp. aureus MW2
ccaaauaacguuaauauaauu

SEQ ID NO: 2102305 - RNA, 13 nt, Staphylococcus aureus subsp. aureus MW2
ccaaauaaauaua

SEQ ID NO: 2102306 - RNA, 13 nt, Staphylococcus aureus subsp. aureus MW2
ccaaauaauaucu

SEQ ID NO: 2102307 - RNA, 11 nt, Staphylococcus aureus subsp. aureus MW2
ccaaauacuag

SEQ ID NO: 2102308 - RNA, 18 nt, Staphylococcus aureus subsp. aureus MW2
ccaaaucuuuaauaaccu

SEQ ID NO: 2102309 - RNA, 15 nt, Staphylococcus aureus subsp. aureus MW2
ccaacaucuucaaca

SEQ ID NO: 2102310 - RNA, 15 nt, Staphylococcus aureus subsp. aureus MW2
ccaacacagaagcug

SEQ ID NO: 2102311 - RNA, 14 nt, Staphylococcus aureus subsp. aureus MW2
ccaacacagagaaa

SEQ ID NO: 2102312 - RNA, 14 nt, Staphylococcus aureus subsp. aureus MW2
ccaacacagagaau

SEQ ID NO: 2102313 - RNA, 13 nt, Staphylococcus aureus subsp. aureus MW2
ccaacacauaaau

SEQ ID NO: 2102314 - RNA, 22 nt, Staphylococcus aureus subsp. aureus MW2
ccaaauuuaggcaugucaaauc

SEQ ID NO: 2102315 - RNA, 18 nt, Staphylococcus aureus subsp. aureus MW2
ccaccgcugcucuucucu

SEQ ID NO: 2102316 - RNA, 14 nt, Staphylococcus aureus subsp. aureus MW2
ccaccuuuaucugu

SEQ ID NO: 2102317 - RNA, 13 nt, Staphylococcus aureus subsp. aureus MW2
ccaccuuucuuua

SEQ ID NO: 2102318 - RNA, 23 nt, Staphylococcus aureus subsp. aureus MW2
ccaccuuucuuuaucauaucuau

SEQ ID NO: 2102319 - RNA, 14 nt, Staphylococcus aureus subsp. aureus MW2
ccaccuuguuuaag

SEQ ID NO: 2102320 - RNA, 21 nt, Staphylococcus aureus subsp. aureus MW2
ccaccuuguuuaaguuuuuca

SEQ ID NO: 2102321 - RNA, 20 nt, Staphylococcus aureus subsp. aureus MW2
ccaccuacgcccaucaucac

SEQ ID NO: 2102322 - RNA, 10 nt, Staphylococcus aureus subsp. aureus MW2
ccaauaaucc

SEQ ID NO: 2102323 - RNA, 14 nt, Staphylococcus aureus subsp. aureus MW2
ccaauaaaauguca

SEQ ID NO: 2102324 - RNA, 17 nt, Staphylococcus aureus subsp. aureus MW2
ccaauaaaacuaugugu

SEQ ID NO: 2102325 - RNA, 19 nt, Staphylococcus aureus subsp. aureus MW2
ccaaguuuugcacgcauac

SEQ ID NO: 2102326 - RNA, 14 nt, Staphylococcus aureus subsp. aureus MW2
ccaauuaauaaaca

SEQ ID NO: 2102327 - RNA, 16 nt, Staphylococcus aureus subsp. aureus MW2
ccaaugauuguuaaua

SEQ ID NO: 2102328 - RNA, 17 nt, Staphylococcus aureus subsp. aureus MW2
ccaaugaugaauuguaa

SEQ ID NO: 2102329 - RNA, 21 nt, Staphylococcus aureus subsp. aureus MW2
ccaauuaucaacauaauauuu

SEQ ID NO: 2102330 - RNA, 11 nt, Staphylococcus aureus subsp. aureus MW2
ccacaaauaac

SEQ ID NO: 2102331 - RNA, 13 nt, Staphylococcus aureus subsp. aureus MW2
ccacaacauguuu

SEQ ID NO: 2102332 - RNA, 17 nt, Staphylococcus aureus subsp. aureus MW2
ccacaucccaauuuaaa

SEQ ID NO: 2102333 - RNA, 13 nt, Staphylococcus aureus subsp. aureus MW2
ccacaucauagca

SEQ ID NO: 2102334 - RNA, 21 nt, Staphylococcus aureus subsp. aureus MW2
ccacaucauagcacuacauca

SEQ ID NO: 2102335 - RNA, 14 nt, Staphylococcus aureus subsp. aureus MW2
ccacauuuuccuug

SEQ ID NO: 2102336 - RNA, 21 nt, Staphylococcus aureus subsp. aureus MW2
ccacuugaauacuuuuuaacu

SEQ ID NO: 2102337 - RNA, 16 nt, Staphylococcus aureus subsp. aureus MW2
ccacuugaauacuuuu

SEQ ID NO: 2102338 - RNA, 20 nt, Staphylococcus aureus subsp. aureus MW2
ccacuugaauacuuuuuaac

SEQ ID NO: 2102339 - RNA, 14 nt, Staphylococcus aureus subsp. aureus MW2
ccacuucuucaccu

SEQ ID NO: 2102340 - RNA, 17 nt, Staphylococcus aureus subsp. aureus MW2
ccacuguagaaacacaa

SEQ ID NO: 2102341 - RNA, 22 nt, Staphylococcus aureus subsp. aureus MW2
ccagaauguguuggcuuuuuga

SEQ ID NO: 2102342 - RNA, 20 nt, Staphylococcus aureus subsp. aureus MW2
ccagaugcaaugauaccuuu

SEQ ID NO: 2102343 - RNA, 22 nt, Staphylococcus aureus subsp. aureus MW2
ccagcaugaaucgcauuuaaau

SEQ ID NO: 2102344 - RNA, 12 nt, Staphylococcus aureus subsp. aureus MW2
ccagauuugaau

SEQ ID NO: 2102345 - RNA, 16 nt, Staphylococcus aureus subsp. aureus MW2
cauacuucuauuuuau

SEQ ID NO: 2102346 - RNA, 22 nt, Staphylococcus aureus subsp. aureus MW2
cauacuugucguauucuucaau

SEQ ID NO: 2102347 - RNA, 12 nt, Staphylococcus aureus subsp. aureus MW2
cauacuucaaac

SEQ ID NO: 2102348 - RNA, 13 nt, Staphylococcus aureus subsp. aureus MW2
cagugcaugauga

SEQ ID NO: 2102349 - RNA, 17 nt, Staphylococcus aureus subsp. aureus MW2
cauacugauuaaacugu

SEQ ID NO: 2102350 - RNA, 18 nt, Staphylococcus aureus subsp. aureus MW2
cauagaugacgaucuaua

SEQ ID NO: 2102351 - RNA, 13 nt, Staphylococcus aureus subsp. aureus MW2
cauagauuauauu

SEQ ID NO: 2102352 - RNA, 13 nt, Staphylococcus aureus subsp. aureus MW2
cauagagcauuug

SEQ ID NO: 2102353 - RNA, 15 nt, Staphylococcus aureus subsp. aureus MW2
cauagagaaauuuga

SEQ ID NO: 2102354 - RNA, 14 nt, Staphylococcus aureus subsp. aureus MW2
cauagagaauuuca

SEQ ID NO: 2102355 - RNA, 22 nt, Staphylococcus aureus subsp. aureus MW2
cauagagaauuucaaaaaggaa

SEQ ID NO: 2102356 - RNA, 20 nt, Staphylococcus aureus subsp. aureus MW2
cauagaaauugucuuuucau

SEQ ID NO: 2102357 - RNA, 13 nt, Staphylococcus aureus subsp. aureus MW2
cauagaagcuggc

SEQ ID NO: 2102358 - RNA, 14 nt, Staphylococcus aureus subsp. aureus MW2
cauagaagcuggcg

SEQ ID NO: 2102359 - RNA, 16 nt, Staphylococcus aureus subsp. aureus MW2
cauagacacuuaacuu

SEQ ID NO: 2102360 - RNA, 15 nt, Staphylococcus aureus subsp. aureus MW2
cauaggcgcuuuuuu

SEQ ID NO: 2102361 - RNA, 23 nt, Staphylococcus aureus subsp. aureus MW2
cauaggcgcuguuccaaauucau

SEQ ID NO: 2102362 - RNA, 13 nt, Staphylococcus aureus subsp. aureus MW2
cauagguaaccuu

SEQ ID NO: 2102363 - RNA, 13 nt, Staphylococcus aureus subsp. aureus MW2
cauaguaacaaaa

SEQ ID NO: 2102364 - RNA, 18 nt, Staphylococcus aureus subsp. aureus MW2
cauauaugauaaauauug

SEQ ID NO: 2102365 - RNA, 21 nt, Staphylococcus aureus subsp. aureus MW2
cauauaagccccaccaugauu

SEQ ID NO: 2102366 - RNA, 19 nt, Staphylococcus aureus subsp. aureus MW2
cauauaaagcugcgauaua

SEQ ID NO: 2102367 - RNA, 12 nt, Staphylococcus aureus subsp. aureus MW2
cauauaaaaacc

SEQ ID NO: 2102368 - RNA, 15 nt, Staphylococcus aureus subsp. aureus MW2
cauagccucuuaaaa

SEQ ID NO: 2102369 - RNA, 16 nt, Staphylococcus aureus subsp. aureus MW2
cauagcuaaauaaauu

SEQ ID NO: 2102370 - RNA, 14 nt, Staphylococcus aureus subsp. aureus MW2
cauaggauaucuac

SEQ ID NO: 2102371 - RNA, 11 nt, Staphylococcus aureus subsp. aureus MW2
cauauuuugau

SEQ ID NO: 2102372 - RNA, 13 nt, Staphylococcus aureus subsp. aureus MW2
cauauuuucacaa

SEQ ID NO: 2102373 - RNA, 17 nt, Staphylococcus aureus subsp. aureus MW2
cauauuuuuuaaauuua

SEQ ID NO: 2102374 - RNA, 19 nt, Staphylococcus aureus subsp. aureus MW2
caucaaauagacaccaaaa

SEQ ID NO: 2102375 - RNA, 14 nt, Staphylococcus aureus subsp. aureus MW2
caucaaauucaaau

SEQ ID NO: 2102376 - RNA, 16 nt, Staphylococcus aureus subsp. aureus MW2
cauauaugucucucuu

SEQ ID NO: 2102377 - RNA, 13 nt, Staphylococcus aureus subsp. aureus MW2
cauauauuuuguu

SEQ ID NO: 2102378 - RNA, 19 nt, Staphylococcus aureus subsp. aureus MW2
cauaucgcgcaucaaaaau

SEQ ID NO: 2102379 - RNA, 20 nt, Staphylococcus aureus subsp. aureus MW2
caucacuugcuguugcaaua

SEQ ID NO: 2102380 - RNA, 19 nt, Staphylococcus aureus subsp. aureus MW2
caucacuguagauucaaau

SEQ ID NO: 2102381 - RNA, 19 nt, Staphylococcus aureus subsp. aureus MW2
caucacuaaaguaaauaac

SEQ ID NO: 2102382 - RNA, 18 nt, Staphylococcus aureus subsp. aureus MW2
caucaauaaauauugauu

SEQ ID NO: 2102383 - RNA, 14 nt, Staphylococcus aureus subsp. aureus MW2
caucaauaucaaau

SEQ ID NO: 2102384 - RNA, 18 nt, Staphylococcus aureus subsp. aureus MW2
caucaauuucgacuccau

SEQ ID NO: 2102385 - RNA, 14 nt, Staphylococcus aureus subsp. aureus MW2
caucgaagauguua

SEQ ID NO: 2102386 - RNA, 19 nt, Staphylococcus aureus subsp. aureus MW2
caucgucgcuaaagaccuu

SEQ ID NO: 2102387 - RNA, 16 nt, Staphylococcus aureus subsp. aureus MW2
caucgggaucuaauuu

SEQ ID NO: 2102388 - RNA, 14 nt, Staphylococcus aureus subsp. aureus MW2
cauccccagccauu

SEQ ID NO: 2102389 - RNA, 16 nt, Staphylococcus aureus subsp. aureus MW2
caucauguuuaucuac

SEQ ID NO: 2102390 - RNA, 15 nt, Staphylococcus aureus subsp. aureus MW2
caucauguuuauuag

SEQ ID NO: 2102391 - RNA, 20 nt, Staphylococcus aureus subsp. aureus MW2
caucauguuuauuagcuuuu

SEQ ID NO: 2102392 - RNA, 13 nt, Staphylococcus aureus subsp. aureus MW2
caucauuaaaauc

SEQ ID NO: 2102393 - RNA, 16 nt, Staphylococcus aureus subsp. aureus MW2
caucauuuaaauauuu

SEQ ID NO: 2102394 - RNA, 21 nt, Staphylococcus aureus subsp. aureus MW2
caucauuuauauggaauacua

SEQ ID NO: 2102395 - RNA, 20 nt, Staphylococcus aureus subsp. aureus MW2
caucauuuguguaaaugaau

SEQ ID NO: 2102396 - RNA, 23 nt, Staphylococcus aureus subsp. aureus MW2
caucauuuucaauacuugaaaga

SEQ ID NO: 2102397 - RNA, 14 nt, Staphylococcus aureus subsp. aureus MW2
caucauuuguguuu

SEQ ID NO: 2102398 - RNA, 21 nt, Staphylococcus aureus subsp. aureus MW2
caucaugauuauuucgccuuu

SEQ ID NO: 2102399 - RNA, 14 nt, Staphylococcus aureus subsp. aureus MW2
caucaugacauuaa

SEQ ID NO: 2102400 - RNA, 19 nt, Staphylococcus aureus subsp. aureus MW2
cauccaauuauguuuaucu

SEQ ID NO: 2102401 - RNA, 18 nt, Staphylococcus aureus subsp. aureus MW2
caucuuuaagcuuaaaua

SEQ ID NO: 2102402 - RNA, 14 nt, Staphylococcus aureus subsp. aureus MW2
caucuuuauuuaca

SEQ ID NO: 2102403 - RNA, 14 nt, Staphylococcus aureus subsp. aureus MW2
caucuuuauacaca

SEQ ID NO: 2102404 - RNA, 12 nt, Staphylococcus aureus subsp. aureus MW2
caucuuucaaau

SEQ ID NO: 2102405 - RNA, 13 nt, Staphylococcus aureus subsp. aureus MW2
caucuugacacaa

SEQ ID NO: 2102406 - RNA, 19 nt, Staphylococcus aureus subsp. aureus MW2
caucuugcgccuuguucaa

SEQ ID NO: 2102407 - RNA, 15 nt, Staphylococcus aureus subsp. aureus MW2
caucuucuucaaaac

SEQ ID NO: 2102408 - RNA, 23 nt, Staphylococcus aureus subsp. aureus MW2
caucuucuggauagguaucacua

SEQ ID NO: 2102409 - RNA, 13 nt, Staphylococcus aureus subsp. aureus MW2
caucuucuucauc

SEQ ID NO: 2102410 - RNA, 15 nt, Staphylococcus aureus subsp. aureus MW2
caucuucuucaucau

SEQ ID NO: 2102411 - RNA, 16 nt, Staphylococcus aureus subsp. aureus MW2
caucuucuucaucaua

SEQ ID NO: 2102412 - RNA, 13 nt, Staphylococcus aureus subsp. aureus MW2
caucuuuuuaaaa

SEQ ID NO: 2102413 - RNA, 19 nt, Staphylococcus aureus subsp. aureus MW2
caucuuuugguuuaucugu

SEQ ID NO: 2102414 - RNA, 12 nt, Staphylococcus aureus subsp. aureus MW2
caucuuuuucac

SEQ ID NO: 2102415 - RNA, 19 nt, Staphylococcus aureus subsp. aureus MW2
caucuuucacaauuguaua

SEQ ID NO: 2102416 - RNA, 18 nt, Staphylococcus aureus subsp. aureus MW2
caugaaaauuaaaaaaug

SEQ ID NO: 2102417 - RNA, 22 nt, Staphylococcus aureus subsp. aureus MW2
caugaaucaacaauauaaaagc

SEQ ID NO: 2102418 - RNA, 21 nt, Staphylococcus aureus subsp. aureus MW2
caugaaucgcauuuaaauaua

SEQ ID NO: 2102419 - RNA, 20 nt, Staphylococcus aureus subsp. aureus MW2
caugacauaaaacuuacauu

SEQ ID NO: 2102420 - RNA, 16 nt, Staphylococcus aureus subsp. aureus MW2
caugacgauuccaauc

SEQ ID NO: 2102421 - RNA, 13 nt, Staphylococcus aureus subsp. aureus MW2
caugauaaaaaua

SEQ ID NO: 2102422 - RNA, 18 nt, Staphylococcus aureus subsp. aureus MW2
caugccuuaugucauaua

SEQ ID NO: 2102423 - RNA, 18 nt, Staphylococcus aureus subsp. aureus MW2
caugcccgauaaaaccac

SEQ ID NO: 2102424 - RNA, 14 nt, Staphylococcus aureus subsp. aureus MW2
caugccaauuaauu

SEQ ID NO: 2102425 - RNA, 12 nt, Staphylococcus aureus subsp. aureus MW2
caugauuuacua

SEQ ID NO: 2102426 - RNA, 16 nt, Staphylococcus aureus subsp. aureus MW2
caugcacuuuauuaaa

SEQ ID NO: 2102427 - RNA, 20 nt, Staphylococcus aureus subsp. aureus MW2
caugaugaacuuaaugcuuc

SEQ ID NO: 2102428 - RNA, 17 nt, Staphylococcus aureus subsp. aureus MW2
caugauacugaaauuuc

SEQ ID NO: 2102429 - RNA, 19 nt, Staphylococcus aureus subsp. aureus MW2
caugauacugaaauuucau

SEQ ID NO: 2102430 - RNA, 17 nt, Staphylococcus aureus subsp. aureus MW2
caugauucaugauaugu

SEQ ID NO: 2102431 - RNA, 15 nt, Staphylococcus aureus subsp. aureus MW2
cauguaacaaaauac

SEQ ID NO: 2102432 - RNA, 22 nt, Staphylococcus aureus subsp. aureus MW2
cauguaacaaaauacccugcuu

SEQ ID NO: 2102433 - RNA, 22 nt, Staphylococcus aureus subsp. aureus MW2
cauguuccccauuaauuaacaa

SEQ ID NO: 2102434 - RNA, 15 nt, Staphylococcus aureus subsp. aureus MW2
cauguauuggccaaa

SEQ ID NO: 2102435 - RNA, 20 nt, Staphylococcus aureus subsp. aureus MW2
cauguauucuuagauauuau

SEQ ID NO: 2102436 - RNA, 17 nt, Staphylococcus aureus subsp. aureus MW2
cauguauaaggauaucu

SEQ ID NO: 2102437 - RNA, 19 nt, Staphylococcus aureus subsp. aureus MW2
cauguuuggaugaacaaaa

SEQ ID NO: 2102438 - RNA, 22 nt, Staphylococcus aureus subsp. aureus MW2
cauguuuauuagcuuuuucaac

SEQ ID NO: 2102439 - RNA, 20 nt, Staphylococcus aureus subsp. aureus MW2
cauguuugauucuaaauaau

SEQ ID NO: 2102440 - RNA, 19 nt, Staphylococcus aureus subsp. aureus MW2
cauguuccgcuacaaaaca

SEQ ID NO: 2102441 - RNA, 14 nt, Staphylococcus aureus subsp. aureus MW2
cauguugauaaaaa

SEQ ID NO: 2102442 - RNA, 19 nt, Staphylococcus aureus subsp. aureus MW2
cauuaaaauguguuuucaa

SEQ ID NO: 2102443 - RNA, 14 nt, Staphylococcus aureus subsp. aureus MW2
cauuaaaccaauca

SEQ ID NO: 2102444 - RNA, 12 nt, Staphylococcus aureus subsp. aureus MW2
cauuaaaccacu

SEQ ID NO: 2102445 - RNA, 23 nt, Staphylococcus aureus subsp. aureus MW2
cauuaaaaggaugugacaaauac

SEQ ID NO: 2102446 - RNA, 13 nt, Staphylococcus aureus subsp. aureus MW2
cauuaaaauaauu

SEQ ID NO: 2102447 - RNA, 21 nt, Staphylococcus aureus subsp. aureus MW2
cauuaaaauaauuaaauaaaa

SEQ ID NO: 2102448 - RNA, 11 nt, Staphylococcus aureus subsp. aureus MW2
cauuaaaauaa

SEQ ID NO: 2102449 - RNA, 18 nt, Staphylococcus aureus subsp. aureus MW2
cauuaaaaauaaaagcaa

SEQ ID NO: 2102450 - RNA, 16 nt, Staphylococcus aureus subsp. aureus MW2
cauuaacuuucucaaa

SEQ ID NO: 2102451 - RNA, 17 nt, Staphylococcus aureus subsp. aureus MW2
cauuaaucuauauaaaa

SEQ ID NO: 2102452 - RNA, 20 nt, Staphylococcus aureus subsp. aureus MW2
cauuaaucuauauaaaaacu

SEQ ID NO: 2102453 - RNA, 16 nt, Staphylococcus aureus subsp. aureus MW2
cauuaauccuuuauau

SEQ ID NO: 2102454 - RNA, 20 nt, Staphylococcus aureus subsp. aureus MW2
cauuaucaagaacuuuaaaa

SEQ ID NO: 2102455 - RNA, 16 nt, Staphylococcus aureus subsp. aureus MW2
cauuacagauaauuau

SEQ ID NO: 2102456 - RNA, 21 nt, Staphylococcus aureus subsp. aureus MW2
cauuaauuggauuaaauacgc

SEQ ID NO: 2102457 - RNA, 13 nt, Staphylococcus aureus subsp. aureus MW2
cauuaauguucaa

SEQ ID NO: 2102458 - RNA, 15 nt, Staphylococcus aureus subsp. aureus MW2
cauuacaaacauaau

SEQ ID NO: 2102459 - RNA, 22 nt, Staphylococcus aureus subsp. aureus MW2
cauuacaaaucaugacauaaaa

SEQ ID NO: 2102460 - RNA, 16 nt, Staphylococcus aureus subsp. aureus MW2
cauuaugugucuucca

SEQ ID NO: 2102461 - RNA, 13 nt, Staphylococcus aureus subsp. aureus MW2
cauuaucauuaag

SEQ ID NO: 2102462 - RNA, 14 nt, Staphylococcus aureus subsp. aureus MW2
cauucaauguuuaa

SEQ ID NO: 2102463 - RNA, 16 nt, Staphylococcus aureus subsp. aureus MW2
cauuauuaauuccucc

SEQ ID NO: 2102464 - RNA, 22 nt, Staphylococcus aureus subsp. aureus MW2
cauuccaaaguaccaucucuau

SEQ ID NO: 2102465 - RNA, 15 nt, Staphylococcus aureus subsp. aureus MW2
cauucaucguuuacu

SEQ ID NO: 2102466 - RNA, 21 nt, Staphylococcus aureus subsp. aureus MW2
cauucauuuaguuaaauacaa

SEQ ID NO: 2102467 - RNA, 20 nt, Staphylococcus aureus subsp. aureus MW2
cauucauuaagcuuuguuug

SEQ ID NO: 2102468 - RNA, 21 nt, Staphylococcus aureus subsp. aureus MW2
cauugagauuaucuuuagaca

SEQ ID NO: 2102469 - RNA, 22 nt, Staphylococcus aureus subsp. aureus MW2
cauugacuaugaaacuggauaa

SEQ ID NO: 2102470 - RNA, 21 nt, Staphylococcus aureus subsp. aureus MW2
cauugagauaucuuauaacaa

SEQ ID NO: 2102471 - RNA, 21 nt, Staphylococcus aureus subsp. aureus MW2
cauugacacacccaaauuuag

SEQ ID NO: 2102472 - RNA, 14 nt, Staphylococcus aureus subsp. aureus MW2
cauugaaugaugcu

SEQ ID NO: 2102473 - RNA, 21 nt, Staphylococcus aureus subsp. aureus MW2
cauugaaaauauuuuauuaua

SEQ ID NO: 2102474 - RNA, 19 nt, Staphylococcus aureus subsp. aureus MW2
cauucuuuuucucaaugug

SEQ ID NO: 2102475 - RNA, 21 nt, Staphylococcus aureus subsp. aureus MW2
cauucuuuuucucaaugugag

SEQ ID NO: 2102476 - RNA, 20 nt, Staphylococcus aureus subsp. aureus MW2
cauucuuuaauauaaauuuu

SEQ ID NO: 2102477 - RNA, 15 nt, Staphylococcus aureus subsp. aureus MW2
cauucuucaaaaaau

SEQ ID NO: 2102478 - RNA, 19 nt, Staphylococcus aureus subsp. aureus MW2
cauucuugaauaaauuuua

SEQ ID NO: 2102479 - RNA, 23 nt, Staphylococcus aureus subsp. aureus MW2
cauucuucaucgcaaugucaucu

SEQ ID NO: 2102480 - RNA, 16 nt, Staphylococcus aureus subsp. aureus MW2
cauucuucaaaaaaua

SEQ ID NO: 2102481 - RNA, 18 nt, Staphylococcus aureus subsp. aureus MW2
cauucuaugaugcuucua

SEQ ID NO: 2102482 - RNA, 22 nt, Staphylococcus aureus subsp. aureus MW2
cauucucauucagucaaacacu

SEQ ID NO: 2102483 - RNA, 17 nt, Staphylococcus aureus subsp. aureus MW2
cauucccuuuucaucaa

SEQ ID NO: 2102484 - RNA, 21 nt, Staphylococcus aureus subsp. aureus MW2
cauucccuuuucaucaaauuc

SEQ ID NO: 2102485 - RNA, 17 nt, Staphylococcus aureus subsp. aureus MW2
cauucuacguaaacucu

SEQ ID NO: 2102486 - RNA, 17 nt, Staphylococcus aureus subsp. aureus MW2
cauucuaguagcuagaa

SEQ ID NO: 2102487 - RNA, 15 nt, Staphylococcus aureus subsp. aureus MW2
ccugcuuuuuuuaua

SEQ ID NO: 2102488 - RNA, 16 nt, Staphylococcus aureus subsp. aureus MW2
ccuucaauccaagcaa

SEQ ID NO: 2102489 - RNA, 16 nt, Staphylococcus aureus subsp. aureus MW2
ccuuaauacguugcuc

SEQ ID NO: 2102490 - RNA, 18 nt, Staphylococcus aureus subsp. aureus MW2
ccuuacccaaaaaauugu

SEQ ID NO: 2102491 - RNA, 15 nt, Staphylococcus aureus subsp. aureus MW2
ccuucuuucgcuuca

SEQ ID NO: 2102492 - RNA, 21 nt, Staphylococcus aureus subsp. aureus MW2
ccuucuuuuugcguuuuuaaa

SEQ ID NO: 2102493 - RNA, 15 nt, Staphylococcus aureus subsp. aureus MW2
ccuucuuuauaacuu

SEQ ID NO: 2102494 - RNA, 21 nt, Staphylococcus aureus subsp. aureus MW2
ccuucuguacguuuuaaauaa

SEQ ID NO: 2102495 - RNA, 14 nt, Staphylococcus aureus subsp. aureus MW2
ccuuuugaauaauu

SEQ ID NO: 2102496 - RNA, 19 nt, Staphylococcus aureus subsp. aureus MW2
ccuuugcuuuuuauuuugu

SEQ ID NO: 2102497 - RNA, 23 nt, Staphylococcus aureus subsp. aureus MW2
ccuuuugaacguuuacucuuacu

SEQ ID NO: 2102498 - RNA, 16 nt, Staphylococcus aureus subsp. aureus MW2
ccuuugcuaaauauua

SEQ ID NO: 2102499 - RNA, 20 nt, Staphylococcus aureus subsp. aureus MW2
ccuuuccauucguauaagaa

SEQ ID NO: 2102500 - RNA, 15 nt, Staphylococcus aureus subsp. aureus MW2
ccuuuaauuacacua

SEQ ID NO: 2102501 - RNA, 20 nt, Staphylococcus aureus subsp. aureus MW2
ccuuuaaaucuacuuuguuc

SEQ ID NO: 2102502 - RNA, 18 nt, Staphylococcus aureus subsp. aureus MW2
ccuuuaaaacaucauuca

SEQ ID NO: 2102503 - RNA, 12 nt, Staphylococcus aureus subsp. aureus MW2
ccuuuaaaacau

SEQ ID NO: 2102504 - RNA, 22 nt, Staphylococcus aureus subsp. aureus MW2
ccuuuaagaagucgaauucacc

SEQ ID NO: 2102505 - RNA, 17 nt, Staphylococcus aureus subsp. aureus MW2
ccuuuacucauauugaa

SEQ ID NO: 2102506 - RNA, 18 nt, Staphylococcus aureus subsp. aureus MW2
ccuuuauuaccagcuuuc

SEQ ID NO: 2102507 - RNA, 20 nt, Staphylococcus aureus subsp. aureus MW2
ccuuuauuuugauagacuaa

SEQ ID NO: 2102508 - RNA, 17 nt, Staphylococcus aureus subsp. aureus MW2
ccuuuauacaauuuuuu

SEQ ID NO: 2102509 - RNA, 21 nt, Staphylococcus aureus subsp. aureus MW2
ccuuguuuaaguuuuucaggg

SEQ ID NO: 2102510 - RNA, 11 nt, Staphylococcus aureus subsp. aureus MW2
ccuuguuuauu

SEQ ID NO: 2102511 - RNA, 16 nt, Staphylococcus aureus subsp. aureus MW2
ccuuguuuauuuuuaa

SEQ ID NO: 2102512 - RNA, 17 nt, Staphylococcus aureus subsp. aureus MW2
ccuugaaugauauuaac

SEQ ID NO: 2102513 - RNA, 21 nt, Staphylococcus aureus subsp. aureus MW2
cgaccagucgcauauuuugau

SEQ ID NO: 2102514 - RNA, 18 nt, Staphylococcus aureus subsp. aureus MW2
cgaagauguuaaacuguc

SEQ ID NO: 2102515 - RNA, 18 nt, Staphylococcus aureus subsp. aureus MW2
cgaagaaaacuuccauug

SEQ ID NO: 2102516 - RNA, 18 nt, Staphylococcus aureus subsp. aureus MW2
cgaacgauagauucugau

SEQ ID NO: 2102517 - RNA, 20 nt, Staphylococcus aureus subsp. aureus MW2
cgaauaacguuggaaacuuc

SEQ ID NO: 2102518 - RNA, 17 nt, Staphylococcus aureus subsp. aureus MW2
cgaauaucuuaaagaau

SEQ ID NO: 2102519 - RNA, 22 nt, Staphylococcus aureus subsp. aureus MW2
cgaauguauugcuauaagaacu

SEQ ID NO: 2102520 - RNA, 14 nt, Staphylococcus aureus subsp. aureus MW2
cgaauuaaaauaac

SEQ ID NO: 2102521 - RNA, 15 nt, Staphylococcus aureus subsp. aureus MW2
cgacaggggcuuaac

SEQ ID NO: 2102522 - RNA, 17 nt, Staphylococcus aureus subsp. aureus MW2
cgacacguguaaaaaug

SEQ ID NO: 2102523 - RNA, 21 nt, Staphylococcus aureus subsp. aureus MW2
cgaauucucgauuuuuuuaua

SEQ ID NO: 2102524 - RNA, 22 nt, Staphylococcus aureus subsp. aureus MW2
cgaauucucgauuuuuuuauau

SEQ ID NO: 2102525 - RNA, 14 nt, Staphylococcus aureus subsp. aureus MW2
cgaauugccaccgc

SEQ ID NO: 2102526 - RNA, 20 nt, Staphylococcus aureus subsp. aureus MW2
cgacaauuauaauaaaacuu

SEQ ID NO: 2102527 - RNA, 22 nt, Staphylococcus aureus subsp. aureus MW2
cgacaauuauaauaaaacuugu

SEQ ID NO: 2102528 - RNA, 16 nt, Staphylococcus aureus subsp. aureus MW2
aaaccguuauauauua

SEQ ID NO: 2102529 - RNA, 23 nt, Staphylococcus aureus subsp. aureus MW2
aaaccgugagggacgucaucaug

SEQ ID NO: 2102530 - RNA, 14 nt, Staphylococcus aureus subsp. aureus MW2
ccgcuuuauuuuau

SEQ ID NO: 2102531 - RNA, 20 nt, Staphylococcus aureus subsp. aureus MW2
ccuacaacaccaauugaaau

SEQ ID NO: 2102532 - RNA, 19 nt, Staphylococcus aureus subsp. aureus MW2
ccuacaacaccaauugaaa

SEQ ID NO: 2102533 - RNA, 14 nt, Staphylococcus aureus subsp. aureus MW2
ccuacaacaccaau

SEQ ID NO: 2102534 - RNA, 13 nt, Staphylococcus aureus subsp. aureus MW2
ccuaauucuaagu

SEQ ID NO: 2102535 - RNA, 21 nt, Staphylococcus aureus subsp. aureus MW2
ccuaaugagcccguuaaaaag

SEQ ID NO: 2102536 - RNA, 17 nt, Staphylococcus aureus subsp. aureus MW2
ccuaauguaauuauugc

SEQ ID NO: 2102537 - RNA, 22 nt, Staphylococcus aureus subsp. aureus MW2
ccuagaacauugauuauuguuc

SEQ ID NO: 2102538 - RNA, 23 nt, Staphylococcus aureus subsp. aureus MW2
ccuacuuugauauguuuccucuu

SEQ ID NO: 2102539 - RNA, 15 nt, Staphylococcus aureus subsp. aureus MW2
ccuagauaccaaacu

SEQ ID NO: 2102540 - RNA, 13 nt, Staphylococcus aureus subsp. aureus MW2
ccuagcaaaaaua

SEQ ID NO: 2102541 - RNA, 16 nt, Staphylococcus aureus subsp. aureus MW2
ccuagcaaaaauacuu

SEQ ID NO: 2102542 - RNA, 21 nt, Staphylococcus aureus subsp. aureus MW2
ccuagcaaaaauacuuuuuga

SEQ ID NO: 2102543 - RNA, 21 nt, Staphylococcus aureus subsp. aureus MW2
ccuaccgcuaaaauucuuuca

SEQ ID NO: 2102544 - RNA, 21 nt, Staphylococcus aureus subsp. aureus MW2
ccuaccuauuugauuaaauua

SEQ ID NO: 2102545 - RNA, 14 nt, Staphylococcus aureus subsp. aureus MW2
ccuauaagucucuu

SEQ ID NO: 2102546 - RNA, 18 nt, Staphylococcus aureus subsp. aureus MW2
ccuagguuuauauaucac

SEQ ID NO: 2102547 - RNA, 13 nt, Staphylococcus aureus subsp. aureus MW2
ccuauauguaggg

SEQ ID NO: 2102548 - RNA, 22 nt, Staphylococcus aureus subsp. aureus MW2
ccuauuccuaauaaauaucuua

SEQ ID NO: 2102549 - RNA, 11 nt, Staphylococcus aureus subsp. aureus MW2
ccuauuuuuua

SEQ ID NO: 2102550 - RNA, 19 nt, Staphylococcus aureus subsp. aureus MW2
ccuauuuuuuuauguuaua

SEQ ID NO: 2102551 - RNA, 18 nt, Staphylococcus aureus subsp. aureus MW2
ccuccuggugcugcacca

SEQ ID NO: 2102552 - RNA, 12 nt, Staphylococcus aureus subsp. aureus MW2
ccguuauuuuca

SEQ ID NO: 2102553 - RNA, 21 nt, Staphylococcus aureus subsp. aureus MW2
ccguguuuugauuuauuaucu

SEQ ID NO: 2102554 - RNA, 16 nt, Staphylococcus aureus subsp. aureus MW2
ccguuaaaaagacggu

SEQ ID NO: 2102555 - RNA, 15 nt, Staphylococcus aureus subsp. aureus MW2
ccguugguugugauu

SEQ ID NO: 2102556 - RNA, 14 nt, Staphylococcus aureus subsp. aureus MW2
ccuaauaaauaucu

SEQ ID NO: 2102557 - RNA, 18 nt, Staphylococcus aureus subsp. aureus MW2
ccuaauaauaaaauagcu

SEQ ID NO: 2102558 - RNA, 19 nt, Staphylococcus aureus subsp. aureus MW2
ccuaaagguaacuuuuuaa

SEQ ID NO: 2102559 - RNA, 21 nt, Staphylococcus aureus subsp. aureus MW2
ccuaaagguaacuuuuuaacu

SEQ ID NO: 2102560 - RNA, 18 nt, Staphylococcus aureus subsp. aureus MW2
ccuaaagcuaaugcaagc

SEQ ID NO: 2102561 - RNA, 15 nt, Staphylococcus aureus subsp. aureus MW2
ccuaaaguauuaucu

SEQ ID NO: 2102562 - RNA, 16 nt, Staphylococcus aureus subsp. aureus MW2
ccuaaagacuuuaugc

SEQ ID NO: 2102563 - RNA, 12 nt, Staphylococcus aureus subsp. aureus MW2
ccuaaaaacaaa

SEQ ID NO: 2102564 - RNA, 20 nt, Staphylococcus aureus subsp. aureus MW2
ccgucgaauauaauuuuuug

SEQ ID NO: 2102565 - RNA, 13 nt, Staphylococcus aureus subsp. aureus MW2
aaacgauacugcu

SEQ ID NO: 2102566 - RNA, 15 nt, Staphylococcus aureus subsp. aureus MW2
aaacgauauagaccg

SEQ ID NO: 2102567 - RNA, 22 nt, Staphylococcus aureus subsp. aureus MW2
aaacgauauagaccguugaaau

SEQ ID NO: 2102568 - RNA, 21 nt, Staphylococcus aureus subsp. aureus MW2
aaacgauaagaauuaacaaca

SEQ ID NO: 2102569 - RNA, 19 nt, Staphylococcus aureus subsp. aureus MW2
aaacgauaagaauuaacaa

SEQ ID NO: 2102570 - RNA, 14 nt, Staphylococcus aureus subsp. aureus MW2
ccgccuaauaauaa

SEQ ID NO: 2102571 - RNA, 12 nt, Staphylococcus aureus subsp. aureus MW2
aaaccaugugua

SEQ ID NO: 2102572 - RNA, 16 nt, Staphylococcus aureus subsp. aureus MW2
aaaccauuaauaaaac

SEQ ID NO: 2102573 - RNA, 21 nt, Staphylococcus aureus subsp. aureus MW2
aaaccauuuucaagaggacaa

SEQ ID NO: 2102574 - RNA, 17 nt, Staphylococcus aureus subsp. aureus MW2
ccgccaacuugcacauu

SEQ ID NO: 2102575 - RNA, 16 nt, Staphylococcus aureus subsp. aureus MW2
ccgauuuugauauaaa

SEQ ID NO: 2102576 - RNA, 18 nt, Staphylococcus aureus subsp. aureus MW2
ccgauuugauaaaaaaug

SEQ ID NO: 2102577 - RNA, 20 nt, Staphylococcus aureus subsp. aureus MW2
ccgauuugauaaaaaaugaa

SEQ ID NO: 2102578 - RNA, 13 nt, Staphylococcus aureus subsp. aureus MW2
ccgauuguuucac

SEQ ID NO: 2102579 - RNA, 18 nt, Staphylococcus aureus subsp. aureus MW2
aaacagcaaauaaaauca

SEQ ID NO: 2102580 - RNA, 14 nt, Staphylococcus aureus subsp. aureus MW2
aaacagcaaauaaa

SEQ ID NO: 2102581 - RNA, 22 nt, Staphylococcus aureus subsp. aureus MW2
cccuuauauuuuuuacaagcuu

SEQ ID NO: 2102582 - RNA, 19 nt, Staphylococcus aureus subsp. aureus MW2
cccuuuuugucucucaaca

SEQ ID NO: 2102583 - RNA, 23 nt, Staphylococcus aureus subsp. aureus MW2
ccgaaaaaaccgagaaucuccau

SEQ ID NO: 2102584 - RNA, 24 nt, Staphylococcus aureus subsp. aureus MW2
ccgaaaaaaccgagaaucuccauu

SEQ ID NO: 2102585 - RNA, 21 nt, Staphylococcus aureus subsp. aureus MW2
aaacagguuaucacaacagua

SEQ ID NO: 2102586 - RNA, 21 nt, Staphylococcus aureus subsp. aureus MW2
aaacauguacaauuuuuaaaa

SEQ ID NO: 2102587 - RNA, 19 nt, Staphylococcus aureus subsp. aureus MW2
aaacauguacaauuuuuaa

SEQ ID NO: 2102588 - RNA, 23 nt, Staphylococcus aureus subsp. aureus MW2
aaacaugguuuucuuuuuaucau

SEQ ID NO: 2102589 - RNA, 18 nt, Staphylococcus aureus subsp. aureus MW2
aaacauuaaaauaauuaa

SEQ ID NO: 2102590 - RNA, 16 nt, Staphylococcus aureus subsp. aureus MW2
aaacauuaaaauaauu

SEQ ID NO: 2102591 - RNA, 15 nt, Staphylococcus aureus subsp. aureus MW2
aaacauguuacccua

SEQ ID NO: 2102592 - RNA, 22 nt, Staphylococcus aureus subsp. aureus MW2
aaacauuacccuuuaaucucau

SEQ ID NO: 2102593 - RNA, 23 nt, Staphylococcus aureus subsp. aureus MW2
aaacauuacccuuuaaucucaug

SEQ ID NO: 2102594 - RNA, 14 nt, Staphylococcus aureus subsp. aureus MW2
ccgaauaauuuuga

SEQ ID NO: 2102595 - RNA, 21 nt, Staphylococcus aureus subsp. aureus MW2
ccgaauaaaggucuauauaua

SEQ ID NO: 2102596 - RNA, 22 nt, Staphylococcus aureus subsp. aureus MW2
ccgaauaaaggucuauauauau

SEQ ID NO: 2102597 - RNA, 15 nt, Staphylococcus aureus subsp. aureus MW2
aaacauagagaaauu

SEQ ID NO: 2102598 - RNA, 18 nt, Staphylococcus aureus subsp. aureus MW2
aaacauagagaauuucaa

SEQ ID NO: 2102599 - RNA, 13 nt, Staphylococcus aureus subsp. aureus MW2
aaacauaucuucu

SEQ ID NO: 2102600 - RNA, 14 nt, Staphylococcus aureus subsp. aureus MW2
aaacauaacaugac

SEQ ID NO: 2102601 - RNA, 20 nt, Staphylococcus aureus subsp. aureus MW2
aaacauucccuuaauaauaa

SEQ ID NO: 2102602 - RNA, 18 nt, Staphylococcus aureus subsp. aureus MW2
aaacauuauuaagugagu

SEQ ID NO: 2102603 - RNA, 12 nt, Staphylococcus aureus subsp. aureus MW2
aaacauuuagau

SEQ ID NO: 2102604 - RNA, 17 nt, Staphylococcus aureus subsp. aureus MW2
aaacauuuagauuucau

SEQ ID NO: 2102605 - RNA, 23 nt, Staphylococcus aureus subsp. aureus MW2
aaacauuuauauagauugccauu

SEQ ID NO: 2102606 - RNA, 16 nt, Staphylococcus aureus subsp. aureus MW2
aaaccacucauuuuuu

SEQ ID NO: 2102607 - RNA, 21 nt, Staphylococcus aureus subsp. aureus MW2
cccuacugcaccgauaucaua

SEQ ID NO: 2102608 - RNA, 16 nt, Staphylococcus aureus subsp. aureus MW2
cccuaugaaauaacua

SEQ ID NO: 2102609 - RNA, 21 nt, Staphylococcus aureus subsp. aureus MW2
cccuaucauacauauuuauau

SEQ ID NO: 2102610 - RNA, 15 nt, Staphylococcus aureus subsp. aureus MW2
cccuaaagcuaaugc

SEQ ID NO: 2102611 - RNA, 22 nt, Staphylococcus aureus subsp. aureus MW2
cccuacaaaguuuauacuuaau

SEQ ID NO: 2102612 - RNA, 13 nt, Staphylococcus aureus subsp. aureus MW2
cccguuugauuuc

SEQ ID NO: 2102613 - RNA, 15 nt, Staphylococcus aureus subsp. aureus MW2
aaacacccaauaauu

SEQ ID NO: 2102614 - RNA, 19 nt, Staphylococcus aureus subsp. aureus MW2
aaacacccugcuuaucauu

SEQ ID NO: 2102615 - RNA, 21 nt, Staphylococcus aureus subsp. aureus MW2
cccuccuggugcugcaccaag

SEQ ID NO: 2102616 - RNA, 21 nt, Staphylococcus aureus subsp. aureus MW2
cccaucuuuuagguaauaauu

SEQ ID NO: 2102617 - RNA, 13 nt, Staphylococcus aureus subsp. aureus MW2
cccauuuuaaagu

SEQ ID NO: 2102618 - RNA, 13 nt, Staphylococcus aureus subsp. aureus MW2
cccauuuuuaaaa

SEQ ID NO: 2102619 - RNA, 11 nt, Staphylococcus aureus subsp. aureus MW2
ccccaacacag

SEQ ID NO: 2102620 - RNA, 16 nt, Staphylococcus aureus subsp. aureus MW2
ccccaacacagagaaa

SEQ ID NO: 2102621 - RNA, 16 nt, Staphylococcus aureus subsp. aureus MW2
aaacacauaugcaggu

SEQ ID NO: 2102622 - RNA, 20 nt, Staphylococcus aureus subsp. aureus MW2
aaacacagacguuuuugaau

SEQ ID NO: 2102623 - RNA, 14 nt, Staphylococcus aureus subsp. aureus MW2
aaacacaguacaaa

SEQ ID NO: 2102624 - RNA, 16 nt, Staphylococcus aureus subsp. aureus MW2
aaacacaaauaaaagc

SEQ ID NO: 2102625 - RNA, 15 nt, Staphylococcus aureus subsp. aureus MW2
aaacacaaggaauau

SEQ ID NO: 2102626 - RNA, 18 nt, Staphylococcus aureus subsp. aureus MW2
aaacacacuguugaaaau

SEQ ID NO: 2102627 - RNA, 16 nt, Staphylococcus aureus subsp. aureus MW2
cccauaccuacaaaua

SEQ ID NO: 2102628 - RNA, 17 nt, Staphylococcus aureus subsp. aureus MW2
cccauaccuacaaauau

SEQ ID NO: 2102629 - RNA, 13 nt, Staphylococcus aureus subsp. aureus MW2
aaacaauuuaaaa

SEQ ID NO: 2102630 - RNA, 17 nt, Staphylococcus aureus subsp. aureus MW2
aaacaauuacaaaauca

SEQ ID NO: 2102631 - RNA, 22 nt, Staphylococcus aureus subsp. aureus MW2
cccagcuugaccgccuaugaua

SEQ ID NO: 2102632 - RNA, 17 nt, Staphylococcus aureus subsp. aureus MW2
ccauaugugguggcuau

SEQ ID NO: 2102633 - RNA, 16 nt, Staphylococcus aureus subsp. aureus MW2
ccauauguauuauaga

SEQ ID NO: 2102634 - RNA, 17 nt, Staphylococcus aureus subsp. aureus MW2
aaacaaugauuacuuua

SEQ ID NO: 2102635 - RNA, 22 nt, Staphylococcus aureus subsp. aureus MW2
ccaucauaaauguuauuaacca

SEQ ID NO: 2102636 - RNA, 19 nt, Staphylococcus aureus subsp. aureus MW2
ccauggaauaaauuuauaa

SEQ ID NO: 2102637 - RNA, 22 nt, Staphylococcus aureus subsp. aureus MW2
ccaugacgauuccaaucuauuu

SEQ ID NO: 2102638 - RNA, 20 nt, Staphylococcus aureus subsp. aureus MW2
ccaucguagcgcuuagauaa

SEQ ID NO: 2102639 - RNA, 20 nt, Staphylococcus aureus subsp. aureus MW2
ccaucuuuuagguaauaauu

SEQ ID NO: 2102640 - RNA, 18 nt, Staphylococcus aureus subsp. aureus MW2
ccaucuucuugauuguaa

SEQ ID NO: 2102641 - RNA, 19 nt, Staphylococcus aureus subsp. aureus MW2
ccaugugccuuugcuuuuu

SEQ ID NO: 2102642 - RNA, 17 nt, Staphylococcus aureus subsp. aureus MW2
ccauggcuuaaaucaaa

SEQ ID NO: 2102643 - RNA, 23 nt, Staphylococcus aureus subsp. aureus MW2
ccauucgaaagccaauuaauaaa

SEQ ID NO: 2102644 - RNA, 16 nt, Staphylococcus aureus subsp. aureus MW2
ccauuauuauuuuuuu

SEQ ID NO: 2102645 - RNA, 19 nt, Staphylococcus aureus subsp. aureus MW2
ccauuacaaugcgcaauga

SEQ ID NO: 2102646 - RNA, 16 nt, Staphylococcus aureus subsp. aureus MW2
ccauuucuuuuuucaa

SEQ ID NO: 2102647 - RNA, 16 nt, Staphylococcus aureus subsp. aureus MW2
ccauuuguaacaauau

SEQ ID NO: 2102648 - RNA, 17 nt, Staphylococcus aureus subsp. aureus MW2
ccauuuuuuuccaagca

SEQ ID NO: 2102649 - RNA, 18 nt, Staphylococcus aureus subsp. aureus MW2
ccauuuuuuuccaagcau

SEQ ID NO: 2102650 - RNA, 20 nt, Staphylococcus aureus subsp. aureus MW2
ccauaauuaaauaacuuuuu

SEQ ID NO: 2102651 - RNA, 14 nt, Staphylococcus aureus subsp. aureus MW2
ccauaaugacuaua

SEQ ID NO: 2102652 - RNA, 16 nt, Staphylococcus aureus subsp. aureus MW2
ccauacccauauuaaa

SEQ ID NO: 2102653 - RNA, 14 nt, Staphylococcus aureus subsp. aureus MW2
ccauaccuacaaau

SEQ ID NO: 2102654 - RNA, 19 nt, Staphylococcus aureus subsp. aureus MW2
ccauacuaaaacaugauac

SEQ ID NO: 2102655 - RNA, 11 nt, Staphylococcus aureus subsp. aureus MW2
ccauacguugu

SEQ ID NO: 2102656 - RNA, 15 nt, Staphylococcus aureus subsp. aureus MW2
ccauaguaacaaaau

SEQ ID NO: 2102657 - RNA, 18 nt, Staphylococcus aureus subsp. aureus MW2
ccauaguaacaaaaugau

SEQ ID NO: 2102658 - RNA, 14 nt, Staphylococcus aureus subsp. aureus MW2
ccaguuaauuauuu

SEQ ID NO: 2102659 - RNA, 17 nt, Staphylococcus aureus subsp. aureus MW2
ccaguuaauuauuuaga

SEQ ID NO: 2102660 - RNA, 18 nt, Staphylococcus aureus subsp. aureus MW2
ccagucauuguauaaaaa

SEQ ID NO: 2102661 - RNA, 13 nt, Staphylococcus aureus subsp. aureus MW2
ccagucauguccc

SEQ ID NO: 2102662 - RNA, 12 nt, Staphylococcus aureus subsp. aureus MW2
ccagucaauuuu

SEQ ID NO: 2102663 - RNA, 15 nt, Staphylococcus aureus subsp. aureus MW2
ccagucaauuuuuuc

SEQ ID NO: 2102664 - RNA, 23 nt, Staphylococcus aureus subsp. aureus MW2
ccaguacuuucgaguaauacuuu

SEQ ID NO: 2102665 - RNA, 21 nt, Staphylococcus aureus subsp. aureus MW2
ccaguacuuucgaguaauacu

SEQ ID NO: 2102666 - RNA, 13 nt, Staphylococcus aureus subsp. aureus MW2
ccaguauaauuuu

SEQ ID NO: 2102667 - RNA, 15 nt, Staphylococcus aureus subsp. aureus MW2
cgcuuggauuuuuug

SEQ ID NO: 2102668 - RNA, 20 nt, Staphylococcus aureus subsp. aureus MW2
cggcauaauacacauugcaa

SEQ ID NO: 2102669 - RNA, 18 nt, Staphylococcus aureus subsp. aureus MW2
cgccauaaucuucauuaa

SEQ ID NO: 2102670 - RNA, 13 nt, Staphylococcus aureus subsp. aureus MW2
cgccauacauaug

SEQ ID NO: 2102671 - RNA, 11 nt, Staphylococcus aureus subsp. aureus MW2
cgccagcuucu

SEQ ID NO: 2102672 - RNA, 13 nt, Staphylococcus aureus subsp. aureus MW2
cgcauacaggaaa

SEQ ID NO: 2102673 - RNA, 14 nt, Staphylococcus aureus subsp. aureus MW2
cgcaaugaaaacag

SEQ ID NO: 2102674 - RNA, 21 nt, Staphylococcus aureus subsp. aureus MW2
cgcaaucauuagcgaaaaccu

SEQ ID NO: 2102675 - RNA, 19 nt, Staphylococcus aureus subsp. aureus MW2
cgauuucauuaauuuuuuc

SEQ ID NO: 2102676 - RNA, 22 nt, Staphylococcus aureus subsp. aureus MW2
cgcacugcauuaucaacuugaa

SEQ ID NO: 2102677 - RNA, 15 nt, Staphylococcus aureus subsp. aureus MW2
cgauaccuaaaauac

SEQ ID NO: 2102678 - RNA, 23 nt, Staphylococcus aureus subsp. aureus MW2
cgauauagugcuuguuuauuaca

SEQ ID NO: 2102679 - RNA, 20 nt, Staphylococcus aureus subsp. aureus MW2
cgauagaaagcgucuuuuua

SEQ ID NO: 2102680 - RNA, 18 nt, Staphylococcus aureus subsp. aureus MW2
cgaucauaaauauuuucu

SEQ ID NO: 2102681 - RNA, 18 nt, Staphylococcus aureus subsp. aureus MW2
cgaucuuuuucaauguga

SEQ ID NO: 2102682 - RNA, 14 nt, Staphylococcus aureus subsp. aureus MW2
cgaugacuuuuuaa

SEQ ID NO: 2102683 - RNA, 16 nt, Staphylococcus aureus subsp. aureus MW2
cgaucuaacaauugca

SEQ ID NO: 2102684 - RNA, 15 nt, Staphylococcus aureus subsp. aureus MW2
cgauuaauucuucuu

SEQ ID NO: 2102685 - RNA, 19 nt, Staphylococcus aureus subsp. aureus MW2
cgauuauuuagauaaaaaa

SEQ ID NO: 2102686 - RNA, 19 nt, Staphylococcus aureus subsp. aureus MW2
cgauuaagaaugcaccaac

SEQ ID NO: 2102687 - RNA, 11 nt, Staphylococcus aureus subsp. aureus MW2
cgauuaauaua

SEQ ID NO: 2102688 - RNA, 23 nt, Staphylococcus aureus subsp. aureus MW2
cgauuaauauaagucuauuaugu

SEQ ID NO: 2102689 - RNA, 16 nt, Staphylococcus aureus subsp. aureus MW2
cgauuuauuauuacca

SEQ ID NO: 2102690 - RNA, 14 nt, Staphylococcus aureus subsp. aureus MW2
cgaugucagacgaa

SEQ ID NO: 2102691 - RNA, 16 nt, Staphylococcus aureus subsp. aureus MW2
cgcucuggauuuuucu

SEQ ID NO: 2102692 - RNA, 14 nt, Staphylococcus aureus subsp. aureus MW2
cgcucuuauaaaga

SEQ ID NO: 2102693 - RNA, 13 nt, Staphylococcus aureus subsp. aureus MW2
cgcucucuuuuua

SEQ ID NO: 2102694 - RNA, 23 nt, Staphylococcus aureus subsp. aureus MW2
cgcucauaugucuguuccucaau

SEQ ID NO: 2102695 - RNA, 14 nt, Staphylococcus aureus subsp. aureus MW2
cgcuccuacuuuuc

SEQ ID NO: 2102696 - RNA, 14 nt, Staphylococcus aureus subsp. aureus MW2
cgcugcuacaccac

SEQ ID NO: 2102697 - RNA, 13 nt, Staphylococcus aureus subsp. aureus MW2
cgcugcucuucuc

SEQ ID NO: 2102698 - RNA, 22 nt, Staphylococcus aureus subsp. aureus MW2
cgcuguaauaccuuuacuuuca

SEQ ID NO: 2102699 - RNA, 13 nt, Staphylococcus aureus subsp. aureus MW2
cgcuguuuuuaaa

SEQ ID NO: 2102700 - RNA, 23 nt, Staphylococcus aureus subsp. aureus MW2
cgcuguuuuuaaaugcuuuaaau

SEQ ID NO: 2102701 - RNA, 13 nt, Staphylococcus aureus subsp. aureus MW2
cgcuguuuuaaau

SEQ ID NO: 2102702 - RNA, 22 nt, Staphylococcus aureus subsp. aureus MW2
cgcuuagauaaauuaauaugaa

SEQ ID NO: 2102703 - RNA, 15 nt, Staphylococcus aureus subsp. aureus MW2
cgcuuacauuaugaa

SEQ ID NO: 2102704 - RNA, 20 nt, Staphylococcus aureus subsp. aureus MW2
cgcuuauacuauauaauaau

SEQ ID NO: 2102705 - RNA, 16 nt, Staphylococcus aureus subsp. aureus MW2
cgcuuauugcauugua

SEQ ID NO: 2102706 - RNA, 14 nt, Staphylococcus aureus subsp. aureus MW2
cgcuucaauuauuu

SEQ ID NO: 2102707 - RNA, 20 nt, Staphylococcus aureus subsp. aureus MW2
cgcgacguuuaaaugcccac

SEQ ID NO: 2102708 - RNA, 14 nt, Staphylococcus aureus subsp. aureus MW2
cgccuaaauauuua

SEQ ID NO: 2102709 - RNA, 21 nt, Staphylococcus aureus subsp. aureus MW2
uuuuuuaugcacaaaaaaauc

SEQ ID NO: 2102710 - RNA, 14 nt, Staphylococcus aureus subsp. aureus MW2
uuuuuguugcaauu

SEQ ID NO: 2102711 - RNA, 21 nt, Staphylococcus aureus subsp. aureus MW2
uuuuuguccccagcccuuuuc

SEQ ID NO: 2102712 - RNA, 13 nt, Staphylococcus aureus subsp. aureus MW2
uuuuuguauuuau

SEQ ID NO: 2102713 - RNA, 11 nt, Staphylococcus aureus subsp. aureus MW2
uuuuuuaauuu

SEQ ID NO: 2102714 - RNA, 18 nt, Staphylococcus aureus subsp. aureus MW2
uuuuuuaaugaaucugua

SEQ ID NO: 2102715 - RNA, 19 nt, Staphylococcus aureus subsp. aureus MW2
uuuuuuaacuuuaacaauu

SEQ ID NO: 2102716 - RNA, 13 nt, Staphylococcus aureus subsp. aureus MW2
uuuuuuaaaauga

SEQ ID NO: 2102717 - RNA, 14 nt, Staphylococcus aureus subsp. aureus MW2
uuuuucuaaauaaa

SEQ ID NO: 2102718 - RNA, 15 nt, Staphylococcus aureus subsp. aureus MW2
uuuuucguaacauuu

SEQ ID NO: 2102719 - RNA, 13 nt, Staphylococcus aureus subsp. aureus MW2
uuuuucgcauuaa

SEQ ID NO: 2102720 - RNA, 18 nt, Staphylococcus aureus subsp. aureus MW2
uuuugauuuacgugcauu

SEQ ID NO: 2102721 - RNA, 19 nt, Staphylococcus aureus subsp. aureus MW2
uuuugauuaguaaauauag

SEQ ID NO: 2102722 - RNA, 16 nt, Staphylococcus aureus subsp. aureus MW2
uuuugauggucagcaa

SEQ ID NO: 2102723 - RNA, 17 nt, Staphylococcus aureus subsp. aureus MW2
uuuuugaauaucuaaug

SEQ ID NO: 2102724 - RNA, 17 nt, Staphylococcus aureus subsp. aureus MW2
uuuuugacauauuuuuu

SEQ ID NO: 2102725 - RNA, 17 nt, Staphylococcus aureus subsp. aureus MW2
uuuuugagcacuuaaua

SEQ ID NO: 2102726 - RNA, 18 nt, Staphylococcus aureus subsp. aureus MW2
uuuuugauuuaacugggc

SEQ ID NO: 2102727 - RNA, 14 nt, Staphylococcus aureus subsp. aureus MW2
uuuuugguagcauu

SEQ ID NO: 2102728 - RNA, 15 nt, Staphylococcus aureus subsp. aureus MW2
uuuuuguaauacauc

SEQ ID NO: 2102729 - RNA, 12 nt, Staphylococcus aureus subsp. aureus MW2
uuuuugccauca

SEQ ID NO: 2102730 - RNA, 16 nt, Staphylococcus aureus subsp. aureus MW2
uuuguguaucuguaac

SEQ ID NO: 2102731 - RNA, 22 nt, Staphylococcus aureus subsp. aureus MW2
uuuguggcgcaguuugcaaagc

SEQ ID NO: 2102732 - RNA, 11 nt, Staphylococcus aureus subsp. aureus MW2
uuugugguaau

SEQ ID NO: 2102733 - RNA, 17 nt, Staphylococcus aureus subsp. aureus MW2
uuugugcuuuuuuguuu

SEQ ID NO: 2102734 - RNA, 15 nt, Staphylococcus aureus subsp. aureus MW2
uuugucucucaacau

SEQ ID NO: 2102735 - RNA, 13 nt, Staphylococcus aureus subsp. aureus MW2
uuuguuuugaaug

SEQ ID NO: 2102736 - RNA, 12 nt, Staphylococcus aureus subsp. aureus MW2
uuuguuuuaaau

SEQ ID NO: 2102737 - RNA, 12 nt, Staphylococcus aureus subsp. aureus MW2
uuuguuuuaaaa

SEQ ID NO: 2102738 - RNA, 13 nt, Staphylococcus aureus subsp. aureus MW2
uuuguuucuaaau

SEQ ID NO: 2102739 - RNA, 23 nt, Staphylococcus aureus subsp. aureus MW2
uuuguuuacggauuuuucucauu

SEQ ID NO: 2102740 - RNA, 19 nt, Staphylococcus aureus subsp. aureus MW2
uuuguuguuuuaauuucac

SEQ ID NO: 2102741 - RNA, 16 nt, Staphylococcus aureus subsp. aureus MW2
uuuguuauaucuaauu

SEQ ID NO: 2102742 - RNA, 21 nt, Staphylococcus aureus subsp. aureus MW2
uuuguuaccaaacaauacaua

SEQ ID NO: 2102743 - RNA, 18 nt, Staphylococcus aureus subsp. aureus MW2
uuuguguuugcuuuuauu

SEQ ID NO: 2102744 - RNA, 12 nt, Staphylococcus aureus subsp. aureus MW2
uuuguuaaaaaa

SEQ ID NO: 2102745 - RNA, 17 nt, Staphylococcus aureus subsp. aureus MW2
uuuguuaaaaaauuaaa

SEQ ID NO: 2102746 - RNA, 17 nt, Staphylococcus aureus subsp. aureus MW2
uuuguucaaucacuaua

SEQ ID NO: 2102747 - RNA, 17 nt, Staphylococcus aureus subsp. aureus MW2
uuuuaaaaaauuuaaau

SEQ ID NO: 2102748 - RNA, 15 nt, Staphylococcus aureus subsp. aureus MW2
uuuuaaaaaacauac

SEQ ID NO: 2102749 - RNA, 19 nt, Staphylococcus aureus subsp. aureus MW2
uuuuaaaaaauuuaaauaa

SEQ ID NO: 2102750 - RNA, 12 nt, Staphylococcus aureus subsp. aureus MW2
uuuuaaaaaccu

SEQ ID NO: 2102751 - RNA, 16 nt, Staphylococcus aureus subsp. aureus MW2
uuuuaaaaauacagcu

SEQ ID NO: 2102752 - RNA, 15 nt, Staphylococcus aureus subsp. aureus MW2
uuuuaaaaauucaua

SEQ ID NO: 2102753 - RNA, 12 nt, Staphylococcus aureus subsp. aureus MW2
uuuuaaaauacg

SEQ ID NO: 2102754 - RNA, 11 nt, Staphylococcus aureus subsp. aureus MW2
uuuuaaaggac

SEQ ID NO: 2102755 - RNA, 23 nt, Staphylococcus aureus subsp. aureus MW2
uuuuaaauaaucgaaaauuucag

SEQ ID NO: 2102756 - RNA, 16 nt, Staphylococcus aureus subsp. aureus MW2
uuuuaaauaaaaugca

SEQ ID NO: 2102757 - RNA, 23 nt, Staphylococcus aureus subsp. aureus MW2
uuuuaaacucauccauugaucuu

SEQ ID NO: 2102758 - RNA, 19 nt, Staphylococcus aureus subsp. aureus MW2
uuuuaaacguacauuuuua

SEQ ID NO: 2102759 - RNA, 21 nt, Staphylococcus aureus subsp. aureus MW2
uuuuaaaauuaugauuauuuu

SEQ ID NO: 2102760 - RNA, 16 nt, Staphylococcus aureus subsp. aureus MW2
uuuuaaacaaaaauaa

SEQ ID NO: 2102761 - RNA, 13 nt, Staphylococcus aureus subsp. aureus MW2
uuuuaaaucuuuu

SEQ ID NO: 2102762 - RNA, 13 nt, Staphylococcus aureus subsp. aureus MW2
uuuuaaauuacua

SEQ ID NO: 2102763 - RNA, 18 nt, Staphylococcus aureus subsp. aureus MW2
uuuuaaaucuacaauauu

SEQ ID NO: 2102764 - RNA, 17 nt, Staphylococcus aureus subsp. aureus MW2
uuuuaaaucuauauaaa

SEQ ID NO: 2102765 - RNA, 17 nt, Staphylococcus aureus subsp. aureus MW2
uuuuaaauuuaauuucg

SEQ ID NO: 2102766 - RNA, 13 nt, Staphylococcus aureus subsp. aureus MW2
uuuuaaauuuaag

SEQ ID NO: 2102767 - RNA, 12 nt, Staphylococcus aureus subsp. aureus MW2
uuuuaaauucuu

SEQ ID NO: 2102768 - RNA, 21 nt, Staphylococcus aureus subsp. aureus MW2
uuuuaacaaaauauacuaaau

SEQ ID NO: 2102769 - RNA, 23 nt, Staphylococcus aureus subsp. aureus MW2
uuuuaacaagugaugaaaaagag

SEQ ID NO: 2102770 - RNA, 20 nt, Staphylococcus aureus subsp. aureus MW2
uuuuaacagcgugaauauaa

SEQ ID NO: 2102771 - RNA, 13 nt, Staphylococcus aureus subsp. aureus MW2
uuuuaacaucauu

SEQ ID NO: 2102772 - RNA, 17 nt, Staphylococcus aureus subsp. aureus MW2
uuuuaacaaaauauacu

SEQ ID NO: 2102773 - RNA, 15 nt, Staphylococcus aureus subsp. aureus MW2
uuuuaacaaaauaua

SEQ ID NO: 2102774 - RNA, 12 nt, Staphylococcus aureus subsp. aureus MW2
uuuuaaauuuag

SEQ ID NO: 2102775 - RNA, 19 nt, Staphylococcus aureus subsp. aureus MW2
uuuuaacgaagccuaauuu

SEQ ID NO: 2102776 - RNA, 17 nt, Staphylococcus aureus subsp. aureus MW2
uuuuaauauauuuauuu

SEQ ID NO: 2102777 - RNA, 21 nt, Staphylococcus aureus subsp. aureus MW2
uuuuaauauauuuauuuuuga

SEQ ID NO: 2102778 - RNA, 23 nt, Staphylococcus aureus subsp. aureus MW2
uuuuaaguuguugauuuaaaaua

SEQ ID NO: 2102779 - RNA, 12 nt, Staphylococcus aureus subsp. aureus MW2
uuuuaagugaug

SEQ ID NO: 2102780 - RNA, 23 nt, Staphylococcus aureus subsp. aureus MW2
uuuuaacuuuaacaucugaaucu

SEQ ID NO: 2102781 - RNA, 20 nt, Staphylococcus aureus subsp. aureus MW2
uuuuaacugguugauaaaua

SEQ ID NO: 2102782 - RNA, 17 nt, Staphylococcus aureus subsp. aureus MW2
uuuuaagacuuuaaaau

SEQ ID NO: 2102783 - RNA, 24 nt, Staphylococcus aureus subsp. aureus MW2
uuuuaaggcagcuaaaaaguauac

SEQ ID NO: 2102784 - RNA, 22 nt, Staphylococcus aureus subsp. aureus MW2
uuugguucaaucauucacuuca

SEQ ID NO: 2102785 - RNA, 15 nt, Staphylococcus aureus subsp. aureus MW2
uuugguuugcuuuaa

SEQ ID NO: 2102786 - RNA, 17 nt, Staphylococcus aureus subsp. aureus MW2
uuugguaggcauuuuau

SEQ ID NO: 2102787 - RNA, 12 nt, Staphylococcus aureus subsp. aureus MW2
uuuggucaaguu

SEQ ID NO: 2102788 - RNA, 22 nt, Staphylococcus aureus subsp. aureus MW2
uuugggaauuguauuaaucaaa

SEQ ID NO: 2102789 - RNA, 18 nt, Staphylococcus aureus subsp. aureus MW2
uuuguaauucuuguaaau

SEQ ID NO: 2102790 - RNA, 13 nt, Staphylococcus aureus subsp. aureus MW2
uuuguacauaaaa

SEQ ID NO: 2102791 - RNA, 14 nt, Staphylococcus aureus subsp. aureus MW2
uuuguacauaaaaa

SEQ ID NO: 2102792 - RNA, 16 nt, Staphylococcus aureus subsp. aureus MW2
uuuguacauaaaaaua

SEQ ID NO: 2102793 - RNA, 13 nt, Staphylococcus aureus subsp. aureus MW2
uuuguaauacauc

SEQ ID NO: 2102794 - RNA, 18 nt, Staphylococcus aureus subsp. aureus MW2
uuuguaaccuaaaaacaa

SEQ ID NO: 2102795 - RNA, 17 nt, Staphylococcus aureus subsp. aureus MW2
uuuguaacguucuuaua

SEQ ID NO: 2102796 - RNA, 22 nt, Staphylococcus aureus subsp. aureus MW2
uuuguaaccccauuuuaaaguc

SEQ ID NO: 2102797 - RNA, 14 nt, Staphylococcus aureus subsp. aureus MW2
uuuguaaauuuuua

SEQ ID NO: 2102798 - RNA, 19 nt, Staphylococcus aureus subsp. aureus MW2
uuuguauaccuauuccuau

SEQ ID NO: 2102799 - RNA, 16 nt, Staphylococcus aureus subsp. aureus MW2
uuuguaugauaaccau

SEQ ID NO: 2102800 - RNA, 14 nt, Staphylococcus aureus subsp. aureus MW2
uuuguauuagcauc

SEQ ID NO: 2102801 - RNA, 15 nt, Staphylococcus aureus subsp. aureus MW2
uuuguauuguuugaa

SEQ ID NO: 2102802 - RNA, 14 nt, Staphylococcus aureus subsp. aureus MW2
uuuguauuuaaaau

SEQ ID NO: 2102803 - RNA, 16 nt, Staphylococcus aureus subsp. aureus MW2
uuuguauuuuucaaau

SEQ ID NO: 2102804 - RNA, 21 nt, Staphylococcus aureus subsp. aureus MW2
uuugucacucuuuaaaucaaa

SEQ ID NO: 2102805 - RNA, 22 nt, Staphylococcus aureus subsp. aureus MW2
uuugcucuaaacuucuauuaau

SEQ ID NO: 2102806 - RNA, 22 nt, Staphylococcus aureus subsp. aureus MW2
uuugcugaaugaagcauuuuau

SEQ ID NO: 2102807 - RNA, 20 nt, Staphylococcus aureus subsp. aureus MW2
uuugcugguugcuucuuauc

SEQ ID NO: 2102808 - RNA, 18 nt, Staphylococcus aureus subsp. aureus MW2
uuugcuaaccaucauaaa

SEQ ID NO: 2102809 - RNA, 16 nt, Staphylococcus aureus subsp. aureus MW2
uuugcuuuuuguaaug

SEQ ID NO: 2102810 - RNA, 15 nt, Staphylococcus aureus subsp. aureus MW2
uuuggaacauauuca

SEQ ID NO: 2102811 - RNA, 14 nt, Staphylococcus aureus subsp. aureus MW2
uuuggaaauaucuu

SEQ ID NO: 2102812 - RNA, 17 nt, Staphylococcus aureus subsp. aureus MW2
uuugcuuaaaccuuaau

SEQ ID NO: 2102813 - RNA, 16 nt, Staphylococcus aureus subsp. aureus MW2
uuuggaauacuuuucu

SEQ ID NO: 2102814 - RNA, 18 nt, Staphylococcus aureus subsp. aureus MW2
uuuggaauacuuuucuuc

SEQ ID NO: 2102815 - RNA, 13 nt, Staphylococcus aureus subsp. aureus MW2
uuuuccaauaaua

SEQ ID NO: 2102816 - RNA, 13 nt, Staphylococcus aureus subsp. aureus MW2
uuuuccaacuucu

SEQ ID NO: 2102817 - RNA, 19 nt, Staphylococcus aureus subsp. aureus MW2
uuuuccaacuucuuuugua

SEQ ID NO: 2102818 - RNA, 20 nt, Staphylococcus aureus subsp. aureus MW2
uuuuauuuuuuucacuaauu

SEQ ID NO: 2102819 - RNA, 16 nt, Staphylococcus aureus subsp. aureus MW2
uuuuauuuuauuuuuu

SEQ ID NO: 2102820 - RNA, 13 nt, Staphylococcus aureus subsp. aureus MW2
uuuuauuuuuaau

SEQ ID NO: 2102821 - RNA, 16 nt, Staphylococcus aureus subsp. aureus MW2
uuuucaaaaauagucg

SEQ ID NO: 2102822 - RNA, 15 nt, Staphylococcus aureus subsp. aureus MW2
uuuucaauauuugau

SEQ ID NO: 2102823 - RNA, 13 nt, Staphylococcus aureus subsp. aureus MW2
uuuuauuuauauu

SEQ ID NO: 2102824 - RNA, 11 nt, Staphylococcus aureus subsp. aureus MW2
uuuuauuuauc

SEQ ID NO: 2102825 - RNA, 18 nt, Staphylococcus aureus subsp. aureus MW2
uuuuauuugauuauucuu

SEQ ID NO: 2102826 - RNA, 22 nt, Staphylococcus aureus subsp. aureus MW2
uuuuauuaucaguccaaucagu

SEQ ID NO: 2102827 - RNA, 13 nt, Staphylococcus aureus subsp. aureus MW2
uuuuauucuaaua

SEQ ID NO: 2102828 - RNA, 14 nt, Staphylococcus aureus subsp. aureus MW2
uuuuauuuaaaaau

SEQ ID NO: 2102829 - RNA, 16 nt, Staphylococcus aureus subsp. aureus MW2
uuuuauuuaaaaauag

SEQ ID NO: 2102830 - RNA, 13 nt, Staphylococcus aureus subsp. aureus MW2
uuuuauuaauuaa

SEQ ID NO: 2102831 - RNA, 19 nt, Staphylococcus aureus subsp. aureus MW2
uuuuauguuuaauuugauu

SEQ ID NO: 2102832 - RNA, 14 nt, Staphylococcus aureus subsp. aureus MW2
uuuuauuaaugaag

SEQ ID NO: 2102833 - RNA, 15 nt, Staphylococcus aureus subsp. aureus MW2
uuuuauguuauaauu

SEQ ID NO: 2102834 - RNA, 13 nt, Staphylococcus aureus subsp. aureus MW2
uuuucuauggcac

SEQ ID NO: 2102835 - RNA, 14 nt, Staphylococcus aureus subsp. aureus MW2
uuuucuaaacaacu

SEQ ID NO: 2102836 - RNA, 20 nt, Staphylococcus aureus subsp. aureus MW2
uuuucguuaacucuaucuau

SEQ ID NO: 2102837 - RNA, 16 nt, Staphylococcus aureus subsp. aureus MW2
uuuugaaacaucuaaa

SEQ ID NO: 2102838 - RNA, 22 nt, Staphylococcus aureus subsp. aureus MW2
uuuugaaacaucuaaauaguuu

SEQ ID NO: 2102839 - RNA, 19 nt, Staphylococcus aureus subsp. aureus MW2
uuuugaaucauacgaauuu

SEQ ID NO: 2102840 - RNA, 19 nt, Staphylococcus aureus subsp. aureus MW2
uuuugaagggacaaugaag

SEQ ID NO: 2102841 - RNA, 21 nt, Staphylococcus aureus subsp. aureus MW2
uuuugaaucacauuaacaagg

SEQ ID NO: 2102842 - RNA, 12 nt, Staphylococcus aureus subsp. aureus MW2
uuuugaauauuu

SEQ ID NO: 2102843 - RNA, 21 nt, Staphylococcus aureus subsp. aureus MW2
uuuugaauaauaaacuuaaaa

SEQ ID NO: 2102844 - RNA, 17 nt, Staphylococcus aureus subsp. aureus MW2
uuuucuuccacacaaau

SEQ ID NO: 2102845 - RNA, 17 nt, Staphylococcus aureus subsp. aureus MW2
uuuucuccaacgucaua

SEQ ID NO: 2102846 - RNA, 20 nt, Staphylococcus aureus subsp. aureus MW2
uuuucuuaguuugacaucua

SEQ ID NO: 2102847 - RNA, 23 nt, Staphylococcus aureus subsp. aureus MW2
uuuucuuaaacgcucuucuucuu

SEQ ID NO: 2102848 - RNA, 19 nt, Staphylococcus aureus subsp. aureus MW2
uuuucuguccaaaaagguu

SEQ ID NO: 2102849 - RNA, 19 nt, Staphylococcus aureus subsp. aureus MW2
uuuuagccccagcaaauac

SEQ ID NO: 2102850 - RNA, 20 nt, Staphylococcus aureus subsp. aureus MW2
uuuuagacauaaaaaaagag

SEQ ID NO: 2102851 - RNA, 14 nt, Staphylococcus aureus subsp. aureus MW2
uuuuaccuuuaauu

SEQ ID NO: 2102852 - RNA, 23 nt, Staphylococcus aureus subsp. aureus MW2
uuuuaccuucgcauacuuuuuca

SEQ ID NO: 2102853 - RNA, 21 nt, Staphylococcus aureus subsp. aureus MW2
uuuuacuaggaauauaaaacu

SEQ ID NO: 2102854 - RNA, 19 nt, Staphylococcus aureus subsp. aureus MW2
uuuuacuaggaauauaaaa

SEQ ID NO: 2102855 - RNA, 13 nt, Staphylococcus aureus subsp. aureus MW2
uuuuacaaaguga

SEQ ID NO: 2102856 - RNA, 19 nt, Staphylococcus aureus subsp. aureus MW2
uuuuacaagcuuuauaaaa

SEQ ID NO: 2102857 - RNA, 19 nt, Staphylococcus aureus subsp. aureus MW2
uuuuacaaagugauuuaaa

SEQ ID NO: 2102858 - RNA, 21 nt, Staphylococcus aureus subsp. aureus MW2
uuuuacauugccuaagaacuu

SEQ ID NO: 2102859 - RNA, 19 nt, Staphylococcus aureus subsp. aureus MW2
uuuuaauuguuuaauaaca

SEQ ID NO: 2102860 - RNA, 19 nt, Staphylococcus aureus subsp. aureus MW2
uuuuaauuaauuaucauaa

SEQ ID NO: 2102861 - RNA, 16 nt, Staphylococcus aureus subsp. aureus MW2
uuuuaauuccaaagaa

SEQ ID NO: 2102862 - RNA, 18 nt, Staphylococcus aureus subsp. aureus MW2
uuuuaauuuguauuuaaa

SEQ ID NO: 2102863 - RNA, 21 nt, Staphylococcus aureus subsp. aureus MW2
uuuuaauuuugacauaaaaaa

SEQ ID NO: 2102864 - RNA, 15 nt, Staphylococcus aureus subsp. aureus MW2
uuuuaauguuacauu

SEQ ID NO: 2102865 - RNA, 22 nt, Staphylococcus aureus subsp. aureus MW2
uuuuaauauuugauaacaaaau

SEQ ID NO: 2102866 - RNA, 18 nt, Staphylococcus aureus subsp. aureus MW2
uuuuaucaauauuaguuu

SEQ ID NO: 2102867 - RNA, 18 nt, Staphylococcus aureus subsp. aureus MW2
uuuuauaugcaacuuaua

SEQ ID NO: 2102868 - RNA, 14 nt, Staphylococcus aureus subsp. aureus MW2
uuuuauauuuauuu

SEQ ID NO: 2102869 - RNA, 21 nt, Staphylococcus aureus subsp. aureus MW2
uuuuaucuaucgguaauuuuu

SEQ ID NO: 2102870 - RNA, 13 nt, Staphylococcus aureus subsp. aureus MW2
uuuuaucugaauc

SEQ ID NO: 2102871 - RNA, 18 nt, Staphylococcus aureus subsp. aureus MW2
uuuuaucugaaaauauca

SEQ ID NO: 2102872 - RNA, 18 nt, Staphylococcus aureus subsp. aureus MW2
uuuuaugacguaauuaau

SEQ ID NO: 2102873 - RNA, 15 nt, Staphylococcus aureus subsp. aureus MW2
uuuuaugauuugauu

SEQ ID NO: 2102874 - RNA, 15 nt, Staphylococcus aureus subsp. aureus MW2
uuuuaguuaaaguga

SEQ ID NO: 2102875 - RNA, 23 nt, Staphylococcus aureus subsp. aureus MW2
uuuuaguuagaaaguauuuauuu

SEQ ID NO: 2102876 - RNA, 19 nt, Staphylococcus aureus subsp. aureus MW2
uuuuaguaauuuuacaaaa

SEQ ID NO: 2102877 - RNA, 20 nt, Staphylococcus aureus subsp. aureus MW2
uuuuaggaugcauauauaua

SEQ ID NO: 2102878 - RNA, 15 nt, Staphylococcus aureus subsp. aureus MW2
uuuuagcuauagaaa

SEQ ID NO: 2102879 - RNA, 21 nt, Staphylococcus aureus subsp. aureus MW2
uuuuagccccagcaaauacuu

SEQ ID NO: 2102880 - RNA, 15 nt, Staphylococcus aureus subsp. aureus MW2
uuuuagcuuguuguu

SEQ ID NO: 2102881 - RNA, 13 nt, Staphylococcus aureus subsp. aureus MW2
uuuuauaaauuuu

SEQ ID NO: 2102882 - RNA, 12 nt, Staphylococcus aureus subsp. aureus MW2
uuuuauaaauua

SEQ ID NO: 2102883 - RNA, 17 nt, Staphylococcus aureus subsp. aureus MW2
uuuuaguuguagaguuu

SEQ ID NO: 2102884 - RNA, 18 nt, Staphylococcus aureus subsp. aureus MW2
uuuuagguaauaauucag

SEQ ID NO: 2102885 - RNA, 11 nt, Staphylococcus aureus subsp. aureus MW2
uuuuauaaaaa

SEQ ID NO: 2102886 - RNA, 21 nt, Staphylococcus aureus subsp. aureus MW2
uuuuauaaaaaguuauuuaag

SEQ ID NO: 2102887 - RNA, 13 nt, Staphylococcus aureus subsp. aureus MW2
uuuuauaguaaua

SEQ ID NO: 2102888 - RNA, 17 nt, Staphylococcus aureus subsp. aureus MW2
uugaacaacaucuuuug

SEQ ID NO: 2102889 - RNA, 17 nt, Staphylococcus aureus subsp. aureus MW2
uugaaauuuauuauaau

SEQ ID NO: 2102890 - RNA, 19 nt, Staphylococcus aureus subsp. aureus MW2
uugaacaauucuucaucau

SEQ ID NO: 2102891 - RNA, 15 nt, Staphylococcus aureus subsp. aureus MW2
uugaacaauucuuca

SEQ ID NO: 2102892 - RNA, 18 nt, Staphylococcus aureus subsp. aureus MW2
uugaagaugcuuuaauua

SEQ ID NO: 2102893 - RNA, 13 nt, Staphylococcus aureus subsp. aureus MW2
uugaacagauuca

SEQ ID NO: 2102894 - RNA, 20 nt, Staphylococcus aureus subsp. aureus MW2
uugaagaugcuuuaauuaaa

SEQ ID NO: 2102895 - RNA, 20 nt, Staphylococcus aureus subsp. aureus MW2
uugaagggagcauuucauua

SEQ ID NO: 2102896 - RNA, 13 nt, Staphylococcus aureus subsp. aureus MW2
uugaauaauucuu

SEQ ID NO: 2102897 - RNA, 17 nt, Staphylococcus aureus subsp. aureus MW2
uugaauaccuuuuauua

SEQ ID NO: 2102898 - RNA, 15 nt, Staphylococcus aureus subsp. aureus MW2
uugaauacuuuauuu

SEQ ID NO: 2102899 - RNA, 21 nt, Staphylococcus aureus subsp. aureus MW2
uugaauagugagcguauuauu

SEQ ID NO: 2102900 - RNA, 21 nt, Staphylococcus aureus subsp. aureus MW2
uugaaguuacuauauuuauua

SEQ ID NO: 2102901 - RNA, 22 nt, Staphylococcus aureus subsp. aureus MW2
uugaagugaguuuaucuacauu

SEQ ID NO: 2102902 - RNA, 12 nt, Staphylococcus aureus subsp. aureus MW2
uugaaguuguuu

SEQ ID NO: 2102903 - RNA, 16 nt, Staphylococcus aureus subsp. aureus MW2
uugaaguuguuucucc

SEQ ID NO: 2102904 - RNA, 13 nt, Staphylococcus aureus subsp. aureus MW2
uugaauaaaaaaa

SEQ ID NO: 2102905 - RNA, 19 nt, Staphylococcus aureus subsp. aureus MW2
uugacacacccaaauuuag

SEQ ID NO: 2102906 - RNA, 14 nt, Staphylococcus aureus subsp. aureus MW2
uugacaaucuaaau

SEQ ID NO: 2102907 - RNA, 20 nt, Staphylococcus aureus subsp. aureus MW2
uugaaucauacgaauuugug

SEQ ID NO: 2102908 - RNA, 20 nt, Staphylococcus aureus subsp. aureus MW2
uugaaucaacaguuuuauua

SEQ ID NO: 2102909 - RNA, 16 nt, Staphylococcus aureus subsp. aureus MW2
uugaaucaacaguuuu

SEQ ID NO: 2102910 - RNA, 14 nt, Staphylococcus aureus subsp. aureus MW2
uugaauauaaaaaa

SEQ ID NO: 2102911 - RNA, 14 nt, Staphylococcus aureus subsp. aureus MW2
uugacauuugacca

SEQ ID NO: 2102912 - RNA, 22 nt, Staphylococcus aureus subsp. aureus MW2
uugacauaccagguuauagaau

SEQ ID NO: 2102913 - RNA, 24 nt, Staphylococcus aureus subsp. aureus MW2
uucuuucaggcuuuguuuuucacu

SEQ ID NO: 2102914 - RNA, 12 nt, Staphylococcus aureus subsp. aureus MW2
uucuuucauaaa

SEQ ID NO: 2102915 - RNA, 12 nt, Staphylococcus aureus subsp. aureus MW2
uucuuucuaaaa

SEQ ID NO: 2102916 - RNA, 23 nt, Staphylococcus aureus subsp. aureus MW2
uucuuuaauuaaaucuucaagug

SEQ ID NO: 2102917 - RNA, 23 nt, Staphylococcus aureus subsp. aureus MW2
uucuuuaugauaauaagaauauu

SEQ ID NO: 2102918 - RNA, 16 nt, Staphylococcus aureus subsp. aureus MW2
uucuuuauuagaauga

SEQ ID NO: 2102919 - RNA, 19 nt, Staphylococcus aureus subsp. aureus MW2
uucuuuaucauaucuauau

SEQ ID NO: 2102920 - RNA, 21 nt, Staphylococcus aureus subsp. aureus MW2
uucuuguuuagggaaucccau

SEQ ID NO: 2102921 - RNA, 22 nt, Staphylococcus aureus subsp. aureus MW2
uucuuuaacaauugauugcucu

SEQ ID NO: 2102922 - RNA, 12 nt, Staphylococcus aureus subsp. aureus MW2
uucuuuaacaau

SEQ ID NO: 2102923 - RNA, 13 nt, Staphylococcus aureus subsp. aureus MW2
uucuuuaagcuuu

SEQ ID NO: 2102924 - RNA, 23 nt, Staphylococcus aureus subsp. aureus MW2
uucuucuuguuuagggaauccca

SEQ ID NO: 2102925 - RNA, 14 nt, Staphylococcus aureus subsp. aureus MW2
uucuucuuuuuuau

SEQ ID NO: 2102926 - RNA, 13 nt, Staphylococcus aureus subsp. aureus MW2
uucuucuucagga

SEQ ID NO: 2102927 - RNA, 13 nt, Staphylococcus aureus subsp. aureus MW2
uucuucuucagua

SEQ ID NO: 2102928 - RNA, 17 nt, Staphylococcus aureus subsp. aureus MW2
uucuuuucgaaauucuc

SEQ ID NO: 2102929 - RNA, 14 nt, Staphylococcus aureus subsp. aureus MW2
uucuuuuguuuuac

SEQ ID NO: 2102930 - RNA, 13 nt, Staphylococcus aureus subsp. aureus MW2
uucuuuuguaauu

SEQ ID NO: 2102931 - RNA, 19 nt, Staphylococcus aureus subsp. aureus MW2
uucuuuuguaauugaaaug

SEQ ID NO: 2102932 - RNA, 23 nt, Staphylococcus aureus subsp. aureus MW2
uucuuuuguaauugaaaugauag

SEQ ID NO: 2102933 - RNA, 19 nt, Staphylococcus aureus subsp. aureus MW2
uugaaaaguaauuaaauac

SEQ ID NO: 2102934 - RNA, 12 nt, Staphylococcus aureus subsp. aureus MW2
uugaaaaguuug

SEQ ID NO: 2102935 - RNA, 16 nt, Staphylococcus aureus subsp. aureus MW2
uugaaaagauaaacaa

SEQ ID NO: 2102936 - RNA, 17 nt, Staphylococcus aureus subsp. aureus MW2
uugaaaaucuaauccug

SEQ ID NO: 2102937 - RNA, 17 nt, Staphylococcus aureus subsp. aureus MW2
uugaaauaaucuaguau

SEQ ID NO: 2102938 - RNA, 14 nt, Staphylococcus aureus subsp. aureus MW2
uugaaaugauaaaa

SEQ ID NO: 2102939 - RNA, 18 nt, Staphylococcus aureus subsp. aureus MW2
uugaaauguuuauaauaa

SEQ ID NO: 2102940 - RNA, 18 nt, Staphylococcus aureus subsp. aureus MW2
uugagagauuauuuaaaa

SEQ ID NO: 2102941 - RNA, 21 nt, Staphylococcus aureus subsp. aureus MW2
uugaccgccuaugauauaugu

SEQ ID NO: 2102942 - RNA, 14 nt, Staphylococcus aureus subsp. aureus MW2
uugacccccuguau

SEQ ID NO: 2102943 - RNA, 20 nt, Staphylococcus aureus subsp. aureus MW2
uugacucaaagauauacuua

SEQ ID NO: 2102944 - RNA, 14 nt, Staphylococcus aureus subsp. aureus MW2
uugacguucugauc

SEQ ID NO: 2102945 - RNA, 12 nt, Staphylococcus aureus subsp. aureus MW2
uugauauaaaaa

SEQ ID NO: 2102946 - RNA, 13 nt, Staphylococcus aureus subsp. aureus MW2
uugauauaaaaag

SEQ ID NO: 2102947 - RNA, 23 nt, Staphylococcus aureus subsp. aureus MW2
uugauauaaaaagugaaaguauu

SEQ ID NO: 2102948 - RNA, 20 nt, Staphylococcus aureus subsp. aureus MW2
uugauauaguuauaugugcu

SEQ ID NO: 2102949 - RNA, 17 nt, Staphylococcus aureus subsp. aureus MW2
uugauaguaauaguuaa

SEQ ID NO: 2102950 - RNA, 15 nt, Staphylococcus aureus subsp. aureus MW2
uugauagauagaaau

SEQ ID NO: 2102951 - RNA, 20 nt, Staphylococcus aureus subsp. aureus MW2
uugauagcaccguaacauau

SEQ ID NO: 2102952 - RNA, 21 nt, Staphylococcus aureus subsp. aureus MW2
uugauaaguagaaaauaugac

SEQ ID NO: 2102953 - RNA, 23 nt, Staphylococcus aureus subsp. aureus MW2
uugaggaccacggucuugauauu

SEQ ID NO: 2102954 - RNA, 15 nt, Staphylococcus aureus subsp. aureus MW2
uugcaaauuaucauu

SEQ ID NO: 2102955 - RNA, 19 nt, Staphylococcus aureus subsp. aureus MW2
uugcaaauuaucauuaaau

SEQ ID NO: 2102956 - RNA, 20 nt, Staphylococcus aureus subsp. aureus MW2
uugcaaauuaucauuaaauu

SEQ ID NO: 2102957 - RNA, 21 nt, Staphylococcus aureus subsp. aureus MW2
uugcaaaauuuugcaaaaaaa

SEQ ID NO: 2102958 - RNA, 12 nt, Staphylococcus aureus subsp. aureus MW2
uugauuauguaa

SEQ ID NO: 2102959 - RNA, 17 nt, Staphylococcus aureus subsp. aureus MW2
uugauuagcauaccuuu

SEQ ID NO: 2102960 - RNA, 22 nt, Staphylococcus aureus subsp. aureus MW2
uugauggcaacuaaaauuugua

SEQ ID NO: 2102961 - RNA, 16 nt, Staphylococcus aureus subsp. aureus MW2
uugauggauauucaau

SEQ ID NO: 2102962 - RNA, 13 nt, Staphylococcus aureus subsp. aureus MW2
uugauuaaauaaa

SEQ ID NO: 2102963 - RNA, 20 nt, Staphylococcus aureus subsp. aureus MW2
uugauguguugcauuacuau

SEQ ID NO: 2102964 - RNA, 12 nt, Staphylococcus aureus subsp. aureus MW2
uugauuaaaauc

SEQ ID NO: 2102965 - RNA, 13 nt, Staphylococcus aureus subsp. aureus MW2
uugauauauauuu

SEQ ID NO: 2102966 - RNA, 21 nt, Staphylococcus aureus subsp. aureus MW2
uugauaucgaaacgcuuugca

SEQ ID NO: 2102967 - RNA, 18 nt, Staphylococcus aureus subsp. aureus MW2
uugaucagcauuuaaguu

SEQ ID NO: 2102968 - RNA, 13 nt, Staphylococcus aureus subsp. aureus MW2
uucuuauucaaau

SEQ ID NO: 2102969 - RNA, 11 nt, Staphylococcus aureus subsp. aureus MW2
uucuuauaaaa

SEQ ID NO: 2102970 - RNA, 12 nt, Staphylococcus aureus subsp. aureus MW2
uucuuauaaaaa

SEQ ID NO: 2102971 - RNA, 14 nt, Staphylococcus aureus subsp. aureus MW2
uucuuauaaaauaa

SEQ ID NO: 2102972 - RNA, 12 nt, Staphylococcus aureus subsp. aureus MW2
uucuucugcuaa

SEQ ID NO: 2102973 - RNA, 20 nt, Staphylococcus aureus subsp. aureus MW2
uucuuaaaauaugauuuaaa

SEQ ID NO: 2102974 - RNA, 17 nt, Staphylococcus aureus subsp. aureus MW2
uucuuaaaaagcagcag

SEQ ID NO: 2102975 - RNA, 16 nt, Staphylococcus aureus subsp. aureus MW2
uucuuaaaucaacauc

SEQ ID NO: 2102976 - RNA, 18 nt, Staphylococcus aureus subsp. aureus MW2
uucuuaaacgcucuucuu

SEQ ID NO: 2102977 - RNA, 22 nt, Staphylococcus aureus subsp. aureus MW2
uucuuaaaucaacaucaucuuu

SEQ ID NO: 2102978 - RNA, 19 nt, Staphylococcus aureus subsp. aureus MW2
uucuguugcaguuucaauc

SEQ ID NO: 2102979 - RNA, 21 nt, Staphylococcus aureus subsp. aureus MW2
uucuguuccacaacaaucacg

SEQ ID NO: 2102980 - RNA, 21 nt, Staphylococcus aureus subsp. aureus MW2
uucugcaaaauguuacacaaa

SEQ ID NO: 2102981 - RNA, 18 nt, Staphylococcus aureus subsp. aureus MW2
uucucuuugaacgaaaga

SEQ ID NO: 2102982 - RNA, 24 nt, Staphylococcus aureus subsp. aureus MW2
uucucuuugaacgagagagaaaag

SEQ ID NO: 2102983 - RNA, 22 nt, Staphylococcus aureus subsp. aureus MW2
uucucuuuaccaguaacagcua

SEQ ID NO: 2102984 - RNA, 14 nt, Staphylococcus aureus subsp. aureus MW2
uucugaaaaauauu

SEQ ID NO: 2102985 - RNA, 16 nt, Staphylococcus aureus subsp. aureus MW2
uucucaauuaauuuag

SEQ ID NO: 2102986 - RNA, 12 nt, Staphylococcus aureus subsp. aureus MW2
uucucaccagcu

SEQ ID NO: 2102987 - RNA, 17 nt, Staphylococcus aureus subsp. aureus MW2
uucucacugcuguucuu

SEQ ID NO: 2102988 - RNA, 20 nt, Staphylococcus aureus subsp. aureus MW2
uucucuaucaguaugaaguu

SEQ ID NO: 2102989 - RNA, 17 nt, Staphylococcus aureus subsp. aureus MW2
uucucuauacccuuuau

SEQ ID NO: 2102990 - RNA, 15 nt, Staphylococcus aureus subsp. aureus MW2
uucucccuuaaauac

SEQ ID NO: 2102991 - RNA, 22 nt, Staphylococcus aureus subsp. aureus MW2
uuaucagcauuaaucguauuuu

SEQ ID NO: 2102992 - RNA, 16 nt, Staphylococcus aureus subsp. aureus MW2
uuaucagcuuuaauaa

SEQ ID NO: 2102993 - RNA, 15 nt, Staphylococcus aureus subsp. aureus MW2
uucggcuuuccuaau

SEQ ID NO: 2102994 - RNA, 17 nt, Staphylococcus aureus subsp. aureus MW2
uucguuguucauaauca

SEQ ID NO: 2102995 - RNA, 15 nt, Staphylococcus aureus subsp. aureus MW2
uucguuugaauuauu

SEQ ID NO: 2102996 - RNA, 16 nt, Staphylococcus aureus subsp. aureus MW2
uucguuucuuuauuaa

SEQ ID NO: 2102997 - RNA, 13 nt, Staphylococcus aureus subsp. aureus MW2
uucguuuuauuaa

SEQ ID NO: 2102998 - RNA, 11 nt, Staphylococcus aureus subsp. aureus MW2
uucguaugagu

SEQ ID NO: 2102999 - RNA, 20 nt, Staphylococcus aureus subsp. aureus MW2
uucguaugucucuuuauuau

SEQ ID NO: 2103000 - RNA, 23 nt, Staphylococcus aureus subsp. aureus MW2
uucguaguaaccuaauucuaagu

SEQ ID NO: 2103001 - RNA, 19 nt, Staphylococcus aureus subsp. aureus MW2
uucuauuaaacauuuuuga

SEQ ID NO: 2103002 - RNA, 23 nt, Staphylococcus aureus subsp. aureus MW2
uucuauuuaaacaagaaaacuaa

SEQ ID NO: 2103003 - RNA, 14 nt, Staphylococcus aureus subsp. aureus MW2
uucuauuuuauaau

SEQ ID NO: 2103004 - RNA, 18 nt, Staphylococcus aureus subsp. aureus MW2
uucuauuuuauaauaaau

SEQ ID NO: 2103005 - RNA, 15 nt, Staphylococcus aureus subsp. aureus MW2
uucuauuuuucaauu

SEQ ID NO: 2103006 - RNA, 19 nt, Staphylococcus aureus subsp. aureus MW2
uucucaaauuagauaaaac

SEQ ID NO: 2103007 - RNA, 13 nt, Staphylococcus aureus subsp. aureus MW2
uucuaucaaauaa

SEQ ID NO: 2103008 - RNA, 16 nt, Staphylococcus aureus subsp. aureus MW2
uucuaucaaauaauga

SEQ ID NO: 2103009 - RNA, 23 nt, Staphylococcus aureus subsp. aureus MW2
uucuaucacacgcauacaggaaa

SEQ ID NO: 2103010 - RNA, 18 nt, Staphylococcus aureus subsp. aureus MW2
uucuaugcucuacgaagu

SEQ ID NO: 2103011 - RNA, 14 nt, Staphylococcus aureus subsp. aureus MW2
uucuauauuaauaa

SEQ ID NO: 2103012 - RNA, 22 nt, Staphylococcus aureus subsp. aureus MW2
uucuaaaagaauuauucaagua

SEQ ID NO: 2103013 - RNA, 19 nt, Staphylococcus aureus subsp. aureus MW2
uucuaaaauagaucgaacu

SEQ ID NO: 2103014 - RNA, 18 nt, Staphylococcus aureus subsp. aureus MW2
uucuaaacaacuucugaa

SEQ ID NO: 2103015 - RNA, 15 nt, Staphylococcus aureus subsp. aureus MW2
uucuaaaauuaacca

SEQ ID NO: 2103016 - RNA, 23 nt, Staphylococcus aureus subsp. aureus MW2
uucuaaaaucguuccaauacucg

SEQ ID NO: 2103017 - RNA, 14 nt, Staphylococcus aureus subsp. aureus MW2
uucuaauucugaaa

SEQ ID NO: 2103018 - RNA, 15 nt, Staphylococcus aureus subsp. aureus MW2
uucuaauugcacauu

SEQ ID NO: 2103019 - RNA, 12 nt, Staphylococcus aureus subsp. aureus MW2
uucuaaauaaac

SEQ ID NO: 2103020 - RNA, 22 nt, Staphylococcus aureus subsp. aureus MW2
uucuacaacuucauuaguugcc

SEQ ID NO: 2103021 - RNA, 21 nt, Staphylococcus aureus subsp. aureus MW2
uucuacaaacaaugcaaguug

SEQ ID NO: 2103022 - RNA, 19 nt, Staphylococcus aureus subsp. aureus MW2
uucuacagacaaugcaagu

SEQ ID NO: 2103023 - RNA, 20 nt, Staphylococcus aureus subsp. aureus MW2
uucuacagacaaugcaaguu

SEQ ID NO: 2103024 - RNA, 23 nt, Staphylococcus aureus subsp. aureus MW2
uucuacaguuggagguccauaau

SEQ ID NO: 2103025 - RNA, 20 nt, Staphylococcus aureus subsp. aureus MW2
uucuacaggcaaugcaaguu

SEQ ID NO: 2103026 - RNA, 22 nt, Staphylococcus aureus subsp. aureus MW2
uucuacagcgucaccuaaugcu

SEQ ID NO: 2103027 - RNA, 23 nt, Staphylococcus aureus subsp. aureus MW2
uuguuaauucaacggaacuacua

SEQ ID NO: 2103028 - RNA, 22 nt, Staphylococcus aureus subsp. aureus MW2
uuguuacaagcgcauucucauu

SEQ ID NO: 2103029 - RNA, 13 nt, Staphylococcus aureus subsp. aureus MW2
uuguuagcaucug

SEQ ID NO: 2103030 - RNA, 22 nt, Staphylococcus aureus subsp. aureus MW2
uuguuaccaaacaauacauaau

SEQ ID NO: 2103031 - RNA, 14 nt, Staphylococcus aureus subsp. aureus MW2
uuguucauguuuaa

SEQ ID NO: 2103032 - RNA, 21 nt, Staphylococcus aureus subsp. aureus MW2
uuguucauguuuaaaauaaag

SEQ ID NO: 2103033 - RNA, 23 nt, Staphylococcus aureus subsp. aureus MW2
uuguggcguaguuugaauuggga

SEQ ID NO: 2103034 - RNA, 16 nt, Staphylococcus aureus subsp. aureus MW2
uuguuaagcagcuugc

SEQ ID NO: 2103035 - RNA, 17 nt, Staphylococcus aureus subsp. aureus MW2
uugugcuuuuucauaaa

SEQ ID NO: 2103036 - RNA, 16 nt, Staphylococcus aureus subsp. aureus MW2
uugucucaauaauguu

SEQ ID NO: 2103037 - RNA, 20 nt, Staphylococcus aureus subsp. aureus MW2
uuguauagauuguauuuaau

SEQ ID NO: 2103038 - RNA, 18 nt, Staphylococcus aureus subsp. aureus MW2
uuguauaucuguauaaaa

SEQ ID NO: 2103039 - RNA, 19 nt, Staphylococcus aureus subsp. aureus MW2
uuguauaccuauuccuauu

SEQ ID NO: 2103040 - RNA, 22 nt, Staphylococcus aureus subsp. aureus MW2
uuguauaaaaauguauuaaaua

SEQ ID NO: 2103041 - RNA, 19 nt, Staphylococcus aureus subsp. aureus MW2
uugucacuuggauucaaau

SEQ ID NO: 2103042 - RNA, 11 nt, Staphylococcus aureus subsp. aureus MW2
uugucaugccu

SEQ ID NO: 2103043 - RNA, 19 nt, Staphylococcus aureus subsp. aureus MW2
uugucauuugaacaucauu

SEQ ID NO: 2103044 - RNA, 18 nt, Staphylococcus aureus subsp. aureus MW2
uugucaucauguucuaau

SEQ ID NO: 2103045 - RNA, 18 nt, Staphylococcus aureus subsp. aureus MW2
uugucauuuugaugaagu

SEQ ID NO: 2103046 - RNA, 12 nt, Staphylococcus aureus subsp. aureus MW2
uugucaucuuuu

SEQ ID NO: 2103047 - RNA, 18 nt, Staphylococcus aureus subsp. aureus MW2
uuguacauuauuaauauc

SEQ ID NO: 2103048 - RNA, 17 nt, Staphylococcus aureus subsp. aureus MW2
uuguacaguaauauuca

SEQ ID NO: 2103049 - RNA, 13 nt, Staphylococcus aureus subsp. aureus MW2
uuguaauuuaaau

SEQ ID NO: 2103050 - RNA, 21 nt, Staphylococcus aureus subsp. aureus MW2
uuguacgcuucaauuauuuca

SEQ ID NO: 2103051 - RNA, 11 nt, Staphylococcus aureus subsp. aureus MW2
uuguacuucuu

SEQ ID NO: 2103052 - RNA, 14 nt, Staphylococcus aureus subsp. aureus MW2
uuguauaacuaaga

SEQ ID NO: 2103053 - RNA, 23 nt, Staphylococcus aureus subsp. aureus MW2
uuguagaauuucuuuucgaaauu

SEQ ID NO: 2103054 - RNA, 22 nt, Staphylococcus aureus subsp. aureus MW2
uuguaagucgcucuagacauua

SEQ ID NO: 2103055 - RNA, 21 nt, Staphylococcus aureus subsp. aureus MW2
uugguuaauacguuuaauaau

SEQ ID NO: 2103056 - RNA, 17 nt, Staphylococcus aureus subsp. aureus MW2
uuguaauucuuguaaau

SEQ ID NO: 2103057 - RNA, 22 nt, Staphylococcus aureus subsp. aureus MW2
uuguaauacaucuaauaaauau

SEQ ID NO: 2103058 - RNA, 20 nt, Staphylococcus aureus subsp. aureus MW2
uuguaauacugaaugcucau

SEQ ID NO: 2103059 - RNA, 21 nt, Staphylococcus aureus subsp. aureus MW2
uuuaauuuaguuauaauuucu

SEQ ID NO: 2103060 - RNA, 20 nt, Staphylococcus aureus subsp. aureus MW2
uuuaauuugauuaaauucuu

SEQ ID NO: 2103061 - RNA, 15 nt, Staphylococcus aureus subsp. aureus MW2
uuuaauuuucuaaag

SEQ ID NO: 2103062 - RNA, 21 nt, Staphylococcus aureus subsp. aureus MW2
uuuaauuguuuaauaacaaaa

SEQ ID NO: 2103063 - RNA, 21 nt, Staphylococcus aureus subsp. aureus MW2
uuuaauugguuucacauuguc

SEQ ID NO: 2103064 - RNA, 14 nt, Staphylococcus aureus subsp. aureus MW2
uuuaauugcuguaa

SEQ ID NO: 2103065 - RNA, 16 nt, Staphylococcus aureus subsp. aureus MW2
uuuaauuaauuaucau

SEQ ID NO: 2103066 - RNA, 14 nt, Staphylococcus aureus subsp. aureus MW2
uuuaauaauuaaau

SEQ ID NO: 2103067 - RNA, 18 nt, Staphylococcus aureus subsp. aureus MW2
uuuaauaauuaaauauaa

SEQ ID NO: 2103068 - RNA, 14 nt, Staphylococcus aureus subsp. aureus MW2
uuuaauaauacauu

SEQ ID NO: 2103069 - RNA, 21 nt, Staphylococcus aureus subsp. aureus MW2
uuuaauuauuucccuggaaaa

SEQ ID NO: 2103070 - RNA, 15 nt, Staphylococcus aureus subsp. aureus MW2
uuuaauuauuucccu

SEQ ID NO: 2103071 - RNA, 21 nt, Staphylococcus aureus subsp. aureus MW2
uuuaauuaauuaucauaaaua

SEQ ID NO: 2103072 - RNA, 21 nt, Staphylococcus aureus subsp. aureus MW2
uuuaauuccaaagaaagcuaa

SEQ ID NO: 2103073 - RNA, 17 nt, Staphylococcus aureus subsp. aureus MW2
uuuaaguuuauaaucag

SEQ ID NO: 2103074 - RNA, 17 nt, Staphylococcus aureus subsp. aureus MW2
uuuaauaaaaucaucuu

SEQ ID NO: 2103075 - RNA, 14 nt, Staphylococcus aureus subsp. aureus MW2
uuuaaguuuauaau

SEQ ID NO: 2103076 - RNA, 19 nt, Staphylococcus aureus subsp. aureus MW2
uuuaaguuaucaaauugac

SEQ ID NO: 2103077 - RNA, 14 nt, Staphylococcus aureus subsp. aureus MW2
uuuaauaacaaaau

SEQ ID NO: 2103078 - RNA, 17 nt, Staphylococcus aureus subsp. aureus MW2
uuuaauaacaaaauuaa

SEQ ID NO: 2103079 - RNA, 19 nt, Staphylococcus aureus subsp. aureus MW2
uuuaauaaccuuuaaaaca

SEQ ID NO: 2103080 - RNA, 21 nt, Staphylococcus aureus subsp. aureus MW2
uuuaauaaccuuuaaaacauc

SEQ ID NO: 2103081 - RNA, 16 nt, Staphylococcus aureus subsp. aureus MW2
uuuaauaaaucguguu

SEQ ID NO: 2103082 - RNA, 18 nt, Staphylococcus aureus subsp. aureus MW2
uuuaauaaacaccaauau

SEQ ID NO: 2103083 - RNA, 21 nt, Staphylococcus aureus subsp. aureus MW2
uuuaauaaacaccaauauuuc

SEQ ID NO: 2103084 - RNA, 23 nt, Staphylococcus aureus subsp. aureus MW2
uuuaauaaacaccaauauuucug

SEQ ID NO: 2103085 - RNA, 13 nt, Staphylococcus aureus subsp. aureus MW2
uuuaacuaaacca

SEQ ID NO: 2103086 - RNA, 18 nt, Staphylococcus aureus subsp. aureus MW2
uuuaacguuauucauuug

SEQ ID NO: 2103087 - RNA, 19 nt, Staphylococcus aureus subsp. aureus MW2
uuuaacugggcaacuuuuu

SEQ ID NO: 2103088 - RNA, 18 nt, Staphylococcus aureus subsp. aureus MW2
uuuaacugguugauaaau

SEQ ID NO: 2103089 - RNA, 22 nt, Staphylococcus aureus subsp. aureus MW2
uuuaacuuauauacguugauua

SEQ ID NO: 2103090 - RNA, 16 nt, Staphylococcus aureus subsp. aureus MW2
uuuaacguaucauccc

SEQ ID NO: 2103091 - RNA, 15 nt, Staphylococcus aureus subsp. aureus MW2
uuuaacgaaaauuaa

SEQ ID NO: 2103092 - RNA, 13 nt, Staphylococcus aureus subsp. aureus MW2
uuuaaaauauuaa

SEQ ID NO: 2103093 - RNA, 14 nt, Staphylococcus aureus subsp. aureus MW2
uuuaaaauauuaau

SEQ ID NO: 2103094 - RNA, 22 nt, Staphylococcus aureus subsp. aureus MW2
uuuaaaaggcgaaacauuaaaa

SEQ ID NO: 2103095 - RNA, 15 nt, Staphylococcus aureus subsp. aureus MW2
uuuaaauaaaugacu

SEQ ID NO: 2103096 - RNA, 18 nt, Staphylococcus aureus subsp. aureus MW2
uuuaaaaucucauaauaa

SEQ ID NO: 2103097 - RNA, 16 nt, Staphylococcus aureus subsp. aureus MW2
uuuaaaaucucauaau

SEQ ID NO: 2103098 - RNA, 18 nt, Staphylococcus aureus subsp. aureus MW2
uuuaaauaaaugacuuca

SEQ ID NO: 2103099 - RNA, 17 nt, Staphylococcus aureus subsp. aureus MW2
uuuaaauauacuucuau

SEQ ID NO: 2103100 - RNA, 18 nt, Staphylococcus aureus subsp. aureus MW2
uuuaaaugcgaaguauaa

SEQ ID NO: 2103101 - RNA, 19 nt, Staphylococcus aureus subsp. aureus MW2
uuuaaaugauuucacuuca

SEQ ID NO: 2103102 - RNA, 18 nt, Staphylococcus aureus subsp. aureus MW2
uuuaaaucuuuuagcuuu

SEQ ID NO: 2103103 - RNA, 18 nt, Staphylococcus aureus subsp. aureus MW2
uuuaaaucuuguucuaau

SEQ ID NO: 2103104 - RNA, 20 nt, Staphylococcus aureus subsp. aureus MW2
uuuaaaucuguacuucuaau

SEQ ID NO: 2103105 - RNA, 18 nt, Staphylococcus aureus subsp. aureus MW2
uuuaacaagugaugaaaa

SEQ ID NO: 2103106 - RNA, 14 nt, Staphylococcus aureus subsp. aureus MW2
uuuaacaauauaua

SEQ ID NO: 2103107 - RNA, 15 nt, Staphylococcus aureus subsp. aureus MW2
uuuaacaauauauaa

SEQ ID NO: 2103108 - RNA, 19 nt, Staphylococcus aureus subsp. aureus MW2
uuuaacaauuuuaucugaa

SEQ ID NO: 2103109 - RNA, 17 nt, Staphylococcus aureus subsp. aureus MW2
uuuaacauuuuuuucaa

SEQ ID NO: 2103110 - RNA, 13 nt, Staphylococcus aureus subsp. aureus MW2
uuuaaccaaaauu

SEQ ID NO: 2103111 - RNA, 14 nt, Staphylococcus aureus subsp. aureus MW2
uuuaacauuucuga

SEQ ID NO: 2103112 - RNA, 13 nt, Staphylococcus aureus subsp. aureus MW2
uuuaacaucugaa

SEQ ID NO: 2103113 - RNA, 17 nt, Staphylococcus aureus subsp. aureus MW2
uuguuuaaguuuuucag

SEQ ID NO: 2103114 - RNA, 14 nt, Staphylococcus aureus subsp. aureus MW2
uuguugguuuugca

SEQ ID NO: 2103115 - RNA, 15 nt, Staphylococcus aureus subsp. aureus MW2
uuguuggggccccgc

SEQ ID NO: 2103116 - RNA, 23 nt, Staphylococcus aureus subsp. aureus MW2
uuguuggucuaucgccuaaaaau

SEQ ID NO: 2103117 - RNA, 14 nt, Staphylococcus aureus subsp. aureus MW2
uuguucuaauuguu

SEQ ID NO: 2103118 - RNA, 20 nt, Staphylococcus aureus subsp. aureus MW2
uuguucuucgucguuuaaug

SEQ ID NO: 2103119 - RNA, 23 nt, Staphylococcus aureus subsp. aureus MW2
uuguuuuccaauaauaaaccuaa

SEQ ID NO: 2103120 - RNA, 21 nt, Staphylococcus aureus subsp. aureus MW2
uuguuuuucacuguuaaaguc

SEQ ID NO: 2103121 - RNA, 16 nt, Staphylococcus aureus subsp. aureus MW2
uuguuuuuaaaaucuc

SEQ ID NO: 2103122 - RNA, 22 nt, Staphylococcus aureus subsp. aureus MW2
uuuaaaacaaugauuaaaauua

SEQ ID NO: 2103123 - RNA, 22 nt, Staphylococcus aureus subsp. aureus MW2
uuuaaaacaucauucacaaguu

SEQ ID NO: 2103124 - RNA, 14 nt, Staphylococcus aureus subsp. aureus MW2
uuggaaaaauaaau

SEQ ID NO: 2103125 - RNA, 21 nt, Staphylococcus aureus subsp. aureus MW2
uuggaaugguauagauuuuau

SEQ ID NO: 2103126 - RNA, 18 nt, Staphylococcus aureus subsp. aureus MW2
uugcuuuuauuuuuaaug

SEQ ID NO: 2103127 - RNA, 14 nt, Staphylococcus aureus subsp. aureus MW2
uugcuuuuuacuau

SEQ ID NO: 2103128 - RNA, 18 nt, Staphylococcus aureus subsp. aureus MW2
uugcuuuuuacuauguaa

SEQ ID NO: 2103129 - RNA, 19 nt, Staphylococcus aureus subsp. aureus MW2
uugcuuuuuauuuuguaua

SEQ ID NO: 2103130 - RNA, 21 nt, Staphylococcus aureus subsp. aureus MW2
uugcuuuuucaaauaauauaa

SEQ ID NO: 2103131 - RNA, 19 nt, Staphylococcus aureus subsp. aureus MW2
uugcuuuuucguuaaauga

SEQ ID NO: 2103132 - RNA, 14 nt, Staphylococcus aureus subsp. aureus MW2
uuggauaaaaugau

SEQ ID NO: 2103133 - RNA, 23 nt, Staphylococcus aureus subsp. aureus MW2
uuggcagacguaucaucaaaauu

SEQ ID NO: 2103134 - RNA, 19 nt, Staphylococcus aureus subsp. aureus MW2
uuggcuccccaauuucucu

SEQ ID NO: 2103135 - RNA, 21 nt, Staphylococcus aureus subsp. aureus MW2
uuggcggggccccaacauaga

SEQ ID NO: 2103136 - RNA, 14 nt, Staphylococcus aureus subsp. aureus MW2
uuggcgggccccaa

SEQ ID NO: 2103137 - RNA, 20 nt, Staphylococcus aureus subsp. aureus MW2
uuggcgggccccaacauaga

SEQ ID NO: 2103138 - RNA, 21 nt, Staphylococcus aureus subsp. aureus MW2
uuggcggggccccaacacaga

SEQ ID NO: 2103139 - RNA, 17 nt, Staphylococcus aureus subsp. aureus MW2
uuggcauaaccuguuuu

SEQ ID NO: 2103140 - RNA, 18 nt, Staphylococcus aureus subsp. aureus MW2
uugguagcauuuuagauu

SEQ ID NO: 2103141 - RNA, 21 nt, Staphylococcus aureus subsp. aureus MW2
uugggcgcuuuuuaauuugua

SEQ ID NO: 2103142 - RNA, 16 nt, Staphylococcus aureus subsp. aureus MW2
uugguguuuagucuuu

SEQ ID NO: 2103143 - RNA, 23 nt, Staphylococcus aureus subsp. aureus MW2
uugguggaugucaugucuagauu

SEQ ID NO: 2103144 - RNA, 16 nt, Staphylococcus aureus subsp. aureus MW2
uuggucaaguuuuggu

SEQ ID NO: 2103145 - RNA, 12 nt, Staphylococcus aureus subsp. aureus MW2
uugguauuuauc

SEQ ID NO: 2103146 - RNA, 22 nt, Staphylococcus aureus subsp. aureus MW2
uuggucaccuacagauaaagcu

SEQ ID NO: 2103147 - RNA, 13 nt, Staphylococcus aureus subsp. aureus MW2
uugguauuauucu

SEQ ID NO: 2103148 - RNA, 15 nt, Staphylococcus aureus subsp. aureus MW2
uugcccaugucauga

SEQ ID NO: 2103149 - RNA, 14 nt, Staphylococcus aureus subsp. aureus MW2
uugcccgcuuauug

SEQ ID NO: 2103150 - RNA, 17 nt, Staphylococcus aureus subsp. aureus MW2
uugcaucacuuguugcu

SEQ ID NO: 2103151 - RNA, 12 nt, Staphylococcus aureus subsp. aureus MW2
uugcaucauaau

SEQ ID NO: 2103152 - RNA, 18 nt, Staphylococcus aureus subsp. aureus MW2
uugcauugccuguagaau

SEQ ID NO: 2103153 - RNA, 17 nt, Staphylococcus aureus subsp. aureus MW2
uugcauuguauaugugu

SEQ ID NO: 2103154 - RNA, 14 nt, Staphylococcus aureus subsp. aureus MW2
uugcaugucuuaaa

SEQ ID NO: 2103155 - RNA, 17 nt, Staphylococcus aureus subsp. aureus MW2
uugcacuaugcauaaua

SEQ ID NO: 2103156 - RNA, 22 nt, Staphylococcus aureus subsp. aureus MW2
uugcacgucuuguaucaacauu

SEQ ID NO: 2103157 - RNA, 18 nt, Staphylococcus aureus subsp. aureus MW2
uugcuaaaaaaauuaaaa

SEQ ID NO: 2103158 - RNA, 20 nt, Staphylococcus aureus subsp. aureus MW2
uugcuaaaguguagccaaau

SEQ ID NO: 2103159 - RNA, 22 nt, Staphylococcus aureus subsp. aureus MW2
uugcuaaacgcuaaaauuuccu

SEQ ID NO: 2103160 - RNA, 20 nt, Staphylococcus aureus subsp. aureus MW2
uugcguuuaauaacauugaa

SEQ ID NO: 2103161 - RNA, 13 nt, Staphylococcus aureus subsp. aureus MW2
uugcuaaaacuaa

SEQ ID NO: 2103162 - RNA, 22 nt, Staphylococcus aureus subsp. aureus MW2
uugcucaccuuuagacaauauu

SEQ ID NO: 2103163 - RNA, 14 nt, Staphylococcus aureus subsp. aureus MW2
uugccuuucauuuu

SEQ ID NO: 2103164 - RNA, 19 nt, Staphylococcus aureus subsp. aureus MW2
uugcgaauaccguuucuau

SEQ ID NO: 2103165 - RNA, 20 nt, Staphylococcus aureus subsp. aureus MW2
uugcgaauaccguuucuauu

SEQ ID NO: 2103166 - RNA, 21 nt, Staphylococcus aureus subsp. aureus MW2
uugcgauauacgaauccucau

SEQ ID NO: 2103167 - RNA, 16 nt, Staphylococcus aureus subsp. aureus MW2
uuucugcaaaauguua

SEQ ID NO: 2103168 - RNA, 22 nt, Staphylococcus aureus subsp. aureus MW2
uuucugacuuuuaaaaaacaua

SEQ ID NO: 2103169 - RNA, 21 nt, Staphylococcus aureus subsp. aureus MW2
uuucugaaaacuuaauagaaa

SEQ ID NO: 2103170 - RNA, 18 nt, Staphylococcus aureus subsp. aureus MW2
uuucuauacaaugaauuu

SEQ ID NO: 2103171 - RNA, 22 nt, Staphylococcus aureus subsp. aureus MW2
uuucuaucaaaaaaacaaaaaa

SEQ ID NO: 2103172 - RNA, 12 nt, Staphylococcus aureus subsp. aureus MW2
uuucuaucaaau

SEQ ID NO: 2103173 - RNA, 15 nt, Staphylococcus aureus subsp. aureus MW2
uuucuaucuuguucu

SEQ ID NO: 2103174 - RNA, 16 nt, Staphylococcus aureus subsp. aureus MW2
uuucucaaugugagau

SEQ ID NO: 2103175 - RNA, 20 nt, Staphylococcus aureus subsp. aureus MW2
uuucucaaguaacucaagug

SEQ ID NO: 2103176 - RNA, 22 nt, Staphylococcus aureus subsp. aureus MW2
uuucucaaauuagauaaaacaa

SEQ ID NO: 2103177 - RNA, 15 nt, Staphylococcus aureus subsp. aureus MW2
uuucuauuuaaacaa

SEQ ID NO: 2103178 - RNA, 20 nt, Staphylococcus aureus subsp. aureus MW2
uuucgggaauuuuacguuga

SEQ ID NO: 2103179 - RNA, 14 nt, Staphylococcus aureus subsp. aureus MW2
uuucgucagauuca

SEQ ID NO: 2103180 - RNA, 19 nt, Staphylococcus aureus subsp. aureus MW2
uuucguguuccaauuuuau

SEQ ID NO: 2103181 - RNA, 17 nt, Staphylococcus aureus subsp. aureus MW2
uuucguucaauuucgau

SEQ ID NO: 2103182 - RNA, 12 nt, Staphylococcus aureus subsp. aureus MW2
uuucuagcaugu

SEQ ID NO: 2103183 - RNA, 17 nt, Staphylococcus aureus subsp. aureus MW2
uuucuaggccacuaaga

SEQ ID NO: 2103184 - RNA, 22 nt, Staphylococcus aureus subsp. aureus MW2
uuucuaggccacuaagaccaug

SEQ ID NO: 2103185 - RNA, 15 nt, Staphylococcus aureus subsp. aureus MW2
uuucuagcuuuaauu

SEQ ID NO: 2103186 - RNA, 19 nt, Staphylococcus aureus subsp. aureus MW2
uuucuacuguauaagugcu

SEQ ID NO: 2103187 - RNA, 17 nt, Staphylococcus aureus subsp. aureus MW2
uuucuacuguauaagug

SEQ ID NO: 2103188 - RNA, 21 nt, Staphylococcus aureus subsp. aureus MW2
uuucuacucuaauuacauaua

SEQ ID NO: 2103189 - RNA, 19 nt, Staphylococcus aureus subsp. aureus MW2
uuucuacagacaaugcaag

SEQ ID NO: 2103190 - RNA, 15 nt, Staphylococcus aureus subsp. aureus MW2
uuucuaauuuuucuu

SEQ ID NO: 2103191 - RNA, 23 nt, Staphylococcus aureus subsp. aureus MW2
uuucccuacugcuugugugaaau

SEQ ID NO: 2103192 - RNA, 13 nt, Staphylococcus aureus subsp. aureus MW2
uuuccaugaauaa

SEQ ID NO: 2103193 - RNA, 18 nt, Staphylococcus aureus subsp. aureus MW2
uuuccaguccauuuuuua

SEQ ID NO: 2103194 - RNA, 22 nt, Staphylococcus aureus subsp. aureus MW2
uuucgacguaccaauuagcaug

SEQ ID NO: 2103195 - RNA, 18 nt, Staphylococcus aureus subsp. aureus MW2
uuucgauaccuaaaauac

SEQ ID NO: 2103196 - RNA, 18 nt, Staphylococcus aureus subsp. aureus MW2
uuucgaacguuugaaaaa

SEQ ID NO: 2103197 - RNA, 22 nt, Staphylococcus aureus subsp. aureus MW2
uuucgaaaagaaauucuacagg

SEQ ID NO: 2103198 - RNA, 23 nt, Staphylococcus aureus subsp. aureus MW2
uuuccuuggacucagugcuaugu

SEQ ID NO: 2103199 - RNA, 16 nt, Staphylococcus aureus subsp. aureus MW2
uuuccucacuagauag

SEQ ID NO: 2103200 - RNA, 16 nt, Staphylococcus aureus subsp. aureus MW2
uuugcauacauaucuu

SEQ ID NO: 2103201 - RNA, 15 nt, Staphylococcus aureus subsp. aureus MW2
uuugcaucacagaua

SEQ ID NO: 2103202 - RNA, 13 nt, Staphylococcus aureus subsp. aureus MW2
uuugcaugaaaau

SEQ ID NO: 2103203 - RNA, 19 nt, Staphylococcus aureus subsp. aureus MW2
uuugcaacauauuuucaca

SEQ ID NO: 2103204 - RNA, 21 nt, Staphylococcus aureus subsp. aureus MW2
uuugcaacauauuuucacaau

SEQ ID NO: 2103205 - RNA, 19 nt, Staphylococcus aureus subsp. aureus MW2
uuugcaaauuggaaaaaua

SEQ ID NO: 2103206 - RNA, 14 nt, Staphylococcus aureus subsp. aureus MW2
uuugcaaucaucug

SEQ ID NO: 2103207 - RNA, 17 nt, Staphylococcus aureus subsp. aureus MW2
uuugcaauuuuuuaugu

SEQ ID NO: 2103208 - RNA, 20 nt, Staphylococcus aureus subsp. aureus MW2
uuugcaauuuuuuauguauu

SEQ ID NO: 2103209 - RNA, 17 nt, Staphylococcus aureus subsp. aureus MW2
uuugcagauugauauaa

SEQ ID NO: 2103210 - RNA, 21 nt, Staphylococcus aureus subsp. aureus MW2
uuugccagucauuguauaaaa

SEQ ID NO: 2103211 - RNA, 14 nt, Staphylococcus aureus subsp. aureus MW2
uuugccaaaaguua

SEQ ID NO: 2103212 - RNA, 23 nt, Staphylococcus aureus subsp. aureus MW2
uuugccuaaaguauuaucuaauu

SEQ ID NO: 2103213 - RNA, 22 nt, Staphylococcus aureus subsp. aureus MW2
uuugcgaaaauaucauuucugu

SEQ ID NO: 2103214 - RNA, 18 nt, Staphylococcus aureus subsp. aureus MW2
uuugauguucuugaaaac

SEQ ID NO: 2103215 - RNA, 19 nt, Staphylococcus aureus subsp. aureus MW2
uuugauguuuaacuaaacc

SEQ ID NO: 2103216 - RNA, 16 nt, Staphylococcus aureus subsp. aureus MW2
uuugauguucacuaaa

SEQ ID NO: 2103217 - RNA, 14 nt, Staphylococcus aureus subsp. aureus MW2
uuugaucuuuaaau

SEQ ID NO: 2103218 - RNA, 24 nt, Staphylococcus aureus subsp. aureus MW2
uuugaugaucauuaguguagaaaa

SEQ ID NO: 2103219 - RNA, 21 nt, Staphylococcus aureus subsp. aureus MW2
uuugauccauauauguaacaa

SEQ ID NO: 2103220 - RNA, 20 nt, Staphylococcus aureus subsp. aureus MW2
uuugaucuaaaguacucaag

SEQ ID NO: 2103221 - RNA, 13 nt, Staphylococcus aureus subsp. aureus MW2
uuugauuauguaa

SEQ ID NO: 2103222 - RNA, 14 nt, Staphylococcus aureus subsp. aureus MW2
uuugauuaaauuaa

SEQ ID NO: 2103223 - RNA, 17 nt, Staphylococcus aureus subsp. aureus MW2
uuugauuaguaaauaua

SEQ ID NO: 2103224 - RNA, 16 nt, Staphylococcus aureus subsp. aureus MW2
uuugauucuaaauaau

SEQ ID NO: 2103225 - RNA, 13 nt, Staphylococcus aureus subsp. aureus MW2
uuugauuguuuaa

SEQ ID NO: 2103226 - RNA, 21 nt, Staphylococcus aureus subsp. aureus MW2
uuugauuuaauaauauuugcu

SEQ ID NO: 2103227 - RNA, 15 nt, Staphylococcus aureus subsp. aureus MW2
uuugauuuauauuuu

SEQ ID NO: 2103228 - RNA, 20 nt, Staphylococcus aureus subsp. aureus MW2
uuugauuuggguaauguuuu

SEQ ID NO: 2103229 - RNA, 12 nt, Staphylococcus aureus subsp. aureus MW2
uuugauuuuaau

SEQ ID NO: 2103230 - RNA, 13 nt, Staphylococcus aureus subsp. aureus MW2
uuugauuuugaau

SEQ ID NO: 2103231 - RNA, 17 nt, Staphylococcus aureus subsp. aureus MW2
uuugauaaauaaaauuu

SEQ ID NO: 2103232 - RNA, 19 nt, Staphylococcus aureus subsp. aureus MW2
uuugauaacaauuuuaaau

SEQ ID NO: 2103233 - RNA, 23 nt, Staphylococcus aureus subsp. aureus MW2
uuugaguauuugccuuuuuuauu

SEQ ID NO: 2103234 - RNA, 17 nt, Staphylococcus aureus subsp. aureus MW2
uuugaguauccaauacu

SEQ ID NO: 2103235 - RNA, 21 nt, Staphylococcus aureus subsp. aureus MW2
uuugaguguuuaugaaagucu

SEQ ID NO: 2103236 - RNA, 22 nt, Staphylococcus aureus subsp. aureus MW2
uuugagaaaauaucauuucugu

SEQ ID NO: 2103237 - RNA, 18 nt, Staphylococcus aureus subsp. aureus MW2
uuugagcuaaccacauca

SEQ ID NO: 2103238 - RNA, 16 nt, Staphylococcus aureus subsp. aureus MW2
uuugacaucuauuucu

SEQ ID NO: 2103239 - RNA, 19 nt, Staphylococcus aureus subsp. aureus MW2
uuugacauauuuuuuaaau

SEQ ID NO: 2103240 - RNA, 20 nt, Staphylococcus aureus subsp. aureus MW2
uuugacauaaaaaaauagcu

SEQ ID NO: 2103241 - RNA, 18 nt, Staphylococcus aureus subsp. aureus MW2
uuugacuauguuguuuaa

SEQ ID NO: 2103242 - RNA, 16 nt, Staphylococcus aureus subsp. aureus MW2
uuugacuauucucagu

SEQ ID NO: 2103243 - RNA, 12 nt, Staphylococcus aureus subsp. aureus MW2
uuugaauuggga

SEQ ID NO: 2103244 - RNA, 13 nt, Staphylococcus aureus subsp. aureus MW2
uuugaauuuaauu

SEQ ID NO: 2103245 - RNA, 14 nt, Staphylococcus aureus subsp. aureus MW2
uuugaauuuuauuu

SEQ ID NO: 2103246 - RNA, 19 nt, Staphylococcus aureus subsp. aureus MW2
uuugaauuuucguucaauu

SEQ ID NO: 2103247 - RNA, 19 nt, Staphylococcus aureus subsp. aureus MW2
uuugacacauuauugaagu

SEQ ID NO: 2103248 - RNA, 16 nt, Staphylococcus aureus subsp. aureus MW2
uuugaauauacuuaau

SEQ ID NO: 2103249 - RNA, 16 nt, Staphylococcus aureus subsp. aureus MW2
uuugaaucuuguugaa

SEQ ID NO: 2103250 - RNA, 23 nt, Staphylococcus aureus subsp. aureus MW2
uuugaauaauaaacuuaaaagag

SEQ ID NO: 2103251 - RNA, 14 nt, Staphylococcus aureus subsp. aureus MW2
uuugaauauaaaaa

SEQ ID NO: 2103252 - RNA, 17 nt, Staphylococcus aureus subsp. aureus MW2
uuugaagaauaaaaaag

SEQ ID NO: 2103253 - RNA, 17 nt, Staphylococcus aureus subsp. aureus MW2
uuugaagaauguuucau

SEQ ID NO: 2103254 - RNA, 21 nt, Staphylococcus aureus subsp. aureus MW2
uuugaaguuacuauauuuauu

SEQ ID NO: 2103255 - RNA, 20 nt, Staphylococcus aureus subsp. aureus MW2
uuugaacgaaagagaaaagc

SEQ ID NO: 2103256 - RNA, 20 nt, Staphylococcus aureus subsp. aureus MW2
uuugaacgagagagaaaagc

SEQ ID NO: 2103257 - RNA, 23 nt, Staphylococcus aureus subsp. aureus MW2
uuugaacaacaucuuuuguuguu

SEQ ID NO: 2103258 - RNA, 19 nt, Staphylococcus aureus subsp. aureus MW2
uuugaaauuucgacaucua

SEQ ID NO: 2103259 - RNA, 22 nt, Staphylococcus aureus subsp. aureus MW2
uuugaaaggaauguuuaaaaaa

SEQ ID NO: 2103260 - RNA, 21 nt, Staphylococcus aureus subsp. aureus MW2
uuucuucauuuucauuguaug

SEQ ID NO: 2103261 - RNA, 15 nt, Staphylococcus aureus subsp. aureus MW2
uuucuucauuaucaa

SEQ ID NO: 2103262 - RNA, 11 nt, Staphylococcus aureus subsp. aureus MW2
uuucuucuucu

SEQ ID NO: 2103263 - RNA, 20 nt, Staphylococcus aureus subsp. aureus MW2
uuucuugaaauaaacauauc

SEQ ID NO: 2103264 - RNA, 15 nt, Staphylococcus aureus subsp. aureus MW2
uuucuuuauuuuaaa

SEQ ID NO: 2103265 - RNA, 17 nt, Staphylococcus aureus subsp. aureus MW2
uuucuuguguauuuuua

SEQ ID NO: 2103266 - RNA, 23 nt, Staphylococcus aureus subsp. aureus MW2
uuucuugccaucaauuucuguaa

SEQ ID NO: 2103267 - RNA, 14 nt, Staphylococcus aureus subsp. aureus MW2
uuucuuaacauaaa

SEQ ID NO: 2103268 - RNA, 18 nt, Staphylococcus aureus subsp. aureus MW2
uuucuuaguuugacaucu

SEQ ID NO: 2103269 - RNA, 16 nt, Staphylococcus aureus subsp. aureus MW2
uuucuuauuuguaauu

SEQ ID NO: 2103270 - RNA, 12 nt, Staphylococcus aureus subsp. aureus MW2
uuucuuaugaua

SEQ ID NO: 2103271 - RNA, 20 nt, Staphylococcus aureus subsp. aureus MW2
uuucuucagaaccuugaaug

SEQ ID NO: 2103272 - RNA, 15 nt, Staphylococcus aureus subsp. aureus MW2
uuucuucaauugucu

SEQ ID NO: 2103273 - RNA, 14 nt, Staphylococcus aureus subsp. aureus MW2
uuucuguaccaaau

SEQ ID NO: 2103274 - RNA, 14 nt, Staphylococcus aureus subsp. aureus MW2
uuucugugaccaau

SEQ ID NO: 2103275 - RNA, 18 nt, Staphylococcus aureus subsp. aureus MW2
uuucuggucacuaaugca

SEQ ID NO: 2103276 - RNA, 13 nt, Staphylococcus aureus subsp. aureus MW2
uuucaaacauauu

SEQ ID NO: 2103277 - RNA, 20 nt, Staphylococcus aureus subsp. aureus MW2
uuucaaaaucaauugaaaaa

SEQ ID NO: 2103278 - RNA, 22 nt, Staphylococcus aureus subsp. aureus MW2
uuucaaauaauauaaaacgaua

SEQ ID NO: 2103279 - RNA, 17 nt, Staphylococcus aureus subsp. aureus MW2
uuucaaagauacaccaa

SEQ ID NO: 2103280 - RNA, 20 nt, Staphylococcus aureus subsp. aureus MW2
uuucaaagauacaccaauau

SEQ ID NO: 2103281 - RNA, 23 nt, Staphylococcus aureus subsp. aureus MW2
uuucaaaugugaaagucauccua

SEQ ID NO: 2103282 - RNA, 19 nt, Staphylococcus aureus subsp. aureus MW2
uuucaaauguguaaacuag

SEQ ID NO: 2103283 - RNA, 14 nt, Staphylococcus aureus subsp. aureus MW2
uuucaaauauaaaa

SEQ ID NO: 2103284 - RNA, 14 nt, Staphylococcus aureus subsp. aureus MW2
uuucaaaacuagca

SEQ ID NO: 2103285 - RNA, 24 nt, Staphylococcus aureus subsp. aureus MW2
uuucaaaacuagcaguaauauguu

SEQ ID NO: 2103286 - RNA, 18 nt, Staphylococcus aureus subsp. aureus MW2
uuucaaaaaggaauucua

SEQ ID NO: 2103287 - RNA, 11 nt, Staphylococcus aureus subsp. aureus MW2
uuuauuuuuuu

SEQ ID NO: 2103288 - RNA, 22 nt, Staphylococcus aureus subsp. aureus MW2
uuuauuuuuggauucaccaauu

SEQ ID NO: 2103289 - RNA, 11 nt, Staphylococcus aureus subsp. aureus MW2
uuuauuuuugg

SEQ ID NO: 2103290 - RNA, 14 nt, Staphylococcus aureus subsp. aureus MW2
uuuauuuuauaaga

SEQ ID NO: 2103291 - RNA, 16 nt, Staphylococcus aureus subsp. aureus MW2
uuuauuugucuuugaa

SEQ ID NO: 2103292 - RNA, 19 nt, Staphylococcus aureus subsp. aureus MW2
uuuauuuucaauaaauaaa

SEQ ID NO: 2103293 - RNA, 14 nt, Staphylococcus aureus subsp. aureus MW2
uuuauuugaaauaa

SEQ ID NO: 2103294 - RNA, 13 nt, Staphylococcus aureus subsp. aureus MW2
uuuauuuugauua

SEQ ID NO: 2103295 - RNA, 16 nt, Staphylococcus aureus subsp. aureus MW2
uuuauucuaaguuaaa

SEQ ID NO: 2103296 - RNA, 14 nt, Staphylococcus aureus subsp. aureus MW2
uuuauuagaaugaa

SEQ ID NO: 2103297 - RNA, 19 nt, Staphylococcus aureus subsp. aureus MW2
uuuauuaguauucaaaaaa

SEQ ID NO: 2103298 - RNA, 24 nt, Staphylococcus aureus subsp. aureus MW2
uuuauuagcuagcaugagcgcaua

SEQ ID NO: 2103299 - RNA, 15 nt, Staphylococcus aureus subsp. aureus MW2
uuuauuauaaaauag

SEQ ID NO: 2103300 - RNA, 19 nt, Staphylococcus aureus subsp. aureus MW2
uuuauuuagaauaaacuuu

SEQ ID NO: 2103301 - RNA, 22 nt, Staphylococcus aureus subsp. aureus MW2
uuuauuuauaaaauaaaaugca

SEQ ID NO: 2103302 - RNA, 12 nt, Staphylococcus aureus subsp. aureus MW2
uuuauuucuaua

SEQ ID NO: 2103303 - RNA, 14 nt, Staphylococcus aureus subsp. aureus MW2
uuucaauuagaaaa

SEQ ID NO: 2103304 - RNA, 16 nt, Staphylococcus aureus subsp. aureus MW2
uuucaauuucuacuga

SEQ ID NO: 2103305 - RNA, 20 nt, Staphylococcus aureus subsp. aureus MW2
uuucaauuagaaaauuucuc

SEQ ID NO: 2103306 - RNA, 12 nt, Staphylococcus aureus subsp. aureus MW2
uuucaauugcac

SEQ ID NO: 2103307 - RNA, 16 nt, Staphylococcus aureus subsp. aureus MW2
uuucacauugucuaca

SEQ ID NO: 2103308 - RNA, 21 nt, Staphylococcus aureus subsp. aureus MW2
uuucacgaauaucuuaaagaa

SEQ ID NO: 2103309 - RNA, 22 nt, Staphylococcus aureus subsp. aureus MW2
uuucacuacgucaagcuuugcu

SEQ ID NO: 2103310 - RNA, 19 nt, Staphylococcus aureus subsp. aureus MW2
uuucacuguuuuaucuaca

SEQ ID NO: 2103311 - RNA, 15 nt, Staphylococcus aureus subsp. aureus MW2
uuucaacauuuuuua

SEQ ID NO: 2103312 - RNA, 15 nt, Staphylococcus aureus subsp. aureus MW2
uuucaacauaauauu

SEQ ID NO: 2103313 - RNA, 16 nt, Staphylococcus aureus subsp. aureus MW2
uuucaacauaauauuu

SEQ ID NO: 2103314 - RNA, 13 nt, Staphylococcus aureus subsp. aureus MW2
uuucaacauuacu

SEQ ID NO: 2103315 - RNA, 11 nt, Staphylococcus aureus subsp. aureus MW2
uuucaacauuu

SEQ ID NO: 2103316 - RNA, 13 nt, Staphylococcus aureus subsp. aureus MW2
uuucaauaaauuu

SEQ ID NO: 2103317 - RNA, 17 nt, Staphylococcus aureus subsp. aureus MW2
uuucaaguuuaaaauac

SEQ ID NO: 2103318 - RNA, 18 nt, Staphylococcus aureus subsp. aureus MW2
uuucaaugcauauucuau

SEQ ID NO: 2103319 - RNA, 16 nt, Staphylococcus aureus subsp. aureus MW2
uuucaauccuuuguuu

SEQ ID NO: 2103320 - RNA, 23 nt, Staphylococcus aureus subsp. aureus MW2
uuucauaaauauuuaaaauauua

SEQ ID NO: 2103321 - RNA, 16 nt, Staphylococcus aureus subsp. aureus MW2
uuucauaaaguuuauu

SEQ ID NO: 2103322 - RNA, 19 nt, Staphylococcus aureus subsp. aureus MW2
uuucauaugcaucaacaga

SEQ ID NO: 2103323 - RNA, 16 nt, Staphylococcus aureus subsp. aureus MW2
uuucauauggugaacu

SEQ ID NO: 2103324 - RNA, 19 nt, Staphylococcus aureus subsp. aureus MW2
uuucauauucacaucuuua

SEQ ID NO: 2103325 - RNA, 23 nt, Staphylococcus aureus subsp. aureus MW2
uuucauauaaauagcuucuuaaa

SEQ ID NO: 2103326 - RNA, 19 nt, Staphylococcus aureus subsp. aureus MW2
uuucaggcuuuguuuuuca

SEQ ID NO: 2103327 - RNA, 19 nt, Staphylococcus aureus subsp. aureus MW2
uuucaggaauuguuaaaug

SEQ ID NO: 2103328 - RNA, 17 nt, Staphylococcus aureus subsp. aureus MW2
uuucagucguuaaaaua

SEQ ID NO: 2103329 - RNA, 14 nt, Staphylococcus aureus subsp. aureus MW2
uuucaguagaugcu

SEQ ID NO: 2103330 - RNA, 18 nt, Staphylococcus aureus subsp. aureus MW2
uuucagccacugucaugu

SEQ ID NO: 2103331 - RNA, 21 nt, Staphylococcus aureus subsp. aureus MW2
uuucagcaucgggaucuaauu

SEQ ID NO: 2103332 - RNA, 16 nt, Staphylococcus aureus subsp. aureus MW2
uuucagcaguugcaca

SEQ ID NO: 2103333 - RNA, 15 nt, Staphylococcus aureus subsp. aureus MW2
uuucaucauuaguuu

SEQ ID NO: 2103334 - RNA, 16 nt, Staphylococcus aureus subsp. aureus MW2
uuucaucaaauucaaa

SEQ ID NO: 2103335 - RNA, 18 nt, Staphylococcus aureus subsp. aureus MW2
uuucaucaaauucucauu

SEQ ID NO: 2103336 - RNA, 13 nt, Staphylococcus aureus subsp. aureus MW2
uuucaucaauauc

SEQ ID NO: 2103337 - RNA, 14 nt, Staphylococcus aureus subsp. aureus MW2
uuucaucaauauca

SEQ ID NO: 2103338 - RNA, 18 nt, Staphylococcus aureus subsp. aureus MW2
uuucaucuuucaaaugcu

SEQ ID NO: 2103339 - RNA, 11 nt, Staphylococcus aureus subsp. aureus MW2
uuucaucuuuc

SEQ ID NO: 2103340 - RNA, 19 nt, Staphylococcus aureus subsp. aureus MW2
uuucauuaauuuuuucguu

SEQ ID NO: 2103341 - RNA, 22 nt, Staphylococcus aureus subsp. aureus MW2
uuucauguuugauucuaaauaa

SEQ ID NO: 2103342 - RNA, 16 nt, Staphylococcus aureus subsp. aureus MW2
uuucaugugcauuuug

SEQ ID NO: 2103343 - RNA, 22 nt, Staphylococcus aureus subsp. aureus MW2
uuucaugugucacaaugaccau

SEQ ID NO: 2103344 - RNA, 18 nt, Staphylococcus aureus subsp. aureus MW2
uuucauuuuuucaauguc

SEQ ID NO: 2103345 - RNA, 15 nt, Staphylococcus aureus subsp. aureus MW2
uuucauuuuuauccc

SEQ ID NO: 2103346 - RNA, 13 nt, Staphylococcus aureus subsp. aureus MW2
uuuccaauaucuu

SEQ ID NO: 2103347 - RNA, 22 nt, Staphylococcus aureus subsp. aureus MW2
uuucauuaucaacuuuauaacc

SEQ ID NO: 2103348 - RNA, 22 nt, Staphylococcus aureus subsp. aureus MW2
uuuaugcuuauucugaaaaaua

SEQ ID NO: 2103349 - RNA, 12 nt, Staphylococcus aureus subsp. aureus MW2
uuuaugauuguu

SEQ ID NO: 2103350 - RNA, 11 nt, Staphylococcus aureus subsp. aureus MW2
uuuaugaaaau

SEQ ID NO: 2103351 - RNA, 17 nt, Staphylococcus aureus subsp. aureus MW2
uuuaugauaauaagaau

SEQ ID NO: 2103352 - RNA, 20 nt, Staphylococcus aureus subsp. aureus MW2
uuuaugauaauaagaauauu

SEQ ID NO: 2103353 - RNA, 16 nt, Staphylococcus aureus subsp. aureus MW2
uuuauuaaguauaucu

SEQ ID NO: 2103354 - RNA, 21 nt, Staphylococcus aureus subsp. aureus MW2
uuuauuaauggcaacuaagau

SEQ ID NO: 2103355 - RNA, 16 nt, Staphylococcus aureus subsp. aureus MW2
uuuaugggauguauuu

SEQ ID NO: 2103356 - RNA, 23 nt, Staphylococcus aureus subsp. aureus MW2
uuuauggcguagcugaggauuuu

SEQ ID NO: 2103357 - RNA, 19 nt, Staphylococcus aureus subsp. aureus MW2
uuuauccaaaccaauuuua

SEQ ID NO: 2103358 - RNA, 18 nt, Staphylococcus aureus subsp. aureus MW2
uuuauccaaugcauaaaa

SEQ ID NO: 2103359 - RNA, 12 nt, Staphylococcus aureus subsp. aureus MW2
uuuauccaaacc

SEQ ID NO: 2103360 - RNA, 14 nt, Staphylococcus aureus subsp. aureus MW2
uuuaucaugucuga

SEQ ID NO: 2103361 - RNA, 16 nt, Staphylococcus aureus subsp. aureus MW2
uuuaucuauaugcaua

SEQ ID NO: 2103362 - RNA, 15 nt, Staphylococcus aureus subsp. aureus MW2
uuuaucuaguuguuu

SEQ ID NO: 2103363 - RNA, 19 nt, Staphylococcus aureus subsp. aureus MW2
uuuaucuacauuaaagaaa

SEQ ID NO: 2103364 - RNA, 22 nt, Staphylococcus aureus subsp. aureus MW2
uuuaucuacaguuuuaugaaua

SEQ ID NO: 2103365 - RNA, 17 nt, Staphylococcus aureus subsp. aureus MW2
uuuaucugaaaauauca

SEQ ID NO: 2103366 - RNA, 22 nt, Staphylococcus aureus subsp. aureus MW2
uuuaucuguagaaacacuuuua

SEQ ID NO: 2103367 - RNA, 21 nt, Staphylococcus aureus subsp. aureus MW2
uuuauauuaaauacuauauau

SEQ ID NO: 2103368 - RNA, 16 nt, Staphylococcus aureus subsp. aureus MW2
uuuauauuaaauacua

SEQ ID NO: 2103369 - RNA, 19 nt, Staphylococcus aureus subsp. aureus MW2
uuuauauuccauuucaaau

SEQ ID NO: 2103370 - RNA, 18 nt, Staphylococcus aureus subsp. aureus MW2
uuuauauuuaaacucucu

SEQ ID NO: 2103371 - RNA, 14 nt, Staphylococcus aureus subsp. aureus MW2
uuuauauuuaucag

SEQ ID NO: 2103372 - RNA, 13 nt, Staphylococcus aureus subsp. aureus MW2
uuuauauuuauuu

SEQ ID NO: 2103373 - RNA, 16 nt, Staphylococcus aureus subsp. aureus MW2
uuuauauuuauuuuau

SEQ ID NO: 2103374 - RNA, 13 nt, Staphylococcus aureus subsp. aureus MW2
uuuauauuuuuau

SEQ ID NO: 2103375 - RNA, 15 nt, Staphylococcus aureus subsp. aureus MW2
uuuauauuuuuauca

SEQ ID NO: 2103376 - RNA, 14 nt, Staphylococcus aureus subsp. aureus MW2
uuuauauuaaauaa

SEQ ID NO: 2103377 - RNA, 21 nt, Staphylococcus aureus subsp. aureus MW2
uuuauauauaaaaucauuaau

SEQ ID NO: 2103378 - RNA, 15 nt, Staphylococcus aureus subsp. aureus MW2
uuuauaguaauagcu

SEQ ID NO: 2103379 - RNA, 12 nt, Staphylococcus aureus subsp. aureus MW2
uuuaucaauauu

SEQ ID NO: 2103380 - RNA, 15 nt, Staphylococcus aureus subsp. aureus MW2
uuuaucaauuucuau

SEQ ID NO: 2103381 - RNA, 21 nt, Staphylococcus aureus subsp. aureus MW2
uuuauauuuuuuguacauuau

SEQ ID NO: 2103382 - RNA, 13 nt, Staphylococcus aureus subsp. aureus MW2
uuuaucauaacaa

SEQ ID NO: 2103383 - RNA, 15 nt, Staphylococcus aureus subsp. aureus MW2
uuuauaaauuaaaug

SEQ ID NO: 2103384 - RNA, 21 nt, Staphylococcus aureus subsp. aureus MW2
uuuauaaauuaaaugcaauac

SEQ ID NO: 2103385 - RNA, 12 nt, Staphylococcus aureus subsp. aureus MW2
uuuauaaguauu

SEQ ID NO: 2103386 - RNA, 15 nt, Staphylococcus aureus subsp. aureus MW2
uuuauaauaaauuuc

SEQ ID NO: 2103387 - RNA, 23 nt, Staphylococcus aureus subsp. aureus MW2
uuuauaaaugaauuauuuaaaau

SEQ ID NO: 2103388 - RNA, 12 nt, Staphylococcus aureus subsp. aureus MW2
uuuauaaauuaa

SEQ ID NO: 2103389 - RNA, 12 nt, Staphylococcus aureus subsp. aureus MW2
uuuauaaauaaa

SEQ ID NO: 2103390 - RNA, 16 nt, Staphylococcus aureus subsp. aureus MW2
uuuauaaauaaacaua

SEQ ID NO: 2103391 - RNA, 18 nt, Staphylococcus aureus subsp. aureus MW2
uuuauaaacaauaaaaaa

SEQ ID NO: 2103392 - RNA, 13 nt, Staphylococcus aureus subsp. aureus MW2
uuuauaaacaauu

SEQ ID NO: 2103393 - RNA, 14 nt, Staphylococcus aureus subsp. aureus MW2
uuuauagaaaauua

SEQ ID NO: 2103394 - RNA, 13 nt, Staphylococcus aureus subsp. aureus MW2
uuuauacuuaaua

SEQ ID NO: 2103395 - RNA, 18 nt, Staphylococcus aureus subsp. aureus MW2
uuuauacauguacauuau

SEQ ID NO: 2103396 - RNA, 21 nt, Staphylococcus aureus subsp. aureus MW2
uuuauaauaaccuacauuaau

SEQ ID NO: 2103397 - RNA, 16 nt, Staphylococcus aureus subsp. aureus MW2
uuuauaauucuaaguc

SEQ ID NO: 2103398 - RNA, 12 nt, Staphylococcus aureus subsp. aureus MW2
uuuauaauuucu

SEQ ID NO: 2103399 - RNA, 14 nt, Staphylococcus aureus subsp. aureus MW2
uuuauaauuucuaa

SEQ ID NO: 2103400 - RNA, 16 nt, Staphylococcus aureus subsp. aureus MW2
uuuauaauuucuaaau

SEQ ID NO: 2103401 - RNA, 19 nt, Staphylococcus aureus subsp. aureus MW2
uuuauaauuucuaaaucua

SEQ ID NO: 2103402 - RNA, 18 nt, Staphylococcus aureus subsp. aureus MW2
uuuauaaugauuaaaaau

SEQ ID NO: 2103403 - RNA, 16 nt, Staphylococcus aureus subsp. aureus MW2
uuuagcauauucugca

SEQ ID NO: 2103404 - RNA, 12 nt, Staphylococcus aureus subsp. aureus MW2
uuuagcauugcc

SEQ ID NO: 2103405 - RNA, 13 nt, Staphylococcus aureus subsp. aureus MW2
uuuagccaaugcu

SEQ ID NO: 2103406 - RNA, 17 nt, Staphylococcus aureus subsp. aureus MW2
uuuagccccagcaaaua

SEQ ID NO: 2103407 - RNA, 22 nt, Staphylococcus aureus subsp. aureus MW2
uuuagaaucaaccguuuuauug

SEQ ID NO: 2103408 - RNA, 14 nt, Staphylococcus aureus subsp. aureus MW2
uuuagacauaaaaa

SEQ ID NO: 2103409 - RNA, 19 nt, Staphylococcus aureus subsp. aureus MW2
uuuagacuuuauuuuucca

SEQ ID NO: 2103410 - RNA, 19 nt, Staphylococcus aureus subsp. aureus MW2
uuuagauaaaaaauacuaa

SEQ ID NO: 2103411 - RNA, 15 nt, Staphylococcus aureus subsp. aureus MW2
uuuaguauaaauaaa

SEQ ID NO: 2103412 - RNA, 21 nt, Staphylococcus aureus subsp. aureus MW2
uuuaguaucuauacaauuaug

SEQ ID NO: 2103413 - RNA, 14 nt, Staphylococcus aureus subsp. aureus MW2
uuuaguauaaauaa

SEQ ID NO: 2103414 - RNA, 19 nt, Staphylococcus aureus subsp. aureus MW2
uuuaguacauauguuguuu

SEQ ID NO: 2103415 - RNA, 19 nt, Staphylococcus aureus subsp. aureus MW2
uuuaggccacacaucaaca

SEQ ID NO: 2103416 - RNA, 13 nt, Staphylococcus aureus subsp. aureus MW2
uuuauaaaaagag

SEQ ID NO: 2103417 - RNA, 17 nt, Staphylococcus aureus subsp. aureus MW2
uuuaguucacaauuucg

SEQ ID NO: 2103418 - RNA, 16 nt, Staphylococcus aureus subsp. aureus MW2
uuuaguuaaguauuuu

SEQ ID NO: 2103419 - RNA, 13 nt, Staphylococcus aureus subsp. aureus MW2
uuuaguuaaauag

SEQ ID NO: 2103420 - RNA, 15 nt, Staphylococcus aureus subsp. aureus MW2
uuuaguuaaauagua

SEQ ID NO: 2103421 - RNA, 16 nt, Staphylococcus aureus subsp. aureus MW2
uuuaguuaaauaguaa

SEQ ID NO: 2103422 - RNA, 14 nt, Staphylococcus aureus subsp. aureus MW2
uuuaguuaaaguga

SEQ ID NO: 2103423 - RNA, 15 nt, Staphylococcus aureus subsp. aureus MW2
uuuagugaaaauacc

SEQ ID NO: 2103424 - RNA, 20 nt, Staphylococcus aureus subsp. aureus MW2
uuuaguccuucuuuacuaaa

SEQ ID NO: 2103425 - RNA, 18 nt, Staphylococcus aureus subsp. aureus MW2
uuuagucgguguuuucuu

SEQ ID NO: 2103426 - RNA, 19 nt, Staphylococcus aureus subsp. aureus MW2
uuuagucauuacaaaucau

SEQ ID NO: 2103427 - RNA, 14 nt, Staphylococcus aureus subsp. aureus MW2
uuuacuuuguaauu

SEQ ID NO: 2103428 - RNA, 17 nt, Staphylococcus aureus subsp. aureus MW2
uuuacuuuguaauucuu

SEQ ID NO: 2103429 - RNA, 15 nt, Staphylococcus aureus subsp. aureus MW2
uuuacugcuucaauc

SEQ ID NO: 2103430 - RNA, 12 nt, Staphylococcus aureus subsp. aureus MW2
uuuacuuaaucu

SEQ ID NO: 2103431 - RNA, 20 nt, Staphylococcus aureus subsp. aureus MW2
uuuacuccaaaguaacauau

SEQ ID NO: 2103432 - RNA, 15 nt, Staphylococcus aureus subsp. aureus MW2
uuuacuauuaaagga

SEQ ID NO: 2103433 - RNA, 16 nt, Staphylococcus aureus subsp. aureus MW2
uuuacucauauugaau

SEQ ID NO: 2103434 - RNA, 22 nt, Staphylococcus aureus subsp. aureus MW2
uuuacucauauugaauacuucu

SEQ ID NO: 2103435 - RNA, 22 nt, Staphylococcus aureus subsp. aureus MW2
uuuacuaggaauauaaaacugu

SEQ ID NO: 2103436 - RNA, 16 nt, Staphylococcus aureus subsp. aureus MW2
uuuacuauacuuugag

SEQ ID NO: 2103437 - RNA, 14 nt, Staphylococcus aureus subsp. aureus MW2
uuuacuacaaagca

SEQ ID NO: 2103438 - RNA, 17 nt, Staphylococcus aureus subsp. aureus MW2
uuuacuauauucaauga

SEQ ID NO: 2103439 - RNA, 13 nt, Staphylococcus aureus subsp. aureus MW2
uuuacgauaaaua

SEQ ID NO: 2103440 - RNA, 18 nt, Staphylococcus aureus subsp. aureus MW2
uuuacauauugugguaaa

SEQ ID NO: 2103441 - RNA, 19 nt, Staphylococcus aureus subsp. aureus MW2
uuuacagaacguucauaua

SEQ ID NO: 2103442 - RNA, 14 nt, Staphylococcus aureus subsp. aureus MW2
uuuacuaaaugaau

SEQ ID NO: 2103443 - RNA, 14 nt, Staphylococcus aureus subsp. aureus MW2
uuuacguucugauu

SEQ ID NO: 2103444 - RNA, 21 nt, Staphylococcus aureus subsp. aureus MW2
uuuacggggugcuuuuuaugu

SEQ ID NO: 2103445 - RNA, 19 nt, Staphylococcus aureus subsp. aureus MW2
ucaggggccccaacacaga

SEQ ID NO: 2103446 - RNA, 21 nt, Staphylococcus aureus subsp. aureus MW2
ucaggggccccaacacagaga

SEQ ID NO: 2103447 - RNA, 16 nt, Staphylococcus aureus subsp. aureus MW2
ucagggaaaucaucug

SEQ ID NO: 2103448 - RNA, 13 nt, Staphylococcus aureus subsp. aureus MW2
ucagguaauguuu

SEQ ID NO: 2103449 - RNA, 18 nt, Staphylococcus aureus subsp. aureus MW2
ucagguguaucuuugaua

SEQ ID NO: 2103450 - RNA, 14 nt, Staphylococcus aureus subsp. aureus MW2
ucagguuaacauuu

SEQ ID NO: 2103451 - RNA, 23 nt, Staphylococcus aureus subsp. aureus MW2
ucaggaucacguuuuucuuuaaa

SEQ ID NO: 2103452 - RNA, 16 nt, Staphylococcus aureus subsp. aureus MW2
ucaggaucacguuuuu

SEQ ID NO: 2103453 - RNA, 15 nt, Staphylococcus aureus subsp. aureus MW2
uaucuucacucuuuu

SEQ ID NO: 2103454 - RNA, 19 nt, Staphylococcus aureus subsp. aureus MW2
uaucuucacucuuuuagaa

SEQ ID NO: 2103455 - RNA, 14 nt, Staphylococcus aureus subsp. aureus MW2
uaucuucaguuauu

SEQ ID NO: 2103456 - RNA, 19 nt, Staphylococcus aureus subsp. aureus MW2
ucagcguuaucuuuaagua

SEQ ID NO: 2103457 - RNA, 13 nt, Staphylococcus aureus subsp. aureus MW2
ucagcuuuuucac

SEQ ID NO: 2103458 - RNA, 17 nt, Staphylococcus aureus subsp. aureus MW2
ucagcuuuuuuacauug

SEQ ID NO: 2103459 - RNA, 16 nt, Staphylococcus aureus subsp. aureus MW2
ucagcuuuucaguuuu

SEQ ID NO: 2103460 - RNA, 14 nt, Staphylococcus aureus subsp. aureus MW2
ucagcuuuucuuca

SEQ ID NO: 2103461 - RNA, 22 nt, Staphylococcus aureus subsp. aureus MW2
ucagcuuuggcgacauaaauac

SEQ ID NO: 2103462 - RNA, 14 nt, Staphylococcus aureus subsp. aureus MW2
ucagcuuuaauaau

SEQ ID NO: 2103463 - RNA, 16 nt, Staphylococcus aureus subsp. aureus MW2
ucagcuuuaauaauau

SEQ ID NO: 2103464 - RNA, 15 nt, Staphylococcus aureus subsp. aureus MW2
ucagcuaauucgucu

SEQ ID NO: 2103465 - RNA, 15 nt, Staphylococcus aureus subsp. aureus MW2
ucagcuaaguuaaau

SEQ ID NO: 2103466 - RNA, 13 nt, Staphylococcus aureus subsp. aureus MW2
ucagcuuauuaag

SEQ ID NO: 2103467 - RNA, 17 nt, Staphylococcus aureus subsp. aureus MW2
ucagcuuacaauaaugu

SEQ ID NO: 2103468 - RNA, 23 nt, Staphylococcus aureus subsp. aureus MW2
ucagcuuacaauaaugugcaagu

SEQ ID NO: 2103469 - RNA, 15 nt, Staphylococcus aureus subsp. aureus MW2
ucaguaauaauguag

SEQ ID NO: 2103470 - RNA, 21 nt, Staphylococcus aureus subsp. aureus MW2
ucaguaacaguauaaauauuu

SEQ ID NO: 2103471 - RNA, 22 nt, Staphylococcus aureus subsp. aureus MW2
ucaguaacaguauaaauauuuu

SEQ ID NO: 2103472 - RNA, 17 nt, Staphylococcus aureus subsp. aureus MW2
ucaguacgaacaacuaa

SEQ ID NO: 2103473 - RNA, 14 nt, Staphylococcus aureus subsp. aureus MW2
ucagucaauucaaa

SEQ ID NO: 2103474 - RNA, 22 nt, Staphylococcus aureus subsp. aureus MW2
ucaguauuuguauugacaucuu

SEQ ID NO: 2103475 - RNA, 16 nt, Staphylococcus aureus subsp. aureus MW2
ucaguauuuaauguuu

SEQ ID NO: 2103476 - RNA, 17 nt, Staphylococcus aureus subsp. aureus MW2
ucaguauuuaauguuuu

SEQ ID NO: 2103477 - RNA, 18 nt, Staphylococcus aureus subsp. aureus MW2
ucaguauuuaauguuuua

SEQ ID NO: 2103478 - RNA, 13 nt, Staphylococcus aureus subsp. aureus MW2
ucagugcauuuuu

SEQ ID NO: 2103479 - RNA, 23 nt, Staphylococcus aureus subsp. aureus MW2
ucagugcauuuuuuauuuuacuu

SEQ ID NO: 2103480 - RNA, 19 nt, Staphylococcus aureus subsp. aureus MW2
ucaguugcccgauuuuaaa

SEQ ID NO: 2103481 - RNA, 16 nt, Staphylococcus aureus subsp. aureus MW2
ucaguuguguaauaaa

SEQ ID NO: 2103482 - RNA, 13 nt, Staphylococcus aureus subsp. aureus MW2
ucaguuaaaucuu

SEQ ID NO: 2103483 - RNA, 17 nt, Staphylococcus aureus subsp. aureus MW2
ucaguuagcuuauuuag

SEQ ID NO: 2103484 - RNA, 19 nt, Staphylococcus aureus subsp. aureus MW2
ucaguuagcuuauuuagaa

SEQ ID NO: 2103485 - RNA, 18 nt, Staphylococcus aureus subsp. aureus MW2
ucauaaaauuuaaaacaa

SEQ ID NO: 2103486 - RNA, 15 nt, Staphylococcus aureus subsp. aureus MW2
ucauaaaauuuaaaa

SEQ ID NO: 2103487 - RNA, 17 nt, Staphylococcus aureus subsp. aureus MW2
ucauaaaguuuauuuau

SEQ ID NO: 2103488 - RNA, 22 nt, Staphylococcus aureus subsp. aureus MW2
ucauaaaguuuauuuauguucg

SEQ ID NO: 2103489 - RNA, 15 nt, Staphylococcus aureus subsp. aureus MW2
ucauaaauauaaaau

SEQ ID NO: 2103490 - RNA, 15 nt, Staphylococcus aureus subsp. aureus MW2
ucauaaacucuuaua

SEQ ID NO: 2103491 - RNA, 12 nt, Staphylococcus aureus subsp. aureus MW2
ucauaaauauuu

SEQ ID NO: 2103492 - RNA, 18 nt, Staphylococcus aureus subsp. aureus MW2
ucauaaauauuuaaaaua

SEQ ID NO: 2103493 - RNA, 13 nt, Staphylococcus aureus subsp. aureus MW2
ucauaaauauuuu

SEQ ID NO: 2103494 - RNA, 15 nt, Staphylococcus aureus subsp. aureus MW2
ucauaaaucaugaaa

SEQ ID NO: 2103495 - RNA, 22 nt, Staphylococcus aureus subsp. aureus MW2
ucauaaaucaugaaauuaaaaa

SEQ ID NO: 2103496 - RNA, 19 nt, Staphylococcus aureus subsp. aureus MW2
ucauaacgacaacuugaac

SEQ ID NO: 2103497 - RNA, 13 nt, Staphylococcus aureus subsp. aureus MW2
ucauaacaacauc

SEQ ID NO: 2103498 - RNA, 18 nt, Staphylococcus aureus subsp. aureus MW2
ucaucaaacaacaucacu

SEQ ID NO: 2103499 - RNA, 11 nt, Staphylococcus aureus subsp. aureus MW2
ucaucaaaauu

SEQ ID NO: 2103500 - RNA, 14 nt, Staphylococcus aureus subsp. aureus MW2
ucaucaaacaacau

SEQ ID NO: 2103501 - RNA, 20 nt, Staphylococcus aureus subsp. aureus MW2
ucauauuugaauacuuuauu

SEQ ID NO: 2103502 - RNA, 17 nt, Staphylococcus aureus subsp. aureus MW2
ucauauuugaauacuuu

SEQ ID NO: 2103503 - RNA, 18 nt, Staphylococcus aureus subsp. aureus MW2
ucauauuuagguaauaca

SEQ ID NO: 2103504 - RNA, 13 nt, Staphylococcus aureus subsp. aureus MW2
ucauauugaauac

SEQ ID NO: 2103505 - RNA, 15 nt, Staphylococcus aureus subsp. aureus MW2
ucauauugcacauaa

SEQ ID NO: 2103506 - RNA, 19 nt, Staphylococcus aureus subsp. aureus MW2
ucauauugcacauaaacuu

SEQ ID NO: 2103507 - RNA, 19 nt, Staphylococcus aureus subsp. aureus MW2
ucauauaaugguugaauaa

SEQ ID NO: 2103508 - RNA, 14 nt, Staphylococcus aureus subsp. aureus MW2
ucauauaaugaaug

SEQ ID NO: 2103509 - RNA, 14 nt, Staphylococcus aureus subsp. aureus MW2
ucauaguugucuuu

SEQ ID NO: 2103510 - RNA, 17 nt, Staphylococcus aureus subsp. aureus MW2
ucauauauuuuguuaau

SEQ ID NO: 2103511 - RNA, 16 nt, Staphylococcus aureus subsp. aureus MW2
ucauaucauaccaaaa

SEQ ID NO: 2103512 - RNA, 14 nt, Staphylococcus aureus subsp. aureus MW2
ucauauucaaaaua

SEQ ID NO: 2103513 - RNA, 19 nt, Staphylococcus aureus subsp. aureus MW2
ucauauucaaaauaacuua

SEQ ID NO: 2103514 - RNA, 15 nt, Staphylococcus aureus subsp. aureus MW2
ucauauuaauauuuu

SEQ ID NO: 2103515 - RNA, 15 nt, Staphylococcus aureus subsp. aureus MW2
ucauauucacaucuu

SEQ ID NO: 2103516 - RNA, 19 nt, Staphylococcus aureus subsp. aureus MW2
ucauauucaacuaguaaau

SEQ ID NO: 2103517 - RNA, 19 nt, Staphylococcus aureus subsp. aureus MW2
ucauauucgccuucuaaua

SEQ ID NO: 2103518 - RNA, 22 nt, Staphylococcus aureus subsp. aureus MW2
ucauaucuuuauuugauucuuc

SEQ ID NO: 2103519 - RNA, 17 nt, Staphylococcus aureus subsp. aureus MW2
ucauaucuuuauuugau

SEQ ID NO: 2103520 - RNA, 20 nt, Staphylococcus aureus subsp. aureus MW2
ucauaucuuucaauuaauuu

SEQ ID NO: 2103521 - RNA, 11 nt, Staphylococcus aureus subsp. aureus MW2
ucauaucuuua

SEQ ID NO: 2103522 - RNA, 16 nt, Staphylococcus aureus subsp. aureus MW2
ucauaauuuucuauua

SEQ ID NO: 2103523 - RNA, 17 nt, Staphylococcus aureus subsp. aureus MW2
ucauaauuuucuauuau

SEQ ID NO: 2103524 - RNA, 18 nt, Staphylococcus aureus subsp. aureus MW2
ucauacauauuuauauuu

SEQ ID NO: 2103525 - RNA, 18 nt, Staphylococcus aureus subsp. aureus MW2
ucauaccgaagaaacuaa

SEQ ID NO: 2103526 - RNA, 22 nt, Staphylococcus aureus subsp. aureus MW2
ucauaacgauuguugcaaugau

SEQ ID NO: 2103527 - RNA, 15 nt, Staphylococcus aureus subsp. aureus MW2
ucauaaguuaaaguu

SEQ ID NO: 2103528 - RNA, 15 nt, Staphylococcus aureus subsp. aureus MW2
ucauaaucuacugcu

SEQ ID NO: 2103529 - RNA, 21 nt, Staphylococcus aureus subsp. aureus MW2
ucauaauauugaugaauaaau

SEQ ID NO: 2103530 - RNA, 14 nt, Staphylococcus aureus subsp. aureus MW2
ucauacgagaaauu

SEQ ID NO: 2103531 - RNA, 16 nt, Staphylococcus aureus subsp. aureus MW2
ucauagccuauuuaaa

SEQ ID NO: 2103532 - RNA, 15 nt, Staphylococcus aureus subsp. aureus MW2
ucauaguuauuaaau

SEQ ID NO: 2103533 - RNA, 18 nt, Staphylococcus aureus subsp. aureus MW2
ucauaguuauuaaaucuu

SEQ ID NO: 2103534 - RNA, 14 nt, Staphylococcus aureus subsp. aureus MW2
ucauaguuauuaaa

SEQ ID NO: 2103535 - RNA, 22 nt, Staphylococcus aureus subsp. aureus MW2
ucauagucgguuauuacaaaau

SEQ ID NO: 2103536 - RNA, 23 nt, Staphylococcus aureus subsp. aureus MW2
ucauagucgguuauuacaaaauu

SEQ ID NO: 2103537 - RNA, 16 nt, Staphylococcus aureus subsp. aureus MW2
ucauagugaaauucga

SEQ ID NO: 2103538 - RNA, 15 nt, Staphylococcus aureus subsp. aureus MW2
ucauccgccaauuaa

SEQ ID NO: 2103539 - RNA, 17 nt, Staphylococcus aureus subsp. aureus MW2
ucaucgaagauguuaaa

SEQ ID NO: 2103540 - RNA, 21 nt, Staphylococcus aureus subsp. aureus MW2
ucaucgaagauguuaaacugu

SEQ ID NO: 2103541 - RNA, 15 nt, Staphylococcus aureus subsp. aureus MW2
ucaucauuaaaucug

SEQ ID NO: 2103542 - RNA, 16 nt, Staphylococcus aureus subsp. aureus MW2
ucaucauuaaaucuga

SEQ ID NO: 2103543 - RNA, 17 nt, Staphylococcus aureus subsp. aureus MW2
ucaucauuaguuuuuaa

SEQ ID NO: 2103544 - RNA, 21 nt, Staphylococcus aureus subsp. aureus MW2
ucaucaugacuauuuuccauc

SEQ ID NO: 2103545 - RNA, 16 nt, Staphylococcus aureus subsp. aureus MW2
ucaucauggucaacuu

SEQ ID NO: 2103546 - RNA, 20 nt, Staphylococcus aureus subsp. aureus MW2
ucaucauggucaacuuuuuu

SEQ ID NO: 2103547 - RNA, 16 nt, Staphylococcus aureus subsp. aureus MW2
ucaucaguuguguaau

SEQ ID NO: 2103548 - RNA, 16 nt, Staphylococcus aureus subsp. aureus MW2
ucaucauauucgccuu

SEQ ID NO: 2103549 - RNA, 18 nt, Staphylococcus aureus subsp. aureus MW2
ucaucacaaauaaggaau

SEQ ID NO: 2103550 - RNA, 20 nt, Staphylococcus aureus subsp. aureus MW2
ucaucacaaauaaggaaugu

SEQ ID NO: 2103551 - RNA, 20 nt, Staphylococcus aureus subsp. aureus MW2
ucaucaccauacuaaaacau

SEQ ID NO: 2103552 - RNA, 16 nt, Staphylococcus aureus subsp. aureus MW2
ucaucacuuuuuaaac

SEQ ID NO: 2103553 - RNA, 23 nt, Staphylococcus aureus subsp. aureus MW2
ucaucuaacgacccaaauuauau

SEQ ID NO: 2103554 - RNA, 15 nt, Staphylococcus aureus subsp. aureus MW2
ucaucuaaaaagucu

SEQ ID NO: 2103555 - RNA, 12 nt, Staphylococcus aureus subsp. aureus MW2
ucaucuaaaauu

SEQ ID NO: 2103556 - RNA, 17 nt, Staphylococcus aureus subsp. aureus MW2
ucaucguccacgaaucu

SEQ ID NO: 2103557 - RNA, 13 nt, Staphylococcus aureus subsp. aureus MW2
ucaucguuuacua

SEQ ID NO: 2103558 - RNA, 21 nt, Staphylococcus aureus subsp. aureus MW2
ucaucguucauauauuuuguu

SEQ ID NO: 2103559 - RNA, 16 nt, Staphylococcus aureus subsp. aureus MW2
ucaucuacuuaaaaua

SEQ ID NO: 2103560 - RNA, 21 nt, Staphylococcus aureus subsp. aureus MW2
ucaucuacuuaaaauaaguau

SEQ ID NO: 2103561 - RNA, 16 nt, Staphylococcus aureus subsp. aureus MW2
ucaucuacuauuuaau

SEQ ID NO: 2103562 - RNA, 21 nt, Staphylococcus aureus subsp. aureus MW2
ucaucuacuauuuaaucuuaa

SEQ ID NO: 2103563 - RNA, 18 nt, Staphylococcus aureus subsp. aureus MW2
ucaucuauuuaauaaugu

SEQ ID NO: 2103564 - RNA, 22 nt, Staphylococcus aureus subsp. aureus MW2
ucaucuauuuuuaacuaauaga

SEQ ID NO: 2103565 - RNA, 21 nt, Staphylococcus aureus subsp. aureus MW2
ucaucuauucaaaugauuuua

SEQ ID NO: 2103566 - RNA, 12 nt, Staphylococcus aureus subsp. aureus MW2
ucaucuauuuaa

SEQ ID NO: 2103567 - RNA, 19 nt, Staphylococcus aureus subsp. aureus MW2
ucaucuggugcaauauuau

SEQ ID NO: 2103568 - RNA, 19 nt, Staphylococcus aureus subsp. aureus MW2
ucaucuguccgauuuuuaa

SEQ ID NO: 2103569 - RNA, 16 nt, Staphylococcus aureus subsp. aureus MW2
ucaucugcuuguaaua

SEQ ID NO: 2103570 - RNA, 23 nt, Staphylococcus aureus subsp. aureus MW2
ucaucuugcgccuuguucaauuc

SEQ ID NO: 2103571 - RNA, 20 nt, Staphylococcus aureus subsp. aureus MW2
ucaucuugcgccuuguucaa

SEQ ID NO: 2103572 - RNA, 13 nt, Staphylococcus aureus subsp. aureus MW2
ucaucuuuaugca

SEQ ID NO: 2103573 - RNA, 19 nt, Staphylococcus aureus subsp. aureus MW2
ucaucuucugaauuuaaua

SEQ ID NO: 2103574 - RNA, 20 nt, Staphylococcus aureus subsp. aureus MW2
ucaucuuaugacugcuuuuu

SEQ ID NO: 2103575 - RNA, 12 nt, Staphylococcus aureus subsp. aureus MW2
ucaugccuucau

SEQ ID NO: 2103576 - RNA, 13 nt, Staphylococcus aureus subsp. aureus MW2
ucaugccaaaaac

SEQ ID NO: 2103577 - RNA, 19 nt, Staphylococcus aureus subsp. aureus MW2
ucaugccaaaaacauuaac

SEQ ID NO: 2103578 - RNA, 15 nt, Staphylococcus aureus subsp. aureus MW2
ucaugcaaaauaaua

SEQ ID NO: 2103579 - RNA, 13 nt, Staphylococcus aureus subsp. aureus MW2
ucaugcacuuuau

SEQ ID NO: 2103580 - RNA, 17 nt, Staphylococcus aureus subsp. aureus MW2
ucaugcacuuuauuaaa

SEQ ID NO: 2103581 - RNA, 23 nt, Staphylococcus aureus subsp. aureus MW2
ucaugcacuuuauuaaaaauccu

SEQ ID NO: 2103582 - RNA, 22 nt, Staphylococcus aureus subsp. aureus MW2
ucaugcaaaacuaaucaaauua

SEQ ID NO: 2103583 - RNA, 13 nt, Staphylococcus aureus subsp. aureus MW2
ucaugccuucauu

SEQ ID NO: 2103584 - RNA, 15 nt, Staphylococcus aureus subsp. aureus MW2
ucaucuuuuucacua

SEQ ID NO: 2103585 - RNA, 18 nt, Staphylococcus aureus subsp. aureus MW2
ucaucuuuuugaaauuuc

SEQ ID NO: 2103586 - RNA, 16 nt, Staphylococcus aureus subsp. aureus MW2
ucaucuuuuuuaucau

SEQ ID NO: 2103587 - RNA, 17 nt, Staphylococcus aureus subsp. aureus MW2
ucaugaaauuaaaaaca

SEQ ID NO: 2103588 - RNA, 16 nt, Staphylococcus aureus subsp. aureus MW2
ucaugaauaaauacaa

SEQ ID NO: 2103589 - RNA, 20 nt, Staphylococcus aureus subsp. aureus MW2
ucaugaauaaauacaauguu

SEQ ID NO: 2103590 - RNA, 17 nt, Staphylococcus aureus subsp. aureus MW2
ucaugagcacaaacuaa

SEQ ID NO: 2103591 - RNA, 15 nt, Staphylococcus aureus subsp. aureus MW2
ucaugauuaauuaaa

SEQ ID NO: 2103592 - RNA, 19 nt, Staphylococcus aureus subsp. aureus MW2
ucauuauuuagaauucuaa

SEQ ID NO: 2103593 - RNA, 20 nt, Staphylococcus aureus subsp. aureus MW2
ucauuauuuagaauucuaaa

SEQ ID NO: 2103594 - RNA, 12 nt, Staphylococcus aureus subsp. aureus MW2
ucauuauuuaaa

SEQ ID NO: 2103595 - RNA, 22 nt, Staphylococcus aureus subsp. aureus MW2
ucauuauuaccuuugcuaaaua

SEQ ID NO: 2103596 - RNA, 12 nt, Staphylococcus aureus subsp. aureus MW2
ucauucagucaa

SEQ ID NO: 2103597 - RNA, 18 nt, Staphylococcus aureus subsp. aureus MW2
ucauuaguguagaaaaua

SEQ ID NO: 2103598 - RNA, 17 nt, Staphylococcus aureus subsp. aureus MW2
ucauuagcgaaaacuaa

SEQ ID NO: 2103599 - RNA, 16 nt, Staphylococcus aureus subsp. aureus MW2
ucauuagccaaaucuu

SEQ ID NO: 2103600 - RNA, 19 nt, Staphylococcus aureus subsp. aureus MW2
ucauuauagucuuaaacau

SEQ ID NO: 2103601 - RNA, 22 nt, Staphylococcus aureus subsp. aureus MW2
ucauuaguugccccuagcaaaa

SEQ ID NO: 2103602 - RNA, 14 nt, Staphylococcus aureus subsp. aureus MW2
ucauuauaaaaugg

SEQ ID NO: 2103603 - RNA, 16 nt, Staphylococcus aureus subsp. aureus MW2
ucauuaucaaauaacc

SEQ ID NO: 2103604 - RNA, 11 nt, Staphylococcus aureus subsp. aureus MW2
ucauuaucauu

SEQ ID NO: 2103605 - RNA, 15 nt, Staphylococcus aureus subsp. aureus MW2
ucauucuuuauagaa

SEQ ID NO: 2103606 - RNA, 16 nt, Staphylococcus aureus subsp. aureus MW2
ucauucuuuaauauaa

SEQ ID NO: 2103607 - RNA, 14 nt, Staphylococcus aureus subsp. aureus MW2
ucauugaagaauau

SEQ ID NO: 2103608 - RNA, 19 nt, Staphylococcus aureus subsp. aureus MW2
ucauugaagaauauaaacu

SEQ ID NO: 2103609 - RNA, 15 nt, Staphylococcus aureus subsp. aureus MW2
ucauugaaaauauuu

SEQ ID NO: 2103610 - RNA, 16 nt, Staphylococcus aureus subsp. aureus MW2
ucauugaaaauauuuu

SEQ ID NO: 2103611 - RNA, 22 nt, Staphylococcus aureus subsp. aureus MW2
ucauugaaaauauuuuauuaua

SEQ ID NO: 2103612 - RNA, 21 nt, Staphylococcus aureus subsp. aureus MW2
ucauguucuuaacaauaucau

SEQ ID NO: 2103613 - RNA, 21 nt, Staphylococcus aureus subsp. aureus MW2
ucaugugucacaaugaccauu

SEQ ID NO: 2103614 - RNA, 17 nt, Staphylococcus aureus subsp. aureus MW2
ucaugugucauaaucca

SEQ ID NO: 2103615 - RNA, 17 nt, Staphylococcus aureus subsp. aureus MW2
ucauguauauggcauca

SEQ ID NO: 2103616 - RNA, 18 nt, Staphylococcus aureus subsp. aureus MW2
ucaugucuagauuucaaa

SEQ ID NO: 2103617 - RNA, 18 nt, Staphylococcus aureus subsp. aureus MW2
ucauguaacguaaaaaug

SEQ ID NO: 2103618 - RNA, 20 nt, Staphylococcus aureus subsp. aureus MW2
ucauguaacguaaaaaugua

SEQ ID NO: 2103619 - RNA, 18 nt, Staphylococcus aureus subsp. aureus MW2
ucauguacaguuacuuuc

SEQ ID NO: 2103620 - RNA, 20 nt, Staphylococcus aureus subsp. aureus MW2
ucauggucaacuuuuuuaac

SEQ ID NO: 2103621 - RNA, 14 nt, Staphylococcus aureus subsp. aureus MW2
ucauuacauuuuau

SEQ ID NO: 2103622 - RNA, 16 nt, Staphylococcus aureus subsp. aureus MW2
ucauguucuuguaauc

SEQ ID NO: 2103623 - RNA, 19 nt, Staphylococcus aureus subsp. aureus MW2
ucauguucuuguaauccua

SEQ ID NO: 2103624 - RNA, 21 nt, Staphylococcus aureus subsp. aureus MW2
ucauguucuuauaaaagucag

SEQ ID NO: 2103625 - RNA, 18 nt, Staphylococcus aureus subsp. aureus MW2
ucauguuuggcauaauaa

SEQ ID NO: 2103626 - RNA, 13 nt, Staphylococcus aureus subsp. aureus MW2
ucauuaaauauuu

SEQ ID NO: 2103627 - RNA, 18 nt, Staphylococcus aureus subsp. aureus MW2
ucauuaacauaauaauaa

SEQ ID NO: 2103628 - RNA, 17 nt, Staphylococcus aureus subsp. aureus MW2
ucauuaagaaaaggcuc

SEQ ID NO: 2103629 - RNA, 15 nt, Staphylococcus aureus subsp. aureus MW2
ucauuaaguugaaaa

SEQ ID NO: 2103630 - RNA, 16 nt, Staphylococcus aureus subsp. aureus MW2
ucauuaaccuuacaua

SEQ ID NO: 2103631 - RNA, 19 nt, Staphylococcus aureus subsp. aureus MW2
ucauuaaaucugauucauu

SEQ ID NO: 2103632 - RNA, 21 nt, Staphylococcus aureus subsp. aureus MW2
uccaacacccauauaauuugg

SEQ ID NO: 2103633 - RNA, 18 nt, Staphylococcus aureus subsp. aureus MW2
uccaacacccauauaauu

SEQ ID NO: 2103634 - RNA, 18 nt, Staphylococcus aureus subsp. aureus MW2
uccaacauguaacaaaau

SEQ ID NO: 2103635 - RNA, 15 nt, Staphylococcus aureus subsp. aureus MW2
uccaaaguaauauga

SEQ ID NO: 2103636 - RNA, 16 nt, Staphylococcus aureus subsp. aureus MW2
uccaaauauuaaaaac

SEQ ID NO: 2103637 - RNA, 22 nt, Staphylococcus aureus subsp. aureus MW2
uccaaaguaacauaugcaagua

SEQ ID NO: 2103638 - RNA, 14 nt, Staphylococcus aureus subsp. aureus MW2
uccaaauaaauaua

SEQ ID NO: 2103639 - RNA, 18 nt, Staphylococcus aureus subsp. aureus MW2
uccaaaucgugauaucuu

SEQ ID NO: 2103640 - RNA, 21 nt, Staphylococcus aureus subsp. aureus MW2
uccaaagcuugauuuaacaac

SEQ ID NO: 2103641 - RNA, 12 nt, Staphylococcus aureus subsp. aureus MW2
ucauuuuucgcc

SEQ ID NO: 2103642 - RNA, 13 nt, Staphylococcus aureus subsp. aureus MW2
ucauuuuuggaug

SEQ ID NO: 2103643 - RNA, 19 nt, Staphylococcus aureus subsp. aureus MW2
ucauuuuucuuccuaaaua

SEQ ID NO: 2103644 - RNA, 14 nt, Staphylococcus aureus subsp. aureus MW2
uccaaaacauuuug

SEQ ID NO: 2103645 - RNA, 13 nt, Staphylococcus aureus subsp. aureus MW2
uccaaaaauugua

SEQ ID NO: 2103646 - RNA, 19 nt, Staphylococcus aureus subsp. aureus MW2
uccaaaaauuguaaaaccu

SEQ ID NO: 2103647 - RNA, 17 nt, Staphylococcus aureus subsp. aureus MW2
ucauuguuuuaaauuuu

SEQ ID NO: 2103648 - RNA, 13 nt, Staphylococcus aureus subsp. aureus MW2
ucauuuaaaauau

SEQ ID NO: 2103649 - RNA, 15 nt, Staphylococcus aureus subsp. aureus MW2
ucauuuaaaauauuu

SEQ ID NO: 2103650 - RNA, 14 nt, Staphylococcus aureus subsp. aureus MW2
ucauuuaauguucu

SEQ ID NO: 2103651 - RNA, 20 nt, Staphylococcus aureus subsp. aureus MW2
ucauuucaaauaagaaugug

SEQ ID NO: 2103652 - RNA, 13 nt, Staphylococcus aureus subsp. aureus MW2
ucauuuauaacau

SEQ ID NO: 2103653 - RNA, 22 nt, Staphylococcus aureus subsp. aureus MW2
ucauuuaaauuaguuauacuaa

SEQ ID NO: 2103654 - RNA, 19 nt, Staphylococcus aureus subsp. aureus MW2
ucauuguguccauaaauau

SEQ ID NO: 2103655 - RNA, 12 nt, Staphylococcus aureus subsp. aureus MW2
ucauuguauaaa

SEQ ID NO: 2103656 - RNA, 15 nt, Staphylococcus aureus subsp. aureus MW2
ucauuguauaaaaag

SEQ ID NO: 2103657 - RNA, 14 nt, Staphylococcus aureus subsp. aureus MW2
ucauuguaacucaa

SEQ ID NO: 2103658 - RNA, 23 nt, Staphylococcus aureus subsp. aureus MW2
ucauuggcaauauacuuuuuaaa

SEQ ID NO: 2103659 - RNA, 18 nt, Staphylococcus aureus subsp. aureus MW2
ucauugcuugguuugauu

SEQ ID NO: 2103660 - RNA, 12 nt, Staphylococcus aureus subsp. aureus MW2
ucauuuucaaua

SEQ ID NO: 2103661 - RNA, 18 nt, Staphylococcus aureus subsp. aureus MW2
ucauuuucaaauaacuga

SEQ ID NO: 2103662 - RNA, 16 nt, Staphylococcus aureus subsp. aureus MW2
ucauuuucauuguaug

SEQ ID NO: 2103663 - RNA, 17 nt, Staphylococcus aureus subsp. aureus MW2
ucauuuuuaauuuugac

SEQ ID NO: 2103664 - RNA, 11 nt, Staphylococcus aureus subsp. aureus MW2
ucauuuuuaau

SEQ ID NO: 2103665 - RNA, 13 nt, Staphylococcus aureus subsp. aureus MW2
ucauuuuggcaaa

SEQ ID NO: 2103666 - RNA, 17 nt, Staphylococcus aureus subsp. aureus MW2
ucauuuguguaaaugaa

SEQ ID NO: 2103667 - RNA, 18 nt, Staphylococcus aureus subsp. aureus MW2
ucauuugauuuaaaaagu

SEQ ID NO: 2103668 - RNA, 20 nt, Staphylococcus aureus subsp. aureus MW2
ucauuuggcguucaacauua

SEQ ID NO: 2103669 - RNA, 20 nt, Staphylococcus aureus subsp. aureus MW2
uccauacgaucuuuuucaau

SEQ ID NO: 2103670 - RNA, 21 nt, Staphylococcus aureus subsp. aureus MW2
uccauaguaaucgauugguaa

SEQ ID NO: 2103671 - RNA, 13 nt, Staphylococcus aureus subsp. aureus MW2
uccauaaauauua

SEQ ID NO: 2103672 - RNA, 16 nt, Staphylococcus aureus subsp. aureus MW2
uccauaaauaaaaugc

SEQ ID NO: 2103673 - RNA, 21 nt, Staphylococcus aureus subsp. aureus MW2
uccaguuuucaauuuauuaac

SEQ ID NO: 2103674 - RNA, 23 nt, Staphylococcus aureus subsp. aureus MW2
uccaguuuucaauuuauuaacug

SEQ ID NO: 2103675 - RNA, 14 nt, Staphylococcus aureus subsp. aureus MW2
uccaguuuucaauu

SEQ ID NO: 2103676 - RNA, 21 nt, Staphylococcus aureus subsp. aureus MW2
uccaucauuuguguaaaugaa

SEQ ID NO: 2103677 - RNA, 16 nt, Staphylococcus aureus subsp. aureus MW2
uccaucaucucugcuu

SEQ ID NO: 2103678 - RNA, 19 nt, Staphylococcus aureus subsp. aureus MW2
uccaucgcaacugauaauu

SEQ ID NO: 2103679 - RNA, 17 nt, Staphylococcus aureus subsp. aureus MW2
uccauauaaccuauuuc

SEQ ID NO: 2103680 - RNA, 23 nt, Staphylococcus aureus subsp. aureus MW2
uccaguccuuuuuuuauguuuaa

SEQ ID NO: 2103681 - RNA, 19 nt, Staphylococcus aureus subsp. aureus MW2
uccaguuuauaacugggau

SEQ ID NO: 2103682 - RNA, 14 nt, Staphylococcus aureus subsp. aureus MW2
uccaguauuaacug

SEQ ID NO: 2103683 - RNA, 15 nt, Staphylococcus aureus subsp. aureus MW2
uccagacuccuaaau

SEQ ID NO: 2103684 - RNA, 18 nt, Staphylococcus aureus subsp. aureus MW2
uccagacuccuaaauuau

SEQ ID NO: 2103685 - RNA, 13 nt, Staphylococcus aureus subsp. aureus MW2
uccacagaauuag

SEQ ID NO: 2103686 - RNA, 14 nt, Staphylococcus aureus subsp. aureus MW2
uccacagcaauuca

SEQ ID NO: 2103687 - RNA, 22 nt, Staphylococcus aureus subsp. aureus MW2
uccacagcuuguucaauacuuu

SEQ ID NO: 2103688 - RNA, 17 nt, Staphylococcus aureus subsp. aureus MW2
uccacaucccaauuuaa

SEQ ID NO: 2103689 - RNA, 16 nt, Staphylococcus aureus subsp. aureus MW2
uccaccguuaaaauau

SEQ ID NO: 2103690 - RNA, 16 nt, Staphylococcus aureus subsp. aureus MW2
uccaagauuaugacaa

SEQ ID NO: 2103691 - RNA, 19 nt, Staphylococcus aureus subsp. aureus MW2
uccaagauuaugacaacau

SEQ ID NO: 2103692 - RNA, 16 nt, Staphylococcus aureus subsp. aureus MW2
uccaagcaaucuuagu

SEQ ID NO: 2103693 - RNA, 19 nt, Staphylococcus aureus subsp. aureus MW2
uccaaggauguuauaaaau

SEQ ID NO: 2103694 - RNA, 18 nt, Staphylococcus aureus subsp. aureus MW2
uccaaggauguuauaaaa

SEQ ID NO: 2103695 - RNA, 22 nt, Staphylococcus aureus subsp. aureus MW2
uccaagcgcuucaggcauaacu

SEQ ID NO: 2103696 - RNA, 20 nt, Staphylococcus aureus subsp. aureus MW2
uccaauuaaauauuuaaccu

SEQ ID NO: 2103697 - RNA, 21 nt, Staphylococcus aureus subsp. aureus MW2
uccaauuaccaaugaauaaau

SEQ ID NO: 2103698 - RNA, 15 nt, Staphylococcus aureus subsp. aureus MW2
uccaaugcauaaaac

SEQ ID NO: 2103699 - RNA, 22 nt, Staphylococcus aureus subsp. aureus MW2
uccaaucaucauuaaaucugau

SEQ ID NO: 2103700 - RNA, 16 nt, Staphylococcus aureus subsp. aureus MW2
uccaaucaucauuaaa

SEQ ID NO: 2103701 - RNA, 12 nt, Staphylococcus aureus subsp. aureus MW2
uccaauuuaaaa

SEQ ID NO: 2103702 - RNA, 14 nt, Staphylococcus aureus subsp. aureus MW2
uccaauuucucuau

SEQ ID NO: 2103703 - RNA, 13 nt, Staphylococcus aureus subsp. aureus MW2
uccacaauaagau

SEQ ID NO: 2103704 - RNA, 17 nt, Staphylococcus aureus subsp. aureus MW2
ucccauaacaaaaacau

SEQ ID NO: 2103705 - RNA, 21 nt, Staphylococcus aureus subsp. aureus MW2
ucccauaucgugcguuaaaua

SEQ ID NO: 2103706 - RNA, 23 nt, Staphylococcus aureus subsp. aureus MW2
ucccauuaacacgaacugcauag

SEQ ID NO: 2103707 - RNA, 22 nt, Staphylococcus aureus subsp. aureus MW2
ucccaucuuuuagguaauaauu

SEQ ID NO: 2103708 - RNA, 17 nt, Staphylococcus aureus subsp. aureus MW2
ucccauucuuugaggug

SEQ ID NO: 2103709 - RNA, 18 nt, Staphylococcus aureus subsp. aureus MW2
ucccauuugccuaaagua

SEQ ID NO: 2103710 - RNA, 17 nt, Staphylococcus aureus subsp. aureus MW2
uccccaacccggugcau

SEQ ID NO: 2103711 - RNA, 22 nt, Staphylococcus aureus subsp. aureus MW2
uccccaacccggugcauguugu

SEQ ID NO: 2103712 - RNA, 15 nt, Staphylococcus aureus subsp. aureus MW2
uccccaauuucucug

SEQ ID NO: 2103713 - RNA, 19 nt, Staphylococcus aureus subsp. aureus MW2
ucccauaaaagacagaaau

SEQ ID NO: 2103714 - RNA, 20 nt, Staphylococcus aureus subsp. aureus MW2
ucccauaaugacuauaacac

SEQ ID NO: 2103715 - RNA, 16 nt, Staphylococcus aureus subsp. aureus MW2
uccauggaauaaauuu

SEQ ID NO: 2103716 - RNA, 15 nt, Staphylococcus aureus subsp. aureus MW2
uccaucuacacccau

SEQ ID NO: 2103717 - RNA, 17 nt, Staphylococcus aureus subsp. aureus MW2
uccaucucauacuauac

SEQ ID NO: 2103718 - RNA, 19 nt, Staphylococcus aureus subsp. aureus MW2
uccaucucauacuauacaa

SEQ ID NO: 2103719 - RNA, 14 nt, Staphylococcus aureus subsp. aureus MW2
uccaugaauaaguc

SEQ ID NO: 2103720 - RNA, 21 nt, Staphylococcus aureus subsp. aureus MW2
uccauugaucuuuuauaauga

SEQ ID NO: 2103721 - RNA, 19 nt, Staphylococcus aureus subsp. aureus MW2
uccauucuuuuucaaaaua

SEQ ID NO: 2103722 - RNA, 13 nt, Staphylococcus aureus subsp. aureus MW2
uccauugcacuau

SEQ ID NO: 2103723 - RNA, 14 nt, Staphylococcus aureus subsp. aureus MW2
uccauuagaacuaa

SEQ ID NO: 2103724 - RNA, 15 nt, Staphylococcus aureus subsp. aureus MW2
uccauuuaucaacaa

SEQ ID NO: 2103725 - RNA, 19 nt, Staphylococcus aureus subsp. aureus MW2
uccauuuucuuuuuuuaug

SEQ ID NO: 2103726 - RNA, 14 nt, Staphylococcus aureus subsp. aureus MW2
ucccaacuuaauaa

SEQ ID NO: 2103727 - RNA, 20 nt, Staphylococcus aureus subsp. aureus MW2
ucccaacaacauaucauaga

SEQ ID NO: 2103728 - RNA, 14 nt, Staphylococcus aureus subsp. aureus MW2
ucccaaccaugcuu

SEQ ID NO: 2103729 - RNA, 21 nt, Staphylococcus aureus subsp. aureus MW2
ucccaaugcugaauaaauaac

SEQ ID NO: 2103730 - RNA, 17 nt, Staphylococcus aureus subsp. aureus MW2
ucccaaugcuugaauuu

SEQ ID NO: 2103731 - RNA, 21 nt, Staphylococcus aureus subsp. aureus MW2
ucccaaugcuugaauuuuauu

SEQ ID NO: 2103732 - RNA, 14 nt, Staphylococcus aureus subsp. aureus MW2
ucccaccccaacuu

SEQ ID NO: 2103733 - RNA, 15 nt, Staphylococcus aureus subsp. aureus MW2
ucccacgugccucau

SEQ ID NO: 2103734 - RNA, 21 nt, Staphylococcus aureus subsp. aureus MW2
ucccgaaaguuagacuaaaaa

SEQ ID NO: 2103735 - RNA, 12 nt, Staphylococcus aureus subsp. aureus MW2
ucccuaugaaau

SEQ ID NO: 2103736 - RNA, 16 nt, Staphylococcus aureus subsp. aureus MW2
ucccuaucauacauau

SEQ ID NO: 2103737 - RNA, 19 nt, Staphylococcus aureus subsp. aureus MW2
ucccuaucauacauauuua

SEQ ID NO: 2103738 - RNA, 16 nt, Staphylococcus aureus subsp. aureus MW2
ucccuacugcaccgau

SEQ ID NO: 2103739 - RNA, 14 nt, Staphylococcus aureus subsp. aureus MW2
ucccuggaaaauga

SEQ ID NO: 2103740 - RNA, 14 nt, Staphylococcus aureus subsp. aureus MW2
ucccuucaacauag

SEQ ID NO: 2103741 - RNA, 17 nt, Staphylococcus aureus subsp. aureus MW2
ucccuuaauaauaagua

SEQ ID NO: 2103742 - RNA, 12 nt, Staphylococcus aureus subsp. aureus MW2
ucccuuaauaau

SEQ ID NO: 2103743 - RNA, 11 nt, Staphylococcus aureus subsp. aureus MW2
ucccuuaauaa

SEQ ID NO: 2103744 - RNA, 17 nt, Staphylococcus aureus subsp. aureus MW2
ucccuuaaauacaauuu

SEQ ID NO: 2103745 - RNA, 19 nt, Staphylococcus aureus subsp. aureus MW2
ucccuucaacaguaauuuu

SEQ ID NO: 2103746 - RNA, 20 nt, Staphylococcus aureus subsp. aureus MW2
ucccuuuacuuuauaaauua

SEQ ID NO: 2103747 - RNA, 15 nt, Staphylococcus aureus subsp. aureus MW2
ucccuuuucaucaaa

SEQ ID NO: 2103748 - RNA, 14 nt, Staphylococcus aureus subsp. aureus MW2
ucccuuuuuaaaau

SEQ ID NO: 2103749 - RNA, 15 nt, Staphylococcus aureus subsp. aureus MW2
ucccuuuuuaaaaua

SEQ ID NO: 2103750 - RNA, 21 nt, Staphylococcus aureus subsp. aureus MW2
uccgaaaauugcuaaaaaaau

SEQ ID NO: 2103751 - RNA, 15 nt, Staphylococcus aureus subsp. aureus MW2
uccgauaucuuuuaa

SEQ ID NO: 2103752 - RNA, 13 nt, Staphylococcus aureus subsp. aureus MW2
uccgaucaugccu

SEQ ID NO: 2103753 - RNA, 16 nt, Staphylococcus aureus subsp. aureus MW2
uccgauuuaauauuga

SEQ ID NO: 2103754 - RNA, 13 nt, Staphylococcus aureus subsp. aureus MW2
ucgcuaauacuuu

SEQ ID NO: 2103755 - RNA, 17 nt, Staphylococcus aureus subsp. aureus MW2
ucgcucauccucauuaa

SEQ ID NO: 2103756 - RNA, 16 nt, Staphylococcus aureus subsp. aureus MW2
ucgcucacaugugaaa

SEQ ID NO: 2103757 - RNA, 14 nt, Staphylococcus aureus subsp. aureus MW2
ucgcucuagacauu

SEQ ID NO: 2103758 - RNA, 21 nt, Staphylococcus aureus subsp. aureus MW2
ucgcuugcaaagacucaauuu

SEQ ID NO: 2103759 - RNA, 10 nt, Staphylococcus aureus subsp. aureus MW2
ucggaaacau

SEQ ID NO: 2103760 - RNA, 21 nt, Staphylococcus aureus subsp. aureus MW2
ucggacugauagaaaaaguuu

SEQ ID NO: 2103761 - RNA, 17 nt, Staphylococcus aureus subsp. aureus MW2
ucgccuacuauaaauac

SEQ ID NO: 2103762 - RNA, 19 nt, Staphylococcus aureus subsp. aureus MW2
ucgccucaaaagcuguagu

SEQ ID NO: 2103763 - RNA, 14 nt, Staphylococcus aureus subsp. aureus MW2
ucgccuacuauaaa

SEQ ID NO: 2103764 - RNA, 18 nt, Staphylococcus aureus subsp. aureus MW2
ucgccuuuuuuauuuuuc

SEQ ID NO: 2103765 - RNA, 19 nt, Staphylococcus aureus subsp. aureus MW2
ucgccuuuuuuauuuuucu

SEQ ID NO: 2103766 - RNA, 23 nt, Staphylococcus aureus subsp. aureus MW2
ucgccuuuuuuauuuuucuuuuu

SEQ ID NO: 2103767 - RNA, 16 nt, Staphylococcus aureus subsp. aureus MW2
ucgcgcucuucuucag

SEQ ID NO: 2103768 - RNA, 15 nt, Staphylococcus aureus subsp. aureus MW2
ucgcgcaucaaaaau

SEQ ID NO: 2103769 - RNA, 20 nt, Staphylococcus aureus subsp. aureus MW2
ucgacuaauuuuucuuucag

SEQ ID NO: 2103770 - RNA, 22 nt, Staphylococcus aureus subsp. aureus MW2
ucgacuaauuuuucuuucaggc

SEQ ID NO: 2103771 - RNA, 12 nt, Staphylococcus aureus subsp. aureus MW2
ucgaauuaaccc

SEQ ID NO: 2103772 - RNA, 17 nt, Staphylococcus aureus subsp. aureus MW2
ucgaauuaaccccuuca

SEQ ID NO: 2103773 - RNA, 15 nt, Staphylococcus aureus subsp. aureus MW2
ucgaauucauuugca

SEQ ID NO: 2103774 - RNA, 17 nt, Staphylococcus aureus subsp. aureus MW2
uccuuaaacaaauaaau

SEQ ID NO: 2103775 - RNA, 19 nt, Staphylococcus aureus subsp. aureus MW2
ucgacaucuagaugaaauu

SEQ ID NO: 2103776 - RNA, 20 nt, Staphylococcus aureus subsp. aureus MW2
ucgacaucuagaugaaauug

SEQ ID NO: 2103777 - RNA, 16 nt, Staphylococcus aureus subsp. aureus MW2
ucgcaaauuuccacag

SEQ ID NO: 2103778 - RNA, 15 nt, Staphylococcus aureus subsp. aureus MW2
ucgauuaauuuaauu

SEQ ID NO: 2103779 - RNA, 16 nt, Staphylococcus aureus subsp. aureus MW2
ucgauuaauucuucuu

SEQ ID NO: 2103780 - RNA, 17 nt, Staphylococcus aureus subsp. aureus MW2
ucgauuaauucuucuuc

SEQ ID NO: 2103781 - RNA, 14 nt, Staphylococcus aureus subsp. aureus MW2
ucgauuauuuagau

SEQ ID NO: 2103782 - RNA, 13 nt, Staphylococcus aureus subsp. aureus MW2
ucgauuuuuuaau

SEQ ID NO: 2103783 - RNA, 14 nt, Staphylococcus aureus subsp. aureus MW2
ucgauuuuuuaaug

SEQ ID NO: 2103784 - RNA, 22 nt, Staphylococcus aureus subsp. aureus MW2
ucgauuuuuuaaugucuaaaaa

SEQ ID NO: 2103785 - RNA, 21 nt, Staphylococcus aureus subsp. aureus MW2
ucgauucuccuuuuguuucaa

SEQ ID NO: 2103786 - RNA, 13 nt, Staphylococcus aureus subsp. aureus MW2
ucgauaaguuuuu

SEQ ID NO: 2103787 - RNA, 23 nt, Staphylococcus aureus subsp. aureus MW2
ucgauaacguugccauacccaua

SEQ ID NO: 2103788 - RNA, 18 nt, Staphylococcus aureus subsp. aureus MW2
uccugauuuaauguuaaa

SEQ ID NO: 2103789 - RNA, 20 nt, Staphylococcus aureus subsp. aureus MW2
uccucuauuuuaugauuuga

SEQ ID NO: 2103790 - RNA, 16 nt, Staphylococcus aureus subsp. aureus MW2
uccucaacgggaacau

SEQ ID NO: 2103791 - RNA, 15 nt, Staphylococcus aureus subsp. aureus MW2
uccuaucuguaccgu

SEQ ID NO: 2103792 - RNA, 14 nt, Staphylococcus aureus subsp. aureus MW2
uccuauuaauauau

SEQ ID NO: 2103793 - RNA, 16 nt, Staphylococcus aureus subsp. aureus MW2
uccuauuacuacauaa

SEQ ID NO: 2103794 - RNA, 19 nt, Staphylococcus aureus subsp. aureus MW2
uccuauuacuacauaauuu

SEQ ID NO: 2103795 - RNA, 17 nt, Staphylococcus aureus subsp. aureus MW2
uccuauuacuacauaau

SEQ ID NO: 2103796 - RNA, 13 nt, Staphylococcus aureus subsp. aureus MW2
uccuacuuuucaa

SEQ ID NO: 2103797 - RNA, 18 nt, Staphylococcus aureus subsp. aureus MW2
uccuaggaaauacguggc

SEQ ID NO: 2103798 - RNA, 14 nt, Staphylococcus aureus subsp. aureus MW2
uccuaguucuaugu

SEQ ID NO: 2103799 - RNA, 16 nt, Staphylococcus aureus subsp. aureus MW2
uccucauuaauaaauu

SEQ ID NO: 2103800 - RNA, 19 nt, Staphylococcus aureus subsp. aureus MW2
uccucaguauuuaauguuu

SEQ ID NO: 2103801 - RNA, 21 nt, Staphylococcus aureus subsp. aureus MW2
uccuaaagguaacuuuuuaac

SEQ ID NO: 2103802 - RNA, 17 nt, Staphylococcus aureus subsp. aureus MW2
uccuaaguuaugacuaa

SEQ ID NO: 2103803 - RNA, 16 nt, Staphylococcus aureus subsp. aureus MW2
uccuaaauuauaaaua

SEQ ID NO: 2103804 - RNA, 15 nt, Staphylococcus aureus subsp. aureus MW2
uccuaauguaauuau

SEQ ID NO: 2103805 - RNA, 23 nt, Staphylococcus aureus subsp. aureus MW2
uccuacgacacguguaaaaauga

SEQ ID NO: 2103806 - RNA, 13 nt, Staphylococcus aureus subsp. aureus MW2
uccuacugcuguc

SEQ ID NO: 2103807 - RNA, 18 nt, Staphylococcus aureus subsp. aureus MW2
uccuagacucuaaaaugu

SEQ ID NO: 2103808 - RNA, 23 nt, Staphylococcus aureus subsp. aureus MW2
uccguugaauuaacaauauuaaa

SEQ ID NO: 2103809 - RNA, 16 nt, Staphylococcus aureus subsp. aureus MW2
uccguucgcaucuuug

SEQ ID NO: 2103810 - RNA, 22 nt, Staphylococcus aureus subsp. aureus MW2
uccgucuuuuuuuaugaaaaga

SEQ ID NO: 2103811 - RNA, 14 nt, Staphylococcus aureus subsp. aureus MW2
uccggcugaaggga

SEQ ID NO: 2103812 - RNA, 21 nt, Staphylococcus aureus subsp. aureus MW2
uccgcacugccuuuuuguaau

SEQ ID NO: 2103813 - RNA, 16 nt, Staphylococcus aureus subsp. aureus MW2
uccgcacugccuuuuu

SEQ ID NO: 2103814 - RNA, 21 nt, Staphylococcus aureus subsp. aureus MW2
uccgccagcuucuauguuggg

SEQ ID NO: 2103815 - RNA, 21 nt, Staphylococcus aureus subsp. aureus MW2
uccgccagcuucuuuguuggg

SEQ ID NO: 2103816 - RNA, 19 nt, Staphylococcus aureus subsp. aureus MW2
uccgccagucaucaucaug

SEQ ID NO: 2103817 - RNA, 17 nt, Staphylococcus aureus subsp. aureus MW2
uccgcuuguucaacuaa

SEQ ID NO: 2103818 - RNA, 16 nt, Staphylococcus aureus subsp. aureus MW2
uccgcuuuauuuuauc

SEQ ID NO: 2103819 - RNA, 17 nt, Staphylococcus aureus subsp. aureus MW2
ucucauagucaucuuag

SEQ ID NO: 2103820 - RNA, 11 nt, Staphylococcus aureus subsp. aureus MW2
ucuccaauacu

SEQ ID NO: 2103821 - RNA, 21 nt, Staphylococcus aureus subsp. aureus MW2
ucuccaauacuuuuuauauaa

SEQ ID NO: 2103822 - RNA, 21 nt, Staphylococcus aureus subsp. aureus MW2
ucucagcguauuuuaguacuu

SEQ ID NO: 2103823 - RNA, 19 nt, Staphylococcus aureus subsp. aureus MW2
ucuccauuagaacuaagau

SEQ ID NO: 2103824 - RNA, 14 nt, Staphylococcus aureus subsp. aureus MW2
ucuccauuauaaag

SEQ ID NO: 2103825 - RNA, 22 nt, Staphylococcus aureus subsp. aureus MW2
ucuccuaaagguaacuuuuuaa

SEQ ID NO: 2103826 - RNA, 15 nt, Staphylococcus aureus subsp. aureus MW2
ucucaccagcucguu

SEQ ID NO: 2103827 - RNA, 20 nt, Staphylococcus aureus subsp. aureus MW2
ucucaauccaauuaaauauu

SEQ ID NO: 2103828 - RNA, 14 nt, Staphylococcus aureus subsp. aureus MW2
ucucaaauauuaau

SEQ ID NO: 2103829 - RNA, 16 nt, Staphylococcus aureus subsp. aureus MW2
ucucacuuaauaaaua

SEQ ID NO: 2103830 - RNA, 19 nt, Staphylococcus aureus subsp. aureus MW2
ucuauuuuauaauaaauuu

SEQ ID NO: 2103831 - RNA, 17 nt, Staphylococcus aureus subsp. aureus MW2
ucuauuuuauaauaaau

SEQ ID NO: 2103832 - RNA, 19 nt, Staphylococcus aureus subsp. aureus MW2
ucuauuuuaugauuugauu

SEQ ID NO: 2103833 - RNA, 12 nt, Staphylococcus aureus subsp. aureus MW2
ucuauuuuauga

SEQ ID NO: 2103834 - RNA, 14 nt, Staphylococcus aureus subsp. aureus MW2
ucuauuuuacucuu

SEQ ID NO: 2103835 - RNA, 22 nt, Staphylococcus aureus subsp. aureus MW2
ucuauuuuacucuuuuuaauau

SEQ ID NO: 2103836 - RNA, 17 nt, Staphylococcus aureus subsp. aureus MW2
ucuauuuaaacaagaaa

SEQ ID NO: 2103837 - RNA, 14 nt, Staphylococcus aureus subsp. aureus MW2
ucuauuucuauaua

SEQ ID NO: 2103838 - RNA, 16 nt, Staphylococcus aureus subsp. aureus MW2
ucuauuucuauauaca

SEQ ID NO: 2103839 - RNA, 16 nt, Staphylococcus aureus subsp. aureus MW2
ucuauuuaauaaugua

SEQ ID NO: 2103840 - RNA, 13 nt, Staphylococcus aureus subsp. aureus MW2
ucuauuuaauaau

SEQ ID NO: 2103841 - RNA, 21 nt, Staphylococcus aureus subsp. aureus MW2
ucuauugugauauaugaaaua

SEQ ID NO: 2103842 - RNA, 22 nt, Staphylococcus aureus subsp. aureus MW2
ucuauuuugcuugcuuacaaua

SEQ ID NO: 2103843 - RNA, 22 nt, Staphylococcus aureus subsp. aureus MW2
ucucaaagguuuacuauuaaag

SEQ ID NO: 2103844 - RNA, 18 nt, Staphylococcus aureus subsp. aureus MW2
ucucaaauuaaaucaccu

SEQ ID NO: 2103845 - RNA, 21 nt, Staphylococcus aureus subsp. aureus MW2
ucucaacaaaucuauaaauau

SEQ ID NO: 2103846 - RNA, 14 nt, Staphylococcus aureus subsp. aureus MW2
ucuauuaauuuucu

SEQ ID NO: 2103847 - RNA, 14 nt, Staphylococcus aureus subsp. aureus MW2
ucuaugucaaauug

SEQ ID NO: 2103848 - RNA, 13 nt, Staphylococcus aureus subsp. aureus MW2
ucuauuaauaauu

SEQ ID NO: 2103849 - RNA, 16 nt, Staphylococcus aureus subsp. aureus MW2
ucuaugcuuuuauaga

SEQ ID NO: 2103850 - RNA, 13 nt, Staphylococcus aureus subsp. aureus MW2
ucuauguauaaua

SEQ ID NO: 2103851 - RNA, 16 nt, Staphylococcus aureus subsp. aureus MW2
ucuauuauuuuacuuu

SEQ ID NO: 2103852 - RNA, 17 nt, Staphylococcus aureus subsp. aureus MW2
ucuauucaaaugauuuu

SEQ ID NO: 2103853 - RNA, 16 nt, Staphylococcus aureus subsp. aureus MW2
ucuauucgaaaaaggu

SEQ ID NO: 2103854 - RNA, 21 nt, Staphylococcus aureus subsp. aureus MW2
ucuaucguuguguauuguuug

SEQ ID NO: 2103855 - RNA, 21 nt, Staphylococcus aureus subsp. aureus MW2
ucuaucuccgcuacaauuaua

SEQ ID NO: 2103856 - RNA, 15 nt, Staphylococcus aureus subsp. aureus MW2
ucuaucuauuuuacu

SEQ ID NO: 2103857 - RNA, 16 nt, Staphylococcus aureus subsp. aureus MW2
ucuaucuauuuuacuc

SEQ ID NO: 2103858 - RNA, 17 nt, Staphylococcus aureus subsp. aureus MW2
ucuaucgguaauuuuug

SEQ ID NO: 2103859 - RNA, 18 nt, Staphylococcus aureus subsp. aureus MW2
ucuauauuuaauuuugau

SEQ ID NO: 2103860 - RNA, 16 nt, Staphylococcus aureus subsp. aureus MW2
ucuauauuaauagaaa

SEQ ID NO: 2103861 - RNA, 15 nt, Staphylococcus aureus subsp. aureus MW2
ucuauauuuuauuag

SEQ ID NO: 2103862 - RNA, 16 nt, Staphylococcus aureus subsp. aureus MW2
ucuauauaaaaacugu

SEQ ID NO: 2103863 - RNA, 19 nt, Staphylococcus aureus subsp. aureus MW2
ucuauauaaauguuuauau

SEQ ID NO: 2103864 - RNA, 21 nt, Staphylococcus aureus subsp. aureus MW2
ucuauauaaaguugacaauac

SEQ ID NO: 2103865 - RNA, 19 nt, Staphylococcus aureus subsp. aureus MW2
ucuauacuuuuaauuguau

SEQ ID NO: 2103866 - RNA, 21 nt, Staphylococcus aureus subsp. aureus MW2
ucuauagcuagcaaucccauu

SEQ ID NO: 2103867 - RNA, 12 nt, Staphylococcus aureus subsp. aureus MW2
ucuauaugcaua

SEQ ID NO: 2103868 - RNA, 19 nt, Staphylococcus aureus subsp. aureus MW2
ucuauauguccuaggaaau

SEQ ID NO: 2103869 - RNA, 16 nt, Staphylococcus aureus subsp. aureus MW2
ucuauauaauuuauuu

SEQ ID NO: 2103870 - RNA, 19 nt, Staphylococcus aureus subsp. aureus MW2
ucuauauaguaaaauaaau

SEQ ID NO: 2103871 - RNA, 24 nt, Staphylococcus aureus subsp. aureus MW2
ucuagacuuauuugaaugcaaauc

SEQ ID NO: 2103872 - RNA, 15 nt, Staphylococcus aureus subsp. aureus MW2
ucuagauuucaaauc

SEQ ID NO: 2103873 - RNA, 13 nt, Staphylococcus aureus subsp. aureus MW2
ucuagaugaaauu

SEQ ID NO: 2103874 - RNA, 17 nt, Staphylococcus aureus subsp. aureus MW2
ucuagcugcuucugcug

SEQ ID NO: 2103875 - RNA, 17 nt, Staphylococcus aureus subsp. aureus MW2
ucuacuuaguaauaaga

SEQ ID NO: 2103876 - RNA, 19 nt, Staphylococcus aureus subsp. aureus MW2
ucuacuuaaaauaaguauu

SEQ ID NO: 2103877 - RNA, 19 nt, Staphylococcus aureus subsp. aureus MW2
ucuaguucgaacacacacu

SEQ ID NO: 2103878 - RNA, 22 nt, Staphylococcus aureus subsp. aureus MW2
ucuaguacaccucuaaguucac

SEQ ID NO: 2103879 - RNA, 12 nt, Staphylococcus aureus subsp. aureus MW2
ucuauaaauauc

SEQ ID NO: 2103880 - RNA, 14 nt, Staphylococcus aureus subsp. aureus MW2
ucuauaauauucaa

SEQ ID NO: 2103881 - RNA, 15 nt, Staphylococcus aureus subsp. aureus MW2
ucuauaauauucaau

SEQ ID NO: 2103882 - RNA, 22 nt, Staphylococcus aureus subsp. aureus MW2
ucuauaccauuccaaaaauugu

SEQ ID NO: 2103883 - RNA, 15 nt, Staphylococcus aureus subsp. aureus MW2
ucuauaauuugugug

SEQ ID NO: 2103884 - RNA, 23 nt, Staphylococcus aureus subsp. aureus MW2
ucuauaccauuccaaaaauugua

SEQ ID NO: 2103885 - RNA, 21 nt, Staphylococcus aureus subsp. aureus MW2
ucuacagcgucaccuaaugcu

SEQ ID NO: 2103886 - RNA, 18 nt, Staphylococcus aureus subsp. aureus MW2
ucuacagacaaugcaagu

SEQ ID NO: 2103887 - RNA, 22 nt, Staphylococcus aureus subsp. aureus MW2
ucuacagacaaugcaaguuggc

SEQ ID NO: 2103888 - RNA, 11 nt, Staphylococcus aureus subsp. aureus MW2
ucuacacccau

SEQ ID NO: 2103889 - RNA, 15 nt, Staphylococcus aureus subsp. aureus MW2
ucuacccuugcaaau

SEQ ID NO: 2103890 - RNA, 15 nt, Staphylococcus aureus subsp. aureus MW2
ucuaccgaaugaguu

SEQ ID NO: 2103891 - RNA, 22 nt, Staphylococcus aureus subsp. aureus MW2
ucuacccauaauuuaaaugaua

SEQ ID NO: 2103892 - RNA, 13 nt, Staphylococcus aureus subsp. aureus MW2
ucuaauauuuugg

SEQ ID NO: 2103893 - RNA, 22 nt, Staphylococcus aureus subsp. aureus MW2
ucuaauacuuucacuuuuuaua

SEQ ID NO: 2103894 - RNA, 18 nt, Staphylococcus aureus subsp. aureus MW2
ucuaauacuuucacuuuu

SEQ ID NO: 2103895 - RNA, 22 nt, Staphylococcus aureus subsp. aureus MW2
ucuaauagcuauauuuaaaauc

SEQ ID NO: 2103896 - RNA, 21 nt, Staphylococcus aureus subsp. aureus MW2
ucuaauacauacugauuaaac

SEQ ID NO: 2103897 - RNA, 12 nt, Staphylococcus aureus subsp. aureus MW2
ucuaaccaucuc

SEQ ID NO: 2103898 - RNA, 21 nt, Staphylococcus aureus subsp. aureus MW2
ucuaaucgacuuuuacaauca

SEQ ID NO: 2103899 - RNA, 17 nt, Staphylococcus aureus subsp. aureus MW2
ucuaaucuucacgcuua

SEQ ID NO: 2103900 - RNA, 21 nt, Staphylococcus aureus subsp. aureus MW2
ucuaauucaaugauuuuuaaa

SEQ ID NO: 2103901 - RNA, 19 nt, Staphylococcus aureus subsp. aureus MW2
ucuaaugcucauuaauggu

SEQ ID NO: 2103902 - RNA, 16 nt, Staphylococcus aureus subsp. aureus MW2
ucuaauuacauauacg

SEQ ID NO: 2103903 - RNA, 18 nt, Staphylococcus aureus subsp. aureus MW2
ucuacaauauuaaaauua

SEQ ID NO: 2103904 - RNA, 16 nt, Staphylococcus aureus subsp. aureus MW2
ucuacaauauuaaaau

SEQ ID NO: 2103905 - RNA, 15 nt, Staphylococcus aureus subsp. aureus MW2
ucuacaauugcgacc

SEQ ID NO: 2103906 - RNA, 15 nt, Staphylococcus aureus subsp. aureus MW2
ucuaauucuucuaau

SEQ ID NO: 2103907 - RNA, 16 nt, Staphylococcus aureus subsp. aureus MW2
ucuaaaacggaaauaa

SEQ ID NO: 2103908 - RNA, 16 nt, Staphylococcus aureus subsp. aureus MW2
ucuaaaacuuuuucaa

SEQ ID NO: 2103909 - RNA, 16 nt, Staphylococcus aureus subsp. aureus MW2
ucuaaacuauaauaau

SEQ ID NO: 2103910 - RNA, 13 nt, Staphylococcus aureus subsp. aureus MW2
ucuaaaauuaacc

SEQ ID NO: 2103911 - RNA, 16 nt, Staphylococcus aureus subsp. aureus MW2
ucuaaaauuaaccauu

SEQ ID NO: 2103912 - RNA, 18 nt, Staphylococcus aureus subsp. aureus MW2
ucuaaacuucuauuaaua

SEQ ID NO: 2103913 - RNA, 14 nt, Staphylococcus aureus subsp. aureus MW2
ucuaaagauuucag

SEQ ID NO: 2103914 - RNA, 18 nt, Staphylococcus aureus subsp. aureus MW2
ucuaaagcuauaaaaaau

SEQ ID NO: 2103915 - RNA, 16 nt, Staphylococcus aureus subsp. aureus MW2
ucuaaagcuuauuaaa

SEQ ID NO: 2103916 - RNA, 13 nt, Staphylococcus aureus subsp. aureus MW2
ucuaaauucuuuu

SEQ ID NO: 2103917 - RNA, 20 nt, Staphylococcus aureus subsp. aureus MW2
ucuaaauucuuuuuguucgg

SEQ ID NO: 2103918 - RNA, 16 nt, Staphylococcus aureus subsp. aureus MW2
ucuaacaucauuaacu

SEQ ID NO: 2103919 - RNA, 23 nt, Staphylococcus aureus subsp. aureus MW2
ucuaacagggaacccaggugcau

SEQ ID NO: 2103920 - RNA, 14 nt, Staphylococcus aureus subsp. aureus MW2
ucuaaccacuucuu

SEQ ID NO: 2103921 - RNA, 21 nt, Staphylococcus aureus subsp. aureus MW2
ucguuuugcuaaccaucauaa

SEQ ID NO: 2103922 - RNA, 16 nt, Staphylococcus aureus subsp. aureus MW2
ucguuuucaacauaau

SEQ ID NO: 2103923 - RNA, 19 nt, Staphylococcus aureus subsp. aureus MW2
ucguuuucaacauaauauu

SEQ ID NO: 2103924 - RNA, 20 nt, Staphylococcus aureus subsp. aureus MW2
ucguuuucaacauaauauuu

SEQ ID NO: 2103925 - RNA, 15 nt, Staphylococcus aureus subsp. aureus MW2
ucguuucuuuuauau

SEQ ID NO: 2103926 - RNA, 17 nt, Staphylococcus aureus subsp. aureus MW2
ucguuucuuuauuaaau

SEQ ID NO: 2103927 - RNA, 17 nt, Staphylococcus aureus subsp. aureus MW2
ucguguuugaauguuuu

SEQ ID NO: 2103928 - RNA, 18 nt, Staphylococcus aureus subsp. aureus MW2
ucguuaaaacacccugcu

SEQ ID NO: 2103929 - RNA, 14 nt, Staphylococcus aureus subsp. aureus MW2
ucguucuuugauua

SEQ ID NO: 2103930 - RNA, 13 nt, Staphylococcus aureus subsp. aureus MW2
ucgucaaaaacag

SEQ ID NO: 2103931 - RNA, 13 nt, Staphylococcus aureus subsp. aureus MW2
ucguauuuuuaag

SEQ ID NO: 2103932 - RNA, 13 nt, Staphylococcus aureus subsp. aureus MW2
ucguauuucauau

SEQ ID NO: 2103933 - RNA, 16 nt, Staphylococcus aureus subsp. aureus MW2
ucgucauauuaauauu

SEQ ID NO: 2103934 - RNA, 21 nt, Staphylococcus aureus subsp. aureus MW2
ucgucauauuaauauuuuuug

SEQ ID NO: 2103935 - RNA, 15 nt, Staphylococcus aureus subsp. aureus MW2
ucgguuuauuuaaua

SEQ ID NO: 2103936 - RNA, 16 nt, Staphylococcus aureus subsp. aureus MW2
ucgguucaucuaaaau

SEQ ID NO: 2103937 - RNA, 19 nt, Staphylococcus aureus subsp. aureus MW2
ucgugaaaagcaguuaaug

SEQ ID NO: 2103938 - RNA, 21 nt, Staphylococcus aureus subsp. aureus MW2
ucgucuuguaaacuucuuuuc

SEQ ID NO: 2103939 - RNA, 23 nt, Staphylococcus aureus subsp. aureus MW2
ucgucuucuuuuuguccccagcc

SEQ ID NO: 2103940 - RNA, 21 nt, Staphylococcus aureus subsp. aureus MW2
ucgucgauuucauuaauuuuu

SEQ ID NO: 2103941 - RNA, 18 nt, Staphylococcus aureus subsp. aureus MW2
ucguguacgcaaaaacuu

SEQ ID NO: 2103942 - RNA, 23 nt, Staphylococcus aureus subsp. aureus MW2
ucuuccuccgccaucaauauuua

SEQ ID NO: 2103943 - RNA, 13 nt, Staphylococcus aureus subsp. aureus MW2
ucuuccuaaauaa

SEQ ID NO: 2103944 - RNA, 15 nt, Staphylococcus aureus subsp. aureus MW2
ucuuccuaaauaauu

SEQ ID NO: 2103945 - RNA, 19 nt, Staphylococcus aureus subsp. aureus MW2
ucuucauguucuuauaaaa

SEQ ID NO: 2103946 - RNA, 18 nt, Staphylococcus aureus subsp. aureus MW2
ucuucaugucguuuucuu

SEQ ID NO: 2103947 - RNA, 19 nt, Staphylococcus aureus subsp. aureus MW2
ucuucaugucguuuucuua

SEQ ID NO: 2103948 - RNA, 20 nt, Staphylococcus aureus subsp. aureus MW2
ucuucaugucguuuucuuaa

SEQ ID NO: 2103949 - RNA, 17 nt, Staphylococcus aureus subsp. aureus MW2
ucuucauuaucaauaga

SEQ ID NO: 2103950 - RNA, 14 nt, Staphylococcus aureus subsp. aureus MW2
ucuucauuuucauu

SEQ ID NO: 2103951 - RNA, 16 nt, Staphylococcus aureus subsp. aureus MW2
ucuuaaguacauaaau

SEQ ID NO: 2103952 - RNA, 13 nt, Staphylococcus aureus subsp. aureus MW2
ucuuaaguacaua

SEQ ID NO: 2103953 - RNA, 19 nt, Staphylococcus aureus subsp. aureus MW2
ucuuaaucagcuauaaaag

SEQ ID NO: 2103954 - RNA, 17 nt, Staphylococcus aureus subsp. aureus MW2
ucuuaaaucaacaucau

SEQ ID NO: 2103955 - RNA, 17 nt, Staphylococcus aureus subsp. aureus MW2
ucuuaauugaauuaaau

SEQ ID NO: 2103956 - RNA, 13 nt, Staphylococcus aureus subsp. aureus MW2
ucuuaauuaucau

SEQ ID NO: 2103957 - RNA, 17 nt, Staphylococcus aureus subsp. aureus MW2
ucuuaaucuaaaaauag

SEQ ID NO: 2103958 - RNA, 17 nt, Staphylococcus aureus subsp. aureus MW2
ucuucaggugauucauu

SEQ ID NO: 2103959 - RNA, 16 nt, Staphylococcus aureus subsp. aureus MW2
ucuucagguguaguag

SEQ ID NO: 2103960 - RNA, 22 nt, Staphylococcus aureus subsp. aureus MW2
ucuucuauuaaacauuuuugau

SEQ ID NO: 2103961 - RNA, 17 nt, Staphylococcus aureus subsp. aureus MW2
ucuucuacauauacaaa

SEQ ID NO: 2103962 - RNA, 19 nt, Staphylococcus aureus subsp. aureus MW2
ucuugauuggcacagucaa

SEQ ID NO: 2103963 - RNA, 14 nt, Staphylococcus aureus subsp. aureus MW2
ucuugauuguaaau

SEQ ID NO: 2103964 - RNA, 22 nt, Staphylococcus aureus subsp. aureus MW2
ucuugucauuugaacaucauuu

SEQ ID NO: 2103965 - RNA, 22 nt, Staphylococcus aureus subsp. aureus MW2
ucuugcgccuuguucaauucag

SEQ ID NO: 2103966 - RNA, 17 nt, Staphylococcus aureus subsp. aureus MW2
ucuuuaaagucuuuaau

SEQ ID NO: 2103967 - RNA, 20 nt, Staphylococcus aureus subsp. aureus MW2
ucuuuaaacucguaaauuuu

SEQ ID NO: 2103968 - RNA, 20 nt, Staphylococcus aureus subsp. aureus MW2
ucuuuacgauaaacuaaaaa

SEQ ID NO: 2103969 - RNA, 21 nt, Staphylococcus aureus subsp. aureus MW2
ucuuuacgacguuuacguucu

SEQ ID NO: 2103970 - RNA, 14 nt, Staphylococcus aureus subsp. aureus MW2
ucuuuaccauucaa

SEQ ID NO: 2103971 - RNA, 22 nt, Staphylococcus aureus subsp. aureus MW2
ucuuuacuaaaccucaacauua

SEQ ID NO: 2103972 - RNA, 19 nt, Staphylococcus aureus subsp. aureus MW2
ucuuuacggucgaauuuuu

SEQ ID NO: 2103973 - RNA, 15 nt, Staphylococcus aureus subsp. aureus MW2
ucuuuauaaaauugu

SEQ ID NO: 2103974 - RNA, 13 nt, Staphylococcus aureus subsp. aureus MW2
ucuuuagcaaaac

SEQ ID NO: 2103975 - RNA, 16 nt, Staphylococcus aureus subsp. aureus MW2
ucuuuagcuauuuaaa

SEQ ID NO: 2103976 - RNA, 18 nt, Staphylococcus aureus subsp. aureus MW2
ucuuuagcuauuuaaaau

SEQ ID NO: 2103977 - RNA, 15 nt, Staphylococcus aureus subsp. aureus MW2
ucuugaugaauuaaa

SEQ ID NO: 2103978 - RNA, 13 nt, Staphylococcus aureus subsp. aureus MW2
ucuugauauucau

SEQ ID NO: 2103979 - RNA, 13 nt, Staphylococcus aureus subsp. aureus MW2
ucuugaguacuaa

SEQ ID NO: 2103980 - RNA, 19 nt, Staphylococcus aureus subsp. aureus MW2
ucuucuuuuuguccccagc

SEQ ID NO: 2103981 - RNA, 18 nt, Staphylococcus aureus subsp. aureus MW2
ucuugaaacacaaaaagg

SEQ ID NO: 2103982 - RNA, 13 nt, Staphylococcus aureus subsp. aureus MW2
ucuucuuuuaaua

SEQ ID NO: 2103983 - RNA, 19 nt, Staphylococcus aureus subsp. aureus MW2
ucuucuugauuguaaauaa

SEQ ID NO: 2103984 - RNA, 13 nt, Staphylococcus aureus subsp. aureus MW2
ucuucuucuucag

SEQ ID NO: 2103985 - RNA, 16 nt, Staphylococcus aureus subsp. aureus MW2
ucuucugcuaacucug

SEQ ID NO: 2103986 - RNA, 13 nt, Staphylococcus aureus subsp. aureus MW2
ucugaauuuaaua

SEQ ID NO: 2103987 - RNA, 13 nt, Staphylococcus aureus subsp. aureus MW2
ucugaauuuagga

SEQ ID NO: 2103988 - RNA, 20 nt, Staphylococcus aureus subsp. aureus MW2
ucugaauuuaggaaugaaua

SEQ ID NO: 2103989 - RNA, 21 nt, Staphylococcus aureus subsp. aureus MW2
ucugauacaucaucgccagca

SEQ ID NO: 2103990 - RNA, 14 nt, Staphylococcus aureus subsp. aureus MW2
ucugauguuuuaua

SEQ ID NO: 2103991 - RNA, 19 nt, Staphylococcus aureus subsp. aureus MW2
ucucgcauacugucaucuu

SEQ ID NO: 2103992 - RNA, 16 nt, Staphylococcus aureus subsp. aureus MW2
ucuccuuuuguuucaa

SEQ ID NO: 2103993 - RNA, 18 nt, Staphylococcus aureus subsp. aureus MW2
ucugaaacuuuaauacua

SEQ ID NO: 2103994 - RNA, 20 nt, Staphylococcus aureus subsp. aureus MW2
ucucgcuaaauuuauauagu

SEQ ID NO: 2103995 - RNA, 19 nt, Staphylococcus aureus subsp. aureus MW2
ucugaaaugauacauuauu

SEQ ID NO: 2103996 - RNA, 23 nt, Staphylococcus aureus subsp. aureus MW2
ucugauuucacuucuaaaacuaa

SEQ ID NO: 2103997 - RNA, 22 nt, Staphylococcus aureus subsp. aureus MW2
ucugauuucacuucuaaaacua

SEQ ID NO: 2103998 - RNA, 18 nt, Staphylococcus aureus subsp. aureus MW2
ucugauuucacuucuaaa

SEQ ID NO: 2103999 - RNA, 23 nt, Staphylococcus aureus subsp. aureus MW2
ucugcaugguuugcugguugcuu

SEQ ID NO: 2104000 - RNA, 15 nt, Staphylococcus aureus subsp. aureus MW2
ucuguuucaaagcug

SEQ ID NO: 2104001 - RNA, 20 nt, Staphylococcus aureus subsp. aureus MW2
ucuguugaagucaauaauuu

SEQ ID NO: 2104002 - RNA, 19 nt, Staphylococcus aureus subsp. aureus MW2
ucuguuccucaauaggaau

SEQ ID NO: 2104003 - RNA, 14 nt, Staphylococcus aureus subsp. aureus MW2
ucuuaacaauauca

SEQ ID NO: 2104004 - RNA, 17 nt, Staphylococcus aureus subsp. aureus MW2
ucuuaacaauaucaucu

SEQ ID NO: 2104005 - RNA, 18 nt, Staphylococcus aureus subsp. aureus MW2
ucuuaacaauuuuaauuu

SEQ ID NO: 2104006 - RNA, 16 nt, Staphylococcus aureus subsp. aureus MW2
ucuuaacaacaugauu

SEQ ID NO: 2104007 - RNA, 22 nt, Staphylococcus aureus subsp. aureus MW2
ucuuaaaucacuagcuaaugca

SEQ ID NO: 2104008 - RNA, 23 nt, Staphylococcus aureus subsp. aureus MW2
ucuguaucgauucgauuauuuag

SEQ ID NO: 2104009 - RNA, 14 nt, Staphylococcus aureus subsp. aureus MW2
ucuguauauccauu

SEQ ID NO: 2104010 - RNA, 16 nt, Staphylococcus aureus subsp. aureus MW2
ucuguauuauuauaau

SEQ ID NO: 2104011 - RNA, 18 nt, Staphylococcus aureus subsp. aureus MW2
ucuguauuauuauaauuu

SEQ ID NO: 2104012 - RNA, 20 nt, Staphylococcus aureus subsp. aureus MW2
ucuguacguuuuaaauaaau

SEQ ID NO: 2104013 - RNA, 16 nt, Staphylococcus aureus subsp. aureus MW2
ucuguacguuuuaaau

SEQ ID NO: 2104014 - RNA, 19 nt, Staphylococcus aureus subsp. aureus MW2
ucuguacguuuuaaauaaa

SEQ ID NO: 2104015 - RNA, 12 nt, Staphylococcus aureus subsp. aureus MW2
ucuguacuucua

SEQ ID NO: 2104016 - RNA, 15 nt, Staphylococcus aureus subsp. aureus MW2
ucuguagaaauuggc

SEQ ID NO: 2104017 - RNA, 15 nt, Staphylococcus aureus subsp. aureus MW2
ucuggcaaauugccu

SEQ ID NO: 2104018 - RNA, 14 nt, Staphylococcus aureus subsp. aureus MW2
ucugguaaaaaaau

SEQ ID NO: 2104019 - RNA, 14 nt, Staphylococcus aureus subsp. aureus MW2
uggcuuuuuuaauu

SEQ ID NO: 2104020 - RNA, 21 nt, Staphylococcus aureus subsp. aureus MW2
uggcuuuuuaauuguuuaaua

SEQ ID NO: 2104021 - RNA, 14 nt, Staphylococcus aureus subsp. aureus MW2
uggcuuuuuuauuu

SEQ ID NO: 2104022 - RNA, 21 nt, Staphylococcus aureus subsp. aureus MW2
uggcuuuuuauaccaauaauu

SEQ ID NO: 2104023 - RNA, 13 nt, Staphylococcus aureus subsp. aureus MW2
uggcuuuuuuaau

SEQ ID NO: 2104024 - RNA, 16 nt, Staphylococcus aureus subsp. aureus MW2
ugggauaauuuguauu

SEQ ID NO: 2104025 - RNA, 17 nt, Staphylococcus aureus subsp. aureus MW2
ugggauaauuuguauua

SEQ ID NO: 2104026 - RNA, 19 nt, Staphylococcus aureus subsp. aureus MW2
uggcuuuuuuuauggugug

SEQ ID NO: 2104027 - RNA, 21 nt, Staphylococcus aureus subsp. aureus MW2
ugggcauuacagguagaugua

SEQ ID NO: 2104028 - RNA, 20 nt, Staphylococcus aureus subsp. aureus MW2
ugggauuuuuucguuuuaau

SEQ ID NO: 2104029 - RNA, 12 nt, Staphylococcus aureus subsp. aureus MW2
ugggcugacauu

SEQ ID NO: 2104030 - RNA, 14 nt, Staphylococcus aureus subsp. aureus MW2
ugggcguucugcua

SEQ ID NO: 2104031 - RNA, 12 nt, Staphylococcus aureus subsp. aureus MW2
uggguaaucuuu

SEQ ID NO: 2104032 - RNA, 20 nt, Staphylococcus aureus subsp. aureus MW2
uggguaaggugauugaacaa

SEQ ID NO: 2104033 - RNA, 12 nt, Staphylococcus aureus subsp. aureus MW2
ugggucuuuauc

SEQ ID NO: 2104034 - RNA, 18 nt, Staphylococcus aureus subsp. aureus MW2
uggucuaaagcuuauuaa

SEQ ID NO: 2104035 - RNA, 20 nt, Staphylococcus aureus subsp. aureus MW2
uggugacacugcuuuuaaau

SEQ ID NO: 2104036 - RNA, 24 nt, Staphylococcus aureus subsp. aureus MW2
uggugaguguuucauaaucucuuu

SEQ ID NO: 2104037 - RNA, 15 nt, Staphylococcus aureus subsp. aureus MW2
ugguggaugucaugu

SEQ ID NO: 2104038 - RNA, 22 nt, Staphylococcus aureus subsp. aureus MW2
ugguggagaaccauauuuacac

SEQ ID NO: 2104039 - RNA, 20 nt, Staphylococcus aureus subsp. aureus MW2
uggugugccggcuuuuucuu

SEQ ID NO: 2104040 - RNA, 12 nt, Staphylococcus aureus subsp. aureus MW2
ugguauaacaau

SEQ ID NO: 2104041 - RNA, 15 nt, Staphylococcus aureus subsp. aureus MW2
ugguauaacaauuuu

SEQ ID NO: 2104042 - RNA, 19 nt, Staphylococcus aureus subsp. aureus MW2
ugguauaacaauuuuagac

SEQ ID NO: 2104043 - RNA, 17 nt, Staphylococcus aureus subsp. aureus MW2
ugguauaucgaaaggua

SEQ ID NO: 2104044 - RNA, 13 nt, Staphylococcus aureus subsp. aureus MW2
ugguauuauucuu

SEQ ID NO: 2104045 - RNA, 18 nt, Staphylococcus aureus subsp. aureus MW2
uggucacuaaugcauaau

SEQ ID NO: 2104046 - RNA, 18 nt, Staphylococcus aureus subsp. aureus MW2
ugguaugacugcaaauac

SEQ ID NO: 2104047 - RNA, 17 nt, Staphylococcus aureus subsp. aureus MW2
ugguauucgcaucauuc

SEQ ID NO: 2104048 - RNA, 17 nt, Staphylococcus aureus subsp. aureus MW2
ugguaaaucaugacaua

SEQ ID NO: 2104049 - RNA, 23 nt, Staphylococcus aureus subsp. aureus MW2
ugguacauaaagcuuugacauau

SEQ ID NO: 2104050 - RNA, 15 nt, Staphylococcus aureus subsp. aureus MW2
ugguaaaaaguuuaa

SEQ ID NO: 2104051 - RNA, 20 nt, Staphylococcus aureus subsp. aureus MW2
uggguguuuuuuuuauuaau

SEQ ID NO: 2104052 - RNA, 20 nt, Staphylococcus aureus subsp. aureus MW2
uguauuuuagcgucauuuuu

SEQ ID NO: 2104053 - RNA, 23 nt, Staphylococcus aureus subsp. aureus MW2
ugucacauguaccacauuuuccu

SEQ ID NO: 2104054 - RNA, 12 nt, Staphylococcus aureus subsp. aureus MW2
ugucacaggcug

SEQ ID NO: 2104055 - RNA, 12 nt, Staphylococcus aureus subsp. aureus MW2
uguauuuuucau

SEQ ID NO: 2104056 - RNA, 18 nt, Staphylococcus aureus subsp. aureus MW2
uguauuuuucauauugcu

SEQ ID NO: 2104057 - RNA, 13 nt, Staphylococcus aureus subsp. aureus MW2
uguauuuuucuua

SEQ ID NO: 2104058 - RNA, 21 nt, Staphylococcus aureus subsp. aureus MW2
uguauuuuucuuaauuaucau

SEQ ID NO: 2104059 - RNA, 21 nt, Staphylococcus aureus subsp. aureus MW2
uguaugggauaauuuguauua

SEQ ID NO: 2104060 - RNA, 14 nt, Staphylococcus aureus subsp. aureus MW2
uguauggcauaacc

SEQ ID NO: 2104061 - RNA, 13 nt, Staphylococcus aureus subsp. aureus MW2
uguaucucuuauu

SEQ ID NO: 2104062 - RNA, 15 nt, Staphylococcus aureus subsp. aureus MW2
uguaucucuuauuuu

SEQ ID NO: 2104063 - RNA, 21 nt, Staphylococcus aureus subsp. aureus MW2
uguauguaagcagacuaaaag

SEQ ID NO: 2104064 - RNA, 17 nt, Staphylococcus aureus subsp. aureus MW2
uguauuaaucaaauauu

SEQ ID NO: 2104065 - RNA, 19 nt, Staphylococcus aureus subsp. aureus MW2
uguauuaaucaaauauuuu

SEQ ID NO: 2104066 - RNA, 12 nt, Staphylococcus aureus subsp. aureus MW2
uguauuuauuac

SEQ ID NO: 2104067 - RNA, 21 nt, Staphylococcus aureus subsp. aureus MW2
uguauucaacugcguuaugaa

SEQ ID NO: 2104068 - RNA, 20 nt, Staphylococcus aureus subsp. aureus MW2
uguauauggcgauaacaaga

SEQ ID NO: 2104069 - RNA, 18 nt, Staphylococcus aureus subsp. aureus MW2
uguauaauacaugauaua

SEQ ID NO: 2104070 - RNA, 14 nt, Staphylococcus aureus subsp. aureus MW2
uguauacaaggcau

SEQ ID NO: 2104071 - RNA, 17 nt, Staphylococcus aureus subsp. aureus MW2
uguauaccuauuccuau

SEQ ID NO: 2104072 - RNA, 20 nt, Staphylococcus aureus subsp. aureus MW2
uguauagcuggcuuuuuaau

SEQ ID NO: 2104073 - RNA, 17 nt, Staphylococcus aureus subsp. aureus MW2
uguauagauuguauuua

SEQ ID NO: 2104074 - RNA, 22 nt, Staphylococcus aureus subsp. aureus MW2
uguauauccauucuuuuucaaa

SEQ ID NO: 2104075 - RNA, 22 nt, Staphylococcus aureus subsp. aureus MW2
uguagacaauuguaguaaugaa

SEQ ID NO: 2104076 - RNA, 12 nt, Staphylococcus aureus subsp. aureus MW2
uguagagaugug

SEQ ID NO: 2104077 - RNA, 22 nt, Staphylococcus aureus subsp. aureus MW2
uguagauggacaguuuuuauau

SEQ ID NO: 2104078 - RNA, 21 nt, Staphylococcus aureus subsp. aureus MW2
uguagcaggcaacuuuuauua

SEQ ID NO: 2104079 - RNA, 12 nt, Staphylococcus aureus subsp. aureus MW2
uguagcuccuaa

SEQ ID NO: 2104080 - RNA, 17 nt, Staphylococcus aureus subsp. aureus MW2
uguagggggcauuauua

SEQ ID NO: 2104081 - RNA, 16 nt, Staphylococcus aureus subsp. aureus MW2
uguaguacuauaguca

SEQ ID NO: 2104082 - RNA, 20 nt, Staphylococcus aureus subsp. aureus MW2
uguauaaagggcuauuugau

SEQ ID NO: 2104083 - RNA, 16 nt, Staphylococcus aureus subsp. aureus MW2
uguauaaaacagaauu

SEQ ID NO: 2104084 - RNA, 14 nt, Staphylococcus aureus subsp. aureus MW2
uguauaaaaaugua

SEQ ID NO: 2104085 - RNA, 17 nt, Staphylococcus aureus subsp. aureus MW2
uguauaaaaauguauua

SEQ ID NO: 2104086 - RNA, 21 nt, Staphylococcus aureus subsp. aureus MW2
uguauaaaagauauaaacauu

SEQ ID NO: 2104087 - RNA, 20 nt, Staphylococcus aureus subsp. aureus MW2
uguauaaaaaccaguuugau

SEQ ID NO: 2104088 - RNA, 22 nt, Staphylococcus aureus subsp. aureus MW2
uguauaaaaaccaguuugauua

SEQ ID NO: 2104089 - RNA, 18 nt, Staphylococcus aureus subsp. aureus MW2
uguaguuaagauaccuuu

SEQ ID NO: 2104090 - RNA, 18 nt, Staphylococcus aureus subsp. aureus MW2
uguaaacuucuuuucuuu

SEQ ID NO: 2104091 - RNA, 11 nt, Staphylococcus aureus subsp. aureus MW2
uguaaagacac

SEQ ID NO: 2104092 - RNA, 20 nt, Staphylococcus aureus subsp. aureus MW2
uguaaaaugcucccuucaaa

SEQ ID NO: 2104093 - RNA, 21 nt, Staphylococcus aureus subsp. aureus MW2
uguaaaaugugccuuuuguua

SEQ ID NO: 2104094 - RNA, 18 nt, Staphylococcus aureus subsp. aureus MW2
uguaaacaguauguagcu

SEQ ID NO: 2104095 - RNA, 23 nt, Staphylococcus aureus subsp. aureus MW2
uguaaaaugaugauuuaaagcaa

SEQ ID NO: 2104096 - RNA, 17 nt, Staphylococcus aureus subsp. aureus MW2
uguaaaacugaaguaaa

SEQ ID NO: 2104097 - RNA, 13 nt, Staphylococcus aureus subsp. aureus MW2
ugguuaucuuauc

SEQ ID NO: 2104098 - RNA, 13 nt, Staphylococcus aureus subsp. aureus MW2
ugguucaaauauc

SEQ ID NO: 2104099 - RNA, 15 nt, Staphylococcus aureus subsp. aureus MW2
ugguucaaauaucau

SEQ ID NO: 2104100 - RNA, 12 nt, Staphylococcus aureus subsp. aureus MW2
ugguuauuuccg

SEQ ID NO: 2104101 - RNA, 21 nt, Staphylococcus aureus subsp. aureus MW2
ugguuauuuccguuuuagaau

SEQ ID NO: 2104102 - RNA, 14 nt, Staphylococcus aureus subsp. aureus MW2
ugguuaucuaaaau

SEQ ID NO: 2104103 - RNA, 22 nt, Staphylococcus aureus subsp. aureus MW2
uguaaaacauucccuuaauaau

SEQ ID NO: 2104104 - RNA, 16 nt, Staphylococcus aureus subsp. aureus MW2
ugguucaucaaacaac

SEQ ID NO: 2104105 - RNA, 20 nt, Staphylococcus aureus subsp. aureus MW2
uguaaagcuuuaguuaaaua

SEQ ID NO: 2104106 - RNA, 17 nt, Staphylococcus aureus subsp. aureus MW2
uguaaagccaccuaaau

SEQ ID NO: 2104107 - RNA, 19 nt, Staphylococcus aureus subsp. aureus MW2
uguaaauauaguaauaaaa

SEQ ID NO: 2104108 - RNA, 17 nt, Staphylococcus aureus subsp. aureus MW2
uguaaaucacgauuuuc

SEQ ID NO: 2104109 - RNA, 21 nt, Staphylococcus aureus subsp. aureus MW2
uguaaauaaaaauuauauaaa

SEQ ID NO: 2104110 - RNA, 18 nt, Staphylococcus aureus subsp. aureus MW2
uguaauaaagaauaaaca

SEQ ID NO: 2104111 - RNA, 18 nt, Staphylococcus aureus subsp. aureus MW2
uguaacucaauaugaaac

SEQ ID NO: 2104112 - RNA, 13 nt, Staphylococcus aureus subsp. aureus MW2
uguaacguucuua

SEQ ID NO: 2104113 - RNA, 15 nt, Staphylococcus aureus subsp. aureus MW2
uguaacguucuuaua

SEQ ID NO: 2104114 - RNA, 11 nt, Staphylococcus aureus subsp. aureus MW2
uguaaaugaaa

SEQ ID NO: 2104115 - RNA, 14 nt, Staphylococcus aureus subsp. aureus MW2
uguaaccaccugau

SEQ ID NO: 2104116 - RNA, 20 nt, Staphylococcus aureus subsp. aureus MW2
uguaauuuaaauuacaauua

SEQ ID NO: 2104117 - RNA, 19 nt, Staphylococcus aureus subsp. aureus MW2
uguaauauauuaauauuga

SEQ ID NO: 2104118 - RNA, 22 nt, Staphylococcus aureus subsp. aureus MW2
uguaauaauaucaccuuuuuua

SEQ ID NO: 2104119 - RNA, 16 nt, Staphylococcus aureus subsp. aureus MW2
uguaauaauaaucuuu

SEQ ID NO: 2104120 - RNA, 21 nt, Staphylococcus aureus subsp. aureus MW2
uguaauaccaauuuuuagcau

SEQ ID NO: 2104121 - RNA, 19 nt, Staphylococcus aureus subsp. aureus MW2
uguaauacaugacauucau

SEQ ID NO: 2104122 - RNA, 15 nt, Staphylococcus aureus subsp. aureus MW2
uguaauacaucuaau

SEQ ID NO: 2104123 - RNA, 16 nt, Staphylococcus aureus subsp. aureus MW2
uguacaauuuuuaaaa

SEQ ID NO: 2104124 - RNA, 14 nt, Staphylococcus aureus subsp. aureus MW2
uguacaauuuuuaa

SEQ ID NO: 2104125 - RNA, 18 nt, Staphylococcus aureus subsp. aureus MW2
uguacaauuuuuaaaaac

SEQ ID NO: 2104126 - RNA, 14 nt, Staphylococcus aureus subsp. aureus MW2
uguaccaaauuuau

SEQ ID NO: 2104127 - RNA, 17 nt, Staphylococcus aureus subsp. aureus MW2
uguacauuguaaauaua

SEQ ID NO: 2104128 - RNA, 16 nt, Staphylococcus aureus subsp. aureus MW2
uguacauugguuuuua

SEQ ID NO: 2104129 - RNA, 19 nt, Staphylococcus aureus subsp. aureus MW2
uguacauugguuuuuacua

SEQ ID NO: 2104130 - RNA, 19 nt, Staphylococcus aureus subsp. aureus MW2
uguaccaauugauuuugcu

SEQ ID NO: 2104131 - RNA, 13 nt, Staphylococcus aureus subsp. aureus MW2
uguagaaaacaug

SEQ ID NO: 2104132 - RNA, 15 nt, Staphylococcus aureus subsp. aureus MW2
uguacuucuuugguc

SEQ ID NO: 2104133 - RNA, 22 nt, Staphylococcus aureus subsp. aureus MW2
uguacuuaaaccuaacauaacu

SEQ ID NO: 2104134 - RNA, 19 nt, Staphylococcus aureus subsp. aureus MW2
uguacuuaaaccuaacaua

SEQ ID NO: 2104135 - RNA, 20 nt, Staphylococcus aureus subsp. aureus MW2
uguacuuaaaccuaacauaa

SEQ ID NO: 2104136 - RNA, 16 nt, Staphylococcus aureus subsp. aureus MW2
uguacguuuuuuuaaa

SEQ ID NO: 2104137 - RNA, 15 nt, Staphylococcus aureus subsp. aureus MW2
uguacguuuuuuuaa

SEQ ID NO: 2104138 - RNA, 16 nt, Staphylococcus aureus subsp. aureus MW2
uguacuacuugauucu

SEQ ID NO: 2104139 - RNA, 16 nt, Staphylococcus aureus subsp. aureus MW2
uguaccguauuuuaau

SEQ ID NO: 2104140 - RNA, 21 nt, Staphylococcus aureus subsp. aureus MW2
uguaccaucacuaaaguaaau

SEQ ID NO: 2104141 - RNA, 23 nt, Staphylococcus aureus subsp. aureus MW2
uguacgaccagucgcauauuuug

SEQ ID NO: 2104142 - RNA, 22 nt, Staphylococcus aureus subsp. aureus MW2
uguaccuuuuuauugauauuaa

SEQ ID NO: 2104143 - RNA, 23 nt, Staphylococcus aureus subsp. aureus MW2
uggccaaacaaccugugauaaaa

SEQ ID NO: 2104144 - RNA, 21 nt, Staphylococcus aureus subsp. aureus MW2
uggcgacauuuguaaauauuu

SEQ ID NO: 2104145 - RNA, 18 nt, Staphylococcus aureus subsp. aureus MW2
uggccuacuuuuucaaua

SEQ ID NO: 2104146 - RNA, 13 nt, Staphylococcus aureus subsp. aureus MW2
uggccuuuuaaac

SEQ ID NO: 2104147 - RNA, 14 nt, Staphylococcus aureus subsp. aureus MW2
uggccuuuuaaaca

SEQ ID NO: 2104148 - RNA, 19 nt, Staphylococcus aureus subsp. aureus MW2
uggagccucuuguucuccg

SEQ ID NO: 2104149 - RNA, 17 nt, Staphylococcus aureus subsp. aureus MW2
uggacuucuaucuucac

SEQ ID NO: 2104150 - RNA, 19 nt, Staphylococcus aureus subsp. aureus MW2
uggacuccaucgcaacuga

SEQ ID NO: 2104151 - RNA, 17 nt, Staphylococcus aureus subsp. aureus MW2
uggacuaacgucauuau

SEQ ID NO: 2104152 - RNA, 22 nt, Staphylococcus aureus subsp. aureus MW2
uggacuaauaauuguccaugcc

SEQ ID NO: 2104153 - RNA, 19 nt, Staphylococcus aureus subsp. aureus MW2
uggacgcggguucaaaucc

SEQ ID NO: 2104154 - RNA, 21 nt, Staphylococcus aureus subsp. aureus MW2
uggauaugcguauauguauaa

SEQ ID NO: 2104155 - RNA, 16 nt, Staphylococcus aureus subsp. aureus MW2
uggauaauugcauuac

SEQ ID NO: 2104156 - RNA, 13 nt, Staphylococcus aureus subsp. aureus MW2
uggauaauugcau

SEQ ID NO: 2104157 - RNA, 14 nt, Staphylococcus aureus subsp. aureus MW2
uggauaauccuuuu

SEQ ID NO: 2104158 - RNA, 15 nt, Staphylococcus aureus subsp. aureus MW2
uggauaauccuuuuu

SEQ ID NO: 2104159 - RNA, 17 nt, Staphylococcus aureus subsp. aureus MW2
uggauaauccuuuuuua

SEQ ID NO: 2104160 - RNA, 13 nt, Staphylococcus aureus subsp. aureus MW2
uggaucuguuaca

SEQ ID NO: 2104161 - RNA, 16 nt, Staphylococcus aureus subsp. aureus MW2
uggcauaaccuguaau

SEQ ID NO: 2104162 - RNA, 23 nt, Staphylococcus aureus subsp. aureus MW2
uggcauaaccuguuuuuauuugu

SEQ ID NO: 2104163 - RNA, 11 nt, Staphylococcus aureus subsp. aureus MW2
uggcaccagua

SEQ ID NO: 2104164 - RNA, 16 nt, Staphylococcus aureus subsp. aureus MW2
uggcaccacauacaua

SEQ ID NO: 2104165 - RNA, 21 nt, Staphylococcus aureus subsp. aureus MW2
uggcaccgccaaaccacucau

SEQ ID NO: 2104166 - RNA, 15 nt, Staphylococcus aureus subsp. aureus MW2
uggcacugcaaucag

SEQ ID NO: 2104167 - RNA, 14 nt, Staphylococcus aureus subsp. aureus MW2
uggcaaauaugagu

SEQ ID NO: 2104168 - RNA, 20 nt, Staphylococcus aureus subsp. aureus MW2
uggcaacuaaaauuuguaau

SEQ ID NO: 2104169 - RNA, 21 nt, Staphylococcus aureus subsp. aureus MW2
uggauuuuaacaagauaacua

SEQ ID NO: 2104170 - RNA, 16 nt, Staphylococcus aureus subsp. aureus MW2
uggauuucuuuuuaaa

SEQ ID NO: 2104171 - RNA, 15 nt, Staphylococcus aureus subsp. aureus MW2
uggauuuuaauuauu

SEQ ID NO: 2104172 - RNA, 14 nt, Staphylococcus aureus subsp. aureus MW2
uggauuuuuuggau

SEQ ID NO: 2104173 - RNA, 17 nt, Staphylococcus aureus subsp. aureus MW2
uggauucaaaugacauu

SEQ ID NO: 2104174 - RNA, 15 nt, Staphylococcus aureus subsp. aureus MW2
uggauuccaucucau

SEQ ID NO: 2104175 - RNA, 19 nt, Staphylococcus aureus subsp. aureus MW2
uggauuccaucucauacua

SEQ ID NO: 2104176 - RNA, 13 nt, Staphylococcus aureus subsp. aureus MW2
uggauuuauuggg

SEQ ID NO: 2104177 - RNA, 18 nt, Staphylococcus aureus subsp. aureus MW2
uguuugaauguuuuugau

SEQ ID NO: 2104178 - RNA, 19 nt, Staphylococcus aureus subsp. aureus MW2
uguuugagauauauuaaua

SEQ ID NO: 2104179 - RNA, 22 nt, Staphylococcus aureus subsp. aureus MW2
uguuugagauauauuaauauuu

SEQ ID NO: 2104180 - RNA, 16 nt, Staphylococcus aureus subsp. aureus MW2
uguuugaagaccuucu

SEQ ID NO: 2104181 - RNA, 20 nt, Staphylococcus aureus subsp. aureus MW2
uguuugaagugaaaaauuuc

SEQ ID NO: 2104182 - RNA, 22 nt, Staphylococcus aureus subsp. aureus MW2
uguuugaagugaaaaauuucuc

SEQ ID NO: 2104183 - RNA, 13 nt, Staphylococcus aureus subsp. aureus MW2
uguuuggcauaau

SEQ ID NO: 2104184 - RNA, 15 nt, Staphylococcus aureus subsp. aureus MW2
uguuuggaugaacaa

SEQ ID NO: 2104185 - RNA, 16 nt, Staphylococcus aureus subsp. aureus MW2
uguuuggaugaacaaa

SEQ ID NO: 2104186 - RNA, 14 nt, Staphylococcus aureus subsp. aureus MW2
uguuugcuuuuugu

SEQ ID NO: 2104187 - RNA, 22 nt, Staphylococcus aureus subsp. aureus MW2
uguuugcccugcuguuuuauuc

SEQ ID NO: 2104188 - RNA, 13 nt, Staphylococcus aureus subsp. aureus MW2
uguuucuuguucu

SEQ ID NO: 2104189 - RNA, 19 nt, Staphylococcus aureus subsp. aureus MW2
uguuucuuguucuaaaaaa

SEQ ID NO: 2104190 - RNA, 14 nt, Staphylococcus aureus subsp. aureus MW2
uguuucuaaugcuc

SEQ ID NO: 2104191 - RNA, 15 nt, Staphylococcus aureus subsp. aureus MW2
uguuucuauauuaau

SEQ ID NO: 2104192 - RNA, 18 nt, Staphylococcus aureus subsp. aureus MW2
uguuucuaaauucuuuuu

SEQ ID NO: 2104193 - RNA, 14 nt, Staphylococcus aureus subsp. aureus MW2
uguuucgucagauu

SEQ ID NO: 2104194 - RNA, 12 nt, Staphylococcus aureus subsp. aureus MW2
uguuuuaaaaaa

SEQ ID NO: 2104195 - RNA, 11 nt, Staphylococcus aureus subsp. aureus MW2
uguuuguauuc

SEQ ID NO: 2104196 - RNA, 14 nt, Staphylococcus aureus subsp. aureus MW2
uguuuuauagcauu

SEQ ID NO: 2104197 - RNA, 18 nt, Staphylococcus aureus subsp. aureus MW2
uguuuuaaauuuuaugaa

SEQ ID NO: 2104198 - RNA, 20 nt, Staphylococcus aureus subsp. aureus MW2
uguuuucaacaguuuuaaag

SEQ ID NO: 2104199 - RNA, 17 nt, Staphylococcus aureus subsp. aureus MW2
uguuuuccuuuugaaua

SEQ ID NO: 2104200 - RNA, 20 nt, Staphylococcus aureus subsp. aureus MW2
uguuuugagagauuauuuaa

SEQ ID NO: 2104201 - RNA, 16 nt, Staphylococcus aureus subsp. aureus MW2
uguuuauaauaauauu

SEQ ID NO: 2104202 - RNA, 18 nt, Staphylococcus aureus subsp. aureus MW2
uguuuauaauaauauuga

SEQ ID NO: 2104203 - RNA, 23 nt, Staphylococcus aureus subsp. aureus MW2
uguuuaguauggaauaaaugguu

SEQ ID NO: 2104204 - RNA, 16 nt, Staphylococcus aureus subsp. aureus MW2
uguuuauauugcaaaa

SEQ ID NO: 2104205 - RNA, 21 nt, Staphylococcus aureus subsp. aureus MW2
uguuuaucaugaugauaaauu

SEQ ID NO: 2104206 - RNA, 22 nt, Staphylococcus aureus subsp. aureus MW2
uguuuaucaugaugauaaauug

SEQ ID NO: 2104207 - RNA, 12 nt, Staphylococcus aureus subsp. aureus MW2
uguuuauaucuu

SEQ ID NO: 2104208 - RNA, 15 nt, Staphylococcus aureus subsp. aureus MW2
uguuuauccauauau

SEQ ID NO: 2104209 - RNA, 20 nt, Staphylococcus aureus subsp. aureus MW2
uguuuacggauuuuucucau

SEQ ID NO: 2104210 - RNA, 12 nt, Staphylococcus aureus subsp. aureus MW2
uguuuaauaaua

SEQ ID NO: 2104211 - RNA, 14 nt, Staphylococcus aureus subsp. aureus MW2
uguuuaauaauaca

SEQ ID NO: 2104212 - RNA, 21 nt, Staphylococcus aureus subsp. aureus MW2
uguuuaauuugauuaaauuca

SEQ ID NO: 2104213 - RNA, 21 nt, Staphylococcus aureus subsp. aureus MW2
uguuuaccuaaaucuuuaaau

SEQ ID NO: 2104214 - RNA, 15 nt, Staphylococcus aureus subsp. aureus MW2
uguuuaaacauguac

SEQ ID NO: 2104215 - RNA, 13 nt, Staphylococcus aureus subsp. aureus MW2
uguuuaaaugcua

SEQ ID NO: 2104216 - RNA, 21 nt, Staphylococcus aureus subsp. aureus MW2
uguuucagcuuguccauagua

SEQ ID NO: 2104217 - RNA, 19 nt, Staphylococcus aureus subsp. aureus MW2
uguuucauaugcaucaaca

SEQ ID NO: 2104218 - RNA, 21 nt, Staphylococcus aureus subsp. aureus MW2
uguuucauaugcaucaacaga

SEQ ID NO: 2104219 - RNA, 13 nt, Staphylococcus aureus subsp. aureus MW2
uguuucaaacaaa

SEQ ID NO: 2104220 - RNA, 21 nt, Staphylococcus aureus subsp. aureus MW2
uguuuauuuguguuuuuauua

SEQ ID NO: 2104221 - RNA, 15 nt, Staphylococcus aureus subsp. aureus MW2
uguuucaaauuuugu

SEQ ID NO: 2104222 - RNA, 19 nt, Staphylococcus aureus subsp. aureus MW2
uguuuauuuagaauaaacu

SEQ ID NO: 2104223 - RNA, 17 nt, Staphylococcus aureus subsp. aureus MW2
uguuucaauucaauugc

SEQ ID NO: 2104224 - RNA, 19 nt, Staphylococcus aureus subsp. aureus MW2
uguuucaacauauuauaua

SEQ ID NO: 2104225 - RNA, 16 nt, Staphylococcus aureus subsp. aureus MW2
uguuuauuuagaauaa

SEQ ID NO: 2104226 - RNA, 19 nt, Staphylococcus aureus subsp. aureus MW2
uguuuaugucuugcucuau

SEQ ID NO: 2104227 - RNA, 22 nt, Staphylococcus aureus subsp. aureus MW2
uguuuaugagcuuaauaaauug

SEQ ID NO: 2104228 - RNA, 18 nt, Staphylococcus aureus subsp. aureus MW2
uguuuaugacaaaguucu

SEQ ID NO: 2104229 - RNA, 14 nt, Staphylococcus aureus subsp. aureus MW2
uuaaaauaaaccac

SEQ ID NO: 2104230 - RNA, 22 nt, Staphylococcus aureus subsp. aureus MW2
uuaaaagcaaaggcgcgccaug

SEQ ID NO: 2104231 - RNA, 18 nt, Staphylococcus aureus subsp. aureus MW2
uuaaaauaccaaauauga

SEQ ID NO: 2104232 - RNA, 12 nt, Staphylococcus aureus subsp. aureus MW2
uuaaaauaccug

SEQ ID NO: 2104233 - RNA, 22 nt, Staphylococcus aureus subsp. aureus MW2
uuaaaauauaaauuucuucaua

SEQ ID NO: 2104234 - RNA, 21 nt, Staphylococcus aureus subsp. aureus MW2
uuaaaauaugauuuaaaauau

SEQ ID NO: 2104235 - RNA, 11 nt, Staphylococcus aureus subsp. aureus MW2
uuaaaauauua

SEQ ID NO: 2104236 - RNA, 13 nt, Staphylococcus aureus subsp. aureus MW2
uuaaaauauuaau

SEQ ID NO: 2104237 - RNA, 22 nt, Staphylococcus aureus subsp. aureus MW2
uuaaaauauuaaucaauuuauc

SEQ ID NO: 2104238 - RNA, 19 nt, Staphylococcus aureus subsp. aureus MW2
uuaaaagagaauauaaaau

SEQ ID NO: 2104239 - RNA, 20 nt, Staphylococcus aureus subsp. aureus MW2
uuaaaagaggggaacaaugg

SEQ ID NO: 2104240 - RNA, 20 nt, Staphylococcus aureus subsp. aureus MW2
uuaaaagaguacauuuauuu

SEQ ID NO: 2104241 - RNA, 15 nt, Staphylococcus aureus subsp. aureus MW2
uuaaaagauaaauaa

SEQ ID NO: 2104242 - RNA, 18 nt, Staphylococcus aureus subsp. aureus MW2
uuaaaaggcgaaacauua

SEQ ID NO: 2104243 - RNA, 18 nt, Staphylococcus aureus subsp. aureus MW2
uuaaaauauuauuuuuaa

SEQ ID NO: 2104244 - RNA, 11 nt, Staphylococcus aureus subsp. aureus MW2
uuaaaaugcuu

SEQ ID NO: 2104245 - RNA, 21 nt, Staphylococcus aureus subsp. aureus MW2
uuaaaaugauuguuuuaagug

SEQ ID NO: 2104246 - RNA, 21 nt, Staphylococcus aureus subsp. aureus MW2
uuaaaaucuugaugauauuca

SEQ ID NO: 2104247 - RNA, 21 nt, Staphylococcus aureus subsp. aureus MW2
uuaaaaucucauaauaauuca

SEQ ID NO: 2104248 - RNA, 15 nt, Staphylococcus aureus subsp. aureus MW2
uuaaaauuuaaauau

SEQ ID NO: 2104249 - RNA, 14 nt, Staphylococcus aureus subsp. aureus MW2
uuaaacguaucauu

SEQ ID NO: 2104250 - RNA, 22 nt, Staphylococcus aureus subsp. aureus MW2
uuaaaauuguauagaaugugua

SEQ ID NO: 2104251 - RNA, 15 nt, Staphylococcus aureus subsp. aureus MW2
uuaaaaucaaccuuu

SEQ ID NO: 2104252 - RNA, 19 nt, Staphylococcus aureus subsp. aureus MW2
uuaaagauguugaaaagua

SEQ ID NO: 2104253 - RNA, 19 nt, Staphylococcus aureus subsp. aureus MW2
uuaaagauggcugcaucaa

SEQ ID NO: 2104254 - RNA, 18 nt, Staphylococcus aureus subsp. aureus MW2
uuaaagauuuacccauua

SEQ ID NO: 2104255 - RNA, 15 nt, Staphylococcus aureus subsp. aureus MW2
uuaaagauuaaaaua

SEQ ID NO: 2104256 - RNA, 21 nt, Staphylococcus aureus subsp. aureus MW2
uuaaagagcaauuaaagucaa

SEQ ID NO: 2104257 - RNA, 16 nt, Staphylococcus aureus subsp. aureus MW2
uuaaacuuuaugaaaa

SEQ ID NO: 2104258 - RNA, 14 nt, Staphylococcus aureus subsp. aureus MW2
uuaaacuuauuaau

SEQ ID NO: 2104259 - RNA, 20 nt, Staphylococcus aureus subsp. aureus MW2
uuaaacuuauuaauuaauag

SEQ ID NO: 2104260 - RNA, 13 nt, Staphylococcus aureus subsp. aureus MW2
uuaaacugcgaac

SEQ ID NO: 2104261 - RNA, 13 nt, Staphylococcus aureus subsp. aureus MW2
uuaaacuguaaac

SEQ ID NO: 2104262 - RNA, 17 nt, Staphylococcus aureus subsp. aureus MW2
uuaaacuguaaacauuu

SEQ ID NO: 2104263 - RNA, 16 nt, Staphylococcus aureus subsp. aureus MW2
uuaaacucucuaaaaa

SEQ ID NO: 2104264 - RNA, 17 nt, Staphylococcus aureus subsp. aureus MW2
uuaaacucauaauuuuc

SEQ ID NO: 2104265 - RNA, 17 nt, Staphylococcus aureus subsp. aureus MW2
uuaaacuacgaauucuc

SEQ ID NO: 2104266 - RNA, 22 nt, Staphylococcus aureus subsp. aureus MW2
uuaaacgugaauucgaugacuu

SEQ ID NO: 2104267 - RNA, 17 nt, Staphylococcus aureus subsp. aureus MW2
uuaaaguuuuguucaau

SEQ ID NO: 2104268 - RNA, 13 nt, Staphylococcus aureus subsp. aureus MW2
uuaaauaaaaaua

SEQ ID NO: 2104269 - RNA, 14 nt, Staphylococcus aureus subsp. aureus MW2
uuaaagucuucauc

SEQ ID NO: 2104270 - RNA, 16 nt, Staphylococcus aureus subsp. aureus MW2
uuaaaguugauuuugc

SEQ ID NO: 2104271 - RNA, 14 nt, Staphylococcus aureus subsp. aureus MW2
uuaaagucaguaua

SEQ ID NO: 2104272 - RNA, 22 nt, Staphylococcus aureus subsp. aureus MW2
uuaaagucuguugguuuaucag

SEQ ID NO: 2104273 - RNA, 15 nt, Staphylococcus aureus subsp. aureus MW2
uuaaagcacauguau

SEQ ID NO: 2104274 - RNA, 13 nt, Staphylococcus aureus subsp. aureus MW2
uuaaagcaucaua

SEQ ID NO: 2104275 - RNA, 19 nt, Staphylococcus aureus subsp. aureus MW2
uuaaaaauugaaggaaaau

SEQ ID NO: 2104276 - RNA, 14 nt, Staphylococcus aureus subsp. aureus MW2
uuaaaaauaguucu

SEQ ID NO: 2104277 - RNA, 16 nt, Staphylococcus aureus subsp. aureus MW2
uuaaaaaucuacauau

SEQ ID NO: 2104278 - RNA, 15 nt, Staphylococcus aureus subsp. aureus MW2
uuaaaaaucaaagag

SEQ ID NO: 2104279 - RNA, 15 nt, Staphylococcus aureus subsp. aureus MW2
uuaaaacaucauuca

SEQ ID NO: 2104280 - RNA, 16 nt, Staphylococcus aureus subsp. aureus MW2
uuaaaaaauuuaaaua

SEQ ID NO: 2104281 - RNA, 19 nt, Staphylococcus aureus subsp. aureus MW2
uuaaaaaauauguauguuu

SEQ ID NO: 2104282 - RNA, 23 nt, Staphylococcus aureus subsp. aureus MW2
uuaaaaagguacuaauguuaauc

SEQ ID NO: 2104283 - RNA, 16 nt, Staphylococcus aureus subsp. aureus MW2
uuaaaaagucaaagag

SEQ ID NO: 2104284 - RNA, 12 nt, Staphylococcus aureus subsp. aureus MW2
uuaaaaaaggaa

SEQ ID NO: 2104285 - RNA, 22 nt, Staphylococcus aureus subsp. aureus MW2
uguuuuuuuuauuaauuuaaaa

SEQ ID NO: 2104286 - RNA, 21 nt, Staphylococcus aureus subsp. aureus MW2
uguuuuucacuguuaaagucu

SEQ ID NO: 2104287 - RNA, 13 nt, Staphylococcus aureus subsp. aureus MW2
uguuuuuauuaau

SEQ ID NO: 2104288 - RNA, 17 nt, Staphylococcus aureus subsp. aureus MW2
uguuuuucaucauuaaa

SEQ ID NO: 2104289 - RNA, 18 nt, Staphylococcus aureus subsp. aureus MW2
uguuuuucaucauuaaaa

SEQ ID NO: 2104290 - RNA, 21 nt, Staphylococcus aureus subsp. aureus MW2
uguuuuuaaaugcuuuaaaua

SEQ ID NO: 2104291 - RNA, 14 nt, Staphylococcus aureus subsp. aureus MW2
uguuuuuaguaauu

SEQ ID NO: 2104292 - RNA, 15 nt, Staphylococcus aureus subsp. aureus MW2
uguuaacugauaaaa

SEQ ID NO: 2104293 - RNA, 14 nt, Staphylococcus aureus subsp. aureus MW2
uguuaagcuacccg

SEQ ID NO: 2104294 - RNA, 21 nt, Staphylococcus aureus subsp. aureus MW2
uguuaagcccucauuuuuaua

SEQ ID NO: 2104295 - RNA, 21 nt, Staphylococcus aureus subsp. aureus MW2
uguuaacugauaaaaggggaa

SEQ ID NO: 2104296 - RNA, 11 nt, Staphylococcus aureus subsp. aureus MW2
uguuaauaaug

SEQ ID NO: 2104297 - RNA, 14 nt, Staphylococcus aureus subsp. aureus MW2
uguuaugaaguauc

SEQ ID NO: 2104298 - RNA, 16 nt, Staphylococcus aureus subsp. aureus MW2
uguucacauucuugaa

SEQ ID NO: 2104299 - RNA, 15 nt, Staphylococcus aureus subsp. aureus MW2
uguuauguaugaaag

SEQ ID NO: 2104300 - RNA, 15 nt, Staphylococcus aureus subsp. aureus MW2
uguuauugaaugaag

SEQ ID NO: 2104301 - RNA, 22 nt, Staphylococcus aureus subsp. aureus MW2
uguuauugaaugaaguaggcug

SEQ ID NO: 2104302 - RNA, 22 nt, Staphylococcus aureus subsp. aureus MW2
uguuccugcuacaacuucuucu

SEQ ID NO: 2104303 - RNA, 23 nt, Staphylococcus aureus subsp. aureus MW2
uguuccugcuacaacuucuucuc

SEQ ID NO: 2104304 - RNA, 14 nt, Staphylococcus aureus subsp. aureus MW2
uguucuaaugcugc

SEQ ID NO: 2104305 - RNA, 17 nt, Staphylococcus aureus subsp. aureus MW2
uguucccauuuuuaaaa

SEQ ID NO: 2104306 - RNA, 21 nt, Staphylococcus aureus subsp. aureus MW2
uguuccauggaauaaauuuau

SEQ ID NO: 2104307 - RNA, 17 nt, Staphylococcus aureus subsp. aureus MW2
uguuccgcuacaaaaca

SEQ ID NO: 2104308 - RNA, 18 nt, Staphylococcus aureus subsp. aureus MW2
uguuccgcuacaaaacau

SEQ ID NO: 2104309 - RNA, 21 nt, Staphylococcus aureus subsp. aureus MW2
uguuccgcuacaaaacauauu

SEQ ID NO: 2104310 - RNA, 16 nt, Staphylococcus aureus subsp. aureus MW2
uguuggcaaacuauua

SEQ ID NO: 2104311 - RNA, 18 nt, Staphylococcus aureus subsp. aureus MW2
uguuggaauaccuuuuuc

SEQ ID NO: 2104312 - RNA, 17 nt, Staphylococcus aureus subsp. aureus MW2
uguugcauuagaucaua

SEQ ID NO: 2104313 - RNA, 16 nt, Staphylococcus aureus subsp. aureus MW2
uguugcauccccagcc

SEQ ID NO: 2104314 - RNA, 18 nt, Staphylococcus aureus subsp. aureus MW2
uguucucauuauaaugau

SEQ ID NO: 2104315 - RNA, 14 nt, Staphylococcus aureus subsp. aureus MW2
uguucucuauuuau

SEQ ID NO: 2104316 - RNA, 14 nt, Staphylococcus aureus subsp. aureus MW2
uguugauuuaaaau

SEQ ID NO: 2104317 - RNA, 15 nt, Staphylococcus aureus subsp. aureus MW2
uguugcaaaauuaag

SEQ ID NO: 2104318 - RNA, 21 nt, Staphylococcus aureus subsp. aureus MW2
uguugucguuucuagcaacug

SEQ ID NO: 2104319 - RNA, 17 nt, Staphylococcus aureus subsp. aureus MW2
uguugugcaacauugau

SEQ ID NO: 2104320 - RNA, 14 nt, Staphylococcus aureus subsp. aureus MW2
uguuguuauauaaa

SEQ ID NO: 2104321 - RNA, 18 nt, Staphylococcus aureus subsp. aureus MW2
uguuguuuaaauuucaaa

SEQ ID NO: 2104322 - RNA, 22 nt, Staphylococcus aureus subsp. aureus MW2
uguuguugcccgcuuauugcau

SEQ ID NO: 2104323 - RNA, 20 nt, Staphylococcus aureus subsp. aureus MW2
uguugguucaucaaacaaca

SEQ ID NO: 2104324 - RNA, 16 nt, Staphylococcus aureus subsp. aureus MW2
uguuggcuuuuugagu

SEQ ID NO: 2104325 - RNA, 15 nt, Staphylococcus aureus subsp. aureus MW2
ugugccuuucuaaua

SEQ ID NO: 2104326 - RNA, 20 nt, Staphylococcus aureus subsp. aureus MW2
ugugccggcuuuuucuuuug

SEQ ID NO: 2104327 - RNA, 18 nt, Staphylococcus aureus subsp. aureus MW2
ugugccggcuuuuucuuu

SEQ ID NO: 2104328 - RNA, 23 nt, Staphylococcus aureus subsp. aureus MW2
ugugcaaguuggcggggccccaa

SEQ ID NO: 2104329 - RNA, 23 nt, Staphylococcus aureus subsp. aureus MW2
ugugacucggggaauuuuuaugc

SEQ ID NO: 2104330 - RNA, 13 nt, Staphylococcus aureus subsp. aureus MW2
ugugcaucauuua

SEQ ID NO: 2104331 - RNA, 18 nt, Staphylococcus aureus subsp. aureus MW2
ugugcauugcuuuuguua

SEQ ID NO: 2104332 - RNA, 22 nt, Staphylococcus aureus subsp. aureus MW2
ugucacuuggauucaaaugaca

SEQ ID NO: 2104333 - RNA, 22 nt, Staphylococcus aureus subsp. aureus MW2
ugucagcauucauagcugcuuu

SEQ ID NO: 2104334 - RNA, 18 nt, Staphylococcus aureus subsp. aureus MW2
ugugggccccaacaaaga

SEQ ID NO: 2104335 - RNA, 22 nt, Staphylococcus aureus subsp. aureus MW2
ugugguaaagggggcucucauu

SEQ ID NO: 2104336 - RNA, 13 nt, Staphylococcus aureus subsp. aureus MW2
uguuaaaaaauua

SEQ ID NO: 2104337 - RNA, 18 nt, Staphylococcus aureus subsp. aureus MW2
uguuaaagauuauuauua

SEQ ID NO: 2104338 - RNA, 15 nt, Staphylococcus aureus subsp. aureus MW2
uguuaaauucuaaaa

SEQ ID NO: 2104339 - RNA, 18 nt, Staphylococcus aureus subsp. aureus MW2
uguuaaaauuugaauuga

SEQ ID NO: 2104340 - RNA, 18 nt, Staphylococcus aureus subsp. aureus MW2
uguguuuucaacaguuuu

SEQ ID NO: 2104341 - RNA, 14 nt, Staphylococcus aureus subsp. aureus MW2
uguguuuuuauuaa

SEQ ID NO: 2104342 - RNA, 11 nt, Staphylococcus aureus subsp. aureus MW2
uguguuuucaa

SEQ ID NO: 2104343 - RNA, 13 nt, Staphylococcus aureus subsp. aureus MW2
uguguuucuuuua

SEQ ID NO: 2104344 - RNA, 21 nt, Staphylococcus aureus subsp. aureus MW2
uguguaugguuuuguacauau

SEQ ID NO: 2104345 - RNA, 20 nt, Staphylococcus aureus subsp. aureus MW2
uguguccauaaauauuaaau

SEQ ID NO: 2104346 - RNA, 13 nt, Staphylococcus aureus subsp. aureus MW2
uuacccuuuaauc

SEQ ID NO: 2104347 - RNA, 14 nt, Staphylococcus aureus subsp. aureus MW2
uuaccaguaacagc

SEQ ID NO: 2104348 - RNA, 17 nt, Staphylococcus aureus subsp. aureus MW2
uuaccaguaacagcuaa

SEQ ID NO: 2104349 - RNA, 14 nt, Staphylococcus aureus subsp. aureus MW2
uuaccaguaucauu

SEQ ID NO: 2104350 - RNA, 19 nt, Staphylococcus aureus subsp. aureus MW2
uuacaaucaucacacauaa

SEQ ID NO: 2104351 - RNA, 20 nt, Staphylococcus aureus subsp. aureus MW2
uuacaaugcgcaaugaaaac

SEQ ID NO: 2104352 - RNA, 20 nt, Staphylococcus aureus subsp. aureus MW2
uuacaauuaguguuucaugu

SEQ ID NO: 2104353 - RNA, 22 nt, Staphylococcus aureus subsp. aureus MW2
uuacaggagcgagccauuauua

SEQ ID NO: 2104354 - RNA, 23 nt, Staphylococcus aureus subsp. aureus MW2
uuacagguagauguaguguucaa

SEQ ID NO: 2104355 - RNA, 19 nt, Staphylococcus aureus subsp. aureus MW2
uuacagguuuuaaaauuaa

SEQ ID NO: 2104356 - RNA, 20 nt, Staphylococcus aureus subsp. aureus MW2
uuacagguuuuaaaauuaaa

SEQ ID NO: 2104357 - RNA, 16 nt, Staphylococcus aureus subsp. aureus MW2
uuaccaauaucaugca

SEQ ID NO: 2104358 - RNA, 23 nt, Staphylococcus aureus subsp. aureus MW2
uuaccaauaucaugcaaaauaau

SEQ ID NO: 2104359 - RNA, 23 nt, Staphylococcus aureus subsp. aureus MW2
uuaccacaaccagucagaaagaa

SEQ ID NO: 2104360 - RNA, 16 nt, Staphylococcus aureus subsp. aureus MW2
uuaaucgcucuaaaua

SEQ ID NO: 2104361 - RNA, 19 nt, Staphylococcus aureus subsp. aureus MW2
uuaaucggaucauuauuua

SEQ ID NO: 2104362 - RNA, 16 nt, Staphylococcus aureus subsp. aureus MW2
uuaaugucuaaaaaug

SEQ ID NO: 2104363 - RNA, 17 nt, Staphylococcus aureus subsp. aureus MW2
uuaaucuauauaaaaac

SEQ ID NO: 2104364 - RNA, 13 nt, Staphylococcus aureus subsp. aureus MW2
uuaauucuuaauc

SEQ ID NO: 2104365 - RNA, 17 nt, Staphylococcus aureus subsp. aureus MW2
uuaauucugauuauguu

SEQ ID NO: 2104366 - RNA, 17 nt, Staphylococcus aureus subsp. aureus MW2
uuaauuacuguaaauau

SEQ ID NO: 2104367 - RNA, 18 nt, Staphylococcus aureus subsp. aureus MW2
uuaauucguguuugcaua

SEQ ID NO: 2104368 - RNA, 22 nt, Staphylococcus aureus subsp. aureus MW2
uuaauuacagcgugauucaucu

SEQ ID NO: 2104369 - RNA, 15 nt, Staphylococcus aureus subsp. aureus MW2
uuaauuacauguugg

SEQ ID NO: 2104370 - RNA, 20 nt, Staphylococcus aureus subsp. aureus MW2
uuaauuacgucauaaaauac

SEQ ID NO: 2104371 - RNA, 13 nt, Staphylococcus aureus subsp. aureus MW2
uuaauuaaagauu

SEQ ID NO: 2104372 - RNA, 19 nt, Staphylococcus aureus subsp. aureus MW2
uuaauuaaagcaucuucaa

SEQ ID NO: 2104373 - RNA, 20 nt, Staphylococcus aureus subsp. aureus MW2
uuaauuaaagcaucuucaau

SEQ ID NO: 2104374 - RNA, 23 nt, Staphylococcus aureus subsp. aureus MW2
uuaauuaaagcaucuucaauauu

SEQ ID NO: 2104375 - RNA, 15 nt, Staphylococcus aureus subsp. aureus MW2
uuaauuaauaauuua

SEQ ID NO: 2104376 - RNA, 20 nt, Staphylococcus aureus subsp. aureus MW2
uuaauuaaacuguaaacauu

SEQ ID NO: 2104377 - RNA, 14 nt, Staphylococcus aureus subsp. aureus MW2
uuaauuaauuauca

SEQ ID NO: 2104378 - RNA, 16 nt, Staphylococcus aureus subsp. aureus MW2
uuaauguuugaguguu

SEQ ID NO: 2104379 - RNA, 14 nt, Staphylococcus aureus subsp. aureus MW2
uuaauguuugcuuu

SEQ ID NO: 2104380 - RNA, 14 nt, Staphylococcus aureus subsp. aureus MW2
uuaauguucucgug

SEQ ID NO: 2104381 - RNA, 15 nt, Staphylococcus aureus subsp. aureus MW2
uuaauuuuaaauauu

SEQ ID NO: 2104382 - RNA, 19 nt, Staphylococcus aureus subsp. aureus MW2
uuaauuuguuuuaaauacu

SEQ ID NO: 2104383 - RNA, 18 nt, Staphylococcus aureus subsp. aureus MW2
uuaauuuguuuuaaauac

SEQ ID NO: 2104384 - RNA, 19 nt, Staphylococcus aureus subsp. aureus MW2
uuaauuucugguaaaaaaa

SEQ ID NO: 2104385 - RNA, 23 nt, Staphylococcus aureus subsp. aureus MW2
uuaauuucugguaaaaaaauaac

SEQ ID NO: 2104386 - RNA, 23 nt, Staphylococcus aureus subsp. aureus MW2
uuaauuugacaaucuaaauguaa

SEQ ID NO: 2104387 - RNA, 13 nt, Staphylococcus aureus subsp. aureus MW2
uuaauuucuggua

SEQ ID NO: 2104388 - RNA, 18 nt, Staphylococcus aureus subsp. aureus MW2
uuaauuucugguaaaaaa

SEQ ID NO: 2104389 - RNA, 16 nt, Staphylococcus aureus subsp. aureus MW2
uuaauugaaaugauaa

SEQ ID NO: 2104390 - RNA, 19 nt, Staphylococcus aureus subsp. aureus MW2
uuaauugaaaugauaaaaa

SEQ ID NO: 2104391 - RNA, 16 nt, Staphylococcus aureus subsp. aureus MW2
uuaauugaaguaugca

SEQ ID NO: 2104392 - RNA, 14 nt, Staphylococcus aureus subsp. aureus MW2
uuaauugcagguaa

SEQ ID NO: 2104393 - RNA, 14 nt, Staphylococcus aureus subsp. aureus MW2
uuaauuuuuuauua

SEQ ID NO: 2104394 - RNA, 16 nt, Staphylococcus aureus subsp. aureus MW2
uuacaauaaugugcaa

SEQ ID NO: 2104395 - RNA, 19 nt, Staphylococcus aureus subsp. aureus MW2
uuacaauaaugugcaaguu

SEQ ID NO: 2104396 - RNA, 14 nt, Staphylococcus aureus subsp. aureus MW2
uuaauuuucucaaa

SEQ ID NO: 2104397 - RNA, 19 nt, Staphylococcus aureus subsp. aureus MW2
uuaauuuugauauuuuuca

SEQ ID NO: 2104398 - RNA, 14 nt, Staphylococcus aureus subsp. aureus MW2
uuaauuuugacaua

SEQ ID NO: 2104399 - RNA, 15 nt, Staphylococcus aureus subsp. aureus MW2
uuaauuuuauuauua

SEQ ID NO: 2104400 - RNA, 18 nt, Staphylococcus aureus subsp. aureus MW2
uuaauuuuauuauuaauc

SEQ ID NO: 2104401 - RNA, 12 nt, Staphylococcus aureus subsp. aureus MW2
uuaauauuuauu

SEQ ID NO: 2104402 - RNA, 21 nt, Staphylococcus aureus subsp. aureus MW2
uuaauauuuauuaccuuaugg

SEQ ID NO: 2104403 - RNA, 14 nt, Staphylococcus aureus subsp. aureus MW2
uuaauauuugauua

SEQ ID NO: 2104404 - RNA, 18 nt, Staphylococcus aureus subsp. aureus MW2
uuaauauuugauuauucg

SEQ ID NO: 2104405 - RNA, 12 nt, Staphylococcus aureus subsp. aureus MW2
uuaauauuuucu

SEQ ID NO: 2104406 - RNA, 16 nt, Staphylococcus aureus subsp. aureus MW2
uuaauauuuuuuucaa

SEQ ID NO: 2104407 - RNA, 14 nt, Staphylococcus aureus subsp. aureus MW2
uuaaucaaauauuu

SEQ ID NO: 2104408 - RNA, 23 nt, Staphylococcus aureus subsp. aureus MW2
uuaaucaacguauauaaguuaaa

SEQ ID NO: 2104409 - RNA, 14 nt, Staphylococcus aureus subsp. aureus MW2
uuaauauugaauaa

SEQ ID NO: 2104410 - RNA, 22 nt, Staphylococcus aureus subsp. aureus MW2
uuaauauugguuauauauuguc

SEQ ID NO: 2104411 - RNA, 14 nt, Staphylococcus aureus subsp. aureus MW2
uuaauauuaaauuu

SEQ ID NO: 2104412 - RNA, 19 nt, Staphylococcus aureus subsp. aureus MW2
uuaauaucacgaucuuuaa

SEQ ID NO: 2104413 - RNA, 13 nt, Staphylococcus aureus subsp. aureus MW2
uuaauauauuugg

SEQ ID NO: 2104414 - RNA, 23 nt, Staphylococcus aureus subsp. aureus MW2
uuaauauauuuaaacucauaauu

SEQ ID NO: 2104415 - RNA, 12 nt, Staphylococcus aureus subsp. aureus MW2
uuaauauccaaa

SEQ ID NO: 2104416 - RNA, 19 nt, Staphylococcus aureus subsp. aureus MW2
uuaauaugaacaaaaauaa

SEQ ID NO: 2104417 - RNA, 15 nt, Staphylococcus aureus subsp. aureus MW2
uuaaucaauuuaucg

SEQ ID NO: 2104418 - RNA, 16 nt, Staphylococcus aureus subsp. aureus MW2
uuaaucaauuuaauua

SEQ ID NO: 2104419 - RNA, 19 nt, Staphylococcus aureus subsp. aureus MW2
uuaaucauacauaugcuau

SEQ ID NO: 2104420 - RNA, 16 nt, Staphylococcus aureus subsp. aureus MW2
uuaauauaauuaauuu

SEQ ID NO: 2104421 - RNA, 13 nt, Staphylococcus aureus subsp. aureus MW2
uuaauauaaguau

SEQ ID NO: 2104422 - RNA, 21 nt, Staphylococcus aureus subsp. aureus MW2
uuaauauacgagacauuucuu

SEQ ID NO: 2104423 - RNA, 17 nt, Staphylococcus aureus subsp. aureus MW2
uuaauauaaauaucaau

SEQ ID NO: 2104424 - RNA, 13 nt, Staphylococcus aureus subsp. aureus MW2
uuaauauaaauuu

SEQ ID NO: 2104425 - RNA, 22 nt, Staphylococcus aureus subsp. aureus MW2
uuaauauaaauuuugaauuaca

SEQ ID NO: 2104426 - RNA, 14 nt, Staphylococcus aureus subsp. aureus MW2
uuaauauaaaauaa

SEQ ID NO: 2104427 - RNA, 15 nt, Staphylococcus aureus subsp. aureus MW2
uuaauauaaauauca

SEQ ID NO: 2104428 - RNA, 22 nt, Staphylococcus aureus subsp. aureus MW2
uuaauagagacauuuuaucuga

SEQ ID NO: 2104429 - RNA, 16 nt, Staphylococcus aureus subsp. aureus MW2
uuaauagagguauaau

SEQ ID NO: 2104430 - RNA, 22 nt, Staphylococcus aureus subsp. aureus MW2
uuaauagagguauaauuaaaug

SEQ ID NO: 2104431 - RNA, 20 nt, Staphylococcus aureus subsp. aureus MW2
uuaauagagacauuuuaucu

SEQ ID NO: 2104432 - RNA, 19 nt, Staphylococcus aureus subsp. aureus MW2
uuaauaggauuauuaucaa

SEQ ID NO: 2104433 - RNA, 17 nt, Staphylococcus aureus subsp. aureus MW2
uuaauaguguuauauug

SEQ ID NO: 2104434 - RNA, 17 nt, Staphylococcus aureus subsp. aureus MW2
uuaauaguuuuaauauu

SEQ ID NO: 2104435 - RNA, 14 nt, Staphylococcus aureus subsp. aureus MW2
uuaauaguuuuaua

SEQ ID NO: 2104436 - RNA, 20 nt, Staphylococcus aureus subsp. aureus MW2
uuaauagguuaguaauauau

SEQ ID NO: 2104437 - RNA, 21 nt, Staphylococcus aureus subsp. aureus MW2
uuaauagguuaguaauauauu

SEQ ID NO: 2104438 - RNA, 20 nt, Staphylococcus aureus subsp. aureus MW2
uuaauagguucuucuuucau

SEQ ID NO: 2104439 - RNA, 23 nt, Staphylococcus aureus subsp. aureus MW2
uuaauaguaccgugaaaaguguu

SEQ ID NO: 2104440 - RNA, 19 nt, Staphylococcus aureus subsp. aureus MW2
uuaauaauuuguuuuauuu

SEQ ID NO: 2104441 - RNA, 15 nt, Staphylococcus aureus subsp. aureus MW2
uuaauacaucaauau

SEQ ID NO: 2104442 - RNA, 19 nt, Staphylococcus aureus subsp. aureus MW2
uuaauaauacauucauuaa

SEQ ID NO: 2104443 - RNA, 13 nt, Staphylococcus aureus subsp. aureus MW2
uuaauaauaagua

SEQ ID NO: 2104444 - RNA, 17 nt, Staphylococcus aureus subsp. aureus MW2
uuaauaaugaauucuau

SEQ ID NO: 2104445 - RNA, 15 nt, Staphylococcus aureus subsp. aureus MW2
uuaauaauuaaacaa

SEQ ID NO: 2104446 - RNA, 17 nt, Staphylococcus aureus subsp. aureus MW2
uuaauaauuaaacaaaa

SEQ ID NO: 2104447 - RNA, 21 nt, Staphylococcus aureus subsp. aureus MW2
uuaauaauuaaacaaaacuua

SEQ ID NO: 2104448 - RNA, 22 nt, Staphylococcus aureus subsp. aureus MW2
uuaaaugacauggaaaauauau

SEQ ID NO: 2104449 - RNA, 21 nt, Staphylococcus aureus subsp. aureus MW2
uuaaaucuucuaguaauucuu

SEQ ID NO: 2104450 - RNA, 13 nt, Staphylococcus aureus subsp. aureus MW2
uuaaaucuucuag

SEQ ID NO: 2104451 - RNA, 14 nt, Staphylococcus aureus subsp. aureus MW2
uuaaaucuuuuacu

SEQ ID NO: 2104452 - RNA, 15 nt, Staphylococcus aureus subsp. aureus MW2
uuaaaucuacuuugu

SEQ ID NO: 2104453 - RNA, 19 nt, Staphylococcus aureus subsp. aureus MW2
uuaaaucugauucauuaaa

SEQ ID NO: 2104454 - RNA, 15 nt, Staphylococcus aureus subsp. aureus MW2
uuaaaucuaauuauu

SEQ ID NO: 2104455 - RNA, 17 nt, Staphylococcus aureus subsp. aureus MW2
uuaaaucuaauuauuca

SEQ ID NO: 2104456 - RNA, 16 nt, Staphylococcus aureus subsp. aureus MW2
uuaaaucauuauuuua

SEQ ID NO: 2104457 - RNA, 18 nt, Staphylococcus aureus subsp. aureus MW2
uuaaauccgcuuguucaa

SEQ ID NO: 2104458 - RNA, 21 nt, Staphylococcus aureus subsp. aureus MW2
uuaacuguaugccgccuaaua

SEQ ID NO: 2104459 - RNA, 19 nt, Staphylococcus aureus subsp. aureus MW2
uuaacuguuuauccauaua

SEQ ID NO: 2104460 - RNA, 18 nt, Staphylococcus aureus subsp. aureus MW2
uuaacugggcaacuuuuu

SEQ ID NO: 2104461 - RNA, 22 nt, Staphylococcus aureus subsp. aureus MW2
uuaacugguugauaaauaaacu

SEQ ID NO: 2104462 - RNA, 22 nt, Staphylococcus aureus subsp. aureus MW2
uuaacuguacgauucaauuuaa

SEQ ID NO: 2104463 - RNA, 20 nt, Staphylococcus aureus subsp. aureus MW2
uuaacugccauauagauauu

SEQ ID NO: 2104464 - RNA, 12 nt, Staphylococcus aureus subsp. aureus MW2
uuaaaucuucaa

SEQ ID NO: 2104465 - RNA, 19 nt, Staphylococcus aureus subsp. aureus MW2
uuaacucuaucaaauuacu

SEQ ID NO: 2104466 - RNA, 21 nt, Staphylococcus aureus subsp. aureus MW2
uuaagacugauuaauuauuga

SEQ ID NO: 2104467 - RNA, 19 nt, Staphylococcus aureus subsp. aureus MW2
uuaaguagaugauuagugu

SEQ ID NO: 2104468 - RNA, 14 nt, Staphylococcus aureus subsp. aureus MW2
uuaaguauaucuuu

SEQ ID NO: 2104469 - RNA, 18 nt, Staphylococcus aureus subsp. aureus MW2
uuaaguacaacaguugca

SEQ ID NO: 2104470 - RNA, 14 nt, Staphylococcus aureus subsp. aureus MW2
uuaaguacuucaaa

SEQ ID NO: 2104471 - RNA, 13 nt, Staphylococcus aureus subsp. aureus MW2
uuaaguacuuuua

SEQ ID NO: 2104472 - RNA, 22 nt, Staphylococcus aureus subsp. aureus MW2
uuaagucgccuaacuuuuauua

SEQ ID NO: 2104473 - RNA, 12 nt, Staphylococcus aureus subsp. aureus MW2
uuaagucaucaa

SEQ ID NO: 2104474 - RNA, 21 nt, Staphylococcus aureus subsp. aureus MW2
uuaagugccagauuugaauuu

SEQ ID NO: 2104475 - RNA, 19 nt, Staphylococcus aureus subsp. aureus MW2
uuaagugaugaccaauauu

SEQ ID NO: 2104476 - RNA, 22 nt, Staphylococcus aureus subsp. aureus MW2
uuaagugcaauaacaccaauug

SEQ ID NO: 2104477 - RNA, 17 nt, Staphylococcus aureus subsp. aureus MW2
uuaagugaguuuuauuu

SEQ ID NO: 2104478 - RNA, 16 nt, Staphylococcus aureus subsp. aureus MW2
uuaggcauuuuagauu

SEQ ID NO: 2104479 - RNA, 20 nt, Staphylococcus aureus subsp. aureus MW2
uuaggaaugauagauuuagg

SEQ ID NO: 2104480 - RNA, 16 nt, Staphylococcus aureus subsp. aureus MW2
uuaggaaugacauuua

SEQ ID NO: 2104481 - RNA, 13 nt, Staphylococcus aureus subsp. aureus MW2
uuaggacauugau

SEQ ID NO: 2104482 - RNA, 15 nt, Staphylococcus aureus subsp. aureus MW2
uuaggaaugauagau

SEQ ID NO: 2104483 - RNA, 19 nt, Staphylococcus aureus subsp. aureus MW2
uuaggaaaacuucaauaau

SEQ ID NO: 2104484 - RNA, 19 nt, Staphylococcus aureus subsp. aureus MW2
uuaggaaucgucauauuaa

SEQ ID NO: 2104485 - RNA, 15 nt, Staphylococcus aureus subsp. aureus MW2
uuaggaaugaauaaa

SEQ ID NO: 2104486 - RNA, 19 nt, Staphylococcus aureus subsp. aureus MW2
uuagcgcaccaauuaucaa

SEQ ID NO: 2104487 - RNA, 23 nt, Staphylococcus aureus subsp. aureus MW2
uuagccccagcaaauacuucaag

SEQ ID NO: 2104488 - RNA, 18 nt, Staphylococcus aureus subsp. aureus MW2
uuagccaauaaaauguca

SEQ ID NO: 2104489 - RNA, 19 nt, Staphylococcus aureus subsp. aureus MW2
uuagcauuaaauuccaugu

SEQ ID NO: 2104490 - RNA, 13 nt, Staphylococcus aureus subsp. aureus MW2
uuagcaucaaaaa

SEQ ID NO: 2104491 - RNA, 19 nt, Staphylococcus aureus subsp. aureus MW2
uuagcauaccuuuauuauu

SEQ ID NO: 2104492 - RNA, 15 nt, Staphylococcus aureus subsp. aureus MW2
uuagcaaauauuucu

SEQ ID NO: 2104493 - RNA, 18 nt, Staphylococcus aureus subsp. aureus MW2
uuagcaaaacgcauuuca

SEQ ID NO: 2104494 - RNA, 13 nt, Staphylococcus aureus subsp. aureus MW2
uuagaagaaacuu

SEQ ID NO: 2104495 - RNA, 12 nt, Staphylococcus aureus subsp. aureus MW2
uuagaaccauca

SEQ ID NO: 2104496 - RNA, 19 nt, Staphylococcus aureus subsp. aureus MW2
uuagaacuucucuuugaac

SEQ ID NO: 2104497 - RNA, 16 nt, Staphylococcus aureus subsp. aureus MW2
uuagacuaaaaaacua

SEQ ID NO: 2104498 - RNA, 17 nt, Staphylococcus aureus subsp. aureus MW2
uuagacucacuucuuaa

SEQ ID NO: 2104499 - RNA, 18 nt, Staphylococcus aureus subsp. aureus MW2
uuagacucacuucuuaaa

SEQ ID NO: 2104500 - RNA, 17 nt, Staphylococcus aureus subsp. aureus MW2
uuagauaaaaaauacua

SEQ ID NO: 2104501 - RNA, 18 nt, Staphylococcus aureus subsp. aureus MW2
uuagaccccuaauuaaaa

SEQ ID NO: 2104502 - RNA, 19 nt, Staphylococcus aureus subsp. aureus MW2
uuagaccccuaauuaaaau

SEQ ID NO: 2104503 - RNA, 18 nt, Staphylococcus aureus subsp. aureus MW2
uuagacgcuguuuuaaau

SEQ ID NO: 2104504 - RNA, 14 nt, Staphylococcus aureus subsp. aureus MW2
uuagauugacuaag

SEQ ID NO: 2104505 - RNA, 21 nt, Staphylococcus aureus subsp. aureus MW2
uuagauugacuaaguuuguuu

SEQ ID NO: 2104506 - RNA, 14 nt, Staphylococcus aureus subsp. aureus MW2
uuagauucuuuucu

SEQ ID NO: 2104507 - RNA, 18 nt, Staphylococcus aureus subsp. aureus MW2
uuagauucuuuucugaau

SEQ ID NO: 2104508 - RNA, 14 nt, Staphylococcus aureus subsp. aureus MW2
uuagaugugcgugg

SEQ ID NO: 2104509 - RNA, 20 nt, Staphylococcus aureus subsp. aureus MW2
uuagaugcauaaaaaaagaa

SEQ ID NO: 2104510 - RNA, 17 nt, Staphylococcus aureus subsp. aureus MW2
uuagauuuuauauaaaa

SEQ ID NO: 2104511 - RNA, 12 nt, Staphylococcus aureus subsp. aureus MW2
uuagauuuaaaa

SEQ ID NO: 2104512 - RNA, 12 nt, Staphylococcus aureus subsp. aureus MW2
uuagauuucaaa

SEQ ID NO: 2104513 - RNA, 23 nt, Staphylococcus aureus subsp. aureus MW2
uuagauuucaaacgauuuucaaa

SEQ ID NO: 2104514 - RNA, 17 nt, Staphylococcus aureus subsp. aureus MW2
uuagauuguauguuaua

SEQ ID NO: 2104515 - RNA, 16 nt, Staphylococcus aureus subsp. aureus MW2
uuagaucgauguguaa

SEQ ID NO: 2104516 - RNA, 21 nt, Staphylococcus aureus subsp. aureus MW2
uuagauauauuugaaagguaa

SEQ ID NO: 2104517 - RNA, 15 nt, Staphylococcus aureus subsp. aureus MW2
uuagauaauaaggaa

SEQ ID NO: 2104518 - RNA, 21 nt, Staphylococcus aureus subsp. aureus MW2
uuagauaaauuaauaugaaca

SEQ ID NO: 2104519 - RNA, 13 nt, Staphylococcus aureus subsp. aureus MW2
uuagauaaaacaa

SEQ ID NO: 2104520 - RNA, 14 nt, Staphylococcus aureus subsp. aureus MW2
uuagauaaauuaau

SEQ ID NO: 2104521 - RNA, 23 nt, Staphylococcus aureus subsp. aureus MW2
uuacuuaaucuggguuguaaucu

SEQ ID NO: 2104522 - RNA, 23 nt, Staphylococcus aureus subsp. aureus MW2
uuacgacauacuugucguauucu

SEQ ID NO: 2104523 - RNA, 13 nt, Staphylococcus aureus subsp. aureus MW2
uuaccuuuaauua

SEQ ID NO: 2104524 - RNA, 15 nt, Staphylococcus aureus subsp. aureus MW2
uuaccuuuaauuaca

SEQ ID NO: 2104525 - RNA, 19 nt, Staphylococcus aureus subsp. aureus MW2
uuagaaaguauuuauuucu

SEQ ID NO: 2104526 - RNA, 21 nt, Staphylococcus aureus subsp. aureus MW2
uuagaaaguuuuauuuaaauu

SEQ ID NO: 2104527 - RNA, 13 nt, Staphylococcus aureus subsp. aureus MW2
uuacuucaguuug

SEQ ID NO: 2104528 - RNA, 21 nt, Staphylococcus aureus subsp. aureus MW2
uuacuuccgacugcaccucca

SEQ ID NO: 2104529 - RNA, 13 nt, Staphylococcus aureus subsp. aureus MW2
uuacuucuccaug

SEQ ID NO: 2104530 - RNA, 17 nt, Staphylococcus aureus subsp. aureus MW2
uuacuugcuuuuucaaa

SEQ ID NO: 2104531 - RNA, 15 nt, Staphylococcus aureus subsp. aureus MW2
uuauagugguaaaaa

SEQ ID NO: 2104532 - RNA, 22 nt, Staphylococcus aureus subsp. aureus MW2
uuauagugguaaaaaguuuaaa

SEQ ID NO: 2104533 - RNA, 22 nt, Staphylococcus aureus subsp. aureus MW2
uuauacuauaaauaaaaauaua

SEQ ID NO: 2104534 - RNA, 23 nt, Staphylococcus aureus subsp. aureus MW2
uuauacuauaaauaaaaauauau

SEQ ID NO: 2104535 - RNA, 13 nt, Staphylococcus aureus subsp. aureus MW2
uuauacuacuauu

SEQ ID NO: 2104536 - RNA, 10 nt, Staphylococcus aureus subsp. aureus MW2
uuauacugug

SEQ ID NO: 2104537 - RNA, 19 nt, Staphylococcus aureus subsp. aureus MW2
uuauacauguacauuauca

SEQ ID NO: 2104538 - RNA, 14 nt, Staphylococcus aureus subsp. aureus MW2
uuauaccaauaauu

SEQ ID NO: 2104539 - RNA, 22 nt, Staphylococcus aureus subsp. aureus MW2
uuauacgaaucacaguuauaua

SEQ ID NO: 2104540 - RNA, 12 nt, Staphylococcus aureus subsp. aureus MW2
uuauaaauuucg

SEQ ID NO: 2104541 - RNA, 19 nt, Staphylococcus aureus subsp. aureus MW2
uuauaaauucuaucuauaa

SEQ ID NO: 2104542 - RNA, 14 nt, Staphylococcus aureus subsp. aureus MW2
uuauaaaugauuaa

SEQ ID NO: 2104543 - RNA, 21 nt, Staphylococcus aureus subsp. aureus MW2
uuauaaaugaauuauuuaaaa

SEQ ID NO: 2104544 - RNA, 18 nt, Staphylococcus aureus subsp. aureus MW2
uuauaaaucauucuuuau

SEQ ID NO: 2104545 - RNA, 16 nt, Staphylococcus aureus subsp. aureus MW2
uuauaacauucuucaa

SEQ ID NO: 2104546 - RNA, 23 nt, Staphylococcus aureus subsp. aureus MW2
uuauaacuaaagaacuauguuca

SEQ ID NO: 2104547 - RNA, 17 nt, Staphylococcus aureus subsp. aureus MW2
uuauaacauccccuucu

SEQ ID NO: 2104548 - RNA, 23 nt, Staphylococcus aureus subsp. aureus MW2
uuauaaauuucgauuaauugaau

SEQ ID NO: 2104549 - RNA, 16 nt, Staphylococcus aureus subsp. aureus MW2
uuauaucuuaaguaca

SEQ ID NO: 2104550 - RNA, 15 nt, Staphylococcus aureus subsp. aureus MW2
uuauauaaagaggca

SEQ ID NO: 2104551 - RNA, 17 nt, Staphylococcus aureus subsp. aureus MW2
uuauagucuuaaacaua

SEQ ID NO: 2104552 - RNA, 15 nt, Staphylococcus aureus subsp. aureus MW2
uuauauugcaaaaau

SEQ ID NO: 2104553 - RNA, 12 nt, Staphylococcus aureus subsp. aureus MW2
uuauauuaucau

SEQ ID NO: 2104554 - RNA, 13 nt, Staphylococcus aureus subsp. aureus MW2
uuaucacaacagu

SEQ ID NO: 2104555 - RNA, 18 nt, Staphylococcus aureus subsp. aureus MW2
uuauauuuuauuuaaaaa

SEQ ID NO: 2104556 - RNA, 13 nt, Staphylococcus aureus subsp. aureus MW2
uuauauuuuauuu

SEQ ID NO: 2104557 - RNA, 18 nt, Staphylococcus aureus subsp. aureus MW2
uuauauugcaaaaauaau

SEQ ID NO: 2104558 - RNA, 19 nt, Staphylococcus aureus subsp. aureus MW2
uuauauucaacuuauuauu

SEQ ID NO: 2104559 - RNA, 18 nt, Staphylococcus aureus subsp. aureus MW2
uuauauugcgaaaaauaa

SEQ ID NO: 2104560 - RNA, 14 nt, Staphylococcus aureus subsp. aureus MW2
uuauauuguauuuu

SEQ ID NO: 2104561 - RNA, 16 nt, Staphylococcus aureus subsp. aureus MW2
uuauauuguauuuuau

SEQ ID NO: 2104562 - RNA, 19 nt, Staphylococcus aureus subsp. aureus MW2
uuauauuggcaguucugaa

SEQ ID NO: 2104563 - RNA, 18 nt, Staphylococcus aureus subsp. aureus MW2
uuauauuuaaaugcuuuc

SEQ ID NO: 2104564 - RNA, 23 nt, Staphylococcus aureus subsp. aureus MW2
uuauauuuaugauaauuaauuaa

SEQ ID NO: 2104565 - RNA, 16 nt, Staphylococcus aureus subsp. aureus MW2
uuaguuugacaucuau

SEQ ID NO: 2104566 - RNA, 19 nt, Staphylococcus aureus subsp. aureus MW2
uuagucauugaaaauauuu

SEQ ID NO: 2104567 - RNA, 15 nt, Staphylococcus aureus subsp. aureus MW2
uuaguauuucaucau

SEQ ID NO: 2104568 - RNA, 14 nt, Staphylococcus aureus subsp. aureus MW2
uuagugaaaauacc

SEQ ID NO: 2104569 - RNA, 23 nt, Staphylococcus aureus subsp. aureus MW2
uuagugacaaguaugucaucuuc

SEQ ID NO: 2104570 - RNA, 21 nt, Staphylococcus aureus subsp. aureus MW2
uuaggcuuauuaacuuuuccu

SEQ ID NO: 2104571 - RNA, 17 nt, Staphylococcus aureus subsp. aureus MW2
uuaggcuuaaauauaau

SEQ ID NO: 2104572 - RNA, 18 nt, Staphylococcus aureus subsp. aureus MW2
uuagguuaauuaaacaag

SEQ ID NO: 2104573 - RNA, 14 nt, Staphylococcus aureus subsp. aureus MW2
uuagguuacuuauu

SEQ ID NO: 2104574 - RNA, 15 nt, Staphylococcus aureus subsp. aureus MW2
uuagguccuuucaca

SEQ ID NO: 2104575 - RNA, 19 nt, Staphylococcus aureus subsp. aureus MW2
uuaggucuacgaucaaaau

SEQ ID NO: 2104576 - RNA, 15 nt, Staphylococcus aureus subsp. aureus MW2
uuaguacaaaauugu

SEQ ID NO: 2104577 - RNA, 12 nt, Staphylococcus aureus subsp. aureus MW2
uuaguaauaaca

SEQ ID NO: 2104578 - RNA, 15 nt, Staphylococcus aureus subsp. aureus MW2
uuaguaauuuuacaa

SEQ ID NO: 2104579 - RNA, 14 nt, Staphylococcus aureus subsp. aureus MW2
uuaguacuaaaccg

SEQ ID NO: 2104580 - RNA, 19 nt, Staphylococcus aureus subsp. aureus MW2
uuaguaauaacaucuaaau

SEQ ID NO: 2104581 - RNA, 19 nt, Staphylococcus aureus subsp. aureus MW2
uuaguaaggaauauuuccc

SEQ ID NO: 2104582 - RNA, 18 nt, Staphylococcus aureus subsp. aureus MW2
uuaguaaguuguacuucu

SEQ ID NO: 2104583 - RNA, 22 nt, Staphylococcus aureus subsp. aureus MW2
uuaguaagauuaccuacaauaa

SEQ ID NO: 2104584 - RNA, 15 nt, Staphylococcus aureus subsp. aureus MW2
uuaguaaggaauauu

SEQ ID NO: 2104585 - RNA, 20 nt, Staphylococcus aureus subsp. aureus MW2
uuaguacauauguuguuucu

SEQ ID NO: 2104586 - RNA, 24 nt, Staphylococcus aureus subsp. aureus MW2
uuaguacuaaaccgauuaauauaa

SEQ ID NO: 2104587 - RNA, 16 nt, Staphylococcus aureus subsp. aureus MW2
uuaguacuuaauacua

SEQ ID NO: 2104588 - RNA, 14 nt, Staphylococcus aureus subsp. aureus MW2
uuaguaucuauaca

SEQ ID NO: 2104589 - RNA, 16 nt, Staphylococcus aureus subsp. aureus MW2
uuaguauggaauaaau

SEQ ID NO: 2104590 - RNA, 19 nt, Staphylococcus aureus subsp. aureus MW2
uuaguauggaauaaauggu

SEQ ID NO: 2104591 - RNA, 19 nt, Staphylococcus aureus subsp. aureus MW2
uuaguaucgauaguucuau

SEQ ID NO: 2104592 - RNA, 18 nt, Staphylococcus aureus subsp. aureus MW2
ugcugcuaaaauaacaac

SEQ ID NO: 2104593 - RNA, 17 nt, Staphylococcus aureus subsp. aureus MW2
ugcugaaugaagcauuu

SEQ ID NO: 2104594 - RNA, 15 nt, Staphylococcus aureus subsp. aureus MW2
ugcuucgucauuagg

SEQ ID NO: 2104595 - RNA, 18 nt, Staphylococcus aureus subsp. aureus MW2
ugcuucugguucuucaau

SEQ ID NO: 2104596 - RNA, 17 nt, Staphylococcus aureus subsp. aureus MW2
ugcuucugguucuucaa

SEQ ID NO: 2104597 - RNA, 20 nt, Staphylococcus aureus subsp. aureus MW2
ugcuucauuauauaauucuu

SEQ ID NO: 2104598 - RNA, 12 nt, Staphylococcus aureus subsp. aureus MW2
ugcuuacaauaa

SEQ ID NO: 2104599 - RNA, 19 nt, Staphylococcus aureus subsp. aureus MW2
ugcuuaauuuguuuuaaau

SEQ ID NO: 2104600 - RNA, 15 nt, Staphylococcus aureus subsp. aureus MW2
ugcuguuuuauucaa

SEQ ID NO: 2104601 - RNA, 14 nt, Staphylococcus aureus subsp. aureus MW2
ugcuguuuuuauua

SEQ ID NO: 2104602 - RNA, 18 nt, Staphylococcus aureus subsp. aureus MW2
ugcuguuuuuauuauaau

SEQ ID NO: 2104603 - RNA, 12 nt, Staphylococcus aureus subsp. aureus MW2
ugcuucuuauca

SEQ ID NO: 2104604 - RNA, 17 nt, Staphylococcus aureus subsp. aureus MW2
ugcuuguccucuaaaac

SEQ ID NO: 2104605 - RNA, 19 nt, Staphylococcus aureus subsp. aureus MW2
ugcuuugcauacauaucuu

SEQ ID NO: 2104606 - RNA, 14 nt, Staphylococcus aureus subsp. aureus MW2
ugcuuugauuucau

SEQ ID NO: 2104607 - RNA, 17 nt, Staphylococcus aureus subsp. aureus MW2
ugcuuuuguuaauauug

SEQ ID NO: 2104608 - RNA, 19 nt, Staphylococcus aureus subsp. aureus MW2
ugcuuugagcaauaaugcc

SEQ ID NO: 2104609 - RNA, 17 nt, Staphylococcus aureus subsp. aureus MW2
ugcuuuggaguuucuuc

SEQ ID NO: 2104610 - RNA, 14 nt, Staphylococcus aureus subsp. aureus MW2
ugcuuucgcauuau

SEQ ID NO: 2104611 - RNA, 22 nt, Staphylococcus aureus subsp. aureus MW2
uggaaaguaauaaguaauaauu

SEQ ID NO: 2104612 - RNA, 16 nt, Staphylococcus aureus subsp. aureus MW2
uggaaaguaauaagua

SEQ ID NO: 2104613 - RNA, 18 nt, Staphylococcus aureus subsp. aureus MW2
uggaaauuuauuauaaaa

SEQ ID NO: 2104614 - RNA, 22 nt, Staphylococcus aureus subsp. aureus MW2
uggaaauuuauuauaaaauaga

SEQ ID NO: 2104615 - RNA, 23 nt, Staphylococcus aureus subsp. aureus MW2
uggaaauuuauuauaaaauagaa

SEQ ID NO: 2104616 - RNA, 13 nt, Staphylococcus aureus subsp. aureus MW2
uggaaauuuauua

SEQ ID NO: 2104617 - RNA, 14 nt, Staphylococcus aureus subsp. aureus MW2
uggaaauuuauuau

SEQ ID NO: 2104618 - RNA, 15 nt, Staphylococcus aureus subsp. aureus MW2
ugcuuuuuuuacaau

SEQ ID NO: 2104619 - RNA, 12 nt, Staphylococcus aureus subsp. aureus MW2
ugcuuuuuuaaa

SEQ ID NO: 2104620 - RNA, 13 nt, Staphylococcus aureus subsp. aureus MW2
ugcuuuuuuagaa

SEQ ID NO: 2104621 - RNA, 20 nt, Staphylococcus aureus subsp. aureus MW2
ugcuuuuuguguaucuguaa

SEQ ID NO: 2104622 - RNA, 17 nt, Staphylococcus aureus subsp. aureus MW2
ugcuuuuucaaaaucuu

SEQ ID NO: 2104623 - RNA, 17 nt, Staphylococcus aureus subsp. aureus MW2
ugcuuuuucauaaauau

SEQ ID NO: 2104624 - RNA, 18 nt, Staphylococcus aureus subsp. aureus MW2
uggaaguauauguuacuc

SEQ ID NO: 2104625 - RNA, 19 nt, Staphylococcus aureus subsp. aureus MW2
uggaacauuaaguucuuag

SEQ ID NO: 2104626 - RNA, 15 nt, Staphylococcus aureus subsp. aureus MW2
uggaaauuuauuaua

SEQ ID NO: 2104627 - RNA, 16 nt, Staphylococcus aureus subsp. aureus MW2
uggaaauuuauuauaa

SEQ ID NO: 2104628 - RNA, 16 nt, Staphylococcus aureus subsp. aureus MW2
uggaaguuguugcuuu

SEQ ID NO: 2104629 - RNA, 18 nt, Staphylococcus aureus subsp. aureus MW2
uggaauaaauuuauaacu

SEQ ID NO: 2104630 - RNA, 20 nt, Staphylococcus aureus subsp. aureus MW2
uggaauacucuuuaaucuac

SEQ ID NO: 2104631 - RNA, 19 nt, Staphylococcus aureus subsp. aureus MW2
uggaauacuugucaaaauu

SEQ ID NO: 2104632 - RNA, 15 nt, Staphylococcus aureus subsp. aureus MW2
uggaauacuuuucuu

SEQ ID NO: 2104633 - RNA, 21 nt, Staphylococcus aureus subsp. aureus MW2
uggaauaaugaugauacugau

SEQ ID NO: 2104634 - RNA, 22 nt, Staphylococcus aureus subsp. aureus MW2
uggaaucauuuucuugauuuua

SEQ ID NO: 2104635 - RNA, 21 nt, Staphylococcus aureus subsp. aureus MW2
uggaaugguauagauuuuaua

SEQ ID NO: 2104636 - RNA, 18 nt, Staphylococcus aureus subsp. aureus MW2
uggacauuguaaaaugcu

SEQ ID NO: 2104637 - RNA, 13 nt, Staphylococcus aureus subsp. aureus MW2
ugcucuaagcauu

SEQ ID NO: 2104638 - RNA, 22 nt, Staphylococcus aureus subsp. aureus MW2
ugcucuaaacuucuauuaauaa

SEQ ID NO: 2104639 - RNA, 14 nt, Staphylococcus aureus subsp. aureus MW2
ugcucuaugcuuuu

SEQ ID NO: 2104640 - RNA, 20 nt, Staphylococcus aureus subsp. aureus MW2
ugcugaaucgaguuugaaau

SEQ ID NO: 2104641 - RNA, 23 nt, Staphylococcus aureus subsp. aureus MW2
ugcuaaaaaaauuaaaauguuaa

SEQ ID NO: 2104642 - RNA, 16 nt, Staphylococcus aureus subsp. aureus MW2
ugcuaaaaaguuagca

SEQ ID NO: 2104643 - RNA, 21 nt, Staphylococcus aureus subsp. aureus MW2
ugcuaaauauuauaaaaagau

SEQ ID NO: 2104644 - RNA, 21 nt, Staphylococcus aureus subsp. aureus MW2
ugcuaaaguguagccaaauaa

SEQ ID NO: 2104645 - RNA, 20 nt, Staphylococcus aureus subsp. aureus MW2
ugcuaaucuucucauaaaau

SEQ ID NO: 2104646 - RNA, 17 nt, Staphylococcus aureus subsp. aureus MW2
ugcuacaauuuccuacc

SEQ ID NO: 2104647 - RNA, 20 nt, Staphylococcus aureus subsp. aureus MW2
ugcuacagcacgagacaaua

SEQ ID NO: 2104648 - RNA, 18 nt, Staphylococcus aureus subsp. aureus MW2
ugcuacccaccuuucuuu

SEQ ID NO: 2104649 - RNA, 19 nt, Staphylococcus aureus subsp. aureus MW2
ugcuagcuuucuuuuucau

SEQ ID NO: 2104650 - RNA, 14 nt, Staphylococcus aureus subsp. aureus MW2
ugcuauguaaaucg

SEQ ID NO: 2104651 - RNA, 16 nt, Staphylococcus aureus subsp. aureus MW2
ugcuauuuuuuuaaua

SEQ ID NO: 2104652 - RNA, 16 nt, Staphylococcus aureus subsp. aureus MW2
ugcgcucuuuucuugu

SEQ ID NO: 2104653 - RNA, 11 nt, Staphylococcus aureus subsp. aureus MW2
ugccauaccug

SEQ ID NO: 2104654 - RNA, 18 nt, Staphylococcus aureus subsp. aureus MW2
ugccauacccauauuaaa

SEQ ID NO: 2104655 - RNA, 13 nt, Staphylococcus aureus subsp. aureus MW2
ugccauauguuuu

SEQ ID NO: 2104656 - RNA, 23 nt, Staphylococcus aureus subsp. aureus MW2
ugccaucaauuucgacuccauua

SEQ ID NO: 2104657 - RNA, 17 nt, Staphylococcus aureus subsp. aureus MW2
ugcccaccauguacauu

SEQ ID NO: 2104658 - RNA, 17 nt, Staphylococcus aureus subsp. aureus MW2
ugccaauaaaaugcaau

SEQ ID NO: 2104659 - RNA, 15 nt, Staphylococcus aureus subsp. aureus MW2
ugcccuuauauuuuu

SEQ ID NO: 2104660 - RNA, 15 nt, Staphylococcus aureus subsp. aureus MW2
ugcgauuacagugug

SEQ ID NO: 2104661 - RNA, 18 nt, Staphylococcus aureus subsp. aureus MW2
ugcgauaagcaaaaauuc

SEQ ID NO: 2104662 - RNA, 15 nt, Staphylococcus aureus subsp. aureus MW2
ugcgaauuguuagau

SEQ ID NO: 2104663 - RNA, 14 nt, Staphylococcus aureus subsp. aureus MW2
ugcgaauaauaaua

SEQ ID NO: 2104664 - RNA, 20 nt, Staphylococcus aureus subsp. aureus MW2
ugccuuuuuguaauuguaau

SEQ ID NO: 2104665 - RNA, 13 nt, Staphylococcus aureus subsp. aureus MW2
ugccuuuuuguaa

SEQ ID NO: 2104666 - RNA, 22 nt, Staphylococcus aureus subsp. aureus MW2
ugcgacaucgccaauuugauua

SEQ ID NO: 2104667 - RNA, 23 nt, Staphylococcus aureus subsp. aureus MW2
ugccguaucuauaaaaagaauau

SEQ ID NO: 2104668 - RNA, 17 nt, Staphylococcus aureus subsp. aureus MW2
ugccguaucuauaaaaa

SEQ ID NO: 2104669 - RNA, 21 nt, Staphylococcus aureus subsp. aureus MW2
ugccguauuucaaauguaauu

SEQ ID NO: 2104670 - RNA, 15 nt, Staphylococcus aureus subsp. aureus MW2
ugccguccauuucca

SEQ ID NO: 2104671 - RNA, 18 nt, Staphylococcus aureus subsp. aureus MW2
ugccggcuuuuucuuuug

SEQ ID NO: 2104672 - RNA, 16 nt, Staphylococcus aureus subsp. aureus MW2
ugccuugucuauugua

SEQ ID NO: 2104673 - RNA, 21 nt, Staphylococcus aureus subsp. aureus MW2
ugccuuuaccgugaauauaau

SEQ ID NO: 2104674 - RNA, 15 nt, Staphylococcus aureus subsp. aureus MW2
ugccuuaucagcauu

SEQ ID NO: 2104675 - RNA, 17 nt, Staphylococcus aureus subsp. aureus MW2
ugccuuaacuucauaau

SEQ ID NO: 2104676 - RNA, 16 nt, Staphylococcus aureus subsp. aureus MW2
ugccuauuuuuuuaug

SEQ ID NO: 2104677 - RNA, 20 nt, Staphylococcus aureus subsp. aureus MW2
ugccucaguuagaagaugau

SEQ ID NO: 2104678 - RNA, 23 nt, Staphylococcus aureus subsp. aureus MW2
ugaaucugcuaauuuauaaacaa

SEQ ID NO: 2104679 - RNA, 23 nt, Staphylococcus aureus subsp. aureus MW2
ugaaucuuauuuuguuuuaaaaa

SEQ ID NO: 2104680 - RNA, 20 nt, Staphylococcus aureus subsp. aureus MW2
ugaaucuuauuuuguuuuaa

SEQ ID NO: 2104681 - RNA, 13 nt, Staphylococcus aureus subsp. aureus MW2
ugaaugaagcauu

SEQ ID NO: 2104682 - RNA, 17 nt, Staphylococcus aureus subsp. aureus MW2
ugaaugaagcauuuuau

SEQ ID NO: 2104683 - RNA, 18 nt, Staphylococcus aureus subsp. aureus MW2
ugaaucgcauuuaaauau

SEQ ID NO: 2104684 - RNA, 20 nt, Staphylococcus aureus subsp. aureus MW2
ugaaucgauauaaugaaguu

SEQ ID NO: 2104685 - RNA, 16 nt, Staphylococcus aureus subsp. aureus MW2
ugaauauuauucauaa

SEQ ID NO: 2104686 - RNA, 13 nt, Staphylococcus aureus subsp. aureus MW2
ugaauauuauuca

SEQ ID NO: 2104687 - RNA, 19 nt, Staphylococcus aureus subsp. aureus MW2
ugaauauguguagugaaaa

SEQ ID NO: 2104688 - RNA, 14 nt, Staphylococcus aureus subsp. aureus MW2
ugaauaucuaaugc

SEQ ID NO: 2104689 - RNA, 22 nt, Staphylococcus aureus subsp. aureus MW2
ugaauauacuuaauuuaaaucu

SEQ ID NO: 2104690 - RNA, 14 nt, Staphylococcus aureus subsp. aureus MW2
ugaauaauugagaa

SEQ ID NO: 2104691 - RNA, 16 nt, Staphylococcus aureus subsp. aureus MW2
ugaauaauugagaaaa

SEQ ID NO: 2104692 - RNA, 17 nt, Staphylococcus aureus subsp. aureus MW2
ugaauaauugagaaaaa

SEQ ID NO: 2104693 - RNA, 18 nt, Staphylococcus aureus subsp. aureus MW2
ugaauaauguuuucauug

SEQ ID NO: 2104694 - RNA, 22 nt, Staphylococcus aureus subsp. aureus MW2
ugaauaauuacuaaaauaucaa

SEQ ID NO: 2104695 - RNA, 11 nt, Staphylococcus aureus subsp. aureus MW2
ugaauaauucc

SEQ ID NO: 2104696 - RNA, 14 nt, Staphylococcus aureus subsp. aureus MW2
ugaauaauggaugu

SEQ ID NO: 2104697 - RNA, 23 nt, Staphylococcus aureus subsp. aureus MW2
ucuuucaauuaauuuaaaugcuu

SEQ ID NO: 2104698 - RNA, 18 nt, Staphylococcus aureus subsp. aureus MW2
ucuuucaauuaauuuaaa

SEQ ID NO: 2104699 - RNA, 21 nt, Staphylococcus aureus subsp. aureus MW2
ucuuuauuugauucuucacca

SEQ ID NO: 2104700 - RNA, 13 nt, Staphylococcus aureus subsp. aureus MW2
ucuuuauaacuuu

SEQ ID NO: 2104701 - RNA, 18 nt, Staphylococcus aureus subsp. aureus MW2
ucuuuauuuuuuaucauu

SEQ ID NO: 2104702 - RNA, 15 nt, Staphylococcus aureus subsp. aureus MW2
ucuuucaauuaauuu

SEQ ID NO: 2104703 - RNA, 14 nt, Staphylococcus aureus subsp. aureus MW2
ucuuucaaugcaua

SEQ ID NO: 2104704 - RNA, 13 nt, Staphylococcus aureus subsp. aureus MW2
ucuuuauuuaaag

SEQ ID NO: 2104705 - RNA, 19 nt, Staphylococcus aureus subsp. aureus MW2
ucuuuauuuuaaacaugaa

SEQ ID NO: 2104706 - RNA, 18 nt, Staphylococcus aureus subsp. aureus MW2
ucuuuauauauaaaauca

SEQ ID NO: 2104707 - RNA, 14 nt, Staphylococcus aureus subsp. aureus MW2
ucuuuauaugagaa

SEQ ID NO: 2104708 - RNA, 13 nt, Staphylococcus aureus subsp. aureus MW2
ugaauugaaaaau

SEQ ID NO: 2104709 - RNA, 14 nt, Staphylococcus aureus subsp. aureus MW2
ugaauucauuuuau

SEQ ID NO: 2104710 - RNA, 18 nt, Staphylococcus aureus subsp. aureus MW2
ugaauuauuuaaaaugcu

SEQ ID NO: 2104711 - RNA, 17 nt, Staphylococcus aureus subsp. aureus MW2
ugaauuaugaucaauaa

SEQ ID NO: 2104712 - RNA, 14 nt, Staphylococcus aureus subsp. aureus MW2
ugaaugauauuaac

SEQ ID NO: 2104713 - RNA, 14 nt, Staphylococcus aureus subsp. aureus MW2
ugaaugaugcugcc

SEQ ID NO: 2104714 - RNA, 21 nt, Staphylococcus aureus subsp. aureus MW2
ugaaugaaguaauauauaaaa

SEQ ID NO: 2104715 - RNA, 21 nt, Staphylococcus aureus subsp. aureus MW2
ugaauuuagcaucaaaaauaa

SEQ ID NO: 2104716 - RNA, 14 nt, Staphylococcus aureus subsp. aureus MW2
ugaauuuagcauca

SEQ ID NO: 2104717 - RNA, 18 nt, Staphylococcus aureus subsp. aureus MW2
ugaauuuacuccuuacaa

SEQ ID NO: 2104718 - RNA, 18 nt, Staphylococcus aureus subsp. aureus MW2
ugaauugguugaucaauu

SEQ ID NO: 2104719 - RNA, 19 nt, Staphylococcus aureus subsp. aureus MW2
ugacaaguaugucaucuuc

SEQ ID NO: 2104720 - RNA, 15 nt, Staphylococcus aureus subsp. aureus MW2
ugacaagagacugaa

SEQ ID NO: 2104721 - RNA, 14 nt, Staphylococcus aureus subsp. aureus MW2
ugacaacauaacaa

SEQ ID NO: 2104722 - RNA, 15 nt, Staphylococcus aureus subsp. aureus MW2
ugacaaauuaaaaag

SEQ ID NO: 2104723 - RNA, 13 nt, Staphylococcus aureus subsp. aureus MW2
ugacauaaaacuu

SEQ ID NO: 2104724 - RNA, 13 nt, Staphylococcus aureus subsp. aureus MW2
ugacaguuuccau

SEQ ID NO: 2104725 - RNA, 22 nt, Staphylococcus aureus subsp. aureus MW2
ugacauaucgauauucuccaac

SEQ ID NO: 2104726 - RNA, 19 nt, Staphylococcus aureus subsp. aureus MW2
ugacaccuaauaccauugu

SEQ ID NO: 2104727 - RNA, 17 nt, Staphylococcus aureus subsp. aureus MW2
ugaccauuaucaagaac

SEQ ID NO: 2104728 - RNA, 23 nt, Staphylococcus aureus subsp. aureus MW2
ugaccaucuggcguuaaccauuu

SEQ ID NO: 2104729 - RNA, 16 nt, Staphylococcus aureus subsp. aureus MW2
ugacugcaaauacgag

SEQ ID NO: 2104730 - RNA, 21 nt, Staphylococcus aureus subsp. aureus MW2
ugacucggggaauuuuuaugc

SEQ ID NO: 2104731 - RNA, 18 nt, Staphylococcus aureus subsp. aureus MW2
ugacucaaagauauacuu

SEQ ID NO: 2104732 - RNA, 18 nt, Staphylococcus aureus subsp. aureus MW2
ugagaaaaauauuucuaa

SEQ ID NO: 2104733 - RNA, 20 nt, Staphylococcus aureus subsp. aureus MW2
ugagaaaaauauuucuaaua

SEQ ID NO: 2104734 - RNA, 16 nt, Staphylococcus aureus subsp. aureus MW2
ugacuuuuauaauucu

SEQ ID NO: 2104735 - RNA, 14 nt, Staphylococcus aureus subsp. aureus MW2
ugacuuuuauaauu

SEQ ID NO: 2104736 - RNA, 13 nt, Staphylococcus aureus subsp. aureus MW2
ugacuuuuuaaua

SEQ ID NO: 2104737 - RNA, 16 nt, Staphylococcus aureus subsp. aureus MW2
ugacuuuuaaaaaaca

SEQ ID NO: 2104738 - RNA, 19 nt, Staphylococcus aureus subsp. aureus MW2
ugacuuuauuucuauaucu

SEQ ID NO: 2104739 - RNA, 14 nt, Staphylococcus aureus subsp. aureus MW2
ugacuuuagcauuc

SEQ ID NO: 2104740 - RNA, 16 nt, Staphylococcus aureus subsp. aureus MW2
ugacuuuaauugcucu

SEQ ID NO: 2104741 - RNA, 13 nt, Staphylococcus aureus subsp. aureus MW2
ugagauggucuuu

SEQ ID NO: 2104742 - RNA, 23 nt, Staphylococcus aureus subsp. aureus MW2
ugagauccaccguuaaaauauau

SEQ ID NO: 2104743 - RNA, 21 nt, Staphylococcus aureus subsp. aureus MW2
ugagauugcuaguuuuuuauu

SEQ ID NO: 2104744 - RNA, 16 nt, Staphylococcus aureus subsp. aureus MW2
ugagauuaucuuuaga

SEQ ID NO: 2104745 - RNA, 22 nt, Staphylococcus aureus subsp. aureus MW2
ugagauuauuuuuuuaaaucua

SEQ ID NO: 2104746 - RNA, 19 nt, Staphylococcus aureus subsp. aureus MW2
ugagaauauuuauuguuuu

SEQ ID NO: 2104747 - RNA, 19 nt, Staphylococcus aureus subsp. aureus MW2
ugagggccccaacacagaa

SEQ ID NO: 2104748 - RNA, 13 nt, Staphylococcus aureus subsp. aureus MW2
ugagggccccaac

SEQ ID NO: 2104749 - RNA, 14 nt, Staphylococcus aureus subsp. aureus MW2
ugagggccccaaca

SEQ ID NO: 2104750 - RNA, 18 nt, Staphylococcus aureus subsp. aureus MW2
ugaggcccauaaauuacu

SEQ ID NO: 2104751 - RNA, 13 nt, Staphylococcus aureus subsp. aureus MW2
ugaguauuacuug

SEQ ID NO: 2104752 - RNA, 20 nt, Staphylococcus aureus subsp. aureus MW2
ugaguaucaugcuuuuuaau

SEQ ID NO: 2104753 - RNA, 16 nt, Staphylococcus aureus subsp. aureus MW2
ugaguauccaauacua

SEQ ID NO: 2104754 - RNA, 22 nt, Staphylococcus aureus subsp. aureus MW2
ugaguauuugccuuuuuuauuu

SEQ ID NO: 2104755 - RNA, 22 nt, Staphylococcus aureus subsp. aureus MW2
ugagucuuuuugauuaaaguug

SEQ ID NO: 2104756 - RNA, 17 nt, Staphylococcus aureus subsp. aureus MW2
ugaguaggcucuuaaug

SEQ ID NO: 2104757 - RNA, 13 nt, Staphylococcus aureus subsp. aureus MW2
ugaguacaacaua

SEQ ID NO: 2104758 - RNA, 18 nt, Staphylococcus aureus subsp. aureus MW2
ugaggauacauaaaucua

SEQ ID NO: 2104759 - RNA, 19 nt, Staphylococcus aureus subsp. aureus MW2
ugagcuuuguuugaaacaa

SEQ ID NO: 2104760 - RNA, 16 nt, Staphylococcus aureus subsp. aureus MW2
ugagcuucuuuaaaua

SEQ ID NO: 2104761 - RNA, 17 nt, Staphylococcus aureus subsp. aureus MW2
ugagcuucuuuaaauac

SEQ ID NO: 2104762 - RNA, 20 nt, Staphylococcus aureus subsp. aureus MW2
ugagcuguuacacuuuucuu

SEQ ID NO: 2104763 - RNA, 19 nt, Staphylococcus aureus subsp. aureus MW2
ugcaggcaucauaucauac

SEQ ID NO: 2104764 - RNA, 19 nt, Staphylococcus aureus subsp. aureus MW2
ugcaggauaacguucacuu

SEQ ID NO: 2104765 - RNA, 16 nt, Staphylococcus aureus subsp. aureus MW2
ugcagcuguauaacca

SEQ ID NO: 2104766 - RNA, 14 nt, Staphylococcus aureus subsp. aureus MW2
ugcagauaauugaa

SEQ ID NO: 2104767 - RNA, 20 nt, Staphylococcus aureus subsp. aureus MW2
ugcagauugauauaaauuau

SEQ ID NO: 2104768 - RNA, 20 nt, Staphylococcus aureus subsp. aureus MW2
ugcagauucuucaccaacuu

SEQ ID NO: 2104769 - RNA, 23 nt, Staphylococcus aureus subsp. aureus MW2
ugcagcaacugcauuacgcuguc

SEQ ID NO: 2104770 - RNA, 21 nt, Staphylococcus aureus subsp. aureus MW2
ugcaauaacaccaauugaaua

SEQ ID NO: 2104771 - RNA, 12 nt, Staphylococcus aureus subsp. aureus MW2
ugcaaguugggg

SEQ ID NO: 2104772 - RNA, 16 nt, Staphylococcus aureus subsp. aureus MW2
ugcaaguugggguggg

SEQ ID NO: 2104773 - RNA, 22 nt, Staphylococcus aureus subsp. aureus MW2
ugcaaguuggggugugggcccc

SEQ ID NO: 2104774 - RNA, 22 nt, Staphylococcus aureus subsp. aureus MW2
ugcaauaauaaauaggaugaaa

SEQ ID NO: 2104775 - RNA, 14 nt, Staphylococcus aureus subsp. aureus MW2
ugcaauaauaaaua

SEQ ID NO: 2104776 - RNA, 14 nt, Staphylococcus aureus subsp. aureus MW2
ugcaauaauuacua

SEQ ID NO: 2104777 - RNA, 12 nt, Staphylococcus aureus subsp. aureus MW2
ugcaaguauuuu

SEQ ID NO: 2104778 - RNA, 19 nt, Staphylococcus aureus subsp. aureus MW2
ugcaaacuugauucaauau

SEQ ID NO: 2104779 - RNA, 14 nt, Staphylococcus aureus subsp. aureus MW2
ugcaauuuguaaua

SEQ ID NO: 2104780 - RNA, 15 nt, Staphylococcus aureus subsp. aureus MW2
ugcaauacauuaaua

SEQ ID NO: 2104781 - RNA, 20 nt, Staphylococcus aureus subsp. aureus MW2
ugcaaucguauguaacaauu

SEQ ID NO: 2104782 - RNA, 15 nt, Staphylococcus aureus subsp. aureus MW2
ugcaaucguugaaaa

SEQ ID NO: 2104783 - RNA, 15 nt, Staphylococcus aureus subsp. aureus MW2
ugcacacauaccuca

SEQ ID NO: 2104784 - RNA, 16 nt, Staphylococcus aureus subsp. aureus MW2
ugcaauuuuuuaugua

SEQ ID NO: 2104785 - RNA, 19 nt, Staphylococcus aureus subsp. aureus MW2
ugcaauuuuuuauguauua

SEQ ID NO: 2104786 - RNA, 15 nt, Staphylococcus aureus subsp. aureus MW2
ugcacaaauugcaau

SEQ ID NO: 2104787 - RNA, 13 nt, Staphylococcus aureus subsp. aureus MW2
ugcacuuuauuaa

SEQ ID NO: 2104788 - RNA, 19 nt, Staphylococcus aureus subsp. aureus MW2
ugcacuuuuuauacauuaa

SEQ ID NO: 2104789 - RNA, 15 nt, Staphylococcus aureus subsp. aureus MW2
ugcagaacguucuaa

SEQ ID NO: 2104790 - RNA, 17 nt, Staphylococcus aureus subsp. aureus MW2
ugcacuuacugcugcuu

SEQ ID NO: 2104791 - RNA, 20 nt, Staphylococcus aureus subsp. aureus MW2
ugcaccuggucguacuuuca

SEQ ID NO: 2104792 - RNA, 16 nt, Staphylococcus aureus subsp. aureus MW2
ugcaccuguuuuaauu

SEQ ID NO: 2104793 - RNA, 17 nt, Staphylococcus aureus subsp. aureus MW2
ugcaccuuuacaacaua

SEQ ID NO: 2104794 - RNA, 18 nt, Staphylococcus aureus subsp. aureus MW2
ugcacgaaugguucuucc

SEQ ID NO: 2104795 - RNA, 17 nt, Staphylococcus aureus subsp. aureus MW2
ugcacaguuucaucuuc

SEQ ID NO: 2104796 - RNA, 21 nt, Staphylococcus aureus subsp. aureus MW2
ugcacauaaaaaaugugaccu

SEQ ID NO: 2104797 - RNA, 23 nt, Staphylococcus aureus subsp. aureus MW2
ugcacaucauaauaaaucuaucu

SEQ ID NO: 2104798 - RNA, 19 nt, Staphylococcus aureus subsp. aureus MW2
ugauauaccuugauucauu

SEQ ID NO: 2104799 - RNA, 22 nt, Staphylococcus aureus subsp. aureus MW2
ugauauauaaccauaguaacaa

SEQ ID NO: 2104800 - RNA, 13 nt, Staphylococcus aureus subsp. aureus MW2
ugauauauaacca

SEQ ID NO: 2104801 - RNA, 22 nt, Staphylococcus aureus subsp. aureus MW2
ugaguguguccaucauuugugu

SEQ ID NO: 2104802 - RNA, 12 nt, Staphylococcus aureus subsp. aureus MW2
ugauauuuaccg

SEQ ID NO: 2104803 - RNA, 22 nt, Staphylococcus aureus subsp. aureus MW2
ugauauccaaagcuugauuuaa

SEQ ID NO: 2104804 - RNA, 20 nt, Staphylococcus aureus subsp. aureus MW2
ugauaucaucugcaagugcu

SEQ ID NO: 2104805 - RNA, 17 nt, Staphylococcus aureus subsp. aureus MW2
ugauauauguaacauaa

SEQ ID NO: 2104806 - RNA, 20 nt, Staphylococcus aureus subsp. aureus MW2
ugauccuggaaucgaaaaua

SEQ ID NO: 2104807 - RNA, 15 nt, Staphylococcus aureus subsp. aureus MW2
ugaugagauaaaauc

SEQ ID NO: 2104808 - RNA, 19 nt, Staphylococcus aureus subsp. aureus MW2
ugaugcgcuucuaacucac

SEQ ID NO: 2104809 - RNA, 12 nt, Staphylococcus aureus subsp. aureus MW2
ugaugacaucaa

SEQ ID NO: 2104810 - RNA, 18 nt, Staphylococcus aureus subsp. aureus MW2
ugaugaauuguuguacau

SEQ ID NO: 2104811 - RNA, 16 nt, Staphylococcus aureus subsp. aureus MW2
ugaugacaucaauauc

SEQ ID NO: 2104812 - RNA, 16 nt, Staphylococcus aureus subsp. aureus MW2
ugauuuguuacuucua

SEQ ID NO: 2104813 - RNA, 23 nt, Staphylococcus aureus subsp. aureus MW2
ugauuuguuacuucuaauaguaa

SEQ ID NO: 2104814 - RNA, 15 nt, Staphylococcus aureus subsp. aureus MW2
ugauuuguuacuucu

SEQ ID NO: 2104815 - RNA, 15 nt, Staphylococcus aureus subsp. aureus MW2
ugauuugauaauauu

SEQ ID NO: 2104816 - RNA, 17 nt, Staphylococcus aureus subsp. aureus MW2
ugauuugauaauauuau

SEQ ID NO: 2104817 - RNA, 15 nt, Staphylococcus aureus subsp. aureus MW2
ugauuugauuuaaau

SEQ ID NO: 2104818 - RNA, 23 nt, Staphylococcus aureus subsp. aureus MW2
ugcaaaaaaauggggacauguuc

SEQ ID NO: 2104819 - RNA, 12 nt, Staphylococcus aureus subsp. aureus MW2
ugauuuuucaua

SEQ ID NO: 2104820 - RNA, 24 nt, Staphylococcus aureus subsp. aureus MW2
ugauuuuucaucaauaucaaauuu

SEQ ID NO: 2104821 - RNA, 19 nt, Staphylococcus aureus subsp. aureus MW2
ugauucuauagcacugaaa

SEQ ID NO: 2104822 - RNA, 14 nt, Staphylococcus aureus subsp. aureus MW2
ugauucuaaauaau

SEQ ID NO: 2104823 - RNA, 19 nt, Staphylococcus aureus subsp. aureus MW2
ugauucgauaugaauaacc

SEQ ID NO: 2104824 - RNA, 17 nt, Staphylococcus aureus subsp. aureus MW2
ugauuuaaaaaaauuaa

SEQ ID NO: 2104825 - RNA, 22 nt, Staphylococcus aureus subsp. aureus MW2
ugauuuaaaaaaauuaauguuu

SEQ ID NO: 2104826 - RNA, 14 nt, Staphylococcus aureus subsp. aureus MW2
ugauuuaaaauauu

SEQ ID NO: 2104827 - RNA, 12 nt, Staphylococcus aureus subsp. aureus MW2
ugauuucauuug

SEQ ID NO: 2104828 - RNA, 13 nt, Staphylococcus aureus subsp. aureus MW2
ugauuuaauaaua

SEQ ID NO: 2104829 - RNA, 15 nt, Staphylococcus aureus subsp. aureus MW2
ugauuuaauaauauu

SEQ ID NO: 2104830 - RNA, 16 nt, Staphylococcus aureus subsp. aureus MW2
ugauuuaauaauauuu

SEQ ID NO: 2104831 - RNA, 17 nt, Staphylococcus aureus subsp. aureus MW2
ugauuuaagauuuaaua

SEQ ID NO: 2104832 - RNA, 14 nt, Staphylococcus aureus subsp. aureus MW2
ugauuuaauguuaa

SEQ ID NO: 2104833 - RNA, 14 nt, Staphylococcus aureus subsp. aureus MW2
ugauggucagcaaa

SEQ ID NO: 2104834 - RNA, 16 nt, Staphylococcus aureus subsp. aureus MW2
ugaugguuuaucuuuu

SEQ ID NO: 2104835 - RNA, 18 nt, Staphylococcus aureus subsp. aureus MW2
ugaugguuuaucuuuuuc

SEQ ID NO: 2104836 - RNA, 12 nt, Staphylococcus aureus subsp. aureus MW2
ugauguaauucu

SEQ ID NO: 2104837 - RNA, 15 nt, Staphylococcus aureus subsp. aureus MW2
ugauguaauucuguu

SEQ ID NO: 2104838 - RNA, 12 nt, Staphylococcus aureus subsp. aureus MW2
ugauucaaauaa

SEQ ID NO: 2104839 - RNA, 15 nt, Staphylococcus aureus subsp. aureus MW2
ugauuauucuucauu

SEQ ID NO: 2104840 - RNA, 22 nt, Staphylococcus aureus subsp. aureus MW2
ugauucaccagguuuuuuauuu

SEQ ID NO: 2104841 - RNA, 19 nt, Staphylococcus aureus subsp. aureus MW2
ugauuauauuuuucuucag

SEQ ID NO: 2104842 - RNA, 13 nt, Staphylococcus aureus subsp. aureus MW2
ugauuaucauaug

SEQ ID NO: 2104843 - RNA, 11 nt, Staphylococcus aureus subsp. aureus MW2
ugauuauuaca

SEQ ID NO: 2104844 - RNA, 20 nt, Staphylococcus aureus subsp. aureus MW2
ugauuauguucagaacuaca

SEQ ID NO: 2104845 - RNA, 19 nt, Staphylococcus aureus subsp. aureus MW2
ugauuauucguauucaaag

SEQ ID NO: 2104846 - RNA, 18 nt, Staphylococcus aureus subsp. aureus MW2
ugaugugccuuucuaaua

SEQ ID NO: 2104847 - RNA, 17 nt, Staphylococcus aureus subsp. aureus MW2
ugaugucgaaaauagcu

SEQ ID NO: 2104848 - RNA, 20 nt, Staphylococcus aureus subsp. aureus MW2
ugauguucaauauuuucaug

SEQ ID NO: 2104849 - RNA, 16 nt, Staphylococcus aureus subsp. aureus MW2
gaccuuacuacucauu

SEQ ID NO: 2104850 - RNA, 14 nt, Staphylococcus aureus subsp. aureus MW2
gaccuuauauuuua

SEQ ID NO: 2104851 - RNA, 19 nt, Staphylococcus aureus subsp. aureus MW2
gaccguauuuuuuuauaau

SEQ ID NO: 2104852 - RNA, 23 nt, Staphylococcus aureus subsp. aureus MW2
gacccuugucaguuuuuuuauaa

SEQ ID NO: 2104853 - RNA, 19 nt, Staphylococcus aureus subsp. aureus MW2
gaccauugucaugccuuca

SEQ ID NO: 2104854 - RNA, 23 nt, Staphylococcus aureus subsp. aureus MW2
gacgaaauaaauuuugagaaaau

SEQ ID NO: 2104855 - RNA, 21 nt, Staphylococcus aureus subsp. aureus MW2
gacgaaccauuuccgaauaaa

SEQ ID NO: 2104856 - RNA, 20 nt, Staphylococcus aureus subsp. aureus MW2
gacgauuuauuaguuuuuac

SEQ ID NO: 2104857 - RNA, 19 nt, Staphylococcus aureus subsp. aureus MW2
gacgauuuauuaguuuuua

SEQ ID NO: 2104858 - RNA, 21 nt, Staphylococcus aureus subsp. aureus MW2
gacgaucuucaugaacagcau

SEQ ID NO: 2104859 - RNA, 19 nt, Staphylococcus aureus subsp. aureus MW2
gacacauuuacuuaagaac

SEQ ID NO: 2104860 - RNA, 20 nt, Staphylococcus aureus subsp. aureus MW2
gacaauuuucgaugcauauu

SEQ ID NO: 2104861 - RNA, 17 nt, Staphylococcus aureus subsp. aureus MW2
gacacauuuacuuaaga

SEQ ID NO: 2104862 - RNA, 23 nt, Staphylococcus aureus subsp. aureus MW2
gacacguccgacaucauaaauga

SEQ ID NO: 2104863 - RNA, 19 nt, Staphylococcus aureus subsp. aureus MW2
gacagaaaugauauuuucg

SEQ ID NO: 2104864 - RNA, 18 nt, Staphylococcus aureus subsp. aureus MW2
gacacuuaacuuguguua

SEQ ID NO: 2104865 - RNA, 14 nt, Staphylococcus aureus subsp. aureus MW2
gacaauuauaauaa

SEQ ID NO: 2104866 - RNA, 19 nt, Staphylococcus aureus subsp. aureus MW2
gacaauuauaauaaaacuu

SEQ ID NO: 2104867 - RNA, 18 nt, Staphylococcus aureus subsp. aureus MW2
gacaaugcaaguuggggu

SEQ ID NO: 2104868 - RNA, 22 nt, Staphylococcus aureus subsp. aureus MW2
gacaaguugcugaauaaaauau

SEQ ID NO: 2104869 - RNA, 14 nt, Staphylococcus aureus subsp. aureus MW2
gacaacugauuuaa

SEQ ID NO: 2104870 - RNA, 15 nt, Staphylococcus aureus subsp. aureus MW2
gacaaggauugaaaa

SEQ ID NO: 2104871 - RNA, 21 nt, Staphylococcus aureus subsp. aureus MW2
gacaaccuaucacgauuucag

SEQ ID NO: 2104872 - RNA, 13 nt, Staphylococcus aureus subsp. aureus MW2
gacaaauguucua

SEQ ID NO: 2104873 - RNA, 15 nt, Staphylococcus aureus subsp. aureus MW2
gacaaagcuuguaau

SEQ ID NO: 2104874 - RNA, 13 nt, Staphylococcus aureus subsp. aureus MW2
gaauuuucguuca

SEQ ID NO: 2104875 - RNA, 16 nt, Staphylococcus aureus subsp. aureus MW2
gacaaaaauucuuucu

SEQ ID NO: 2104876 - RNA, 14 nt, Staphylococcus aureus subsp. aureus MW2
gaauuuuuuuaaug

SEQ ID NO: 2104877 - RNA, 20 nt, Staphylococcus aureus subsp. aureus MW2
cuuuguaaccuaaaaacaaa

SEQ ID NO: 2104878 - RNA, 14 nt, Staphylococcus aureus subsp. aureus MW2
cuuuguaaauuuuu

SEQ ID NO: 2104879 - RNA, 12 nt, Staphylococcus aureus subsp. aureus MW2
gaauuuuauaaa

SEQ ID NO: 2104880 - RNA, 14 nt, Staphylococcus aureus subsp. aureus MW2
gaauuuuauuuuuc

SEQ ID NO: 2104881 - RNA, 22 nt, Staphylococcus aureus subsp. aureus MW2
gaauuuuauuagguaauacuuu

SEQ ID NO: 2104882 - RNA, 17 nt, Staphylococcus aureus subsp. aureus MW2
cuuuguaaguauuuaaa

SEQ ID NO: 2104883 - RNA, 15 nt, Staphylococcus aureus subsp. aureus MW2
gaauuuuacguugaa

SEQ ID NO: 2104884 - RNA, 21 nt, Staphylococcus aureus subsp. aureus MW2
gaccacucaauucucuaacuu

SEQ ID NO: 2104885 - RNA, 15 nt, Staphylococcus aureus subsp. aureus MW2
gacauuuuuggcuug

SEQ ID NO: 2104886 - RNA, 23 nt, Staphylococcus aureus subsp. aureus MW2
gacauuuuuggcuuguuaagcag

SEQ ID NO: 2104887 - RNA, 13 nt, Staphylococcus aureus subsp. aureus MW2
gaccaaguaugag

SEQ ID NO: 2104888 - RNA, 14 nt, Staphylococcus aureus subsp. aureus MW2
gaccaaguaugaga

SEQ ID NO: 2104889 - RNA, 23 nt, Staphylococcus aureus subsp. aureus MW2
gaccaaguaugagacgcauugca

SEQ ID NO: 2104890 - RNA, 18 nt, Staphylococcus aureus subsp. aureus MW2
gaccagucgcauauuuug

SEQ ID NO: 2104891 - RNA, 15 nt, Staphylococcus aureus subsp. aureus MW2
gacauuuguaaauau

SEQ ID NO: 2104892 - RNA, 16 nt, Staphylococcus aureus subsp. aureus MW2
gacauuuguaaauauu

SEQ ID NO: 2104893 - RNA, 15 nt, Staphylococcus aureus subsp. aureus MW2
gacauuuucaaguuu

SEQ ID NO: 2104894 - RNA, 21 nt, Staphylococcus aureus subsp. aureus MW2
gacauuaaucaugcguuuuaa

SEQ ID NO: 2104895 - RNA, 18 nt, Staphylococcus aureus subsp. aureus MW2
gacauuacauuuaguaca

SEQ ID NO: 2104896 - RNA, 12 nt, Staphylococcus aureus subsp. aureus MW2
gacaucuagaug

SEQ ID NO: 2104897 - RNA, 18 nt, Staphylococcus aureus subsp. aureus MW2
gacaucaauaucuucuuc

SEQ ID NO: 2104898 - RNA, 14 nt, Staphylococcus aureus subsp. aureus MW2
gacauaaggucuug

SEQ ID NO: 2104899 - RNA, 21 nt, Staphylococcus aureus subsp. aureus MW2
gacauacagucaauacaaaac

SEQ ID NO: 2104900 - RNA, 22 nt, Staphylococcus aureus subsp. aureus MW2
gacauaccagguuauagaauac

SEQ ID NO: 2104901 - RNA, 11 nt, Staphylococcus aureus subsp. aureus MW2
gacaguuuuua

SEQ ID NO: 2104902 - RNA, 15 nt, Staphylococcus aureus subsp. aureus MW2
gacauaaaaaaauag

SEQ ID NO: 2104903 - RNA, 23 nt, Staphylococcus aureus subsp. aureus MW2
gacauaaaauuaacuuaaaauuu

SEQ ID NO: 2104904 - RNA, 15 nt, Staphylococcus aureus subsp. aureus MW2
gacaguaaucaaagu

SEQ ID NO: 2104905 - RNA, 18 nt, Staphylococcus aureus subsp. aureus MW2
gacuuauuugaaugcaaa

SEQ ID NO: 2104906 - RNA, 13 nt, Staphylococcus aureus subsp. aureus MW2
gacuuaacaucuu

SEQ ID NO: 2104907 - RNA, 19 nt, Staphylococcus aureus subsp. aureus MW2
gacuuaacaucuuuuucac

SEQ ID NO: 2104908 - RNA, 14 nt, Staphylococcus aureus subsp. aureus MW2
gacuguagaaaaca

SEQ ID NO: 2104909 - RNA, 22 nt, Staphylococcus aureus subsp. aureus MW2
gacuugugcgcgacguuuaaau

SEQ ID NO: 2104910 - RNA, 16 nt, Staphylococcus aureus subsp. aureus MW2
gacuuggugcccaagu

SEQ ID NO: 2104911 - RNA, 15 nt, Staphylococcus aureus subsp. aureus MW2
gacuuggugcccaag

SEQ ID NO: 2104912 - RNA, 14 nt, Staphylococcus aureus subsp. aureus MW2
gacuuuccgccagc

SEQ ID NO: 2104913 - RNA, 19 nt, Staphylococcus aureus subsp. aureus MW2
gacuuuccgccagcuucua

SEQ ID NO: 2104914 - RNA, 19 nt, Staphylococcus aureus subsp. aureus MW2
gacuuuccgccagcuucuu

SEQ ID NO: 2104915 - RNA, 20 nt, Staphylococcus aureus subsp. aureus MW2
gacuuuucuaucaaaaaaac

SEQ ID NO: 2104916 - RNA, 13 nt, Staphylococcus aureus subsp. aureus MW2
gagaaauuagaac

SEQ ID NO: 2104917 - RNA, 17 nt, Staphylococcus aureus subsp. aureus MW2
gagaacaucaucauguu

SEQ ID NO: 2104918 - RNA, 18 nt, Staphylococcus aureus subsp. aureus MW2
gagaaaagcuagaaguuc

SEQ ID NO: 2104919 - RNA, 15 nt, Staphylococcus aureus subsp. aureus MW2
gagacuguuuuuuug

SEQ ID NO: 2104920 - RNA, 16 nt, Staphylococcus aureus subsp. aureus MW2
gagaguaauguuccau

SEQ ID NO: 2104921 - RNA, 22 nt, Staphylococcus aureus subsp. aureus MW2
gagagauuauuuaaaacuugua

SEQ ID NO: 2104922 - RNA, 12 nt, Staphylococcus aureus subsp. aureus MW2
gagagagaaaag

SEQ ID NO: 2104923 - RNA, 18 nt, Staphylococcus aureus subsp. aureus MW2
gagaauuucaaaaaggaa

SEQ ID NO: 2104924 - RNA, 17 nt, Staphylococcus aureus subsp. aureus MW2
gagaauuucgaaaagaa

SEQ ID NO: 2104925 - RNA, 14 nt, Staphylococcus aureus subsp. aureus MW2
gagaaucaauuauu

SEQ ID NO: 2104926 - RNA, 16 nt, Staphylococcus aureus subsp. aureus MW2
gagacauuucuucaau

SEQ ID NO: 2104927 - RNA, 16 nt, Staphylococcus aureus subsp. aureus MW2
gagaauagacauuguu

SEQ ID NO: 2104928 - RNA, 22 nt, Staphylococcus aureus subsp. aureus MW2
gagaauagacauuguuaaacua

SEQ ID NO: 2104929 - RNA, 20 nt, Staphylococcus aureus subsp. aureus MW2
gacugaagagcuuuuaguaa

SEQ ID NO: 2104930 - RNA, 14 nt, Staphylococcus aureus subsp. aureus MW2
gacugauaauaaaa

SEQ ID NO: 2104931 - RNA, 16 nt, Staphylococcus aureus subsp. aureus MW2
gacucuccaaauauug

SEQ ID NO: 2104932 - RNA, 18 nt, Staphylococcus aureus subsp. aureus MW2
gacugccaauaaaaugca

SEQ ID NO: 2104933 - RNA, 22 nt, Staphylococcus aureus subsp. aureus MW2
gacugcagacuucuuucaauua

SEQ ID NO: 2104934 - RNA, 17 nt, Staphylococcus aureus subsp. aureus MW2
gacuacaaguuuauaau

SEQ ID NO: 2104935 - RNA, 11 nt, Staphylococcus aureus subsp. aureus MW2
gacuacucaau

SEQ ID NO: 2104936 - RNA, 20 nt, Staphylococcus aureus subsp. aureus MW2
gacuauaacaccaauuaaau

SEQ ID NO: 2104937 - RNA, 22 nt, Staphylococcus aureus subsp. aureus MW2
gacuauucucagucucuuugaa

SEQ ID NO: 2104938 - RNA, 17 nt, Staphylococcus aureus subsp. aureus MW2
gacuaugcaaaugaaau

SEQ ID NO: 2104939 - RNA, 19 nt, Staphylococcus aureus subsp. aureus MW2
gacuaaaaugaaugaagac

SEQ ID NO: 2104940 - RNA, 14 nt, Staphylococcus aureus subsp. aureus MW2
gacuaaaaaacuaa

SEQ ID NO: 2104941 - RNA, 17 nt, Staphylococcus aureus subsp. aureus MW2
gacguuuacguucuuca

SEQ ID NO: 2104942 - RNA, 15 nt, Staphylococcus aureus subsp. aureus MW2
gacguucauggauuc

SEQ ID NO: 2104943 - RNA, 13 nt, Staphylococcus aureus subsp. aureus MW2
gacguaucaucaa

SEQ ID NO: 2104944 - RNA, 14 nt, Staphylococcus aureus subsp. aureus MW2
gacggcuacaauuu

SEQ ID NO: 2104945 - RNA, 20 nt, Staphylococcus aureus subsp. aureus MW2
gagcuaauaugucuagacuu

SEQ ID NO: 2104946 - RNA, 23 nt, Staphylococcus aureus subsp. aureus MW2
gagcuauucauagaccuaugaau

SEQ ID NO: 2104947 - RNA, 16 nt, Staphylococcus aureus subsp. aureus MW2
gagcucauguuucagu

SEQ ID NO: 2104948 - RNA, 14 nt, Staphylococcus aureus subsp. aureus MW2
gaggcgauaaaaga

SEQ ID NO: 2104949 - RNA, 19 nt, Staphylococcus aureus subsp. aureus MW2
gaggauacauaaaucuaau

SEQ ID NO: 2104950 - RNA, 15 nt, Staphylococcus aureus subsp. aureus MW2
gaggauauuuauucu

SEQ ID NO: 2104951 - RNA, 17 nt, Staphylococcus aureus subsp. aureus MW2
gagcuuuucuaaugcua

SEQ ID NO: 2104952 - RNA, 17 nt, Staphylococcus aureus subsp. aureus MW2
gagcuggugagaaauug

SEQ ID NO: 2104953 - RNA, 19 nt, Staphylococcus aureus subsp. aureus MW2
gagcacuaucuuuugcuuc

SEQ ID NO: 2104954 - RNA, 15 nt, Staphylococcus aureus subsp. aureus MW2
gagcacuaucuuuug

SEQ ID NO: 2104955 - RNA, 19 nt, Staphylococcus aureus subsp. aureus MW2
gagcaauucuucaauuuca

SEQ ID NO: 2104956 - RNA, 14 nt, Staphylococcus aureus subsp. aureus MW2
gagcaauucuucaa

SEQ ID NO: 2104957 - RNA, 19 nt, Staphylococcus aureus subsp. aureus MW2
gagcaagucuucuaaaaaa

SEQ ID NO: 2104958 - RNA, 16 nt, Staphylococcus aureus subsp. aureus MW2
gagcaaguuauaucau

SEQ ID NO: 2104959 - RNA, 16 nt, Staphylococcus aureus subsp. aureus MW2
gagcaacgauaccaaa

SEQ ID NO: 2104960 - RNA, 20 nt, Staphylococcus aureus subsp. aureus MW2
gagcaaagcuuuuuugcuuu

SEQ ID NO: 2104961 - RNA, 15 nt, Staphylococcus aureus subsp. aureus MW2
gagauuguaagaauu

SEQ ID NO: 2104962 - RNA, 20 nt, Staphylococcus aureus subsp. aureus MW2
gagauuaucuuuagacauaa

SEQ ID NO: 2104963 - RNA, 14 nt, Staphylococcus aureus subsp. aureus MW2
gagauauaaaggaa

SEQ ID NO: 2104964 - RNA, 21 nt, Staphylococcus aureus subsp. aureus MW2
gagauauauuaauauuugauu

SEQ ID NO: 2104965 - RNA, 22 nt, Staphylococcus aureus subsp. aureus MW2
gagccaauuucuacagacaaug

SEQ ID NO: 2104966 - RNA, 14 nt, Staphylococcus aureus subsp. aureus MW2
gagcauaguuuuca

SEQ ID NO: 2104967 - RNA, 22 nt, Staphylococcus aureus subsp. aureus MW2
gagcaguauauaucaaauacau

SEQ ID NO: 2104968 - RNA, 22 nt, Staphylococcus aureus subsp. aureus MW2
gagccauuauuauuuuuuucuu

SEQ ID NO: 2104969 - RNA, 13 nt, Staphylococcus aureus subsp. aureus MW2
gauguguugaaac

SEQ ID NO: 2104970 - RNA, 14 nt, Staphylococcus aureus subsp. aureus MW2
gauguuaaaaaaua

SEQ ID NO: 2104971 - RNA, 15 nt, Staphylococcus aureus subsp. aureus MW2
gauguucaucaacau

SEQ ID NO: 2104972 - RNA, 15 nt, Staphylococcus aureus subsp. aureus MW2
gauguugaaaaguau

SEQ ID NO: 2104973 - RNA, 18 nt, Staphylococcus aureus subsp. aureus MW2
gauguugaaaaguauaug

SEQ ID NO: 2104974 - RNA, 14 nt, Staphylococcus aureus subsp. aureus MW2
gauguuauaaaaug

SEQ ID NO: 2104975 - RNA, 16 nt, Staphylococcus aureus subsp. aureus MW2
gauuaccaaguaauga

SEQ ID NO: 2104976 - RNA, 22 nt, Staphylococcus aureus subsp. aureus MW2
gauuaauccuauacguacugca

SEQ ID NO: 2104977 - RNA, 19 nt, Staphylococcus aureus subsp. aureus MW2
gauuaauccaguaaucaaa

SEQ ID NO: 2104978 - RNA, 17 nt, Staphylococcus aureus subsp. aureus MW2
gauuaauucuucuucag

SEQ ID NO: 2104979 - RNA, 20 nt, Staphylococcus aureus subsp. aureus MW2
gauuaauuauaaguagugau

SEQ ID NO: 2104980 - RNA, 19 nt, Staphylococcus aureus subsp. aureus MW2
gaugggaaaucaguaauau

SEQ ID NO: 2104981 - RNA, 18 nt, Staphylococcus aureus subsp. aureus MW2
gauggcugcaacaauuug

SEQ ID NO: 2104982 - RNA, 16 nt, Staphylococcus aureus subsp. aureus MW2
gauucauaaaauuuaa

SEQ ID NO: 2104983 - RNA, 21 nt, Staphylococcus aureus subsp. aureus MW2
gauucauaaaauuuaaaacaa

SEQ ID NO: 2104984 - RNA, 20 nt, Staphylococcus aureus subsp. aureus MW2
gauucaggauuguagaaucu

SEQ ID NO: 2104985 - RNA, 22 nt, Staphylococcus aureus subsp. aureus MW2
gauuaguaauuuuuaaaucuac

SEQ ID NO: 2104986 - RNA, 20 nt, Staphylococcus aureus subsp. aureus MW2
gauuauagguauaagaaugu

SEQ ID NO: 2104987 - RNA, 21 nt, Staphylococcus aureus subsp. aureus MW2
gauuauauuuagauuuauaac

SEQ ID NO: 2104988 - RNA, 11 nt, Staphylococcus aureus subsp. aureus MW2
gauuauauaua

SEQ ID NO: 2104989 - RNA, 15 nt, Staphylococcus aureus subsp. aureus MW2
gauuauauuuuucuu

SEQ ID NO: 2104990 - RNA, 13 nt, Staphylococcus aureus subsp. aureus MW2
gauucaaccuuaa

SEQ ID NO: 2104991 - RNA, 17 nt, Staphylococcus aureus subsp. aureus MW2
gauucauaucuuucaau

SEQ ID NO: 2104992 - RNA, 15 nt, Staphylococcus aureus subsp. aureus MW2
gauuccaaucuauuu

SEQ ID NO: 2104993 - RNA, 14 nt, Staphylococcus aureus subsp. aureus MW2
gauuccaaauugga

SEQ ID NO: 2104994 - RNA, 17 nt, Staphylococcus aureus subsp. aureus MW2
gauuuuaaaagauaaau

SEQ ID NO: 2104995 - RNA, 10 nt, Staphylococcus aureus subsp. aureus MW2
gauuuugcuu

SEQ ID NO: 2104996 - RNA, 15 nt, Staphylococcus aureus subsp. aureus MW2
gauuuucuaaagcuu

SEQ ID NO: 2104997 - RNA, 14 nt, Staphylococcus aureus subsp. aureus MW2
gauuuuuuggauuc

SEQ ID NO: 2104998 - RNA, 15 nt, Staphylococcus aureus subsp. aureus MW2
gauuuccucgguuuu

SEQ ID NO: 2104999 - RNA, 18 nt, Staphylococcus aureus subsp. aureus MW2
gauuuccuauuaggaucc

SEQ ID NO: 2105000 - RNA, 13 nt, Staphylococcus aureus subsp. aureus MW2
gauuucauuugug

SEQ ID NO: 2105001 - RNA, 17 nt, Staphylococcus aureus subsp. aureus MW2
gauuucuaucaaauaau

SEQ ID NO: 2105002 - RNA, 21 nt, Staphylococcus aureus subsp. aureus MW2
gauuggcuugaaguuguuucu

SEQ ID NO: 2105003 - RNA, 19 nt, Staphylococcus aureus subsp. aureus MW2
gauuggcugugcuauaauc

SEQ ID NO: 2105004 - RNA, 16 nt, Staphylococcus aureus subsp. aureus MW2
gauuuagcauacauua

SEQ ID NO: 2105005 - RNA, 16 nt, Staphylococcus aureus subsp. aureus MW2
gauuucauuaauuuuu

SEQ ID NO: 2105006 - RNA, 19 nt, Staphylococcus aureus subsp. aureus MW2
gauucguuuuguuauugaa

SEQ ID NO: 2105007 - RNA, 21 nt, Staphylococcus aureus subsp. aureus MW2
gauucgugauuuggaauacuu

SEQ ID NO: 2105008 - RNA, 21 nt, Staphylococcus aureus subsp. aureus MW2
gauugcaaauuaucauuaaau

SEQ ID NO: 2105009 - RNA, 14 nt, Staphylococcus aureus subsp. aureus MW2
gaugcgcuucuaac

SEQ ID NO: 2105010 - RNA, 16 nt, Staphylococcus aureus subsp. aureus MW2
gaugcucguauagaaa

SEQ ID NO: 2105011 - RNA, 23 nt, Staphylococcus aureus subsp. aureus MW2
gaugcuacuuaaagcuaauaaug

SEQ ID NO: 2105012 - RNA, 14 nt, Staphylococcus aureus subsp. aureus MW2
gaugauucuuauca

SEQ ID NO: 2105013 - RNA, 18 nt, Staphylococcus aureus subsp. aureus MW2
gaugaacuuaaugcuuca

SEQ ID NO: 2105014 - RNA, 21 nt, Staphylococcus aureus subsp. aureus MW2
gaugaacuuaaugcuucaaau

SEQ ID NO: 2105015 - RNA, 21 nt, Staphylococcus aureus subsp. aureus MW2
gaugaaagacugacuaauaaa

SEQ ID NO: 2105016 - RNA, 16 nt, Staphylococcus aureus subsp. aureus MW2
gaugaaaaucaguugc

SEQ ID NO: 2105017 - RNA, 15 nt, Staphylococcus aureus subsp. aureus MW2
gaugaaaaaguggau

SEQ ID NO: 2105018 - RNA, 19 nt, Staphylococcus aureus subsp. aureus MW2
gaugaacauaccugcauau

SEQ ID NO: 2105019 - RNA, 21 nt, Staphylococcus aureus subsp. aureus MW2
gaugaaauuguguugaaucaa

SEQ ID NO: 2105020 - RNA, 19 nt, Staphylococcus aureus subsp. aureus MW2
gaugaacaaaauaacaugu

SEQ ID NO: 2105021 - RNA, 16 nt, Staphylococcus aureus subsp. aureus MW2
gaucuugcuuaucuau

SEQ ID NO: 2105022 - RNA, 18 nt, Staphylococcus aureus subsp. aureus MW2
gaucuucaugaacagcau

SEQ ID NO: 2105023 - RNA, 17 nt, Staphylococcus aureus subsp. aureus MW2
gaucuaaaguacucaag

SEQ ID NO: 2105024 - RNA, 16 nt, Staphylococcus aureus subsp. aureus MW2
gaucuaacaucauuaa

SEQ ID NO: 2105025 - RNA, 18 nt, Staphylococcus aureus subsp. aureus MW2
gaucuaugguuauggugu

SEQ ID NO: 2105026 - RNA, 22 nt, Staphylococcus aureus subsp. aureus MW2
gauauagugcuuguuuauuaca

SEQ ID NO: 2105027 - RNA, 22 nt, Staphylococcus aureus subsp. aureus MW2
gauauauacuagcaauucacau

SEQ ID NO: 2105028 - RNA, 23 nt, Staphylococcus aureus subsp. aureus MW2
gauauuucaacuuuuuaauaaua

SEQ ID NO: 2105029 - RNA, 13 nt, Staphylococcus aureus subsp. aureus MW2
gaucaugccuuca

SEQ ID NO: 2105030 - RNA, 18 nt, Staphylococcus aureus subsp. aureus MW2
gaucauaaauauuuucug

SEQ ID NO: 2105031 - RNA, 16 nt, Staphylococcus aureus subsp. aureus MW2
gauaggaaacuuaaau

SEQ ID NO: 2105032 - RNA, 17 nt, Staphylococcus aureus subsp. aureus MW2
gauauaaugaaguuaug

SEQ ID NO: 2105033 - RNA, 15 nt, Staphylococcus aureus subsp. aureus MW2
gauauacgaauccuc

SEQ ID NO: 2105034 - RNA, 21 nt, Staphylococcus aureus subsp. aureus MW2
gauauagagccgugaaagaaa

SEQ ID NO: 2105035 - RNA, 19 nt, Staphylococcus aureus subsp. aureus MW2
gauauaagauucauauuua

SEQ ID NO: 2105036 - RNA, 21 nt, Staphylococcus aureus subsp. aureus MW2
gauauaauaaaaacagcagug

SEQ ID NO: 2105037 - RNA, 16 nt, Staphylococcus aureus subsp. aureus MW2
gauauaaacuacuaaa

SEQ ID NO: 2105038 - RNA, 15 nt, Staphylococcus aureus subsp. aureus MW2
gauaguuuuauaauu

SEQ ID NO: 2105039 - RNA, 14 nt, Staphylococcus aureus subsp. aureus MW2
gauaccuaaaauac

SEQ ID NO: 2105040 - RNA, 14 nt, Staphylococcus aureus subsp. aureus MW2
gauaaguucagcgu

SEQ ID NO: 2105041 - RNA, 16 nt, Staphylococcus aureus subsp. aureus MW2
gauacuaauaucuucu

SEQ ID NO: 2105042 - RNA, 20 nt, Staphylococcus aureus subsp. aureus MW2
gauacuaaacgauaaauuaa

SEQ ID NO: 2105043 - RNA, 21 nt, Staphylococcus aureus subsp. aureus MW2
gauacgugguuuuauuugauu

SEQ ID NO: 2105044 - RNA, 23 nt, Staphylococcus aureus subsp. aureus MW2
gauaccucauccgccaauuaaaa

SEQ ID NO: 2105045 - RNA, 21 nt, Staphylococcus aureus subsp. aureus MW2
gauaccuuuaauaauauugaa

SEQ ID NO: 2105046 - RNA, 18 nt, Staphylococcus aureus subsp. aureus MW2
gauaccuuuaauaucuaa

SEQ ID NO: 2105047 - RNA, 14 nt, Staphylococcus aureus subsp. aureus MW2
gauagaaaggcagg

SEQ ID NO: 2105048 - RNA, 21 nt, Staphylococcus aureus subsp. aureus MW2
gauagaauacuaaaaguguua

SEQ ID NO: 2105049 - RNA, 21 nt, Staphylococcus aureus subsp. aureus MW2
gauagaaugucgauauuucua

SEQ ID NO: 2105050 - RNA, 15 nt, Staphylococcus aureus subsp. aureus MW2
gauagaaguuuuuug

SEQ ID NO: 2105051 - RNA, 22 nt, Staphylococcus aureus subsp. aureus MW2
gauagaaguuuuuugauuagua

SEQ ID NO: 2105052 - RNA, 15 nt, Staphylococcus aureus subsp. aureus MW2
gauagaauacuaaaa

SEQ ID NO: 2105053 - RNA, 21 nt, Staphylococcus aureus subsp. aureus MW2
gauagcauguuauauuaugaa

SEQ ID NO: 2105054 - RNA, 19 nt, Staphylococcus aureus subsp. aureus MW2
gaguacuaaucaauacuaa

SEQ ID NO: 2105055 - RNA, 19 nt, Staphylococcus aureus subsp. aureus MW2
gaggugugguguaaagauc

SEQ ID NO: 2105056 - RNA, 21 nt, Staphylococcus aureus subsp. aureus MW2
gauaagaaucaucuaaaugca

SEQ ID NO: 2105057 - RNA, 23 nt, Staphylococcus aureus subsp. aureus MW2
gauaagaauuaacaacaaauaua

SEQ ID NO: 2105058 - RNA, 22 nt, Staphylococcus aureus subsp. aureus MW2
gauaacaauuuuaaaucuuuua

SEQ ID NO: 2105059 - RNA, 20 nt, Staphylococcus aureus subsp. aureus MW2
gauaaauuuuuaguuaaagu

SEQ ID NO: 2105060 - RNA, 17 nt, Staphylococcus aureus subsp. aureus MW2
gauaacuauuuaauuau

SEQ ID NO: 2105061 - RNA, 20 nt, Staphylococcus aureus subsp. aureus MW2
gauaacuacacuuaauauau

SEQ ID NO: 2105062 - RNA, 22 nt, Staphylococcus aureus subsp. aureus MW2
gauaaauaugauguuaaaaaau

SEQ ID NO: 2105063 - RNA, 14 nt, Staphylococcus aureus subsp. aureus MW2
gauaaaucaucauu

SEQ ID NO: 2105064 - RNA, 15 nt, Staphylococcus aureus subsp. aureus MW2
gauaaacuacacacg

SEQ ID NO: 2105065 - RNA, 14 nt, Staphylococcus aureus subsp. aureus MW2
gauaaacuacacac

SEQ ID NO: 2105066 - RNA, 21 nt, Staphylococcus aureus subsp. aureus MW2
gauaaauuccauguauucuua

SEQ ID NO: 2105067 - RNA, 19 nt, Staphylococcus aureus subsp. aureus MW2
gauaaaugcgguuaaugac

SEQ ID NO: 2105068 - RNA, 23 nt, Staphylococcus aureus subsp. aureus MW2
gauaaaugcgguuaaugacuaug

SEQ ID NO: 2105069 - RNA, 15 nt, Staphylococcus aureus subsp. aureus MW2
gagugaaaauaagau

SEQ ID NO: 2105070 - RNA, 14 nt, Staphylococcus aureus subsp. aureus MW2
gagucuuauuuuua

SEQ ID NO: 2105071 - RNA, 19 nt, Staphylococcus aureus subsp. aureus MW2
gaguguguccaucauuugu

SEQ ID NO: 2105072 - RNA, 20 nt, Staphylococcus aureus subsp. aureus MW2
gaguuguacuacuugauucu

SEQ ID NO: 2105073 - RNA, 12 nt, Staphylococcus aureus subsp. aureus MW2
gaguugggguga

SEQ ID NO: 2105074 - RNA, 15 nt, Staphylococcus aureus subsp. aureus MW2
gcagagaauauagau

SEQ ID NO: 2105075 - RNA, 15 nt, Staphylococcus aureus subsp. aureus MW2
gcagacuaaaagugg

SEQ ID NO: 2105076 - RNA, 14 nt, Staphylococcus aureus subsp. aureus MW2
gcacuuuauuaaaa

SEQ ID NO: 2105077 - RNA, 20 nt, Staphylococcus aureus subsp. aureus MW2
gcacuugucucaaauuaaau

SEQ ID NO: 2105078 - RNA, 22 nt, Staphylococcus aureus subsp. aureus MW2
gcacuuuauuaaaaauccucac

SEQ ID NO: 2105079 - RNA, 22 nt, Staphylococcus aureus subsp. aureus MW2
gcacgcgugccaacaucuucaa

SEQ ID NO: 2105080 - RNA, 13 nt, Staphylococcus aureus subsp. aureus MW2
gcauaagauugcu

SEQ ID NO: 2105081 - RNA, 14 nt, Staphylococcus aureus subsp. aureus MW2
gcauaauuuuuuaa

SEQ ID NO: 2105082 - RNA, 22 nt, Staphylococcus aureus subsp. aureus MW2
gcauaacgagcaguauauauca

SEQ ID NO: 2105083 - RNA, 22 nt, Staphylococcus aureus subsp. aureus MW2
gcagugaaguuaacuauaacaa

SEQ ID NO: 2105084 - RNA, 23 nt, Staphylococcus aureus subsp. aureus MW2
gcaguaagauuauuuucaauuag

SEQ ID NO: 2105085 - RNA, 13 nt, Staphylococcus aureus subsp. aureus MW2
gcaccuaaaauag

SEQ ID NO: 2105086 - RNA, 15 nt, Staphylococcus aureus subsp. aureus MW2
gcaccuaaaauagaa

SEQ ID NO: 2105087 - RNA, 16 nt, Staphylococcus aureus subsp. aureus MW2
gcaccgacaauuauaa

SEQ ID NO: 2105088 - RNA, 19 nt, Staphylococcus aureus subsp. aureus MW2
gcacagcgauuaaaugaug

SEQ ID NO: 2105089 - RNA, 14 nt, Staphylococcus aureus subsp. aureus MW2
gcacagucaaugac

SEQ ID NO: 2105090 - RNA, 15 nt, Staphylococcus aureus subsp. aureus MW2
gcaaugcaugcuucu

SEQ ID NO: 2105091 - RNA, 16 nt, Staphylococcus aureus subsp. aureus MW2
gcaaugcaaguugggg

SEQ ID NO: 2105092 - RNA, 14 nt, Staphylococcus aureus subsp. aureus MW2
gcaaugcauauugu

SEQ ID NO: 2105093 - RNA, 17 nt, Staphylococcus aureus subsp. aureus MW2
gcaaugcgaguuggggu

SEQ ID NO: 2105094 - RNA, 16 nt, Staphylococcus aureus subsp. aureus MW2
gcaaugcgaguugggg

SEQ ID NO: 2105095 - RNA, 13 nt, Staphylococcus aureus subsp. aureus MW2
gcacaaaugaaug

SEQ ID NO: 2105096 - RNA, 20 nt, Staphylococcus aureus subsp. aureus MW2
gcacauuauuguaaccugac

SEQ ID NO: 2105097 - RNA, 15 nt, Staphylococcus aureus subsp. aureus MW2
gcaccagcacaucaa

SEQ ID NO: 2105098 - RNA, 16 nt, Staphylococcus aureus subsp. aureus MW2
gcaacuguaaaugaaa

SEQ ID NO: 2105099 - RNA, 21 nt, Staphylococcus aureus subsp. aureus MW2
gcaacuaaaacuaucugauua

SEQ ID NO: 2105100 - RNA, 12 nt, Staphylococcus aureus subsp. aureus MW2
gcaacuaagaug

SEQ ID NO: 2105101 - RNA, 17 nt, Staphylococcus aureus subsp. aureus MW2
gcaacgucccaacaaca

SEQ ID NO: 2105102 - RNA, 12 nt, Staphylococcus aureus subsp. aureus MW2
gcaaguugggga

SEQ ID NO: 2105103 - RNA, 18 nt, Staphylococcus aureus subsp. aureus MW2
gcaauaauuacuaaccua

SEQ ID NO: 2105104 - RNA, 14 nt, Staphylococcus aureus subsp. aureus MW2
gcaaucauaauacu

SEQ ID NO: 2105105 - RNA, 20 nt, Staphylococcus aureus subsp. aureus MW2
gcaaaacuugcgcaugcuuu

SEQ ID NO: 2105106 - RNA, 22 nt, Staphylococcus aureus subsp. aureus MW2
gcaacauugauaguuuuauaau

SEQ ID NO: 2105107 - RNA, 17 nt, Staphylococcus aureus subsp. aureus MW2
gcaacagcgcaucauaa

SEQ ID NO: 2105108 - RNA, 18 nt, Staphylococcus aureus subsp. aureus MW2
gcaacagcgcaucauaac

SEQ ID NO: 2105109 - RNA, 15 nt, Staphylococcus aureus subsp. aureus MW2
gcccaucaucacugu

SEQ ID NO: 2105110 - RNA, 12 nt, Staphylococcus aureus subsp. aureus MW2
gcccauccccaa

SEQ ID NO: 2105111 - RNA, 15 nt, Staphylococcus aureus subsp. aureus MW2
gcccauccccaacuu

SEQ ID NO: 2105112 - RNA, 15 nt, Staphylococcus aureus subsp. aureus MW2
gccccaacacagaga

SEQ ID NO: 2105113 - RNA, 16 nt, Staphylococcus aureus subsp. aureus MW2
gccccaacacagagaa

SEQ ID NO: 2105114 - RNA, 14 nt, Staphylococcus aureus subsp. aureus MW2
gccccaacacagaa

SEQ ID NO: 2105115 - RNA, 14 nt, Staphylococcus aureus subsp. aureus MW2
gccccaacauagaa

SEQ ID NO: 2105116 - RNA, 21 nt, Staphylococcus aureus subsp. aureus MW2
gccccaacauagaagcuggcg

SEQ ID NO: 2105117 - RNA, 11 nt, Staphylococcus aureus subsp. aureus MW2
gccccaacaca

SEQ ID NO: 2105118 - RNA, 12 nt, Staphylococcus aureus subsp. aureus MW2
gccccaacacag

SEQ ID NO: 2105119 - RNA, 21 nt, Staphylococcus aureus subsp. aureus MW2
gccccaacaaagaagcuggcg

SEQ ID NO: 2105120 - RNA, 16 nt, Staphylococcus aureus subsp. aureus MW2
gccccaacacagaagc

SEQ ID NO: 2105121 - RNA, 17 nt, Staphylococcus aureus subsp. aureus MW2
gccccaucuauuagaaa

SEQ ID NO: 2105122 - RNA, 16 nt, Staphylococcus aureus subsp. aureus MW2
gccccgccaacuugca

SEQ ID NO: 2105123 - RNA, 17 nt, Staphylococcus aureus subsp. aureus MW2
gcccucauuuuuauaaa

SEQ ID NO: 2105124 - RNA, 14 nt, Staphylococcus aureus subsp. aureus MW2
gccauaaucuucau

SEQ ID NO: 2105125 - RNA, 23 nt, Staphylococcus aureus subsp. aureus MW2
gccauauguuuuagaauaguuac

SEQ ID NO: 2105126 - RNA, 20 nt, Staphylococcus aureus subsp. aureus MW2
gccagcuucuuuguuggggc

SEQ ID NO: 2105127 - RNA, 18 nt, Staphylococcus aureus subsp. aureus MW2
gcauacaggaaauugaag

SEQ ID NO: 2105128 - RNA, 14 nt, Staphylococcus aureus subsp. aureus MW2
gcauacaauaaugu

SEQ ID NO: 2105129 - RNA, 11 nt, Staphylococcus aureus subsp. aureus MW2
gccucaucuaa

SEQ ID NO: 2105130 - RNA, 23 nt, Staphylococcus aureus subsp. aureus MW2
gccuaauacacuugcuaaaacua

SEQ ID NO: 2105131 - RNA, 13 nt, Staphylococcus aureus subsp. aureus MW2
gccuaauaauaaa

SEQ ID NO: 2105132 - RNA, 22 nt, Staphylococcus aureus subsp. aureus MW2
gccucugcuagacaaucaucuu

SEQ ID NO: 2105133 - RNA, 23 nt, Staphylococcus aureus subsp. aureus MW2
gccuguagaauuucuuuucgaaa

SEQ ID NO: 2105134 - RNA, 16 nt, Staphylococcus aureus subsp. aureus MW2
gccuguagaauuucuu

SEQ ID NO: 2105135 - RNA, 23 nt, Staphylococcus aureus subsp. aureus MW2
gcguacuuggcucaaaacuuuua

SEQ ID NO: 2105136 - RNA, 13 nt, Staphylococcus aureus subsp. aureus MW2
gcguacauauaau

SEQ ID NO: 2105137 - RNA, 22 nt, Staphylococcus aureus subsp. aureus MW2
gcguaacaucacagaaaauaca

SEQ ID NO: 2105138 - RNA, 23 nt, Staphylococcus aureus subsp. aureus MW2
gcggggccccaacauagaagcug

SEQ ID NO: 2105139 - RNA, 22 nt, Staphylococcus aureus subsp. aureus MW2
gcgggccccaacauagaagcug

SEQ ID NO: 2105140 - RNA, 22 nt, Staphylococcus aureus subsp. aureus MW2
gcggccuuuuuauuguaauaaa

SEQ ID NO: 2105141 - RNA, 20 nt, Staphylococcus aureus subsp. aureus MW2
gcuagucauaauuuagaaga

SEQ ID NO: 2105142 - RNA, 19 nt, Staphylococcus aureus subsp. aureus MW2
gcuacuuuuucaucuuuca

SEQ ID NO: 2105143 - RNA, 18 nt, Staphylococcus aureus subsp. aureus MW2
gcucauuucaauauuaaa

SEQ ID NO: 2105144 - RNA, 15 nt, Staphylococcus aureus subsp. aureus MW2
gcucauugugcuuga

SEQ ID NO: 2105145 - RNA, 19 nt, Staphylococcus aureus subsp. aureus MW2
gcucauccucauuaauaaa

SEQ ID NO: 2105146 - RNA, 15 nt, Staphylococcus aureus subsp. aureus MW2
gcuccaaacauagag

SEQ ID NO: 2105147 - RNA, 15 nt, Staphylococcus aureus subsp. aureus MW2
gcucauccucauuaa

SEQ ID NO: 2105148 - RNA, 14 nt, Staphylococcus aureus subsp. aureus MW2
gcuccuaaauguua

SEQ ID NO: 2105149 - RNA, 23 nt, Staphylococcus aureus subsp. aureus MW2
gcuaaugcaacuaaaacuaucug

SEQ ID NO: 2105150 - RNA, 20 nt, Staphylococcus aureus subsp. aureus MW2
gcuaauauuuauagcaucaa

SEQ ID NO: 2105151 - RNA, 22 nt, Staphylococcus aureus subsp. aureus MW2
gcuaacgaaucgccuacuauaa

SEQ ID NO: 2105152 - RNA, 16 nt, Staphylococcus aureus subsp. aureus MW2
gcuaaaaaaauuaaaa

SEQ ID NO: 2105153 - RNA, 18 nt, Staphylococcus aureus subsp. aureus MW2
gcuaacauucagugcaau

SEQ ID NO: 2105154 - RNA, 14 nt, Staphylococcus aureus subsp. aureus MW2
gcuaaauauuauaa

SEQ ID NO: 2105155 - RNA, 18 nt, Staphylococcus aureus subsp. aureus MW2
gcuaaugcauuauuauaa

SEQ ID NO: 2105156 - RNA, 17 nt, Staphylococcus aureus subsp. aureus MW2
gcuaauuucuaauacau

SEQ ID NO: 2105157 - RNA, 19 nt, Staphylococcus aureus subsp. aureus MW2
gcuacaaagucauuuucau

SEQ ID NO: 2105158 - RNA, 17 nt, Staphylococcus aureus subsp. aureus MW2
gcuacccaccuuucuuu

SEQ ID NO: 2105159 - RNA, 18 nt, Staphylococcus aureus subsp. aureus MW2
gcuacuaaaggaauuuca

SEQ ID NO: 2105160 - RNA, 15 nt, Staphylococcus aureus subsp. aureus MW2
gcguaguuugaauug

SEQ ID NO: 2105161 - RNA, 18 nt, Staphylococcus aureus subsp. aureus MW2
gcguauccccauuuaugu

SEQ ID NO: 2105162 - RNA, 16 nt, Staphylococcus aureus subsp. aureus MW2
gcuaaaaaauuugcau

SEQ ID NO: 2105163 - RNA, 21 nt, Staphylococcus aureus subsp. aureus MW2
gcguucgugauagaaguuuuu

SEQ ID NO: 2105164 - RNA, 22 nt, Staphylococcus aureus subsp. aureus MW2
gcgcucgaaucucauugauuug

SEQ ID NO: 2105165 - RNA, 18 nt, Staphylococcus aureus subsp. aureus MW2
gcgauacguuuauaucuu

SEQ ID NO: 2105166 - RNA, 15 nt, Staphylococcus aureus subsp. aureus MW2
gcgauacguuuauau

SEQ ID NO: 2105167 - RNA, 21 nt, Staphylococcus aureus subsp. aureus MW2
gcgacuucauuacaaacauaa

SEQ ID NO: 2105168 - RNA, 13 nt, Staphylococcus aureus subsp. aureus MW2
gcgacuucuaucu

SEQ ID NO: 2105169 - RNA, 22 nt, Staphylococcus aureus subsp. aureus MW2
gcgauuacaguguggucuugug

SEQ ID NO: 2105170 - RNA, 19 nt, Staphylococcus aureus subsp. aureus MW2
gcgaacgcaagcauaucuu

SEQ ID NO: 2105171 - RNA, 21 nt, Staphylococcus aureus subsp. aureus MW2
gccuuucuaauauuuuggcuu

SEQ ID NO: 2105172 - RNA, 14 nt, Staphylococcus aureus subsp. aureus MW2
gccuuuugaauaau

SEQ ID NO: 2105173 - RNA, 16 nt, Staphylococcus aureus subsp. aureus MW2
gccuuuuuauuguaau

SEQ ID NO: 2105174 - RNA, 15 nt, Staphylococcus aureus subsp. aureus MW2
gccuuuugaauaauu

SEQ ID NO: 2105175 - RNA, 21 nt, Staphylococcus aureus subsp. aureus MW2
gccuucuauauaguaaaauaa

SEQ ID NO: 2105176 - RNA, 15 nt, Staphylococcus aureus subsp. aureus MW2
gccuucuauauagua

SEQ ID NO: 2105177 - RNA, 17 nt, Staphylococcus aureus subsp. aureus MW2
gccuucuaucucuuuag

SEQ ID NO: 2105178 - RNA, 16 nt, Staphylococcus aureus subsp. aureus MW2
gccuucuaauaaugcu

SEQ ID NO: 2105179 - RNA, 17 nt, Staphylococcus aureus subsp. aureus MW2
gccuucuaauaaugcug

SEQ ID NO: 2105180 - RNA, 14 nt, Staphylococcus aureus subsp. aureus MW2
gccuuguucaauuc

SEQ ID NO: 2105181 - RNA, 23 nt, Staphylococcus aureus subsp. aureus MW2
gccuuggccuacuuuuucaauau

SEQ ID NO: 2105182 - RNA, 12 nt, Staphylococcus aureus subsp. aureus MW2
gccuuaaaauau

SEQ ID NO: 2105183 - RNA, 14 nt, Staphylococcus aureus subsp. aureus MW2
gccuuaaaauauuu

SEQ ID NO: 2105184 - RNA, 13 nt, Staphylococcus aureus subsp. aureus MW2
gccuucauuagcc

SEQ ID NO: 2105185 - RNA, 15 nt, Staphylococcus aureus subsp. aureus MW2
gugccuuugcuuuuu

SEQ ID NO: 2105186 - RNA, 12 nt, Staphylococcus aureus subsp. aureus MW2
gugccuuuuguu

SEQ ID NO: 2105187 - RNA, 21 nt, Staphylococcus aureus subsp. aureus MW2
gugcgcucaucuauaaauacu

SEQ ID NO: 2105188 - RNA, 21 nt, Staphylococcus aureus subsp. aureus MW2
gugcgugaagagaugaaagau

SEQ ID NO: 2105189 - RNA, 18 nt, Staphylococcus aureus subsp. aureus MW2
gugcguuaaauauauauu

SEQ ID NO: 2105190 - RNA, 16 nt, Staphylococcus aureus subsp. aureus MW2
gugcuauguuuuggua

SEQ ID NO: 2105191 - RNA, 23 nt, Staphylococcus aureus subsp. aureus MW2
gugcuaaucuauuuugcuugcuu

SEQ ID NO: 2105192 - RNA, 20 nt, Staphylococcus aureus subsp. aureus MW2
gugcucuugcaauagcaaca

SEQ ID NO: 2105193 - RNA, 18 nt, Staphylococcus aureus subsp. aureus MW2
gugaugcuugaauguuug

SEQ ID NO: 2105194 - RNA, 22 nt, Staphylococcus aureus subsp. aureus MW2
gugaugaugugcaaacgauaug

SEQ ID NO: 2105195 - RNA, 23 nt, Staphylococcus aureus subsp. aureus MW2
gugcaauauuauauuuugaauca

SEQ ID NO: 2105196 - RNA, 18 nt, Staphylococcus aureus subsp. aureus MW2
gugcaauaauaaauagga

SEQ ID NO: 2105197 - RNA, 22 nt, Staphylococcus aureus subsp. aureus MW2
gugcaauaauaaauaggaugaa

SEQ ID NO: 2105198 - RNA, 20 nt, Staphylococcus aureus subsp. aureus MW2
gugcaauuaauguaaugaua

SEQ ID NO: 2105199 - RNA, 22 nt, Staphylococcus aureus subsp. aureus MW2
gugcaagugguaaaaaugaacc

SEQ ID NO: 2105200 - RNA, 13 nt, Staphylococcus aureus subsp. aureus MW2
gugcauuuagaug

SEQ ID NO: 2105201 - RNA, 15 nt, Staphylococcus aureus subsp. aureus MW2
gugcuguuaucaugg

SEQ ID NO: 2105202 - RNA, 21 nt, Staphylococcus aureus subsp. aureus MW2
guggcuacuugaauaccuuuu

SEQ ID NO: 2105203 - RNA, 21 nt, Staphylococcus aureus subsp. aureus MW2
guggccuuuuaaacaaauaaa

SEQ ID NO: 2105204 - RNA, 19 nt, Staphylococcus aureus subsp. aureus MW2
guggcuuuuuuuauggugu

SEQ ID NO: 2105205 - RNA, 20 nt, Staphylococcus aureus subsp. aureus MW2
guguuuuuaauguuugcuuu

SEQ ID NO: 2105206 - RNA, 14 nt, Staphylococcus aureus subsp. aureus MW2
guguuucuuuuauu

SEQ ID NO: 2105207 - RNA, 13 nt, Staphylococcus aureus subsp. aureus MW2
guguuggggcccc

SEQ ID NO: 2105208 - RNA, 20 nt, Staphylococcus aureus subsp. aureus MW2
guguuaaucaacguauauaa

SEQ ID NO: 2105209 - RNA, 19 nt, Staphylococcus aureus subsp. aureus MW2
guguugaaaucuguuuguu

SEQ ID NO: 2105210 - RNA, 15 nt, Staphylococcus aureus subsp. aureus MW2
gugugggccccaaca

SEQ ID NO: 2105211 - RNA, 15 nt, Staphylococcus aureus subsp. aureus MW2
gugugauuuuggaac

SEQ ID NO: 2105212 - RNA, 22 nt, Staphylococcus aureus subsp. aureus MW2
guguacguuaaucagugaaaua

SEQ ID NO: 2105213 - RNA, 20 nt, Staphylococcus aureus subsp. aureus MW2
guuacucugcgauuucuaaa

SEQ ID NO: 2105214 - RNA, 22 nt, Staphylococcus aureus subsp. aureus MW2
guuacacaugcaucaacuauuu

SEQ ID NO: 2105215 - RNA, 20 nt, Staphylococcus aureus subsp. aureus MW2
guuacacuuuucuuaucagu

SEQ ID NO: 2105216 - RNA, 16 nt, Staphylococcus aureus subsp. aureus MW2
guuaauuauguauuuu

SEQ ID NO: 2105217 - RNA, 16 nt, Staphylococcus aureus subsp. aureus MW2
guuacaauaaugugca

SEQ ID NO: 2105218 - RNA, 21 nt, Staphylococcus aureus subsp. aureus MW2
guuaauacaaccaucagcauu

SEQ ID NO: 2105219 - RNA, 19 nt, Staphylococcus aureus subsp. aureus MW2
guuaaagauuauuauuaca

SEQ ID NO: 2105220 - RNA, 22 nt, Staphylococcus aureus subsp. aureus MW2
guuaaagucuguugguuuauca

SEQ ID NO: 2105221 - RNA, 19 nt, Staphylococcus aureus subsp. aureus MW2
guuaaaguacuuacaaaua

SEQ ID NO: 2105222 - RNA, 20 nt, Staphylococcus aureus subsp. aureus MW2
guuaauaacccauuuucaaa

SEQ ID NO: 2105223 - RNA, 14 nt, Staphylococcus aureus subsp. aureus MW2
guuaauaaaauuac

SEQ ID NO: 2105224 - RNA, 13 nt, Staphylococcus aureus subsp. aureus MW2
guuaaauauauau

SEQ ID NO: 2105225 - RNA, 14 nt, Staphylococcus aureus subsp. aureus MW2
guucccauucuuug

SEQ ID NO: 2105226 - RNA, 16 nt, Staphylococcus aureus subsp. aureus MW2
guuccaccgaacccug

SEQ ID NO: 2105227 - RNA, 17 nt, Staphylococcus aureus subsp. aureus MW2
guuccaccgaacccugu

SEQ ID NO: 2105228 - RNA, 14 nt, Staphylococcus aureus subsp. aureus MW2
guuccaaucuuuuu

SEQ ID NO: 2105229 - RNA, 19 nt, Staphylococcus aureus subsp. aureus MW2
guucgauuguaauaaccau

SEQ ID NO: 2105230 - RNA, 18 nt, Staphylococcus aureus subsp. aureus MW2
guucagaacuacaauuca

SEQ ID NO: 2105231 - RNA, 18 nt, Staphylococcus aureus subsp. aureus MW2
guucagauuuguauuuug

SEQ ID NO: 2105232 - RNA, 19 nt, Staphylococcus aureus subsp. aureus MW2
guuacuuucacauuuucaa

SEQ ID NO: 2105233 - RNA, 18 nt, Staphylococcus aureus subsp. aureus MW2
guuacuuuuuuaauguaa

SEQ ID NO: 2105234 - RNA, 13 nt, Staphylococcus aureus subsp. aureus MW2
guuagaaaaaaau

SEQ ID NO: 2105235 - RNA, 22 nt, Staphylococcus aureus subsp. aureus MW2
guuagaggauggauacuuaaag

SEQ ID NO: 2105236 - RNA, 13 nt, Staphylococcus aureus subsp. aureus MW2
guuagauuucaaa

SEQ ID NO: 2105237 - RNA, 14 nt, Staphylococcus aureus subsp. aureus MW2
guucaguaggaauu

SEQ ID NO: 2105238 - RNA, 22 nt, Staphylococcus aureus subsp. aureus MW2
guucauuggcaauauacuuuuu

SEQ ID NO: 2105239 - RNA, 20 nt, Staphylococcus aureus subsp. aureus MW2
guucauugcuagugcucuug

SEQ ID NO: 2105240 - RNA, 16 nt, Staphylococcus aureus subsp. aureus MW2
guucaucaaacaacau

SEQ ID NO: 2105241 - RNA, 18 nt, Staphylococcus aureus subsp. aureus MW2
guucuugguauuuuuuaa

SEQ ID NO: 2105242 - RNA, 14 nt, Staphylococcus aureus subsp. aureus MW2
guucuuucuuucuu

SEQ ID NO: 2105243 - RNA, 20 nt, Staphylococcus aureus subsp. aureus MW2
guucuaauacuucuaacgca

SEQ ID NO: 2105244 - RNA, 17 nt, Staphylococcus aureus subsp. aureus MW2
guucuaaaauuaaccau

SEQ ID NO: 2105245 - RNA, 21 nt, Staphylococcus aureus subsp. aureus MW2
guugaagccccuggugauuca

SEQ ID NO: 2105246 - RNA, 13 nt, Staphylococcus aureus subsp. aureus MW2
guucuuuuuguug

SEQ ID NO: 2105247 - RNA, 19 nt, Staphylococcus aureus subsp. aureus MW2
guugaauguggaacaugau

SEQ ID NO: 2105248 - RNA, 21 nt, Staphylococcus aureus subsp. aureus MW2
guugauugcaugacagcaaau

SEQ ID NO: 2105249 - RNA, 14 nt, Staphylococcus aureus subsp. aureus MW2
guugauuuaaaaua

SEQ ID NO: 2105250 - RNA, 15 nt, Staphylococcus aureus subsp. aureus MW2
guugauuuaaaauau

SEQ ID NO: 2105251 - RNA, 21 nt, Staphylococcus aureus subsp. aureus MW2
guugaucuuugacauguguua

SEQ ID NO: 2105252 - RNA, 23 nt, Staphylococcus aureus subsp. aureus MW2
guugacguuguggcaugcugaau

SEQ ID NO: 2105253 - RNA, 16 nt, Staphylococcus aureus subsp. aureus MW2
guugacuguaaaacaa

SEQ ID NO: 2105254 - RNA, 14 nt, Staphylococcus aureus subsp. aureus MW2
guugauaacuauuu

SEQ ID NO: 2105255 - RNA, 18 nt, Staphylococcus aureus subsp. aureus MW2
guugguuuuauuaauucu

SEQ ID NO: 2105256 - RNA, 16 nt, Staphylococcus aureus subsp. aureus MW2
guugguucaucaaaca

SEQ ID NO: 2105257 - RNA, 18 nt, Staphylococcus aureus subsp. aureus MW2
guuggcggggccccaaca

SEQ ID NO: 2105258 - RNA, 13 nt, Staphylococcus aureus subsp. aureus MW2
guuggcuuuaaag

SEQ ID NO: 2105259 - RNA, 21 nt, Staphylococcus aureus subsp. aureus MW2
guugcugaauaaaauauaucu

SEQ ID NO: 2105260 - RNA, 14 nt, Staphylococcus aureus subsp. aureus MW2
guugcuucuuauca

SEQ ID NO: 2105261 - RNA, 15 nt, Staphylococcus aureus subsp. aureus MW2
guugcauuacuuucu

SEQ ID NO: 2105262 - RNA, 20 nt, Staphylococcus aureus subsp. aureus MW2
guugcauuacuuucugccca

SEQ ID NO: 2105263 - RNA, 19 nt, Staphylococcus aureus subsp. aureus MW2
guuucgaacguuugaaaaa

SEQ ID NO: 2105264 - RNA, 23 nt, Staphylococcus aureus subsp. aureus MW2
guuuaucgaucgguauuuucauu

SEQ ID NO: 2105265 - RNA, 16 nt, Staphylococcus aureus subsp. aureus MW2
guuuauccauauauga

SEQ ID NO: 2105266 - RNA, 20 nt, Staphylococcus aureus subsp. aureus MW2
guuuaucuguugucaucaug

SEQ ID NO: 2105267 - RNA, 15 nt, Staphylococcus aureus subsp. aureus MW2
guuuauggauuuauu

SEQ ID NO: 2105268 - RNA, 14 nt, Staphylococcus aureus subsp. aureus MW2
guuuccauaaauaa

SEQ ID NO: 2105269 - RNA, 11 nt, Staphylococcus aureus subsp. aureus MW2
guuucccaagc

SEQ ID NO: 2105270 - RNA, 17 nt, Staphylococcus aureus subsp. aureus MW2
guuucuuuuauuuucau

SEQ ID NO: 2105271 - RNA, 14 nt, Staphylococcus aureus subsp. aureus MW2
guuucugacuuuua

SEQ ID NO: 2105272 - RNA, 15 nt, Staphylococcus aureus subsp. aureus MW2
guuugaauggcaaau

SEQ ID NO: 2105273 - RNA, 15 nt, Staphylococcus aureus subsp. aureus MW2
guuugaaucauuuga

SEQ ID NO: 2105274 - RNA, 20 nt, Staphylococcus aureus subsp. aureus MW2
guuucuauaaagaaugauuu

SEQ ID NO: 2105275 - RNA, 20 nt, Staphylococcus aureus subsp. aureus MW2
guuucuccuacuauaaaauc

SEQ ID NO: 2105276 - RNA, 19 nt, Staphylococcus aureus subsp. aureus MW2
guuuacgaucauaaauauu

SEQ ID NO: 2105277 - RNA, 16 nt, Staphylococcus aureus subsp. aureus MW2
guuuauauugcaaaaa

SEQ ID NO: 2105278 - RNA, 19 nt, Staphylococcus aureus subsp. aureus MW2
guuuauaauaauauugaaa

SEQ ID NO: 2105279 - RNA, 16 nt, Staphylococcus aureus subsp. aureus MW2
guuuaucagcuuuaau

SEQ ID NO: 2105280 - RNA, 19 nt, Staphylococcus aureus subsp. aureus MW2
guuuauauugcaaaaauaa

SEQ ID NO: 2105281 - RNA, 18 nt, Staphylococcus aureus subsp. aureus MW2
guuuaacaacacuaccca

SEQ ID NO: 2105282 - RNA, 19 nt, Staphylococcus aureus subsp. aureus MW2
guuuaaauuuaaaagaaaa

SEQ ID NO: 2105283 - RNA, 15 nt, Staphylococcus aureus subsp. aureus MW2
guuuaacaacacuac

SEQ ID NO: 2105284 - RNA, 20 nt, Staphylococcus aureus subsp. aureus MW2
guuuaaaugugcaauuagaa

SEQ ID NO: 2105285 - RNA, 14 nt, Staphylococcus aureus subsp. aureus MW2
guuuaauuuuaaau

SEQ ID NO: 2105286 - RNA, 15 nt, Staphylococcus aureus subsp. aureus MW2
guuuaauuuuaaaua

SEQ ID NO: 2105287 - RNA, 15 nt, Staphylococcus aureus subsp. aureus MW2
guuguucuuuuuguu

SEQ ID NO: 2105288 - RNA, 19 nt, Staphylococcus aureus subsp. aureus MW2
guuguucccauuuuuaaaa

SEQ ID NO: 2105289 - RNA, 22 nt, Staphylococcus aureus subsp. aureus MW2
guugucacuuggauucaaauga

SEQ ID NO: 2105290 - RNA, 15 nt, Staphylococcus aureus subsp. aureus MW2
guuguaccaaugaau

SEQ ID NO: 2105291 - RNA, 19 nt, Staphylococcus aureus subsp. aureus MW2
guuguuuaaauuucaaaau

SEQ ID NO: 2105292 - RNA, 16 nt, Staphylococcus aureus subsp. aureus MW2
guuguugaaauuaaau

SEQ ID NO: 2105293 - RNA, 22 nt, Staphylococcus aureus subsp. aureus MW2
guuguugcccgcuuauugcauu

SEQ ID NO: 2105294 - RNA, 13 nt, Staphylococcus aureus subsp. aureus MW2
guuuaaacauuuu

SEQ ID NO: 2105295 - RNA, 17 nt, Staphylococcus aureus subsp. aureus MW2
guuuaaaaagucaaaga

SEQ ID NO: 2105296 - RNA, 17 nt, Staphylococcus aureus subsp. aureus MW2
guuuaaaauacgacacc

SEQ ID NO: 2105297 - RNA, 21 nt, Staphylococcus aureus subsp. aureus MW2
uaaaaagaccucguuacauuu

SEQ ID NO: 2105298 - RNA, 23 nt, Staphylococcus aureus subsp. aureus MW2
uaaaaagaccucguuacauuuau

SEQ ID NO: 2105299 - RNA, 22 nt, Staphylococcus aureus subsp. aureus MW2
uaaaaagacgcuuucuauuuau

SEQ ID NO: 2105300 - RNA, 22 nt, Staphylococcus aureus subsp. aureus MW2
uaaaaagaauaugauauugauu

SEQ ID NO: 2105301 - RNA, 13 nt, Staphylococcus aureus subsp. aureus MW2
guuugauuucacu

SEQ ID NO: 2105302 - RNA, 13 nt, Staphylococcus aureus subsp. aureus MW2
guuugaucauaau

SEQ ID NO: 2105303 - RNA, 15 nt, Staphylococcus aureus subsp. aureus MW2
uaaaaaguuaauaaa

SEQ ID NO: 2105304 - RNA, 19 nt, Staphylococcus aureus subsp. aureus MW2
uaaaaagagguuuucauua

SEQ ID NO: 2105305 - RNA, 21 nt, Staphylococcus aureus subsp. aureus MW2
uaaaaauacauuuugcucuaa

SEQ ID NO: 2105306 - RNA, 20 nt, Staphylococcus aureus subsp. aureus MW2
uaaaaauacauaauaaaaag

SEQ ID NO: 2105307 - RNA, 14 nt, Staphylococcus aureus subsp. aureus MW2
uaaaaaucuuggug

SEQ ID NO: 2105308 - RNA, 15 nt, Staphylococcus aureus subsp. aureus MW2
uaaaaauagaaaaaa

SEQ ID NO: 2105309 - RNA, 16 nt, Staphylococcus aureus subsp. aureus MW2
uaaaaauagaaaaaac

SEQ ID NO: 2105310 - RNA, 16 nt, Staphylococcus aureus subsp. aureus MW2
uaaaaagauauaagaa

SEQ ID NO: 2105311 - RNA, 19 nt, Staphylococcus aureus subsp. aureus MW2
uaaaaagauauaagaaaaa

SEQ ID NO: 2105312 - RNA, 20 nt, Staphylococcus aureus subsp. aureus MW2
uaaaaagauauaagaaaaag

SEQ ID NO: 2105313 - RNA, 21 nt, Staphylococcus aureus subsp. aureus MW2
uaaaaagguacuaauguuaau

SEQ ID NO: 2105314 - RNA, 16 nt, Staphylococcus aureus subsp. aureus MW2
uaaaaaguaauuaauu

SEQ ID NO: 2105315 - RNA, 15 nt, Staphylococcus aureus subsp. aureus MW2
uaaaagcugauguga

SEQ ID NO: 2105316 - RNA, 21 nt, Staphylococcus aureus subsp. aureus MW2
uaaaaggacucauacaugugc

SEQ ID NO: 2105317 - RNA, 14 nt, Staphylococcus aureus subsp. aureus MW2
uaaaagacagaaau

SEQ ID NO: 2105318 - RNA, 17 nt, Staphylococcus aureus subsp. aureus MW2
uaaaagagaauauaaaa

SEQ ID NO: 2105319 - RNA, 22 nt, Staphylococcus aureus subsp. aureus MW2
uaaaagagaauauaaaauaaug

SEQ ID NO: 2105320 - RNA, 19 nt, Staphylococcus aureus subsp. aureus MW2
uaaaagacauccacagaau

SEQ ID NO: 2105321 - RNA, 15 nt, Staphylococcus aureus subsp. aureus MW2
uaaaagaauuauuca

SEQ ID NO: 2105322 - RNA, 16 nt, Staphylococcus aureus subsp. aureus MW2
uaaaacuauaauaaag

SEQ ID NO: 2105323 - RNA, 17 nt, Staphylococcus aureus subsp. aureus MW2
uaaaacuauaauaaaga

SEQ ID NO: 2105324 - RNA, 20 nt, Staphylococcus aureus subsp. aureus MW2
uaaaacuaaugauaguacau

SEQ ID NO: 2105325 - RNA, 16 nt, Staphylococcus aureus subsp. aureus MW2
uaaaaauguaaucacu

SEQ ID NO: 2105326 - RNA, 22 nt, Staphylococcus aureus subsp. aureus MW2
uaaaaauguauuaaauaugcac

SEQ ID NO: 2105327 - RNA, 16 nt, Staphylococcus aureus subsp. aureus MW2
uaaaaauuaaguaaua

SEQ ID NO: 2105328 - RNA, 16 nt, Staphylococcus aureus subsp. aureus MW2
uaaaaauugcaaugcu

SEQ ID NO: 2105329 - RNA, 22 nt, Staphylococcus aureus subsp. aureus MW2
uaaaaauugcaaugcuaucaug

SEQ ID NO: 2105330 - RNA, 21 nt, Staphylococcus aureus subsp. aureus MW2
uaaaaauuucgccucaucuaa

SEQ ID NO: 2105331 - RNA, 23 nt, Staphylococcus aureus subsp. aureus MW2
uaaaaauuucgccucaucuaauu

SEQ ID NO: 2105332 - RNA, 21 nt, Staphylococcus aureus subsp. aureus MW2
uaaaacaaauucauauuaacu

SEQ ID NO: 2105333 - RNA, 14 nt, Staphylococcus aureus subsp. aureus MW2
uaaaacaauaauaa

SEQ ID NO: 2105334 - RNA, 16 nt, Staphylococcus aureus subsp. aureus MW2
uaaaacaauaauaaua

SEQ ID NO: 2105335 - RNA, 15 nt, Staphylococcus aureus subsp. aureus MW2
uaaaacaaauuauua

SEQ ID NO: 2105336 - RNA, 22 nt, Staphylococcus aureus subsp. aureus MW2
uaaaacaaaaccaaaauacuga

SEQ ID NO: 2105337 - RNA, 23 nt, Staphylococcus aureus subsp. aureus MW2
uaaaacauuggcgaggccccaac

SEQ ID NO: 2105338 - RNA, 18 nt, Staphylococcus aureus subsp. aureus MW2
uaaaaccauagagcauuu

SEQ ID NO: 2105339 - RNA, 14 nt, Staphylococcus aureus subsp. aureus MW2
uaaacaagcaucau

SEQ ID NO: 2105340 - RNA, 19 nt, Staphylococcus aureus subsp. aureus MW2
uaaacaagcaucaugaaau

SEQ ID NO: 2105341 - RNA, 20 nt, Staphylococcus aureus subsp. aureus MW2
uaaacaagcaucaugaaauu

SEQ ID NO: 2105342 - RNA, 21 nt, Staphylococcus aureus subsp. aureus MW2
uaaacaacugagucaaaguca

SEQ ID NO: 2105343 - RNA, 17 nt, Staphylococcus aureus subsp. aureus MW2
uaaacaauacguuuucg

SEQ ID NO: 2105344 - RNA, 14 nt, Staphylococcus aureus subsp. aureus MW2
uaaacaacauacag

SEQ ID NO: 2105345 - RNA, 23 nt, Staphylococcus aureus subsp. aureus MW2
uaaacaaagcuauguaugaguca

SEQ ID NO: 2105346 - RNA, 17 nt, Staphylococcus aureus subsp. aureus MW2
uaaacaaaaggcuggga

SEQ ID NO: 2105347 - RNA, 14 nt, Staphylococcus aureus subsp. aureus MW2
uaaacaaaaauaag

SEQ ID NO: 2105348 - RNA, 18 nt, Staphylococcus aureus subsp. aureus MW2
uaaacacuauaaaagcca

SEQ ID NO: 2105349 - RNA, 23 nt, Staphylococcus aureus subsp. aureus MW2
uaaacacuauaaaagccaugaua

SEQ ID NO: 2105350 - RNA, 15 nt, Staphylococcus aureus subsp. aureus MW2
uaaacacaucuaugu

SEQ ID NO: 2105351 - RNA, 20 nt, Staphylococcus aureus subsp. aureus MW2
uaaacaccaauauuucuggg

SEQ ID NO: 2105352 - RNA, 18 nt, Staphylococcus aureus subsp. aureus MW2
uaaaauuuguuaauuuaa

SEQ ID NO: 2105353 - RNA, 15 nt, Staphylococcus aureus subsp. aureus MW2
uaaaauuuguaauuu

SEQ ID NO: 2105354 - RNA, 22 nt, Staphylococcus aureus subsp. aureus MW2
uaaaauuuugaagaagugccgu

SEQ ID NO: 2105355 - RNA, 23 nt, Staphylococcus aureus subsp. aureus MW2
uaaaauuuuuugggcuuuuucac

SEQ ID NO: 2105356 - RNA, 22 nt, Staphylococcus aureus subsp. aureus MW2
uaaaauuuuuuucauaauuaau

SEQ ID NO: 2105357 - RNA, 15 nt, Staphylococcus aureus subsp. aureus MW2
uaaaauuuaaauauu

SEQ ID NO: 2105358 - RNA, 18 nt, Staphylococcus aureus subsp. aureus MW2
uaaaauuuaaauauugaa

SEQ ID NO: 2105359 - RNA, 20 nt, Staphylococcus aureus subsp. aureus MW2
uaaaauuucugcuucuuuua

SEQ ID NO: 2105360 - RNA, 15 nt, Staphylococcus aureus subsp. aureus MW2
uaaaauuaaaacagc

SEQ ID NO: 2105361 - RNA, 20 nt, Staphylococcus aureus subsp. aureus MW2
uaaaauuacgcaaagaaaaa

SEQ ID NO: 2105362 - RNA, 22 nt, Staphylococcus aureus subsp. aureus MW2
uaaaauuacgcaaagaaaaaca

SEQ ID NO: 2105363 - RNA, 13 nt, Staphylococcus aureus subsp. aureus MW2
uaaaauuaugauu

SEQ ID NO: 2105364 - RNA, 22 nt, Staphylococcus aureus subsp. aureus MW2
uaaaauuaugauuauuuuucuc

SEQ ID NO: 2105365 - RNA, 23 nt, Staphylococcus aureus subsp. aureus MW2
uaaaauuaugauuauuuuucuca

SEQ ID NO: 2105366 - RNA, 14 nt, Staphylococcus aureus subsp. aureus MW2
uaaaauucuuucag

SEQ ID NO: 2105367 - RNA, 20 nt, Staphylococcus aureus subsp. aureus MW2
uaaaauugccaguaucucuu

SEQ ID NO: 2105368 - RNA, 11 nt, Staphylococcus aureus subsp. aureus MW2
uaaaauucuuu

SEQ ID NO: 2105369 - RNA, 22 nt, Staphylococcus aureus subsp. aureus MW2
uaaaauuaacuuaaaauuuaaa

SEQ ID NO: 2105370 - RNA, 14 nt, Staphylococcus aureus subsp. aureus MW2
uaaaauuaaauaau

SEQ ID NO: 2105371 - RNA, 17 nt, Staphylococcus aureus subsp. aureus MW2
uaaaauuaaccauuucu

SEQ ID NO: 2105372 - RNA, 17 nt, Staphylococcus aureus subsp. aureus MW2
uaaaauuaacuuaaaau

SEQ ID NO: 2105373 - RNA, 19 nt, Staphylococcus aureus subsp. aureus MW2
uaaaauguuaauaaugacu

SEQ ID NO: 2105374 - RNA, 14 nt, Staphylococcus aureus subsp. aureus MW2
uaaaauuaaaacuu

SEQ ID NO: 2105375 - RNA, 14 nt, Staphylococcus aureus subsp. aureus MW2
uaaaauuaaaacag

SEQ ID NO: 2105376 - RNA, 16 nt, Staphylococcus aureus subsp. aureus MW2
uaaaauguuaauaaug

SEQ ID NO: 2105377 - RNA, 19 nt, Staphylococcus aureus subsp. aureus MW2
uaaaauggcaucuggcaaa

SEQ ID NO: 2105378 - RNA, 18 nt, Staphylococcus aureus subsp. aureus MW2
uaaaauggcaucuggcaa

SEQ ID NO: 2105379 - RNA, 23 nt, Staphylococcus aureus subsp. aureus MW2
uaaaauccuaagcaucguaaaaa

SEQ ID NO: 2105380 - RNA, 17 nt, Staphylococcus aureus subsp. aureus MW2
uaaaauccgcuuuauuu

SEQ ID NO: 2105381 - RNA, 20 nt, Staphylococcus aureus subsp. aureus MW2
uaaaauccgcuuuauuuuau

SEQ ID NO: 2105382 - RNA, 16 nt, Staphylococcus aureus subsp. aureus MW2
uaaaaucuauaccauu

SEQ ID NO: 2105383 - RNA, 18 nt, Staphylococcus aureus subsp. aureus MW2
uaaaaugcuacaauuucc

SEQ ID NO: 2105384 - RNA, 13 nt, Staphylococcus aureus subsp. aureus MW2
uaaaauaaucggu

SEQ ID NO: 2105385 - RNA, 14 nt, Staphylococcus aureus subsp. aureus MW2
uaaaauaacuaagu

SEQ ID NO: 2105386 - RNA, 15 nt, Staphylococcus aureus subsp. aureus MW2
uaaaauaagauauau

SEQ ID NO: 2105387 - RNA, 11 nt, Staphylococcus aureus subsp. aureus MW2
uaaaauaacua

SEQ ID NO: 2105388 - RNA, 22 nt, Staphylococcus aureus subsp. aureus MW2
uaaaaggcgaaacauuaaaaua

SEQ ID NO: 2105389 - RNA, 17 nt, Staphylococcus aureus subsp. aureus MW2
uaaaaggcuuuguuaaa

SEQ ID NO: 2105390 - RNA, 21 nt, Staphylococcus aureus subsp. aureus MW2
uaaaaggcgaaacauuaaaau

SEQ ID NO: 2105391 - RNA, 17 nt, Staphylococcus aureus subsp. aureus MW2
uaaaaggcgaaacauua

SEQ ID NO: 2105392 - RNA, 20 nt, Staphylococcus aureus subsp. aureus MW2
uaaaaggaugugacaaauac

SEQ ID NO: 2105393 - RNA, 19 nt, Staphylococcus aureus subsp. aureus MW2
uaaaauaaugcuuauuaaa

SEQ ID NO: 2105394 - RNA, 16 nt, Staphylococcus aureus subsp. aureus MW2
uaaaauaauuaaacuu

SEQ ID NO: 2105395 - RNA, 15 nt, Staphylococcus aureus subsp. aureus MW2
uaaaauaauuaaaua

SEQ ID NO: 2105396 - RNA, 13 nt, Staphylococcus aureus subsp. aureus MW2
uaaaauaauuaaa

SEQ ID NO: 2105397 - RNA, 19 nt, Staphylococcus aureus subsp. aureus MW2
uaaaauauaugaauaaguc

SEQ ID NO: 2105398 - RNA, 13 nt, Staphylococcus aureus subsp. aureus MW2
uaaaauauaucuu

SEQ ID NO: 2105399 - RNA, 16 nt, Staphylococcus aureus subsp. aureus MW2
uaaaauauuuaacuuu

SEQ ID NO: 2105400 - RNA, 14 nt, Staphylococcus aureus subsp. aureus MW2
uaaaauauuaauaa

SEQ ID NO: 2105401 - RNA, 23 nt, Staphylococcus aureus subsp. aureus MW2
uaaaauauuaggugaaaccauac

SEQ ID NO: 2105402 - RNA, 15 nt, Staphylococcus aureus subsp. aureus MW2
uaaaauaucaaaaua

SEQ ID NO: 2105403 - RNA, 19 nt, Staphylococcus aureus subsp. aureus MW2
uaaaucguguuaauucuuc

SEQ ID NO: 2105404 - RNA, 15 nt, Staphylococcus aureus subsp. aureus MW2
uaaaucuaaaucuau

SEQ ID NO: 2105405 - RNA, 14 nt, Staphylococcus aureus subsp. aureus MW2
uaaaucuacaauau

SEQ ID NO: 2105406 - RNA, 23 nt, Staphylococcus aureus subsp. aureus MW2
uaaaugauggguaguuaauauaa

SEQ ID NO: 2105407 - RNA, 14 nt, Staphylococcus aureus subsp. aureus MW2
uaaaugauuaauaa

SEQ ID NO: 2105408 - RNA, 18 nt, Staphylococcus aureus subsp. aureus MW2
uaaaugaugcaguaaaac

SEQ ID NO: 2105409 - RNA, 20 nt, Staphylococcus aureus subsp. aureus MW2
uaaaugaugcaguaaaacca

SEQ ID NO: 2105410 - RNA, 16 nt, Staphylococcus aureus subsp. aureus MW2
uaaaugauuuaauaaa

SEQ ID NO: 2105411 - RNA, 15 nt, Staphylococcus aureus subsp. aureus MW2
uaaaugauuucacuu

SEQ ID NO: 2105412 - RNA, 22 nt, Staphylococcus aureus subsp. aureus MW2
uaaaugauuucuucauuaucaa

SEQ ID NO: 2105413 - RNA, 16 nt, Staphylococcus aureus subsp. aureus MW2
uaaaugcaauacauua

SEQ ID NO: 2105414 - RNA, 17 nt, Staphylococcus aureus subsp. aureus MW2
uaaaucgauaaaaugua

SEQ ID NO: 2105415 - RNA, 14 nt, Staphylococcus aureus subsp. aureus MW2
uaaaucgauaacag

SEQ ID NO: 2105416 - RNA, 21 nt, Staphylococcus aureus subsp. aureus MW2
uaaauauuuaaaauauuauuu

SEQ ID NO: 2105417 - RNA, 20 nt, Staphylococcus aureus subsp. aureus MW2
uaaauauuggaauacucuuu

SEQ ID NO: 2105418 - RNA, 15 nt, Staphylococcus aureus subsp. aureus MW2
uaaauauugauauaa

SEQ ID NO: 2105419 - RNA, 16 nt, Staphylococcus aureus subsp. aureus MW2
uaaauaguuuuucaua

SEQ ID NO: 2105420 - RNA, 14 nt, Staphylococcus aureus subsp. aureus MW2
uaaauauuauaaaa

SEQ ID NO: 2105421 - RNA, 18 nt, Staphylococcus aureus subsp. aureus MW2
uaaauauuauaaaaagau

SEQ ID NO: 2105422 - RNA, 23 nt, Staphylococcus aureus subsp. aureus MW2
uaaaucauagucgguuauuacaa

SEQ ID NO: 2105423 - RNA, 12 nt, Staphylococcus aureus subsp. aureus MW2
uaaaucauuauu

SEQ ID NO: 2105424 - RNA, 13 nt, Staphylococcus aureus subsp. aureus MW2
uaaaucauuauuu

SEQ ID NO: 2105425 - RNA, 17 nt, Staphylococcus aureus subsp. aureus MW2
uaaaucaucuucaguua

SEQ ID NO: 2105426 - RNA, 18 nt, Staphylococcus aureus subsp. aureus MW2
uaaaucaugaaauuaaaa

SEQ ID NO: 2105427 - RNA, 22 nt, Staphylococcus aureus subsp. aureus MW2
uaaaucauacgagaaauuagaa

SEQ ID NO: 2105428 - RNA, 19 nt, Staphylococcus aureus subsp. aureus MW2
uaaauaagugauaaauaau

SEQ ID NO: 2105429 - RNA, 19 nt, Staphylococcus aureus subsp. aureus MW2
uaaauaaguaguucaauaa

SEQ ID NO: 2105430 - RNA, 12 nt, Staphylococcus aureus subsp. aureus MW2
uaaauaaguagu

SEQ ID NO: 2105431 - RNA, 13 nt, Staphylococcus aureus subsp. aureus MW2
uaaauaacuucgu

SEQ ID NO: 2105432 - RNA, 19 nt, Staphylococcus aureus subsp. aureus MW2
uaaauaagcaaucauaaua

SEQ ID NO: 2105433 - RNA, 19 nt, Staphylococcus aureus subsp. aureus MW2
uaaauaacuuuuuaaagga

SEQ ID NO: 2105434 - RNA, 13 nt, Staphylococcus aureus subsp. aureus MW2
uaaauacaucgga

SEQ ID NO: 2105435 - RNA, 17 nt, Staphylococcus aureus subsp. aureus MW2
uaaauacgccaaauacu

SEQ ID NO: 2105436 - RNA, 19 nt, Staphylococcus aureus subsp. aureus MW2
uaaauacgccaaauacuag

SEQ ID NO: 2105437 - RNA, 22 nt, Staphylococcus aureus subsp. aureus MW2
uaaauaguaagguuugaacucu

SEQ ID NO: 2105438 - RNA, 14 nt, Staphylococcus aureus subsp. aureus MW2
uaaauagcuuuacu

SEQ ID NO: 2105439 - RNA, 19 nt, Staphylococcus aureus subsp. aureus MW2
uaaauaggaugaaaaagau

SEQ ID NO: 2105440 - RNA, 19 nt, Staphylococcus aureus subsp. aureus MW2
uaaauaggugauuauauau

SEQ ID NO: 2105441 - RNA, 15 nt, Staphylococcus aureus subsp. aureus MW2
uaaagugaaauaaag

SEQ ID NO: 2105442 - RNA, 21 nt, Staphylococcus aureus subsp. aureus MW2
uaaaguguagccaaauaaauu

SEQ ID NO: 2105443 - RNA, 15 nt, Staphylococcus aureus subsp. aureus MW2
uaaaguguaaauuug

SEQ ID NO: 2105444 - RNA, 19 nt, Staphylococcus aureus subsp. aureus MW2
uaaauaacuauccauaaag

SEQ ID NO: 2105445 - RNA, 22 nt, Staphylococcus aureus subsp. aureus MW2
uaaauaacuauccauaaaguga

SEQ ID NO: 2105446 - RNA, 19 nt, Staphylococcus aureus subsp. aureus MW2
uaaaguuccaaguuaaugc

SEQ ID NO: 2105447 - RNA, 17 nt, Staphylococcus aureus subsp. aureus MW2
uaaaguguuucaacaua

SEQ ID NO: 2105448 - RNA, 18 nt, Staphylococcus aureus subsp. aureus MW2
uaaagucaauuuaaauaa

SEQ ID NO: 2105449 - RNA, 21 nt, Staphylococcus aureus subsp. aureus MW2
uaaagucaacaucguauucuu

SEQ ID NO: 2105450 - RNA, 16 nt, Staphylococcus aureus subsp. aureus MW2
uaaaguauguugucau

SEQ ID NO: 2105451 - RNA, 21 nt, Staphylococcus aureus subsp. aureus MW2
uaaagucguaucauauauuga

SEQ ID NO: 2105452 - RNA, 17 nt, Staphylococcus aureus subsp. aureus MW2
uaaagggggcucucauu

SEQ ID NO: 2105453 - RNA, 19 nt, Staphylococcus aureus subsp. aureus MW2
uaaagggcuauuugauaca

SEQ ID NO: 2105454 - RNA, 15 nt, Staphylococcus aureus subsp. aureus MW2
uaaacauguacaauu

SEQ ID NO: 2105455 - RNA, 19 nt, Staphylococcus aureus subsp. aureus MW2
uaaacaugggcaaucacuc

SEQ ID NO: 2105456 - RNA, 18 nt, Staphylococcus aureus subsp. aureus MW2
uaaaccaguuuaguauua

SEQ ID NO: 2105457 - RNA, 19 nt, Staphylococcus aureus subsp. aureus MW2
uaaaccauuuucaagagga

SEQ ID NO: 2105458 - RNA, 23 nt, Staphylococcus aureus subsp. aureus MW2
uaaaccgcacuucuauauuaaua

SEQ ID NO: 2105459 - RNA, 18 nt, Staphylococcus aureus subsp. aureus MW2
uaaaccgauuaauauaau

SEQ ID NO: 2105460 - RNA, 14 nt, Staphylococcus aureus subsp. aureus MW2
uaaacaugaacaau

SEQ ID NO: 2105461 - RNA, 17 nt, Staphylococcus aureus subsp. aureus MW2
uaaacaucuucuucauc

SEQ ID NO: 2105462 - RNA, 16 nt, Staphylococcus aureus subsp. aureus MW2
uaaacauaucaucaua

SEQ ID NO: 2105463 - RNA, 14 nt, Staphylococcus aureus subsp. aureus MW2
uaaacauaacauga

SEQ ID NO: 2105464 - RNA, 23 nt, Staphylococcus aureus subsp. aureus MW2
uaaacuagaaaacauaaauacaa

SEQ ID NO: 2105465 - RNA, 14 nt, Staphylococcus aureus subsp. aureus MW2
uaaacuauaauaau

SEQ ID NO: 2105466 - RNA, 15 nt, Staphylococcus aureus subsp. aureus MW2
uaaacuauuaaauca

SEQ ID NO: 2105467 - RNA, 18 nt, Staphylococcus aureus subsp. aureus MW2
uaaacggaauaacuuuuu

SEQ ID NO: 2105468 - RNA, 23 nt, Staphylococcus aureus subsp. aureus MW2
uaaacgguaacaaagauuauuga

SEQ ID NO: 2105469 - RNA, 24 nt, Staphylococcus aureus subsp. aureus MW2
uaaacucaaaaagccaacacauuc

SEQ ID NO: 2105470 - RNA, 20 nt, Staphylococcus aureus subsp. aureus MW2
uaaacucauaauuuucuauu

SEQ ID NO: 2105471 - RNA, 15 nt, Staphylococcus aureus subsp. aureus MW2
uaaacuguaaacauu

SEQ ID NO: 2105472 - RNA, 14 nt, Staphylococcus aureus subsp. aureus MW2
uaaagauucaauua

SEQ ID NO: 2105473 - RNA, 20 nt, Staphylococcus aureus subsp. aureus MW2
uaaagauugauauuuaggug

SEQ ID NO: 2105474 - RNA, 16 nt, Staphylococcus aureus subsp. aureus MW2
uaaagauuaaaauaug

SEQ ID NO: 2105475 - RNA, 15 nt, Staphylococcus aureus subsp. aureus MW2
uaaagauguugaaaa

SEQ ID NO: 2105476 - RNA, 15 nt, Staphylococcus aureus subsp. aureus MW2
uaaagcuauaaaaaa

SEQ ID NO: 2105477 - RNA, 18 nt, Staphylococcus aureus subsp. aureus MW2
uaaagcugauuuuucauu

SEQ ID NO: 2105478 - RNA, 21 nt, Staphylococcus aureus subsp. aureus MW2
uaaagcuaacauaccuaauaa

SEQ ID NO: 2105479 - RNA, 21 nt, Staphylococcus aureus subsp. aureus MW2
uaaagcuucgucaaugacuaa

SEQ ID NO: 2105480 - RNA, 16 nt, Staphylococcus aureus subsp. aureus MW2
uaaagcuuuaguuaaa

SEQ ID NO: 2105481 - RNA, 22 nt, Staphylococcus aureus subsp. aureus MW2
uaaaggcauuguguaugagucu

SEQ ID NO: 2105482 - RNA, 21 nt, Staphylococcus aureus subsp. aureus MW2
uaaagaguuauguuugucguu

SEQ ID NO: 2105483 - RNA, 20 nt, Staphylococcus aureus subsp. aureus MW2
uaaagaacuauguucaauuu

SEQ ID NO: 2105484 - RNA, 23 nt, Staphylococcus aureus subsp. aureus MW2
uaaagaacuauguucaauuuaug

SEQ ID NO: 2105485 - RNA, 13 nt, Staphylococcus aureus subsp. aureus MW2
uaaacuuauuaau

SEQ ID NO: 2105486 - RNA, 15 nt, Staphylococcus aureus subsp. aureus MW2
uaaacugaucaugau

SEQ ID NO: 2105487 - RNA, 15 nt, Staphylococcus aureus subsp. aureus MW2
uaaacuuaaaagaga

SEQ ID NO: 2105488 - RNA, 13 nt, Staphylococcus aureus subsp. aureus MW2
uaaacuuaagaau

SEQ ID NO: 2105489 - RNA, 20 nt, Staphylococcus aureus subsp. aureus MW2
uaacaagaaguaauguuaaa

SEQ ID NO: 2105490 - RNA, 19 nt, Staphylococcus aureus subsp. aureus MW2
uaacaagaaguaauguuaa

SEQ ID NO: 2105491 - RNA, 17 nt, Staphylococcus aureus subsp. aureus MW2
uaacaaguacaauaaua

SEQ ID NO: 2105492 - RNA, 21 nt, Staphylococcus aureus subsp. aureus MW2
uaacaaccuauuaauugaaau

SEQ ID NO: 2105493 - RNA, 20 nt, Staphylococcus aureus subsp. aureus MW2
uaacaaguacaauaauaccu

SEQ ID NO: 2105494 - RNA, 13 nt, Staphylococcus aureus subsp. aureus MW2
uaacaaguauaaa

SEQ ID NO: 2105495 - RNA, 17 nt, Staphylococcus aureus subsp. aureus MW2
uaacaagugaugaaaaa

SEQ ID NO: 2105496 - RNA, 18 nt, Staphylococcus aureus subsp. aureus MW2
uaacaagugaugaaaaag

SEQ ID NO: 2105497 - RNA, 19 nt, Staphylococcus aureus subsp. aureus MW2
uaacaagugaugaaaaaga

SEQ ID NO: 2105498 - RNA, 19 nt, Staphylococcus aureus subsp. aureus MW2
uaacaaguucauuucaaua

SEQ ID NO: 2105499 - RNA, 17 nt, Staphylococcus aureus subsp. aureus MW2
uaacaaucguuuuaaug

SEQ ID NO: 2105500 - RNA, 22 nt, Staphylococcus aureus subsp. aureus MW2
uaacacgcucuuuucaaaaaua

SEQ ID NO: 2105501 - RNA, 17 nt, Staphylococcus aureus subsp. aureus MW2
uaacaacacuacccaca

SEQ ID NO: 2105502 - RNA, 16 nt, Staphylococcus aureus subsp. aureus MW2
uaaauuuuuuaauaua

SEQ ID NO: 2105503 - RNA, 18 nt, Staphylococcus aureus subsp. aureus MW2
uaaauguuaaauucuaaa

SEQ ID NO: 2105504 - RNA, 14 nt, Staphylococcus aureus subsp. aureus MW2
uaaaugugcaauua

SEQ ID NO: 2105505 - RNA, 16 nt, Staphylococcus aureus subsp. aureus MW2
uaaauguauuaaacau

SEQ ID NO: 2105506 - RNA, 16 nt, Staphylococcus aureus subsp. aureus MW2
uaaaugucacugcaaa

SEQ ID NO: 2105507 - RNA, 20 nt, Staphylococcus aureus subsp. aureus MW2
uaaaugcccaccauguacau

SEQ ID NO: 2105508 - RNA, 13 nt, Staphylococcus aureus subsp. aureus MW2
uaaaugcauaaua

SEQ ID NO: 2105509 - RNA, 17 nt, Staphylococcus aureus subsp. aureus MW2
uaaaugcauaauauauu

SEQ ID NO: 2105510 - RNA, 20 nt, Staphylococcus aureus subsp. aureus MW2
uaaaugcauaauauauuaaa

SEQ ID NO: 2105511 - RNA, 15 nt, Staphylococcus aureus subsp. aureus MW2
uaacauaaaaugagu

SEQ ID NO: 2105512 - RNA, 23 nt, Staphylococcus aureus subsp. aureus MW2
uaacauaaaaaggucuauguaca

SEQ ID NO: 2105513 - RNA, 14 nt, Staphylococcus aureus subsp. aureus MW2
uaacauaagaaaaa

SEQ ID NO: 2105514 - RNA, 19 nt, Staphylococcus aureus subsp. aureus MW2
uaacaucacagaaaauaca

SEQ ID NO: 2105515 - RNA, 22 nt, Staphylococcus aureus subsp. aureus MW2
uaacaucaaauagacaccaaaa

SEQ ID NO: 2105516 - RNA, 16 nt, Staphylococcus aureus subsp. aureus MW2
uaacaucaaauagaca

SEQ ID NO: 2105517 - RNA, 13 nt, Staphylococcus aureus subsp. aureus MW2
uaacauaugcaag

SEQ ID NO: 2105518 - RNA, 14 nt, Staphylococcus aureus subsp. aureus MW2
uaacauaugcaagu

SEQ ID NO: 2105519 - RNA, 21 nt, Staphylococcus aureus subsp. aureus MW2
uaacauaucgcgcaucaaaaa

SEQ ID NO: 2105520 - RNA, 16 nt, Staphylococcus aureus subsp. aureus MW2
uaacagcuacaaauaa

SEQ ID NO: 2105521 - RNA, 15 nt, Staphylococcus aureus subsp. aureus MW2
uaacagcuaaaaauu

SEQ ID NO: 2105522 - RNA, 20 nt, Staphylococcus aureus subsp. aureus MW2
uaacagcuuaauuuuauuau

SEQ ID NO: 2105523 - RNA, 21 nt, Staphylococcus aureus subsp. aureus MW2
uaacagucccaaccccuuuau

SEQ ID NO: 2105524 - RNA, 12 nt, Staphylococcus aureus subsp. aureus MW2
uaacaucugaau

SEQ ID NO: 2105525 - RNA, 21 nt, Staphylococcus aureus subsp. aureus MW2
uaacauccugcuuauuaauug

SEQ ID NO: 2105526 - RNA, 21 nt, Staphylococcus aureus subsp. aureus MW2
uaacauccccaaaaauagauu

SEQ ID NO: 2105527 - RNA, 19 nt, Staphylococcus aureus subsp. aureus MW2
uaacauccugcuuauuaau

SEQ ID NO: 2105528 - RNA, 19 nt, Staphylococcus aureus subsp. aureus MW2
uaaccaaaccauuaauaaa

SEQ ID NO: 2105529 - RNA, 18 nt, Staphylococcus aureus subsp. aureus MW2
uaaccacuccuuaaacaa

SEQ ID NO: 2105530 - RNA, 22 nt, Staphylococcus aureus subsp. aureus MW2
uaaccacaucauucgaauacug

SEQ ID NO: 2105531 - RNA, 22 nt, Staphylococcus aureus subsp. aureus MW2
uaaccaccaucccauuaaacca

SEQ ID NO: 2105532 - RNA, 23 nt, Staphylococcus aureus subsp. aureus MW2
uaaccaccaucccauuaaaccac

SEQ ID NO: 2105533 - RNA, 22 nt, Staphylococcus aureus subsp. aureus MW2
uaacugugauauuaauugaaaa

SEQ ID NO: 2105534 - RNA, 15 nt, Staphylococcus aureus subsp. aureus MW2
uaacuguaaaacauu

SEQ ID NO: 2105535 - RNA, 20 nt, Staphylococcus aureus subsp. aureus MW2
uaacuggcaaaucaaacaau

SEQ ID NO: 2105536 - RNA, 15 nt, Staphylococcus aureus subsp. aureus MW2
uaacucuuuaauuuu

SEQ ID NO: 2105537 - RNA, 16 nt, Staphylococcus aureus subsp. aureus MW2
uaacucuuuguauaag

SEQ ID NO: 2105538 - RNA, 14 nt, Staphylococcus aureus subsp. aureus MW2
uaacucuucaguac

SEQ ID NO: 2105539 - RNA, 19 nt, Staphylococcus aureus subsp. aureus MW2
uaacugcaaacuugauuca

SEQ ID NO: 2105540 - RNA, 17 nt, Staphylococcus aureus subsp. aureus MW2
uaacuagugccucuuuu

SEQ ID NO: 2105541 - RNA, 17 nt, Staphylococcus aureus subsp. aureus MW2
uaacuaguguaaugucu

SEQ ID NO: 2105542 - RNA, 20 nt, Staphylococcus aureus subsp. aureus MW2
uaacuaguauccuuuauaaa

SEQ ID NO: 2105543 - RNA, 22 nt, Staphylococcus aureus subsp. aureus MW2
uaacuagauguucacauucuug

SEQ ID NO: 2105544 - RNA, 16 nt, Staphylococcus aureus subsp. aureus MW2
uaacuagaaugauuaa

SEQ ID NO: 2105545 - RNA, 14 nt, Staphylococcus aureus subsp. aureus MW2
uaacuauuuaauua

SEQ ID NO: 2105546 - RNA, 16 nt, Staphylococcus aureus subsp. aureus MW2
uaacuauccauaaagu

SEQ ID NO: 2105547 - RNA, 22 nt, Staphylococcus aureus subsp. aureus MW2
uaacuauaacaauaguuuucuu

SEQ ID NO: 2105548 - RNA, 16 nt, Staphylococcus aureus subsp. aureus MW2
uaacucguaaucauag

SEQ ID NO: 2105549 - RNA, 19 nt, Staphylococcus aureus subsp. aureus MW2
uaacucaugcacuuuauua

SEQ ID NO: 2105550 - RNA, 21 nt, Staphylococcus aureus subsp. aureus MW2
uaacuaaaaugucuuugaaaa

SEQ ID NO: 2105551 - RNA, 21 nt, Staphylococcus aureus subsp. aureus MW2
uaacuaaagaacuauguucaa

SEQ ID NO: 2105552 - RNA, 17 nt, Staphylococcus aureus subsp. aureus MW2
uaacuaaaccauugaau

SEQ ID NO: 2105553 - RNA, 12 nt, Staphylococcus aureus subsp. aureus MW2
uaacggcucgcg

SEQ ID NO: 2105554 - RNA, 15 nt, Staphylococcus aureus subsp. aureus MW2
uaaccuuuaaaacau

SEQ ID NO: 2105555 - RNA, 16 nt, Staphylococcus aureus subsp. aureus MW2
uaaccuuuaaaacauc

SEQ ID NO: 2105556 - RNA, 17 nt, Staphylococcus aureus subsp. aureus MW2
uaaccuuuaaaacauca

SEQ ID NO: 2105557 - RNA, 14 nt, Staphylococcus aureus subsp. aureus MW2
uaaccuuaauuauu

SEQ ID NO: 2105558 - RNA, 12 nt, Staphylococcus aureus subsp. aureus MW2
uaaccuuacaua

SEQ ID NO: 2105559 - RNA, 14 nt, Staphylococcus aureus subsp. aureus MW2
uaaccuguuuuuau

SEQ ID NO: 2105560 - RNA, 12 nt, Staphylococcus aureus subsp. aureus MW2
uaaccugacuuu

SEQ ID NO: 2105561 - RNA, 15 nt, Staphylococcus aureus subsp. aureus MW2
uaaccugacuuuccg

SEQ ID NO: 2105562 - RNA, 15 nt, Staphylococcus aureus subsp. aureus MW2
uaaccauuuaaaaau

SEQ ID NO: 2105563 - RNA, 14 nt, Staphylococcus aureus subsp. aureus MW2
uaaccauuuaaaaa

SEQ ID NO: 2105564 - RNA, 14 nt, Staphylococcus aureus subsp. aureus MW2
uaaccauuucauuu

SEQ ID NO: 2105565 - RNA, 16 nt, Staphylococcus aureus subsp. aureus MW2
uaaccccauuuuaaag

SEQ ID NO: 2105566 - RNA, 17 nt, Staphylococcus aureus subsp. aureus MW2
uaaccccauuuuaaagu

SEQ ID NO: 2105567 - RNA, 21 nt, Staphylococcus aureus subsp. aureus MW2
uaagcuuucuaucuuguucuu

SEQ ID NO: 2105568 - RNA, 14 nt, Staphylococcus aureus subsp. aureus MW2
uaaggaaccugucu

SEQ ID NO: 2105569 - RNA, 19 nt, Staphylococcus aureus subsp. aureus MW2
uaaggaaccugucuuaauu

SEQ ID NO: 2105570 - RNA, 23 nt, Staphylococcus aureus subsp. aureus MW2
uaaggaaccugucuuaauucauu

SEQ ID NO: 2105571 - RNA, 21 nt, Staphylococcus aureus subsp. aureus MW2
uaagcucauuucaauauuaaa

SEQ ID NO: 2105572 - RNA, 12 nt, Staphylococcus aureus subsp. aureus MW2
uaagcugaaaua

SEQ ID NO: 2105573 - RNA, 21 nt, Staphylococcus aureus subsp. aureus MW2
uaagcugcucgauauaagucu

SEQ ID NO: 2105574 - RNA, 21 nt, Staphylococcus aureus subsp. aureus MW2
uaagcgcaauggccauuugau

SEQ ID NO: 2105575 - RNA, 18 nt, Staphylococcus aureus subsp. aureus MW2
uaagccuuuucaaacaua

SEQ ID NO: 2105576 - RNA, 17 nt, Staphylococcus aureus subsp. aureus MW2
uaagccuuuucaaacau

SEQ ID NO: 2105577 - RNA, 13 nt, Staphylococcus aureus subsp. aureus MW2
uaagcuaauauuu

SEQ ID NO: 2105578 - RNA, 14 nt, Staphylococcus aureus subsp. aureus MW2
uaagcguaauauuu

SEQ ID NO: 2105579 - RNA, 18 nt, Staphylococcus aureus subsp. aureus MW2
uaagcguaauauuuaaga

SEQ ID NO: 2105580 - RNA, 22 nt, Staphylococcus aureus subsp. aureus MW2
uaagcguaauauuuaagaaguu

SEQ ID NO: 2105581 - RNA, 23 nt, Staphylococcus aureus subsp. aureus MW2
uaagcauuaauguucaauuuaua

SEQ ID NO: 2105582 - RNA, 20 nt, Staphylococcus aureus subsp. aureus MW2
uaagcauuaauguucaauuu

SEQ ID NO: 2105583 - RNA, 18 nt, Staphylococcus aureus subsp. aureus MW2
uaagcaucguaaaaaaca

SEQ ID NO: 2105584 - RNA, 20 nt, Staphylococcus aureus subsp. aureus MW2
uaagcagacuaaaaguggcc

SEQ ID NO: 2105585 - RNA, 20 nt, Staphylococcus aureus subsp. aureus MW2
uaagcaguuaauaagaaacu

SEQ ID NO: 2105586 - RNA, 19 nt, Staphylococcus aureus subsp. aureus MW2
uaagcaguuaauaagaaac

SEQ ID NO: 2105587 - RNA, 22 nt, Staphylococcus aureus subsp. aureus MW2
uaagcagagccguaaugagagu

SEQ ID NO: 2105588 - RNA, 22 nt, Staphylococcus aureus subsp. aureus MW2
uaagaugcaugccaauuaauuc

SEQ ID NO: 2105589 - RNA, 21 nt, Staphylococcus aureus subsp. aureus MW2
uaagauguauaugaauuuuau

SEQ ID NO: 2105590 - RNA, 12 nt, Staphylococcus aureus subsp. aureus MW2
uaagauuagcua

SEQ ID NO: 2105591 - RNA, 15 nt, Staphylococcus aureus subsp. aureus MW2
uaagauuauuuucaa

SEQ ID NO: 2105592 - RNA, 21 nt, Staphylococcus aureus subsp. aureus MW2
uaagauuauuuucaauuagaa

SEQ ID NO: 2105593 - RNA, 22 nt, Staphylococcus aureus subsp. aureus MW2
uaagauuuuuuauguuuaauuu

SEQ ID NO: 2105594 - RNA, 15 nt, Staphylococcus aureus subsp. aureus MW2
uaagauuuaaacauc

SEQ ID NO: 2105595 - RNA, 12 nt, Staphylococcus aureus subsp. aureus MW2
uaagcaaaaauu

SEQ ID NO: 2105596 - RNA, 20 nt, Staphylococcus aureus subsp. aureus MW2
uaagauuuugcuuuaaacau

SEQ ID NO: 2105597 - RNA, 13 nt, Staphylococcus aureus subsp. aureus MW2
uaagcaaagauga

SEQ ID NO: 2105598 - RNA, 21 nt, Staphylococcus aureus subsp. aureus MW2
uaagaaaaauguguuaaaaua

SEQ ID NO: 2105599 - RNA, 21 nt, Staphylococcus aureus subsp. aureus MW2
uaacuuuuugugauuauucca

SEQ ID NO: 2105600 - RNA, 15 nt, Staphylococcus aureus subsp. aureus MW2
uaagaaaaggcuccc

SEQ ID NO: 2105601 - RNA, 15 nt, Staphylococcus aureus subsp. aureus MW2
uaagaaaauacuaac

SEQ ID NO: 2105602 - RNA, 20 nt, Staphylococcus aureus subsp. aureus MW2
uaacuuucuuuuguuuuuau

SEQ ID NO: 2105603 - RNA, 14 nt, Staphylococcus aureus subsp. aureus MW2
uaacuuuggcauca

SEQ ID NO: 2105604 - RNA, 16 nt, Staphylococcus aureus subsp. aureus MW2
uaacuuuguaugaaga

SEQ ID NO: 2105605 - RNA, 18 nt, Staphylococcus aureus subsp. aureus MW2
uaacuuugucuguauuau

SEQ ID NO: 2105606 - RNA, 13 nt, Staphylococcus aureus subsp. aureus MW2
uaacuuucuuuug

SEQ ID NO: 2105607 - RNA, 13 nt, Staphylococcus aureus subsp. aureus MW2
uaacuuucccuac

SEQ ID NO: 2105608 - RNA, 22 nt, Staphylococcus aureus subsp. aureus MW2
uaacuuuccgccuucaauccaa

SEQ ID NO: 2105609 - RNA, 23 nt, Staphylococcus aureus subsp. aureus MW2
uaagaacuugcuuuucauuuaau

SEQ ID NO: 2105610 - RNA, 22 nt, Staphylococcus aureus subsp. aureus MW2
uaagaagguguuugauuuugag

SEQ ID NO: 2105611 - RNA, 17 nt, Staphylococcus aureus subsp. aureus MW2
uaagaaaaucauucauu

SEQ ID NO: 2105612 - RNA, 19 nt, Staphylococcus aureus subsp. aureus MW2
uaacuucauaauauauccu

SEQ ID NO: 2105613 - RNA, 17 nt, Staphylococcus aureus subsp. aureus MW2
uaacuuaucugauuguu

SEQ ID NO: 2105614 - RNA, 23 nt, Staphylococcus aureus subsp. aureus MW2
uaacuuagaccccuaauuaaaau

SEQ ID NO: 2105615 - RNA, 19 nt, Staphylococcus aureus subsp. aureus MW2
uaacuuaagcucauuucaa

SEQ ID NO: 2105616 - RNA, 13 nt, Staphylococcus aureus subsp. aureus MW2
uaacuuaaaauuu

SEQ ID NO: 2105617 - RNA, 18 nt, Staphylococcus aureus subsp. aureus MW2
uaacuuaaaauuuaaaua

SEQ ID NO: 2105618 - RNA, 15 nt, Staphylococcus aureus subsp. aureus MW2
uaacuguuuaucaug

SEQ ID NO: 2105619 - RNA, 17 nt, Staphylococcus aureus subsp. aureus MW2
uaacuguuuuaaauuaa

SEQ ID NO: 2105620 - RNA, 15 nt, Staphylococcus aureus subsp. aureus MW2
uaacuguguauggca

SEQ ID NO: 2105621 - RNA, 21 nt, Staphylococcus aureus subsp. aureus MW2
uaacuuuaauauaaguauaau

SEQ ID NO: 2105622 - RNA, 18 nt, Staphylococcus aureus subsp. aureus MW2
uaacuuuaacaucugaau

SEQ ID NO: 2105623 - RNA, 16 nt, Staphylococcus aureus subsp. aureus MW2
uaacuuuaauuaaagc

SEQ ID NO: 2105624 - RNA, 14 nt, Staphylococcus aureus subsp. aureus MW2
uaacuugauaucau

SEQ ID NO: 2105625 - RNA, 16 nt, Staphylococcus aureus subsp. aureus MW2
uaacuugauaucaucu

SEQ ID NO: 2105626 - RNA, 18 nt, Staphylococcus aureus subsp. aureus MW2
uaacuucugguucuucac

SEQ ID NO: 2105627 - RNA, 17 nt, Staphylococcus aureus subsp. aureus MW2
uaagacagcuucucauu

SEQ ID NO: 2105628 - RNA, 16 nt, Staphylococcus aureus subsp. aureus MW2
uaagacugauuaauua

SEQ ID NO: 2105629 - RNA, 22 nt, Staphylococcus aureus subsp. aureus MW2
uaagaagugacaucguugcuuu

SEQ ID NO: 2105630 - RNA, 18 nt, Staphylococcus aureus subsp. aureus MW2
uaagaagugcuuaugaau

SEQ ID NO: 2105631 - RNA, 14 nt, Staphylococcus aureus subsp. aureus MW2
uaagaauuuaaaag

SEQ ID NO: 2105632 - RNA, 22 nt, Staphylococcus aureus subsp. aureus MW2
uaagaaugugagauacguuauu

SEQ ID NO: 2105633 - RNA, 12 nt, Staphylococcus aureus subsp. aureus MW2
uaagaauuuaaa

SEQ ID NO: 2105634 - RNA, 12 nt, Staphylococcus aureus subsp. aureus MW2
uaagauauauug

SEQ ID NO: 2105635 - RNA, 18 nt, Staphylococcus aureus subsp. aureus MW2
uaagauaguuugagaaaa

SEQ ID NO: 2105636 - RNA, 15 nt, Staphylococcus aureus subsp. aureus MW2
uaagauagauaaauc

SEQ ID NO: 2105637 - RNA, 14 nt, Staphylococcus aureus subsp. aureus MW2
uaagauauuuccaa

SEQ ID NO: 2105638 - RNA, 22 nt, Staphylococcus aureus subsp. aureus MW2
uaagagauuuucuuaauugaaa

SEQ ID NO: 2105639 - RNA, 16 nt, Staphylococcus aureus subsp. aureus MW2
uauagaggauauuuau

SEQ ID NO: 2105640 - RNA, 19 nt, Staphylococcus aureus subsp. aureus MW2
uauagauggcguaagcagu

SEQ ID NO: 2105641 - RNA, 15 nt, Staphylococcus aureus subsp. aureus MW2
uauagaugugucuuu

SEQ ID NO: 2105642 - RNA, 14 nt, Staphylococcus aureus subsp. aureus MW2
uauagauugccauu

SEQ ID NO: 2105643 - RNA, 20 nt, Staphylococcus aureus subsp. aureus MW2
uauagccgccuuuuaacaua

SEQ ID NO: 2105644 - RNA, 17 nt, Staphylococcus aureus subsp. aureus MW2
uauagaaugauuaaaau

SEQ ID NO: 2105645 - RNA, 13 nt, Staphylococcus aureus subsp. aureus MW2
uauagaauaccaa

SEQ ID NO: 2105646 - RNA, 15 nt, Staphylococcus aureus subsp. aureus MW2
uauacuuuuauagaa

SEQ ID NO: 2105647 - RNA, 18 nt, Staphylococcus aureus subsp. aureus MW2
uauacuuuuuaaaugauu

SEQ ID NO: 2105648 - RNA, 16 nt, Staphylococcus aureus subsp. aureus MW2
uauacuuuuuaaauga

SEQ ID NO: 2105649 - RNA, 21 nt, Staphylococcus aureus subsp. aureus MW2
uauagaaaaugaguacaacau

SEQ ID NO: 2105650 - RNA, 23 nt, Staphylococcus aureus subsp. aureus MW2
uauagaaaaugaguacaacauag

SEQ ID NO: 2105651 - RNA, 20 nt, Staphylococcus aureus subsp. aureus MW2
uauagaaaaagggcaaaaaa

SEQ ID NO: 2105652 - RNA, 17 nt, Staphylococcus aureus subsp. aureus MW2
uauagaaaccaaaaaau

SEQ ID NO: 2105653 - RNA, 17 nt, Staphylococcus aureus subsp. aureus MW2
uauacuacuauugauau

SEQ ID NO: 2105654 - RNA, 22 nt, Staphylococcus aureus subsp. aureus MW2
uauacuuugagcggaaauauga

SEQ ID NO: 2105655 - RNA, 15 nt, Staphylococcus aureus subsp. aureus MW2
uauacugaugaaaac

SEQ ID NO: 2105656 - RNA, 17 nt, Staphylococcus aureus subsp. aureus MW2
uauaccauuccaaaaau

SEQ ID NO: 2105657 - RNA, 16 nt, Staphylococcus aureus subsp. aureus MW2
uauacauguaacagug

SEQ ID NO: 2105658 - RNA, 17 nt, Staphylococcus aureus subsp. aureus MW2
uauacauugauaaauuu

SEQ ID NO: 2105659 - RNA, 17 nt, Staphylococcus aureus subsp. aureus MW2
uauaauuuuaauauuau

SEQ ID NO: 2105660 - RNA, 12 nt, Staphylococcus aureus subsp. aureus MW2
uauaauuuuggc

SEQ ID NO: 2105661 - RNA, 17 nt, Staphylococcus aureus subsp. aureus MW2
uauaauuuuguuucacu

SEQ ID NO: 2105662 - RNA, 18 nt, Staphylococcus aureus subsp. aureus MW2
uauaauuuuguuucacua

SEQ ID NO: 2105663 - RNA, 13 nt, Staphylococcus aureus subsp. aureus MW2
uauacaaauuuau

SEQ ID NO: 2105664 - RNA, 20 nt, Staphylococcus aureus subsp. aureus MW2
uauacaaauuuauauuaaau

SEQ ID NO: 2105665 - RNA, 17 nt, Staphylococcus aureus subsp. aureus MW2
uauacaacauguguaug

SEQ ID NO: 2105666 - RNA, 12 nt, Staphylococcus aureus subsp. aureus MW2
uauaauuuauuu

SEQ ID NO: 2105667 - RNA, 14 nt, Staphylococcus aureus subsp. aureus MW2
uauaauuauuaaac

SEQ ID NO: 2105668 - RNA, 22 nt, Staphylococcus aureus subsp. aureus MW2
uauaauuuauuuagcaucuuua

SEQ ID NO: 2105669 - RNA, 16 nt, Staphylococcus aureus subsp. aureus MW2
uauaauuuaucuuaau

SEQ ID NO: 2105670 - RNA, 19 nt, Staphylococcus aureus subsp. aureus MW2
uauaauucuuguuugauuu

SEQ ID NO: 2105671 - RNA, 17 nt, Staphylococcus aureus subsp. aureus MW2
uauaauuuaauugguuu

SEQ ID NO: 2105672 - RNA, 20 nt, Staphylococcus aureus subsp. aureus MW2
uauaauuggcagauagaaug

SEQ ID NO: 2105673 - RNA, 18 nt, Staphylococcus aureus subsp. aureus MW2
uauaauuguaaugcuucu

SEQ ID NO: 2105674 - RNA, 18 nt, Staphylococcus aureus subsp. aureus MW2
uauacaauaguauaaaua

SEQ ID NO: 2105675 - RNA, 19 nt, Staphylococcus aureus subsp. aureus MW2
uauacacaaaguauuugaa

SEQ ID NO: 2105676 - RNA, 18 nt, Staphylococcus aureus subsp. aureus MW2
uauacacuuuuugacaua

SEQ ID NO: 2105677 - RNA, 16 nt, Staphylococcus aureus subsp. aureus MW2
uauacagguuuaauaa

SEQ ID NO: 2105678 - RNA, 21 nt, Staphylococcus aureus subsp. aureus MW2
uauacauaccacacuuuaaac

SEQ ID NO: 2105679 - RNA, 20 nt, Staphylococcus aureus subsp. aureus MW2
uauacagguuuaauaaauuu

SEQ ID NO: 2105680 - RNA, 14 nt, Staphylococcus aureus subsp. aureus MW2
uauaauuaaacuaa

SEQ ID NO: 2105681 - RNA, 15 nt, Staphylococcus aureus subsp. aureus MW2
uauaauuaaacauuu

SEQ ID NO: 2105682 - RNA, 21 nt, Staphylococcus aureus subsp. aureus MW2
uauaauuaaacauuuagauuu

SEQ ID NO: 2105683 - RNA, 16 nt, Staphylococcus aureus subsp. aureus MW2
uauaaugguugaauaa

SEQ ID NO: 2105684 - RNA, 15 nt, Staphylococcus aureus subsp. aureus MW2
uauaauguauaaaac

SEQ ID NO: 2105685 - RNA, 17 nt, Staphylococcus aureus subsp. aureus MW2
uauaauucuaagucucu

SEQ ID NO: 2105686 - RNA, 22 nt, Staphylococcus aureus subsp. aureus MW2
uauaauucgucuguuucauaua

SEQ ID NO: 2105687 - RNA, 11 nt, Staphylococcus aureus subsp. aureus MW2
uauaauucuuc

SEQ ID NO: 2105688 - RNA, 17 nt, Staphylococcus aureus subsp. aureus MW2
uauaaauuaaaugcaau

SEQ ID NO: 2105689 - RNA, 20 nt, Staphylococcus aureus subsp. aureus MW2
uauaauaaccuacauuaauu

SEQ ID NO: 2105690 - RNA, 13 nt, Staphylococcus aureus subsp. aureus MW2
uauaauagaaaua

SEQ ID NO: 2105691 - RNA, 14 nt, Staphylococcus aureus subsp. aureus MW2
uauaauagaaauaa

SEQ ID NO: 2105692 - RNA, 13 nt, Staphylococcus aureus subsp. aureus MW2
uauaauagagaaa

SEQ ID NO: 2105693 - RNA, 13 nt, Staphylococcus aureus subsp. aureus MW2
uauaauaauauug

SEQ ID NO: 2105694 - RNA, 15 nt, Staphylococcus aureus subsp. aureus MW2
uauaauaauauugaa

SEQ ID NO: 2105695 - RNA, 21 nt, Staphylococcus aureus subsp. aureus MW2
uauaauaauauugaaagauau

SEQ ID NO: 2105696 - RNA, 19 nt, Staphylococcus aureus subsp. aureus MW2
uauaauacaugauauaaau

SEQ ID NO: 2105697 - RNA, 11 nt, Staphylococcus aureus subsp. aureus MW2
uauaauaauau

SEQ ID NO: 2105698 - RNA, 15 nt, Staphylococcus aureus subsp. aureus MW2
uauaauauauacaaa

SEQ ID NO: 2105699 - RNA, 17 nt, Staphylococcus aureus subsp. aureus MW2
uauaauauauacaaaua

SEQ ID NO: 2105700 - RNA, 19 nt, Staphylococcus aureus subsp. aureus MW2
uauaauauauacaaauaaa

SEQ ID NO: 2105701 - RNA, 21 nt, Staphylococcus aureus subsp. aureus MW2
uaggucaacuguaguggaaga

SEQ ID NO: 2105702 - RNA, 18 nt, Staphylococcus aureus subsp. aureus MW2
uagucgguuauuacaaaa

SEQ ID NO: 2105703 - RNA, 15 nt, Staphylococcus aureus subsp. aureus MW2
uagucggggccccaa

SEQ ID NO: 2105704 - RNA, 16 nt, Staphylococcus aureus subsp. aureus MW2
uagucggggccccaac

SEQ ID NO: 2105705 - RNA, 23 nt, Staphylococcus aureus subsp. aureus MW2
uagucuuuuuauuuuaauauuuu

SEQ ID NO: 2105706 - RNA, 12 nt, Staphylococcus aureus subsp. aureus MW2
uagugaauaaug

SEQ ID NO: 2105707 - RNA, 13 nt, Staphylococcus aureus subsp. aureus MW2
uagugaaaauacc

SEQ ID NO: 2105708 - RNA, 15 nt, Staphylococcus aureus subsp. aureus MW2
uagucugcuauuuuu

SEQ ID NO: 2105709 - RNA, 14 nt, Staphylococcus aureus subsp. aureus MW2
uagugucacauuau

SEQ ID NO: 2105710 - RNA, 23 nt, Staphylococcus aureus subsp. aureus MW2
uaguggaagacaaugauuugugg

SEQ ID NO: 2105711 - RNA, 16 nt, Staphylococcus aureus subsp. aureus MW2
uaguuaauauaauuaa

SEQ ID NO: 2105712 - RNA, 17 nt, Staphylococcus aureus subsp. aureus MW2
uaguuagcccuauucaa

SEQ ID NO: 2105713 - RNA, 18 nt, Staphylococcus aureus subsp. aureus MW2
uaguuauacuacuauuga

SEQ ID NO: 2105714 - RNA, 18 nt, Staphylococcus aureus subsp. aureus MW2
uauaaauaaaaauacaua

SEQ ID NO: 2105715 - RNA, 20 nt, Staphylococcus aureus subsp. aureus MW2
uauaaauaaaaauacauaau

SEQ ID NO: 2105716 - RNA, 19 nt, Staphylococcus aureus subsp. aureus MW2
uauaaauaaaaauauaucu

SEQ ID NO: 2105717 - RNA, 14 nt, Staphylococcus aureus subsp. aureus MW2
uauaaauaaacaua

SEQ ID NO: 2105718 - RNA, 20 nt, Staphylococcus aureus subsp. aureus MW2
uauaaauaaacauaaaaaua

SEQ ID NO: 2105719 - RNA, 22 nt, Staphylococcus aureus subsp. aureus MW2
uauaaauaaacauaaaaauauu

SEQ ID NO: 2105720 - RNA, 20 nt, Staphylococcus aureus subsp. aureus MW2
uauaaauaaccgcacuuucu

SEQ ID NO: 2105721 - RNA, 17 nt, Staphylococcus aureus subsp. aureus MW2
uauaaaccgccaacuaa

SEQ ID NO: 2105722 - RNA, 12 nt, Staphylococcus aureus subsp. aureus MW2
uauaaaauucac

SEQ ID NO: 2105723 - RNA, 16 nt, Staphylococcus aureus subsp. aureus MW2
uauaaaauucaccaac

SEQ ID NO: 2105724 - RNA, 13 nt, Staphylococcus aureus subsp. aureus MW2
uauaaaaacaaaa

SEQ ID NO: 2105725 - RNA, 17 nt, Staphylococcus aureus subsp. aureus MW2
uauaaacaauuacaaaa

SEQ ID NO: 2105726 - RNA, 21 nt, Staphylococcus aureus subsp. aureus MW2
uauaaacaauuacaaaaucac

SEQ ID NO: 2105727 - RNA, 15 nt, Staphylococcus aureus subsp. aureus MW2
uauaaauauuuuuua

SEQ ID NO: 2105728 - RNA, 13 nt, Staphylococcus aureus subsp. aureus MW2
uauaaauaucaau

SEQ ID NO: 2105729 - RNA, 13 nt, Staphylococcus aureus subsp. aureus MW2
uauaaauaucuuu

SEQ ID NO: 2105730 - RNA, 23 nt, Staphylococcus aureus subsp. aureus MW2
uauaaauaggucacuuuuaaucu

SEQ ID NO: 2105731 - RNA, 22 nt, Staphylococcus aureus subsp. aureus MW2
uauaaaucauucuuuauagaaa

SEQ ID NO: 2105732 - RNA, 20 nt, Staphylococcus aureus subsp. aureus MW2
uauaaaugauuucuucauua

SEQ ID NO: 2105733 - RNA, 15 nt, Staphylococcus aureus subsp. aureus MW2
uauaaaugucauagu

SEQ ID NO: 2105734 - RNA, 22 nt, Staphylococcus aureus subsp. aureus MW2
uauaaauguuuauaucuuuuau

SEQ ID NO: 2105735 - RNA, 19 nt, Staphylococcus aureus subsp. aureus MW2
uauaaauguuuauaucuuu

SEQ ID NO: 2105736 - RNA, 20 nt, Staphylococcus aureus subsp. aureus MW2
uauaaaaaagcgccaauaca

SEQ ID NO: 2105737 - RNA, 16 nt, Staphylococcus aureus subsp. aureus MW2
uaguuuuaauauaauu

SEQ ID NO: 2105738 - RNA, 15 nt, Staphylococcus aureus subsp. aureus MW2
uaguuuguaauaauu

SEQ ID NO: 2105739 - RNA, 15 nt, Staphylococcus aureus subsp. aureus MW2
uaguuugaauuggga

SEQ ID NO: 2105740 - RNA, 21 nt, Staphylococcus aureus subsp. aureus MW2
uaguucacaugaauuuuaaua

SEQ ID NO: 2105741 - RNA, 20 nt, Staphylococcus aureus subsp. aureus MW2
uaguucacaugaauuuuaau

SEQ ID NO: 2105742 - RNA, 19 nt, Staphylococcus aureus subsp. aureus MW2
uaguucaaauugaacuucu

SEQ ID NO: 2105743 - RNA, 19 nt, Staphylococcus aureus subsp. aureus MW2
uaucauauucaaaauaacu

SEQ ID NO: 2105744 - RNA, 14 nt, Staphylococcus aureus subsp. aureus MW2
uaucauauuacuuc

SEQ ID NO: 2105745 - RNA, 13 nt, Staphylococcus aureus subsp. aureus MW2
uaucauauucaaa

SEQ ID NO: 2105746 - RNA, 14 nt, Staphylococcus aureus subsp. aureus MW2
uaucauauucaaaa

SEQ ID NO: 2105747 - RNA, 22 nt, Staphylococcus aureus subsp. aureus MW2
uaucauauaaugguugaauaac

SEQ ID NO: 2105748 - RNA, 14 nt, Staphylococcus aureus subsp. aureus MW2
uaucauacauauuu

SEQ ID NO: 2105749 - RNA, 22 nt, Staphylococcus aureus subsp. aureus MW2
uaucauaauauugaugaauaaa

SEQ ID NO: 2105750 - RNA, 18 nt, Staphylococcus aureus subsp. aureus MW2
uaucauacuucaaacguu

SEQ ID NO: 2105751 - RNA, 17 nt, Staphylococcus aureus subsp. aureus MW2
uaucauaaauauaagau

SEQ ID NO: 2105752 - RNA, 18 nt, Staphylococcus aureus subsp. aureus MW2
uaucagugugauuuugga

SEQ ID NO: 2105753 - RNA, 17 nt, Staphylococcus aureus subsp. aureus MW2
uaucaguuagcuuauuu

SEQ ID NO: 2105754 - RNA, 13 nt, Staphylococcus aureus subsp. aureus MW2
uaucagcuuuaau

SEQ ID NO: 2105755 - RNA, 23 nt, Staphylococcus aureus subsp. aureus MW2
uauauuuaguuagcccuauucaa

SEQ ID NO: 2105756 - RNA, 12 nt, Staphylococcus aureus subsp. aureus MW2
uauauuuaauuu

SEQ ID NO: 2105757 - RNA, 22 nt, Staphylococcus aureus subsp. aureus MW2
uauauuggcaguucugaaacau

SEQ ID NO: 2105758 - RNA, 19 nt, Staphylococcus aureus subsp. aureus MW2
uauauuggcgggccccaac

SEQ ID NO: 2105759 - RNA, 12 nt, Staphylococcus aureus subsp. aureus MW2
uauauuuaaacu

SEQ ID NO: 2105760 - RNA, 17 nt, Staphylococcus aureus subsp. aureus MW2
uauauuuaaacucucua

SEQ ID NO: 2105761 - RNA, 18 nt, Staphylococcus aureus subsp. aureus MW2
uauauuuaaaucaauauu

SEQ ID NO: 2105762 - RNA, 14 nt, Staphylococcus aureus subsp. aureus MW2
uauauuuaaauugg

SEQ ID NO: 2105763 - RNA, 19 nt, Staphylococcus aureus subsp. aureus MW2
uaucaauugaaugaaguaa

SEQ ID NO: 2105764 - RNA, 13 nt, Staphylococcus aureus subsp. aureus MW2
uaucacaacagua

SEQ ID NO: 2105765 - RNA, 17 nt, Staphylococcus aureus subsp. aureus MW2
uaucacaacaguauuaa

SEQ ID NO: 2105766 - RNA, 17 nt, Staphylococcus aureus subsp. aureus MW2
uaucaauagaugaaaau

SEQ ID NO: 2105767 - RNA, 16 nt, Staphylococcus aureus subsp. aureus MW2
uauauucaucucuuau

SEQ ID NO: 2105768 - RNA, 15 nt, Staphylococcus aureus subsp. aureus MW2
uauauuccauuucaa

SEQ ID NO: 2105769 - RNA, 23 nt, Staphylococcus aureus subsp. aureus MW2
uauauugacugccugacauucau

SEQ ID NO: 2105770 - RNA, 15 nt, Staphylococcus aureus subsp. aureus MW2
uauauucuaauugca

SEQ ID NO: 2105771 - RNA, 15 nt, Staphylococcus aureus subsp. aureus MW2
uauauuaaaguaaaa

SEQ ID NO: 2105772 - RNA, 14 nt, Staphylococcus aureus subsp. aureus MW2
uauaugaaaagaga

SEQ ID NO: 2105773 - RNA, 14 nt, Staphylococcus aureus subsp. aureus MW2
uauaucuuuauaug

SEQ ID NO: 2105774 - RNA, 18 nt, Staphylococcus aureus subsp. aureus MW2
uauaugaaauauuuaucu

SEQ ID NO: 2105775 - RNA, 17 nt, Staphylococcus aureus subsp. aureus MW2
uauauuaaauacuauau

SEQ ID NO: 2105776 - RNA, 20 nt, Staphylococcus aureus subsp. aureus MW2
uauauuaagacguuguaaug

SEQ ID NO: 2105777 - RNA, 18 nt, Staphylococcus aureus subsp. aureus MW2
uauauuacccuccuauua

SEQ ID NO: 2105778 - RNA, 22 nt, Staphylococcus aureus subsp. aureus MW2
uauauuacuaaccuauuaaaau

SEQ ID NO: 2105779 - RNA, 14 nt, Staphylococcus aureus subsp. aureus MW2
uauauuaguauaau

SEQ ID NO: 2105780 - RNA, 21 nt, Staphylococcus aureus subsp. aureus MW2
uauauagcacgcuuauugaaa

SEQ ID NO: 2105781 - RNA, 15 nt, Staphylococcus aureus subsp. aureus MW2
uauauaguaaaauaa

SEQ ID NO: 2105782 - RNA, 20 nt, Staphylococcus aureus subsp. aureus MW2
uauauaguaggguauugaaa

SEQ ID NO: 2105783 - RNA, 18 nt, Staphylococcus aureus subsp. aureus MW2
uauauaucaaauacauuu

SEQ ID NO: 2105784 - RNA, 21 nt, Staphylococcus aureus subsp. aureus MW2
uauauaucacaacacauaaau

SEQ ID NO: 2105785 - RNA, 17 nt, Staphylococcus aureus subsp. aureus MW2
uauauaucacauauuau

SEQ ID NO: 2105786 - RNA, 15 nt, Staphylococcus aureus subsp. aureus MW2
uauaucgcuuuugaa

SEQ ID NO: 2105787 - RNA, 16 nt, Staphylococcus aureus subsp. aureus MW2
uauaucuaaaugauca

SEQ ID NO: 2105788 - RNA, 24 nt, Staphylococcus aureus subsp. aureus MW2
uauaucuaauucguaauuuaugau

SEQ ID NO: 2105789 - RNA, 21 nt, Staphylococcus aureus subsp. aureus MW2
uauaucuauuuaucauacuuc

SEQ ID NO: 2105790 - RNA, 20 nt, Staphylococcus aureus subsp. aureus MW2
uauauagaaauaauuuaaag

SEQ ID NO: 2105791 - RNA, 16 nt, Staphylococcus aureus subsp. aureus MW2
uauauaccuugaacau

SEQ ID NO: 2105792 - RNA, 18 nt, Staphylococcus aureus subsp. aureus MW2
uauauaccuugaacauag

SEQ ID NO: 2105793 - RNA, 19 nt, Staphylococcus aureus subsp. aureus MW2
uauagggcuguuuuuuaau

SEQ ID NO: 2105794 - RNA, 18 nt, Staphylococcus aureus subsp. aureus MW2
uauaggaauuuuuuuaau

SEQ ID NO: 2105795 - RNA, 22 nt, Staphylococcus aureus subsp. aureus MW2
uaucgaauuagaucuaugguua

SEQ ID NO: 2105796 - RNA, 14 nt, Staphylococcus aureus subsp. aureus MW2
uauccuuuuugacu

SEQ ID NO: 2105797 - RNA, 16 nt, Staphylococcus aureus subsp. aureus MW2
uauccuucucaucauu

SEQ ID NO: 2105798 - RNA, 20 nt, Staphylococcus aureus subsp. aureus MW2
uauccuguuucauaugguga

SEQ ID NO: 2105799 - RNA, 14 nt, Staphylococcus aureus subsp. aureus MW2
uauccuuuaaauca

SEQ ID NO: 2105800 - RNA, 21 nt, Staphylococcus aureus subsp. aureus MW2
uauccuuuugaacguuuacuc

SEQ ID NO: 2105801 - RNA, 23 nt, Staphylococcus aureus subsp. aureus MW2
uauccgaaaauugcuaaaaaaau

SEQ ID NO: 2105802 - RNA, 21 nt, Staphylococcus aureus subsp. aureus MW2
uauccgaaaauugcuaaaaaa

SEQ ID NO: 2105803 - RNA, 12 nt, Staphylococcus aureus subsp. aureus MW2
uaucauauuuga

SEQ ID NO: 2105804 - RNA, 13 nt, Staphylococcus aureus subsp. aureus MW2
uaucaucaaaauu

SEQ ID NO: 2105805 - RNA, 16 nt, Staphylococcus aureus subsp. aureus MW2
uaucaucaaaauuuaa

SEQ ID NO: 2105806 - RNA, 17 nt, Staphylococcus aureus subsp. aureus MW2
uaucaucaaaauuuaau

SEQ ID NO: 2105807 - RNA, 19 nt, Staphylococcus aureus subsp. aureus MW2
uaucaucauacuucaauaa

SEQ ID NO: 2105808 - RNA, 16 nt, Staphylococcus aureus subsp. aureus MW2
uaucaucauuuaaaua

SEQ ID NO: 2105809 - RNA, 21 nt, Staphylococcus aureus subsp. aureus MW2
uaucaucgucuccaacuuuaa

SEQ ID NO: 2105810 - RNA, 16 nt, Staphylococcus aureus subsp. aureus MW2
uaucaucccauugcau

SEQ ID NO: 2105811 - RNA, 23 nt, Staphylococcus aureus subsp. aureus MW2
uaucaugcaaaacuaaucaaauu

SEQ ID NO: 2105812 - RNA, 15 nt, Staphylococcus aureus subsp. aureus MW2
uaucaugcaaaauaa

SEQ ID NO: 2105813 - RNA, 19 nt, Staphylococcus aureus subsp. aureus MW2
uaucauuaaauugcuugaa

SEQ ID NO: 2105814 - RNA, 22 nt, Staphylococcus aureus subsp. aureus MW2
uaucauuaugcccgauaauucu

SEQ ID NO: 2105815 - RNA, 19 nt, Staphylococcus aureus subsp. aureus MW2
uaucucugaaaaacuucuu

SEQ ID NO: 2105816 - RNA, 14 nt, Staphylococcus aureus subsp. aureus MW2
uaucuauguauagu

SEQ ID NO: 2105817 - RNA, 14 nt, Staphylococcus aureus subsp. aureus MW2
uaucuauacaauua

SEQ ID NO: 2105818 - RNA, 20 nt, Staphylococcus aureus subsp. aureus MW2
uaucuauacaauuauggaua

SEQ ID NO: 2105819 - RNA, 20 nt, Staphylococcus aureus subsp. aureus MW2
uaucugaaguagauugauau

SEQ ID NO: 2105820 - RNA, 18 nt, Staphylococcus aureus subsp. aureus MW2
uaucuuauaacaaaaauu

SEQ ID NO: 2105821 - RNA, 14 nt, Staphylococcus aureus subsp. aureus MW2
uaucuuauauucuu

SEQ ID NO: 2105822 - RNA, 17 nt, Staphylococcus aureus subsp. aureus MW2
uaucuguugucaucaug

SEQ ID NO: 2105823 - RNA, 13 nt, Staphylococcus aureus subsp. aureus MW2
uaucuguugucau

SEQ ID NO: 2105824 - RNA, 19 nt, Staphylococcus aureus subsp. aureus MW2
uaucuguaccguauuuuaa

SEQ ID NO: 2105825 - RNA, 16 nt, Staphylococcus aureus subsp. aureus MW2
uaucuagccugaaaua

SEQ ID NO: 2105826 - RNA, 13 nt, Staphylococcus aureus subsp. aureus MW2
uaucuauaaaaag

SEQ ID NO: 2105827 - RNA, 18 nt, Staphylococcus aureus subsp. aureus MW2
uaucuauaaaaagaauau

SEQ ID NO: 2105828 - RNA, 22 nt, Staphylococcus aureus subsp. aureus MW2
uaucuacgccuuggccuacuuu

SEQ ID NO: 2105829 - RNA, 23 nt, Staphylococcus aureus subsp. aureus MW2
uaucuaaugaucaucuauauuua

SEQ ID NO: 2105830 - RNA, 20 nt, Staphylococcus aureus subsp. aureus MW2
uaucuaaugggucaaugacu

SEQ ID NO: 2105831 - RNA, 13 nt, Staphylococcus aureus subsp. aureus MW2
uaucuaauucugu

SEQ ID NO: 2105832 - RNA, 16 nt, Staphylococcus aureus subsp. aureus MW2
uaucuaauucuucuaa

SEQ ID NO: 2105833 - RNA, 23 nt, Staphylococcus aureus subsp. aureus MW2
uaucuacaugguuuucaccagac

SEQ ID NO: 2105834 - RNA, 17 nt, Staphylococcus aureus subsp. aureus MW2
uaucgauucgauuauuu

SEQ ID NO: 2105835 - RNA, 22 nt, Staphylococcus aureus subsp. aureus MW2
uaucgauucgauuauuuagaua

SEQ ID NO: 2105836 - RNA, 14 nt, Staphylococcus aureus subsp. aureus MW2
uaucgauuaucuga

SEQ ID NO: 2105837 - RNA, 13 nt, Staphylococcus aureus subsp. aureus MW2
uaucgauaaaugu

SEQ ID NO: 2105838 - RNA, 16 nt, Staphylococcus aureus subsp. aureus MW2
uaucgacuuugucauu

SEQ ID NO: 2105839 - RNA, 20 nt, Staphylococcus aureus subsp. aureus MW2
uaucuaacaaucguuuuaau

SEQ ID NO: 2105840 - RNA, 14 nt, Staphylococcus aureus subsp. aureus MW2
uaucuaaaugugaa

SEQ ID NO: 2105841 - RNA, 16 nt, Staphylococcus aureus subsp. aureus MW2
uaucuaaacaauuccc

SEQ ID NO: 2105842 - RNA, 19 nt, Staphylococcus aureus subsp. aureus MW2
uaucuaaagcuauaaaaaa

SEQ ID NO: 2105843 - RNA, 23 nt, Staphylococcus aureus subsp. aureus MW2
uagccaaugcuuccaucacauca

SEQ ID NO: 2105844 - RNA, 13 nt, Staphylococcus aureus subsp. aureus MW2
uagccaauaaaau

SEQ ID NO: 2105845 - RNA, 16 nt, Staphylococcus aureus subsp. aureus MW2
uagcacugaaaucuag

SEQ ID NO: 2105846 - RNA, 22 nt, Staphylococcus aureus subsp. aureus MW2
uagcaccguaacauauguacua

SEQ ID NO: 2105847 - RNA, 18 nt, Staphylococcus aureus subsp. aureus MW2
uagcacgcuuauugaaaa

SEQ ID NO: 2105848 - RNA, 21 nt, Staphylococcus aureus subsp. aureus MW2
uagcacgcuuauugaaaagau

SEQ ID NO: 2105849 - RNA, 17 nt, Staphylococcus aureus subsp. aureus MW2
uagcaccagcacaucaa

SEQ ID NO: 2105850 - RNA, 19 nt, Staphylococcus aureus subsp. aureus MW2
uagcaccagcacaucaaag

SEQ ID NO: 2105851 - RNA, 19 nt, Staphylococcus aureus subsp. aureus MW2
uagcauauucgcuuaaaaa

SEQ ID NO: 2105852 - RNA, 19 nt, Staphylococcus aureus subsp. aureus MW2
uagcaucaaaaauaaaaau

SEQ ID NO: 2105853 - RNA, 12 nt, Staphylococcus aureus subsp. aureus MW2
uagcauaaaauu

SEQ ID NO: 2105854 - RNA, 13 nt, Staphylococcus aureus subsp. aureus MW2
uagccaaauaaau

SEQ ID NO: 2105855 - RNA, 22 nt, Staphylococcus aureus subsp. aureus MW2
uagauaucuuaaucuaaaaaua

SEQ ID NO: 2105856 - RNA, 14 nt, Staphylococcus aureus subsp. aureus MW2
uagcaauaucauca

SEQ ID NO: 2105857 - RNA, 16 nt, Staphylococcus aureus subsp. aureus MW2
uagcaauaucaucauu

SEQ ID NO: 2105858 - RNA, 12 nt, Staphylococcus aureus subsp. aureus MW2
uagcucuacuaa

SEQ ID NO: 2105859 - RNA, 12 nt, Staphylococcus aureus subsp. aureus MW2
uagcucuucuuu

SEQ ID NO: 2105860 - RNA, 14 nt, Staphylococcus aureus subsp. aureus MW2
uagcucuucuuuuu

SEQ ID NO: 2105861 - RNA, 20 nt, Staphylococcus aureus subsp. aureus MW2
uagcucuuuuuugauuuaac

SEQ ID NO: 2105862 - RNA, 16 nt, Staphylococcus aureus subsp. aureus MW2
uagcuuucguuucuuu

SEQ ID NO: 2105863 - RNA, 15 nt, Staphylococcus aureus subsp. aureus MW2
uagcuuuaguuacua

SEQ ID NO: 2105864 - RNA, 17 nt, Staphylococcus aureus subsp. aureus MW2
uagcuugaauaauauau

SEQ ID NO: 2105865 - RNA, 18 nt, Staphylococcus aureus subsp. aureus MW2
uagcuugaauaauauauu

SEQ ID NO: 2105866 - RNA, 21 nt, Staphylococcus aureus subsp. aureus MW2
uagcuucuuaaaucaacauca

SEQ ID NO: 2105867 - RNA, 15 nt, Staphylococcus aureus subsp. aureus MW2
uaggaaaacuucaau

SEQ ID NO: 2105868 - RNA, 23 nt, Staphylococcus aureus subsp. aureus MW2
uaggggcuucuuucuaaaauaac

SEQ ID NO: 2105869 - RNA, 20 nt, Staphylococcus aureus subsp. aureus MW2
uaggcgccauaaucauuagu

SEQ ID NO: 2105870 - RNA, 16 nt, Staphylococcus aureus subsp. aureus MW2
uagggauaauuuuauu

SEQ ID NO: 2105871 - RNA, 16 nt, Staphylococcus aureus subsp. aureus MW2
uaggaauccaauuucu

SEQ ID NO: 2105872 - RNA, 18 nt, Staphylococcus aureus subsp. aureus MW2
uaggaaugacauuuaaag

SEQ ID NO: 2105873 - RNA, 14 nt, Staphylococcus aureus subsp. aureus MW2
uagacauuaaaaaa

SEQ ID NO: 2105874 - RNA, 23 nt, Staphylococcus aureus subsp. aureus MW2
uagacaauguucuuuucaacauu

SEQ ID NO: 2105875 - RNA, 21 nt, Staphylococcus aureus subsp. aureus MW2
uagacaauauuuuuacauauu

SEQ ID NO: 2105876 - RNA, 18 nt, Staphylococcus aureus subsp. aureus MW2
uagacaaucaucuuaaug

SEQ ID NO: 2105877 - RNA, 14 nt, Staphylococcus aureus subsp. aureus MW2
uagacauaaaaaaa

SEQ ID NO: 2105878 - RNA, 17 nt, Staphylococcus aureus subsp. aureus MW2
uagacauaagcaaagau

SEQ ID NO: 2105879 - RNA, 13 nt, Staphylococcus aureus subsp. aureus MW2
uagacuaaaaaac

SEQ ID NO: 2105880 - RNA, 19 nt, Staphylococcus aureus subsp. aureus MW2
uagacuaagcagucugcuc

SEQ ID NO: 2105881 - RNA, 16 nt, Staphylococcus aureus subsp. aureus MW2
uagagacuuauuuuau

SEQ ID NO: 2105882 - RNA, 22 nt, Staphylococcus aureus subsp. aureus MW2
uagagaauuucaaaaaggaauu

SEQ ID NO: 2105883 - RNA, 13 nt, Staphylococcus aureus subsp. aureus MW2
uagagaacagcag

SEQ ID NO: 2105884 - RNA, 18 nt, Staphylococcus aureus subsp. aureus MW2
uagacuuggauaaaaauu

SEQ ID NO: 2105885 - RNA, 13 nt, Staphylococcus aureus subsp. aureus MW2
uagagaaaaaaua

SEQ ID NO: 2105886 - RNA, 15 nt, Staphylococcus aureus subsp. aureus MW2
uagagaaaaaauaaa

SEQ ID NO: 2105887 - RNA, 17 nt, Staphylococcus aureus subsp. aureus MW2
uagacuuuauuuuucca

SEQ ID NO: 2105888 - RNA, 15 nt, Staphylococcus aureus subsp. aureus MW2
uagaguuuaggacau

SEQ ID NO: 2105889 - RNA, 12 nt, Staphylococcus aureus subsp. aureus MW2
uagaguagaaag

SEQ ID NO: 2105890 - RNA, 13 nt, Staphylococcus aureus subsp. aureus MW2
uagaguagaaagu

SEQ ID NO: 2105891 - RNA, 13 nt, Staphylococcus aureus subsp. aureus MW2
uagauaccaaacu

SEQ ID NO: 2105892 - RNA, 13 nt, Staphylococcus aureus subsp. aureus MW2
uagauagcggauu

SEQ ID NO: 2105893 - RNA, 17 nt, Staphylococcus aureus subsp. aureus MW2
uagauagcggauuuauu

SEQ ID NO: 2105894 - RNA, 17 nt, Staphylococcus aureus subsp. aureus MW2
uagauacuucuuuagca

SEQ ID NO: 2105895 - RNA, 17 nt, Staphylococcus aureus subsp. aureus MW2
uagauagaaauugugcu

SEQ ID NO: 2105896 - RNA, 18 nt, Staphylococcus aureus subsp. aureus MW2
uagauaaaucgauaaaau

SEQ ID NO: 2105897 - RNA, 12 nt, Staphylococcus aureus subsp. aureus MW2
uagauaaucuca

SEQ ID NO: 2105898 - RNA, 17 nt, Staphylococcus aureus subsp. aureus MW2
uagaaauaauuuaaagg

SEQ ID NO: 2105899 - RNA, 15 nt, Staphylococcus aureus subsp. aureus MW2
uagaaaguuuuauuu

SEQ ID NO: 2105900 - RNA, 20 nt, Staphylococcus aureus subsp. aureus MW2
uagaaagugcgguuauuuau

SEQ ID NO: 2105901 - RNA, 15 nt, Staphylococcus aureus subsp. aureus MW2
uagaaaguugugguc

SEQ ID NO: 2105902 - RNA, 18 nt, Staphylococcus aureus subsp. aureus MW2
uagaaagcgucuuuuuau

SEQ ID NO: 2105903 - RNA, 15 nt, Staphylococcus aureus subsp. aureus MW2
uagaaaguaaugcuu

SEQ ID NO: 2105904 - RNA, 18 nt, Staphylococcus aureus subsp. aureus MW2
uagaaaucagcuuuucuu

SEQ ID NO: 2105905 - RNA, 21 nt, Staphylococcus aureus subsp. aureus MW2
uagaaaucgccuuguuuauuu

SEQ ID NO: 2105906 - RNA, 17 nt, Staphylococcus aureus subsp. aureus MW2
uagaaauuguaguauuu

SEQ ID NO: 2105907 - RNA, 20 nt, Staphylococcus aureus subsp. aureus MW2
uagaaauugucuuuucauuu

SEQ ID NO: 2105908 - RNA, 23 nt, Staphylococcus aureus subsp. aureus MW2
uagaaauugucuuuucauuuuuu

SEQ ID NO: 2105909 - RNA, 15 nt, Staphylococcus aureus subsp. aureus MW2
uagaacaguuagaaa

SEQ ID NO: 2105910 - RNA, 18 nt, Staphylococcus aureus subsp. aureus MW2
uagaacaguuagaaacag

SEQ ID NO: 2105911 - RNA, 14 nt, Staphylococcus aureus subsp. aureus MW2
uacuauauuuaaau

SEQ ID NO: 2105912 - RNA, 15 nt, Staphylococcus aureus subsp. aureus MW2
uacuauauucaauga

SEQ ID NO: 2105913 - RNA, 13 nt, Staphylococcus aureus subsp. aureus MW2
uacuauauauaau

SEQ ID NO: 2105914 - RNA, 14 nt, Staphylococcus aureus subsp. aureus MW2
uacuauacaaugua

SEQ ID NO: 2105915 - RNA, 16 nt, Staphylococcus aureus subsp. aureus MW2
uacuauacaauguauu

SEQ ID NO: 2105916 - RNA, 18 nt, Staphylococcus aureus subsp. aureus MW2
uacuauacaauguauuuu

SEQ ID NO: 2105917 - RNA, 20 nt, Staphylococcus aureus subsp. aureus MW2
uacuauaaaaucaucguauu

SEQ ID NO: 2105918 - RNA, 24 nt, Staphylococcus aureus subsp. aureus MW2
uacuauaaaaucaucguauuucau

SEQ ID NO: 2105919 - RNA, 18 nt, Staphylococcus aureus subsp. aureus MW2
uacuacaaagcacaccua

SEQ ID NO: 2105920 - RNA, 23 nt, Staphylococcus aureus subsp. aureus MW2
uacuaguuuguaauaauuaacuu

SEQ ID NO: 2105921 - RNA, 14 nt, Staphylococcus aureus subsp. aureus MW2
uacuaguaauaaua

SEQ ID NO: 2105922 - RNA, 18 nt, Staphylococcus aureus subsp. aureus MW2
uacuaggaauauaaaacu

SEQ ID NO: 2105923 - RNA, 19 nt, Staphylococcus aureus subsp. aureus MW2
uacuagcauuagcaaauau

SEQ ID NO: 2105924 - RNA, 15 nt, Staphylococcus aureus subsp. aureus MW2
uagaaacacuuuuag

SEQ ID NO: 2105925 - RNA, 16 nt, Staphylococcus aureus subsp. aureus MW2
uagaaacgaaauuaua

SEQ ID NO: 2105926 - RNA, 13 nt, Staphylococcus aureus subsp. aureus MW2
uacuauauuuauu

SEQ ID NO: 2105927 - RNA, 18 nt, Staphylococcus aureus subsp. aureus MW2
uagaauacuaaaaguguu

SEQ ID NO: 2105928 - RNA, 23 nt, Staphylococcus aureus subsp. aureus MW2
uagaauaacuugauauuauauaa

SEQ ID NO: 2105929 - RNA, 13 nt, Staphylococcus aureus subsp. aureus MW2
uagaaguuuagug

SEQ ID NO: 2105930 - RNA, 23 nt, Staphylococcus aureus subsp. aureus MW2
uagaagguuauuuuuuauggucu

SEQ ID NO: 2105931 - RNA, 22 nt, Staphylococcus aureus subsp. aureus MW2
uagaagcuggcggaaagucagc

SEQ ID NO: 2105932 - RNA, 21 nt, Staphylococcus aureus subsp. aureus MW2
uagaagaugauuauucucuuu

SEQ ID NO: 2105933 - RNA, 20 nt, Staphylococcus aureus subsp. aureus MW2
uagaagcaaaagaugaaaau

SEQ ID NO: 2105934 - RNA, 18 nt, Staphylococcus aureus subsp. aureus MW2
uagaagaacaauaauuga

SEQ ID NO: 2105935 - RNA, 22 nt, Staphylococcus aureus subsp. aureus MW2
uagaagaaaagaacauucuaac

SEQ ID NO: 2105936 - RNA, 21 nt, Staphylococcus aureus subsp. aureus MW2
uagaacgaaauaguucaaaau

SEQ ID NO: 2105937 - RNA, 16 nt, Staphylococcus aureus subsp. aureus MW2
uagaaccaucauuuau

SEQ ID NO: 2105938 - RNA, 16 nt, Staphylococcus aureus subsp. aureus MW2
uagaauucuaaaagaa

SEQ ID NO: 2105939 - RNA, 18 nt, Staphylococcus aureus subsp. aureus MW2
uagaaugucgauauuucu

SEQ ID NO: 2105940 - RNA, 14 nt, Staphylococcus aureus subsp. aureus MW2
uagaauuuaacauu

SEQ ID NO: 2105941 - RNA, 14 nt, Staphylococcus aureus subsp. aureus MW2
uagaauuucuuuuc

SEQ ID NO: 2105942 - RNA, 16 nt, Staphylococcus aureus subsp. aureus MW2
uagaaugauuaaaauu

SEQ ID NO: 2105943 - RNA, 18 nt, Staphylococcus aureus subsp. aureus MW2
uagaaugauuaaaauuaa

SEQ ID NO: 2105944 - RNA, 19 nt, Staphylococcus aureus subsp. aureus MW2
uagaaugauuaaaauuaau

SEQ ID NO: 2105945 - RNA, 17 nt, Staphylococcus aureus subsp. aureus MW2
uagaauaguuaccaaaa

SEQ ID NO: 2105946 - RNA, 18 nt, Staphylococcus aureus subsp. aureus MW2
uagaauagucaauuaaug

SEQ ID NO: 2105947 - RNA, 15 nt, Staphylococcus aureus subsp. aureus MW2
uacacuuuucuuauc

SEQ ID NO: 2105948 - RNA, 23 nt, Staphylococcus aureus subsp. aureus MW2
uacacuuuugauuguuuaaacau

SEQ ID NO: 2105949 - RNA, 14 nt, Staphylococcus aureus subsp. aureus MW2
uacaauuuuuaaaa

SEQ ID NO: 2105950 - RNA, 15 nt, Staphylococcus aureus subsp. aureus MW2
uacaauuuuuaaaaa

SEQ ID NO: 2105951 - RNA, 15 nt, Staphylococcus aureus subsp. aureus MW2
uacacaaauuaaaac

SEQ ID NO: 2105952 - RNA, 16 nt, Staphylococcus aureus subsp. aureus MW2
uacaauuuuuaaaaac

SEQ ID NO: 2105953 - RNA, 18 nt, Staphylococcus aureus subsp. aureus MW2
uacaauuuuccuuucaau

SEQ ID NO: 2105954 - RNA, 22 nt, Staphylococcus aureus subsp. aureus MW2
uacaauuuuccuuucaauaaua

SEQ ID NO: 2105955 - RNA, 23 nt, Staphylococcus aureus subsp. aureus MW2
uacaauuuuccuuucaauaauaa

SEQ ID NO: 2105956 - RNA, 16 nt, Staphylococcus aureus subsp. aureus MW2
uacaauguauuuugau

SEQ ID NO: 2105957 - RNA, 16 nt, Staphylococcus aureus subsp. aureus MW2
uacacuugguuaucau

SEQ ID NO: 2105958 - RNA, 22 nt, Staphylococcus aureus subsp. aureus MW2
uacacacugcuaaaauuguauu

SEQ ID NO: 2105959 - RNA, 22 nt, Staphylococcus aureus subsp. aureus MW2
uacacaaugauuauaaauacau

SEQ ID NO: 2105960 - RNA, 16 nt, Staphylococcus aureus subsp. aureus MW2
uacagaucucaaucca

SEQ ID NO: 2105961 - RNA, 20 nt, Staphylococcus aureus subsp. aureus MW2
uacagaucucaauccaauua

SEQ ID NO: 2105962 - RNA, 18 nt, Staphylococcus aureus subsp. aureus MW2
uacagauaggaaacuuaa

SEQ ID NO: 2105963 - RNA, 14 nt, Staphylococcus aureus subsp. aureus MW2
uacagauaauuauu

SEQ ID NO: 2105964 - RNA, 17 nt, Staphylococcus aureus subsp. aureus MW2
uacagauaagaauauuu

SEQ ID NO: 2105965 - RNA, 18 nt, Staphylococcus aureus subsp. aureus MW2
uacagauaaguaauaaua

SEQ ID NO: 2105966 - RNA, 22 nt, Staphylococcus aureus subsp. aureus MW2
uacagauaggaaacuuaaauau

SEQ ID NO: 2105967 - RNA, 17 nt, Staphylococcus aureus subsp. aureus MW2
uaauuguacuuaaaccu

SEQ ID NO: 2105968 - RNA, 23 nt, Staphylococcus aureus subsp. aureus MW2
uaauuguacuuaaaccuaacaua

SEQ ID NO: 2105969 - RNA, 15 nt, Staphylococcus aureus subsp. aureus MW2
uacaaagugauuuaa

SEQ ID NO: 2105970 - RNA, 21 nt, Staphylococcus aureus subsp. aureus MW2
uacaaagugauuuaaaaaaau

SEQ ID NO: 2105971 - RNA, 17 nt, Staphylococcus aureus subsp. aureus MW2
uacaaaggguuauuaac

SEQ ID NO: 2105972 - RNA, 23 nt, Staphylococcus aureus subsp. aureus MW2
uacaaauaacaaacauuaaucua

SEQ ID NO: 2105973 - RNA, 21 nt, Staphylococcus aureus subsp. aureus MW2
uacaaaguuaaucauacauau

SEQ ID NO: 2105974 - RNA, 20 nt, Staphylococcus aureus subsp. aureus MW2
uacaaagucauuuucauuca

SEQ ID NO: 2105975 - RNA, 14 nt, Staphylococcus aureus subsp. aureus MW2
uacaacauguguau

SEQ ID NO: 2105976 - RNA, 21 nt, Staphylococcus aureus subsp. aureus MW2
uacaacaccaauugaaauuaa

SEQ ID NO: 2105977 - RNA, 15 nt, Staphylococcus aureus subsp. aureus MW2
uacaacaguaaucau

SEQ ID NO: 2105978 - RNA, 17 nt, Staphylococcus aureus subsp. aureus MW2
uacaaauuuuaaaauaa

SEQ ID NO: 2105979 - RNA, 18 nt, Staphylococcus aureus subsp. aureus MW2
uacaaauuuuuuuuauua

SEQ ID NO: 2105980 - RNA, 17 nt, Staphylococcus aureus subsp. aureus MW2
uacaaauuuauauuaaa

SEQ ID NO: 2105981 - RNA, 17 nt, Staphylococcus aureus subsp. aureus MW2
uacaaauauguaaucag

SEQ ID NO: 2105982 - RNA, 20 nt, Staphylococcus aureus subsp. aureus MW2
uacaaaucaugacauaaaac

SEQ ID NO: 2105983 - RNA, 14 nt, Staphylococcus aureus subsp. aureus MW2
uacaaaucgauauu

SEQ ID NO: 2105984 - RNA, 14 nt, Staphylococcus aureus subsp. aureus MW2
uacaauaaugugca

SEQ ID NO: 2105985 - RNA, 18 nt, Staphylococcus aureus subsp. aureus MW2
uacaauaaugugcaaguu

SEQ ID NO: 2105986 - RNA, 22 nt, Staphylococcus aureus subsp. aureus MW2
uacaaccuuugcuuaaaccuua

SEQ ID NO: 2105987 - RNA, 20 nt, Staphylococcus aureus subsp. aureus MW2
uacaauaguauaaauaucau

SEQ ID NO: 2105988 - RNA, 15 nt, Staphylococcus aureus subsp. aureus MW2
uacaauauagaaaau

SEQ ID NO: 2105989 - RNA, 17 nt, Staphylococcus aureus subsp. aureus MW2
uacaauauuaaaauuaa

SEQ ID NO: 2105990 - RNA, 18 nt, Staphylococcus aureus subsp. aureus MW2
uacaauauuaaaauuaaa

SEQ ID NO: 2105991 - RNA, 14 nt, Staphylococcus aureus subsp. aureus MW2
uacaauaugauuaa

SEQ ID NO: 2105992 - RNA, 15 nt, Staphylococcus aureus subsp. aureus MW2
uacaauaugauuaau

SEQ ID NO: 2105993 - RNA, 16 nt, Staphylococcus aureus subsp. aureus MW2
uacaauaugauuaaua

SEQ ID NO: 2105994 - RNA, 17 nt, Staphylococcus aureus subsp. aureus MW2
uacaaucaucacacaua

SEQ ID NO: 2105995 - RNA, 17 nt, Staphylococcus aureus subsp. aureus MW2
uacaaugcgguauugca

SEQ ID NO: 2105996 - RNA, 16 nt, Staphylococcus aureus subsp. aureus MW2
uacaaugaauuucuaa

SEQ ID NO: 2105997 - RNA, 17 nt, Staphylococcus aureus subsp. aureus MW2
uacaaugaauuucuaau

SEQ ID NO: 2105998 - RNA, 20 nt, Staphylococcus aureus subsp. aureus MW2
uacaauccugaagagaaaau

SEQ ID NO: 2105999 - RNA, 23 nt, Staphylococcus aureus subsp. aureus MW2
uacaauccuaaaauacuguuuuc

SEQ ID NO: 2106000 - RNA, 14 nt, Staphylococcus aureus subsp. aureus MW2
uaccaaauauauuu

SEQ ID NO: 2106001 - RNA, 21 nt, Staphylococcus aureus subsp. aureus MW2
uaccaacugucgguucaucua

SEQ ID NO: 2106002 - RNA, 18 nt, Staphylococcus aureus subsp. aureus MW2
uaccaauacguuuccaau

SEQ ID NO: 2106003 - RNA, 22 nt, Staphylococcus aureus subsp. aureus MW2
uaccaauacguuuccaauccau

SEQ ID NO: 2106004 - RNA, 22 nt, Staphylococcus aureus subsp. aureus MW2
uaccaauaucaugcaaaauaau

SEQ ID NO: 2106005 - RNA, 17 nt, Staphylococcus aureus subsp. aureus MW2
uaccaauugcuucuucg

SEQ ID NO: 2106006 - RNA, 16 nt, Staphylococcus aureus subsp. aureus MW2
uacauuuuaauaaaau

SEQ ID NO: 2106007 - RNA, 22 nt, Staphylococcus aureus subsp. aureus MW2
uacauuuuaauaaaaucaucuu

SEQ ID NO: 2106008 - RNA, 23 nt, Staphylococcus aureus subsp. aureus MW2
uacauuucucguuucgucagauu

SEQ ID NO: 2106009 - RNA, 22 nt, Staphylococcus aureus subsp. aureus MW2
uacauuuauuuucaauaaauaa

SEQ ID NO: 2106010 - RNA, 16 nt, Staphylococcus aureus subsp. aureus MW2
uacauuuaguacauau

SEQ ID NO: 2106011 - RNA, 17 nt, Staphylococcus aureus subsp. aureus MW2
uacauuguaaauauagu

SEQ ID NO: 2106012 - RNA, 14 nt, Staphylococcus aureus subsp. aureus MW2
uacauugauaaauu

SEQ ID NO: 2106013 - RNA, 15 nt, Staphylococcus aureus subsp. aureus MW2
uacauugauaaaaua

SEQ ID NO: 2106014 - RNA, 17 nt, Staphylococcus aureus subsp. aureus MW2
uacauugauaaaauaau

SEQ ID NO: 2106015 - RNA, 18 nt, Staphylococcus aureus subsp. aureus MW2
uacauuaaagaaaauauc

SEQ ID NO: 2106016 - RNA, 17 nt, Staphylococcus aureus subsp. aureus MW2
uacauuaacgauuaaua

SEQ ID NO: 2106017 - RNA, 18 nt, Staphylococcus aureus subsp. aureus MW2
uacauuaacgauuaauau

SEQ ID NO: 2106018 - RNA, 20 nt, Staphylococcus aureus subsp. aureus MW2
uacauuaacgauuaauauaa

SEQ ID NO: 2106019 - RNA, 22 nt, Staphylococcus aureus subsp. aureus MW2
uacauuaaacauauuuuuugau

SEQ ID NO: 2106020 - RNA, 12 nt, Staphylococcus aureus subsp. aureus MW2
uacauuauuaau

SEQ ID NO: 2106021 - RNA, 17 nt, Staphylococcus aureus subsp. aureus MW2
uacauuaguuugaucau

SEQ ID NO: 2106022 - RNA, 15 nt, Staphylococcus aureus subsp. aureus MW2
uacaugacuccaugc

SEQ ID NO: 2106023 - RNA, 14 nt, Staphylococcus aureus subsp. aureus MW2
uacauguauaaaag

SEQ ID NO: 2106024 - RNA, 14 nt, Staphylococcus aureus subsp. aureus MW2
uacaugugcuuuaa

SEQ ID NO: 2106025 - RNA, 17 nt, Staphylococcus aureus subsp. aureus MW2
uacaugugcuuuaaagg

SEQ ID NO: 2106026 - RNA, 16 nt, Staphylococcus aureus subsp. aureus MW2
uacaucuauccuuguu

SEQ ID NO: 2106027 - RNA, 18 nt, Staphylococcus aureus subsp. aureus MW2
uacaucauaaacgaaaau

SEQ ID NO: 2106028 - RNA, 16 nt, Staphylococcus aureus subsp. aureus MW2
uacaucauuaaauauu

SEQ ID NO: 2106029 - RNA, 14 nt, Staphylococcus aureus subsp. aureus MW2
uacaucuaauaaau

SEQ ID NO: 2106030 - RNA, 15 nt, Staphylococcus aureus subsp. aureus MW2
uacauaggauaucua

SEQ ID NO: 2106031 - RNA, 14 nt, Staphylococcus aureus subsp. aureus MW2
uacauauaauaugu

SEQ ID NO: 2106032 - RNA, 17 nt, Staphylococcus aureus subsp. aureus MW2
uacauauaagaauuguu

SEQ ID NO: 2106033 - RNA, 13 nt, Staphylococcus aureus subsp. aureus MW2
uacauauaagaau

SEQ ID NO: 2106034 - RNA, 16 nt, Staphylococcus aureus subsp. aureus MW2
uacauaggauaucuac

SEQ ID NO: 2106035 - RNA, 18 nt, Staphylococcus aureus subsp. aureus MW2
uacauauacaaauuuaua

SEQ ID NO: 2106036 - RNA, 16 nt, Staphylococcus aureus subsp. aureus MW2
uacauauggcaaaauc

SEQ ID NO: 2106037 - RNA, 16 nt, Staphylococcus aureus subsp. aureus MW2
uacauauucucugcuu

SEQ ID NO: 2106038 - RNA, 17 nt, Staphylococcus aureus subsp. aureus MW2
uacauauucucugcuuc

SEQ ID NO: 2106039 - RNA, 14 nt, Staphylococcus aureus subsp. aureus MW2
uacauauuggcuug

SEQ ID NO: 2106040 - RNA, 15 nt, Staphylococcus aureus subsp. aureus MW2
uacauauuuauauuu

SEQ ID NO: 2106041 - RNA, 14 nt, Staphylococcus aureus subsp. aureus MW2
uaccuaaaauaccc

SEQ ID NO: 2106042 - RNA, 18 nt, Staphylococcus aureus subsp. aureus MW2
uaccuccccaacuuaaua

SEQ ID NO: 2106043 - RNA, 20 nt, Staphylococcus aureus subsp. aureus MW2
uaccacaucgcauaauaucu

SEQ ID NO: 2106044 - RNA, 20 nt, Staphylococcus aureus subsp. aureus MW2
uaccacacuuuaaacaagca

SEQ ID NO: 2106045 - RNA, 16 nt, Staphylococcus aureus subsp. aureus MW2
uaccacauuuuccuug

SEQ ID NO: 2106046 - RNA, 16 nt, Staphylococcus aureus subsp. aureus MW2
uaccauagauuauauu

SEQ ID NO: 2106047 - RNA, 15 nt, Staphylococcus aureus subsp. aureus MW2
uaccaguugauuuaa

SEQ ID NO: 2106048 - RNA, 16 nt, Staphylococcus aureus subsp. aureus MW2
uaccaucaauaaaaau

SEQ ID NO: 2106049 - RNA, 20 nt, Staphylococcus aureus subsp. aureus MW2
uaccauauuuuuuaguaaua

SEQ ID NO: 2106050 - RNA, 22 nt, Staphylococcus aureus subsp. aureus MW2
uaccaugaugagauaaaaucau

SEQ ID NO: 2106051 - RNA, 18 nt, Staphylococcus aureus subsp. aureus MW2
uaccauguuuuuuaagua

SEQ ID NO: 2106052 - RNA, 12 nt, Staphylococcus aureus subsp. aureus MW2
uaccauguuuuu

SEQ ID NO: 2106053 - RNA, 18 nt, Staphylococcus aureus subsp. aureus MW2
uaccauugugaugauaau

SEQ ID NO: 2106054 - RNA, 16 nt, Staphylococcus aureus subsp. aureus MW2
uacccauaauuuaaau

SEQ ID NO: 2106055 - RNA, 16 nt, Staphylococcus aureus subsp. aureus MW2
uacgcaacuugggauu

SEQ ID NO: 2106056 - RNA, 18 nt, Staphylococcus aureus subsp. aureus MW2
uacgcaaagaaaaacauc

SEQ ID NO: 2106057 - RNA, 23 nt, Staphylococcus aureus subsp. aureus MW2
uacgccuuggccuacuuuuucaa

SEQ ID NO: 2106058 - RNA, 17 nt, Staphylococcus aureus subsp. aureus MW2
uacgcccaucaucacug

SEQ ID NO: 2106059 - RNA, 19 nt, Staphylococcus aureus subsp. aureus MW2
uacgauugaguugaaaaua

SEQ ID NO: 2106060 - RNA, 22 nt, Staphylococcus aureus subsp. aureus MW2
uacgauugggcaacuuuugguc

SEQ ID NO: 2106061 - RNA, 16 nt, Staphylococcus aureus subsp. aureus MW2
uacgauugcaauggcu

SEQ ID NO: 2106062 - RNA, 12 nt, Staphylococcus aureus subsp. aureus MW2
uacgauuuucaa

SEQ ID NO: 2106063 - RNA, 16 nt, Staphylococcus aureus subsp. aureus MW2
uacgauucaauuuaac

SEQ ID NO: 2106064 - RNA, 20 nt, Staphylococcus aureus subsp. aureus MW2
uacgaggucuuuaauuuauu

SEQ ID NO: 2106065 - RNA, 18 nt, Staphylococcus aureus subsp. aureus MW2
uacgacgucgcaacagga

SEQ ID NO: 2106066 - RNA, 11 nt, Staphylococcus aureus subsp. aureus MW2
uacgacucucc

SEQ ID NO: 2106067 - RNA, 21 nt, Staphylococcus aureus subsp. aureus MW2
uaccugcucuuuccacagcuu

SEQ ID NO: 2106068 - RNA, 20 nt, Staphylococcus aureus subsp. aureus MW2
uaccuggauuaccaaguaau

SEQ ID NO: 2106069 - RNA, 16 nt, Staphylococcus aureus subsp. aureus MW2
uacgcugucucauuaa

SEQ ID NO: 2106070 - RNA, 17 nt, Staphylococcus aureus subsp. aureus MW2
uacgcuuacuuauauuu

SEQ ID NO: 2106071 - RNA, 21 nt, Staphylococcus aureus subsp. aureus MW2
uacgcuuacuuauauuuuaau

SEQ ID NO: 2106072 - RNA, 16 nt, Staphylococcus aureus subsp. aureus MW2
uacguuauuucaauaa

SEQ ID NO: 2106073 - RNA, 13 nt, Staphylococcus aureus subsp. aureus MW2
uacguggcucuaa

SEQ ID NO: 2106074 - RNA, 16 nt, Staphylococcus aureus subsp. aureus MW2
uacguggcucuaaaaa

SEQ ID NO: 2106075 - RNA, 23 nt, Staphylococcus aureus subsp. aureus MW2
uacgguuauuuaauaaugcuuua

SEQ ID NO: 2106076 - RNA, 21 nt, Staphylococcus aureus subsp. aureus MW2
uacgguuauuuggauaauuuu

SEQ ID NO: 2106077 - RNA, 15 nt, Staphylococcus aureus subsp. aureus MW2
uacuaaauugagaag

SEQ ID NO: 2106078 - RNA, 22 nt, Staphylococcus aureus subsp. aureus MW2
uacuaaauugagaaguauuaug

SEQ ID NO: 2106079 - RNA, 14 nt, Staphylococcus aureus subsp. aureus MW2
uacuaaauugagaa

SEQ ID NO: 2106080 - RNA, 18 nt, Staphylococcus aureus subsp. aureus MW2
uacuaacaauuacgacaa

SEQ ID NO: 2106081 - RNA, 17 nt, Staphylococcus aureus subsp. aureus MW2
uacuaaaggaauuucaa

SEQ ID NO: 2106082 - RNA, 22 nt, Staphylococcus aureus subsp. aureus MW2
uacguucuucaugucguuuucu

SEQ ID NO: 2106083 - RNA, 17 nt, Staphylococcus aureus subsp. aureus MW2
uacuaaacgauaaauua

SEQ ID NO: 2106084 - RNA, 15 nt, Staphylococcus aureus subsp. aureus MW2
uacuaauauauuaau

SEQ ID NO: 2106085 - RNA, 14 nt, Staphylococcus aureus subsp. aureus MW2
uacuaauaacucuu

SEQ ID NO: 2106086 - RNA, 14 nt, Staphylococcus aureus subsp. aureus MW2
uacuaauaaugauu

SEQ ID NO: 2106087 - RNA, 23 nt, Staphylococcus aureus subsp. aureus MW2
uacuacuugauucuacuucaccu

SEQ ID NO: 2106088 - RNA, 22 nt, Staphylococcus aureus subsp. aureus MW2
uacuaccguuuuuauauacuug

SEQ ID NO: 2106089 - RNA, 22 nt, Staphylococcus aureus subsp. aureus MW2
uacuaauuuuguacauaaaaau

SEQ ID NO: 2106090 - RNA, 20 nt, Staphylococcus aureus subsp. aureus MW2
uacuacaaacuugauuaugu

SEQ ID NO: 2106091 - RNA, 21 nt, Staphylococcus aureus subsp. aureus MW2
uacuacacuccccuuaucaaa

SEQ ID NO: 2106092 - RNA, 20 nt, Staphylococcus aureus subsp. aureus MW2
uaauaccuuuacuuucauua

SEQ ID NO: 2106093 - RNA, 19 nt, Staphylococcus aureus subsp. aureus MW2
uaauaccuuuacuuucauu

SEQ ID NO: 2106094 - RNA, 23 nt, Staphylococcus aureus subsp. aureus MW2
uaauaccuucaauugacauuaau

SEQ ID NO: 2106095 - RNA, 17 nt, Staphylococcus aureus subsp. aureus MW2
uaauaccagcauccauu

SEQ ID NO: 2106096 - RNA, 15 nt, Staphylococcus aureus subsp. aureus MW2
uaauaccauugugau

SEQ ID NO: 2106097 - RNA, 16 nt, Staphylococcus aureus subsp. aureus MW2
uaauacuauaugaaaa

SEQ ID NO: 2106098 - RNA, 20 nt, Staphylococcus aureus subsp. aureus MW2
uaauacuaccguuuuuauau

SEQ ID NO: 2106099 - RNA, 17 nt, Staphylococcus aureus subsp. aureus MW2
uaauacguuuaauaaug

SEQ ID NO: 2106100 - RNA, 17 nt, Staphylococcus aureus subsp. aureus MW2
uaauacuguuuaaauaa

SEQ ID NO: 2106101 - RNA, 14 nt, Staphylococcus aureus subsp. aureus MW2
uaauacuuucacuu

SEQ ID NO: 2106102 - RNA, 20 nt, Staphylococcus aureus subsp. aureus MW2
uaauacuuucacuuuuuaua

SEQ ID NO: 2106103 - RNA, 17 nt, Staphylococcus aureus subsp. aureus MW2
uaauacuuucaaacaaa

SEQ ID NO: 2106104 - RNA, 15 nt, Staphylococcus aureus subsp. aureus MW2
uaauagaaauaauca

SEQ ID NO: 2106105 - RNA, 17 nt, Staphylococcus aureus subsp. aureus MW2
uaauacuuuuugaguau

SEQ ID NO: 2106106 - RNA, 22 nt, Staphylococcus aureus subsp. aureus MW2
uaauacuuuuugaguauccaau

SEQ ID NO: 2106107 - RNA, 17 nt, Staphylococcus aureus subsp. aureus MW2
uaauagaacgaaauagu

SEQ ID NO: 2106108 - RNA, 14 nt, Staphylococcus aureus subsp. aureus MW2
uaauacacauugca

SEQ ID NO: 2106109 - RNA, 14 nt, Staphylococcus aureus subsp. aureus MW2
uaauacaagcaaua

SEQ ID NO: 2106110 - RNA, 18 nt, Staphylococcus aureus subsp. aureus MW2
uaauacaugauauaaaua

SEQ ID NO: 2106111 - RNA, 18 nt, Staphylococcus aureus subsp. aureus MW2
uaauacaugcccaaauug

SEQ ID NO: 2106112 - RNA, 18 nt, Staphylococcus aureus subsp. aureus MW2
uaauacaucuaauaaaua

SEQ ID NO: 2106113 - RNA, 20 nt, Staphylococcus aureus subsp. aureus MW2
uaauacauauggcaaaauca

SEQ ID NO: 2106114 - RNA, 15 nt, Staphylococcus aureus subsp. aureus MW2
uaauaaugacgagaa

SEQ ID NO: 2106115 - RNA, 19 nt, Staphylococcus aureus subsp. aureus MW2
uaauaaugaauucuauccu

SEQ ID NO: 2106116 - RNA, 19 nt, Staphylococcus aureus subsp. aureus MW2
uaauaauggcaauuaaaac

SEQ ID NO: 2106117 - RNA, 20 nt, Staphylococcus aureus subsp. aureus MW2
uaauaauggcaauuaaaacu

SEQ ID NO: 2106118 - RNA, 20 nt, Staphylococcus aureus subsp. aureus MW2
uaauaaugacgagaauuaaa

SEQ ID NO: 2106119 - RNA, 16 nt, Staphylococcus aureus subsp. aureus MW2
uaauaauuggaaucau

SEQ ID NO: 2106120 - RNA, 13 nt, Staphylococcus aureus subsp. aureus MW2
uaauaauaaucuu

SEQ ID NO: 2106121 - RNA, 12 nt, Staphylococcus aureus subsp. aureus MW2
uaauaauacauu

SEQ ID NO: 2106122 - RNA, 15 nt, Staphylococcus aureus subsp. aureus MW2
uaauaauacauucau

SEQ ID NO: 2106123 - RNA, 16 nt, Staphylococcus aureus subsp. aureus MW2
uaauaagcugaaauaa

SEQ ID NO: 2106124 - RNA, 19 nt, Staphylococcus aureus subsp. aureus MW2
uaauaauacuucuaaucgu

SEQ ID NO: 2106125 - RNA, 15 nt, Staphylococcus aureus subsp. aureus MW2
uaauaauacuucuaa

SEQ ID NO: 2106126 - RNA, 19 nt, Staphylococcus aureus subsp. aureus MW2
uaauaauaggcuagauaau

SEQ ID NO: 2106127 - RNA, 15 nt, Staphylococcus aureus subsp. aureus MW2
uaauaauauaaauaa

SEQ ID NO: 2106128 - RNA, 14 nt, Staphylococcus aureus subsp. aureus MW2
uaauaauauugaaa

SEQ ID NO: 2106129 - RNA, 21 nt, Staphylococcus aureus subsp. aureus MW2
uaauaauccaccuaaaaagua

SEQ ID NO: 2106130 - RNA, 20 nt, Staphylococcus aureus subsp. aureus MW2
uaauaauauuugcuaaugcu

SEQ ID NO: 2106131 - RNA, 18 nt, Staphylococcus aureus subsp. aureus MW2
uaauaaccuuuaaaacau

SEQ ID NO: 2106132 - RNA, 19 nt, Staphylococcus aureus subsp. aureus MW2
uaauaaccauguaaaauua

SEQ ID NO: 2106133 - RNA, 17 nt, Staphylococcus aureus subsp. aureus MW2
uaauaacaucuaaauuu

SEQ ID NO: 2106134 - RNA, 21 nt, Staphylococcus aureus subsp. aureus MW2
uaauaacauccccaaaaauag

SEQ ID NO: 2106135 - RNA, 17 nt, Staphylococcus aureus subsp. aureus MW2
uaauaacucuucuaagu

SEQ ID NO: 2106136 - RNA, 15 nt, Staphylococcus aureus subsp. aureus MW2
uaauaagagguauag

SEQ ID NO: 2106137 - RNA, 15 nt, Staphylococcus aureus subsp. aureus MW2
uaauaagcuaauauu

SEQ ID NO: 2106138 - RNA, 16 nt, Staphylococcus aureus subsp. aureus MW2
uaauaagcuaauauuu

SEQ ID NO: 2106139 - RNA, 17 nt, Staphylococcus aureus subsp. aureus MW2
uaauaagcuaauauuua

SEQ ID NO: 2106140 - RNA, 21 nt, Staphylococcus aureus subsp. aureus MW2
uaauaaacgacgcaagugacu

SEQ ID NO: 2106141 - RNA, 15 nt, Staphylococcus aureus subsp. aureus MW2
uaauaaaacugcaau

SEQ ID NO: 2106142 - RNA, 17 nt, Staphylococcus aureus subsp. aureus MW2
uaauaaaacugcaauaa

SEQ ID NO: 2106143 - RNA, 22 nt, Staphylococcus aureus subsp. aureus MW2
uaauaaaucacgccauaaucuu

SEQ ID NO: 2106144 - RNA, 15 nt, Staphylococcus aureus subsp. aureus MW2
uaauaaaucauuagu

SEQ ID NO: 2106145 - RNA, 11 nt, Staphylococcus aureus subsp. aureus MW2
uaauaaauauc

SEQ ID NO: 2106146 - RNA, 16 nt, Staphylococcus aureus subsp. aureus MW2
uaauaaaguaaucagu

SEQ ID NO: 2106147 - RNA, 16 nt, Staphylococcus aureus subsp. aureus MW2
uaauaaagaauaaaca

SEQ ID NO: 2106148 - RNA, 21 nt, Staphylococcus aureus subsp. aureus MW2
uaauaaauaggaugaaaaaga

SEQ ID NO: 2106149 - RNA, 13 nt, Staphylococcus aureus subsp. aureus MW2
uaauaaauuuaac

SEQ ID NO: 2106150 - RNA, 21 nt, Staphylococcus aureus subsp. aureus MW2
uaauaaauuuccaaaguaaua

SEQ ID NO: 2106151 - RNA, 20 nt, Staphylococcus aureus subsp. aureus MW2
uaauaaauuagccauuucaa

SEQ ID NO: 2106152 - RNA, 22 nt, Staphylococcus aureus subsp. aureus MW2
uaauaaaucauuaguuguauca

SEQ ID NO: 2106153 - RNA, 23 nt, Staphylococcus aureus subsp. aureus MW2
uaauaaaucuaucuauucaaaua

SEQ ID NO: 2106154 - RNA, 22 nt, Staphylococcus aureus subsp. aureus MW2
uaaguuucgcugcuacaccacc

SEQ ID NO: 2106155 - RNA, 16 nt, Staphylococcus aureus subsp. aureus MW2
uaaguuguugauuuaa

SEQ ID NO: 2106156 - RNA, 17 nt, Staphylococcus aureus subsp. aureus MW2
uaaguuuaaugaucagu

SEQ ID NO: 2106157 - RNA, 17 nt, Staphylococcus aureus subsp. aureus MW2
uaaguugacuauauaau

SEQ ID NO: 2106158 - RNA, 20 nt, Staphylococcus aureus subsp. aureus MW2
uaaguugacuauauaaugau

SEQ ID NO: 2106159 - RNA, 14 nt, Staphylococcus aureus subsp. aureus MW2
uaaguugauuucua

SEQ ID NO: 2106160 - RNA, 15 nt, Staphylococcus aureus subsp. aureus MW2
uaaguugauuucuac

SEQ ID NO: 2106161 - RNA, 21 nt, Staphylococcus aureus subsp. aureus MW2
uaaguuaugacuaacgaaaaa

SEQ ID NO: 2106162 - RNA, 14 nt, Staphylococcus aureus subsp. aureus MW2
uaaguuaugacuaa

SEQ ID NO: 2106163 - RNA, 22 nt, Staphylococcus aureus subsp. aureus MW2
uaaguuaaaaauguaaauaaaa

SEQ ID NO: 2106164 - RNA, 12 nt, Staphylococcus aureus subsp. aureus MW2
uaaguuaaaaau

SEQ ID NO: 2106165 - RNA, 22 nt, Staphylococcus aureus subsp. aureus MW2
uaaguuaauuuuaugucccaau

SEQ ID NO: 2106166 - RNA, 20 nt, Staphylococcus aureus subsp. aureus MW2
uaagugaauuaucuauauau

SEQ ID NO: 2106167 - RNA, 15 nt, Staphylococcus aureus subsp. aureus MW2
uaagugauaaauaau

SEQ ID NO: 2106168 - RNA, 13 nt, Staphylococcus aureus subsp. aureus MW2
uaagugauaaaua

SEQ ID NO: 2106169 - RNA, 22 nt, Staphylococcus aureus subsp. aureus MW2
uaagugauauacgacaaucaca

SEQ ID NO: 2106170 - RNA, 23 nt, Staphylococcus aureus subsp. aureus MW2
uaagugaugaccaauauucugga

SEQ ID NO: 2106171 - RNA, 14 nt, Staphylococcus aureus subsp. aureus MW2
uaaguguauauagu

SEQ ID NO: 2106172 - RNA, 20 nt, Staphylococcus aureus subsp. aureus MW2
uaagucgccuaacuuuuauu

SEQ ID NO: 2106173 - RNA, 13 nt, Staphylococcus aureus subsp. aureus MW2
uaaguauuuaaac

SEQ ID NO: 2106174 - RNA, 13 nt, Staphylococcus aureus subsp. aureus MW2
uaaguauuuuaau

SEQ ID NO: 2106175 - RNA, 17 nt, Staphylococcus aureus subsp. aureus MW2
uaaguauuuuaauaaca

SEQ ID NO: 2106176 - RNA, 21 nt, Staphylococcus aureus subsp. aureus MW2
uaaguauuuuaauaacaagua

SEQ ID NO: 2106177 - RNA, 15 nt, Staphylococcus aureus subsp. aureus MW2
uaagguuugaacucu

SEQ ID NO: 2106178 - RNA, 23 nt, Staphylococcus aureus subsp. aureus MW2
uaagguaagacgccgaaaagagg

SEQ ID NO: 2106179 - RNA, 20 nt, Staphylococcus aureus subsp. aureus MW2
uaaggugauugaacaauaau

SEQ ID NO: 2106180 - RNA, 17 nt, Staphylococcus aureus subsp. aureus MW2
uaaguacagcauauaau

SEQ ID NO: 2106181 - RNA, 15 nt, Staphylococcus aureus subsp. aureus MW2
uaaguacaaauaaua

SEQ ID NO: 2106182 - RNA, 13 nt, Staphylococcus aureus subsp. aureus MW2
uaaguaauauaau

SEQ ID NO: 2106183 - RNA, 18 nt, Staphylococcus aureus subsp. aureus MW2
uaaguaagcguaauauuu

SEQ ID NO: 2106184 - RNA, 15 nt, Staphylococcus aureus subsp. aureus MW2
uaaguacuuuuacaa

SEQ ID NO: 2106185 - RNA, 15 nt, Staphylococcus aureus subsp. aureus MW2
uaaguacauaaaugc

SEQ ID NO: 2106186 - RNA, 22 nt, Staphylococcus aureus subsp. aureus MW2
uaaguacgaggaccaucucuaa

SEQ ID NO: 2106187 - RNA, 17 nt, Staphylococcus aureus subsp. aureus MW2
uaaguagcucaaaacaa

SEQ ID NO: 2106188 - RNA, 17 nt, Staphylococcus aureus subsp. aureus MW2
uaaguagaaaauaugac

SEQ ID NO: 2106189 - RNA, 20 nt, Staphylococcus aureus subsp. aureus MW2
uaaggcuauuccuaguucua

SEQ ID NO: 2106190 - RNA, 22 nt, Staphylococcus aureus subsp. aureus MW2
uaaggaugauuuauuaacucau

SEQ ID NO: 2106191 - RNA, 20 nt, Staphylococcus aureus subsp. aureus MW2
uaaucaaaguaucagucauu

SEQ ID NO: 2106192 - RNA, 13 nt, Staphylococcus aureus subsp. aureus MW2
uaaucaaagauuu

SEQ ID NO: 2106193 - RNA, 12 nt, Staphylococcus aureus subsp. aureus MW2
uaaucaaauauu

SEQ ID NO: 2106194 - RNA, 20 nt, Staphylococcus aureus subsp. aureus MW2
uaaucaagucugcauuaauu

SEQ ID NO: 2106195 - RNA, 13 nt, Staphylococcus aureus subsp. aureus MW2
uaaucacauuaau

SEQ ID NO: 2106196 - RNA, 22 nt, Staphylococcus aureus subsp. aureus MW2
uaaucaauguucuaggcuccua

SEQ ID NO: 2106197 - RNA, 16 nt, Staphylococcus aureus subsp. aureus MW2
uaaucagcuuuuucac

SEQ ID NO: 2106198 - RNA, 18 nt, Staphylococcus aureus subsp. aureus MW2
uaaucagcuauaaaagua

SEQ ID NO: 2106199 - RNA, 21 nt, Staphylococcus aureus subsp. aureus MW2
uaauccaccuaaaaaguacuu

SEQ ID NO: 2106200 - RNA, 24 nt, Staphylococcus aureus subsp. aureus MW2
uaauagagacauuuuaucugaaaa

SEQ ID NO: 2106201 - RNA, 19 nt, Staphylococcus aureus subsp. aureus MW2
uaauagagguauaauuaaa

SEQ ID NO: 2106202 - RNA, 16 nt, Staphylococcus aureus subsp. aureus MW2
uaauagagaaaaaaua

SEQ ID NO: 2106203 - RNA, 18 nt, Staphylococcus aureus subsp. aureus MW2
uaauagcaaccauauuuu

SEQ ID NO: 2106204 - RNA, 20 nt, Staphylococcus aureus subsp. aureus MW2
uaauaugauugguuugugau

SEQ ID NO: 2106205 - RNA, 15 nt, Staphylococcus aureus subsp. aureus MW2
uaauagcgauaagca

SEQ ID NO: 2106206 - RNA, 18 nt, Staphylococcus aureus subsp. aureus MW2
uaauagcgauaagcauga

SEQ ID NO: 2106207 - RNA, 21 nt, Staphylococcus aureus subsp. aureus MW2
uaauaugaauuuagaugcaua

SEQ ID NO: 2106208 - RNA, 12 nt, Staphylococcus aureus subsp. aureus MW2
uaauauuuuggc

SEQ ID NO: 2106209 - RNA, 12 nt, Staphylococcus aureus subsp. aureus MW2
uaauauuuucuu

SEQ ID NO: 2106210 - RNA, 16 nt, Staphylococcus aureus subsp. aureus MW2
uaaucaaaaagacuca

SEQ ID NO: 2106211 - RNA, 21 nt, Staphylococcus aureus subsp. aureus MW2
uaauauuaaauugcguacuug

SEQ ID NO: 2106212 - RNA, 21 nt, Staphylococcus aureus subsp. aureus MW2
uaauccccgaagcacagaaaa

SEQ ID NO: 2106213 - RNA, 14 nt, Staphylococcus aureus subsp. aureus MW2
uaaucgauugguaa

SEQ ID NO: 2106214 - RNA, 15 nt, Staphylococcus aureus subsp. aureus MW2
uaaucgcauucuugg

SEQ ID NO: 2106215 - RNA, 23 nt, Staphylococcus aureus subsp. aureus MW2
uaaucgauugguaaaucuacuac

SEQ ID NO: 2106216 - RNA, 12 nt, Staphylococcus aureus subsp. aureus MW2
uaauccauucuu

SEQ ID NO: 2106217 - RNA, 16 nt, Staphylococcus aureus subsp. aureus MW2
uaaucgguaauuacuu

SEQ ID NO: 2106218 - RNA, 15 nt, Staphylococcus aureus subsp. aureus MW2
uaaucuauaaauggc

SEQ ID NO: 2106219 - RNA, 17 nt, Staphylococcus aureus subsp. aureus MW2
uaaucuauaaauuauuu

SEQ ID NO: 2106220 - RNA, 14 nt, Staphylococcus aureus subsp. aureus MW2
uaaucuacugcugu

SEQ ID NO: 2106221 - RNA, 18 nt, Staphylococcus aureus subsp. aureus MW2
uaaucuacugcuguugaa

SEQ ID NO: 2106222 - RNA, 13 nt, Staphylococcus aureus subsp. aureus MW2
uaaucuaaauuca

SEQ ID NO: 2106223 - RNA, 14 nt, Staphylococcus aureus subsp. aureus MW2
uaaucuauauauau

SEQ ID NO: 2106224 - RNA, 18 nt, Staphylococcus aureus subsp. aureus MW2
uaaucguguauuauugaa

SEQ ID NO: 2106225 - RNA, 19 nt, Staphylococcus aureus subsp. aureus MW2
uaaucucuucaauuuauuu

SEQ ID NO: 2106226 - RNA, 18 nt, Staphylococcus aureus subsp. aureus MW2
uaaucucaugccaaaaac

SEQ ID NO: 2106227 - RNA, 22 nt, Staphylococcus aureus subsp. aureus MW2
uaaucucaugccaaaaacauua

SEQ ID NO: 2106228 - RNA, 14 nt, Staphylococcus aureus subsp. aureus MW2
uaaucuuaauauuu

SEQ ID NO: 2106229 - RNA, 18 nt, Staphylococcus aureus subsp. aureus MW2
uaauggagcacuaucuuu

SEQ ID NO: 2106230 - RNA, 14 nt, Staphylococcus aureus subsp. aureus MW2
uaauggcaacuaag

SEQ ID NO: 2106231 - RNA, 13 nt, Staphylococcus aureus subsp. aureus MW2
uaauguauucuuc

SEQ ID NO: 2106232 - RNA, 15 nt, Staphylococcus aureus subsp. aureus MW2
uaaugucauaucuuu

SEQ ID NO: 2106233 - RNA, 15 nt, Staphylococcus aureus subsp. aureus MW2
uaauguaaaaugaug

SEQ ID NO: 2106234 - RNA, 20 nt, Staphylococcus aureus subsp. aureus MW2
uaauguaaaguugauaaugu

SEQ ID NO: 2106235 - RNA, 17 nt, Staphylococcus aureus subsp. aureus MW2
uaauguagguuauuaua

SEQ ID NO: 2106236 - RNA, 15 nt, Staphylococcus aureus subsp. aureus MW2
uaaucuucucauaaa

SEQ ID NO: 2106237 - RNA, 17 nt, Staphylococcus aureus subsp. aureus MW2
uaaucuugauuauauuu

SEQ ID NO: 2106238 - RNA, 22 nt, Staphylococcus aureus subsp. aureus MW2
uaaucuugauuauauuuuucuu

SEQ ID NO: 2106239 - RNA, 14 nt, Staphylococcus aureus subsp. aureus MW2
uaaucuuuaacauu

SEQ ID NO: 2106240 - RNA, 15 nt, Staphylococcus aureus subsp. aureus MW2
uaaucuuuaacauuu

SEQ ID NO: 2106241 - RNA, 16 nt, Staphylococcus aureus subsp. aureus MW2
uaaucuuguuuucauu

SEQ ID NO: 2106242 - RNA, 14 nt, Staphylococcus aureus subsp. aureus MW2
uaaugcuuauuaaa

SEQ ID NO: 2106243 - RNA, 15 nt, Staphylococcus aureus subsp. aureus MW2
uaaugcuuauuaaaa

SEQ ID NO: 2106244 - RNA, 13 nt, Staphylococcus aureus subsp. aureus MW2
uaaugucuucaua

SEQ ID NO: 2106245 - RNA, 19 nt, Staphylococcus aureus subsp. aureus MW2
uaaugucucuuuucacgaa

SEQ ID NO: 2106246 - RNA, 20 nt, Staphylococcus aureus subsp. aureus MW2
uaaugugcgucacucacuuc

SEQ ID NO: 2106247 - RNA, 19 nt, Staphylococcus aureus subsp. aureus MW2
uaauguguaccuuuuuauu

SEQ ID NO: 2106248 - RNA, 23 nt, Staphylococcus aureus subsp. aureus MW2
uaaugugaugguucaaauaucau

SEQ ID NO: 2106249 - RNA, 14 nt, Staphylococcus aureus subsp. aureus MW2
uaaugugcauugcu

SEQ ID NO: 2106250 - RNA, 18 nt, Staphylococcus aureus subsp. aureus MW2
uaauguuggcaaacuauu

SEQ ID NO: 2106251 - RNA, 20 nt, Staphylococcus aureus subsp. aureus MW2
uaauguucaauuuauauggu

SEQ ID NO: 2106252 - RNA, 19 nt, Staphylococcus aureus subsp. aureus MW2
uaauguuccccugaaaaga

SEQ ID NO: 2106253 - RNA, 20 nt, Staphylococcus aureus subsp. aureus MW2
uaauguuaaaauaacugcua

SEQ ID NO: 2106254 - RNA, 22 nt, Staphylococcus aureus subsp. aureus MW2
uaauguuaaaauaacugcuaau

SEQ ID NO: 2106255 - RNA, 16 nt, Staphylococcus aureus subsp. aureus MW2
uaauguuaaacacuca

SEQ ID NO: 2106256 - RNA, 22 nt, Staphylococcus aureus subsp. aureus MW2
uaauguuaaacuagaaaacaua

SEQ ID NO: 2106257 - RNA, 15 nt, Staphylococcus aureus subsp. aureus MW2
uaauguuacgcugug

SEQ ID NO: 2106258 - RNA, 22 nt, Staphylococcus aureus subsp. aureus MW2
uaauuaacuuacuuuuguaaaa

SEQ ID NO: 2106259 - RNA, 17 nt, Staphylococcus aureus subsp. aureus MW2
uaauuaagaaaaucauu

SEQ ID NO: 2106260 - RNA, 14 nt, Staphylococcus aureus subsp. aureus MW2
uaauuacuuucauu

SEQ ID NO: 2106261 - RNA, 20 nt, Staphylococcus aureus subsp. aureus MW2
uaauuaaaucuucaagugcc

SEQ ID NO: 2106262 - RNA, 19 nt, Staphylococcus aureus subsp. aureus MW2
uaauuaaauagcuuuacuu

SEQ ID NO: 2106263 - RNA, 14 nt, Staphylococcus aureus subsp. aureus MW2
uaauuaaauaacuu

SEQ ID NO: 2106264 - RNA, 12 nt, Staphylococcus aureus subsp. aureus MW2
uaauuaaauaaa

SEQ ID NO: 2106265 - RNA, 19 nt, Staphylococcus aureus subsp. aureus MW2
uaauuguaaucuauuuucu

SEQ ID NO: 2106266 - RNA, 15 nt, Staphylococcus aureus subsp. aureus MW2
uaauuguaaugcuuc

SEQ ID NO: 2106267 - RNA, 16 nt, Staphylococcus aureus subsp. aureus MW2
uaauugggucuuuauc

SEQ ID NO: 2106268 - RNA, 15 nt, Staphylococcus aureus subsp. aureus MW2
uaauuggauuaaaua

SEQ ID NO: 2106269 - RNA, 13 nt, Staphylococcus aureus subsp. aureus MW2
uaauuggcagaua

SEQ ID NO: 2106270 - RNA, 22 nt, Staphylococcus aureus subsp. aureus MW2
uaauuggaaucaucuuuuugaa

SEQ ID NO: 2106271 - RNA, 17 nt, Staphylococcus aureus subsp. aureus MW2
uaauuggaaucaucuuu

SEQ ID NO: 2106272 - RNA, 21 nt, Staphylococcus aureus subsp. aureus MW2
uaauuggaaucaucuuuuuga

SEQ ID NO: 2106273 - RNA, 15 nt, Staphylococcus aureus subsp. aureus MW2
uaauuggaaucaucu

SEQ ID NO: 2106274 - RNA, 17 nt, Staphylococcus aureus subsp. aureus MW2
uaauugcguuuaauaac

SEQ ID NO: 2106275 - RNA, 15 nt, Staphylococcus aureus subsp. aureus MW2
uaauugaaaaaccaa

SEQ ID NO: 2106276 - RNA, 23 nt, Staphylococcus aureus subsp. aureus MW2
uaauucuucaucaauaacuauaa

SEQ ID NO: 2106277 - RNA, 14 nt, Staphylococcus aureus subsp. aureus MW2
uaauucuuuaauaa

SEQ ID NO: 2106278 - RNA, 15 nt, Staphylococcus aureus subsp. aureus MW2
uaauugaaaaucuaa

SEQ ID NO: 2106279 - RNA, 14 nt, Staphylococcus aureus subsp. aureus MW2
uaauugaaaugaua

SEQ ID NO: 2106280 - RNA, 17 nt, Staphylococcus aureus subsp. aureus MW2
uaauugaaaugauaaaa

SEQ ID NO: 2106281 - RNA, 22 nt, Staphylococcus aureus subsp. aureus MW2
uaauugaaaugauagaugcugg

SEQ ID NO: 2106282 - RNA, 22 nt, Staphylococcus aureus subsp. aureus MW2
uaauugaaguaugcacaucauu

SEQ ID NO: 2106283 - RNA, 22 nt, Staphylococcus aureus subsp. aureus MW2
uaauugaauugauuauaaugau

SEQ ID NO: 2106284 - RNA, 16 nt, Staphylococcus aureus subsp. aureus MW2
uaauugaucuaaauua

SEQ ID NO: 2106285 - RNA, 15 nt, Staphylococcus aureus subsp. aureus MW2
uaauugaugucacau

SEQ ID NO: 2106286 - RNA, 23 nt, Staphylococcus aureus subsp. aureus MW2
uaauugagaaaaagguuaauauu

SEQ ID NO: 2106287 - RNA, 20 nt, Staphylococcus aureus subsp. aureus MW2
uaauugauacggaucauaau

SEQ ID NO: 2106288 - RNA, 19 nt, Staphylococcus aureus subsp. aureus MW2
uaauugcauagcuaaauaa

SEQ ID NO: 2106289 - RNA, 21 nt, Staphylococcus aureus subsp. aureus MW2
uaauugcauagcuaaauaaau

SEQ ID NO: 2106290 - RNA, 22 nt, Staphylococcus aureus subsp. aureus MW2
uaauugcauagcuaaauaaauu

SEQ ID NO: 2106291 - RNA, 23 nt, Staphylococcus aureus subsp. aureus MW2
uaauucuuaaucgagugauucag

SEQ ID NO: 2106292 - RNA, 14 nt, Staphylococcus aureus subsp. aureus MW2
uaauucuguuucaa

SEQ ID NO: 2106293 - RNA, 17 nt, Staphylococcus aureus subsp. aureus MW2
uaauucuucaaccauuu

SEQ ID NO: 2106294 - RNA, 14 nt, Staphylococcus aureus subsp. aureus MW2
uaauucuucaucaa

SEQ ID NO: 2106295 - RNA, 16 nt, Staphylococcus aureus subsp. aureus MW2
uaauucuuaaucgagu

SEQ ID NO: 2106296 - RNA, 16 nt, Staphylococcus aureus subsp. aureus MW2
uaauucugguuuaaug

SEQ ID NO: 2106297 - RNA, 12 nt, Staphylococcus aureus subsp. aureus MW2
uaauucugaaau

SEQ ID NO: 2106298 - RNA, 14 nt, Staphylococcus aureus subsp. aureus MW2
uaauucugaaauca

SEQ ID NO: 2106299 - RNA, 13 nt, Staphylococcus aureus subsp. aureus MW2
uaauuccuggugc

SEQ ID NO: 2106300 - RNA, 21 nt, Staphylococcus aureus subsp. aureus MW2
uaauuccuggugcaauaauaa

SEQ ID NO: 2106301 - RNA, 23 nt, Staphylococcus aureus subsp. aureus MW2
uaauuccucuggaacuuuaauac

SEQ ID NO: 2106302 - RNA, 17 nt, Staphylococcus aureus subsp. aureus MW2
uaauuccugaaacaaug

SEQ ID NO: 2106303 - RNA, 20 nt, Staphylococcus aureus subsp. aureus MW2
uaauucccuaggaaauaaaa

SEQ ID NO: 2106304 - RNA, 18 nt, Staphylococcus aureus subsp. aureus MW2
uaauuaggauuaacauaa

SEQ ID NO: 2106305 - RNA, 22 nt, Staphylococcus aureus subsp. aureus MW2
uaauuaggauuuccggaacaau

SEQ ID NO: 2106306 - RNA, 21 nt, Staphylococcus aureus subsp. aureus MW2
uaauuagguauaguguuugac

SEQ ID NO: 2106307 - RNA, 16 nt, Staphylococcus aureus subsp. aureus MW2
uaauuaggauuaacau

SEQ ID NO: 2106308 - RNA, 18 nt, Staphylococcus aureus subsp. aureus MW2
uaauuagauuuaaaaugu

SEQ ID NO: 2106309 - RNA, 13 nt, Staphylococcus aureus subsp. aureus MW2
ggcuuaaaucaaa

SEQ ID NO: 2106310 - RNA, 18 nt, Staphylococcus aureus subsp. aureus MW2
ggcuuuuuuauuuuauaa

SEQ ID NO: 2106311 - RNA, 18 nt, Staphylococcus aureus subsp. aureus MW2
gggaugggccccaacaca

SEQ ID NO: 2106312 - RNA, 14 nt, Staphylococcus aureus subsp. aureus MW2
gggaucuaauuuuu

SEQ ID NO: 2106313 - RNA, 21 nt, Staphylococcus aureus subsp. aureus MW2
gggccccaacacagaagcugg

SEQ ID NO: 2106314 - RNA, 12 nt, Staphylococcus aureus subsp. aureus MW2
gggccccaacac

SEQ ID NO: 2106315 - RNA, 21 nt, Staphylococcus aureus subsp. aureus MW2
gggccccaacaaagaagcugg

SEQ ID NO: 2106316 - RNA, 17 nt, Staphylococcus aureus subsp. aureus MW2
gguacaacuaaauaugc

SEQ ID NO: 2106317 - RNA, 23 nt, Staphylococcus aureus subsp. aureus MW2
gguacacauguacguuuuuuuaa

SEQ ID NO: 2106318 - RNA, 14 nt, Staphylococcus aureus subsp. aureus MW2
gguacaaaaaauua

SEQ ID NO: 2106319 - RNA, 16 nt, Staphylococcus aureus subsp. aureus MW2
gguaauuuaacaacug

SEQ ID NO: 2106320 - RNA, 15 nt, Staphylococcus aureus subsp. aureus MW2
gguaauugaucuaaa

SEQ ID NO: 2106321 - RNA, 22 nt, Staphylococcus aureus subsp. aureus MW2
gguaauucaccaucauauucaa

SEQ ID NO: 2106322 - RNA, 17 nt, Staphylococcus aureus subsp. aureus MW2
gguaaguauaauuaaac

SEQ ID NO: 2106323 - RNA, 10 nt, Staphylococcus aureus subsp. aureus MW2
gguaauaauu

SEQ ID NO: 2106324 - RNA, 12 nt, Staphylococcus aureus subsp. aureus MW2
gguaauacuuuu

SEQ ID NO: 2106325 - RNA, 17 nt, Staphylococcus aureus subsp. aureus MW2
gguaaugauuuugcuuu

SEQ ID NO: 2106326 - RNA, 14 nt, Staphylococcus aureus subsp. aureus MW2
gguauucaaauaaa

SEQ ID NO: 2106327 - RNA, 19 nt, Staphylococcus aureus subsp. aureus MW2
gguauucaaauaaacacau

SEQ ID NO: 2106328 - RNA, 21 nt, Staphylococcus aureus subsp. aureus MW2
gguaugauauuucuaaauugu

SEQ ID NO: 2106329 - RNA, 15 nt, Staphylococcus aureus subsp. aureus MW2
gguaugacugcaaau

SEQ ID NO: 2106330 - RNA, 13 nt, Staphylococcus aureus subsp. aureus MW2
gguaucuaaaugu

SEQ ID NO: 2106331 - RNA, 22 nt, Staphylococcus aureus subsp. aureus MW2
gguauagaaaaagggcaaaaaa

SEQ ID NO: 2106332 - RNA, 21 nt, Staphylococcus aureus subsp. aureus MW2
gguaaggugauugaacaauaa

SEQ ID NO: 2106333 - RNA, 13 nt, Staphylococcus aureus subsp. aureus MW2
gguaacuuuuuaa

SEQ ID NO: 2106334 - RNA, 22 nt, Staphylococcus aureus subsp. aureus MW2
gguaaaucuguuuaaauuuaaa

SEQ ID NO: 2106335 - RNA, 12 nt, Staphylococcus aureus subsp. aureus MW2
gguaaacauaac

SEQ ID NO: 2106336 - RNA, 18 nt, Staphylococcus aureus subsp. aureus MW2
gguaaaaaucucaaaauu

SEQ ID NO: 2106337 - RNA, 11 nt, Staphylococcus aureus subsp. aureus MW2
gguaaaaaaau

SEQ ID NO: 2106338 - RNA, 12 nt, Staphylococcus aureus subsp. aureus MW2
gguaaaaaaaua

SEQ ID NO: 2106339 - RNA, 17 nt, Staphylococcus aureus subsp. aureus MW2
ggggacuuaaccauuua

SEQ ID NO: 2106340 - RNA, 19 nt, Staphylococcus aureus subsp. aureus MW2
gggugagggccccaacaca

SEQ ID NO: 2106341 - RNA, 15 nt, Staphylococcus aureus subsp. aureus MW2
gggugagggccccaa

SEQ ID NO: 2106342 - RNA, 14 nt, Staphylococcus aureus subsp. aureus MW2
gguggcaccacaua

SEQ ID NO: 2106343 - RNA, 21 nt, Staphylococcus aureus subsp. aureus MW2
ggugcaauaauaaauaggaug

SEQ ID NO: 2106344 - RNA, 19 nt, Staphylococcus aureus subsp. aureus MW2
ggugaaaguacuuggaaaa

SEQ ID NO: 2106345 - RNA, 20 nt, Staphylococcus aureus subsp. aureus MW2
ggucgugagccccucccaag

SEQ ID NO: 2106346 - RNA, 21 nt, Staphylococcus aureus subsp. aureus MW2
guaaguaaaauaaaaaaugca

SEQ ID NO: 2106347 - RNA, 19 nt, Staphylococcus aureus subsp. aureus MW2
guaauauguugcuuaucaa

SEQ ID NO: 2106348 - RNA, 12 nt, Staphylococcus aureus subsp. aureus MW2
guaauauuuuug

SEQ ID NO: 2106349 - RNA, 15 nt, Staphylococcus aureus subsp. aureus MW2
guaauauauaaaagu

SEQ ID NO: 2106350 - RNA, 18 nt, Staphylococcus aureus subsp. aureus MW2
guaauaacaucuaaauuu

SEQ ID NO: 2106351 - RNA, 23 nt, Staphylococcus aureus subsp. aureus MW2
guaauaaaagucgauaaauauga

SEQ ID NO: 2106352 - RNA, 16 nt, Staphylococcus aureus subsp. aureus MW2
guaaguuguacuucuu

SEQ ID NO: 2106353 - RNA, 17 nt, Staphylococcus aureus subsp. aureus MW2
guaaguagaagcaaaag

SEQ ID NO: 2106354 - RNA, 21 nt, Staphylococcus aureus subsp. aureus MW2
guaaguacgaggaccaucucu

SEQ ID NO: 2106355 - RNA, 19 nt, Staphylococcus aureus subsp. aureus MW2
guaagacgccgaaaagagg

SEQ ID NO: 2106356 - RNA, 23 nt, Staphylococcus aureus subsp. aureus MW2
guaagauuauuuucaauuagaaa

SEQ ID NO: 2106357 - RNA, 13 nt, Staphylococcus aureus subsp. aureus MW2
guaaccugacuuu

SEQ ID NO: 2106358 - RNA, 18 nt, Staphylococcus aureus subsp. aureus MW2
guaacgaagauuuuguug

SEQ ID NO: 2106359 - RNA, 18 nt, Staphylococcus aureus subsp. aureus MW2
guaacauuaaaaauaaaa

SEQ ID NO: 2106360 - RNA, 19 nt, Staphylococcus aureus subsp. aureus MW2
guaacauuagcaugauaaa

SEQ ID NO: 2106361 - RNA, 15 nt, Staphylococcus aureus subsp. aureus MW2
guaaccccauuuuaa

SEQ ID NO: 2106362 - RNA, 21 nt, Staphylococcus aureus subsp. aureus MW2
guaaaggcgauauuugcuagu

SEQ ID NO: 2106363 - RNA, 16 nt, Staphylococcus aureus subsp. aureus MW2
guaaagccaccuaaau

SEQ ID NO: 2106364 - RNA, 20 nt, Staphylococcus aureus subsp. aureus MW2
guaaauaaaaauuauauaaa

SEQ ID NO: 2106365 - RNA, 14 nt, Staphylococcus aureus subsp. aureus MW2
guaaauaaaacuau

SEQ ID NO: 2106366 - RNA, 19 nt, Staphylococcus aureus subsp. aureus MW2
guaaauaaaaauuauauaa

SEQ ID NO: 2106367 - RNA, 14 nt, Staphylococcus aureus subsp. aureus MW2
guaaauaauuuaaa

SEQ ID NO: 2106368 - RNA, 15 nt, Staphylococcus aureus subsp. aureus MW2
guaaaguuaaaagcu

SEQ ID NO: 2106369 - RNA, 21 nt, Staphylococcus aureus subsp. aureus MW2
guaaauauaguaauaaaaguc

SEQ ID NO: 2106370 - RNA, 19 nt, Staphylococcus aureus subsp. aureus MW2
guaaauauucguugauagu

SEQ ID NO: 2106371 - RNA, 13 nt, Staphylococcus aureus subsp. aureus MW2
guaaaucaucaua

SEQ ID NO: 2106372 - RNA, 18 nt, Staphylococcus aureus subsp. aureus MW2
guaaaucacgauuuucaa

SEQ ID NO: 2106373 - RNA, 22 nt, Staphylococcus aureus subsp. aureus MW2
guaaauauuuuuuaaaaugaua

SEQ ID NO: 2106374 - RNA, 21 nt, Staphylococcus aureus subsp. aureus MW2
guaaaucgugcuguuaucaug

SEQ ID NO: 2106375 - RNA, 18 nt, Staphylococcus aureus subsp. aureus MW2
guaacaagcuuuuuucaa

SEQ ID NO: 2106376 - RNA, 17 nt, Staphylococcus aureus subsp. aureus MW2
guaaauuuaaaauaaua

SEQ ID NO: 2106377 - RNA, 14 nt, Staphylococcus aureus subsp. aureus MW2
guaaauuuaaaaua

SEQ ID NO: 2106378 - RNA, 19 nt, Staphylococcus aureus subsp. aureus MW2
guaaauuuuaucuaaacau

SEQ ID NO: 2106379 - RNA, 14 nt, Staphylococcus aureus subsp. aureus MW2
guaaauguuaaauu

SEQ ID NO: 2106380 - RNA, 23 nt, Staphylococcus aureus subsp. aureus MW2
guaaaccgaggugucaauaaauu

SEQ ID NO: 2106381 - RNA, 16 nt, Staphylococcus aureus subsp. aureus MW2
guaaaagugaauaauu

SEQ ID NO: 2106382 - RNA, 14 nt, Staphylococcus aureus subsp. aureus MW2
guaaacacuauaaa

SEQ ID NO: 2106383 - RNA, 23 nt, Staphylococcus aureus subsp. aureus MW2
guaaacaacaucgauuuaucauu

SEQ ID NO: 2106384 - RNA, 23 nt, Staphylococcus aureus subsp. aureus MW2
guaaaauuuucguguuaauaacc

SEQ ID NO: 2106385 - RNA, 11 nt, Staphylococcus aureus subsp. aureus MW2
guaaaaugaug

SEQ ID NO: 2106386 - RNA, 22 nt, Staphylococcus aureus subsp. aureus MW2
guaaaaugaugauuuaaagcaa

SEQ ID NO: 2106387 - RNA, 16 nt, Staphylococcus aureus subsp. aureus MW2
guaaugcuuaaaaaca

SEQ ID NO: 2106388 - RNA, 11 nt, Staphylococcus aureus subsp. aureus MW2
guaaucuauuu

SEQ ID NO: 2106389 - RNA, 22 nt, Staphylococcus aureus subsp. aureus MW2
guacauuuauuuucaauaaaua

SEQ ID NO: 2106390 - RNA, 16 nt, Staphylococcus aureus subsp. aureus MW2
guacauuuauuuucaa

SEQ ID NO: 2106391 - RNA, 16 nt, Staphylococcus aureus subsp. aureus MW2
guacauguauuggcca

SEQ ID NO: 2106392 - RNA, 21 nt, Staphylococcus aureus subsp. aureus MW2
guacauuaguuugaucauuua

SEQ ID NO: 2106393 - RNA, 11 nt, Staphylococcus aureus subsp. aureus MW2
guacauguauu

SEQ ID NO: 2106394 - RNA, 15 nt, Staphylococcus aureus subsp. aureus MW2
guaaugugcauugcu

SEQ ID NO: 2106395 - RNA, 21 nt, Staphylococcus aureus subsp. aureus MW2
guaauguuccccugaaaagaa

SEQ ID NO: 2106396 - RNA, 13 nt, Staphylococcus aureus subsp. aureus MW2
guaccaagcuuca

SEQ ID NO: 2106397 - RNA, 14 nt, Staphylococcus aureus subsp. aureus MW2
guaccaauuagcau

SEQ ID NO: 2106398 - RNA, 18 nt, Staphylococcus aureus subsp. aureus MW2
guaccaucucuauuuuuu

SEQ ID NO: 2106399 - RNA, 18 nt, Staphylococcus aureus subsp. aureus MW2
guacuucgcccuuccauu

SEQ ID NO: 2106400 - RNA, 12 nt, Staphylococcus aureus subsp. aureus MW2
guacuugccuau

SEQ ID NO: 2106401 - RNA, 12 nt, Staphylococcus aureus subsp. aureus MW2
guacuauuaaaa

SEQ ID NO: 2106402 - RNA, 19 nt, Staphylococcus aureus subsp. aureus MW2
guacuauuaucuauccauu

SEQ ID NO: 2106403 - RNA, 15 nt, Staphylococcus aureus subsp. aureus MW2
guacuaaucaauacu

SEQ ID NO: 2106404 - RNA, 20 nt, Staphylococcus aureus subsp. aureus MW2
guacguuuuuuuaaauacau

SEQ ID NO: 2106405 - RNA, 15 nt, Staphylococcus aureus subsp. aureus MW2
guacguuguaauagu

SEQ ID NO: 2106406 - RNA, 21 nt, Staphylococcus aureus subsp. aureus MW2
guagucgaagaagauuaugaa

SEQ ID NO: 2106407 - RNA, 12 nt, Staphylococcus aureus subsp. aureus MW2
guaguauuuuuu

SEQ ID NO: 2106408 - RNA, 11 nt, Staphylococcus aureus subsp. aureus MW2
guaguauauau

SEQ ID NO: 2106409 - RNA, 13 nt, Staphylococcus aureus subsp. aureus MW2
guaguauauauga

SEQ ID NO: 2106410 - RNA, 23 nt, Staphylococcus aureus subsp. aureus MW2
guaguuggcugauagaugaaaau

SEQ ID NO: 2106411 - RNA, 22 nt, Staphylococcus aureus subsp. aureus MW2
guaguuggcugauagaugaaaa

SEQ ID NO: 2106412 - RNA, 18 nt, Staphylococcus aureus subsp. aureus MW2
guaguugacuguaaaaca

SEQ ID NO: 2106413 - RNA, 22 nt, Staphylococcus aureus subsp. aureus MW2
guaguuaagauaccuuuuucua

SEQ ID NO: 2106414 - RNA, 17 nt, Staphylococcus aureus subsp. aureus MW2
guaguuagguaaaaauu

SEQ ID NO: 2106415 - RNA, 22 nt, Staphylococcus aureus subsp. aureus MW2
guauaaagggcuauuugauaca

SEQ ID NO: 2106416 - RNA, 19 nt, Staphylococcus aureus subsp. aureus MW2
guauaaaaauguauuaaau

SEQ ID NO: 2106417 - RNA, 20 nt, Staphylococcus aureus subsp. aureus MW2
guauaaaaauguauuaaaua

SEQ ID NO: 2106418 - RNA, 23 nt, Staphylococcus aureus subsp. aureus MW2
guauaaaaauguauuaaauaugc

SEQ ID NO: 2106419 - RNA, 13 nt, Staphylococcus aureus subsp. aureus MW2
guauaaaugcagc

SEQ ID NO: 2106420 - RNA, 20 nt, Staphylococcus aureus subsp. aureus MW2
guauaaauaucauaaaugca

SEQ ID NO: 2106421 - RNA, 16 nt, Staphylococcus aureus subsp. aureus MW2
guauaagcccauugcu

SEQ ID NO: 2106422 - RNA, 14 nt, Staphylococcus aureus subsp. aureus MW2
guauaaccauaaug

SEQ ID NO: 2106423 - RNA, 19 nt, Staphylococcus aureus subsp. aureus MW2
guauaaccauaaugaacag

SEQ ID NO: 2106424 - RNA, 13 nt, Staphylococcus aureus subsp. aureus MW2
guagaguuuagga

SEQ ID NO: 2106425 - RNA, 20 nt, Staphylococcus aureus subsp. aureus MW2
guaggggagucuuauuuuua

SEQ ID NO: 2106426 - RNA, 20 nt, Staphylococcus aureus subsp. aureus MW2
guaggcugaaguugaagcca

SEQ ID NO: 2106427 - RNA, 20 nt, Staphylococcus aureus subsp. aureus MW2
guccaucauuuguguuuuua

SEQ ID NO: 2106428 - RNA, 18 nt, Staphylococcus aureus subsp. aureus MW2
guccaucgucaucacuuu

SEQ ID NO: 2106429 - RNA, 15 nt, Staphylococcus aureus subsp. aureus MW2
gucauugaaaauauu

SEQ ID NO: 2106430 - RNA, 21 nt, Staphylococcus aureus subsp. aureus MW2
gucauugguggagauuguaaa

SEQ ID NO: 2106431 - RNA, 22 nt, Staphylococcus aureus subsp. aureus MW2
gucccacucccuuuauuuucga

SEQ ID NO: 2106432 - RNA, 17 nt, Staphylococcus aureus subsp. aureus MW2
gucccauaaaagacaga

SEQ ID NO: 2106433 - RNA, 18 nt, Staphylococcus aureus subsp. aureus MW2
gucccauaaggaaccugu

SEQ ID NO: 2106434 - RNA, 18 nt, Staphylococcus aureus subsp. aureus MW2
guauauugcuuauguaca

SEQ ID NO: 2106435 - RNA, 15 nt, Staphylococcus aureus subsp. aureus MW2
guauuuuuauuuaua

SEQ ID NO: 2106436 - RNA, 15 nt, Staphylococcus aureus subsp. aureus MW2
guauuuuucaaauaa

SEQ ID NO: 2106437 - RNA, 23 nt, Staphylococcus aureus subsp. aureus MW2
guauacacaaauuuuuuggaaac

SEQ ID NO: 2106438 - RNA, 22 nt, Staphylococcus aureus subsp. aureus MW2
guauaauggacgguauuuucaa

SEQ ID NO: 2106439 - RNA, 18 nt, Staphylococcus aureus subsp. aureus MW2
guauauguguguugcuuu

SEQ ID NO: 2106440 - RNA, 17 nt, Staphylococcus aureus subsp. aureus MW2
guauauggcgauaacaa

SEQ ID NO: 2106441 - RNA, 19 nt, Staphylococcus aureus subsp. aureus MW2
guauaugaauuuuauaaau

SEQ ID NO: 2106442 - RNA, 15 nt, Staphylococcus aureus subsp. aureus MW2
guauaccucuuagca

SEQ ID NO: 2106443 - RNA, 14 nt, Staphylococcus aureus subsp. aureus MW2
guauauaagcaaag

SEQ ID NO: 2106444 - RNA, 11 nt, Staphylococcus aureus subsp. aureus MW2
guauaucugua

SEQ ID NO: 2106445 - RNA, 20 nt, Staphylococcus aureus subsp. aureus MW2
guauaucuguauaaaaacca

SEQ ID NO: 2106446 - RNA, 21 nt, Staphylococcus aureus subsp. aureus MW2
gucaaugacugagaaaaauau

SEQ ID NO: 2106447 - RNA, 17 nt, Staphylococcus aureus subsp. aureus MW2
gucaaugacuuaacauc

SEQ ID NO: 2106448 - RNA, 21 nt, Staphylococcus aureus subsp. aureus MW2
gucaacuuuuuuaacuuuaac

SEQ ID NO: 2106449 - RNA, 22 nt, Staphylococcus aureus subsp. aureus MW2
gucaacuuuuuuaacuuuaaca

SEQ ID NO: 2106450 - RNA, 12 nt, Staphylococcus aureus subsp. aureus MW2
gucagauucaaa

SEQ ID NO: 2106451 - RNA, 22 nt, Staphylococcus aureus subsp. aureus MW2
gucagcaaaaagcccuauuauu

SEQ ID NO: 2106452 - RNA, 15 nt, Staphylococcus aureus subsp. aureus MW2
gucacuuuauuaaau

SEQ ID NO: 2106453 - RNA, 14 nt, Staphylococcus aureus subsp. aureus MW2
gucacuuuauuaaa

SEQ ID NO: 2106454 - RNA, 19 nt, Staphylococcus aureus subsp. aureus MW2
gucaauuucuuuaaagucu

SEQ ID NO: 2106455 - RNA, 18 nt, Staphylococcus aureus subsp. aureus MW2
gucaauuuaaagucuuca

SEQ ID NO: 2106456 - RNA, 16 nt, Staphylococcus aureus subsp. aureus MW2
gucagcuuacaauaau

SEQ ID NO: 2106457 - RNA, 15 nt, Staphylococcus aureus subsp. aureus MW2
gucagcauacaauaa

SEQ ID NO: 2106458 - RNA, 23 nt, Staphylococcus aureus subsp. aureus MW2
gucauacacaaugauuauaaaua

SEQ ID NO: 2106459 - RNA, 13 nt, Staphylococcus aureus subsp. aureus MW2
gucauuacaaauc

SEQ ID NO: 2106460 - RNA, 19 nt, Staphylococcus aureus subsp. aureus MW2
gucauuaacauaauaauaa

SEQ ID NO: 2106461 - RNA, 23 nt, Staphylococcus aureus subsp. aureus MW2
gucaggggccccaacacagagaa

SEQ ID NO: 2106462 - RNA, 14 nt, Staphylococcus aureus subsp. aureus MW2
gucaggggccccaa

SEQ ID NO: 2106463 - RNA, 16 nt, Staphylococcus aureus subsp. aureus MW2
gucaggggccccaaca

SEQ ID NO: 2106464 - RNA, 14 nt, Staphylococcus aureus subsp. aureus MW2
gucaguaaaaauac

SEQ ID NO: 2106465 - RNA, 23 nt, Staphylococcus aureus subsp. aureus MW2
ggcgcuguuccaaauucauuugu

SEQ ID NO: 2106466 - RNA, 23 nt, Staphylococcus aureus subsp. aureus MW2
ggcguuucagaaguuguuuagaa

SEQ ID NO: 2106467 - RNA, 12 nt, Staphylococcus aureus subsp. aureus MW2
ggcgggccccaa

SEQ ID NO: 2106468 - RNA, 13 nt, Staphylococcus aureus subsp. aureus MW2
ggcgggccccaac

SEQ ID NO: 2106469 - RNA, 16 nt, Staphylococcus aureus subsp. aureus MW2
ggcggggcccaaacau

SEQ ID NO: 2106470 - RNA, 13 nt, Staphylococcus aureus subsp. aureus MW2
ggcggggccccaa

SEQ ID NO: 2106471 - RNA, 20 nt, Staphylococcus aureus subsp. aureus MW2
ggcauuagcuucuacuuuug

SEQ ID NO: 2106472 - RNA, 11 nt, Staphylococcus aureus subsp. aureus MW2
ggcaguucuga

SEQ ID NO: 2106473 - RNA, 16 nt, Staphylococcus aureus subsp. aureus MW2
ggcaguucugaaacau

SEQ ID NO: 2106474 - RNA, 21 nt, Staphylococcus aureus subsp. aureus MW2
ggcacuuaagcuuuaaucaua

SEQ ID NO: 2106475 - RNA, 16 nt, Staphylococcus aureus subsp. aureus MW2
ggacauguucacuuau

SEQ ID NO: 2106476 - RNA, 12 nt, Staphylococcus aureus subsp. aureus MW2
ggacugaaagaa

SEQ ID NO: 2106477 - RNA, 19 nt, Staphylococcus aureus subsp. aureus MW2
ggagaaaucaguuaggaug

SEQ ID NO: 2106478 - RNA, 20 nt, Staphylococcus aureus subsp. aureus MW2
ggagaaaucaguuaggauga

SEQ ID NO: 2106479 - RNA, 14 nt, Staphylococcus aureus subsp. aureus MW2
ggcaauauacuuuu

SEQ ID NO: 2106480 - RNA, 17 nt, Staphylococcus aureus subsp. aureus MW2
ggcaaucuauauaaaug

SEQ ID NO: 2106481 - RNA, 23 nt, Staphylococcus aureus subsp. aureus MW2
ggcaaaaaaggaugaugugaaug

SEQ ID NO: 2106482 - RNA, 13 nt, Staphylococcus aureus subsp. aureus MW2
ggcaaaucaaaca

SEQ ID NO: 2106483 - RNA, 15 nt, Staphylococcus aureus subsp. aureus MW2
ggcaaagucauuaaa

SEQ ID NO: 2106484 - RNA, 19 nt, Staphylococcus aureus subsp. aureus MW2
ggauuucuuauuuguaauu

SEQ ID NO: 2106485 - RNA, 20 nt, Staphylococcus aureus subsp. aureus MW2
ggauuuccucgguuuuauuu

SEQ ID NO: 2106486 - RNA, 22 nt, Staphylococcus aureus subsp. aureus MW2
ggauuuccuauuaggauccaau

SEQ ID NO: 2106487 - RNA, 19 nt, Staphylococcus aureus subsp. aureus MW2
ggaugaguuuaaaaauaug

SEQ ID NO: 2106488 - RNA, 15 nt, Staphylococcus aureus subsp. aureus MW2
ggauuaucuguaauu

SEQ ID NO: 2106489 - RNA, 19 nt, Staphylococcus aureus subsp. aureus MW2
ggauuaaaagcaucuuuaa

SEQ ID NO: 2106490 - RNA, 16 nt, Staphylococcus aureus subsp. aureus MW2
ggauguuuucguuugc

SEQ ID NO: 2106491 - RNA, 22 nt, Staphylococcus aureus subsp. aureus MW2
cucuuuaaacucguaaauuuua

SEQ ID NO: 2106492 - RNA, 17 nt, Staphylococcus aureus subsp. aureus MW2
cucuuuacaccauugca

SEQ ID NO: 2106493 - RNA, 18 nt, Staphylococcus aureus subsp. aureus MW2
cucuuuacggauugcugc

SEQ ID NO: 2106494 - RNA, 20 nt, Staphylococcus aureus subsp. aureus MW2
cucuuuacggucgaauuuuu

SEQ ID NO: 2106495 - RNA, 22 nt, Staphylococcus aureus subsp. aureus MW2
cucuuuacggucgaauuuuuuu

SEQ ID NO: 2106496 - RNA, 14 nt, Staphylococcus aureus subsp. aureus MW2
cucuugcaauagca

SEQ ID NO: 2106497 - RNA, 14 nt, Staphylococcus aureus subsp. aureus MW2
cucuugcuaaagug

SEQ ID NO: 2106498 - RNA, 21 nt, Staphylococcus aureus subsp. aureus MW2
cucuggauuuuucuuauaaaa

SEQ ID NO: 2106499 - RNA, 15 nt, Staphylococcus aureus subsp. aureus MW2
cucuguguuggggcc

SEQ ID NO: 2106500 - RNA, 16 nt, Staphylococcus aureus subsp. aureus MW2
cucuguguuggggccc

SEQ ID NO: 2106501 - RNA, 17 nt, Staphylococcus aureus subsp. aureus MW2
cucuguguuggggccca

SEQ ID NO: 2106502 - RNA, 17 nt, Staphylococcus aureus subsp. aureus MW2
cucuguguuggggcccc

SEQ ID NO: 2106503 - RNA, 23 nt, Staphylococcus aureus subsp. aureus MW2
cucuucaguacgaacaacuaaca

SEQ ID NO: 2106504 - RNA, 22 nt, Staphylococcus aureus subsp. aureus MW2
cucuuauaaagacaccuucaau

SEQ ID NO: 2106505 - RNA, 21 nt, Staphylococcus aureus subsp. aureus MW2
cucuuauaaagacaccuucaa

SEQ ID NO: 2106506 - RNA, 12 nt, Staphylococcus aureus subsp. aureus MW2
cucuuaaaauac

SEQ ID NO: 2106507 - RNA, 14 nt, Staphylococcus aureus subsp. aureus MW2
cucuuauuuuaaaa

SEQ ID NO: 2106508 - RNA, 14 nt, Staphylococcus aureus subsp. aureus MW2
cucuguuuaacagg

SEQ ID NO: 2106509 - RNA, 23 nt, Staphylococcus aureus subsp. aureus MW2
cucuuaaaucacuagcuaaugca

SEQ ID NO: 2106510 - RNA, 16 nt, Staphylococcus aureus subsp. aureus MW2
cugaaaucuagaccuu

SEQ ID NO: 2106511 - RNA, 22 nt, Staphylococcus aureus subsp. aureus MW2
cugaaauuucauaaaguuuauu

SEQ ID NO: 2106512 - RNA, 16 nt, Staphylococcus aureus subsp. aureus MW2
cugaaauagcuuuuuc

SEQ ID NO: 2106513 - RNA, 15 nt, Staphylococcus aureus subsp. aureus MW2
cugaacgaaaaugcg

SEQ ID NO: 2106514 - RNA, 17 nt, Staphylococcus aureus subsp. aureus MW2
cucuuuuucccaugcuu

SEQ ID NO: 2106515 - RNA, 18 nt, Staphylococcus aureus subsp. aureus MW2
cucuuuuuaauauuuuuu

SEQ ID NO: 2106516 - RNA, 19 nt, Staphylococcus aureus subsp. aureus MW2
cucuuuuuaauauuuuuuu

SEQ ID NO: 2106517 - RNA, 20 nt, Staphylococcus aureus subsp. aureus MW2
cucuuuucacgaauaucuua

SEQ ID NO: 2106518 - RNA, 17 nt, Staphylococcus aureus subsp. aureus MW2
cugaaacuuuaauacua

SEQ ID NO: 2106519 - RNA, 11 nt, Staphylococcus aureus subsp. aureus MW2
cugaaaauaac

SEQ ID NO: 2106520 - RNA, 15 nt, Staphylococcus aureus subsp. aureus MW2
cugaaacauuuauaa

SEQ ID NO: 2106521 - RNA, 13 nt, Staphylococcus aureus subsp. aureus MW2
cugaaaaaauuaa

SEQ ID NO: 2106522 - RNA, 17 nt, Staphylococcus aureus subsp. aureus MW2
cugaaaaauauuuaaau

SEQ ID NO: 2106523 - RNA, 13 nt, Staphylococcus aureus subsp. aureus MW2
cugaaaaacuucu

SEQ ID NO: 2106524 - RNA, 15 nt, Staphylococcus aureus subsp. aureus MW2
cugaaaaacuucuua

SEQ ID NO: 2106525 - RNA, 16 nt, Staphylococcus aureus subsp. aureus MW2
cugaaaacuuaauaga

SEQ ID NO: 2106526 - RNA, 18 nt, Staphylococcus aureus subsp. aureus MW2
cugagaaaaauauuucua

SEQ ID NO: 2106527 - RNA, 12 nt, Staphylococcus aureus subsp. aureus MW2
cugacuaacauu

SEQ ID NO: 2106528 - RNA, 17 nt, Staphylococcus aureus subsp. aureus MW2
cugaagguaauuuaaca

SEQ ID NO: 2106529 - RNA, 17 nt, Staphylococcus aureus subsp. aureus MW2
cugacauuuuuggcuug

SEQ ID NO: 2106530 - RNA, 18 nt, Staphylococcus aureus subsp. aureus MW2
cugaguucaauuaaauua

SEQ ID NO: 2106531 - RNA, 22 nt, Staphylococcus aureus subsp. aureus MW2
cugauaauuuuucuucuuuuuu

SEQ ID NO: 2106532 - RNA, 20 nt, Staphylococcus aureus subsp. aureus MW2
cugauacacguacaaaauaa

SEQ ID NO: 2106533 - RNA, 15 nt, Staphylococcus aureus subsp. aureus MW2
cugauaauuuuucuu

SEQ ID NO: 2106534 - RNA, 18 nt, Staphylococcus aureus subsp. aureus MW2
cugauaauacuguuuaaa

SEQ ID NO: 2106535 - RNA, 22 nt, Staphylococcus aureus subsp. aureus MW2
cugauaauacuguuuaaauaaa

SEQ ID NO: 2106536 - RNA, 22 nt, Staphylococcus aureus subsp. aureus MW2
cugauauugaucugauuucacu

SEQ ID NO: 2106537 - RNA, 18 nt, Staphylococcus aureus subsp. aureus MW2
cugauuguucauguuuaa

SEQ ID NO: 2106538 - RNA, 14 nt, Staphylococcus aureus subsp. aureus MW2
cugcaagugcuuca

SEQ ID NO: 2106539 - RNA, 17 nt, Staphylococcus aureus subsp. aureus MW2
cugcaagugcuucaacu

SEQ ID NO: 2106540 - RNA, 21 nt, Staphylococcus aureus subsp. aureus MW2
cugcaaacuugauucaauaua

SEQ ID NO: 2106541 - RNA, 19 nt, Staphylococcus aureus subsp. aureus MW2
cugcaaacacaguacaaau

SEQ ID NO: 2106542 - RNA, 23 nt, Staphylococcus aureus subsp. aureus MW2
cugcaaacacaguacaaauaaca

SEQ ID NO: 2106543 - RNA, 19 nt, Staphylococcus aureus subsp. aureus MW2
cugcuucaacuacuucauc

SEQ ID NO: 2106544 - RNA, 20 nt, Staphylococcus aureus subsp. aureus MW2
cugcugcuucggcaccuuua

SEQ ID NO: 2106545 - RNA, 17 nt, Staphylococcus aureus subsp. aureus MW2
cugcuggaacaccaaua

SEQ ID NO: 2106546 - RNA, 18 nt, Staphylococcus aureus subsp. aureus MW2
cugcuuuuuuaaauuuaa

SEQ ID NO: 2106547 - RNA, 21 nt, Staphylococcus aureus subsp. aureus MW2
cuggaaaugauaauuuaauaa

SEQ ID NO: 2106548 - RNA, 22 nt, Staphylococcus aureus subsp. aureus MW2
cuggaacaauaaucaauguucu

SEQ ID NO: 2106549 - RNA, 20 nt, Staphylococcus aureus subsp. aureus MW2
cuggauuuuucuuauaaaaa

SEQ ID NO: 2106550 - RNA, 21 nt, Staphylococcus aureus subsp. aureus MW2
cuggcaaauugccuuucauuu

SEQ ID NO: 2106551 - RNA, 20 nt, Staphylococcus aureus subsp. aureus MW2
cuggaucgcccauacuaaau

SEQ ID NO: 2106552 - RNA, 22 nt, Staphylococcus aureus subsp. aureus MW2
aaacucaaaccuguuuggaaaa

SEQ ID NO: 2106553 - RNA, 13 nt, Staphylococcus aureus subsp. aureus MW2
cugcuaacucuga

SEQ ID NO: 2106554 - RNA, 20 nt, Staphylococcus aureus subsp. aureus MW2
cugcuaacucugaucuaaaa

SEQ ID NO: 2106555 - RNA, 13 nt, Staphylococcus aureus subsp. aureus MW2
cugccaaaaagua

SEQ ID NO: 2106556 - RNA, 23 nt, Staphylococcus aureus subsp. aureus MW2
cugccaauaaaaugcaauuuuuc

SEQ ID NO: 2106557 - RNA, 13 nt, Staphylococcus aureus subsp. aureus MW2
cugccaauauaac

SEQ ID NO: 2106558 - RNA, 13 nt, Staphylococcus aureus subsp. aureus MW2
cugccauauguuu

SEQ ID NO: 2106559 - RNA, 17 nt, Staphylococcus aureus subsp. aureus MW2
cugccguuugaagucug

SEQ ID NO: 2106560 - RNA, 17 nt, Staphylococcus aureus subsp. aureus MW2
cugccugacauucauca

SEQ ID NO: 2106561 - RNA, 15 nt, Staphylococcus aureus subsp. aureus MW2
cuaaccacaucauuc

SEQ ID NO: 2106562 - RNA, 15 nt, Staphylococcus aureus subsp. aureus MW2
cuacgaauacuaaaa

SEQ ID NO: 2106563 - RNA, 15 nt, Staphylococcus aureus subsp. aureus MW2
cuacuaaucguugug

SEQ ID NO: 2106564 - RNA, 12 nt, Staphylococcus aureus subsp. aureus MW2
cuaaccaaauaa

SEQ ID NO: 2106565 - RNA, 23 nt, Staphylococcus aureus subsp. aureus MW2
cuaacauugguaccuuuuuauua

SEQ ID NO: 2106566 - RNA, 21 nt, Staphylococcus aureus subsp. aureus MW2
cuaacaugggguuuuauuuuu

SEQ ID NO: 2106567 - RNA, 18 nt, Staphylococcus aureus subsp. aureus MW2
cuacugucucaucuucua

SEQ ID NO: 2106568 - RNA, 14 nt, Staphylococcus aureus subsp. aureus MW2
cuacugucucaucu

SEQ ID NO: 2106569 - RNA, 13 nt, Staphylococcus aureus subsp. aureus MW2
cuacuuaaaauaa

SEQ ID NO: 2106570 - RNA, 14 nt, Staphylococcus aureus subsp. aureus MW2
cuacuuaaaauaag

SEQ ID NO: 2106571 - RNA, 18 nt, Staphylococcus aureus subsp. aureus MW2
cuacuuaauuaauaauuu

SEQ ID NO: 2106572 - RNA, 14 nt, Staphylococcus aureus subsp. aureus MW2
cuacugcuugugug

SEQ ID NO: 2106573 - RNA, 14 nt, Staphylococcus aureus subsp. aureus MW2
cuacuauuaaauaa

SEQ ID NO: 2106574 - RNA, 14 nt, Staphylococcus aureus subsp. aureus MW2
cuacuagaauaacu

SEQ ID NO: 2106575 - RNA, 16 nt, Staphylococcus aureus subsp. aureus MW2
cuacuauuuaaucuua

SEQ ID NO: 2106576 - RNA, 16 nt, Staphylococcus aureus subsp. aureus MW2
cuacuccauagaaauu

SEQ ID NO: 2106577 - RNA, 15 nt, Staphylococcus aureus subsp. aureus MW2
cuacucgacacauau

SEQ ID NO: 2106578 - RNA, 14 nt, Staphylococcus aureus subsp. aureus MW2
cuacuuuuucaaua

SEQ ID NO: 2106579 - RNA, 17 nt, Staphylococcus aureus subsp. aureus MW2
cuacuuuuucaauaugu

SEQ ID NO: 2106580 - RNA, 15 nt, Staphylococcus aureus subsp. aureus MW2
cuacuuuuucaucuu

SEQ ID NO: 2106581 - RNA, 19 nt, Staphylococcus aureus subsp. aureus MW2
cuacuuugauauguuuccu

SEQ ID NO: 2106582 - RNA, 21 nt, Staphylococcus aureus subsp. aureus MW2
cuacuugauucuacuucaccu

SEQ ID NO: 2106583 - RNA, 14 nt, Staphylococcus aureus subsp. aureus MW2
cuagauaauaaucc

SEQ ID NO: 2106584 - RNA, 17 nt, Staphylococcus aureus subsp. aureus MW2
cuaggauguucaucaac

SEQ ID NO: 2106585 - RNA, 17 nt, Staphylococcus aureus subsp. aureus MW2
cuagcaaaaauacuuuu

SEQ ID NO: 2106586 - RNA, 19 nt, Staphylococcus aureus subsp. aureus MW2
cuagcaagaauagauugau

SEQ ID NO: 2106587 - RNA, 20 nt, Staphylococcus aureus subsp. aureus MW2
cuaguaaaccuacuaauaua

SEQ ID NO: 2106588 - RNA, 23 nt, Staphylococcus aureus subsp. aureus MW2
cuaguaaaucaaagaugacuugg

SEQ ID NO: 2106589 - RNA, 14 nt, Staphylococcus aureus subsp. aureus MW2
cuauaguaagaaaa

SEQ ID NO: 2106590 - RNA, 16 nt, Staphylococcus aureus subsp. aureus MW2
cuauagucauucauaa

SEQ ID NO: 2106591 - RNA, 21 nt, Staphylococcus aureus subsp. aureus MW2
cuauaccauuccaaaaauugu

SEQ ID NO: 2106592 - RNA, 16 nt, Staphylococcus aureus subsp. aureus MW2
cuauauauauuuaaau

SEQ ID NO: 2106593 - RNA, 18 nt, Staphylococcus aureus subsp. aureus MW2
cuauauaauuuauaaaaa

SEQ ID NO: 2106594 - RNA, 13 nt, Staphylococcus aureus subsp. aureus MW2
cuauauaauuuau

SEQ ID NO: 2106595 - RNA, 14 nt, Staphylococcus aureus subsp. aureus MW2
cuauauaauuuauu

SEQ ID NO: 2106596 - RNA, 18 nt, Staphylococcus aureus subsp. aureus MW2
cuauauaguaaaauaaau

SEQ ID NO: 2106597 - RNA, 19 nt, Staphylococcus aureus subsp. aureus MW2
cuauauagccuguuaagug

SEQ ID NO: 2106598 - RNA, 13 nt, Staphylococcus aureus subsp. aureus MW2
cuauauaauaauu

SEQ ID NO: 2106599 - RNA, 18 nt, Staphylococcus aureus subsp. aureus MW2
cuauauaaugauuuaauu

SEQ ID NO: 2106600 - RNA, 17 nt, Staphylococcus aureus subsp. aureus MW2
cuauauaacgcuuuaaa

SEQ ID NO: 2106601 - RNA, 13 nt, Staphylococcus aureus subsp. aureus MW2
cuauauaaaaacu

SEQ ID NO: 2106602 - RNA, 13 nt, Staphylococcus aureus subsp. aureus MW2
cuauauaaaguug

SEQ ID NO: 2106603 - RNA, 18 nt, Staphylococcus aureus subsp. aureus MW2
cuauauuuuuguauuuau

SEQ ID NO: 2106604 - RNA, 15 nt, Staphylococcus aureus subsp. aureus MW2
cuaucaaauuacuua

SEQ ID NO: 2106605 - RNA, 13 nt, Staphylococcus aureus subsp. aureus MW2
cuauauuuauuag

SEQ ID NO: 2106606 - RNA, 16 nt, Staphylococcus aureus subsp. aureus MW2
cuauauucaauuuaau

SEQ ID NO: 2106607 - RNA, 17 nt, Staphylococcus aureus subsp. aureus MW2
cuauauucaauuuaaua

SEQ ID NO: 2106608 - RNA, 15 nt, Staphylococcus aureus subsp. aureus MW2
cuauguacaaucauu

SEQ ID NO: 2106609 - RNA, 21 nt, Staphylococcus aureus subsp. aureus MW2
cuauuaaaggaaaucaaucca

SEQ ID NO: 2106610 - RNA, 13 nt, Staphylococcus aureus subsp. aureus MW2
cuauuaaaggaaa

SEQ ID NO: 2106611 - RNA, 19 nt, Staphylococcus aureus subsp. aureus MW2
cuauuaaacauuuuugauu

SEQ ID NO: 2106612 - RNA, 16 nt, Staphylococcus aureus subsp. aureus MW2
cuaugucauaaauaaa

SEQ ID NO: 2106613 - RNA, 19 nt, Staphylococcus aureus subsp. aureus MW2
cuaugauuugauauuucaa

SEQ ID NO: 2106614 - RNA, 11 nt, Staphylococcus aureus subsp. aureus MW2
cuaugauauau

SEQ ID NO: 2106615 - RNA, 21 nt, Staphylococcus aureus subsp. aureus MW2
cuaucguuuauugauagucac

SEQ ID NO: 2106616 - RNA, 20 nt, Staphylococcus aureus subsp. aureus MW2
cuaugauaugugaaaaagcu

SEQ ID NO: 2106617 - RNA, 21 nt, Staphylococcus aureus subsp. aureus MW2
cuaucgccuaaaaauaaaauc

SEQ ID NO: 2106618 - RNA, 17 nt, Staphylococcus aureus subsp. aureus MW2
cuaucgccuaaaaauaa

SEQ ID NO: 2106619 - RNA, 18 nt, Staphylococcus aureus subsp. aureus MW2
cuaucgccuaaaaauaaa

SEQ ID NO: 2106620 - RNA, 15 nt, Staphylococcus aureus subsp. aureus MW2
cuaucgauacuaaac

SEQ ID NO: 2106621 - RNA, 13 nt, Staphylococcus aureus subsp. aureus MW2
cucacaugugaaa

SEQ ID NO: 2106622 - RNA, 17 nt, Staphylococcus aureus subsp. aureus MW2
cucaauccaauuaaaua

SEQ ID NO: 2106623 - RNA, 20 nt, Staphylococcus aureus subsp. aureus MW2
cucaauccaauuaaauauuu

SEQ ID NO: 2106624 - RNA, 23 nt, Staphylococcus aureus subsp. aureus MW2
cucaccuuuagacaauauuuuua

SEQ ID NO: 2106625 - RNA, 17 nt, Staphylococcus aureus subsp. aureus MW2
cucaacauuaaaaugug

SEQ ID NO: 2106626 - RNA, 17 nt, Staphylococcus aureus subsp. aureus MW2
cucaacacgauagucau

SEQ ID NO: 2106627 - RNA, 16 nt, Staphylococcus aureus subsp. aureus MW2
cuauuaauuuucucaa

SEQ ID NO: 2106628 - RNA, 17 nt, Staphylococcus aureus subsp. aureus MW2
cuauuaauuacgucaua

SEQ ID NO: 2106629 - RNA, 15 nt, Staphylococcus aureus subsp. aureus MW2
cuauguuggggcccc

SEQ ID NO: 2106630 - RNA, 12 nt, Staphylococcus aureus subsp. aureus MW2
cuauuaaaucau

SEQ ID NO: 2106631 - RNA, 16 nt, Staphylococcus aureus subsp. aureus MW2
cucaaauauuaauuua

SEQ ID NO: 2106632 - RNA, 20 nt, Staphylococcus aureus subsp. aureus MW2
cuauuagauacauauaagaa

SEQ ID NO: 2106633 - RNA, 15 nt, Staphylococcus aureus subsp. aureus MW2
cucaacuuaaauauc

SEQ ID NO: 2106634 - RNA, 19 nt, Staphylococcus aureus subsp. aureus MW2
cucaagacauuacaucuuu

SEQ ID NO: 2106635 - RNA, 22 nt, Staphylococcus aureus subsp. aureus MW2
cucauccauugaucuuuuauaa

SEQ ID NO: 2106636 - RNA, 12 nt, Staphylococcus aureus subsp. aureus MW2
cucaucuucuaa

SEQ ID NO: 2106637 - RNA, 22 nt, Staphylococcus aureus subsp. aureus MW2
cucaucuauuuaauaauguauc

SEQ ID NO: 2106638 - RNA, 21 nt, Staphylococcus aureus subsp. aureus MW2
cucaucuguccgauaucuuuu

SEQ ID NO: 2106639 - RNA, 18 nt, Staphylococcus aureus subsp. aureus MW2
cucaugagcacaaacuaa

SEQ ID NO: 2106640 - RNA, 20 nt, Staphylococcus aureus subsp. aureus MW2
cucaucgaguuuguuucuaa

SEQ ID NO: 2106641 - RNA, 20 nt, Staphylococcus aureus subsp. aureus MW2
cucaucgcauccauuuuuug

SEQ ID NO: 2106642 - RNA, 14 nt, Staphylococcus aureus subsp. aureus MW2
cucauacaaauuuu

SEQ ID NO: 2106643 - RNA, 15 nt, Staphylococcus aureus subsp. aureus MW2
cucauacaaauuuuu

SEQ ID NO: 2106644 - RNA, 12 nt, Staphylococcus aureus subsp. aureus MW2
cucauaauaauu

SEQ ID NO: 2106645 - RNA, 14 nt, Staphylococcus aureus subsp. aureus MW2
cucauaaucaaguc

SEQ ID NO: 2106646 - RNA, 18 nt, Staphylococcus aureus subsp. aureus MW2
cucauaaccgcuucuuuu

SEQ ID NO: 2106647 - RNA, 17 nt, Staphylococcus aureus subsp. aureus MW2
cucauaaaauacgcaaa

SEQ ID NO: 2106648 - RNA, 17 nt, Staphylococcus aureus subsp. aureus MW2
cucagugcauuuuuuau

SEQ ID NO: 2106649 - RNA, 17 nt, Staphylococcus aureus subsp. aureus MW2
cucaguauuuaauguuu

SEQ ID NO: 2106650 - RNA, 21 nt, Staphylococcus aureus subsp. aureus MW2
cucaguugcccgauuuuaaau

SEQ ID NO: 2106651 - RNA, 13 nt, Staphylococcus aureus subsp. aureus MW2
cucaguaaauuua

SEQ ID NO: 2106652 - RNA, 19 nt, Staphylococcus aureus subsp. aureus MW2
cucaugcugaaauguagac

SEQ ID NO: 2106653 - RNA, 20 nt, Staphylococcus aureus subsp. aureus MW2
cucaugcugaaauguagaca

SEQ ID NO: 2106654 - RNA, 13 nt, Staphylococcus aureus subsp. aureus MW2
cuccucuauuuua

SEQ ID NO: 2106655 - RNA, 23 nt, Staphylococcus aureus subsp. aureus MW2
cuccucuauuuuaugauuugauu

SEQ ID NO: 2106656 - RNA, 23 nt, Staphylococcus aureus subsp. aureus MW2
cucgaaaauaaaacaaauuauua

SEQ ID NO: 2106657 - RNA, 14 nt, Staphylococcus aureus subsp. aureus MW2
cuccuuaaacaaau

SEQ ID NO: 2106658 - RNA, 13 nt, Staphylococcus aureus subsp. aureus MW2
cuccuuacaauaa

SEQ ID NO: 2106659 - RNA, 19 nt, Staphylococcus aureus subsp. aureus MW2
cucgaguuuauucgcuugu

SEQ ID NO: 2106660 - RNA, 13 nt, Staphylococcus aureus subsp. aureus MW2
cucuccaccauau

SEQ ID NO: 2106661 - RNA, 17 nt, Staphylococcus aureus subsp. aureus MW2
cucuauuuauaacacuu

SEQ ID NO: 2106662 - RNA, 16 nt, Staphylococcus aureus subsp. aureus MW2
cucucaacauuuugau

SEQ ID NO: 2106663 - RNA, 15 nt, Staphylococcus aureus subsp. aureus MW2
cucuauuuuaugauu

SEQ ID NO: 2106664 - RNA, 17 nt, Staphylococcus aureus subsp. aureus MW2
cucuauuuuuuauguuu

SEQ ID NO: 2106665 - RNA, 19 nt, Staphylococcus aureus subsp. aureus MW2
cucuaucaaauuaccauuc

SEQ ID NO: 2106666 - RNA, 17 nt, Staphylococcus aureus subsp. aureus MW2
cucugcuagacaaucau

SEQ ID NO: 2106667 - RNA, 14 nt, Staphylococcus aureus subsp. aureus MW2
cucugauauugauc

SEQ ID NO: 2106668 - RNA, 17 nt, Staphylococcus aureus subsp. aureus MW2
cucugauauugaucuga

SEQ ID NO: 2106669 - RNA, 19 nt, Staphylococcus aureus subsp. aureus MW2
cucugaaaagccuacuuug

SEQ ID NO: 2106670 - RNA, 15 nt, Staphylococcus aureus subsp. aureus MW2
cucugaaaaacuucu

SEQ ID NO: 2106671 - RNA, 12 nt, Staphylococcus aureus subsp. aureus MW2
cucguaauaaug

SEQ ID NO: 2106672 - RNA, 18 nt, Staphylococcus aureus subsp. aureus MW2
cucguaaauuuuaucuaa

SEQ ID NO: 2106673 - RNA, 18 nt, Staphylococcus aureus subsp. aureus MW2
cguauuagccaauaaaau

SEQ ID NO: 2106674 - RNA, 13 nt, Staphylococcus aureus subsp. aureus MW2
cguaguauauaug

SEQ ID NO: 2106675 - RNA, 16 nt, Staphylococcus aureus subsp. aureus MW2
cguauaauaguuuacg

SEQ ID NO: 2106676 - RNA, 23 nt, Staphylococcus aureus subsp. aureus MW2
cguaaggaauuacacuuuaaaua

SEQ ID NO: 2106677 - RNA, 13 nt, Staphylococcus aureus subsp. aureus MW2
cgucccauaauag

SEQ ID NO: 2106678 - RNA, 21 nt, Staphylococcus aureus subsp. aureus MW2
cgucccaccccaacuugcauu

SEQ ID NO: 2106679 - RNA, 18 nt, Staphylococcus aureus subsp. aureus MW2
cgucauauuaauauuuuu

SEQ ID NO: 2106680 - RNA, 15 nt, Staphylococcus aureus subsp. aureus MW2
cguaacuauaugaaa

SEQ ID NO: 2106681 - RNA, 13 nt, Staphylococcus aureus subsp. aureus MW2
cguaaacaacauc

SEQ ID NO: 2106682 - RNA, 15 nt, Staphylococcus aureus subsp. aureus MW2
cgguuuuauuuuugu

SEQ ID NO: 2106683 - RNA, 17 nt, Staphylococcus aureus subsp. aureus MW2
cgucuuaauucuucugu

SEQ ID NO: 2106684 - RNA, 22 nt, Staphylococcus aureus subsp. aureus MW2
cgucuuuuuuuaugaaaagaau

SEQ ID NO: 2106685 - RNA, 19 nt, Staphylococcus aureus subsp. aureus MW2
cgucuuuugcaaauuggaa

SEQ ID NO: 2106686 - RNA, 20 nt, Staphylococcus aureus subsp. aureus MW2
cgucuuuugcaaauuggaaa

SEQ ID NO: 2106687 - RNA, 18 nt, Staphylococcus aureus subsp. aureus MW2
cgugcauuguaauaccaa

SEQ ID NO: 2106688 - RNA, 17 nt, Staphylococcus aureus subsp. aureus MW2
cgugguaugauuuuuga

SEQ ID NO: 2106689 - RNA, 13 nt, Staphylococcus aureus subsp. aureus MW2
cgugguucccaau

SEQ ID NO: 2106690 - RNA, 20 nt, Staphylococcus aureus subsp. aureus MW2
cguguaaaaaugauuauucu

SEQ ID NO: 2106691 - RNA, 23 nt, Staphylococcus aureus subsp. aureus MW2
cguguaaaaaugauuauucuuuu

SEQ ID NO: 2106692 - RNA, 12 nt, Staphylococcus aureus subsp. aureus MW2
cguguguaguag

SEQ ID NO: 2106693 - RNA, 20 nt, Staphylococcus aureus subsp. aureus MW2
cguguuugaauggcaaauau

SEQ ID NO: 2106694 - RNA, 14 nt, Staphylococcus aureus subsp. aureus MW2
cguucucuuaaaua

SEQ ID NO: 2106695 - RNA, 13 nt, Staphylococcus aureus subsp. aureus MW2
cguucgcaucuuu

SEQ ID NO: 2106696 - RNA, 12 nt, Staphylococcus aureus subsp. aureus MW2
cguuuaauaaug

SEQ ID NO: 2106697 - RNA, 14 nt, Staphylococcus aureus subsp. aureus MW2
cguuuauuuuaaau

SEQ ID NO: 2106698 - RNA, 16 nt, Staphylococcus aureus subsp. aureus MW2
cguuuacguucuucau

SEQ ID NO: 2106699 - RNA, 17 nt, Staphylococcus aureus subsp. aureus MW2
cguuuacguucuucaug

SEQ ID NO: 2106700 - RNA, 23 nt, Staphylococcus aureus subsp. aureus MW2
cguugcuuuuauuuuuaauguua

SEQ ID NO: 2106701 - RNA, 19 nt, Staphylococcus aureus subsp. aureus MW2
cguuugaagaauguuucau

SEQ ID NO: 2106702 - RNA, 13 nt, Staphylococcus aureus subsp. aureus MW2
cguuuccaaucca

SEQ ID NO: 2106703 - RNA, 19 nt, Staphylococcus aureus subsp. aureus MW2
cguuucuuuguauaccuau

SEQ ID NO: 2106704 - RNA, 15 nt, Staphylococcus aureus subsp. aureus MW2
cguuugaauuauuua

SEQ ID NO: 2106705 - RNA, 13 nt, Staphylococcus aureus subsp. aureus MW2
cguuugauuucac

SEQ ID NO: 2106706 - RNA, 21 nt, Staphylococcus aureus subsp. aureus MW2
cguuucagaaguuguuuagaa

SEQ ID NO: 2106707 - RNA, 21 nt, Staphylococcus aureus subsp. aureus MW2
cuaaaaagcgugguucccaau

SEQ ID NO: 2106708 - RNA, 20 nt, Staphylococcus aureus subsp. aureus MW2
cuaaaacaugauacgugguu

SEQ ID NO: 2106709 - RNA, 17 nt, Staphylococcus aureus subsp. aureus MW2
cuaaaacaucacuugcu

SEQ ID NO: 2106710 - RNA, 21 nt, Staphylococcus aureus subsp. aureus MW2
cuaaaacaaauucauauuaac

SEQ ID NO: 2106711 - RNA, 20 nt, Staphylococcus aureus subsp. aureus MW2
cuaaaaacggacaaguugca

SEQ ID NO: 2106712 - RNA, 23 nt, Staphylococcus aureus subsp. aureus MW2
cuaaaauaucaaaauauaaaauc

SEQ ID NO: 2106713 - RNA, 18 nt, Staphylococcus aureus subsp. aureus MW2
cuaaaauacccauuuuuu

SEQ ID NO: 2106714 - RNA, 22 nt, Staphylococcus aureus subsp. aureus MW2
cuaaaauacuguuuucauuugu

SEQ ID NO: 2106715 - RNA, 15 nt, Staphylococcus aureus subsp. aureus MW2
cuaaaauuaaccauu

SEQ ID NO: 2106716 - RNA, 23 nt, Staphylococcus aureus subsp. aureus MW2
cuaaaauuaaccauuucuuuuuu

SEQ ID NO: 2106717 - RNA, 15 nt, Staphylococcus aureus subsp. aureus MW2
cuaaaaugucuuuga

SEQ ID NO: 2106718 - RNA, 20 nt, Staphylococcus aureus subsp. aureus MW2
cuaaagaaugacguuaucau

SEQ ID NO: 2106719 - RNA, 16 nt, Staphylococcus aureus subsp. aureus MW2
cuaaagacuuuaugcc

SEQ ID NO: 2106720 - RNA, 15 nt, Staphylococcus aureus subsp. aureus MW2
cuaaagaccuuucuu

SEQ ID NO: 2106721 - RNA, 12 nt, Staphylococcus aureus subsp. aureus MW2
cuaaagcaauua

SEQ ID NO: 2106722 - RNA, 20 nt, Staphylococcus aureus subsp. aureus MW2
cuaaagcaauuauuauugcu

SEQ ID NO: 2106723 - RNA, 14 nt, Staphylococcus aureus subsp. aureus MW2
cuaaauaaaauuaa

SEQ ID NO: 2106724 - RNA, 16 nt, Staphylococcus aureus subsp. aureus MW2
cuaaauaaaauuaaaa

SEQ ID NO: 2106725 - RNA, 22 nt, Staphylococcus aureus subsp. aureus MW2
cuaaauaaaauuaaaacagcaa

SEQ ID NO: 2106726 - RNA, 21 nt, Staphylococcus aureus subsp. aureus MW2
cuaaaucaccauuuuuuacaa

SEQ ID NO: 2106727 - RNA, 15 nt, Staphylococcus aureus subsp. aureus MW2
cuaaauauuauaaaa

SEQ ID NO: 2106728 - RNA, 16 nt, Staphylococcus aureus subsp. aureus MW2
cuaaauauuauaaaaa

SEQ ID NO: 2106729 - RNA, 18 nt, Staphylococcus aureus subsp. aureus MW2
cuaaauauuauaaaaaga

SEQ ID NO: 2106730 - RNA, 18 nt, Staphylococcus aureus subsp. aureus MW2
cuaaauauuuaccuugcu

SEQ ID NO: 2106731 - RNA, 14 nt, Staphylococcus aureus subsp. aureus MW2
cuaaaguaaauaac

SEQ ID NO: 2106732 - RNA, 19 nt, Staphylococcus aureus subsp. aureus MW2
cuaaagguauucuauuuuu

SEQ ID NO: 2106733 - RNA, 13 nt, Staphylococcus aureus subsp. aureus MW2
cuaaaguaaauaa

SEQ ID NO: 2106734 - RNA, 13 nt, Staphylococcus aureus subsp. aureus MW2
cuaaagguaacuu

SEQ ID NO: 2106735 - RNA, 18 nt, Staphylococcus aureus subsp. aureus MW2
cuaaagguauucuauuuu

SEQ ID NO: 2106736 - RNA, 15 nt, Staphylococcus aureus subsp. aureus MW2
cuaaaggaauuucaa

SEQ ID NO: 2106737 - RNA, 14 nt, Staphylococcus aureus subsp. aureus MW2
cuaaagcuaaugca

SEQ ID NO: 2106738 - RNA, 22 nt, Staphylococcus aureus subsp. aureus MW2
cuaaauucaguucaaacagaaa

SEQ ID NO: 2106739 - RNA, 22 nt, Staphylococcus aureus subsp. aureus MW2
cuaaauuauuuauucauuauag

SEQ ID NO: 2106740 - RNA, 18 nt, Staphylococcus aureus subsp. aureus MW2
cuaaauucaauaaucuua

SEQ ID NO: 2106741 - RNA, 16 nt, Staphylococcus aureus subsp. aureus MW2
cuaaauucuuuuuguu

SEQ ID NO: 2106742 - RNA, 21 nt, Staphylococcus aureus subsp. aureus MW2
cuaaauuuauauagucuauga

SEQ ID NO: 2106743 - RNA, 17 nt, Staphylococcus aureus subsp. aureus MW2
cuaaaugcacuagcaac

SEQ ID NO: 2106744 - RNA, 20 nt, Staphylococcus aureus subsp. aureus MW2
cuaaaugguuaucuaaaauu

SEQ ID NO: 2106745 - RNA, 14 nt, Staphylococcus aureus subsp. aureus MW2
cuaaauguaaaauc

SEQ ID NO: 2106746 - RNA, 15 nt, Staphylococcus aureus subsp. aureus MW2
cuaaauuauuguuua

SEQ ID NO: 2106747 - RNA, 21 nt, Staphylococcus aureus subsp. aureus MW2
cuaaaugaauugcuuguucuu

SEQ ID NO: 2106748 - RNA, 14 nt, Staphylococcus aureus subsp. aureus MW2
cuaaaucuauacuu

SEQ ID NO: 2106749 - RNA, 17 nt, Staphylococcus aureus subsp. aureus MW2
cuaaaugcaauauguaa

SEQ ID NO: 2106750 - RNA, 23 nt, Staphylococcus aureus subsp. aureus MW2
cuaaaugauggguaguuaauaua

SEQ ID NO: 2106751 - RNA, 13 nt, Staphylococcus aureus subsp. aureus MW2
cuaaaucuuuaaa

SEQ ID NO: 2106752 - RNA, 18 nt, Staphylococcus aureus subsp. aureus MW2
cuaaaucgucugcuaaau

SEQ ID NO: 2106753 - RNA, 20 nt, Staphylococcus aureus subsp. aureus MW2
cgggccccaacauagaagcu

SEQ ID NO: 2106754 - RNA, 23 nt, Staphylococcus aureus subsp. aureus MW2
cgggccccaacauagaagcuggc

SEQ ID NO: 2106755 - RNA, 19 nt, Staphylococcus aureus subsp. aureus MW2
aaacuauaauaaagauuau

SEQ ID NO: 2106756 - RNA, 16 nt, Staphylococcus aureus subsp. aureus MW2
aaacuauaauaaagau

SEQ ID NO: 2106757 - RNA, 17 nt, Staphylococcus aureus subsp. aureus MW2
aaacuauaauaaagauu

SEQ ID NO: 2106758 - RNA, 22 nt, Staphylococcus aureus subsp. aureus MW2
cggugaccuuauauuuuauuua

SEQ ID NO: 2106759 - RNA, 15 nt, Staphylococcus aureus subsp. aureus MW2
cgguauuuucauuuu

SEQ ID NO: 2106760 - RNA, 18 nt, Staphylococcus aureus subsp. aureus MW2
aaacuagcaguaauaugu

SEQ ID NO: 2106761 - RNA, 18 nt, Staphylococcus aureus subsp. aureus MW2
aaacuaaagguauucuau

SEQ ID NO: 2106762 - RNA, 23 nt, Staphylococcus aureus subsp. aureus MW2
cgggggacauagguauaaucauu

SEQ ID NO: 2106763 - RNA, 12 nt, Staphylococcus aureus subsp. aureus MW2
cggguaauauuu

SEQ ID NO: 2106764 - RNA, 16 nt, Staphylococcus aureus subsp. aureus MW2
cggguaauauuuuugu

SEQ ID NO: 2106765 - RNA, 20 nt, Staphylococcus aureus subsp. aureus MW2
cggggccccaacacagagaa

SEQ ID NO: 2106766 - RNA, 17 nt, Staphylococcus aureus subsp. aureus MW2
cggggccccaacacaga

SEQ ID NO: 2106767 - RNA, 17 nt, Staphylococcus aureus subsp. aureus MW2
cggggaauuuuuaugca

SEQ ID NO: 2106768 - RNA, 18 nt, Staphylococcus aureus subsp. aureus MW2
cgguaaaacgaagucagu

SEQ ID NO: 2106769 - RNA, 13 nt, Staphylococcus aureus subsp. aureus MW2
cuucucuuugaac

SEQ ID NO: 2106770 - RNA, 16 nt, Staphylococcus aureus subsp. aureus MW2
cuucugcauagcgcuc

SEQ ID NO: 2106771 - RNA, 20 nt, Staphylococcus aureus subsp. aureus MW2
cuucuggauagguaucacua

SEQ ID NO: 2106772 - RNA, 21 nt, Staphylococcus aureus subsp. aureus MW2
cuucuggagccucuuguucuc

SEQ ID NO: 2106773 - RNA, 18 nt, Staphylococcus aureus subsp. aureus MW2
cuucucccuuaaauacaa

SEQ ID NO: 2106774 - RNA, 20 nt, Staphylococcus aureus subsp. aureus MW2
cuucucaucgaauucauuug

SEQ ID NO: 2106775 - RNA, 22 nt, Staphylococcus aureus subsp. aureus MW2
cuucucaauuuaguauaaauaa

SEQ ID NO: 2106776 - RNA, 17 nt, Staphylococcus aureus subsp. aureus MW2
cuucgucuguauccuca

SEQ ID NO: 2106777 - RNA, 19 nt, Staphylococcus aureus subsp. aureus MW2
cuucgucaaugacuaagau

SEQ ID NO: 2106778 - RNA, 19 nt, Staphylococcus aureus subsp. aureus MW2
cuucuaaaacuaaagguau

SEQ ID NO: 2106779 - RNA, 19 nt, Staphylococcus aureus subsp. aureus MW2
cuucguugauuaacauuac

SEQ ID NO: 2106780 - RNA, 17 nt, Staphylococcus aureus subsp. aureus MW2
cuucuaaucguuaauaa

SEQ ID NO: 2106781 - RNA, 17 nt, Staphylococcus aureus subsp. aureus MW2
cuucuaacucaccugca

SEQ ID NO: 2106782 - RNA, 20 nt, Staphylococcus aureus subsp. aureus MW2
cuucuaaaaucguuccaaua

SEQ ID NO: 2106783 - RNA, 13 nt, Staphylococcus aureus subsp. aureus MW2
cuucuaacaaauu

SEQ ID NO: 2106784 - RNA, 19 nt, Staphylococcus aureus subsp. aureus MW2
cuucuacagauuuauauuc

SEQ ID NO: 2106785 - RNA, 17 nt, Staphylococcus aureus subsp. aureus MW2
cuucuaauuugcaaaau

SEQ ID NO: 2106786 - RNA, 22 nt, Staphylococcus aureus subsp. aureus MW2
cuucuaauuuaguuuuaauaua

SEQ ID NO: 2106787 - RNA, 23 nt, Staphylococcus aureus subsp. aureus MW2
cuucuaauuuaguuuuaauauaa

SEQ ID NO: 2106788 - RNA, 21 nt, Staphylococcus aureus subsp. aureus MW2
cuucuaauuugcaaaaucaac

SEQ ID NO: 2106789 - RNA, 13 nt, Staphylococcus aureus subsp. aureus MW2
cuucuauauuaau

SEQ ID NO: 2106790 - RNA, 14 nt, Staphylococcus aureus subsp. aureus MW2
cuucuaguaauucu

SEQ ID NO: 2106791 - RNA, 16 nt, Staphylococcus aureus subsp. aureus MW2
cuucuauuaauaauuu

SEQ ID NO: 2106792 - RNA, 14 nt, Staphylococcus aureus subsp. aureus MW2
cuucuaucuuuauu

SEQ ID NO: 2106793 - RNA, 16 nt, Staphylococcus aureus subsp. aureus MW2
cuucuauuuuauaaua

SEQ ID NO: 2106794 - RNA, 14 nt, Staphylococcus aureus subsp. aureus MW2
cuucuauuauauug

SEQ ID NO: 2106795 - RNA, 17 nt, Staphylococcus aureus subsp. aureus MW2
cuucuauuuuauaauaa

SEQ ID NO: 2106796 - RNA, 22 nt, Staphylococcus aureus subsp. aureus MW2
cuucuucuaaccacuucuucac

SEQ ID NO: 2106797 - RNA, 12 nt, Staphylococcus aureus subsp. aureus MW2
cuucuucaucau

SEQ ID NO: 2106798 - RNA, 20 nt, Staphylococcus aureus subsp. aureus MW2
cuucuuaacuugaaauguug

SEQ ID NO: 2106799 - RNA, 14 nt, Staphylococcus aureus subsp. aureus MW2
cuucuucaguaagc

SEQ ID NO: 2106800 - RNA, 22 nt, Staphylococcus aureus subsp. aureus MW2
cuucuuuguuuuuaauuuuuaa

SEQ ID NO: 2106801 - RNA, 20 nt, Staphylococcus aureus subsp. aureus MW2
cuucuuucuaaaauaacuaa

SEQ ID NO: 2106802 - RNA, 19 nt, Staphylococcus aureus subsp. aureus MW2
cuucuuuagcaaaacgcau

SEQ ID NO: 2106803 - RNA, 20 nt, Staphylococcus aureus subsp. aureus MW2
cuugaacaauucuucaucau

SEQ ID NO: 2106804 - RNA, 22 nt, Staphylococcus aureus subsp. aureus MW2
cuugaaacaucuugauauucau

SEQ ID NO: 2106805 - RNA, 20 nt, Staphylococcus aureus subsp. aureus MW2
cuucuuuuuguccccagccc

SEQ ID NO: 2106806 - RNA, 19 nt, Staphylococcus aureus subsp. aureus MW2
cuucuuuuguuuuaccauc

SEQ ID NO: 2106807 - RNA, 16 nt, Staphylococcus aureus subsp. aureus MW2
cuugaauaauauauuu

SEQ ID NO: 2106808 - RNA, 14 nt, Staphylococcus aureus subsp. aureus MW2
cuugaauguuugaa

SEQ ID NO: 2106809 - RNA, 16 nt, Staphylococcus aureus subsp. aureus MW2
cuugaagcaucgauuu

SEQ ID NO: 2106810 - RNA, 20 nt, Staphylococcus aureus subsp. aureus MW2
cuugaauaaauuuuauucuu

SEQ ID NO: 2106811 - RNA, 18 nt, Staphylococcus aureus subsp. aureus MW2
cuugaucauuauaaaaug

SEQ ID NO: 2106812 - RNA, 15 nt, Staphylococcus aureus subsp. aureus MW2
cuugauaaaauaaau

SEQ ID NO: 2106813 - RNA, 22 nt, Staphylococcus aureus subsp. aureus MW2
cuugagcuuuguuagcaucugc

SEQ ID NO: 2106814 - RNA, 19 nt, Staphylococcus aureus subsp. aureus MW2
cuugauuauauuuuucuuc

SEQ ID NO: 2106815 - RNA, 16 nt, Staphylococcus aureus subsp. aureus MW2
cuugaugaaacugauu

SEQ ID NO: 2106816 - RNA, 22 nt, Staphylococcus aureus subsp. aureus MW2
cuugcaaauauaucaucucuau

SEQ ID NO: 2106817 - RNA, 14 nt, Staphylococcus aureus subsp. aureus MW2
cuugcacaccagug

SEQ ID NO: 2106818 - RNA, 15 nt, Staphylococcus aureus subsp. aureus MW2
cuugauuuaauuuuu

SEQ ID NO: 2106819 - RNA, 15 nt, Staphylococcus aureus subsp. aureus MW2
cuugauuguaaauaa

SEQ ID NO: 2106820 - RNA, 17 nt, Staphylococcus aureus subsp. aureus MW2
cuugauuguaaauaaaa

SEQ ID NO: 2106821 - RNA, 20 nt, Staphylococcus aureus subsp. aureus MW2
cuugcauacgaauuaaaaua

SEQ ID NO: 2106822 - RNA, 21 nt, Staphylococcus aureus subsp. aureus MW2
cuugcauacgaauuaaaauaa

SEQ ID NO: 2106823 - RNA, 22 nt, Staphylococcus aureus subsp. aureus MW2
cuugcauaaccaaguaauucuu

SEQ ID NO: 2106824 - RNA, 17 nt, Staphylococcus aureus subsp. aureus MW2
cuugccuacuuuuuugg

SEQ ID NO: 2106825 - RNA, 22 nt, Staphylococcus aureus subsp. aureus MW2
cuugccugguaacguucuacuc

SEQ ID NO: 2106826 - RNA, 22 nt, Staphylococcus aureus subsp. aureus MW2
aaacuucuuguuucaaacaaag

SEQ ID NO: 2106827 - RNA, 10 nt, Staphylococcus aureus subsp. aureus MW2
aaacuucuuu

SEQ ID NO: 2106828 - RNA, 16 nt, Staphylococcus aureus subsp. aureus MW2
cuugcucaugagcaca

SEQ ID NO: 2106829 - RNA, 20 nt, Staphylococcus aureus subsp. aureus MW2
cuugcuuacaauaaucacuu

SEQ ID NO: 2106830 - RNA, 14 nt, Staphylococcus aureus subsp. aureus MW2
cuugcuucuguauc

SEQ ID NO: 2106831 - RNA, 20 nt, Staphylococcus aureus subsp. aureus MW2
cuugcuucuuuccucuccuu

SEQ ID NO: 2106832 - RNA, 12 nt, Staphylococcus aureus subsp. aureus MW2
cuugcuuacaau

SEQ ID NO: 2106833 - RNA, 22 nt, Staphylococcus aureus subsp. aureus MW2
cuuggaaacgauauagaccguu

SEQ ID NO: 2106834 - RNA, 16 nt, Staphylococcus aureus subsp. aureus MW2
cuguuuauauaaguga

SEQ ID NO: 2106835 - RNA, 23 nt, Staphylococcus aureus subsp. aureus MW2
cuguuaugaaguauccuuauuug

SEQ ID NO: 2106836 - RNA, 15 nt, Staphylococcus aureus subsp. aureus MW2
cuuaauauuuauuac

SEQ ID NO: 2106837 - RNA, 20 nt, Staphylococcus aureus subsp. aureus MW2
cuuaacaacaugauuucuuc

SEQ ID NO: 2106838 - RNA, 12 nt, Staphylococcus aureus subsp. aureus MW2
cuuaacaacaug

SEQ ID NO: 2106839 - RNA, 18 nt, Staphylococcus aureus subsp. aureus MW2
cuuaacaauaucaucuaa

SEQ ID NO: 2106840 - RNA, 23 nt, Staphylococcus aureus subsp. aureus MW2
cuuaacaauuuuaauuuuucauu

SEQ ID NO: 2106841 - RNA, 18 nt, Staphylococcus aureus subsp. aureus MW2
cuuaaccauuuaaaaauu

SEQ ID NO: 2106842 - RNA, 17 nt, Staphylococcus aureus subsp. aureus MW2
cuuaacauaaaaugagu

SEQ ID NO: 2106843 - RNA, 15 nt, Staphylococcus aureus subsp. aureus MW2
cuuaacaucuuuuuc

SEQ ID NO: 2106844 - RNA, 16 nt, Staphylococcus aureus subsp. aureus MW2
cuuaaagaauuaagua

SEQ ID NO: 2106845 - RNA, 23 nt, Staphylococcus aureus subsp. aureus MW2
cuuaaacgcucuucuucuucagg

SEQ ID NO: 2106846 - RNA, 17 nt, Staphylococcus aureus subsp. aureus MW2
cuuaaaagacauccaca

SEQ ID NO: 2106847 - RNA, 18 nt, Staphylococcus aureus subsp. aureus MW2
cuuaaauaucgacaaauu

SEQ ID NO: 2106848 - RNA, 15 nt, Staphylococcus aureus subsp. aureus MW2
cuguuucuuguucua

SEQ ID NO: 2106849 - RNA, 19 nt, Staphylococcus aureus subsp. aureus MW2
cuguuucuuguucuaaaaa

SEQ ID NO: 2106850 - RNA, 18 nt, Staphylococcus aureus subsp. aureus MW2
cuuacccaaaaaauugua

SEQ ID NO: 2106851 - RNA, 19 nt, Staphylococcus aureus subsp. aureus MW2
cuuacauuuuaauaaaauc

SEQ ID NO: 2106852 - RNA, 18 nt, Staphylococcus aureus subsp. aureus MW2
cuuacauugauaaaauaa

SEQ ID NO: 2106853 - RNA, 17 nt, Staphylococcus aureus subsp. aureus MW2
cuuaauggcgugcuuuu

SEQ ID NO: 2106854 - RNA, 21 nt, Staphylococcus aureus subsp. aureus MW2
cuuaauggcgugcuuuucaaa

SEQ ID NO: 2106855 - RNA, 19 nt, Staphylococcus aureus subsp. aureus MW2
cuuaaugcuaugauuaaag

SEQ ID NO: 2106856 - RNA, 23 nt, Staphylococcus aureus subsp. aureus MW2
cuuaaugucccaagcucuuuuuu

SEQ ID NO: 2106857 - RNA, 14 nt, Staphylococcus aureus subsp. aureus MW2
cuuaauucauucca

SEQ ID NO: 2106858 - RNA, 17 nt, Staphylococcus aureus subsp. aureus MW2
cuuaaucgcucuaaaua

SEQ ID NO: 2106859 - RNA, 19 nt, Staphylococcus aureus subsp. aureus MW2
cuuaaucuauaaauuauuu

SEQ ID NO: 2106860 - RNA, 21 nt, Staphylococcus aureus subsp. aureus MW2
cuuaaugacuucuuuauauuu

SEQ ID NO: 2106861 - RNA, 22 nt, Staphylococcus aureus subsp. aureus MW2
cuuacugcuguuuuuuauagua

SEQ ID NO: 2106862 - RNA, 17 nt, Staphylococcus aureus subsp. aureus MW2
cuuacugcuguucucua

SEQ ID NO: 2106863 - RNA, 16 nt, Staphylococcus aureus subsp. aureus MW2
cuuacuacuuaauuaa

SEQ ID NO: 2106864 - RNA, 13 nt, Staphylococcus aureus subsp. aureus MW2
cuuacuacucauu

SEQ ID NO: 2106865 - RNA, 15 nt, Staphylococcus aureus subsp. aureus MW2
cuuacuacucauuau

SEQ ID NO: 2106866 - RNA, 15 nt, Staphylococcus aureus subsp. aureus MW2
cuuacuacuuaauua

SEQ ID NO: 2106867 - RNA, 18 nt, Staphylococcus aureus subsp. aureus MW2
cuuacgaauagaaaauaa

SEQ ID NO: 2106868 - RNA, 18 nt, Staphylococcus aureus subsp. aureus MW2
cuuaggugucaucgcuuu

SEQ ID NO: 2106869 - RNA, 17 nt, Staphylococcus aureus subsp. aureus MW2
cuuaguaaguuguacuu

SEQ ID NO: 2106870 - RNA, 13 nt, Staphylococcus aureus subsp. aureus MW2
cuuaguacaaaau

SEQ ID NO: 2106871 - RNA, 23 nt, Staphylococcus aureus subsp. aureus MW2
cuuaguacacguguauuguauuu

SEQ ID NO: 2106872 - RNA, 20 nt, Staphylococcus aureus subsp. aureus MW2
cuuagcuaauucauucaaua

SEQ ID NO: 2106873 - RNA, 22 nt, Staphylococcus aureus subsp. aureus MW2
cuuauauuuuauuuaaaaauag

SEQ ID NO: 2106874 - RNA, 13 nt, Staphylococcus aureus subsp. aureus MW2
cuuauauuuuuua

SEQ ID NO: 2106875 - RNA, 18 nt, Staphylococcus aureus subsp. aureus MW2
cuuauauuuuuuacaagc

SEQ ID NO: 2106876 - RNA, 22 nt, Staphylococcus aureus subsp. aureus MW2
cuuaucaaaaccgcuauaaaau

SEQ ID NO: 2106877 - RNA, 17 nt, Staphylococcus aureus subsp. aureus MW2
cuuaguaucagucagcu

SEQ ID NO: 2106878 - RNA, 16 nt, Staphylococcus aureus subsp. aureus MW2
cuuaucaacagcuuca

SEQ ID NO: 2106879 - RNA, 21 nt, Staphylococcus aureus subsp. aureus MW2
cuuaucagcauuaaucguauu

SEQ ID NO: 2106880 - RNA, 13 nt, Staphylococcus aureus subsp. aureus MW2
cuuauuuauuuua

SEQ ID NO: 2106881 - RNA, 16 nt, Staphylococcus aureus subsp. aureus MW2
cuuaugucauauacua

SEQ ID NO: 2106882 - RNA, 12 nt, Staphylococcus aureus subsp. aureus MW2
cuuauuaaaauu

SEQ ID NO: 2106883 - RNA, 22 nt, Staphylococcus aureus subsp. aureus MW2
cuuauuuagaaaguuuuauuua

SEQ ID NO: 2106884 - RNA, 15 nt, Staphylococcus aureus subsp. aureus MW2
cuuauggaaaauuuu

SEQ ID NO: 2106885 - RNA, 16 nt, Staphylococcus aureus subsp. aureus MW2
cuuauggaaaauuuua

SEQ ID NO: 2106886 - RNA, 15 nt, Staphylococcus aureus subsp. aureus MW2
cuuaugcauagcucu

SEQ ID NO: 2106887 - RNA, 15 nt, Staphylococcus aureus subsp. aureus MW2
cuuaugaugucaugu

SEQ ID NO: 2106888 - RNA, 18 nt, Staphylococcus aureus subsp. aureus MW2
cuuaugcaguuuuaauua

SEQ ID NO: 2106889 - RNA, 20 nt, Staphylococcus aureus subsp. aureus MW2
cuuaugcaguuuuaauuaaa

SEQ ID NO: 2106890 - RNA, 19 nt, Staphylococcus aureus subsp. aureus MW2
cuucaggaauaucuuucaa

SEQ ID NO: 2106891 - RNA, 22 nt, Staphylococcus aureus subsp. aureus MW2
cuucagcuaaaaguuucccaag

SEQ ID NO: 2106892 - RNA, 13 nt, Staphylococcus aureus subsp. aureus MW2
cuucaucaauaaa

SEQ ID NO: 2106893 - RNA, 16 nt, Staphylococcus aureus subsp. aureus MW2
cuucaucaauaacuau

SEQ ID NO: 2106894 - RNA, 21 nt, Staphylococcus aureus subsp. aureus MW2
cuucaucaauaaauauugauu

SEQ ID NO: 2106895 - RNA, 20 nt, Staphylococcus aureus subsp. aureus MW2
cuucaguacgguuauuuaau

SEQ ID NO: 2106896 - RNA, 23 nt, Staphylococcus aureus subsp. aureus MW2
cuucaguaacaguauaaauauuu

SEQ ID NO: 2106897 - RNA, 16 nt, Staphylococcus aureus subsp. aureus MW2
cuucaguuaaaucuuu

SEQ ID NO: 2106898 - RNA, 21 nt, Staphylococcus aureus subsp. aureus MW2
cuucaguuaaaucuuuaacuu

SEQ ID NO: 2106899 - RNA, 22 nt, Staphylococcus aureus subsp. aureus MW2
cuucauuaguugccccuagcaa

SEQ ID NO: 2106900 - RNA, 18 nt, Staphylococcus aureus subsp. aureus MW2
cuucauuuauaacauuua

SEQ ID NO: 2106901 - RNA, 15 nt, Staphylococcus aureus subsp. aureus MW2
cuucauugaugaugu

SEQ ID NO: 2106902 - RNA, 15 nt, Staphylococcus aureus subsp. aureus MW2
cuucaaaauuuugac

SEQ ID NO: 2106903 - RNA, 13 nt, Staphylococcus aureus subsp. aureus MW2
cuucaaaaaauaa

SEQ ID NO: 2106904 - RNA, 15 nt, Staphylococcus aureus subsp. aureus MW2
cuuauuuuguuuuaa

SEQ ID NO: 2106905 - RNA, 13 nt, Staphylococcus aureus subsp. aureus MW2
cuuauuuuauacg

SEQ ID NO: 2106906 - RNA, 14 nt, Staphylococcus aureus subsp. aureus MW2
cuuauuuuaaaaua

SEQ ID NO: 2106907 - RNA, 13 nt, Staphylococcus aureus subsp. aureus MW2
cuuauuuuacuau

SEQ ID NO: 2106908 - RNA, 13 nt, Staphylococcus aureus subsp. aureus MW2
cuucaacuucauc

SEQ ID NO: 2106909 - RNA, 20 nt, Staphylococcus aureus subsp. aureus MW2
cuucaacuucaucuaaauga

SEQ ID NO: 2106910 - RNA, 13 nt, Staphylococcus aureus subsp. aureus MW2
cuucaauauuuaa

SEQ ID NO: 2106911 - RNA, 14 nt, Staphylococcus aureus subsp. aureus MW2
cuucacauuuaucc

SEQ ID NO: 2106912 - RNA, 14 nt, Staphylococcus aureus subsp. aureus MW2
cuucaccaucuuua

SEQ ID NO: 2106913 - RNA, 14 nt, Staphylococcus aureus subsp. aureus MW2
cuuguucuucuuua

SEQ ID NO: 2106914 - RNA, 13 nt, Staphylococcus aureus subsp. aureus MW2
cuuguucuaauug

SEQ ID NO: 2106915 - RNA, 19 nt, Staphylococcus aureus subsp. aureus MW2
cuuguucuccgaucaugcc

SEQ ID NO: 2106916 - RNA, 20 nt, Staphylococcus aureus subsp. aureus MW2
cuuguugaacucugauauug

SEQ ID NO: 2106917 - RNA, 16 nt, Staphylococcus aureus subsp. aureus MW2
cuuuaaaucuacuuug

SEQ ID NO: 2106918 - RNA, 11 nt, Staphylococcus aureus subsp. aureus MW2
cuuuaaaucuu

SEQ ID NO: 2106919 - RNA, 18 nt, Staphylococcus aureus subsp. aureus MW2
cuuuaaauauacuucuau

SEQ ID NO: 2106920 - RNA, 11 nt, Staphylococcus aureus subsp. aureus MW2
cuuuaaacucg

SEQ ID NO: 2106921 - RNA, 17 nt, Staphylococcus aureus subsp. aureus MW2
cuuuaaacucguaaauu

SEQ ID NO: 2106922 - RNA, 19 nt, Staphylococcus aureus subsp. aureus MW2
cuuuaaaauuguauagaau

SEQ ID NO: 2106923 - RNA, 15 nt, Staphylococcus aureus subsp. aureus MW2
cuuuaaaauuuuuug

SEQ ID NO: 2106924 - RNA, 13 nt, Staphylococcus aureus subsp. aureus MW2
cuuuaaaauuuuu

SEQ ID NO: 2106925 - RNA, 22 nt, Staphylococcus aureus subsp. aureus MW2
cuuuaaaacaucauucacaagu

SEQ ID NO: 2106926 - RNA, 23 nt, Staphylococcus aureus subsp. aureus MW2
cuuuaaaacguuaguacuuugau

SEQ ID NO: 2106927 - RNA, 18 nt, Staphylococcus aureus subsp. aureus MW2
cuuguuggcuuuuuuaau

SEQ ID NO: 2106928 - RNA, 23 nt, Staphylococcus aureus subsp. aureus MW2
cuuguuuauuuuuaaucuucauc

SEQ ID NO: 2106929 - RNA, 18 nt, Staphylococcus aureus subsp. aureus MW2
aaagaaagcuaauaucaa

SEQ ID NO: 2106930 - RNA, 17 nt, Staphylococcus aureus subsp. aureus MW2
aaagaaaauaucugaaa

SEQ ID NO: 2106931 - RNA, 14 nt, Staphylococcus aureus subsp. aureus MW2
aaagaaacaugauu

SEQ ID NO: 2106932 - RNA, 12 nt, Staphylococcus aureus subsp. aureus MW2
aaagaaaaguuu

SEQ ID NO: 2106933 - RNA, 20 nt, Staphylococcus aureus subsp. aureus MW2
aaacuuuuucgauuaauucu

SEQ ID NO: 2106934 - RNA, 14 nt, Staphylococcus aureus subsp. aureus MW2
cuugucuuuuuuaa

SEQ ID NO: 2106935 - RNA, 19 nt, Staphylococcus aureus subsp. aureus MW2
cuugugauaauucuucaac

SEQ ID NO: 2106936 - RNA, 22 nt, Staphylococcus aureus subsp. aureus MW2
cuugugacaaucgcuugcuucu

SEQ ID NO: 2106937 - RNA, 23 nt, Staphylococcus aureus subsp. aureus MW2
cuuguucaaguaaucauuuuucg

SEQ ID NO: 2106938 - RNA, 18 nt, Staphylococcus aureus subsp. aureus MW2
cuuguucaauacuuucag

SEQ ID NO: 2106939 - RNA, 14 nt, Staphylococcus aureus subsp. aureus MW2
cuuggcauuuuuuc

SEQ ID NO: 2106940 - RNA, 16 nt, Staphylococcus aureus subsp. aureus MW2
cuuggccuacuuuuuc

SEQ ID NO: 2106941 - RNA, 19 nt, Staphylococcus aureus subsp. aureus MW2
cuuggccuacuuuuucaau

SEQ ID NO: 2106942 - RNA, 14 nt, Staphylococcus aureus subsp. aureus MW2
cuuggacauuguaa

SEQ ID NO: 2106943 - RNA, 17 nt, Staphylococcus aureus subsp. aureus MW2
cuuggauucaaaugaca

SEQ ID NO: 2106944 - RNA, 20 nt, Staphylococcus aureus subsp. aureus MW2
cuuggcguauuuuuuguucu

SEQ ID NO: 2106945 - RNA, 14 nt, Staphylococcus aureus subsp. aureus MW2
cuugggacagaaaa

SEQ ID NO: 2106946 - RNA, 18 nt, Staphylococcus aureus subsp. aureus MW2
cuugggacagaaaacaaa

SEQ ID NO: 2106947 - RNA, 15 nt, Staphylococcus aureus subsp. aureus MW2
cuuguaauauaacaa

SEQ ID NO: 2106948 - RNA, 12 nt, Staphylococcus aureus subsp. aureus MW2
cuuguaacaagc

SEQ ID NO: 2106949 - RNA, 16 nt, Staphylococcus aureus subsp. aureus MW2
cuuguacgauaacuac

SEQ ID NO: 2106950 - RNA, 19 nt, Staphylococcus aureus subsp. aureus MW2
aaacuuuugcaauuuuuga

SEQ ID NO: 2106951 - RNA, 15 nt, Staphylococcus aureus subsp. aureus MW2
cuuguaaacuucuuu

SEQ ID NO: 2106952 - RNA, 19 nt, Staphylococcus aureus subsp. aureus MW2
cuuguaaauuuauuuuuaa

SEQ ID NO: 2106953 - RNA, 13 nt, Staphylococcus aureus subsp. aureus MW2
cuugguauuuuuu

SEQ ID NO: 2106954 - RNA, 23 nt, Staphylococcus aureus subsp. aureus MW2
cuugguacaccuacaaauauuuc

SEQ ID NO: 2106955 - RNA, 16 nt, Staphylococcus aureus subsp. aureus MW2
cuuuggacuuuaaagu

SEQ ID NO: 2106956 - RNA, 18 nt, Staphylococcus aureus subsp. aureus MW2
cuuuggacuuuaaaguua

SEQ ID NO: 2106957 - RNA, 17 nt, Staphylococcus aureus subsp. aureus MW2
cuuuggcaccaguacuu

SEQ ID NO: 2106958 - RNA, 18 nt, Staphylococcus aureus subsp. aureus MW2
cuuuguaaccuaaaaaca

SEQ ID NO: 2106959 - RNA, 18 nt, Staphylococcus aureus subsp. aureus MW2
cuuuuaauuaauuaucau

SEQ ID NO: 2106960 - RNA, 19 nt, Staphylococcus aureus subsp. aureus MW2
cuuuuaauuguauuuucug

SEQ ID NO: 2106961 - RNA, 20 nt, Staphylococcus aureus subsp. aureus MW2
cuuugauaacaauuuuaaau

SEQ ID NO: 2106962 - RNA, 22 nt, Staphylococcus aureus subsp. aureus MW2
cuuuggaaauuuauuauaaaau

SEQ ID NO: 2106963 - RNA, 20 nt, Staphylococcus aureus subsp. aureus MW2
cuuugccguauuucaaaugu

SEQ ID NO: 2106964 - RNA, 13 nt, Staphylococcus aureus subsp. aureus MW2
cuuucgauaaacu

SEQ ID NO: 2106965 - RNA, 13 nt, Staphylococcus aureus subsp. aureus MW2
cuuucgcgacuuc

SEQ ID NO: 2106966 - RNA, 19 nt, Staphylococcus aureus subsp. aureus MW2
cuuugaagggagcauuuca

SEQ ID NO: 2106967 - RNA, 19 nt, Staphylococcus aureus subsp. aureus MW2
cuuugaacauauuauaaaa

SEQ ID NO: 2106968 - RNA, 20 nt, Staphylococcus aureus subsp. aureus MW2
cuuugaacgagagagaaaag

SEQ ID NO: 2106969 - RNA, 17 nt, Staphylococcus aureus subsp. aureus MW2
cuuugaaggguuuuuuu

SEQ ID NO: 2106970 - RNA, 21 nt, Staphylococcus aureus subsp. aureus MW2
cuuugaaagaaggaauaauuu

SEQ ID NO: 2106971 - RNA, 11 nt, Staphylococcus aureus subsp. aureus MW2
cuuucuuaauu

SEQ ID NO: 2106972 - RNA, 19 nt, Staphylococcus aureus subsp. aureus MW2
cuuucgggcuaguuuuuug

SEQ ID NO: 2106973 - RNA, 20 nt, Staphylococcus aureus subsp. aureus MW2
cuuucugcccacuuaauauc

SEQ ID NO: 2106974 - RNA, 18 nt, Staphylococcus aureus subsp. aureus MW2
aaagaagggaagaguuaa

SEQ ID NO: 2106975 - RNA, 21 nt, Staphylococcus aureus subsp. aureus MW2
aaagaagcccccuaauauauc

SEQ ID NO: 2106976 - RNA, 14 nt, Staphylococcus aureus subsp. aureus MW2
aaagacaauuucua

SEQ ID NO: 2106977 - RNA, 15 nt, Staphylococcus aureus subsp. aureus MW2
cuuuaacaucugaau

SEQ ID NO: 2106978 - RNA, 16 nt, Staphylococcus aureus subsp. aureus MW2
aaagaaugauuuauaa

SEQ ID NO: 2106979 - RNA, 18 nt, Staphylococcus aureus subsp. aureus MW2
cuuuaauuaaaguuaaag

SEQ ID NO: 2106980 - RNA, 19 nt, Staphylococcus aureus subsp. aureus MW2
cuuuaaggaacuuaauguc

SEQ ID NO: 2106981 - RNA, 13 nt, Staphylococcus aureus subsp. aureus MW2
cuuuaauuuucuu

SEQ ID NO: 2106982 - RNA, 23 nt, Staphylococcus aureus subsp. aureus MW2
cuuuaauuuaucauuauuuaauu

SEQ ID NO: 2106983 - RNA, 14 nt, Staphylococcus aureus subsp. aureus MW2
cuuuaauugcucuu

SEQ ID NO: 2106984 - RNA, 18 nt, Staphylococcus aureus subsp. aureus MW2
cuuuaacuucugguucuu

SEQ ID NO: 2106985 - RNA, 17 nt, Staphylococcus aureus subsp. aureus MW2
cuuuaacuucuuuuguu

SEQ ID NO: 2106986 - RNA, 21 nt, Staphylococcus aureus subsp. aureus MW2
cuuuaacuguacgauucaauu

SEQ ID NO: 2106987 - RNA, 15 nt, Staphylococcus aureus subsp. aureus MW2
cuuuaacucuugaaa

SEQ ID NO: 2106988 - RNA, 13 nt, Staphylococcus aureus subsp. aureus MW2
cuuuacuauauuc

SEQ ID NO: 2106989 - RNA, 18 nt, Staphylococcus aureus subsp. aureus MW2
cuuuacuauauucaauga

SEQ ID NO: 2106990 - RNA, 16 nt, Staphylococcus aureus subsp. aureus MW2
cuuuacaacaguaauc

SEQ ID NO: 2106991 - RNA, 18 nt, Staphylococcus aureus subsp. aureus MW2
cuuuacaacaguaaucau

SEQ ID NO: 2106992 - RNA, 22 nt, Staphylococcus aureus subsp. aureus MW2
cuuuauuuucuuguguauuuuu

SEQ ID NO: 2106993 - RNA, 18 nt, Staphylococcus aureus subsp. aureus MW2
cuuuauuuuaaacaugaa

SEQ ID NO: 2106994 - RNA, 20 nt, Staphylococcus aureus subsp. aureus MW2
cuuuaugugguuuugauuaa

SEQ ID NO: 2106995 - RNA, 22 nt, Staphylococcus aureus subsp. aureus MW2
cuuuaugugguuuugauuaaac

SEQ ID NO: 2106996 - RNA, 20 nt, Staphylococcus aureus subsp. aureus MW2
cuuuauuugauucuucacca

SEQ ID NO: 2106997 - RNA, 19 nt, Staphylococcus aureus subsp. aureus MW2
cuuuaugaagugaaaucau

SEQ ID NO: 2106998 - RNA, 19 nt, Staphylococcus aureus subsp. aureus MW2
cuuuaucuauuucuauaua

SEQ ID NO: 2106999 - RNA, 17 nt, Staphylococcus aureus subsp. aureus MW2
cuuuaggguucauugcu

SEQ ID NO: 2107000 - RNA, 17 nt, Staphylococcus aureus subsp. aureus MW2
cuuuaguacgcuguaau

SEQ ID NO: 2107001 - RNA, 21 nt, Staphylococcus aureus subsp. aureus MW2
cuuuaguaguguauucauuuu

SEQ ID NO: 2107002 - RNA, 19 nt, Staphylococcus aureus subsp. aureus MW2
cuuuagucgguguuuucuu

SEQ ID NO: 2107003 - RNA, 14 nt, Staphylococcus aureus subsp. aureus MW2
cuuuacuuucauua

SEQ ID NO: 2107004 - RNA, 13 nt, Staphylococcus aureus subsp. aureus MW2
cuuuacuuucauu

SEQ ID NO: 2107005 - RNA, 21 nt, Staphylococcus aureus subsp. aureus MW2
cuuuacuugcuuuuucaaaua

SEQ ID NO: 2107006 - RNA, 12 nt, Staphylococcus aureus subsp. aureus MW2
cuuuauuuucuu

SEQ ID NO: 2107007 - RNA, 18 nt, Staphylococcus aureus subsp. aureus MW2
cuuucaaauauaucuaau

SEQ ID NO: 2107008 - RNA, 23 nt, Staphylococcus aureus subsp. aureus MW2
cuuucaaauauaucuaauacuuu

SEQ ID NO: 2107009 - RNA, 19 nt, Staphylococcus aureus subsp. aureus MW2
cuuucaaaugcuuaauaaa

SEQ ID NO: 2107010 - RNA, 13 nt, Staphylococcus aureus subsp. aureus MW2
cuuucaacaaaau

SEQ ID NO: 2107011 - RNA, 14 nt, Staphylococcus aureus subsp. aureus MW2
cuuucacuacauua

SEQ ID NO: 2107012 - RNA, 16 nt, Staphylococcus aureus subsp. aureus MW2
cuuucacuacauuaaa

SEQ ID NO: 2107013 - RNA, 18 nt, Staphylococcus aureus subsp. aureus MW2
cuuucacuacauuaaaaa

SEQ ID NO: 2107014 - RNA, 18 nt, Staphylococcus aureus subsp. aureus MW2
gaaaauugaguauauuca

SEQ ID NO: 2107015 - RNA, 13 nt, Staphylococcus aureus subsp. aureus MW2
gaaaauuucucac

SEQ ID NO: 2107016 - RNA, 22 nt, Staphylococcus aureus subsp. aureus MW2
gaaaauuucucacugcuguucu

SEQ ID NO: 2107017 - RNA, 21 nt, Staphylococcus aureus subsp. aureus MW2
gaaaauuauuugauauuucau

SEQ ID NO: 2107018 - RNA, 23 nt, Staphylococcus aureus subsp. aureus MW2
gaaaauuaagaugaaauacuuga

SEQ ID NO: 2107019 - RNA, 19 nt, Staphylococcus aureus subsp. aureus MW2
gaaaauauuuuauuauaau

SEQ ID NO: 2107020 - RNA, 13 nt, Staphylococcus aureus subsp. aureus MW2
gaaaauagcuguu

SEQ ID NO: 2107021 - RNA, 21 nt, Staphylococcus aureus subsp. aureus MW2
gaaaauauauuauaaaaauag

SEQ ID NO: 2107022 - RNA, 13 nt, Staphylococcus aureus subsp. aureus MW2
gaaaauaugauaa

SEQ ID NO: 2107023 - RNA, 15 nt, Staphylococcus aureus subsp. aureus MW2
gaaaauaugauaacu

SEQ ID NO: 2107024 - RNA, 18 nt, Staphylococcus aureus subsp. aureus MW2
gaaaagugcgauuaucag

SEQ ID NO: 2107025 - RNA, 18 nt, Staphylococcus aureus subsp. aureus MW2
gaaaagugaaaacuucuc

SEQ ID NO: 2107026 - RNA, 22 nt, Staphylococcus aureus subsp. aureus MW2
gaaaaguuuuuuacuuuucauc

SEQ ID NO: 2107027 - RNA, 21 nt, Staphylococcus aureus subsp. aureus MW2
gaaaauagcuauuaaaauaga

SEQ ID NO: 2107028 - RNA, 19 nt, Staphylococcus aureus subsp. aureus MW2
gaaaauagcuauuaaaaua

SEQ ID NO: 2107029 - RNA, 18 nt, Staphylococcus aureus subsp. aureus MW2
gaaaauagcuauuaaaau

SEQ ID NO: 2107030 - RNA, 19 nt, Staphylococcus aureus subsp. aureus MW2
gaaaagucagcuuacaaua

SEQ ID NO: 2107031 - RNA, 15 nt, Staphylococcus aureus subsp. aureus MW2
gaaaaguauaugaau

SEQ ID NO: 2107032 - RNA, 21 nt, Staphylococcus aureus subsp. aureus MW2
gaaaagucagcuuacaauaau

SEQ ID NO: 2107033 - RNA, 23 nt, Staphylococcus aureus subsp. aureus MW2
gaaaagucagcuuacaauaaugu

SEQ ID NO: 2107034 - RNA, 20 nt, Staphylococcus aureus subsp. aureus MW2
gaaaaggucaaaaaauuaau

SEQ ID NO: 2107035 - RNA, 14 nt, Staphylococcus aureus subsp. aureus MW2
gaaaagcuagaagu

SEQ ID NO: 2107036 - RNA, 19 nt, Staphylococcus aureus subsp. aureus MW2
gaaaagcuagaaguucuua

SEQ ID NO: 2107037 - RNA, 18 nt, Staphylococcus aureus subsp. aureus MW2
gaaaaauuucaaaaauag

SEQ ID NO: 2107038 - RNA, 12 nt, Staphylococcus aureus subsp. aureus MW2
gaaaaauuaaaa

SEQ ID NO: 2107039 - RNA, 11 nt, Staphylococcus aureus subsp. aureus MW2
gaaaaauaauu

SEQ ID NO: 2107040 - RNA, 15 nt, Staphylococcus aureus subsp. aureus MW2
gaaaaauauuuaaau

SEQ ID NO: 2107041 - RNA, 16 nt, Staphylococcus aureus subsp. aureus MW2
gaaaaauauuuaaaua

SEQ ID NO: 2107042 - RNA, 19 nt, Staphylococcus aureus subsp. aureus MW2
gaaacaaaacaaaaaauau

SEQ ID NO: 2107043 - RNA, 22 nt, Staphylococcus aureus subsp. aureus MW2
gaaacaauucauuaauaggauu

SEQ ID NO: 2107044 - RNA, 16 nt, Staphylococcus aureus subsp. aureus MW2
gaaacacacuaaaagc

SEQ ID NO: 2107045 - RNA, 21 nt, Staphylococcus aureus subsp. aureus MW2
gaaaccgcuucucgccuaauu

SEQ ID NO: 2107046 - RNA, 17 nt, Staphylococcus aureus subsp. aureus MW2
gaaaccaaaaauaauua

SEQ ID NO: 2107047 - RNA, 12 nt, Staphylococcus aureus subsp. aureus MW2
cuuuuucacauu

SEQ ID NO: 2107048 - RNA, 15 nt, Staphylococcus aureus subsp. aureus MW2
cuuuuucacauugcc

SEQ ID NO: 2107049 - RNA, 23 nt, Staphylococcus aureus subsp. aureus MW2
cuuuuucagguguaucccaacca

SEQ ID NO: 2107050 - RNA, 21 nt, Staphylococcus aureus subsp. aureus MW2
cuuuuucauagaacaaaaugu

SEQ ID NO: 2107051 - RNA, 13 nt, Staphylococcus aureus subsp. aureus MW2
cuuuuucaucuuu

SEQ ID NO: 2107052 - RNA, 20 nt, Staphylococcus aureus subsp. aureus MW2
cuuuuugauuaaaguugauu

SEQ ID NO: 2107053 - RNA, 22 nt, Staphylococcus aureus subsp. aureus MW2
cuuuuugggagugggacagaaa

SEQ ID NO: 2107054 - RNA, 17 nt, Staphylococcus aureus subsp. aureus MW2
cuuuuuuuauaaguauu

SEQ ID NO: 2107055 - RNA, 15 nt, Staphylococcus aureus subsp. aureus MW2
cuuuuuuuaugaaaa

SEQ ID NO: 2107056 - RNA, 20 nt, Staphylococcus aureus subsp. aureus MW2
gaaaaaaucggacagcugaa

SEQ ID NO: 2107057 - RNA, 22 nt, Staphylococcus aureus subsp. aureus MW2
gaaaaaaucggacagcugaaaa

SEQ ID NO: 2107058 - RNA, 19 nt, Staphylococcus aureus subsp. aureus MW2
gaaaaaccaaguuuugcac

SEQ ID NO: 2107059 - RNA, 21 nt, Staphylococcus aureus subsp. aureus MW2
gaaaaacuucuuaacuugaaa

SEQ ID NO: 2107060 - RNA, 17 nt, Staphylococcus aureus subsp. aureus MW2
gaaaaacuguaaaucau

SEQ ID NO: 2107061 - RNA, 13 nt, Staphylococcus aureus subsp. aureus MW2
cuuuuggucuguu

SEQ ID NO: 2107062 - RNA, 21 nt, Staphylococcus aureus subsp. aureus MW2
cuuuuguaaagcuuuaguuaa

SEQ ID NO: 2107063 - RNA, 13 nt, Staphylococcus aureus subsp. aureus MW2
cuuuuguaaaaaa

SEQ ID NO: 2107064 - RNA, 23 nt, Staphylococcus aureus subsp. aureus MW2
cuuuuuaaacguacauuuuuaug

SEQ ID NO: 2107065 - RNA, 16 nt, Staphylococcus aureus subsp. aureus MW2
cuuuuuaaaaucguua

SEQ ID NO: 2107066 - RNA, 21 nt, Staphylococcus aureus subsp. aureus MW2
cuuuuuaaaaucguuaaggaa

SEQ ID NO: 2107067 - RNA, 14 nt, Staphylococcus aureus subsp. aureus MW2
cuuuuuaaaugauu

SEQ ID NO: 2107068 - RNA, 19 nt, Staphylococcus aureus subsp. aureus MW2
cuuuuuaucaacaaauuua

SEQ ID NO: 2107069 - RNA, 21 nt, Staphylococcus aureus subsp. aureus MW2
cuuuuuauuuuaauauuuucu

SEQ ID NO: 2107070 - RNA, 13 nt, Staphylococcus aureus subsp. aureus MW2
cuuuuuauuuuau

SEQ ID NO: 2107071 - RNA, 14 nt, Staphylococcus aureus subsp. aureus MW2
cuuuuuauuuugua

SEQ ID NO: 2107072 - RNA, 22 nt, Staphylococcus aureus subsp. aureus MW2
cuuuuuaucaugauuaauuaaa

SEQ ID NO: 2107073 - RNA, 15 nt, Staphylococcus aureus subsp. aureus MW2
cuuuuuauaucaaaa

SEQ ID NO: 2107074 - RNA, 13 nt, Staphylococcus aureus subsp. aureus MW2
cuuuuuauauaau

SEQ ID NO: 2107075 - RNA, 23 nt, Staphylococcus aureus subsp. aureus MW2
cuuuuuagccccagcaaauacuu

SEQ ID NO: 2107076 - RNA, 12 nt, Staphylococcus aureus subsp. aureus MW2
cuuuuuaggaug

SEQ ID NO: 2107077 - RNA, 18 nt, Staphylococcus aureus subsp. aureus MW2
cuuuugcaauuuuugaaa

SEQ ID NO: 2107078 - RNA, 13 nt, Staphylococcus aureus subsp. aureus MW2
cuuuugcaccuuc

SEQ ID NO: 2107079 - RNA, 14 nt, Staphylococcus aureus subsp. aureus MW2
cuuuugcaccuuca

SEQ ID NO: 2107080 - RNA, 12 nt, Staphylococcus aureus subsp. aureus MW2
cuuuuauagaaa

SEQ ID NO: 2107081 - RNA, 15 nt, Staphylococcus aureus subsp. aureus MW2
cuuuuauauuuuuau

SEQ ID NO: 2107082 - RNA, 15 nt, Staphylococcus aureus subsp. aureus MW2
cuuuuacaaacuuca

SEQ ID NO: 2107083 - RNA, 18 nt, Staphylococcus aureus subsp. aureus MW2
cuuuuacaaacuucacau

SEQ ID NO: 2107084 - RNA, 15 nt, Staphylococcus aureus subsp. aureus MW2
cuuuuaguaaauaau

SEQ ID NO: 2107085 - RNA, 11 nt, Staphylococcus aureus subsp. aureus MW2
gaaaucuauug

SEQ ID NO: 2107086 - RNA, 21 nt, Staphylococcus aureus subsp. aureus MW2
gaaauguaugacauaaaccau

SEQ ID NO: 2107087 - RNA, 15 nt, Staphylococcus aureus subsp. aureus MW2
gaaauguagacaaua

SEQ ID NO: 2107088 - RNA, 21 nt, Staphylococcus aureus subsp. aureus MW2
gaaauuguguugaaucaacag

SEQ ID NO: 2107089 - RNA, 14 nt, Staphylococcus aureus subsp. aureus MW2
gaaauuagauuuua

SEQ ID NO: 2107090 - RNA, 20 nt, Staphylococcus aureus subsp. aureus MW2
gaaauuauacgagaauauga

SEQ ID NO: 2107091 - RNA, 13 nt, Staphylococcus aureus subsp. aureus MW2
gaaauuuauuaua

SEQ ID NO: 2107092 - RNA, 20 nt, Staphylococcus aureus subsp. aureus MW2
gaaauuugauuuucaauuuc

SEQ ID NO: 2107093 - RNA, 13 nt, Staphylococcus aureus subsp. aureus MW2
gaaauuaaauuca

SEQ ID NO: 2107094 - RNA, 14 nt, Staphylococcus aureus subsp. aureus MW2
gaaauguuuauaau

SEQ ID NO: 2107095 - RNA, 21 nt, Staphylococcus aureus subsp. aureus MW2
gaaauguuuaucaauucccug

SEQ ID NO: 2107096 - RNA, 17 nt, Staphylococcus aureus subsp. aureus MW2
gaaauuagaaccaucau

SEQ ID NO: 2107097 - RNA, 13 nt, Staphylococcus aureus subsp. aureus MW2
aaagagcguguua

SEQ ID NO: 2107098 - RNA, 16 nt, Staphylococcus aureus subsp. aureus MW2
gaacaacaaauuuuga

SEQ ID NO: 2107099 - RNA, 14 nt, Staphylococcus aureus subsp. aureus MW2
gaaagagaaaagcu

SEQ ID NO: 2107100 - RNA, 17 nt, Staphylococcus aureus subsp. aureus MW2
gaaagccauuaaaccaa

SEQ ID NO: 2107101 - RNA, 13 nt, Staphylococcus aureus subsp. aureus MW2
gaaacuuguccgu

SEQ ID NO: 2107102 - RNA, 16 nt, Staphylococcus aureus subsp. aureus MW2
gaaaucagcuuuucuu

SEQ ID NO: 2107103 - RNA, 18 nt, Staphylococcus aureus subsp. aureus MW2
gaaaucagcuuuucuuca

SEQ ID NO: 2107104 - RNA, 15 nt, Staphylococcus aureus subsp. aureus MW2
gaaauaugaaaagag

SEQ ID NO: 2107105 - RNA, 16 nt, Staphylococcus aureus subsp. aureus MW2
gaaauaugaaaagaga

SEQ ID NO: 2107106 - RNA, 16 nt, Staphylococcus aureus subsp. aureus MW2
gaaauauagugauuga

SEQ ID NO: 2107107 - RNA, 15 nt, Staphylococcus aureus subsp. aureus MW2
gaaaguguaugcaug

SEQ ID NO: 2107108 - RNA, 22 nt, Staphylococcus aureus subsp. aureus MW2
gaaaguugguuuuauuaauucu

SEQ ID NO: 2107109 - RNA, 22 nt, Staphylococcus aureus subsp. aureus MW2
gaaaggcuagcuaaaauuugcu

SEQ ID NO: 2107110 - RNA, 15 nt, Staphylococcus aureus subsp. aureus MW2
gaaagucagcuuaca

SEQ ID NO: 2107111 - RNA, 20 nt, Staphylococcus aureus subsp. aureus MW2
gaaagucagguuacaauaau

SEQ ID NO: 2107112 - RNA, 22 nt, Staphylococcus aureus subsp. aureus MW2
gaaagucagguuacaauaaugu

SEQ ID NO: 2107113 - RNA, 20 nt, Staphylococcus aureus subsp. aureus MW2
gaaagggguuugacaaagcu

SEQ ID NO: 2107114 - RNA, 14 nt, Staphylococcus aureus subsp. aureus MW2
gaagagaugaaaga

SEQ ID NO: 2107115 - RNA, 15 nt, Staphylococcus aureus subsp. aureus MW2
gaagagaugaaagau

SEQ ID NO: 2107116 - RNA, 13 nt, Staphylococcus aureus subsp. aureus MW2
gaagaccauuuua

SEQ ID NO: 2107117 - RNA, 23 nt, Staphylococcus aureus subsp. aureus MW2
gaagaccuucuaaaaucguucca

SEQ ID NO: 2107118 - RNA, 15 nt, Staphylococcus aureus subsp. aureus MW2
gaagagcuuuuagua

SEQ ID NO: 2107119 - RNA, 14 nt, Staphylococcus aureus subsp. aureus MW2
gaagaauacaaaua

SEQ ID NO: 2107120 - RNA, 21 nt, Staphylococcus aureus subsp. aureus MW2
gaagaauauaaacuauuaaau

SEQ ID NO: 2107121 - RNA, 23 nt, Staphylococcus aureus subsp. aureus MW2
gaacauguacuuguaacaaguuc

SEQ ID NO: 2107122 - RNA, 18 nt, Staphylococcus aureus subsp. aureus MW2
gaacaugguaucuuuaau

SEQ ID NO: 2107123 - RNA, 24 nt, Staphylococcus aureus subsp. aureus MW2
gaacaucucuucuggagccucuug

SEQ ID NO: 2107124 - RNA, 15 nt, Staphylococcus aureus subsp. aureus MW2
gaacaucugaaaaaa

SEQ ID NO: 2107125 - RNA, 16 nt, Staphylococcus aureus subsp. aureus MW2
gaacaucugaaaaaau

SEQ ID NO: 2107126 - RNA, 17 nt, Staphylococcus aureus subsp. aureus MW2
gaacaugaaauuaauca

SEQ ID NO: 2107127 - RNA, 16 nt, Staphylococcus aureus subsp. aureus MW2
gaacaugaaugauauu

SEQ ID NO: 2107128 - RNA, 22 nt, Staphylococcus aureus subsp. aureus MW2
gaagauuuuguugaaacuguau

SEQ ID NO: 2107129 - RNA, 16 nt, Staphylococcus aureus subsp. aureus MW2
gaagcccuuugauuua

SEQ ID NO: 2107130 - RNA, 16 nt, Staphylococcus aureus subsp. aureus MW2
gaagcuaaguauauaa

SEQ ID NO: 2107131 - RNA, 20 nt, Staphylococcus aureus subsp. aureus MW2
gaagcuggcggaaagucagc

SEQ ID NO: 2107132 - RNA, 15 nt, Staphylococcus aureus subsp. aureus MW2
gaaggucuacuaaau

SEQ ID NO: 2107133 - RNA, 16 nt, Staphylococcus aureus subsp. aureus MW2
gaaguauuuuccuuca

SEQ ID NO: 2107134 - RNA, 14 nt, Staphylococcus aureus subsp. aureus MW2
gaagugcuuaugaa

SEQ ID NO: 2107135 - RNA, 15 nt, Staphylococcus aureus subsp. aureus MW2
gaauacaaauauuaa

SEQ ID NO: 2107136 - RNA, 14 nt, Staphylococcus aureus subsp. aureus MW2
gaauaauugagaaa

SEQ ID NO: 2107137 - RNA, 23 nt, Staphylococcus aureus subsp. aureus MW2
gaauaauuagauuuaaaauguca

SEQ ID NO: 2107138 - RNA, 17 nt, Staphylococcus aureus subsp. aureus MW2
gaauaauuuuaaaaaua

SEQ ID NO: 2107139 - RNA, 14 nt, Staphylococcus aureus subsp. aureus MW2
gaauacuaaaagug

SEQ ID NO: 2107140 - RNA, 15 nt, Staphylococcus aureus subsp. aureus MW2
gaauacuaaaagugu

SEQ ID NO: 2107141 - RNA, 21 nt, Staphylococcus aureus subsp. aureus MW2
gaauaaauuuugcgaaaauau

SEQ ID NO: 2107142 - RNA, 18 nt, Staphylococcus aureus subsp. aureus MW2
gaauaauguuuucauugg

SEQ ID NO: 2107143 - RNA, 23 nt, Staphylococcus aureus subsp. aureus MW2
gaaguugaagccaguugaaguug

SEQ ID NO: 2107144 - RNA, 22 nt, Staphylococcus aureus subsp. aureus MW2
gaaguugcucgcgcucuucuuc

SEQ ID NO: 2107145 - RNA, 12 nt, Staphylococcus aureus subsp. aureus MW2
gaaugaugcugc

SEQ ID NO: 2107146 - RNA, 14 nt, Staphylococcus aureus subsp. aureus MW2
gaaugauuuauaaa

SEQ ID NO: 2107147 - RNA, 21 nt, Staphylococcus aureus subsp. aureus MW2
gaaugcaaaucaaauacauca

SEQ ID NO: 2107148 - RNA, 14 nt, Staphylococcus aureus subsp. aureus MW2
gaaugauagauuua

SEQ ID NO: 2107149 - RNA, 21 nt, Staphylococcus aureus subsp. aureus MW2
gaaucagaugauuuaauucug

SEQ ID NO: 2107150 - RNA, 13 nt, Staphylococcus aureus subsp. aureus MW2
gaaucgucauauu

SEQ ID NO: 2107151 - RNA, 18 nt, Staphylococcus aureus subsp. aureus MW2
gaauaucuuaaagaauua

SEQ ID NO: 2107152 - RNA, 21 nt, Staphylococcus aureus subsp. aureus MW2
gaauauuguauugaucuacau

SEQ ID NO: 2107153 - RNA, 22 nt, Staphylococcus aureus subsp. aureus MW2
gaauauaaguaaucauaauaau

SEQ ID NO: 2107154 - RNA, 20 nt, Staphylococcus aureus subsp. aureus MW2
gaauauacuaaaguucaaca

SEQ ID NO: 2107155 - RNA, 16 nt, Staphylococcus aureus subsp. aureus MW2
gaauacuuuuuaacug

SEQ ID NO: 2107156 - RNA, 13 nt, Staphylococcus aureus subsp. aureus MW2
gaauacuuuuuaa

SEQ ID NO: 2107157 - RNA, 14 nt, Staphylococcus aureus subsp. aureus MW2
aaagaugaaaaucu

SEQ ID NO: 2107158 - RNA, 17 nt, Staphylococcus aureus subsp. aureus MW2
aaagaugauauauucau

SEQ ID NO: 2107159 - RNA, 14 nt, Staphylococcus aureus subsp. aureus MW2
gacaaauuaaaaaa

SEQ ID NO: 2107160 - RNA, 18 nt, Staphylococcus aureus subsp. aureus MW2
gacaaauguucuauagaa

SEQ ID NO: 2107161 - RNA, 13 nt, Staphylococcus aureus subsp. aureus MW2
gacaaauuaaaaa

SEQ ID NO: 2107162 - RNA, 14 nt, Staphylococcus aureus subsp. aureus MW2
gacaaauucuauga

SEQ ID NO: 2107163 - RNA, 15 nt, Staphylococcus aureus subsp. aureus MW2
gacaacugauuuaau

SEQ ID NO: 2107164 - RNA, 17 nt, Staphylococcus aureus subsp. aureus MW2
gacaagagacugaagag

SEQ ID NO: 2107165 - RNA, 15 nt, Staphylococcus aureus subsp. aureus MW2
gacaaucuaaaugua

SEQ ID NO: 2107166 - RNA, 16 nt, Staphylococcus aureus subsp. aureus MW2
gacaaucuaaauguaa

SEQ ID NO: 2107167 - RNA, 13 nt, Staphylococcus aureus subsp. aureus MW2
gaaugguauaauu

SEQ ID NO: 2107168 - RNA, 16 nt, Staphylococcus aureus subsp. aureus MW2
gaauucaaccaauuau

SEQ ID NO: 2107169 - RNA, 13 nt, Staphylococcus aureus subsp. aureus MW2
gaauucucgauuu

SEQ ID NO: 2107170 - RNA, 13 nt, Staphylococcus aureus subsp. aureus MW2
gaauugaaaaauu

SEQ ID NO: 2107171 - RNA, 15 nt, Staphylococcus aureus subsp. aureus MW2
gaauuucgaaaagaa

SEQ ID NO: 2107172 - RNA, 19 nt, Staphylococcus aureus subsp. aureus MW2
gaauuucguuauuaaacua

SEQ ID NO: 2107173 - RNA, 23 nt, Staphylococcus aureus subsp. aureus MW2
gaauuucguuauuaaacuacgaa

SEQ ID NO: 2107174 - RNA, 16 nt, Staphylococcus aureus subsp. aureus MW2
gaauuugcacaaagau

SEQ ID NO: 2107175 - RNA, 13 nt, Staphylococcus aureus subsp. aureus MW2
gaauuuuaauaua

SEQ ID NO: 2107176 - RNA, 17 nt, Staphylococcus aureus subsp. aureus MW2
gaccauuuuauauuuua

SEQ ID NO: 2107177 - RNA, 21 nt, Staphylococcus aureus subsp. aureus MW2
gacccacucccuauaauguuu

SEQ ID NO: 2107178 - RNA, 18 nt, Staphylococcus aureus subsp. aureus MW2
gaccacucaauucucuaa

SEQ ID NO: 2107179 - RNA, 11 nt, Staphylococcus aureus subsp. aureus MW2
gaccaacagcu

SEQ ID NO: 2107180 - RNA, 23 nt, Staphylococcus aureus subsp. aureus MW2
gacauugaaaggaacauuucaau

SEQ ID NO: 2107181 - RNA, 13 nt, Staphylococcus aureus subsp. aureus MW2
gacagaaaugaua

SEQ ID NO: 2107182 - RNA, 17 nt, Staphylococcus aureus subsp. aureus MW2
gacacguguaaaaauga

SEQ ID NO: 2107183 - RNA, 13 nt, Staphylococcus aureus subsp. aureus MW2
gacauaaauaugg

SEQ ID NO: 2107184 - RNA, 18 nt, Staphylococcus aureus subsp. aureus MW2
gacauaaaucaauauucu

SEQ ID NO: 2107185 - RNA, 19 nt, Staphylococcus aureus subsp. aureus MW2
gacauaaaaaaagagaccu

SEQ ID NO: 2107186 - RNA, 16 nt, Staphylococcus aureus subsp. aureus MW2
gacauaaaacuuacau

SEQ ID NO: 2107187 - RNA, 18 nt, Staphylococcus aureus subsp. aureus MW2
gacaguuuccauaaauaa

SEQ ID NO: 2107188 - RNA, 20 nt, Staphylococcus aureus subsp. aureus MW2
gacauucauuuaguuaaaua

SEQ ID NO: 2107189 - RNA, 23 nt, Staphylococcus aureus subsp. aureus MW2
gacauuaaugauagcaaugaauu

SEQ ID NO: 2107190 - RNA, 22 nt, Staphylococcus aureus subsp. aureus MW2
gacaucgucuucuuuuuguccc

SEQ ID NO: 2107191 - RNA, 22 nt, Staphylococcus aureus subsp. aureus MW2
gacauacuugucguauucuuca

SEQ ID NO: 2107192 - RNA, 16 nt, Staphylococcus aureus subsp. aureus MW2
gacauaugcagugacu

SEQ ID NO: 2107193 - RNA, 20 nt, Staphylococcus aureus subsp. aureus MW2
gaccuucaauaucuucagcu

SEQ ID NO: 2107194 - RNA, 23 nt, Staphylococcus aureus subsp. aureus MW2
gaccuuaucugaccaguauacga

SEQ ID NO: 2107195 - RNA, 18 nt, Staphylococcus aureus subsp. aureus MW2
gaccucguuacauuuaug

SEQ ID NO: 2107196 - RNA, 15 nt, Staphylococcus aureus subsp. aureus MW2
gacugaacgaaaaug

SEQ ID NO: 2107197 - RNA, 15 nt, Staphylococcus aureus subsp. aureus MW2
gacugacuaauaaaa

SEQ ID NO: 2107198 - RNA, 19 nt, Staphylococcus aureus subsp. aureus MW2
gacugguacauuaguuuga

SEQ ID NO: 2107199 - RNA, 17 nt, Staphylococcus aureus subsp. aureus MW2
gacguuuugguuguucu

SEQ ID NO: 2107200 - RNA, 16 nt, Staphylococcus aureus subsp. aureus MW2
gacguuuuuuuauaaa

SEQ ID NO: 2107201 - RNA, 11 nt, Staphylococcus aureus subsp. aureus MW2
gacugaaagaa

SEQ ID NO: 2107202 - RNA, 16 nt, Staphylococcus aureus subsp. aureus MW2
gacucuacuagaauaa

SEQ ID NO: 2107203 - RNA, 15 nt, Staphylococcus aureus subsp. aureus MW2
gacucuaaaauguuc

SEQ ID NO: 2107204 - RNA, 18 nt, Staphylococcus aureus subsp. aureus MW2
gacuuuuaaaaaacauac

SEQ ID NO: 2107205 - RNA, 18 nt, Staphylococcus aureus subsp. aureus MW2
gacuuuaaaucuuguucu

SEQ ID NO: 2107206 - RNA, 20 nt, Staphylococcus aureus subsp. aureus MW2
gacuuauucaacguauaagu

SEQ ID NO: 2107207 - RNA, 23 nt, Staphylococcus aureus subsp. aureus MW2
gacuuuuacagaacguucauaua

SEQ ID NO: 2107208 - RNA, 17 nt, Staphylococcus aureus subsp. aureus MW2
gagaaccauauuuacac

SEQ ID NO: 2107209 - RNA, 17 nt, Staphylococcus aureus subsp. aureus MW2
gagacauuuuaucugaa

SEQ ID NO: 2107210 - RNA, 12 nt, Staphylococcus aureus subsp. aureus MW2
gagaauuucaaa

SEQ ID NO: 2107211 - RNA, 17 nt, Staphylococcus aureus subsp. aureus MW2
gagaauuucaaaaagga

SEQ ID NO: 2107212 - RNA, 15 nt, Staphylococcus aureus subsp. aureus MW2
gagacaaaaaaugaa

SEQ ID NO: 2107213 - RNA, 15 nt, Staphylococcus aureus subsp. aureus MW2
gagacaauaaugcac

SEQ ID NO: 2107214 - RNA, 14 nt, Staphylococcus aureus subsp. aureus MW2
gagaagcugucuua

SEQ ID NO: 2107215 - RNA, 14 nt, Staphylococcus aureus subsp. aureus MW2
gagaaucuccauuu

SEQ ID NO: 2107216 - RNA, 12 nt, Staphylococcus aureus subsp. aureus MW2
gagaaucuccau

SEQ ID NO: 2107217 - RNA, 16 nt, Staphylococcus aureus subsp. aureus MW2
gagaaugcgcuuguaa

SEQ ID NO: 2107218 - RNA, 17 nt, Staphylococcus aureus subsp. aureus MW2
gagaaugcgcuuguaac

SEQ ID NO: 2107219 - RNA, 17 nt, Staphylococcus aureus subsp. aureus MW2
gagagauguauaaaacu

SEQ ID NO: 2107220 - RNA, 16 nt, Staphylococcus aureus subsp. aureus MW2
gagagauuauuuaaaa

SEQ ID NO: 2107221 - RNA, 14 nt, Staphylococcus aureus subsp. aureus MW2
gagagagaaaagcu

SEQ ID NO: 2107222 - RNA, 16 nt, Staphylococcus aureus subsp. aureus MW2
gagaugaaagauacug

SEQ ID NO: 2107223 - RNA, 19 nt, Staphylococcus aureus subsp. aureus MW2
gagaugaaagauacugcuu

SEQ ID NO: 2107224 - RNA, 24 nt, Staphylococcus aureus subsp. aureus MW2
gagauccaccguuaaaauauauga

SEQ ID NO: 2107225 - RNA, 16 nt, Staphylococcus aureus subsp. aureus MW2
gagauauugucuucuc

SEQ ID NO: 2107226 - RNA, 16 nt, Staphylococcus aureus subsp. aureus MW2
gagauauauuaauauu

SEQ ID NO: 2107227 - RNA, 15 nt, Staphylococcus aureus subsp. aureus MW2
gagcaauucuucaau

SEQ ID NO: 2107228 - RNA, 20 nt, Staphylococcus aureus subsp. aureus MW2
gagaugaggcgauaaaagaa

SEQ ID NO: 2107229 - RNA, 21 nt, Staphylococcus aureus subsp. aureus MW2
gagcccgagacauaaauuaau

SEQ ID NO: 2107230 - RNA, 18 nt, Staphylococcus aureus subsp. aureus MW2
gagccauuauuauuuuuu

SEQ ID NO: 2107231 - RNA, 17 nt, Staphylococcus aureus subsp. aureus MW2
aaagcaggcaagcuauc

SEQ ID NO: 2107232 - RNA, 12 nt, Staphylococcus aureus subsp. aureus MW2
aaagcaucuuua

SEQ ID NO: 2107233 - RNA, 21 nt, Staphylococcus aureus subsp. aureus MW2
gauacacguaacgcaguugaa

SEQ ID NO: 2107234 - RNA, 18 nt, Staphylococcus aureus subsp. aureus MW2
gauacaccaauauuuuuc

SEQ ID NO: 2107235 - RNA, 17 nt, Staphylococcus aureus subsp. aureus MW2
aaagcaguuaaugaauc

SEQ ID NO: 2107236 - RNA, 21 nt, Staphylococcus aureus subsp. aureus MW2
aaagcaucuucaauauuuaaa

SEQ ID NO: 2107237 - RNA, 13 nt, Staphylococcus aureus subsp. aureus MW2
gauaauuucuucu

SEQ ID NO: 2107238 - RNA, 13 nt, Staphylococcus aureus subsp. aureus MW2
gauacagaaccaa

SEQ ID NO: 2107239 - RNA, 14 nt, Staphylococcus aureus subsp. aureus MW2
gauacauaaaacau

SEQ ID NO: 2107240 - RNA, 16 nt, Staphylococcus aureus subsp. aureus MW2
gauaccaaacugccua

SEQ ID NO: 2107241 - RNA, 16 nt, Staphylococcus aureus subsp. aureus MW2
gauaccaaaacucaaa

SEQ ID NO: 2107242 - RNA, 19 nt, Staphylococcus aureus subsp. aureus MW2
gauaccaaauauauuuuua

SEQ ID NO: 2107243 - RNA, 18 nt, Staphylococcus aureus subsp. aureus MW2
gauaauaaggaagcguau

SEQ ID NO: 2107244 - RNA, 18 nt, Staphylococcus aureus subsp. aureus MW2
gauaauacuguuuaaaua

SEQ ID NO: 2107245 - RNA, 17 nt, Staphylococcus aureus subsp. aureus MW2
gauaauacuguuuaaau

SEQ ID NO: 2107246 - RNA, 20 nt, Staphylococcus aureus subsp. aureus MW2
gauaauacuguuuaaauaaa

SEQ ID NO: 2107247 - RNA, 21 nt, Staphylococcus aureus subsp. aureus MW2
gauaaugcaccugugauaacu

SEQ ID NO: 2107248 - RNA, 21 nt, Staphylococcus aureus subsp. aureus MW2
gauaaugauaguguaugaaug

SEQ ID NO: 2107249 - RNA, 22 nt, Staphylococcus aureus subsp. aureus MW2
gauaauguacauguauaaaaga

SEQ ID NO: 2107250 - RNA, 22 nt, Staphylococcus aureus subsp. aureus MW2
gauaaucucauucuuuaauaua

SEQ ID NO: 2107251 - RNA, 16 nt, Staphylococcus aureus subsp. aureus MW2
gauaaucguuaaaaca

SEQ ID NO: 2107252 - RNA, 21 nt, Staphylococcus aureus subsp. aureus MW2
gauaauccuuuuuuaggcagg

SEQ ID NO: 2107253 - RNA, 18 nt, Staphylococcus aureus subsp. aureus MW2
gauaauccaccaaauaca

SEQ ID NO: 2107254 - RNA, 17 nt, Staphylococcus aureus subsp. aureus MW2
gauacuaauaucuucuu

SEQ ID NO: 2107255 - RNA, 20 nt, Staphylococcus aureus subsp. aureus MW2
gauaccuaagcugauuaaaa

SEQ ID NO: 2107256 - RNA, 14 nt, Staphylococcus aureus subsp. aureus MW2
gauagccaauauaa

SEQ ID NO: 2107257 - RNA, 23 nt, Staphylococcus aureus subsp. aureus MW2
gauauaaauaggucacuuuuaau

SEQ ID NO: 2107258 - RNA, 14 nt, Staphylococcus aureus subsp. aureus MW2
gauauaaacauuua

SEQ ID NO: 2107259 - RNA, 17 nt, Staphylococcus aureus subsp. aureus MW2
gauaguuugagaaaauu

SEQ ID NO: 2107260 - RNA, 19 nt, Staphylococcus aureus subsp. aureus MW2
gauagcggauuuauuuuuu

SEQ ID NO: 2107261 - RNA, 14 nt, Staphylococcus aureus subsp. aureus MW2
gauagcuaaacauu

SEQ ID NO: 2107262 - RNA, 16 nt, Staphylococcus aureus subsp. aureus MW2
gauauuguuaaguaga

SEQ ID NO: 2107263 - RNA, 13 nt, Staphylococcus aureus subsp. aureus MW2
gauauuuaguaca

SEQ ID NO: 2107264 - RNA, 18 nt, Staphylococcus aureus subsp. aureus MW2
gauauuucuaaauugucg

SEQ ID NO: 2107265 - RNA, 15 nt, Staphylococcus aureus subsp. aureus MW2
gauauugaaaacacg

SEQ ID NO: 2107266 - RNA, 20 nt, Staphylococcus aureus subsp. aureus MW2
gauauugacccccuguaucu

SEQ ID NO: 2107267 - RNA, 19 nt, Staphylococcus aureus subsp. aureus MW2
gauauucuaaaaaauuaaa

SEQ ID NO: 2107268 - RNA, 20 nt, Staphylococcus aureus subsp. aureus MW2
gauauucauguucuuguaau

SEQ ID NO: 2107269 - RNA, 21 nt, Staphylococcus aureus subsp. aureus MW2
gauaucuaagucgauaaguuu

SEQ ID NO: 2107270 - RNA, 19 nt, Staphylococcus aureus subsp. aureus MW2
gauaucagcuaaguuaaau

SEQ ID NO: 2107271 - RNA, 22 nt, Staphylococcus aureus subsp. aureus MW2
gaguagcccuauuuuuaaugua

SEQ ID NO: 2107272 - RNA, 21 nt, Staphylococcus aureus subsp. aureus MW2
gaguaguucggaugagaaaug

SEQ ID NO: 2107273 - RNA, 20 nt, Staphylococcus aureus subsp. aureus MW2
gaguucuuuuugaugaucau

SEQ ID NO: 2107274 - RNA, 13 nt, Staphylococcus aureus subsp. aureus MW2
gaguucuugauug

SEQ ID NO: 2107275 - RNA, 19 nt, Staphylococcus aureus subsp. aureus MW2
gaguuggcaucagacuaaa

SEQ ID NO: 2107276 - RNA, 17 nt, Staphylococcus aureus subsp. aureus MW2
gaguucaucuuguacag

SEQ ID NO: 2107277 - RNA, 12 nt, Staphylococcus aureus subsp. aureus MW2
gaguuauaucuu

SEQ ID NO: 2107278 - RNA, 21 nt, Staphylococcus aureus subsp. aureus MW2
gauaacaagaaguaauguuaa

SEQ ID NO: 2107279 - RNA, 21 nt, Staphylococcus aureus subsp. aureus MW2
gauaacaaccuauuaauugaa

SEQ ID NO: 2107280 - RNA, 16 nt, Staphylococcus aureus subsp. aureus MW2
gauaaauuaauaugaa

SEQ ID NO: 2107281 - RNA, 21 nt, Staphylococcus aureus subsp. aureus MW2
gauaaaaaauaaagucauaug

SEQ ID NO: 2107282 - RNA, 16 nt, Staphylococcus aureus subsp. aureus MW2
gagggccccaacacag

SEQ ID NO: 2107283 - RNA, 16 nt, Staphylococcus aureus subsp. aureus MW2
gaggucuccaauacuu

SEQ ID NO: 2107284 - RNA, 22 nt, Staphylococcus aureus subsp. aureus MW2
gaggcaggaaugauauaccuug

SEQ ID NO: 2107285 - RNA, 19 nt, Staphylococcus aureus subsp. aureus MW2
gagggaagugaaguuguau

SEQ ID NO: 2107286 - RNA, 13 nt, Staphylococcus aureus subsp. aureus MW2
gaggaauuaauaa

SEQ ID NO: 2107287 - RNA, 15 nt, Staphylococcus aureus subsp. aureus MW2
gagcugcuucaacua

SEQ ID NO: 2107288 - RNA, 20 nt, Staphylococcus aureus subsp. aureus MW2
gagcuugggacagaaaacaa

SEQ ID NO: 2107289 - RNA, 13 nt, Staphylococcus aureus subsp. aureus MW2
aaaguugauuuug

SEQ ID NO: 2107290 - RNA, 18 nt, Staphylococcus aureus subsp. aureus MW2
aaaguugacaauacaaau

SEQ ID NO: 2107291 - RNA, 14 nt, Staphylococcus aureus subsp. aureus MW2
aaaguuuauacuua

SEQ ID NO: 2107292 - RNA, 14 nt, Staphylococcus aureus subsp. aureus MW2
aaagugauuuaaaa

SEQ ID NO: 2107293 - RNA, 22 nt, Staphylococcus aureus subsp. aureus MW2
aaagugauuuauuucauauuua

SEQ ID NO: 2107294 - RNA, 18 nt, Staphylococcus aureus subsp. aureus MW2
aaagugcgguuauuuaua

SEQ ID NO: 2107295 - RNA, 18 nt, Staphylococcus aureus subsp. aureus MW2
aaaguggccuuuuaaaca

SEQ ID NO: 2107296 - RNA, 19 nt, Staphylococcus aureus subsp. aureus MW2
aaaguggccuuuuaaacaa

SEQ ID NO: 2107297 - RNA, 15 nt, Staphylococcus aureus subsp. aureus MW2
aaagugguuuuacug

SEQ ID NO: 2107298 - RNA, 23 nt, Staphylococcus aureus subsp. aureus MW2
aaaguggucguuuauuuuaaauu

SEQ ID NO: 2107299 - RNA, 21 nt, Staphylococcus aureus subsp. aureus MW2
aaaguuagacuaaaaaacuaa

SEQ ID NO: 2107300 - RNA, 19 nt, Staphylococcus aureus subsp. aureus MW2
aaaguuagacuaaaaaacu

SEQ ID NO: 2107301 - RNA, 20 nt, Staphylococcus aureus subsp. aureus MW2
aaaguuagacuaaaaaacua

SEQ ID NO: 2107302 - RNA, 21 nt, Staphylococcus aureus subsp. aureus MW2
aaagugucuaacgcuguuuca

SEQ ID NO: 2107303 - RNA, 14 nt, Staphylococcus aureus subsp. aureus MW2
aaaguuaaagacua

SEQ ID NO: 2107304 - RNA, 22 nt, Staphylococcus aureus subsp. aureus MW2
aaaguuuucauuuaacauguau

SEQ ID NO: 2107305 - RNA, 15 nt, Staphylococcus aureus subsp. aureus MW2
aaaguuuuauuuaaa

SEQ ID NO: 2107306 - RNA, 17 nt, Staphylococcus aureus subsp. aureus MW2
aaaguuuucauuuaaca

SEQ ID NO: 2107307 - RNA, 11 nt, Staphylococcus aureus subsp. aureus MW2
aaaguuucucc

SEQ ID NO: 2107308 - RNA, 20 nt, Staphylococcus aureus subsp. aureus MW2
ggccgugguaugauuuuuga

SEQ ID NO: 2107309 - RNA, 22 nt, Staphylococcus aureus subsp. aureus MW2
aaauaaaauuuuuuucauaauu

SEQ ID NO: 2107310 - RNA, 12 nt, Staphylococcus aureus subsp. aureus MW2
aaauaaaauuuu

SEQ ID NO: 2107311 - RNA, 12 nt, Staphylococcus aureus subsp. aureus MW2
aaauaaacauau

SEQ ID NO: 2107312 - RNA, 19 nt, Staphylococcus aureus subsp. aureus MW2
aaauaaacauaucaucaua

SEQ ID NO: 2107313 - RNA, 12 nt, Staphylococcus aureus subsp. aureus MW2
aaauaaaaugcu

SEQ ID NO: 2107314 - RNA, 13 nt, Staphylococcus aureus subsp. aureus MW2
aaauaaaaauuau

SEQ ID NO: 2107315 - RNA, 13 nt, Staphylococcus aureus subsp. aureus MW2
aaauaaaaauaca

SEQ ID NO: 2107316 - RNA, 13 nt, Staphylococcus aureus subsp. aureus MW2
aaauaaaaaauaa

SEQ ID NO: 2107317 - RNA, 13 nt, Staphylococcus aureus subsp. aureus MW2
aaauaaaaaaugc

SEQ ID NO: 2107318 - RNA, 22 nt, Staphylococcus aureus subsp. aureus MW2
aaauaaaugacuucacauuuau

SEQ ID NO: 2107319 - RNA, 15 nt, Staphylococcus aureus subsp. aureus MW2
aaauacuaacaauua

SEQ ID NO: 2107320 - RNA, 17 nt, Staphylococcus aureus subsp. aureus MW2
aaauacuaguaauaaua

SEQ ID NO: 2107321 - RNA, 14 nt, Staphylococcus aureus subsp. aureus MW2
aaauacuauacuga

SEQ ID NO: 2107322 - RNA, 15 nt, Staphylococcus aureus subsp. aureus MW2
aaauacuauacugau

SEQ ID NO: 2107323 - RNA, 13 nt, Staphylococcus aureus subsp. aureus MW2
ggcgaggccccaa

SEQ ID NO: 2107324 - RNA, 23 nt, Staphylococcus aureus subsp. aureus MW2
ggcgcuccuacuuuucaacuuua

SEQ ID NO: 2107325 - RNA, 21 nt, Staphylococcus aureus subsp. aureus MW2
aaauacuaucugacauuuaaa

SEQ ID NO: 2107326 - RNA, 18 nt, Staphylococcus aureus subsp. aureus MW2
aaauacuguuuucauuug

SEQ ID NO: 2107327 - RNA, 20 nt, Staphylococcus aureus subsp. aureus MW2
aaauacuguuuucauuuguu

SEQ ID NO: 2107328 - RNA, 22 nt, Staphylococcus aureus subsp. aureus MW2
aaauacuguuuucauuuguuaa

SEQ ID NO: 2107329 - RNA, 16 nt, Staphylococcus aureus subsp. aureus MW2
aaauacucauuauugu

SEQ ID NO: 2107330 - RNA, 19 nt, Staphylococcus aureus subsp. aureus MW2
aaauacucccuucaacaua

SEQ ID NO: 2107331 - RNA, 18 nt, Staphylococcus aureus subsp. aureus MW2
aaauacuauauauaauga

SEQ ID NO: 2107332 - RNA, 12 nt, Staphylococcus aureus subsp. aureus MW2
ggcguaaugaua

SEQ ID NO: 2107333 - RNA, 14 nt, Staphylococcus aureus subsp. aureus MW2
ggcggaaagucagc

SEQ ID NO: 2107334 - RNA, 16 nt, Staphylococcus aureus subsp. aureus MW2
ggcuagcuaaaauuug

SEQ ID NO: 2107335 - RNA, 22 nt, Staphylococcus aureus subsp. aureus MW2
aaaguaucuaugaaauuuuuua

SEQ ID NO: 2107336 - RNA, 17 nt, Staphylococcus aureus subsp. aureus MW2
ggcaguucugaaacauu

SEQ ID NO: 2107337 - RNA, 14 nt, Staphylococcus aureus subsp. aureus MW2
ggcauccauaucca

SEQ ID NO: 2107338 - RNA, 12 nt, Staphylococcus aureus subsp. aureus MW2
ggcauaauaaua

SEQ ID NO: 2107339 - RNA, 16 nt, Staphylococcus aureus subsp. aureus MW2
ggcauaaccuguaauu

SEQ ID NO: 2107340 - RNA, 23 nt, Staphylococcus aureus subsp. aureus MW2
ggcauaaccuguuuuuauuuguu

SEQ ID NO: 2107341 - RNA, 22 nt, Staphylococcus aureus subsp. aureus MW2
ggcacuaauauuuaaaaaacaa

SEQ ID NO: 2107342 - RNA, 19 nt, Staphylococcus aureus subsp. aureus MW2
aaaguacuuuaaaauugua

SEQ ID NO: 2107343 - RNA, 14 nt, Staphylococcus aureus subsp. aureus MW2
aaaguacuuuaaaa

SEQ ID NO: 2107344 - RNA, 22 nt, Staphylococcus aureus subsp. aureus MW2
aaaguaucgccaaucuauugca

SEQ ID NO: 2107345 - RNA, 19 nt, Staphylococcus aureus subsp. aureus MW2
aaaguacuuacaaauauac

SEQ ID NO: 2107346 - RNA, 22 nt, Staphylococcus aureus subsp. aureus MW2
ggcaccacauacauaucuuuug

SEQ ID NO: 2107347 - RNA, 16 nt, Staphylococcus aureus subsp. aureus MW2
ggcaauagcaccauac

SEQ ID NO: 2107348 - RNA, 21 nt, Staphylococcus aureus subsp. aureus MW2
ggcaaucuugaacaauucuuc

SEQ ID NO: 2107349 - RNA, 14 nt, Staphylococcus aureus subsp. aureus MW2
ggcaaaaucaacuu

SEQ ID NO: 2107350 - RNA, 20 nt, Staphylococcus aureus subsp. aureus MW2
ggauuuacucuaaaacgauu

SEQ ID NO: 2107351 - RNA, 14 nt, Staphylococcus aureus subsp. aureus MW2
aaagggcaaaaaag

SEQ ID NO: 2107352 - RNA, 23 nt, Staphylococcus aureus subsp. aureus MW2
aaagggcaacacucggaaacaug

SEQ ID NO: 2107353 - RNA, 19 nt, Staphylococcus aureus subsp. aureus MW2
ggacauagguauaaucauu

SEQ ID NO: 2107354 - RNA, 14 nt, Staphylococcus aureus subsp. aureus MW2
ggaaucgucauauu

SEQ ID NO: 2107355 - RNA, 23 nt, Staphylococcus aureus subsp. aureus MW2
aaagguuguuuuucaucauuaaa

SEQ ID NO: 2107356 - RNA, 21 nt, Staphylococcus aureus subsp. aureus MW2
aaagguuuacuauuaaaggaa

SEQ ID NO: 2107357 - RNA, 13 nt, Staphylococcus aureus subsp. aureus MW2
ggagaaccauauu

SEQ ID NO: 2107358 - RNA, 23 nt, Staphylococcus aureus subsp. aureus MW2
ggagaaaucaguuaggaugaaaa

SEQ ID NO: 2107359 - RNA, 23 nt, Staphylococcus aureus subsp. aureus MW2
ggaguauuuuugcguuaauaauu

SEQ ID NO: 2107360 - RNA, 19 nt, Staphylococcus aureus subsp. aureus MW2
ggaaaauaaaaaccagcua

SEQ ID NO: 2107361 - RNA, 15 nt, Staphylococcus aureus subsp. aureus MW2
ggaaaauacuauacu

SEQ ID NO: 2107362 - RNA, 23 nt, Staphylococcus aureus subsp. aureus MW2
ggaaaauacuauacugaugaaaa

SEQ ID NO: 2107363 - RNA, 16 nt, Staphylococcus aureus subsp. aureus MW2
ggaaagucagcauaca

SEQ ID NO: 2107364 - RNA, 13 nt, Staphylococcus aureus subsp. aureus MW2
ggaaagucagcuu

SEQ ID NO: 2107365 - RNA, 19 nt, Staphylococcus aureus subsp. aureus MW2
ggaaagucagcuuacaaua

SEQ ID NO: 2107366 - RNA, 21 nt, Staphylococcus aureus subsp. aureus MW2
ggaaagucagcuuacaauaau

SEQ ID NO: 2107367 - RNA, 18 nt, Staphylococcus aureus subsp. aureus MW2
ggaaauaugaaaagagau

SEQ ID NO: 2107368 - RNA, 15 nt, Staphylococcus aureus subsp. aureus MW2
ggaauauaaaacugu

SEQ ID NO: 2107369 - RNA, 20 nt, Staphylococcus aureus subsp. aureus MW2
ggaauauuucccuaugaaau

SEQ ID NO: 2107370 - RNA, 21 nt, Staphylococcus aureus subsp. aureus MW2
ggaauagauguugaugaagua

SEQ ID NO: 2107371 - RNA, 19 nt, Staphylococcus aureus subsp. aureus MW2
ggaacccaggugcaucuuu

SEQ ID NO: 2107372 - RNA, 20 nt, Staphylococcus aureus subsp. aureus MW2
gcuuuuaauuaauuaucaua

SEQ ID NO: 2107373 - RNA, 14 nt, Staphylococcus aureus subsp. aureus MW2
gcuuuguuuuucac

SEQ ID NO: 2107374 - RNA, 16 nt, Staphylococcus aureus subsp. aureus MW2
gcuuugauuucauuug

SEQ ID NO: 2107375 - RNA, 21 nt, Staphylococcus aureus subsp. aureus MW2
gcuuugcauacauaucuuuug

SEQ ID NO: 2107376 - RNA, 20 nt, Staphylococcus aureus subsp. aureus MW2
gcuuucuuuuucaucuuuca

SEQ ID NO: 2107377 - RNA, 23 nt, Staphylococcus aureus subsp. aureus MW2
gcuuucuuuuuugcuguauauau

SEQ ID NO: 2107378 - RNA, 18 nt, Staphylococcus aureus subsp. aureus MW2
gcuuucuuaauuauggua

SEQ ID NO: 2107379 - RNA, 16 nt, Staphylococcus aureus subsp. aureus MW2
gcuuucguuucuuuua

SEQ ID NO: 2107380 - RNA, 17 nt, Staphylococcus aureus subsp. aureus MW2
gcuuucuaucuuguucu

SEQ ID NO: 2107381 - RNA, 21 nt, Staphylococcus aureus subsp. aureus MW2
gcuuuuuuauucuaauacaaa

SEQ ID NO: 2107382 - RNA, 16 nt, Staphylococcus aureus subsp. aureus MW2
gcuuuuuuaccagcau

SEQ ID NO: 2107383 - RNA, 12 nt, Staphylococcus aureus subsp. aureus MW2
gcuuuuuguuuu

SEQ ID NO: 2107384 - RNA, 19 nt, Staphylococcus aureus subsp. aureus MW2
gcuuuuucuucuacauaua

SEQ ID NO: 2107385 - RNA, 18 nt, Staphylococcus aureus subsp. aureus MW2
gcuuuuucuacaccuaca

SEQ ID NO: 2107386 - RNA, 15 nt, Staphylococcus aureus subsp. aureus MW2
gcuuuuuuuacaaua

SEQ ID NO: 2107387 - RNA, 15 nt, Staphylococcus aureus subsp. aureus MW2
gcuuuuuuuuauaag

SEQ ID NO: 2107388 - RNA, 17 nt, Staphylococcus aureus subsp. aureus MW2
gcuuuuguaaagcuuua

SEQ ID NO: 2107389 - RNA, 18 nt, Staphylococcus aureus subsp. aureus MW2
gcuuuuucauaaauauuu

SEQ ID NO: 2107390 - RNA, 13 nt, Staphylococcus aureus subsp. aureus MW2
gcuuuuuaucaac

SEQ ID NO: 2107391 - RNA, 15 nt, Staphylococcus aureus subsp. aureus MW2
gcuuuuaguaaauaa

SEQ ID NO: 2107392 - RNA, 16 nt, Staphylococcus aureus subsp. aureus MW2
gcuuuucuaauuuuuc

SEQ ID NO: 2107393 - RNA, 16 nt, Staphylococcus aureus subsp. aureus MW2
gcuaaauauuauaaaa

SEQ ID NO: 2107394 - RNA, 21 nt, Staphylococcus aureus subsp. aureus MW2
gcuaaaguguagccaaauaaa

SEQ ID NO: 2107395 - RNA, 18 nt, Staphylococcus aureus subsp. aureus MW2
gcuaaacgcaauacgaau

SEQ ID NO: 2107396 - RNA, 18 nt, Staphylococcus aureus subsp. aureus MW2
gcuaaaauuguauuauua

SEQ ID NO: 2107397 - RNA, 14 nt, Staphylococcus aureus subsp. aureus MW2
gcuaaaaguauaaa

SEQ ID NO: 2107398 - RNA, 12 nt, Staphylococcus aureus subsp. aureus MW2
gcuaaucuauuu

SEQ ID NO: 2107399 - RNA, 13 nt, Staphylococcus aureus subsp. aureus MW2
gcuaaucuucuca

SEQ ID NO: 2107400 - RNA, 23 nt, Staphylococcus aureus subsp. aureus MW2
gcuaaugcauuauuauaauagcu

SEQ ID NO: 2107401 - RNA, 20 nt, Staphylococcus aureus subsp. aureus MW2
gcuaaugcaacuaaaacuau

SEQ ID NO: 2107402 - RNA, 18 nt, Staphylococcus aureus subsp. aureus MW2
gcuaaugcaacuaaaacu

SEQ ID NO: 2107403 - RNA, 15 nt, Staphylococcus aureus subsp. aureus MW2
gcuaaugauaaucca

SEQ ID NO: 2107404 - RNA, 11 nt, Staphylococcus aureus subsp. aureus MW2
gcuaaguauau

SEQ ID NO: 2107405 - RNA, 16 nt, Staphylococcus aureus subsp. aureus MW2
gcuaaguuugaaggag

SEQ ID NO: 2107406 - RNA, 15 nt, Staphylococcus aureus subsp. aureus MW2
gcuacuauuaaauaa

SEQ ID NO: 2107407 - RNA, 14 nt, Staphylococcus aureus subsp. aureus MW2
gcuacaaauaauga

SEQ ID NO: 2107408 - RNA, 17 nt, Staphylococcus aureus subsp. aureus MW2
gcuaauucauauucaaa

SEQ ID NO: 2107409 - RNA, 22 nt, Staphylococcus aureus subsp. aureus MW2
gcuaauucauauucaaauuuac

SEQ ID NO: 2107410 - RNA, 22 nt, Staphylococcus aureus subsp. aureus MW2
gcuaauugauacggaucauaau

SEQ ID NO: 2107411 - RNA, 13 nt, Staphylococcus aureus subsp. aureus MW2
gcuaaaaaaauua

SEQ ID NO: 2107412 - RNA, 17 nt, Staphylococcus aureus subsp. aureus MW2
gcguuguuucauuauca

SEQ ID NO: 2107413 - RNA, 14 nt, Staphylococcus aureus subsp. aureus MW2
gcguucaacauuac

SEQ ID NO: 2107414 - RNA, 13 nt, Staphylococcus aureus subsp. aureus MW2
gcuauuuaaaauu

SEQ ID NO: 2107415 - RNA, 15 nt, Staphylococcus aureus subsp. aureus MW2
gcuauguauuuuucu

SEQ ID NO: 2107416 - RNA, 20 nt, Staphylococcus aureus subsp. aureus MW2
gcuauaaaauuuugaagaag

SEQ ID NO: 2107417 - RNA, 14 nt, Staphylococcus aureus subsp. aureus MW2
gcuauaaaauuuug

SEQ ID NO: 2107418 - RNA, 24 nt, Staphylococcus aureus subsp. aureus MW2
gcuaguugaaccguaacuauauga

SEQ ID NO: 2107419 - RNA, 18 nt, Staphylococcus aureus subsp. aureus MW2
gcuaguuuuuuauuuuug

SEQ ID NO: 2107420 - RNA, 18 nt, Staphylococcus aureus subsp. aureus MW2
gcuauaaaaaaucuuuug

SEQ ID NO: 2107421 - RNA, 21 nt, Staphylococcus aureus subsp. aureus MW2
gcuauauuuuuguauuuaugu

SEQ ID NO: 2107422 - RNA, 19 nt, Staphylococcus aureus subsp. aureus MW2
gcuacuugaauaccuuuua

SEQ ID NO: 2107423 - RNA, 16 nt, Staphylococcus aureus subsp. aureus MW2
gcuagaaguucuuaug

SEQ ID NO: 2107424 - RNA, 22 nt, Staphylococcus aureus subsp. aureus MW2
gcuagauuuuaaacgcucauca

SEQ ID NO: 2107425 - RNA, 15 nt, Staphylococcus aureus subsp. aureus MW2
gcuagauaauaaucc

SEQ ID NO: 2107426 - RNA, 19 nt, Staphylococcus aureus subsp. aureus MW2
gcuagucauaauuuagaag

SEQ ID NO: 2107427 - RNA, 17 nt, Staphylococcus aureus subsp. aureus MW2
gcuagcuuucuuuuuca

SEQ ID NO: 2107428 - RNA, 12 nt, Staphylococcus aureus subsp. aureus MW2
gcucuucuucuu

SEQ ID NO: 2107429 - RNA, 14 nt, Staphylococcus aureus subsp. aureus MW2
gcucuucuucuuca

SEQ ID NO: 2107430 - RNA, 18 nt, Staphylococcus aureus subsp. aureus MW2
gcucuuaaaucacuagcu

SEQ ID NO: 2107431 - RNA, 15 nt, Staphylococcus aureus subsp. aureus MW2
gcucuggauuuuucu

SEQ ID NO: 2107432 - RNA, 15 nt, Staphylococcus aureus subsp. aureus MW2
gcugauaauuuuucu

SEQ ID NO: 2107433 - RNA, 14 nt, Staphylococcus aureus subsp. aureus MW2
gcugauaauuuuuc

SEQ ID NO: 2107434 - RNA, 17 nt, Staphylococcus aureus subsp. aureus MW2
gcucuuuuuguaugagu

SEQ ID NO: 2107435 - RNA, 16 nt, Staphylococcus aureus subsp. aureus MW2
gcugauacauaaaaug

SEQ ID NO: 2107436 - RNA, 17 nt, Staphylococcus aureus subsp. aureus MW2
aaagcuuuaguuaaaua

SEQ ID NO: 2107437 - RNA, 18 nt, Staphylococcus aureus subsp. aureus MW2
aaagcuugauuuaacaac

SEQ ID NO: 2107438 - RNA, 15 nt, Staphylococcus aureus subsp. aureus MW2
aaagcuuguaaucau

SEQ ID NO: 2107439 - RNA, 18 nt, Staphylococcus aureus subsp. aureus MW2
aaagcuuuucuugaaaua

SEQ ID NO: 2107440 - RNA, 20 nt, Staphylococcus aureus subsp. aureus MW2
aaagcuucgucaaugacuaa

SEQ ID NO: 2107441 - RNA, 16 nt, Staphylococcus aureus subsp. aureus MW2
aaagcuuauuaaauca

SEQ ID NO: 2107442 - RNA, 15 nt, Staphylococcus aureus subsp. aureus MW2
aaagcuucauauuua

SEQ ID NO: 2107443 - RNA, 14 nt, Staphylococcus aureus subsp. aureus MW2
aaagcugucaacuu

SEQ ID NO: 2107444 - RNA, 15 nt, Staphylococcus aureus subsp. aureus MW2
aaagcugucaacuug

SEQ ID NO: 2107445 - RNA, 23 nt, Staphylococcus aureus subsp. aureus MW2
aaagcuggggaagaccauuuuau

SEQ ID NO: 2107446 - RNA, 23 nt, Staphylococcus aureus subsp. aureus MW2
gcugggacauaaaucaauguucu

SEQ ID NO: 2107447 - RNA, 15 nt, Staphylococcus aureus subsp. aureus MW2
gcgugcuuuucaaac

SEQ ID NO: 2107448 - RNA, 19 nt, Staphylococcus aureus subsp. aureus MW2
gcggggcccaaacauagag

SEQ ID NO: 2107449 - RNA, 23 nt, Staphylococcus aureus subsp. aureus MW2
gcggggccccaacaaagaagcug

SEQ ID NO: 2107450 - RNA, 23 nt, Staphylococcus aureus subsp. aureus MW2
gcggggccccaacacagaagcug

SEQ ID NO: 2107451 - RNA, 17 nt, Staphylococcus aureus subsp. aureus MW2
gcgcuucuaacucaccu

SEQ ID NO: 2107452 - RNA, 16 nt, Staphylococcus aureus subsp. aureus MW2
aaagcggacugaaaga

SEQ ID NO: 2107453 - RNA, 21 nt, Staphylococcus aureus subsp. aureus MW2
gcaagaauagauugauuguau

SEQ ID NO: 2107454 - RNA, 13 nt, Staphylococcus aureus subsp. aureus MW2
gcaacuuauaaua

SEQ ID NO: 2107455 - RNA, 18 nt, Staphylococcus aureus subsp. aureus MW2
gcaacuuuugguaauuua

SEQ ID NO: 2107456 - RNA, 18 nt, Staphylococcus aureus subsp. aureus MW2
gcaacuaagaugacugaa

SEQ ID NO: 2107457 - RNA, 12 nt, Staphylococcus aureus subsp. aureus MW2
gcaacugaaacu

SEQ ID NO: 2107458 - RNA, 18 nt, Staphylococcus aureus subsp. aureus MW2
gcaacugaucauuuucau

SEQ ID NO: 2107459 - RNA, 14 nt, Staphylococcus aureus subsp. aureus MW2
aaagcgccaauaca

SEQ ID NO: 2107460 - RNA, 14 nt, Staphylococcus aureus subsp. aureus MW2
gaucacacgacaug

SEQ ID NO: 2107461 - RNA, 24 nt, Staphylococcus aureus subsp. aureus MW2
gaucaauuaaacuuaagaauacau

SEQ ID NO: 2107462 - RNA, 16 nt, Staphylococcus aureus subsp. aureus MW2
gcaauaggaugaaacu

SEQ ID NO: 2107463 - RNA, 18 nt, Staphylococcus aureus subsp. aureus MW2
gcaauagcuauaacucua

SEQ ID NO: 2107464 - RNA, 15 nt, Staphylococcus aureus subsp. aureus MW2
gcaauagcuauaacu

SEQ ID NO: 2107465 - RNA, 16 nt, Staphylococcus aureus subsp. aureus MW2
gcaauagcaacacguu

SEQ ID NO: 2107466 - RNA, 19 nt, Staphylococcus aureus subsp. aureus MW2
gcaagguuuucgccaauaa

SEQ ID NO: 2107467 - RNA, 14 nt, Staphylococcus aureus subsp. aureus MW2
gcaaguuggcgggg

SEQ ID NO: 2107468 - RNA, 20 nt, Staphylococcus aureus subsp. aureus MW2
gcaaguuggcggggccccaa

SEQ ID NO: 2107469 - RNA, 12 nt, Staphylococcus aureus subsp. aureus MW2
gcaaguuggggu

SEQ ID NO: 2107470 - RNA, 13 nt, Staphylococcus aureus subsp. aureus MW2
gcaaguuggggau

SEQ ID NO: 2107471 - RNA, 19 nt, Staphylococcus aureus subsp. aureus MW2
gcaaguuauaucauaacuu

SEQ ID NO: 2107472 - RNA, 19 nt, Staphylococcus aureus subsp. aureus MW2
gcaauaacaccaauugaau

SEQ ID NO: 2107473 - RNA, 14 nt, Staphylococcus aureus subsp. aureus MW2
gcaagccaucaaua

SEQ ID NO: 2107474 - RNA, 18 nt, Staphylococcus aureus subsp. aureus MW2
gcaagccuucuauauagu

SEQ ID NO: 2107475 - RNA, 15 nt, Staphylococcus aureus subsp. aureus MW2
gcaagcauaucuuua

SEQ ID NO: 2107476 - RNA, 15 nt, Staphylococcus aureus subsp. aureus MW2
gcaaugccacaucau

SEQ ID NO: 2107477 - RNA, 14 nt, Staphylococcus aureus subsp. aureus MW2
gcaaucuuaguaca

SEQ ID NO: 2107478 - RNA, 14 nt, Staphylococcus aureus subsp. aureus MW2
gcaaucuauauaaa

SEQ ID NO: 2107479 - RNA, 19 nt, Staphylococcus aureus subsp. aureus MW2
gcaauggcuaaugacuucg

SEQ ID NO: 2107480 - RNA, 14 nt, Staphylococcus aureus subsp. aureus MW2
gcaauuaaagucaa

SEQ ID NO: 2107481 - RNA, 22 nt, Staphylococcus aureus subsp. aureus MW2
gcaauuaaaacuauaauaaaga

SEQ ID NO: 2107482 - RNA, 22 nt, Staphylococcus aureus subsp. aureus MW2
gcaaugucaucuugacacaaug

SEQ ID NO: 2107483 - RNA, 14 nt, Staphylococcus aureus subsp. aureus MW2
gcaauuaaguauag

SEQ ID NO: 2107484 - RNA, 13 nt, Staphylococcus aureus subsp. aureus MW2
gcaauuuguaaua

SEQ ID NO: 2107485 - RNA, 13 nt, Staphylococcus aureus subsp. aureus MW2
gcaauuucauagu

SEQ ID NO: 2107486 - RNA, 16 nt, Staphylococcus aureus subsp. aureus MW2
gcacauuauuguaagu

SEQ ID NO: 2107487 - RNA, 18 nt, Staphylococcus aureus subsp. aureus MW2
gcacauuuuuaguuagaa

SEQ ID NO: 2107488 - RNA, 16 nt, Staphylococcus aureus subsp. aureus MW2
gcacaacugcauauaa

SEQ ID NO: 2107489 - RNA, 14 nt, Staphylococcus aureus subsp. aureus MW2
gcacaagcaucuau

SEQ ID NO: 2107490 - RNA, 12 nt, Staphylococcus aureus subsp. aureus MW2
gcacaaaugcua

SEQ ID NO: 2107491 - RNA, 18 nt, Staphylococcus aureus subsp. aureus MW2
gcaccacauacauaucuu

SEQ ID NO: 2107492 - RNA, 21 nt, Staphylococcus aureus subsp. aureus MW2
gcaccacauacauaucuuuug

SEQ ID NO: 2107493 - RNA, 15 nt, Staphylococcus aureus subsp. aureus MW2
gcaccuccaaccgcu

SEQ ID NO: 2107494 - RNA, 14 nt, Staphylococcus aureus subsp. aureus MW2
gcacccuaaaaguu

SEQ ID NO: 2107495 - RNA, 19 nt, Staphylococcus aureus subsp. aureus MW2
gcaccgccugaaauagcuu

SEQ ID NO: 2107496 - RNA, 16 nt, Staphylococcus aureus subsp. aureus MW2
gcaccuuuauuaccag

SEQ ID NO: 2107497 - RNA, 19 nt, Staphylococcus aureus subsp. aureus MW2
gcacuaugcauaauaccaa

SEQ ID NO: 2107498 - RNA, 13 nt, Staphylococcus aureus subsp. aureus MW2
gcacuagcaacau

SEQ ID NO: 2107499 - RNA, 22 nt, Staphylococcus aureus subsp. aureus MW2
gcacuugucucaaauuaaauca

SEQ ID NO: 2107500 - RNA, 12 nt, Staphylococcus aureus subsp. aureus MW2
gcacuuggauuu

SEQ ID NO: 2107501 - RNA, 20 nt, Staphylococcus aureus subsp. aureus MW2
gcacuucuauauuaauagaa

SEQ ID NO: 2107502 - RNA, 18 nt, Staphylococcus aureus subsp. aureus MW2
gcacuucuauauuaauag

SEQ ID NO: 2107503 - RNA, 16 nt, Staphylococcus aureus subsp. aureus MW2
gcacuucaaaagaaau

SEQ ID NO: 2107504 - RNA, 23 nt, Staphylococcus aureus subsp. aureus MW2
gcacuuauuuggaugguaaguau

SEQ ID NO: 2107505 - RNA, 22 nt, Staphylococcus aureus subsp. aureus MW2
gcagacguaucaucaaaauuua

SEQ ID NO: 2107506 - RNA, 15 nt, Staphylococcus aureus subsp. aureus MW2
gcagcaaugacacua

SEQ ID NO: 2107507 - RNA, 16 nt, Staphylococcus aureus subsp. aureus MW2
gcaucuuuguuuucaa

SEQ ID NO: 2107508 - RNA, 18 nt, Staphylococcus aureus subsp. aureus MW2
gcaucuuuguuuucaaac

SEQ ID NO: 2107509 - RNA, 14 nt, Staphylococcus aureus subsp. aureus MW2
gcaugacuguaagu

SEQ ID NO: 2107510 - RNA, 17 nt, Staphylococcus aureus subsp. aureus MW2
gcaugacuguaaguaug

SEQ ID NO: 2107511 - RNA, 21 nt, Staphylococcus aureus subsp. aureus MW2
gcaugaaaauuaaaaaaugcu

SEQ ID NO: 2107512 - RNA, 16 nt, Staphylococcus aureus subsp. aureus MW2
gcauuaucaacuugaa

SEQ ID NO: 2107513 - RNA, 18 nt, Staphylococcus aureus subsp. aureus MW2
gcauuacuaucuucauca

SEQ ID NO: 2107514 - RNA, 13 nt, Staphylococcus aureus subsp. aureus MW2
gcauuuuguuuca

SEQ ID NO: 2107515 - RNA, 18 nt, Staphylococcus aureus subsp. aureus MW2
gcauuguuuguagaauuu

SEQ ID NO: 2107516 - RNA, 17 nt, Staphylococcus aureus subsp. aureus MW2
gccaaaaacuuuauauu

SEQ ID NO: 2107517 - RNA, 20 nt, Staphylococcus aureus subsp. aureus MW2
gcauuguaauaccaauuuuu

SEQ ID NO: 2107518 - RNA, 15 nt, Staphylococcus aureus subsp. aureus MW2
gcauugagauggucu

SEQ ID NO: 2107519 - RNA, 19 nt, Staphylococcus aureus subsp. aureus MW2
gcauugaaugaugcugcca

SEQ ID NO: 2107520 - RNA, 16 nt, Staphylococcus aureus subsp. aureus MW2
gcauaccuauaaacau

SEQ ID NO: 2107521 - RNA, 17 nt, Staphylococcus aureus subsp. aureus MW2
gcauacgaauuaaaaua

SEQ ID NO: 2107522 - RNA, 21 nt, Staphylococcus aureus subsp. aureus MW2
gcauacacuugguuaucauua

SEQ ID NO: 2107523 - RNA, 17 nt, Staphylococcus aureus subsp. aureus MW2
gcauacaauaaugugca

SEQ ID NO: 2107524 - RNA, 20 nt, Staphylococcus aureus subsp. aureus MW2
gcauacaauaaugugcaagu

SEQ ID NO: 2107525 - RNA, 18 nt, Staphylococcus aureus subsp. aureus MW2
gcauauaauauuugaaaa

SEQ ID NO: 2107526 - RNA, 19 nt, Staphylococcus aureus subsp. aureus MW2
gcauacugucaucuuucaa

SEQ ID NO: 2107527 - RNA, 22 nt, Staphylococcus aureus subsp. aureus MW2
gccaaaccggucuauaacacca

SEQ ID NO: 2107528 - RNA, 20 nt, Staphylococcus aureus subsp. aureus MW2
gccaacaucuucaacauaac

SEQ ID NO: 2107529 - RNA, 16 nt, Staphylococcus aureus subsp. aureus MW2
gccaacuugcacauua

SEQ ID NO: 2107530 - RNA, 14 nt, Staphylococcus aureus subsp. aureus MW2
gccaauguuuuacu

SEQ ID NO: 2107531 - RNA, 20 nt, Staphylococcus aureus subsp. aureus MW2
gccaauuaauucuuugaaaa

SEQ ID NO: 2107532 - RNA, 21 nt, Staphylococcus aureus subsp. aureus MW2
gccaaucuauugcaauauagu

SEQ ID NO: 2107533 - RNA, 22 nt, Staphylococcus aureus subsp. aureus MW2
gccaccuuguuuaaguuuuuca

SEQ ID NO: 2107534 - RNA, 21 nt, Staphylococcus aureus subsp. aureus MW2
gccacaacauguuuggaugaa

SEQ ID NO: 2107535 - RNA, 16 nt, Staphylococcus aureus subsp. aureus MW2
gccccuggugauucac

SEQ ID NO: 2107536 - RNA, 20 nt, Staphylococcus aureus subsp. aureus MW2
gccccuagcaaaaauacuuu

SEQ ID NO: 2107537 - RNA, 17 nt, Staphylococcus aureus subsp. aureus MW2
gccccaacacagagaau

SEQ ID NO: 2107538 - RNA, 15 nt, Staphylococcus aureus subsp. aureus MW2
gccccaacacagaag

SEQ ID NO: 2107539 - RNA, 14 nt, Staphylococcus aureus subsp. aureus MW2
gccccaacacagag

SEQ ID NO: 2107540 - RNA, 13 nt, Staphylococcus aureus subsp. aureus MW2
gccccaacacaga

SEQ ID NO: 2107541 - RNA, 15 nt, Staphylococcus aureus subsp. aureus MW2
gccccaacaaagaga

SEQ ID NO: 2107542 - RNA, 16 nt, Staphylococcus aureus subsp. aureus MW2
gccccaacauagaagc

SEQ ID NO: 2107543 - RNA, 17 nt, Staphylococcus aureus subsp. aureus MW2
gccccaacacagagaaa

SEQ ID NO: 2107544 - RNA, 22 nt, Staphylococcus aureus subsp. aureus MW2
gccacugucauguguucaaaua

SEQ ID NO: 2107545 - RNA, 21 nt, Staphylococcus aureus subsp. aureus MW2
gccaucaauauugauaucgaa

SEQ ID NO: 2107546 - RNA, 16 nt, Staphylococcus aureus subsp. aureus MW2
gccaucaauauugaua

SEQ ID NO: 2107547 - RNA, 20 nt, Staphylococcus aureus subsp. aureus MW2
gccaucaauuucgacuccau

SEQ ID NO: 2107548 - RNA, 18 nt, Staphylococcus aureus subsp. aureus MW2
gccauacccauauuaaau

SEQ ID NO: 2107549 - RNA, 11 nt, Staphylococcus aureus subsp. aureus MW2
gcccaaacaua

SEQ ID NO: 2107550 - RNA, 13 nt, Staphylococcus aureus subsp. aureus MW2
aaagcuaauuuuu

SEQ ID NO: 2107551 - RNA, 17 nt, Staphylococcus aureus subsp. aureus MW2
aaagcuagaaguucuua

SEQ ID NO: 2107552 - RNA, 17 nt, Staphylococcus aureus subsp. aureus MW2
aaagcuaacauaccuaa

SEQ ID NO: 2107553 - RNA, 14 nt, Staphylococcus aureus subsp. aureus MW2
aaagcuaaugcaag

SEQ ID NO: 2107554 - RNA, 20 nt, Staphylococcus aureus subsp. aureus MW2
aaagcgucuuuuuauacuug

SEQ ID NO: 2107555 - RNA, 15 nt, Staphylococcus aureus subsp. aureus MW2
aaagcguaaggaauu

SEQ ID NO: 2107556 - RNA, 15 nt, Staphylococcus aureus subsp. aureus MW2
gcccgugauggguaa

SEQ ID NO: 2107557 - RNA, 19 nt, Staphylococcus aureus subsp. aureus MW2
aaagcuauguaugagucaa

SEQ ID NO: 2107558 - RNA, 23 nt, Staphylococcus aureus subsp. aureus MW2
aaagcuauaaaaaaucuuuugau

SEQ ID NO: 2107559 - RNA, 18 nt, Staphylococcus aureus subsp. aureus MW2
aaagcuauaaaaaaucuu

SEQ ID NO: 2107560 - RNA, 18 nt, Staphylococcus aureus subsp. aureus MW2
gcgacauuuguaaauauu

SEQ ID NO: 2107561 - RNA, 22 nt, Staphylococcus aureus subsp. aureus MW2
gcgaauagaagguuauuuuuua

SEQ ID NO: 2107562 - RNA, 22 nt, Staphylococcus aureus subsp. aureus MW2
gcgauaauuguugcauuacuuu

SEQ ID NO: 2107563 - RNA, 23 nt, Staphylococcus aureus subsp. aureus MW2
gcgaggccccaacauaaagaauu

SEQ ID NO: 2107564 - RNA, 23 nt, Staphylococcus aureus subsp. aureus MW2
gccugcaucaccugaugaauaga

SEQ ID NO: 2107565 - RNA, 21 nt, Staphylococcus aureus subsp. aureus MW2
gccugccccuuagucauguuu

SEQ ID NO: 2107566 - RNA, 13 nt, Staphylococcus aureus subsp. aureus MW2
gccuauuuaaaag

SEQ ID NO: 2107567 - RNA, 16 nt, Staphylococcus aureus subsp. aureus MW2
gccuauucguuugaau

SEQ ID NO: 2107568 - RNA, 22 nt, Staphylococcus aureus subsp. aureus MW2
gccuucuguacguuuuaaauaa

SEQ ID NO: 2107569 - RNA, 23 nt, Staphylococcus aureus subsp. aureus MW2
gcgaaaacguugaguauuacuug

SEQ ID NO: 2107570 - RNA, 17 nt, Staphylococcus aureus subsp. aureus MW2
gccgucuccauuauaaa

SEQ ID NO: 2107571 - RNA, 12 nt, Staphylococcus aureus subsp. aureus MW2
gguucaucuaaa

SEQ ID NO: 2107572 - RNA, 13 nt, Staphylococcus aureus subsp. aureus MW2
gguucgaaucccu

SEQ ID NO: 2107573 - RNA, 12 nt, Staphylococcus aureus subsp. aureus MW2
gguuauuugaua

SEQ ID NO: 2107574 - RNA, 23 nt, Staphylococcus aureus subsp. aureus MW2
gguuauuuccguuuuagaauuua

SEQ ID NO: 2107575 - RNA, 14 nt, Staphylococcus aureus subsp. aureus MW2
gguuauuaaaauua

SEQ ID NO: 2107576 - RNA, 22 nt, Staphylococcus aureus subsp. aureus MW2
gguuauauaaacaaaaggcugg

SEQ ID NO: 2107577 - RNA, 20 nt, Staphylococcus aureus subsp. aureus MW2
gguuaaugacuaugcaaaug

SEQ ID NO: 2107578 - RNA, 20 nt, Staphylococcus aureus subsp. aureus MW2
gguuaaauucggaaaauauc

SEQ ID NO: 2107579 - RNA, 23 nt, Staphylococcus aureus subsp. aureus MW2
gguguagauaaaucgauaaaaug

SEQ ID NO: 2107580 - RNA, 19 nt, Staphylococcus aureus subsp. aureus MW2
gguuuaaucuauauauaug

SEQ ID NO: 2107581 - RNA, 16 nt, Staphylococcus aureus subsp. aureus MW2
gguuuaauguuuaaua

SEQ ID NO: 2107582 - RNA, 14 nt, Staphylococcus aureus subsp. aureus MW2
gguuguuucaauuc

SEQ ID NO: 2107583 - RNA, 15 nt, Staphylococcus aureus subsp. aureus MW2
gguucuucaauaugc

SEQ ID NO: 2107584 - RNA, 18 nt, Staphylococcus aureus subsp. aureus MW2
guaaaaacguucaaucgu

SEQ ID NO: 2107585 - RNA, 17 nt, Staphylococcus aureus subsp. aureus MW2
gguuuuuuauuuucaua

SEQ ID NO: 2107586 - RNA, 21 nt, Staphylococcus aureus subsp. aureus MW2
guaaaaccuuacccaaaaaau

SEQ ID NO: 2107587 - RNA, 13 nt, Staphylococcus aureus subsp. aureus MW2
guaaaaaugauua

SEQ ID NO: 2107588 - RNA, 10 nt, Staphylococcus aureus subsp. aureus MW2
gguuucacau

SEQ ID NO: 2107589 - RNA, 13 nt, Staphylococcus aureus subsp. aureus MW2
gguuuauuuaaua

SEQ ID NO: 2107590 - RNA, 17 nt, Staphylococcus aureus subsp. aureus MW2
ggugaguguuucauaau

SEQ ID NO: 2107591 - RNA, 19 nt, Staphylococcus aureus subsp. aureus MW2
ggugauucaccuaauaaug

SEQ ID NO: 2107592 - RNA, 20 nt, Staphylococcus aureus subsp. aureus MW2
ggugagggccccaacacaga

SEQ ID NO: 2107593 - RNA, 21 nt, Staphylococcus aureus subsp. aureus MW2
ggugagggccccaacacagaa

SEQ ID NO: 2107594 - RNA, 20 nt, Staphylococcus aureus subsp. aureus MW2
guacggcugcuuuaacugua

SEQ ID NO: 2107595 - RNA, 22 nt, Staphylococcus aureus subsp. aureus MW2
guaccuuuuuauugauauuaau

SEQ ID NO: 2107596 - RNA, 13 nt, Staphylococcus aureus subsp. aureus MW2
guaccguauuuua

SEQ ID NO: 2107597 - RNA, 12 nt, Staphylococcus aureus subsp. aureus MW2
guaccguauuuu

SEQ ID NO: 2107598 - RNA, 16 nt, Staphylococcus aureus subsp. aureus MW2
guaccacuguauuuac

SEQ ID NO: 2107599 - RNA, 18 nt, Staphylococcus aureus subsp. aureus MW2
guaccaucaauaaaaauu

SEQ ID NO: 2107600 - RNA, 16 nt, Staphylococcus aureus subsp. aureus MW2
guacauuguaaauaua

SEQ ID NO: 2107601 - RNA, 15 nt, Staphylococcus aureus subsp. aureus MW2
guacauugguuuuua

SEQ ID NO: 2107602 - RNA, 20 nt, Staphylococcus aureus subsp. aureus MW2
guacauuuauuuucaauaaa

SEQ ID NO: 2107603 - RNA, 17 nt, Staphylococcus aureus subsp. aureus MW2
guacacuuuugauuguu

SEQ ID NO: 2107604 - RNA, 16 nt, Staphylococcus aureus subsp. aureus MW2
guacaguaauauucaa

SEQ ID NO: 2107605 - RNA, 14 nt, Staphylococcus aureus subsp. aureus MW2
guacauauaauaug

SEQ ID NO: 2107606 - RNA, 18 nt, Staphylococcus aureus subsp. aureus MW2
guacaguuacuuucgcuu

SEQ ID NO: 2107607 - RNA, 12 nt, Staphylococcus aureus subsp. aureus MW2
guacauaaaaau

SEQ ID NO: 2107608 - RNA, 14 nt, Staphylococcus aureus subsp. aureus MW2
guacauaaaaauaa

SEQ ID NO: 2107609 - RNA, 15 nt, Staphylococcus aureus subsp. aureus MW2
guacaguaauauuca

SEQ ID NO: 2107610 - RNA, 20 nt, Staphylococcus aureus subsp. aureus MW2
aaauagacugccaauaaaau

SEQ ID NO: 2107611 - RNA, 16 nt, Staphylococcus aureus subsp. aureus MW2
aaauagaugagaaagu

SEQ ID NO: 2107612 - RNA, 15 nt, Staphylococcus aureus subsp. aureus MW2
aaauagauaauauau

SEQ ID NO: 2107613 - RNA, 18 nt, Staphylococcus aureus subsp. aureus MW2
aaauagacaccaaaaaca

SEQ ID NO: 2107614 - RNA, 18 nt, Staphylococcus aureus subsp. aureus MW2
guaaucauagcaacaucg

SEQ ID NO: 2107615 - RNA, 16 nt, Staphylococcus aureus subsp. aureus MW2
guaaucauaccagcaa

SEQ ID NO: 2107616 - RNA, 23 nt, Staphylococcus aureus subsp. aureus MW2
guaaucgauugguaaaucuacua

SEQ ID NO: 2107617 - RNA, 16 nt, Staphylococcus aureus subsp. aureus MW2
guaaugcuugagcuuu

SEQ ID NO: 2107618 - RNA, 23 nt, Staphylococcus aureus subsp. aureus MW2
guaaugcuuaaaaacaauauuga

SEQ ID NO: 2107619 - RNA, 17 nt, Staphylococcus aureus subsp. aureus MW2
guaaugaaucaauugca

SEQ ID NO: 2107620 - RNA, 13 nt, Staphylococcus aureus subsp. aureus MW2
guaaugauacgca

SEQ ID NO: 2107621 - RNA, 17 nt, Staphylococcus aureus subsp. aureus MW2
guaaugagaguaauguu

SEQ ID NO: 2107622 - RNA, 12 nt, Staphylococcus aureus subsp. aureus MW2
guaaucuuuuaa

SEQ ID NO: 2107623 - RNA, 14 nt, Staphylococcus aureus subsp. aureus MW2
guaaucuauuuucu

SEQ ID NO: 2107624 - RNA, 19 nt, Staphylococcus aureus subsp. aureus MW2
aaauagauugaaaaaauaa

SEQ ID NO: 2107625 - RNA, 15 nt, Staphylococcus aureus subsp. aureus MW2
guacaccuacaaaua

SEQ ID NO: 2107626 - RNA, 19 nt, Staphylococcus aureus subsp. aureus MW2
guacaauuuuuaaaaaccu

SEQ ID NO: 2107627 - RNA, 23 nt, Staphylococcus aureus subsp. aureus MW2
guaauuuuuaaaucuacaauauu

SEQ ID NO: 2107628 - RNA, 15 nt, Staphylococcus aureus subsp. aureus MW2
guaauuuuuaaacaa

SEQ ID NO: 2107629 - RNA, 21 nt, Staphylococcus aureus subsp. aureus MW2
guaauuuuuaaacaaaaauaa

SEQ ID NO: 2107630 - RNA, 23 nt, Staphylococcus aureus subsp. aureus MW2
guaauuuuuaaacaaaaauaagu

SEQ ID NO: 2107631 - RNA, 12 nt, Staphylococcus aureus subsp. aureus MW2
guaauuuuaaug

SEQ ID NO: 2107632 - RNA, 20 nt, Staphylococcus aureus subsp. aureus MW2
guaauguuccccugaaaaga

SEQ ID NO: 2107633 - RNA, 11 nt, Staphylococcus aureus subsp. aureus MW2
guaauguguua

SEQ ID NO: 2107634 - RNA, 13 nt, Staphylococcus aureus subsp. aureus MW2
guaauuaauacau

SEQ ID NO: 2107635 - RNA, 13 nt, Staphylococcus aureus subsp. aureus MW2
guaauuaaauacu

SEQ ID NO: 2107636 - RNA, 21 nt, Staphylococcus aureus subsp. aureus MW2
guaauucaccaucauauucaa

SEQ ID NO: 2107637 - RNA, 14 nt, Staphylococcus aureus subsp. aureus MW2
guaauuauuauaau

SEQ ID NO: 2107638 - RNA, 17 nt, Staphylococcus aureus subsp. aureus MW2
guaauuguaaucuauuu

SEQ ID NO: 2107639 - RNA, 20 nt, Staphylococcus aureus subsp. aureus MW2
guaauuuaauagguucuucu

SEQ ID NO: 2107640 - RNA, 21 nt, Staphylococcus aureus subsp. aureus MW2
guaauuuaccuauuugcugaa

SEQ ID NO: 2107641 - RNA, 15 nt, Staphylococcus aureus subsp. aureus MW2
guaauuguaaucuau

SEQ ID NO: 2107642 - RNA, 21 nt, Staphylococcus aureus subsp. aureus MW2
guaauugaucuaaauuaguua

SEQ ID NO: 2107643 - RNA, 18 nt, Staphylococcus aureus subsp. aureus MW2
guaauucuuguaaaucau

SEQ ID NO: 2107644 - RNA, 18 nt, Staphylococcus aureus subsp. aureus MW2
guaauugaugauuacucc

SEQ ID NO: 2107645 - RNA, 17 nt, Staphylococcus aureus subsp. aureus MW2
guaaccauuuuuuuauc

SEQ ID NO: 2107646 - RNA, 15 nt, Staphylococcus aureus subsp. aureus MW2
guaaccuuaaauaua

SEQ ID NO: 2107647 - RNA, 16 nt, Staphylococcus aureus subsp. aureus MW2
guaaccugacuuuccg

SEQ ID NO: 2107648 - RNA, 22 nt, Staphylococcus aureus subsp. aureus MW2
guaacgcucaugaguuucucau

SEQ ID NO: 2107649 - RNA, 14 nt, Staphylococcus aureus subsp. aureus MW2
guaacuaaaauguc

SEQ ID NO: 2107650 - RNA, 22 nt, Staphylococcus aureus subsp. aureus MW2
guaacuauaugaaauguucccu

SEQ ID NO: 2107651 - RNA, 13 nt, Staphylococcus aureus subsp. aureus MW2
guaacuaaaaugu

SEQ ID NO: 2107652 - RNA, 16 nt, Staphylococcus aureus subsp. aureus MW2
guaagacgauuucaau

SEQ ID NO: 2107653 - RNA, 18 nt, Staphylococcus aureus subsp. aureus MW2
guaagacgccgaaaagag

SEQ ID NO: 2107654 - RNA, 13 nt, Staphylococcus aureus subsp. aureus MW2
guaagugcucaaa

SEQ ID NO: 2107655 - RNA, 15 nt, Staphylococcus aureus subsp. aureus MW2
guaaguguaaaugaa

SEQ ID NO: 2107656 - RNA, 16 nt, Staphylococcus aureus subsp. aureus MW2
guaaguuugguuucuu

SEQ ID NO: 2107657 - RNA, 16 nt, Staphylococcus aureus subsp. aureus MW2
guaaguagaagcaaaa

SEQ ID NO: 2107658 - RNA, 20 nt, Staphylococcus aureus subsp. aureus MW2
guaagguggacuucuaucuu

SEQ ID NO: 2107659 - RNA, 23 nt, Staphylococcus aureus subsp. aureus MW2
guaaguaaaauaaaaaaugcacu

SEQ ID NO: 2107660 - RNA, 21 nt, Staphylococcus aureus subsp. aureus MW2
guaaggaauuacacuuuaaau

SEQ ID NO: 2107661 - RNA, 14 nt, Staphylococcus aureus subsp. aureus MW2
guaauaauuuacag

SEQ ID NO: 2107662 - RNA, 20 nt, Staphylococcus aureus subsp. aureus MW2
guaauauuuuuguugcaauu

SEQ ID NO: 2107663 - RNA, 18 nt, Staphylococcus aureus subsp. aureus MW2
guaauauauuaauauuga

SEQ ID NO: 2107664 - RNA, 19 nt, Staphylococcus aureus subsp. aureus MW2
guaauacuauaugaaaaga

SEQ ID NO: 2107665 - RNA, 21 nt, Staphylococcus aureus subsp. aureus MW2
guaauagaacgaaauaguuca

SEQ ID NO: 2107666 - RNA, 22 nt, Staphylococcus aureus subsp. aureus MW2
guaauacugaaugcucaucuuc

SEQ ID NO: 2107667 - RNA, 22 nt, Staphylococcus aureus subsp. aureus MW2
guaauagaacgaaauaguucaa

SEQ ID NO: 2107668 - RNA, 14 nt, Staphylococcus aureus subsp. aureus MW2
guaacauguaauga

SEQ ID NO: 2107669 - RNA, 17 nt, Staphylococcus aureus subsp. aureus MW2
guaacauguaaugaauc

SEQ ID NO: 2107670 - RNA, 16 nt, Staphylococcus aureus subsp. aureus MW2
guaacauuaaaaauaa

SEQ ID NO: 2107671 - RNA, 17 nt, Staphylococcus aureus subsp. aureus MW2
guaacaguauaaauauu

SEQ ID NO: 2107672 - RNA, 15 nt, Staphylococcus aureus subsp. aureus MW2
guaacagugacugau

SEQ ID NO: 2107673 - RNA, 13 nt, Staphylococcus aureus subsp. aureus MW2
guaacauuuaaaa

SEQ ID NO: 2107674 - RNA, 22 nt, Staphylococcus aureus subsp. aureus MW2
guaacauuacguucuaauaauu

SEQ ID NO: 2107675 - RNA, 18 nt, Staphylococcus aureus subsp. aureus MW2
guaacauuuaaaaaaugc

SEQ ID NO: 2107676 - RNA, 19 nt, Staphylococcus aureus subsp. aureus MW2
guaacauuuaaaaaaugcg

SEQ ID NO: 2107677 - RNA, 18 nt, Staphylococcus aureus subsp. aureus MW2
guaacaaguucauuucaa

SEQ ID NO: 2107678 - RNA, 19 nt, Staphylococcus aureus subsp. aureus MW2
guaacaaguucauuucaau

SEQ ID NO: 2107679 - RNA, 18 nt, Staphylococcus aureus subsp. aureus MW2
guaacaauuuagcaaaua

SEQ ID NO: 2107680 - RNA, 22 nt, Staphylococcus aureus subsp. aureus MW2
guaacagcuaaggcugauucaa

SEQ ID NO: 2107681 - RNA, 18 nt, Staphylococcus aureus subsp. aureus MW2
guaaauccuccauuuaac

SEQ ID NO: 2107682 - RNA, 20 nt, Staphylococcus aureus subsp. aureus MW2
guaaaucuuguuggauuuua

SEQ ID NO: 2107683 - RNA, 13 nt, Staphylococcus aureus subsp. aureus MW2
guaaaugaaaugg

SEQ ID NO: 2107684 - RNA, 16 nt, Staphylococcus aureus subsp. aureus MW2
guaaauguuaaauucu

SEQ ID NO: 2107685 - RNA, 13 nt, Staphylococcus aureus subsp. aureus MW2
guaaauuacaaaa

SEQ ID NO: 2107686 - RNA, 22 nt, Staphylococcus aureus subsp. aureus MW2
guaaagaguacagcgguuugua

SEQ ID NO: 2107687 - RNA, 19 nt, Staphylococcus aureus subsp. aureus MW2
guaaacggaauaacuuuuu

SEQ ID NO: 2107688 - RNA, 18 nt, Staphylococcus aureus subsp. aureus MW2
guaaaccuacuaauauau

SEQ ID NO: 2107689 - RNA, 18 nt, Staphylococcus aureus subsp. aureus MW2
guaaacgauacugcuuug

SEQ ID NO: 2107690 - RNA, 16 nt, Staphylococcus aureus subsp. aureus MW2
guaaacuucuuuucuu

SEQ ID NO: 2107691 - RNA, 21 nt, Staphylococcus aureus subsp. aureus MW2
guaaacaacaucgauuuauca

SEQ ID NO: 2107692 - RNA, 17 nt, Staphylococcus aureus subsp. aureus MW2
guaaacacuauaaaagc

SEQ ID NO: 2107693 - RNA, 21 nt, Staphylococcus aureus subsp. aureus MW2
guaaaccgaggugucaauaaa

SEQ ID NO: 2107694 - RNA, 18 nt, Staphylococcus aureus subsp. aureus MW2
guaaaccagcuaaaccau

SEQ ID NO: 2107695 - RNA, 21 nt, Staphylococcus aureus subsp. aureus MW2
guaaaaugcucccuucaaagu

SEQ ID NO: 2107696 - RNA, 18 nt, Staphylococcus aureus subsp. aureus MW2
guaaaaugaugauuuaaa

SEQ ID NO: 2107697 - RNA, 20 nt, Staphylococcus aureus subsp. aureus MW2
guaaaaucauuaauaauuaa

SEQ ID NO: 2107698 - RNA, 14 nt, Staphylococcus aureus subsp. aureus MW2
guaaaauaaaucau

SEQ ID NO: 2107699 - RNA, 20 nt, Staphylococcus aureus subsp. aureus MW2
guaaaaguuuugagccaagu

SEQ ID NO: 2107700 - RNA, 16 nt, Staphylococcus aureus subsp. aureus MW2
guacguuuagugaaaa

SEQ ID NO: 2107701 - RNA, 15 nt, Staphylococcus aureus subsp. aureus MW2
guacguuuuaaauaa

SEQ ID NO: 2107702 - RNA, 21 nt, Staphylococcus aureus subsp. aureus MW2
guacuaggaccuacaauuuuc

SEQ ID NO: 2107703 - RNA, 20 nt, Staphylococcus aureus subsp. aureus MW2
guacgguuauuuaauaaugc

SEQ ID NO: 2107704 - RNA, 23 nt, Staphylococcus aureus subsp. aureus MW2
guacuuugauaucuacagagaau

SEQ ID NO: 2107705 - RNA, 22 nt, Staphylococcus aureus subsp. aureus MW2
guacuucuaauuugcaaaauca

SEQ ID NO: 2107706 - RNA, 21 nt, Staphylococcus aureus subsp. aureus MW2
guacuuaccuuucaaauauau

SEQ ID NO: 2107707 - RNA, 14 nt, Staphylococcus aureus subsp. aureus MW2
guacuuacaaauau

SEQ ID NO: 2107708 - RNA, 19 nt, Staphylococcus aureus subsp. aureus MW2
guacuucaaagcaucuaau

SEQ ID NO: 2107709 - RNA, 16 nt, Staphylococcus aureus subsp. aureus MW2
guacuuacgaauagaa

SEQ ID NO: 2107710 - RNA, 22 nt, Staphylococcus aureus subsp. aureus MW2
guacuuacgaauagaaaauaau

SEQ ID NO: 2107711 - RNA, 18 nt, Staphylococcus aureus subsp. aureus MW2
guagaaacacaaggaaua

SEQ ID NO: 2107712 - RNA, 14 nt, Staphylococcus aureus subsp. aureus MW2
guacuuuucuuuuu

SEQ ID NO: 2107713 - RNA, 20 nt, Staphylococcus aureus subsp. aureus MW2
guagaaucuacgauuuucaa

SEQ ID NO: 2107714 - RNA, 19 nt, Staphylococcus aureus subsp. aureus MW2
guagauaaaucgauaaaau

SEQ ID NO: 2107715 - RNA, 16 nt, Staphylococcus aureus subsp. aureus MW2
guagaauuucuuuucg

SEQ ID NO: 2107716 - RNA, 13 nt, Staphylococcus aureus subsp. aureus MW2
guagccaaauaaa

SEQ ID NO: 2107717 - RNA, 20 nt, Staphylococcus aureus subsp. aureus MW2
guagcauuuuagauugacua

SEQ ID NO: 2107718 - RNA, 13 nt, Staphylococcus aureus subsp. aureus MW2
guaguuaauauaa

SEQ ID NO: 2107719 - RNA, 16 nt, Staphylococcus aureus subsp. aureus MW2
guaguacuauagucau

SEQ ID NO: 2107720 - RNA, 23 nt, Staphylococcus aureus subsp. aureus MW2
guaguauauaugacuuuagcauu

SEQ ID NO: 2107721 - RNA, 19 nt, Staphylococcus aureus subsp. aureus MW2
guaguaugacaaauuaaaa

SEQ ID NO: 2107722 - RNA, 13 nt, Staphylococcus aureus subsp. aureus MW2
guaggcauuuuau

SEQ ID NO: 2107723 - RNA, 23 nt, Staphylococcus aureus subsp. aureus MW2
guaggcgauuuuauuaugacaag

SEQ ID NO: 2107724 - RNA, 16 nt, Staphylococcus aureus subsp. aureus MW2
guaggauaauuucaau

SEQ ID NO: 2107725 - RNA, 16 nt, Staphylococcus aureus subsp. aureus MW2
guaggagugaacuaua

SEQ ID NO: 2107726 - RNA, 14 nt, Staphylococcus aureus subsp. aureus MW2
guauaauuaaacua

SEQ ID NO: 2107727 - RNA, 21 nt, Staphylococcus aureus subsp. aureus MW2
guauaauggacgguauuuuca

SEQ ID NO: 2107728 - RNA, 20 nt, Staphylococcus aureus subsp. aureus MW2
guauaauacaugauauaaau

SEQ ID NO: 2107729 - RNA, 16 nt, Staphylococcus aureus subsp. aureus MW2
guauacaacaugugua

SEQ ID NO: 2107730 - RNA, 17 nt, Staphylococcus aureus subsp. aureus MW2
guauaaaugcagcugua

SEQ ID NO: 2107731 - RNA, 22 nt, Staphylococcus aureus subsp. aureus MW2
guauaaauaucauaaaugcaua

SEQ ID NO: 2107732 - RNA, 19 nt, Staphylococcus aureus subsp. aureus MW2
guauaaauaucauaaaugc

SEQ ID NO: 2107733 - RNA, 15 nt, Staphylococcus aureus subsp. aureus MW2
guauaaauaaaaaua

SEQ ID NO: 2107734 - RNA, 14 nt, Staphylococcus aureus subsp. aureus MW2
guauaaaacagaau

SEQ ID NO: 2107735 - RNA, 12 nt, Staphylococcus aureus subsp. aureus MW2
guauaaauaaaa

SEQ ID NO: 2107736 - RNA, 18 nt, Staphylococcus aureus subsp. aureus MW2
guauaaauaaaaauacau

SEQ ID NO: 2107737 - RNA, 20 nt, Staphylococcus aureus subsp. aureus MW2
guauaaacgcaaauuaaaua

SEQ ID NO: 2107738 - RNA, 20 nt, Staphylococcus aureus subsp. aureus MW2
guaguuccucgguauucaau

SEQ ID NO: 2107739 - RNA, 18 nt, Staphylococcus aureus subsp. aureus MW2
guaguucggaugagaaau

SEQ ID NO: 2107740 - RNA, 18 nt, Staphylococcus aureus subsp. aureus MW2
guaguuagguaaaaauua

SEQ ID NO: 2107741 - RNA, 14 nt, Staphylococcus aureus subsp. aureus MW2
guaguuuauaucaa

SEQ ID NO: 2107742 - RNA, 22 nt, Staphylococcus aureus subsp. aureus MW2
guauauaaguuaaaauugguuu

SEQ ID NO: 2107743 - RNA, 17 nt, Staphylococcus aureus subsp. aureus MW2
guauauaaguuaaaauu

SEQ ID NO: 2107744 - RNA, 22 nt, Staphylococcus aureus subsp. aureus MW2
guauaugaauuuuauaaauuaa

SEQ ID NO: 2107745 - RNA, 13 nt, Staphylococcus aureus subsp. aureus MW2
guauauguauaga

SEQ ID NO: 2107746 - RNA, 14 nt, Staphylococcus aureus subsp. aureus MW2
guauauuaaauuua

SEQ ID NO: 2107747 - RNA, 21 nt, Staphylococcus aureus subsp. aureus MW2
guauauucaacagggguaaaa

SEQ ID NO: 2107748 - RNA, 22 nt, Staphylococcus aureus subsp. aureus MW2
guauagauuguauuuaauaagu

SEQ ID NO: 2107749 - RNA, 20 nt, Staphylococcus aureus subsp. aureus MW2
guauacuaaacuuuuuucaa

SEQ ID NO: 2107750 - RNA, 21 nt, Staphylococcus aureus subsp. aureus MW2
guaucucugaaaaacuucuua

SEQ ID NO: 2107751 - RNA, 16 nt, Staphylococcus aureus subsp. aureus MW2
guaucuauacaauuau

SEQ ID NO: 2107752 - RNA, 19 nt, Staphylococcus aureus subsp. aureus MW2
guaucuauacaauuaugga

SEQ ID NO: 2107753 - RNA, 19 nt, Staphylococcus aureus subsp. aureus MW2
guaucuaugaaauuuuuua

SEQ ID NO: 2107754 - RNA, 16 nt, Staphylococcus aureus subsp. aureus MW2
guaucuugucauuuga

SEQ ID NO: 2107755 - RNA, 14 nt, Staphylococcus aureus subsp. aureus MW2
guaugagucaaauu

SEQ ID NO: 2107756 - RNA, 16 nt, Staphylococcus aureus subsp. aureus MW2
guaugagagauagaaa

SEQ ID NO: 2107757 - RNA, 16 nt, Staphylococcus aureus subsp. aureus MW2
guaugacaaauuaaaa

SEQ ID NO: 2107758 - RNA, 14 nt, Staphylococcus aureus subsp. aureus MW2
guaucuauaaaaag

SEQ ID NO: 2107759 - RNA, 15 nt, Staphylococcus aureus subsp. aureus MW2
guaucguuaccuuuu

SEQ ID NO: 2107760 - RNA, 15 nt, Staphylococcus aureus subsp. aureus MW2
guaucgccaaucuau

SEQ ID NO: 2107761 - RNA, 17 nt, Staphylococcus aureus subsp. aureus MW2
guauccuuuauaaauaa

SEQ ID NO: 2107762 - RNA, 21 nt, Staphylococcus aureus subsp. aureus MW2
guaucaaggucaacaaugcca

SEQ ID NO: 2107763 - RNA, 17 nt, Staphylococcus aureus subsp. aureus MW2
guaucaacauuaauaaa

SEQ ID NO: 2107764 - RNA, 22 nt, Staphylococcus aureus subsp. aureus MW2
guaucaucaaaauuuaauugcu

SEQ ID NO: 2107765 - RNA, 15 nt, Staphylococcus aureus subsp. aureus MW2
guaucauuuaaaaua

SEQ ID NO: 2107766 - RNA, 14 nt, Staphylococcus aureus subsp. aureus MW2
guaucauuucagaa

SEQ ID NO: 2107767 - RNA, 20 nt, Staphylococcus aureus subsp. aureus MW2
guaugcaucaguuaauaauu

SEQ ID NO: 2107768 - RNA, 22 nt, Staphylococcus aureus subsp. aureus MW2
guaugcauauaagauaauuuuu

SEQ ID NO: 2107769 - RNA, 20 nt, Staphylococcus aureus subsp. aureus MW2
guauuaacuaauaacuagua

SEQ ID NO: 2107770 - RNA, 15 nt, Staphylococcus aureus subsp. aureus MW2
guauguaaaaagugg

SEQ ID NO: 2107771 - RNA, 15 nt, Staphylococcus aureus subsp. aureus MW2
guauucuauuuuuca

SEQ ID NO: 2107772 - RNA, 21 nt, Staphylococcus aureus subsp. aureus MW2
guauucgcaucauucccugca

SEQ ID NO: 2107773 - RNA, 22 nt, Staphylococcus aureus subsp. aureus MW2
guauugagaaagacuauauaac

SEQ ID NO: 2107774 - RNA, 23 nt, Staphylococcus aureus subsp. aureus MW2
guauucagucaguaaaaauacau

SEQ ID NO: 2107775 - RNA, 20 nt, Staphylococcus aureus subsp. aureus MW2
guauucaaaguuuucauuua

SEQ ID NO: 2107776 - RNA, 14 nt, Staphylococcus aureus subsp. aureus MW2
guauucaaaaaaau

SEQ ID NO: 2107777 - RNA, 16 nt, Staphylococcus aureus subsp. aureus MW2
guauucaaaaaaauau

SEQ ID NO: 2107778 - RNA, 20 nt, Staphylococcus aureus subsp. aureus MW2
guauuauuauaauuuuguuu

SEQ ID NO: 2107779 - RNA, 22 nt, Staphylococcus aureus subsp. aureus MW2
guauucaaauaaacacaucuau

SEQ ID NO: 2107780 - RNA, 19 nt, Staphylococcus aureus subsp. aureus MW2
guauugccguuauuuucaa

SEQ ID NO: 2107781 - RNA, 21 nt, Staphylococcus aureus subsp. aureus MW2
guauugcauguuuaaauauca

SEQ ID NO: 2107782 - RNA, 14 nt, Staphylococcus aureus subsp. aureus MW2
guauuuaauguuuu

SEQ ID NO: 2107783 - RNA, 18 nt, Staphylococcus aureus subsp. aureus MW2
guauuguccauagauaca

SEQ ID NO: 2107784 - RNA, 23 nt, Staphylococcus aureus subsp. aureus MW2
guauuugaaagcauuuaaauaua

SEQ ID NO: 2107785 - RNA, 18 nt, Staphylococcus aureus subsp. aureus MW2
guauuugccuuuugaaua

SEQ ID NO: 2107786 - RNA, 17 nt, Staphylococcus aureus subsp. aureus MW2
guauuuuaaugauuuuu

SEQ ID NO: 2107787 - RNA, 14 nt, Staphylococcus aureus subsp. aureus MW2
guauuuuauuuauu

SEQ ID NO: 2107788 - RNA, 22 nt, Staphylococcus aureus subsp. aureus MW2
guauuucugaaaugauacauua

SEQ ID NO: 2107789 - RNA, 21 nt, Staphylococcus aureus subsp. aureus MW2
guauuuuucauauugcuaccc

SEQ ID NO: 2107790 - RNA, 19 nt, Staphylococcus aureus subsp. aureus MW2
guauuuuuuuauaauuuug

SEQ ID NO: 2107791 - RNA, 23 nt, Staphylococcus aureus subsp. aureus MW2
guauuuuucuuaauuaucauuac

SEQ ID NO: 2107792 - RNA, 23 nt, Staphylococcus aureus subsp. aureus MW2
guauuuuauuuauuuugauuaac

SEQ ID NO: 2107793 - RNA, 22 nt, Staphylococcus aureus subsp. aureus MW2
guauuuuuauuguuuuggcuuu

SEQ ID NO: 2107794 - RNA, 12 nt, Staphylococcus aureus subsp. aureus MW2
guauuuuuugcc

SEQ ID NO: 2107795 - RNA, 18 nt, Staphylococcus aureus subsp. aureus MW2
gucaaauuggacuuaugg

SEQ ID NO: 2107796 - RNA, 22 nt, Staphylococcus aureus subsp. aureus MW2
gucaaacggcacuaauauuuaa

SEQ ID NO: 2107797 - RNA, 17 nt, Staphylococcus aureus subsp. aureus MW2
gucgaauauaauuuuuu

SEQ ID NO: 2107798 - RNA, 15 nt, Staphylococcus aureus subsp. aureus MW2
guccgauuugauaaa

SEQ ID NO: 2107799 - RNA, 20 nt, Staphylococcus aureus subsp. aureus MW2
guccgauuuaauauugaaua

SEQ ID NO: 2107800 - RNA, 14 nt, Staphylococcus aureus subsp. aureus MW2
guccucuaaaacau

SEQ ID NO: 2107801 - RNA, 19 nt, Staphylococcus aureus subsp. aureus MW2
gucuaauguuggaaaaggu

SEQ ID NO: 2107802 - RNA, 13 nt, Staphylococcus aureus subsp. aureus MW2
gucuacuaaauaa

SEQ ID NO: 2107803 - RNA, 16 nt, Staphylococcus aureus subsp. aureus MW2
gucuaaaaaaauguug

SEQ ID NO: 2107804 - RNA, 13 nt, Staphylococcus aureus subsp. aureus MW2
gucuaacaguuaa

SEQ ID NO: 2107805 - RNA, 22 nt, Staphylococcus aureus subsp. aureus MW2
gucguuuagacucaguugugcg

SEQ ID NO: 2107806 - RNA, 15 nt, Staphylococcus aureus subsp. aureus MW2
gucguacuuucaaau

SEQ ID NO: 2107807 - RNA, 16 nt, Staphylococcus aureus subsp. aureus MW2
gucacaaacaagaaua

SEQ ID NO: 2107808 - RNA, 21 nt, Staphylococcus aureus subsp. aureus MW2
gucacuuuauuaaauaacuca

SEQ ID NO: 2107809 - RNA, 15 nt, Staphylococcus aureus subsp. aureus MW2
gucagcuuacaauaa

SEQ ID NO: 2107810 - RNA, 15 nt, Staphylococcus aureus subsp. aureus MW2
guccgacaucauaaa

SEQ ID NO: 2107811 - RNA, 18 nt, Staphylococcus aureus subsp. aureus MW2
guccauaaucuuuauuaa

SEQ ID NO: 2107812 - RNA, 12 nt, Staphylococcus aureus subsp. aureus MW2
gucaugccuuca

SEQ ID NO: 2107813 - RNA, 23 nt, Staphylococcus aureus subsp. aureus MW2
gucaugaauuuucaucauuaaac

SEQ ID NO: 2107814 - RNA, 13 nt, Staphylococcus aureus subsp. aureus MW2
gucauaaaauacc

SEQ ID NO: 2107815 - RNA, 18 nt, Staphylococcus aureus subsp. aureus MW2
gucauaauagauaaugca

SEQ ID NO: 2107816 - RNA, 17 nt, Staphylococcus aureus subsp. aureus MW2
gucauaaauauaaaaua

SEQ ID NO: 2107817 - RNA, 14 nt, Staphylococcus aureus subsp. aureus MW2
gucauaccuuuuaa

SEQ ID NO: 2107818 - RNA, 22 nt, Staphylococcus aureus subsp. aureus MW2
gucauaauuuagaagauuagau

SEQ ID NO: 2107819 - RNA, 20 nt, Staphylococcus aureus subsp. aureus MW2
gucauaguauacauaauuca

SEQ ID NO: 2107820 - RNA, 16 nt, Staphylococcus aureus subsp. aureus MW2
gucauuugauuuaaaa

SEQ ID NO: 2107821 - RNA, 13 nt, Staphylococcus aureus subsp. aureus MW2
gugccuuuuguua

SEQ ID NO: 2107822 - RNA, 17 nt, Staphylococcus aureus subsp. aureus MW2
gugcgaauaauaauaca

SEQ ID NO: 2107823 - RNA, 14 nt, Staphylococcus aureus subsp. aureus MW2
gugccauuaaaauu

SEQ ID NO: 2107824 - RNA, 21 nt, Staphylococcus aureus subsp. aureus MW2
aaauauacuucuauuaaauga

SEQ ID NO: 2107825 - RNA, 12 nt, Staphylococcus aureus subsp. aureus MW2
gugcaugacgau

SEQ ID NO: 2107826 - RNA, 18 nt, Staphylococcus aureus subsp. aureus MW2
aaauauaguaauaaaagu

SEQ ID NO: 2107827 - RNA, 21 nt, Staphylococcus aureus subsp. aureus MW2
aaauauagugauugaacaaaa

SEQ ID NO: 2107828 - RNA, 17 nt, Staphylococcus aureus subsp. aureus MW2
aaauauaguaauaaaag

SEQ ID NO: 2107829 - RNA, 22 nt, Staphylococcus aureus subsp. aureus MW2
gugauuuuggaacauauucaua

SEQ ID NO: 2107830 - RNA, 18 nt, Staphylococcus aureus subsp. aureus MW2
gugauuacauucuauacu

SEQ ID NO: 2107831 - RNA, 14 nt, Staphylococcus aureus subsp. aureus MW2
gugaugguaaauca

SEQ ID NO: 2107832 - RNA, 21 nt, Staphylococcus aureus subsp. aureus MW2
gucuauuguaaaaacguucaa

SEQ ID NO: 2107833 - RNA, 22 nt, Staphylococcus aureus subsp. aureus MW2
gucuaugaauaauguuuucauu

SEQ ID NO: 2107834 - RNA, 10 nt, Staphylococcus aureus subsp. aureus MW2
gucuaugaau

SEQ ID NO: 2107835 - RNA, 17 nt, Staphylococcus aureus subsp. aureus MW2
gucuauauauauuuaaa

SEQ ID NO: 2107836 - RNA, 21 nt, Staphylococcus aureus subsp. aureus MW2
gucuauauauauuuaaaucaa

SEQ ID NO: 2107837 - RNA, 21 nt, Staphylococcus aureus subsp. aureus MW2
gugauagaaguuuuuugauua

SEQ ID NO: 2107838 - RNA, 21 nt, Staphylococcus aureus subsp. aureus MW2
gugauauuaauugaaaaacca

SEQ ID NO: 2107839 - RNA, 13 nt, Staphylococcus aureus subsp. aureus MW2
gugauagucuucg

SEQ ID NO: 2107840 - RNA, 15 nt, Staphylococcus aureus subsp. aureus MW2
gugcgugaagagaug

SEQ ID NO: 2107841 - RNA, 15 nt, Staphylococcus aureus subsp. aureus MW2
gugcgguuauuuaua

SEQ ID NO: 2107842 - RNA, 12 nt, Staphylococcus aureus subsp. aureus MW2
gugcuuuuucaa

SEQ ID NO: 2107843 - RNA, 15 nt, Staphylococcus aureus subsp. aureus MW2
gugcuuuuuauguua

SEQ ID NO: 2107844 - RNA, 12 nt, Staphylococcus aureus subsp. aureus MW2
gugcuuuuucau

SEQ ID NO: 2107845 - RNA, 21 nt, Staphylococcus aureus subsp. aureus MW2
gugcuuuuucauaaauauuua

SEQ ID NO: 2107846 - RNA, 16 nt, Staphylococcus aureus subsp. aureus MW2
gugcuuguaaaauuuu

SEQ ID NO: 2107847 - RNA, 20 nt, Staphylococcus aureus subsp. aureus MW2
gugcuauuaauuugauaaau

SEQ ID NO: 2107848 - RNA, 14 nt, Staphylococcus aureus subsp. aureus MW2
guguauauuauuuu

SEQ ID NO: 2107849 - RNA, 22 nt, Staphylococcus aureus subsp. aureus MW2
guguaugauagaauacuaaaag

SEQ ID NO: 2107850 - RNA, 22 nt, Staphylococcus aureus subsp. aureus MW2
guguauauuauuuugcuuuaau

SEQ ID NO: 2107851 - RNA, 17 nt, Staphylococcus aureus subsp. aureus MW2
guguauucauuuuaaau

SEQ ID NO: 2107852 - RNA, 20 nt, Staphylococcus aureus subsp. aureus MW2
guguaaucucguuuuuacau

SEQ ID NO: 2107853 - RNA, 21 nt, Staphylococcus aureus subsp. aureus MW2
guguaaauuugacuauugaaa

SEQ ID NO: 2107854 - RNA, 13 nt, Staphylococcus aureus subsp. aureus MW2
guguaaacuagac

SEQ ID NO: 2107855 - RNA, 23 nt, Staphylococcus aureus subsp. aureus MW2
gugguuuucuuuauuuuaaacau

SEQ ID NO: 2107856 - RNA, 16 nt, Staphylococcus aureus subsp. aureus MW2
gugguaugacugcaaa

SEQ ID NO: 2107857 - RNA, 23 nt, Staphylococcus aureus subsp. aureus MW2
guggucuugugaguuaaccacuu

SEQ ID NO: 2107858 - RNA, 20 nt, Staphylococcus aureus subsp. aureus MW2
guggcuuuuuuuauggugug

SEQ ID NO: 2107859 - RNA, 15 nt, Staphylococcus aureus subsp. aureus MW2
gugggcuccaaacau

SEQ ID NO: 2107860 - RNA, 21 nt, Staphylococcus aureus subsp. aureus MW2
gugggcuccaaacauagagaa

SEQ ID NO: 2107861 - RNA, 14 nt, Staphylococcus aureus subsp. aureus MW2
guuaucuaaugauc

SEQ ID NO: 2107862 - RNA, 16 nt, Staphylococcus aureus subsp. aureus MW2
guuaucauuauucaua

SEQ ID NO: 2107863 - RNA, 15 nt, Staphylococcus aureus subsp. aureus MW2
guucaaaauacucaa

SEQ ID NO: 2107864 - RNA, 16 nt, Staphylococcus aureus subsp. aureus MW2
guuauuauaaaauaaa

SEQ ID NO: 2107865 - RNA, 15 nt, Staphylococcus aureus subsp. aureus MW2
guuauuauaaaauaa

SEQ ID NO: 2107866 - RNA, 16 nt, Staphylococcus aureus subsp. aureus MW2
guuauaaguacaaaua

SEQ ID NO: 2107867 - RNA, 23 nt, Staphylococcus aureus subsp. aureus MW2
guuauaaguacaaauaauacagg

SEQ ID NO: 2107868 - RNA, 20 nt, Staphylococcus aureus subsp. aureus MW2
guuagacucacuucuuaaaa

SEQ ID NO: 2107869 - RNA, 18 nt, Staphylococcus aureus subsp. aureus MW2
guuacagguuuuaaaauu

SEQ ID NO: 2107870 - RNA, 16 nt, Staphylococcus aureus subsp. aureus MW2
guuacauauugcauuu

SEQ ID NO: 2107871 - RNA, 13 nt, Staphylococcus aureus subsp. aureus MW2
guuaaauucaucu

SEQ ID NO: 2107872 - RNA, 19 nt, Staphylococcus aureus subsp. aureus MW2
guuaauaacccauuuucaa

SEQ ID NO: 2107873 - RNA, 13 nt, Staphylococcus aureus subsp. aureus MW2
guuaauauaauua

SEQ ID NO: 2107874 - RNA, 13 nt, Staphylococcus aureus subsp. aureus MW2
guuaauacaacca

SEQ ID NO: 2107875 - RNA, 21 nt, Staphylococcus aureus subsp. aureus MW2
guuaauauaauuaaacauuua

SEQ ID NO: 2107876 - RNA, 18 nt, Staphylococcus aureus subsp. aureus MW2
guuaauauaauuaaacau

SEQ ID NO: 2107877 - RNA, 17 nt, Staphylococcus aureus subsp. aureus MW2
guuaaucccguuauauc

SEQ ID NO: 2107878 - RNA, 19 nt, Staphylococcus aureus subsp. aureus MW2
guguuucuuuuauuuucau

SEQ ID NO: 2107879 - RNA, 11 nt, Staphylococcus aureus subsp. aureus MW2
guguuugcuuu

SEQ ID NO: 2107880 - RNA, 15 nt, Staphylococcus aureus subsp. aureus MW2
guuaaaguuuuguuc

SEQ ID NO: 2107881 - RNA, 18 nt, Staphylococcus aureus subsp. aureus MW2
guuaaacuagaaaacaua

SEQ ID NO: 2107882 - RNA, 12 nt, Staphylococcus aureus subsp. aureus MW2
guguuggggccc

SEQ ID NO: 2107883 - RNA, 13 nt, Staphylococcus aureus subsp. aureus MW2
guguuggggccca

SEQ ID NO: 2107884 - RNA, 21 nt, Staphylococcus aureus subsp. aureus MW2
guguuggggcccauccccaac

SEQ ID NO: 2107885 - RNA, 14 nt, Staphylococcus aureus subsp. aureus MW2
guucggaugagaaa

SEQ ID NO: 2107886 - RNA, 15 nt, Staphylococcus aureus subsp. aureus MW2
guuccguugaauuaa

SEQ ID NO: 2107887 - RNA, 16 nt, Staphylococcus aureus subsp. aureus MW2
guucauguuuaaaaua

SEQ ID NO: 2107888 - RNA, 17 nt, Staphylococcus aureus subsp. aureus MW2
guucagguguaucuuug

SEQ ID NO: 2107889 - RNA, 22 nt, Staphylococcus aureus subsp. aureus MW2
guucauaaugaucaaguaguua

SEQ ID NO: 2107890 - RNA, 12 nt, Staphylococcus aureus subsp. aureus MW2
guucaguuguuu

SEQ ID NO: 2107891 - RNA, 18 nt, Staphylococcus aureus subsp. aureus MW2
guucaucaaacaacauca

SEQ ID NO: 2107892 - RNA, 13 nt, Staphylococcus aureus subsp. aureus MW2
guucaucaaacaa

SEQ ID NO: 2107893 - RNA, 18 nt, Staphylococcus aureus subsp. aureus MW2
guucaagcuuuauuuuuu

SEQ ID NO: 2107894 - RNA, 15 nt, Staphylococcus aureus subsp. aureus MW2
guucaagcuuuauuu

SEQ ID NO: 2107895 - RNA, 19 nt, Staphylococcus aureus subsp. aureus MW2
guucaaucacuauauuuca

SEQ ID NO: 2107896 - RNA, 14 nt, Staphylococcus aureus subsp. aureus MW2
guucaauacuucuu

SEQ ID NO: 2107897 - RNA, 16 nt, Staphylococcus aureus subsp. aureus MW2
guucacuugguacacc

SEQ ID NO: 2107898 - RNA, 22 nt, Staphylococcus aureus subsp. aureus MW2
guucugcuaaucuucucauaaa

SEQ ID NO: 2107899 - RNA, 17 nt, Staphylococcus aureus subsp. aureus MW2
guugaaaaccucuuuuu

SEQ ID NO: 2107900 - RNA, 14 nt, Staphylococcus aureus subsp. aureus MW2
guugaaaaguauau

SEQ ID NO: 2107901 - RNA, 17 nt, Staphylococcus aureus subsp. aureus MW2
guucuugguauuuuuua

SEQ ID NO: 2107902 - RNA, 13 nt, Staphylococcus aureus subsp. aureus MW2
guucuugagcugu

SEQ ID NO: 2107903 - RNA, 15 nt, Staphylococcus aureus subsp. aureus MW2
guucuuauauugacu

SEQ ID NO: 2107904 - RNA, 20 nt, Staphylococcus aureus subsp. aureus MW2
guucuucacuaaaaauauau

SEQ ID NO: 2107905 - RNA, 19 nt, Staphylococcus aureus subsp. aureus MW2
guugauauauauuuugcaa

SEQ ID NO: 2107906 - RNA, 16 nt, Staphylococcus aureus subsp. aureus MW2
guugauguguugcauu

SEQ ID NO: 2107907 - RNA, 19 nt, Staphylococcus aureus subsp. aureus MW2
guugaugguuuaucuuuuu

SEQ ID NO: 2107908 - RNA, 12 nt, Staphylococcus aureus subsp. aureus MW2
guugauuuaaaa

SEQ ID NO: 2107909 - RNA, 17 nt, Staphylococcus aureus subsp. aureus MW2
guugauuugauuuaaau

SEQ ID NO: 2107910 - RNA, 18 nt, Staphylococcus aureus subsp. aureus MW2
guugcauaaucaauuuca

SEQ ID NO: 2107911 - RNA, 22 nt, Staphylococcus aureus subsp. aureus MW2
guugcaaauuggauaauuucuu

SEQ ID NO: 2107912 - RNA, 19 nt, Staphylococcus aureus subsp. aureus MW2
guugcauaaucaauuucac

SEQ ID NO: 2107913 - RNA, 15 nt, Staphylococcus aureus subsp. aureus MW2
guugaagcuaauuca

SEQ ID NO: 2107914 - RNA, 16 nt, Staphylococcus aureus subsp. aureus MW2
guugaauuaacaauau

SEQ ID NO: 2107915 - RNA, 22 nt, Staphylococcus aureus subsp. aureus MW2
guugaauaauuaauguuucuuc

SEQ ID NO: 2107916 - RNA, 15 nt, Staphylococcus aureus subsp. aureus MW2
guuuaaaguauaagg

SEQ ID NO: 2107917 - RNA, 14 nt, Staphylococcus aureus subsp. aureus MW2
guuuaaaaauaugu

SEQ ID NO: 2107918 - RNA, 14 nt, Staphylococcus aureus subsp. aureus MW2
guuuaaaaaacuac

SEQ ID NO: 2107919 - RNA, 13 nt, Staphylococcus aureus subsp. aureus MW2
guuguuucaauuc

SEQ ID NO: 2107920 - RNA, 13 nt, Staphylococcus aureus subsp. aureus MW2
guuguuucuccag

SEQ ID NO: 2107921 - RNA, 20 nt, Staphylococcus aureus subsp. aureus MW2
guuguugcaacuugugguug

SEQ ID NO: 2107922 - RNA, 16 nt, Staphylococcus aureus subsp. aureus MW2
guuguuauauaaagag

SEQ ID NO: 2107923 - RNA, 18 nt, Staphylococcus aureus subsp. aureus MW2
guuuaccgucuuuugcaa

SEQ ID NO: 2107924 - RNA, 18 nt, Staphylococcus aureus subsp. aureus MW2
guuuacaucaaaguguaa

SEQ ID NO: 2107925 - RNA, 20 nt, Staphylococcus aureus subsp. aureus MW2
guuuaauuugauuaaauuca

SEQ ID NO: 2107926 - RNA, 23 nt, Staphylococcus aureus subsp. aureus MW2
guuuaauuugauuaaauucaucu

SEQ ID NO: 2107927 - RNA, 15 nt, Staphylococcus aureus subsp. aureus MW2
guuuauaaucaguuu

SEQ ID NO: 2107928 - RNA, 23 nt, Staphylococcus aureus subsp. aureus MW2
guuuauaaucuuuuuuacuaaaa

SEQ ID NO: 2107929 - RNA, 20 nt, Staphylococcus aureus subsp. aureus MW2
guuuaguuaaguauuuuaau

SEQ ID NO: 2107930 - RNA, 19 nt, Staphylococcus aureus subsp. aureus MW2
guuuauuucugaaaacuua

SEQ ID NO: 2107931 - RNA, 23 nt, Staphylococcus aureus subsp. aureus MW2
guuuauaauuuaauugguuucac

SEQ ID NO: 2107932 - RNA, 17 nt, Staphylococcus aureus subsp. aureus MW2
guuuauuacauaauuua

SEQ ID NO: 2107933 - RNA, 20 nt, Staphylococcus aureus subsp. aureus MW2
guuuauuacauaauuuaucu

SEQ ID NO: 2107934 - RNA, 22 nt, Staphylococcus aureus subsp. aureus MW2
guugcccgcuuauugcauugua

SEQ ID NO: 2107935 - RNA, 12 nt, Staphylococcus aureus subsp. aureus MW2
guuggggccucg

SEQ ID NO: 2107936 - RNA, 22 nt, Staphylococcus aureus subsp. aureus MW2
guuguauaaaaauguauuaaau

SEQ ID NO: 2107937 - RNA, 13 nt, Staphylococcus aureus subsp. aureus MW2
guuguaccaauga

SEQ ID NO: 2107938 - RNA, 18 nt, Staphylococcus aureus subsp. aureus MW2
uaaaaagacggugaccuu

SEQ ID NO: 2107939 - RNA, 18 nt, Staphylococcus aureus subsp. aureus MW2
uaaaaagagaugggcuaa

SEQ ID NO: 2107940 - RNA, 18 nt, Staphylococcus aureus subsp. aureus MW2
uaaaaagagguuuucauu

SEQ ID NO: 2107941 - RNA, 13 nt, Staphylococcus aureus subsp. aureus MW2
uaaaaacuguuca

SEQ ID NO: 2107942 - RNA, 24 nt, Staphylococcus aureus subsp. aureus MW2
uaaaaagcguaaggaauuacacuu

SEQ ID NO: 2107943 - RNA, 12 nt, Staphylococcus aureus subsp. aureus MW2
uaaaaaguuuaa

SEQ ID NO: 2107944 - RNA, 20 nt, Staphylococcus aureus subsp. aureus MW2
uaaaaagugguuaauaacag

SEQ ID NO: 2107945 - RNA, 15 nt, Staphylococcus aureus subsp. aureus MW2
uaaaaaguuauuuaa

SEQ ID NO: 2107946 - RNA, 19 nt, Staphylococcus aureus subsp. aureus MW2
uaaaaaguuuaaaguauaa

SEQ ID NO: 2107947 - RNA, 18 nt, Staphylococcus aureus subsp. aureus MW2
uaaaaaaguugauuaaaa

SEQ ID NO: 2107948 - RNA, 13 nt, Staphylococcus aureus subsp. aureus MW2
uaaaaaaugaaug

SEQ ID NO: 2107949 - RNA, 18 nt, Staphylococcus aureus subsp. aureus MW2
uaaaaaaugcgcuuccaa

SEQ ID NO: 2107950 - RNA, 13 nt, Staphylococcus aureus subsp. aureus MW2
uaaaaaauuaaaa

SEQ ID NO: 2107951 - RNA, 22 nt, Staphylococcus aureus subsp. aureus MW2
uaaaaaaugcacugagcaacaa

SEQ ID NO: 2107952 - RNA, 20 nt, Staphylococcus aureus subsp. aureus MW2
uaaaaaauuuaaauaauaau

SEQ ID NO: 2107953 - RNA, 15 nt, Staphylococcus aureus subsp. aureus MW2
uaaaaacaaaagaaa

SEQ ID NO: 2107954 - RNA, 19 nt, Staphylococcus aureus subsp. aureus MW2
uaaaaaauuugcaugaaaa

SEQ ID NO: 2107955 - RNA, 23 nt, Staphylococcus aureus subsp. aureus MW2
uaaaaacggacaaguugcacauu

SEQ ID NO: 2107956 - RNA, 15 nt, Staphylococcus aureus subsp. aureus MW2
uaaaaacguucaauc

SEQ ID NO: 2107957 - RNA, 17 nt, Staphylococcus aureus subsp. aureus MW2
uaaaaacagcagugaag

SEQ ID NO: 2107958 - RNA, 22 nt, Staphylococcus aureus subsp. aureus MW2
uaaaaaccaguuugauuaaaau

SEQ ID NO: 2107959 - RNA, 13 nt, Staphylococcus aureus subsp. aureus MW2
uaaaaaaauuaau

SEQ ID NO: 2107960 - RNA, 14 nt, Staphylococcus aureus subsp. aureus MW2
uaaaaaaauuaaug

SEQ ID NO: 2107961 - RNA, 21 nt, Staphylococcus aureus subsp. aureus MW2
uaaaaaaaucacgcuaacauu

SEQ ID NO: 2107962 - RNA, 23 nt, Staphylococcus aureus subsp. aureus MW2
uaaaaaaacgucuuuccauuuau

SEQ ID NO: 2107963 - RNA, 16 nt, Staphylococcus aureus subsp. aureus MW2
uaaaaaacaaauguuu

SEQ ID NO: 2107964 - RNA, 16 nt, Staphylococcus aureus subsp. aureus MW2
uaaaaaacgguacaga

SEQ ID NO: 2107965 - RNA, 17 nt, Staphylococcus aureus subsp. aureus MW2
uaaaaaaccaauaaucc

SEQ ID NO: 2107966 - RNA, 16 nt, Staphylococcus aureus subsp. aureus MW2
uaaaaaaggaagaaca

SEQ ID NO: 2107967 - RNA, 11 nt, Staphylococcus aureus subsp. aureus MW2
uaaaaaaggaa

SEQ ID NO: 2107968 - RNA, 21 nt, Staphylococcus aureus subsp. aureus MW2
uaaaaaagcugauuucuauua

SEQ ID NO: 2107969 - RNA, 23 nt, Staphylococcus aureus subsp. aureus MW2
uaaaaaagcugauuucuauuaau

SEQ ID NO: 2107970 - RNA, 21 nt, Staphylococcus aureus subsp. aureus MW2
guuuuuugauuguaauaauaa

SEQ ID NO: 2107971 - RNA, 13 nt, Staphylococcus aureus subsp. aureus MW2
guuuuugaaaugu

SEQ ID NO: 2107972 - RNA, 14 nt, Staphylococcus aureus subsp. aureus MW2
guuuuuaaauaauc

SEQ ID NO: 2107973 - RNA, 18 nt, Staphylococcus aureus subsp. aureus MW2
guuuuaaacuuauuaauu

SEQ ID NO: 2107974 - RNA, 17 nt, Staphylococcus aureus subsp. aureus MW2
guuuuaaauugaaaugu

SEQ ID NO: 2107975 - RNA, 13 nt, Staphylococcus aureus subsp. aureus MW2
guuuuaaauuuua

SEQ ID NO: 2107976 - RNA, 13 nt, Staphylococcus aureus subsp. aureus MW2
guuuuaauuucuu

SEQ ID NO: 2107977 - RNA, 23 nt, Staphylococcus aureus subsp. aureus MW2
guuuuacaugauuaaugaugcga

SEQ ID NO: 2107978 - RNA, 19 nt, Staphylococcus aureus subsp. aureus MW2
guuuuaagacuuuaaaauu

SEQ ID NO: 2107979 - RNA, 15 nt, Staphylococcus aureus subsp. aureus MW2
aaaucagcuuuucuu

SEQ ID NO: 2107980 - RNA, 17 nt, Staphylococcus aureus subsp. aureus MW2
aaaucagcuuuuuuaca

SEQ ID NO: 2107981 - RNA, 19 nt, Staphylococcus aureus subsp. aureus MW2
guuugaacaacaucuuuug

SEQ ID NO: 2107982 - RNA, 20 nt, Staphylococcus aureus subsp. aureus MW2
guuugaagaccuucuaaaau

SEQ ID NO: 2107983 - RNA, 21 nt, Staphylococcus aureus subsp. aureus MW2
guuugaagaccuucuaaaauc

SEQ ID NO: 2107984 - RNA, 21 nt, Staphylococcus aureus subsp. aureus MW2
guuucaaaaucaauugaaaaa

SEQ ID NO: 2107985 - RNA, 17 nt, Staphylococcus aureus subsp. aureus MW2
guuuauuuuuuuagaag

SEQ ID NO: 2107986 - RNA, 21 nt, Staphylococcus aureus subsp. aureus MW2
guuuauuuuuaaucuucaucu

SEQ ID NO: 2107987 - RNA, 13 nt, Staphylococcus aureus subsp. aureus MW2
guuuauuuuaaau

SEQ ID NO: 2107988 - RNA, 16 nt, Staphylococcus aureus subsp. aureus MW2
guuuauuuuaaauuua

SEQ ID NO: 2107989 - RNA, 12 nt, Staphylococcus aureus subsp. aureus MW2
guuuauuuuaau

SEQ ID NO: 2107990 - RNA, 18 nt, Staphylococcus aureus subsp. aureus MW2
guuucuuguucuaaaaaa

SEQ ID NO: 2107991 - RNA, 21 nt, Staphylococcus aureus subsp. aureus MW2
guuugaauguuuuugauagua

SEQ ID NO: 2107992 - RNA, 22 nt, Staphylococcus aureus subsp. aureus MW2
guuugacacauuauugaaguuu

SEQ ID NO: 2107993 - RNA, 23 nt, Staphylococcus aureus subsp. aureus MW2
guuugacaaagcuaaagugaagu

SEQ ID NO: 2107994 - RNA, 14 nt, Staphylococcus aureus subsp. aureus MW2
guuugauuaaaauc

SEQ ID NO: 2107995 - RNA, 15 nt, Staphylococcus aureus subsp. aureus MW2
guuugcaacauauuu

SEQ ID NO: 2107996 - RNA, 22 nt, Staphylococcus aureus subsp. aureus MW2
guuuggaugaacaaaauaacau

SEQ ID NO: 2107997 - RNA, 13 nt, Staphylococcus aureus subsp. aureus MW2
guuuuuaaaauua

SEQ ID NO: 2107998 - RNA, 15 nt, Staphylococcus aureus subsp. aureus MW2
guuuucuuaaacgcu

SEQ ID NO: 2107999 - RNA, 17 nt, Staphylococcus aureus subsp. aureus MW2
guuuuaucuacaguuuu

SEQ ID NO: 2108000 - RNA, 13 nt, Staphylococcus aureus subsp. aureus MW2
guuuuaucauaac

SEQ ID NO: 2108001 - RNA, 18 nt, Staphylococcus aureus subsp. aureus MW2
guuuuauucgauaauaua

SEQ ID NO: 2108002 - RNA, 12 nt, Staphylococcus aureus subsp. aureus MW2
guuuuauucaau

SEQ ID NO: 2108003 - RNA, 17 nt, Staphylococcus aureus subsp. aureus MW2
guuuuauuaaugaagcu

SEQ ID NO: 2108004 - RNA, 22 nt, Staphylococcus aureus subsp. aureus MW2
guuuuauuaauucugauuaugu

SEQ ID NO: 2108005 - RNA, 15 nt, Staphylococcus aureus subsp. aureus MW2
aaaucauuaauaauu

SEQ ID NO: 2108006 - RNA, 19 nt, Staphylococcus aureus subsp. aureus MW2
aaaucauuaauaauuaaac

SEQ ID NO: 2108007 - RNA, 13 nt, Staphylococcus aureus subsp. aureus MW2
aaaucauuaauaa

SEQ ID NO: 2108008 - RNA, 20 nt, Staphylococcus aureus subsp. aureus MW2
aaaucaugaaauuaaaaaca

SEQ ID NO: 2108009 - RNA, 20 nt, Staphylococcus aureus subsp. aureus MW2
aaaucaucuuaacaauuuua

SEQ ID NO: 2108010 - RNA, 20 nt, Staphylococcus aureus subsp. aureus MW2
aaaucaucuucaguuaguuu

SEQ ID NO: 2108011 - RNA, 11 nt, Staphylococcus aureus subsp. aureus MW2
aaaucaucuua

SEQ ID NO: 2108012 - RNA, 20 nt, Staphylococcus aureus subsp. aureus MW2
aaaucaucguauuucauaua

SEQ ID NO: 2108013 - RNA, 13 nt, Staphylococcus aureus subsp. aureus MW2
aaaucaguaauau

SEQ ID NO: 2108014 - RNA, 19 nt, Staphylococcus aureus subsp. aureus MW2
aaaucaguuaggaugaaaa

SEQ ID NO: 2108015 - RNA, 13 nt, Staphylococcus aureus subsp. aureus MW2
uaaaaauauauuu

SEQ ID NO: 2108016 - RNA, 20 nt, Staphylococcus aureus subsp. aureus MW2
uaaaaauaguucuuuaaauu

SEQ ID NO: 2108017 - RNA, 14 nt, Staphylococcus aureus subsp. aureus MW2
uaaaaauaguaaag

SEQ ID NO: 2108018 - RNA, 17 nt, Staphylococcus aureus subsp. aureus MW2
uaaaaauagaaaaaaca

SEQ ID NO: 2108019 - RNA, 16 nt, Staphylococcus aureus subsp. aureus MW2
uaaaaaucuuaugaug

SEQ ID NO: 2108020 - RNA, 20 nt, Staphylococcus aureus subsp. aureus MW2
uaaaaaucuacauaugaaaa

SEQ ID NO: 2108021 - RNA, 15 nt, Staphylococcus aureus subsp. aureus MW2
uaaaaaucucaaaau

SEQ ID NO: 2108022 - RNA, 16 nt, Staphylococcus aureus subsp. aureus MW2
uaaaaaucucaaaauu

SEQ ID NO: 2108023 - RNA, 15 nt, Staphylococcus aureus subsp. aureus MW2
uaaaaauccucacaa

SEQ ID NO: 2108024 - RNA, 19 nt, Staphylococcus aureus subsp. aureus MW2
uaaaaauccacacauuaag

SEQ ID NO: 2108025 - RNA, 14 nt, Staphylococcus aureus subsp. aureus MW2
uaaaaaucauaaau

SEQ ID NO: 2108026 - RNA, 19 nt, Staphylococcus aureus subsp. aureus MW2
uaaaaaucauaaauaacac

SEQ ID NO: 2108027 - RNA, 21 nt, Staphylococcus aureus subsp. aureus MW2
uaaaaauccuaugaauaaauu

SEQ ID NO: 2108028 - RNA, 21 nt, Staphylococcus aureus subsp. aureus MW2
uaaaaaucuuggugauagucu

SEQ ID NO: 2108029 - RNA, 12 nt, Staphylococcus aureus subsp. aureus MW2
uaaaaaugaaaa

SEQ ID NO: 2108030 - RNA, 13 nt, Staphylococcus aureus subsp. aureus MW2
uaaaaauguaaau

SEQ ID NO: 2108031 - RNA, 15 nt, Staphylococcus aureus subsp. aureus MW2
uaaaaauguauuaaa

SEQ ID NO: 2108032 - RNA, 23 nt, Staphylococcus aureus subsp. aureus MW2
uaaaaauguauuaaauaugcacu

SEQ ID NO: 2108033 - RNA, 17 nt, Staphylococcus aureus subsp. aureus MW2
uaaaaauuaaguaauag

SEQ ID NO: 2108034 - RNA, 15 nt, Staphylococcus aureus subsp. aureus MW2
uaaaaauuuaugucu

SEQ ID NO: 2108035 - RNA, 15 nt, Staphylococcus aureus subsp. aureus MW2
uaaaaauuauauaaa

SEQ ID NO: 2108036 - RNA, 14 nt, Staphylococcus aureus subsp. aureus MW2
uaaaaauugaauua

SEQ ID NO: 2108037 - RNA, 19 nt, Staphylococcus aureus subsp. aureus MW2
uaaaaauugauauugcaaa

SEQ ID NO: 2108038 - RNA, 13 nt, Staphylococcus aureus subsp. aureus MW2
uaaaaauucugga

SEQ ID NO: 2108039 - RNA, 15 nt, Staphylococcus aureus subsp. aureus MW2
uaaaacaaugauuaa

SEQ ID NO: 2108040 - RNA, 19 nt, Staphylococcus aureus subsp. aureus MW2
uaaaacaaugauuaaaauu

SEQ ID NO: 2108041 - RNA, 13 nt, Staphylococcus aureus subsp. aureus MW2
uaaaacaauaaua

SEQ ID NO: 2108042 - RNA, 15 nt, Staphylococcus aureus subsp. aureus MW2
uaaaacaauaauaau

SEQ ID NO: 2108043 - RNA, 20 nt, Staphylococcus aureus subsp. aureus MW2
uaaaacaaauucauauuaac

SEQ ID NO: 2108044 - RNA, 20 nt, Staphylococcus aureus subsp. aureus MW2
uaaaacaaaaccaaaauacu

SEQ ID NO: 2108045 - RNA, 22 nt, Staphylococcus aureus subsp. aureus MW2
uaaaacauucccuuaauaauaa

SEQ ID NO: 2108046 - RNA, 14 nt, Staphylococcus aureus subsp. aureus MW2
uaaaacaucauuca

SEQ ID NO: 2108047 - RNA, 18 nt, Staphylococcus aureus subsp. aureus MW2
uaaaacagcaaauaaaau

SEQ ID NO: 2108048 - RNA, 21 nt, Staphylococcus aureus subsp. aureus MW2
uaaaacagcaaauaaaaucau

SEQ ID NO: 2108049 - RNA, 19 nt, Staphylococcus aureus subsp. aureus MW2
uaaaagccaucuuaccuuu

SEQ ID NO: 2108050 - RNA, 18 nt, Staphylococcus aureus subsp. aureus MW2
uaaaagccaacacauaaa

SEQ ID NO: 2108051 - RNA, 19 nt, Staphylococcus aureus subsp. aureus MW2
uaaaagcaacaaauauaau

SEQ ID NO: 2108052 - RNA, 23 nt, Staphylococcus aureus subsp. aureus MW2
uaaaagaguacauuuauuuaaug

SEQ ID NO: 2108053 - RNA, 20 nt, Staphylococcus aureus subsp. aureus MW2
uaaaacuuauaacugauaau

SEQ ID NO: 2108054 - RNA, 20 nt, Staphylococcus aureus subsp. aureus MW2
uaaaacuuguuguuauuuau

SEQ ID NO: 2108055 - RNA, 13 nt, Staphylococcus aureus subsp. aureus MW2
uaaaacuuuuuca

SEQ ID NO: 2108056 - RNA, 19 nt, Staphylococcus aureus subsp. aureus MW2
uaaaagagaauauaaaaua

SEQ ID NO: 2108057 - RNA, 19 nt, Staphylococcus aureus subsp. aureus MW2
uaaaagacagaaauuacua

SEQ ID NO: 2108058 - RNA, 16 nt, Staphylococcus aureus subsp. aureus MW2
uaaaacuuauaacuga

SEQ ID NO: 2108059 - RNA, 16 nt, Staphylococcus aureus subsp. aureus MW2
uaaaacuaaugauagu

SEQ ID NO: 2108060 - RNA, 15 nt, Staphylococcus aureus subsp. aureus MW2
uaaaacuaaugauag

SEQ ID NO: 2108061 - RNA, 15 nt, Staphylococcus aureus subsp. aureus MW2
uaaaacgcuucauau

SEQ ID NO: 2108062 - RNA, 14 nt, Staphylococcus aureus subsp. aureus MW2
uaaaaccuucaauc

SEQ ID NO: 2108063 - RNA, 23 nt, Staphylococcus aureus subsp. aureus MW2
uaaaaccuuacccaaaaaauugu

SEQ ID NO: 2108064 - RNA, 19 nt, Staphylococcus aureus subsp. aureus MW2
uaaaaccgguacuuucauu

SEQ ID NO: 2108065 - RNA, 16 nt, Staphylococcus aureus subsp. aureus MW2
uaaaacgauaagaauu

SEQ ID NO: 2108066 - RNA, 15 nt, Staphylococcus aureus subsp. aureus MW2
uaaaacgaagucagu

SEQ ID NO: 2108067 - RNA, 19 nt, Staphylococcus aureus subsp. aureus MW2
uaaaacgaaguuauuuauu

SEQ ID NO: 2108068 - RNA, 14 nt, Staphylococcus aureus subsp. aureus MW2
uaaaacgauuaaua

SEQ ID NO: 2108069 - RNA, 16 nt, Staphylococcus aureus subsp. aureus MW2
uaaaauaaucgguaau

SEQ ID NO: 2108070 - RNA, 11 nt, Staphylococcus aureus subsp. aureus MW2
uaaaauaauga

SEQ ID NO: 2108071 - RNA, 16 nt, Staphylococcus aureus subsp. aureus MW2
uaaaauaauuaaauaa

SEQ ID NO: 2108072 - RNA, 20 nt, Staphylococcus aureus subsp. aureus MW2
uaaaauaauuaaauaaaaau

SEQ ID NO: 2108073 - RNA, 16 nt, Staphylococcus aureus subsp. aureus MW2
uaaaauaauagauaau

SEQ ID NO: 2108074 - RNA, 18 nt, Staphylococcus aureus subsp. aureus MW2
uaaaauaauagauaauag

SEQ ID NO: 2108075 - RNA, 13 nt, Staphylococcus aureus subsp. aureus MW2
uaaaauaaguauu

SEQ ID NO: 2108076 - RNA, 23 nt, Staphylococcus aureus subsp. aureus MW2
uaaaauaacugcuaauuuuuuca

SEQ ID NO: 2108077 - RNA, 19 nt, Staphylococcus aureus subsp. aureus MW2
uaaaauaacuaagugaauu

SEQ ID NO: 2108078 - RNA, 18 nt, Staphylococcus aureus subsp. aureus MW2
uaaaauaagauauauaau

SEQ ID NO: 2108079 - RNA, 13 nt, Staphylococcus aureus subsp. aureus MW2
uaaaauaaaucau

SEQ ID NO: 2108080 - RNA, 23 nt, Staphylococcus aureus subsp. aureus MW2
uaaaauaaaccacgcacaucuaa

SEQ ID NO: 2108081 - RNA, 14 nt, Staphylococcus aureus subsp. aureus MW2
uaaaauauaugaau

SEQ ID NO: 2108082 - RNA, 21 nt, Staphylococcus aureus subsp. aureus MW2
uaaaauauauuuguaguaagu

SEQ ID NO: 2108083 - RNA, 14 nt, Staphylococcus aureus subsp. aureus MW2
uaaaauauaucuua

SEQ ID NO: 2108084 - RNA, 21 nt, Staphylococcus aureus subsp. aureus MW2
uaaaauagaguagacguaagu

SEQ ID NO: 2108085 - RNA, 15 nt, Staphylococcus aureus subsp. aureus MW2
uaaaauagcugcaau

SEQ ID NO: 2108086 - RNA, 20 nt, Staphylococcus aureus subsp. aureus MW2
uaaaauacccauuuuuuucc

SEQ ID NO: 2108087 - RNA, 19 nt, Staphylococcus aureus subsp. aureus MW2
uaaaauacuguuuucauuu

SEQ ID NO: 2108088 - RNA, 17 nt, Staphylococcus aureus subsp. aureus MW2
uaaaagucgauaaauau

SEQ ID NO: 2108089 - RNA, 16 nt, Staphylococcus aureus subsp. aureus MW2
uaaaaguauagauaga

SEQ ID NO: 2108090 - RNA, 21 nt, Staphylococcus aureus subsp. aureus MW2
uaaaaguggccuuuuaaacaa

SEQ ID NO: 2108091 - RNA, 18 nt, Staphylococcus aureus subsp. aureus MW2
uaaaauaaaaaaugcacu

SEQ ID NO: 2108092 - RNA, 20 nt, Staphylococcus aureus subsp. aureus MW2
uaaaauaaaaaaugcacuga

SEQ ID NO: 2108093 - RNA, 12 nt, Staphylococcus aureus subsp. aureus MW2
uaaaauaaaaaa

SEQ ID NO: 2108094 - RNA, 18 nt, Staphylococcus aureus subsp. aureus MW2
uaaaaguuucccaagcau

SEQ ID NO: 2108095 - RNA, 15 nt, Staphylococcus aureus subsp. aureus MW2
uaaaauaaaaugcaa

SEQ ID NO: 2108096 - RNA, 12 nt, Staphylococcus aureus subsp. aureus MW2
uaaaauaaacca

SEQ ID NO: 2108097 - RNA, 19 nt, Staphylococcus aureus subsp. aureus MW2
uaaaaggggcuuuuaauua

SEQ ID NO: 2108098 - RNA, 21 nt, Staphylococcus aureus subsp. aureus MW2
uaaaaggggcuuuuaauuaau

SEQ ID NO: 2108099 - RNA, 15 nt, Staphylococcus aureus subsp. aureus MW2
uaaaaggcgaaacau

SEQ ID NO: 2108100 - RNA, 20 nt, Staphylococcus aureus subsp. aureus MW2
uaaaaggcgaaacauuaaaa

SEQ ID NO: 2108101 - RNA, 17 nt, Staphylococcus aureus subsp. aureus MW2
uaaaaggacucauacau

SEQ ID NO: 2108102 - RNA, 20 nt, Staphylococcus aureus subsp. aureus MW2
uaaaauggugcgaauaauaa

SEQ ID NO: 2108103 - RNA, 20 nt, Staphylococcus aureus subsp. aureus MW2
uaaaaugcuacaauuuccua

SEQ ID NO: 2108104 - RNA, 21 nt, Staphylococcus aureus subsp. aureus MW2
uaaaauuaaaccuacaacgaa

SEQ ID NO: 2108105 - RNA, 21 nt, Staphylococcus aureus subsp. aureus MW2
uaaaauuaacuuaaaauuuaa

SEQ ID NO: 2108106 - RNA, 17 nt, Staphylococcus aureus subsp. aureus MW2
uaaaauguuaauaauga

SEQ ID NO: 2108107 - RNA, 19 nt, Staphylococcus aureus subsp. aureus MW2
uaaaaugucuuugaaaaau

SEQ ID NO: 2108108 - RNA, 20 nt, Staphylococcus aureus subsp. aureus MW2
uaaaaugauaucugacauuu

SEQ ID NO: 2108109 - RNA, 16 nt, Staphylococcus aureus subsp. aureus MW2
uaaaaugaugauuuaa

SEQ ID NO: 2108110 - RNA, 17 nt, Staphylococcus aureus subsp. aureus MW2
uaaaaugauuguuuuaa

SEQ ID NO: 2108111 - RNA, 16 nt, Staphylococcus aureus subsp. aureus MW2
uaaaaugaaugaagac

SEQ ID NO: 2108112 - RNA, 18 nt, Staphylococcus aureus subsp. aureus MW2
uaaaaugaauaauuacua

SEQ ID NO: 2108113 - RNA, 15 nt, Staphylococcus aureus subsp. aureus MW2
uaaaaucaucguauu

SEQ ID NO: 2108114 - RNA, 19 nt, Staphylococcus aureus subsp. aureus MW2
uaaaauccaagugcuaaga

SEQ ID NO: 2108115 - RNA, 20 nt, Staphylococcus aureus subsp. aureus MW2
uaaaauccaagugcuaagag

SEQ ID NO: 2108116 - RNA, 19 nt, Staphylococcus aureus subsp. aureus MW2
uaaaauccuaagcaucgua

SEQ ID NO: 2108117 - RNA, 14 nt, Staphylococcus aureus subsp. aureus MW2
uaaaaucguuccaa

SEQ ID NO: 2108118 - RNA, 15 nt, Staphylococcus aureus subsp. aureus MW2
uaaaaucgcagcaau

SEQ ID NO: 2108119 - RNA, 22 nt, Staphylococcus aureus subsp. aureus MW2
uaaaaucuauaccauuccaaaa

SEQ ID NO: 2108120 - RNA, 21 nt, Staphylococcus aureus subsp. aureus MW2
uaaaaucacuugguaaaacau

SEQ ID NO: 2108121 - RNA, 16 nt, Staphylococcus aureus subsp. aureus MW2
uaaaaucagucauuca

SEQ ID NO: 2108122 - RNA, 19 nt, Staphylococcus aureus subsp. aureus MW2
uaaaauauugguaucucca

SEQ ID NO: 2108123 - RNA, 15 nt, Staphylococcus aureus subsp. aureus MW2
uaaaauauuuaacuu

SEQ ID NO: 2108124 - RNA, 16 nt, Staphylococcus aureus subsp. aureus MW2
uaaaauauuaauaaag

SEQ ID NO: 2108125 - RNA, 16 nt, Staphylococcus aureus subsp. aureus MW2
uaaaauaugacacaua

SEQ ID NO: 2108126 - RNA, 15 nt, Staphylococcus aureus subsp. aureus MW2
uaaaauaugauuuaa

SEQ ID NO: 2108127 - RNA, 13 nt, Staphylococcus aureus subsp. aureus MW2
uaaaggaauuuca

SEQ ID NO: 2108128 - RNA, 16 nt, Staphylococcus aureus subsp. aureus MW2
uaaagcgauuuccauc

SEQ ID NO: 2108129 - RNA, 22 nt, Staphylococcus aureus subsp. aureus MW2
uaaaggguguuuagauagcucu

SEQ ID NO: 2108130 - RNA, 19 nt, Staphylococcus aureus subsp. aureus MW2
uaaaggguguuuagauagc

SEQ ID NO: 2108131 - RNA, 15 nt, Staphylococcus aureus subsp. aureus MW2
uaaaggucuauauau

SEQ ID NO: 2108132 - RNA, 14 nt, Staphylococcus aureus subsp. aureus MW2
uaaaggcgauauuu

SEQ ID NO: 2108133 - RNA, 22 nt, Staphylococcus aureus subsp. aureus MW2
uaaagggaggaauuaauaauga

SEQ ID NO: 2108134 - RNA, 17 nt, Staphylococcus aureus subsp. aureus MW2
uaaagcaagcagugcua

SEQ ID NO: 2108135 - RNA, 17 nt, Staphylococcus aureus subsp. aureus MW2
uaaagauuuacccauua

SEQ ID NO: 2108136 - RNA, 16 nt, Staphylococcus aureus subsp. aureus MW2
uaaagcaguguugcau

SEQ ID NO: 2108137 - RNA, 20 nt, Staphylococcus aureus subsp. aureus MW2
uaaagagcaauuaaagucaa

SEQ ID NO: 2108138 - RNA, 16 nt, Staphylococcus aureus subsp. aureus MW2
uaaagagcaauuaaag

SEQ ID NO: 2108139 - RNA, 14 nt, Staphylococcus aureus subsp. aureus MW2
uaaagacuuuaugc

SEQ ID NO: 2108140 - RNA, 15 nt, Staphylococcus aureus subsp. aureus MW2
uaaauaaaacuaucu

SEQ ID NO: 2108141 - RNA, 13 nt, Staphylococcus aureus subsp. aureus MW2
uaaauaaaacuau

SEQ ID NO: 2108142 - RNA, 15 nt, Staphylococcus aureus subsp. aureus MW2
uaaauaaaaguucaa

SEQ ID NO: 2108143 - RNA, 16 nt, Staphylococcus aureus subsp. aureus MW2
uaaauaaacucaccaa

SEQ ID NO: 2108144 - RNA, 23 nt, Staphylococcus aureus subsp. aureus MW2
uaaauaaacucaccaaguucacu

SEQ ID NO: 2108145 - RNA, 21 nt, Staphylococcus aureus subsp. aureus MW2
uaaauaaaguccaauacaauu

SEQ ID NO: 2108146 - RNA, 15 nt, Staphylococcus aureus subsp. aureus MW2
uaaauaaagauucaa

SEQ ID NO: 2108147 - RNA, 20 nt, Staphylococcus aureus subsp. aureus MW2
uaaauaaagauucaauuaau

SEQ ID NO: 2108148 - RNA, 21 nt, Staphylococcus aureus subsp. aureus MW2
uaaauaaagauucaauuaaug

SEQ ID NO: 2108149 - RNA, 15 nt, Staphylococcus aureus subsp. aureus MW2
uaaauaaacaacugc

SEQ ID NO: 2108150 - RNA, 15 nt, Staphylococcus aureus subsp. aureus MW2
uaaauaaacauaaaa

SEQ ID NO: 2108151 - RNA, 23 nt, Staphylococcus aureus subsp. aureus MW2
uaaauaauguugucacuuggauu

SEQ ID NO: 2108152 - RNA, 19 nt, Staphylococcus aureus subsp. aureus MW2
uaaauaauuuaaauuaaaa

SEQ ID NO: 2108153 - RNA, 20 nt, Staphylococcus aureus subsp. aureus MW2
uaaauacaaagccuuaauau

SEQ ID NO: 2108154 - RNA, 19 nt, Staphylococcus aureus subsp. aureus MW2
uaaauaaucgaagauagag

SEQ ID NO: 2108155 - RNA, 20 nt, Staphylococcus aureus subsp. aureus MW2
uaaauaaugauaaauuaaag

SEQ ID NO: 2108156 - RNA, 17 nt, Staphylococcus aureus subsp. aureus MW2
uaaauacaauuucuuca

SEQ ID NO: 2108157 - RNA, 13 nt, Staphylococcus aureus subsp. aureus MW2
uaaauauugaaga

SEQ ID NO: 2108158 - RNA, 19 nt, Staphylococcus aureus subsp. aureus MW2
uaaauauugauauaaaaaa

SEQ ID NO: 2108159 - RNA, 14 nt, Staphylococcus aureus subsp. aureus MW2
uaaauauugauaua

SEQ ID NO: 2108160 - RNA, 14 nt, Staphylococcus aureus subsp. aureus MW2
uaaauauucuuauc

SEQ ID NO: 2108161 - RNA, 14 nt, Staphylococcus aureus subsp. aureus MW2
uaaauauuuagauu

SEQ ID NO: 2108162 - RNA, 18 nt, Staphylococcus aureus subsp. aureus MW2
uaaauauuggaauacucu

SEQ ID NO: 2108163 - RNA, 19 nt, Staphylococcus aureus subsp. aureus MW2
uaaauauuggaauacucuu

SEQ ID NO: 2108164 - RNA, 18 nt, Staphylococcus aureus subsp. aureus MW2
uaaauagcuucuuaaauc

SEQ ID NO: 2108165 - RNA, 19 nt, Staphylococcus aureus subsp. aureus MW2
uaaauagcuucuuaaauca

SEQ ID NO: 2108166 - RNA, 21 nt, Staphylococcus aureus subsp. aureus MW2
uaaauaggguaauagaucuau

SEQ ID NO: 2108167 - RNA, 21 nt, Staphylococcus aureus subsp. aureus MW2
uaaauacuugcucuaauucaa

SEQ ID NO: 2108168 - RNA, 21 nt, Staphylococcus aureus subsp. aureus MW2
uaaauacuuuugcaucacaga

SEQ ID NO: 2108169 - RNA, 22 nt, Staphylococcus aureus subsp. aureus MW2
uaaauacucauguaacguaaaa

SEQ ID NO: 2108170 - RNA, 18 nt, Staphylococcus aureus subsp. aureus MW2
uaaauacgccaaauacua

SEQ ID NO: 2108171 - RNA, 21 nt, Staphylococcus aureus subsp. aureus MW2
uaaauagacugccaauaaaau

SEQ ID NO: 2108172 - RNA, 16 nt, Staphylococcus aureus subsp. aureus MW2
uaaacacccaauaauu

SEQ ID NO: 2108173 - RNA, 17 nt, Staphylococcus aureus subsp. aureus MW2
uaaacacccaauaauug

SEQ ID NO: 2108174 - RNA, 15 nt, Staphylococcus aureus subsp. aureus MW2
uaaacauaaaaauau

SEQ ID NO: 2108175 - RNA, 22 nt, Staphylococcus aureus subsp. aureus MW2
uaaacauaaccuugcuuugcau

SEQ ID NO: 2108176 - RNA, 15 nt, Staphylococcus aureus subsp. aureus MW2
uaaacaguuuaauuc

SEQ ID NO: 2108177 - RNA, 18 nt, Staphylococcus aureus subsp. aureus MW2
uaaacaugaacaaucaga

SEQ ID NO: 2108178 - RNA, 23 nt, Staphylococcus aureus subsp. aureus MW2
uaaaauuuuuuucauaauuaaua

SEQ ID NO: 2108179 - RNA, 18 nt, Staphylococcus aureus subsp. aureus MW2
uaaaauuuguaauuuaaa

SEQ ID NO: 2108180 - RNA, 18 nt, Staphylococcus aureus subsp. aureus MW2
uaaaauuuugaagaagug

SEQ ID NO: 2108181 - RNA, 21 nt, Staphylococcus aureus subsp. aureus MW2
uaaaauuuucguguuaauaac

SEQ ID NO: 2108182 - RNA, 19 nt, Staphylococcus aureus subsp. aureus MW2
uaaacaaguugauaacuau

SEQ ID NO: 2108183 - RNA, 19 nt, Staphylococcus aureus subsp. aureus MW2
uaaacaauuccccaaagcc

SEQ ID NO: 2108184 - RNA, 20 nt, Staphylococcus aureus subsp. aureus MW2
uaaaauuacuugaauauuau

SEQ ID NO: 2108185 - RNA, 23 nt, Staphylococcus aureus subsp. aureus MW2
uaaaauuagggguggaaauauga

SEQ ID NO: 2108186 - RNA, 21 nt, Staphylococcus aureus subsp. aureus MW2
uaaaauuacgcaaagaaaaac

SEQ ID NO: 2108187 - RNA, 18 nt, Staphylococcus aureus subsp. aureus MW2
uaaaauuacuugaauauu

SEQ ID NO: 2108188 - RNA, 12 nt, Staphylococcus aureus subsp. aureus MW2
uaaaauuaucaa

SEQ ID NO: 2108189 - RNA, 19 nt, Staphylococcus aureus subsp. aureus MW2
uaaaauuauugacauugca

SEQ ID NO: 2108190 - RNA, 16 nt, Staphylococcus aureus subsp. aureus MW2
uaaaauuuaaaacaau

SEQ ID NO: 2108191 - RNA, 15 nt, Staphylococcus aureus subsp. aureus MW2
uaaaauuuaaaacaa

SEQ ID NO: 2108192 - RNA, 15 nt, Staphylococcus aureus subsp. aureus MW2
uaaaauuguauagaa

SEQ ID NO: 2108193 - RNA, 16 nt, Staphylococcus aureus subsp. aureus MW2
uaaaauuguauagaau

SEQ ID NO: 2108194 - RNA, 22 nt, Staphylococcus aureus subsp. aureus MW2
uaaaauugccaguaucucuuuu

SEQ ID NO: 2108195 - RNA, 20 nt, Staphylococcus aureus subsp. aureus MW2
uaaaauuggaacacgaaauu

SEQ ID NO: 2108196 - RNA, 16 nt, Staphylococcus aureus subsp. aureus MW2
uaaaauuuguuaauuu

SEQ ID NO: 2108197 - RNA, 17 nt, Staphylococcus aureus subsp. aureus MW2
uaaaauuuaaaacaaug

SEQ ID NO: 2108198 - RNA, 21 nt, Staphylococcus aureus subsp. aureus MW2
uaaacgcaauacgaauaucug

SEQ ID NO: 2108199 - RNA, 19 nt, Staphylococcus aureus subsp. aureus MW2
uaaaccucuaaauaaaauu

SEQ ID NO: 2108200 - RNA, 22 nt, Staphylococcus aureus subsp. aureus MW2
uaaaccgaggugucaauaaauu

SEQ ID NO: 2108201 - RNA, 20 nt, Staphylococcus aureus subsp. aureus MW2
uaaaccaucugugucagcau

SEQ ID NO: 2108202 - RNA, 21 nt, Staphylococcus aureus subsp. aureus MW2
uaaaccaucugugucagcauu

SEQ ID NO: 2108203 - RNA, 21 nt, Staphylococcus aureus subsp. aureus MW2
uaaacaugggcaaucacuccu

SEQ ID NO: 2108204 - RNA, 19 nt, Staphylococcus aureus subsp. aureus MW2
uaaaccagcugauuccauu

SEQ ID NO: 2108205 - RNA, 18 nt, Staphylococcus aureus subsp. aureus MW2
uaaacuuuggcaaaguca

SEQ ID NO: 2108206 - RNA, 19 nt, Staphylococcus aureus subsp. aureus MW2
uaaagaaacaugauugaaa

SEQ ID NO: 2108207 - RNA, 19 nt, Staphylococcus aureus subsp. aureus MW2
uaaacuaauagcauuugua

SEQ ID NO: 2108208 - RNA, 14 nt, Staphylococcus aureus subsp. aureus MW2
uaaacuuuaugaaa

SEQ ID NO: 2108209 - RNA, 12 nt, Staphylococcus aureus subsp. aureus MW2
uaaacuucuuuu

SEQ ID NO: 2108210 - RNA, 16 nt, Staphylococcus aureus subsp. aureus MW2
uaaacuucuauuaaua

SEQ ID NO: 2108211 - RNA, 19 nt, Staphylococcus aureus subsp. aureus MW2
uaaacguguacuucaauug

SEQ ID NO: 2108212 - RNA, 13 nt, Staphylococcus aureus subsp. aureus MW2
uaaccuuuaaaac

SEQ ID NO: 2108213 - RNA, 17 nt, Staphylococcus aureus subsp. aureus MW2
uaacgacccaaauuaua

SEQ ID NO: 2108214 - RNA, 19 nt, Staphylococcus aureus subsp. aureus MW2
uaaccauuucuuuuuucaa

SEQ ID NO: 2108215 - RNA, 22 nt, Staphylococcus aureus subsp. aureus MW2
uaaccaaucaucgcaaaaacau

SEQ ID NO: 2108216 - RNA, 19 nt, Staphylococcus aureus subsp. aureus MW2
uaaccaaggagaugauaac

SEQ ID NO: 2108217 - RNA, 14 nt, Staphylococcus aureus subsp. aureus MW2
uaaccgaugugauu

SEQ ID NO: 2108218 - RNA, 15 nt, Staphylococcus aureus subsp. aureus MW2
uaaccgcauacagau

SEQ ID NO: 2108219 - RNA, 22 nt, Staphylococcus aureus subsp. aureus MW2
uaacauaucgcgcaucaaaaau

SEQ ID NO: 2108220 - RNA, 19 nt, Staphylococcus aureus subsp. aureus MW2
uaacauagcuuaauaauua

SEQ ID NO: 2108221 - RNA, 21 nt, Staphylococcus aureus subsp. aureus MW2
uaacauagcuuaauaauuaau

SEQ ID NO: 2108222 - RNA, 15 nt, Staphylococcus aureus subsp. aureus MW2
uaacauaauaauaau

SEQ ID NO: 2108223 - RNA, 15 nt, Staphylococcus aureus subsp. aureus MW2
uaacauaagaaaaag

SEQ ID NO: 2108224 - RNA, 20 nt, Staphylococcus aureus subsp. aureus MW2
uaacauugaacgauaacaau

SEQ ID NO: 2108225 - RNA, 19 nt, Staphylococcus aureus subsp. aureus MW2
uaacauuuauuuuuucucu

SEQ ID NO: 2108226 - RNA, 22 nt, Staphylococcus aureus subsp. aureus MW2
uaacauuucugaugcuagcuuu

SEQ ID NO: 2108227 - RNA, 20 nt, Staphylococcus aureus subsp. aureus MW2
uaacauuuguccgauuuauu

SEQ ID NO: 2108228 - RNA, 13 nt, Staphylococcus aureus subsp. aureus MW2
uaacauuugucau

SEQ ID NO: 2108229 - RNA, 14 nt, Staphylococcus aureus subsp. aureus MW2
uaacauuuuuuuca

SEQ ID NO: 2108230 - RNA, 15 nt, Staphylococcus aureus subsp. aureus MW2
uaacauuuuuuucaa

SEQ ID NO: 2108231 - RNA, 19 nt, Staphylococcus aureus subsp. aureus MW2
uaacauucuucaaaaaaua

SEQ ID NO: 2108232 - RNA, 13 nt, Staphylococcus aureus subsp. aureus MW2
uaacauuuaaaaa

SEQ ID NO: 2108233 - RNA, 22 nt, Staphylococcus aureus subsp. aureus MW2
uaacauuacguucuaauaauuu

SEQ ID NO: 2108234 - RNA, 14 nt, Staphylococcus aureus subsp. aureus MW2
uaacaucacagaaa

SEQ ID NO: 2108235 - RNA, 20 nt, Staphylococcus aureus subsp. aureus MW2
uaacaucacagaaaauacau

SEQ ID NO: 2108236 - RNA, 21 nt, Staphylococcus aureus subsp. aureus MW2
uaacaucacagaaaauacauu

SEQ ID NO: 2108237 - RNA, 22 nt, Staphylococcus aureus subsp. aureus MW2
uaacaucacagaaaauacauuu

SEQ ID NO: 2108238 - RNA, 18 nt, Staphylococcus aureus subsp. aureus MW2
uaacagcuacaaauaaug

SEQ ID NO: 2108239 - RNA, 14 nt, Staphylococcus aureus subsp. aureus MW2
uaacaguauaaaua

SEQ ID NO: 2108240 - RNA, 16 nt, Staphylococcus aureus subsp. aureus MW2
uaacagugugaaauaa

SEQ ID NO: 2108241 - RNA, 17 nt, Staphylococcus aureus subsp. aureus MW2
uaacagugugaaauaau

SEQ ID NO: 2108242 - RNA, 19 nt, Staphylococcus aureus subsp. aureus MW2
uaacagugugaaauaauaa

SEQ ID NO: 2108243 - RNA, 23 nt, Staphylococcus aureus subsp. aureus MW2
uaacaaugcagcuguauuuaaua

SEQ ID NO: 2108244 - RNA, 15 nt, Staphylococcus aureus subsp. aureus MW2
uaacaauauuaaauu

SEQ ID NO: 2108245 - RNA, 17 nt, Staphylococcus aureus subsp. aureus MW2
uaaauuuaaaauaauag

SEQ ID NO: 2108246 - RNA, 23 nt, Staphylococcus aureus subsp. aureus MW2
uaaauuuaacucaacuuaaauau

SEQ ID NO: 2108247 - RNA, 14 nt, Staphylococcus aureus subsp. aureus MW2
uaaauuuaaaagaa

SEQ ID NO: 2108248 - RNA, 17 nt, Staphylococcus aureus subsp. aureus MW2
uaaauuuaaaagaaaaa

SEQ ID NO: 2108249 - RNA, 13 nt, Staphylococcus aureus subsp. aureus MW2
uaaauuuacaaaa

SEQ ID NO: 2108250 - RNA, 18 nt, Staphylococcus aureus subsp. aureus MW2
uaaauugcuugaaauuau

SEQ ID NO: 2108251 - RNA, 20 nt, Staphylococcus aureus subsp. aureus MW2
uaaauugcuugaaauuauua

SEQ ID NO: 2108252 - RNA, 17 nt, Staphylococcus aureus subsp. aureus MW2
uaaauuguaugaauaau

SEQ ID NO: 2108253 - RNA, 19 nt, Staphylococcus aureus subsp. aureus MW2
uaaauuguaugaauaauau

SEQ ID NO: 2108254 - RNA, 14 nt, Staphylococcus aureus subsp. aureus MW2
uaaauuguuuuaca

SEQ ID NO: 2108255 - RNA, 17 nt, Staphylococcus aureus subsp. aureus MW2
uaaauuguuuacuauac

SEQ ID NO: 2108256 - RNA, 14 nt, Staphylococcus aureus subsp. aureus MW2
uaaauuauauguuu

SEQ ID NO: 2108257 - RNA, 18 nt, Staphylococcus aureus subsp. aureus MW2
uaaauuaucuaaagaaau

SEQ ID NO: 2108258 - RNA, 23 nt, Staphylococcus aureus subsp. aureus MW2
uaaauuagugguuagcuauauuu

SEQ ID NO: 2108259 - RNA, 15 nt, Staphylococcus aureus subsp. aureus MW2
uaaauuauaaauagu

SEQ ID NO: 2108260 - RNA, 16 nt, Staphylococcus aureus subsp. aureus MW2
uaaauuagccauuuca

SEQ ID NO: 2108261 - RNA, 17 nt, Staphylococcus aureus subsp. aureus MW2
uaaauuagccauuucaa

SEQ ID NO: 2108262 - RNA, 16 nt, Staphylococcus aureus subsp. aureus MW2
uaaauuacaauuaauu

SEQ ID NO: 2108263 - RNA, 14 nt, Staphylococcus aureus subsp. aureus MW2
uaaauuacaauuag

SEQ ID NO: 2108264 - RNA, 21 nt, Staphylococcus aureus subsp. aureus MW2
uaaauuacuugcacaccagug

SEQ ID NO: 2108265 - RNA, 17 nt, Staphylococcus aureus subsp. aureus MW2
uaaauuacuauauuuaa

SEQ ID NO: 2108266 - RNA, 23 nt, Staphylococcus aureus subsp. aureus MW2
uaaauuacuauauuuaaauugga

SEQ ID NO: 2108267 - RNA, 14 nt, Staphylococcus aureus subsp. aureus MW2
uaaauuuaguaucu

SEQ ID NO: 2108268 - RNA, 15 nt, Staphylococcus aureus subsp. aureus MW2
uaaauuuauuauucg

SEQ ID NO: 2108269 - RNA, 23 nt, Staphylococcus aureus subsp. aureus MW2
uaaauuuauuauucguuucuuua

SEQ ID NO: 2108270 - RNA, 20 nt, Staphylococcus aureus subsp. aureus MW2
uaaauuucaaauauaaaaaa

SEQ ID NO: 2108271 - RNA, 22 nt, Staphylococcus aureus subsp. aureus MW2
uaaauuucgauuaauugaaugc

SEQ ID NO: 2108272 - RNA, 20 nt, Staphylococcus aureus subsp. aureus MW2
uaacaaccuauuaauugaaa

SEQ ID NO: 2108273 - RNA, 20 nt, Staphylococcus aureus subsp. aureus MW2
uaacaauagugacuuuuaua

SEQ ID NO: 2108274 - RNA, 20 nt, Staphylococcus aureus subsp. aureus MW2
uaaauuuuaucuaaacauuu

SEQ ID NO: 2108275 - RNA, 17 nt, Staphylococcus aureus subsp. aureus MW2
uaacaacaucaaaaccc

SEQ ID NO: 2108276 - RNA, 20 nt, Staphylococcus aureus subsp. aureus MW2
uaaaugauggguaguuaaua

SEQ ID NO: 2108277 - RNA, 12 nt, Staphylococcus aureus subsp. aureus MW2
uaaaugauuuaa

SEQ ID NO: 2108278 - RNA, 14 nt, Staphylococcus aureus subsp. aureus MW2
uaaaugauuuaaua

SEQ ID NO: 2108279 - RNA, 22 nt, Staphylococcus aureus subsp. aureus MW2
uaaaugcaauacauuaauauaa

SEQ ID NO: 2108280 - RNA, 18 nt, Staphylococcus aureus subsp. aureus MW2
uaaaugcaauauguaaca

SEQ ID NO: 2108281 - RNA, 17 nt, Staphylococcus aureus subsp. aureus MW2
uaaaugcacuagcaaca

SEQ ID NO: 2108282 - RNA, 21 nt, Staphylococcus aureus subsp. aureus MW2
uaaaugcacuagcaacaucuu

SEQ ID NO: 2108283 - RNA, 17 nt, Staphylococcus aureus subsp. aureus MW2
uaaaugaugcaguaaaa

SEQ ID NO: 2108284 - RNA, 16 nt, Staphylococcus aureus subsp. aureus MW2
uaaaugacuucacauu

SEQ ID NO: 2108285 - RNA, 21 nt, Staphylococcus aureus subsp. aureus MW2
uaaaugacuucacauuuaucc

SEQ ID NO: 2108286 - RNA, 16 nt, Staphylococcus aureus subsp. aureus MW2
uaaaugaauuauuuaa

SEQ ID NO: 2108287 - RNA, 22 nt, Staphylococcus aureus subsp. aureus MW2
uaaaugaaagcaccuaaaauag

SEQ ID NO: 2108288 - RNA, 23 nt, Staphylococcus aureus subsp. aureus MW2
uaaaugaaagcaccuaaaauaga

SEQ ID NO: 2108289 - RNA, 21 nt, Staphylococcus aureus subsp. aureus MW2
uaaaugucacugcaaacacag

SEQ ID NO: 2108290 - RNA, 19 nt, Staphylococcus aureus subsp. aureus MW2
uaaaugucacugcaaacac

SEQ ID NO: 2108291 - RNA, 19 nt, Staphylococcus aureus subsp. aureus MW2
uaaauguuaaauucuaaaa

SEQ ID NO: 2108292 - RNA, 17 nt, Staphylococcus aureus subsp. aureus MW2
uaaauguuaaauucuaa

SEQ ID NO: 2108293 - RNA, 13 nt, Staphylococcus aureus subsp. aureus MW2
uaaaugugacuuu

SEQ ID NO: 2108294 - RNA, 16 nt, Staphylococcus aureus subsp. aureus MW2
uaaauguacauuguaa

SEQ ID NO: 2108295 - RNA, 18 nt, Staphylococcus aureus subsp. aureus MW2
uaaauggugucgauacuc

SEQ ID NO: 2108296 - RNA, 19 nt, Staphylococcus aureus subsp. aureus MW2
uaaaugguuaucuaaaauu

SEQ ID NO: 2108297 - RNA, 13 nt, Staphylococcus aureus subsp. aureus MW2
uaaaucuuugauu

SEQ ID NO: 2108298 - RNA, 20 nt, Staphylococcus aureus subsp. aureus MW2
uaaaucuuugauuaugaacu

SEQ ID NO: 2108299 - RNA, 19 nt, Staphylococcus aureus subsp. aureus MW2
uaaaucuucuaguaauucu

SEQ ID NO: 2108300 - RNA, 21 nt, Staphylococcus aureus subsp. aureus MW2
uaaaucuguuuaaauuuaaaa

SEQ ID NO: 2108301 - RNA, 20 nt, Staphylococcus aureus subsp. aureus MW2
uaaaucuuguuggauuuuaa

SEQ ID NO: 2108302 - RNA, 16 nt, Staphylococcus aureus subsp. aureus MW2
uaaaucugauucauua

SEQ ID NO: 2108303 - RNA, 23 nt, Staphylococcus aureus subsp. aureus MW2
uaaaucacgccauaaucuucauu

SEQ ID NO: 2108304 - RNA, 20 nt, Staphylococcus aureus subsp. aureus MW2
uaaaucuguuuaaauuuaaa

SEQ ID NO: 2108305 - RNA, 17 nt, Staphylococcus aureus subsp. aureus MW2
uaaaucaagaaauguua

SEQ ID NO: 2108306 - RNA, 22 nt, Staphylococcus aureus subsp. aureus MW2
uaaaucuaauacuuucaaacaa

SEQ ID NO: 2108307 - RNA, 14 nt, Staphylococcus aureus subsp. aureus MW2
uaaaucaagaaaug

SEQ ID NO: 2108308 - RNA, 17 nt, Staphylococcus aureus subsp. aureus MW2
uaaaucaacuuaaaugg

SEQ ID NO: 2108309 - RNA, 21 nt, Staphylococcus aureus subsp. aureus MW2
uaaaucaaaugguacaguuaa

SEQ ID NO: 2108310 - RNA, 15 nt, Staphylococcus aureus subsp. aureus MW2
uaaaucaaagaguaa

SEQ ID NO: 2108311 - RNA, 22 nt, Staphylococcus aureus subsp. aureus MW2
uaaaucaaagggcuucgauuca

SEQ ID NO: 2108312 - RNA, 21 nt, Staphylococcus aureus subsp. aureus MW2
uagggcuacucgacacauaua

SEQ ID NO: 2108313 - RNA, 12 nt, Staphylococcus aureus subsp. aureus MW2
uaggcuccuaaa

SEQ ID NO: 2108314 - RNA, 23 nt, Staphylococcus aureus subsp. aureus MW2
uaguaaaauaaauacaauagaaa

SEQ ID NO: 2108315 - RNA, 16 nt, Staphylococcus aureus subsp. aureus MW2
uaguacucaauguuag

SEQ ID NO: 2108316 - RNA, 16 nt, Staphylococcus aureus subsp. aureus MW2
uaguacuuaauacuaa

SEQ ID NO: 2108317 - RNA, 22 nt, Staphylococcus aureus subsp. aureus MW2
uaguacuuaauacuaauuuugu

SEQ ID NO: 2108318 - RNA, 23 nt, Staphylococcus aureus subsp. aureus MW2
uaguacuaaaccgauuaauauaa

SEQ ID NO: 2108319 - RNA, 19 nt, Staphylococcus aureus subsp. aureus MW2
uaguaaauauaguuaaagu

SEQ ID NO: 2108320 - RNA, 14 nt, Staphylococcus aureus subsp. aureus MW2
uaguauaaauauca

SEQ ID NO: 2108321 - RNA, 19 nt, Staphylococcus aureus subsp. aureus MW2
uaguaguuuauaucaaaaa

SEQ ID NO: 2108322 - RNA, 16 nt, Staphylococcus aureus subsp. aureus MW2
uaguauccuuuauaaa

SEQ ID NO: 2108323 - RNA, 15 nt, Staphylococcus aureus subsp. aureus MW2
uaguagcuugaauag

SEQ ID NO: 2108324 - RNA, 20 nt, Staphylococcus aureus subsp. aureus MW2
uaguauucaaaaaaauauuu

SEQ ID NO: 2108325 - RNA, 18 nt, Staphylococcus aureus subsp. aureus MW2
uaguaugacaaauuaaaa

SEQ ID NO: 2108326 - RNA, 19 nt, Staphylococcus aureus subsp. aureus MW2
uaguaugacaaauuaaaaa

SEQ ID NO: 2108327 - RNA, 18 nt, Staphylococcus aureus subsp. aureus MW2
uaggucuacgaucaaaau

SEQ ID NO: 2108328 - RNA, 15 nt, Staphylococcus aureus subsp. aureus MW2
uagguauaaucauuu

SEQ ID NO: 2108329 - RNA, 17 nt, Staphylococcus aureus subsp. aureus MW2
uaggguauugaaauaau

SEQ ID NO: 2108330 - RNA, 17 nt, Staphylococcus aureus subsp. aureus MW2
uaggggcuucuuucuaa

SEQ ID NO: 2108331 - RNA, 20 nt, Staphylococcus aureus subsp. aureus MW2
uagggguggaaauaugaaaa

SEQ ID NO: 2108332 - RNA, 22 nt, Staphylococcus aureus subsp. aureus MW2
uagggguggaaauaugaaaaga

SEQ ID NO: 2108333 - RNA, 16 nt, Staphylococcus aureus subsp. aureus MW2
uagguacaacuaaaua

SEQ ID NO: 2108334 - RNA, 19 nt, Staphylococcus aureus subsp. aureus MW2
uagguacauaaauaccugg

SEQ ID NO: 2108335 - RNA, 12 nt, Staphylococcus aureus subsp. aureus MW2
uagguaauaauu

SEQ ID NO: 2108336 - RNA, 23 nt, Staphylococcus aureus subsp. aureus MW2
uaguucaaauugaacuucuuuuu

SEQ ID NO: 2108337 - RNA, 12 nt, Staphylococcus aureus subsp. aureus MW2
uaguuaaauaca

SEQ ID NO: 2108338 - RNA, 18 nt, Staphylococcus aureus subsp. aureus MW2
uaguguucucauuauaau

SEQ ID NO: 2108339 - RNA, 13 nt, Staphylococcus aureus subsp. aureus MW2
uaguuuauaauuu

SEQ ID NO: 2108340 - RNA, 12 nt, Staphylococcus aureus subsp. aureus MW2
uaguuguuuauu

SEQ ID NO: 2108341 - RNA, 20 nt, Staphylococcus aureus subsp. aureus MW2
uaguuguaucguuaauugga

SEQ ID NO: 2108342 - RNA, 20 nt, Staphylococcus aureus subsp. aureus MW2
uagucauguuuggcauaaua

SEQ ID NO: 2108343 - RNA, 22 nt, Staphylococcus aureus subsp. aureus MW2
uagucauguuuggcauaauaau

SEQ ID NO: 2108344 - RNA, 17 nt, Staphylococcus aureus subsp. aureus MW2
uagucauuacaaaucau

SEQ ID NO: 2108345 - RNA, 16 nt, Staphylococcus aureus subsp. aureus MW2
uagucauugaaaauau

SEQ ID NO: 2108346 - RNA, 17 nt, Staphylococcus aureus subsp. aureus MW2
uagucauugaaaauauu

SEQ ID NO: 2108347 - RNA, 18 nt, Staphylococcus aureus subsp. aureus MW2
uagucauuugaugguuua

SEQ ID NO: 2108348 - RNA, 16 nt, Staphylococcus aureus subsp. aureus MW2
uagugucacauuauac

SEQ ID NO: 2108349 - RNA, 15 nt, Staphylococcus aureus subsp. aureus MW2
uaguguacacgaauu

SEQ ID NO: 2108350 - RNA, 18 nt, Staphylococcus aureus subsp. aureus MW2
uauaacaauaguuuucuu

SEQ ID NO: 2108351 - RNA, 15 nt, Staphylococcus aureus subsp. aureus MW2
uauaacaauauuaaa

SEQ ID NO: 2108352 - RNA, 20 nt, Staphylococcus aureus subsp. aureus MW2
uauaacaaaaauugcuauau

SEQ ID NO: 2108353 - RNA, 19 nt, Staphylococcus aureus subsp. aureus MW2
uauaacaauuuuagacuac

SEQ ID NO: 2108354 - RNA, 16 nt, Staphylococcus aureus subsp. aureus MW2
uauaacgcuuuaaauc

SEQ ID NO: 2108355 - RNA, 20 nt, Staphylococcus aureus subsp. aureus MW2
uauaaagaaugauuuauaaa

SEQ ID NO: 2108356 - RNA, 16 nt, Staphylococcus aureus subsp. aureus MW2
uauaaauguuauugcu

SEQ ID NO: 2108357 - RNA, 11 nt, Staphylococcus aureus subsp. aureus MW2
uauaaauuaug

SEQ ID NO: 2108358 - RNA, 22 nt, Staphylococcus aureus subsp. aureus MW2
uauaaaacagaauuucaucaaa

SEQ ID NO: 2108359 - RNA, 17 nt, Staphylococcus aureus subsp. aureus MW2
uauaaaacgauaagaau

SEQ ID NO: 2108360 - RNA, 13 nt, Staphylococcus aureus subsp. aureus MW2
uauaaacauuuau

SEQ ID NO: 2108361 - RNA, 15 nt, Staphylococcus aureus subsp. aureus MW2
uauaaacuauuaaau

SEQ ID NO: 2108362 - RNA, 17 nt, Staphylococcus aureus subsp. aureus MW2
uauaaacgcaaauuaaa

SEQ ID NO: 2108363 - RNA, 18 nt, Staphylococcus aureus subsp. aureus MW2
uauaaacgcaaauuaaau

SEQ ID NO: 2108364 - RNA, 21 nt, Staphylococcus aureus subsp. aureus MW2
uauaaacgucacuuuauuaaa

SEQ ID NO: 2108365 - RNA, 14 nt, Staphylococcus aureus subsp. aureus MW2
uaguuuuuaaaauu

SEQ ID NO: 2108366 - RNA, 18 nt, Staphylococcus aureus subsp. aureus MW2
uaguuuuuacguuuucua

SEQ ID NO: 2108367 - RNA, 23 nt, Staphylococcus aureus subsp. aureus MW2
uauaaaaagaauaugauauugau

SEQ ID NO: 2108368 - RNA, 19 nt, Staphylococcus aureus subsp. aureus MW2
uauaaaaagauauaagaaa

SEQ ID NO: 2108369 - RNA, 23 nt, Staphylococcus aureus subsp. aureus MW2
uauaaaaagucccgcuuaaaaug

SEQ ID NO: 2108370 - RNA, 20 nt, Staphylococcus aureus subsp. aureus MW2
uauaaaaaguuauuuaaguu

SEQ ID NO: 2108371 - RNA, 22 nt, Staphylococcus aureus subsp. aureus MW2
uauaaaaaaccguaauuuuaau

SEQ ID NO: 2108372 - RNA, 18 nt, Staphylococcus aureus subsp. aureus MW2
uaguuucugacuuuuaaa

SEQ ID NO: 2108373 - RNA, 20 nt, Staphylococcus aureus subsp. aureus MW2
uaguuugacaucuauuucuu

SEQ ID NO: 2108374 - RNA, 13 nt, Staphylococcus aureus subsp. aureus MW2
uaguuuuaauauu

SEQ ID NO: 2108375 - RNA, 15 nt, Staphylococcus aureus subsp. aureus MW2
uaguuuuaauauuuu

SEQ ID NO: 2108376 - RNA, 17 nt, Staphylococcus aureus subsp. aureus MW2
uauccaguuaauuauuu

SEQ ID NO: 2108377 - RNA, 20 nt, Staphylococcus aureus subsp. aureus MW2
uauccaaggauguuauaaaa

SEQ ID NO: 2108378 - RNA, 21 nt, Staphylococcus aureus subsp. aureus MW2
uauccaaggauguuauaaaau

SEQ ID NO: 2108379 - RNA, 13 nt, Staphylococcus aureus subsp. aureus MW2
uauccaaagacau

SEQ ID NO: 2108380 - RNA, 20 nt, Staphylococcus aureus subsp. aureus MW2
uauccaaaauccugaaauua

SEQ ID NO: 2108381 - RNA, 16 nt, Staphylococcus aureus subsp. aureus MW2
uaucauuucaaauaag

SEQ ID NO: 2108382 - RNA, 22 nt, Staphylococcus aureus subsp. aureus MW2
uaucauuguguccauaaauauu

SEQ ID NO: 2108383 - RNA, 19 nt, Staphylococcus aureus subsp. aureus MW2
uaucauuucaaauaagaau

SEQ ID NO: 2108384 - RNA, 20 nt, Staphylococcus aureus subsp. aureus MW2
uaucauuaugcccgauaauu

SEQ ID NO: 2108385 - RNA, 15 nt, Staphylococcus aureus subsp. aureus MW2
uaucaguagcauauu

SEQ ID NO: 2108386 - RNA, 18 nt, Staphylococcus aureus subsp. aureus MW2
uaucaguccaaucaguuu

SEQ ID NO: 2108387 - RNA, 16 nt, Staphylococcus aureus subsp. aureus MW2
uaucacugaaugcuaa

SEQ ID NO: 2108388 - RNA, 13 nt, Staphylococcus aureus subsp. aureus MW2
uaucacuuauuau

SEQ ID NO: 2108389 - RNA, 20 nt, Staphylococcus aureus subsp. aureus MW2
uaucauuaucaaauaaccua

SEQ ID NO: 2108390 - RNA, 18 nt, Staphylococcus aureus subsp. aureus MW2
uaucauuaucaaauaacc

SEQ ID NO: 2108391 - RNA, 13 nt, Staphylococcus aureus subsp. aureus MW2
uaucauuaucaaa

SEQ ID NO: 2108392 - RNA, 20 nt, Staphylococcus aureus subsp. aureus MW2
uaucauuacagauaauuauu

SEQ ID NO: 2108393 - RNA, 17 nt, Staphylococcus aureus subsp. aureus MW2
uaucaugaugauaaauu

SEQ ID NO: 2108394 - RNA, 12 nt, Staphylococcus aureus subsp. aureus MW2
uaucaucuauuc

SEQ ID NO: 2108395 - RNA, 22 nt, Staphylococcus aureus subsp. aureus MW2
uaucaauagaugaaaauuuaau

SEQ ID NO: 2108396 - RNA, 18 nt, Staphylococcus aureus subsp. aureus MW2
uaucacuaauauauuuag

SEQ ID NO: 2108397 - RNA, 18 nt, Staphylococcus aureus subsp. aureus MW2
uaucaauugaaugaagua

SEQ ID NO: 2108398 - RNA, 15 nt, Staphylococcus aureus subsp. aureus MW2
uaucaaauuacuuau

SEQ ID NO: 2108399 - RNA, 21 nt, Staphylococcus aureus subsp. aureus MW2
uaucaaauuacuuauucaaau

SEQ ID NO: 2108400 - RNA, 14 nt, Staphylococcus aureus subsp. aureus MW2
uaucaacaauggaa

SEQ ID NO: 2108401 - RNA, 21 nt, Staphylococcus aureus subsp. aureus MW2
uaucaacagaacuaauggcaa

SEQ ID NO: 2108402 - RNA, 14 nt, Staphylococcus aureus subsp. aureus MW2
uauauuuuuauuaa

SEQ ID NO: 2108403 - RNA, 15 nt, Staphylococcus aureus subsp. aureus MW2
uauauuuuuauuaau

SEQ ID NO: 2108404 - RNA, 16 nt, Staphylococcus aureus subsp. aureus MW2
uauauuuuguuaauaa

SEQ ID NO: 2108405 - RNA, 21 nt, Staphylococcus aureus subsp. aureus MW2
uauauuguauuuuauuuauuu

SEQ ID NO: 2108406 - RNA, 16 nt, Staphylococcus aureus subsp. aureus MW2
uauauuuuuuguacau

SEQ ID NO: 2108407 - RNA, 20 nt, Staphylococcus aureus subsp. aureus MW2
uaucaaaaccgcuauaaaau

SEQ ID NO: 2108408 - RNA, 21 nt, Staphylococcus aureus subsp. aureus MW2
uaucaaaaccgcuauaaaauu

SEQ ID NO: 2108409 - RNA, 19 nt, Staphylococcus aureus subsp. aureus MW2
uaucaaaaaaacaaaaaau

SEQ ID NO: 2108410 - RNA, 23 nt, Staphylococcus aureus subsp. aureus MW2
uauauccaguuaauuauuuagau

SEQ ID NO: 2108411 - RNA, 18 nt, Staphylococcus aureus subsp. aureus MW2
uauauuccacgcucacau

SEQ ID NO: 2108412 - RNA, 23 nt, Staphylococcus aureus subsp. aureus MW2
uauaucacaacacauaaauuaag

SEQ ID NO: 2108413 - RNA, 23 nt, Staphylococcus aureus subsp. aureus MW2
uauauugcacauaaaaaauguga

SEQ ID NO: 2108414 - RNA, 16 nt, Staphylococcus aureus subsp. aureus MW2
uauauugauagcaccg

SEQ ID NO: 2108415 - RNA, 17 nt, Staphylococcus aureus subsp. aureus MW2
uauauucguuacaaaug

SEQ ID NO: 2108416 - RNA, 20 nt, Staphylococcus aureus subsp. aureus MW2
uauauucggauccaaucuaa

SEQ ID NO: 2108417 - RNA, 18 nt, Staphylococcus aureus subsp. aureus MW2
uauagucuuaaacauaac

SEQ ID NO: 2108418 - RNA, 15 nt, Staphylococcus aureus subsp. aureus MW2
uauagucuuaaacau

SEQ ID NO: 2108419 - RNA, 16 nt, Staphylococcus aureus subsp. aureus MW2
uauagucuuaaacaua

SEQ ID NO: 2108420 - RNA, 23 nt, Staphylococcus aureus subsp. aureus MW2
uauaguaggguauugaaauaaua

SEQ ID NO: 2108421 - RNA, 14 nt, Staphylococcus aureus subsp. aureus MW2
uauagugguaaaaa

SEQ ID NO: 2108422 - RNA, 14 nt, Staphylococcus aureus subsp. aureus MW2
uauauaagcaaaga

SEQ ID NO: 2108423 - RNA, 19 nt, Staphylococcus aureus subsp. aureus MW2
uauauaacgcuuuaaauca

SEQ ID NO: 2108424 - RNA, 20 nt, Staphylococcus aureus subsp. aureus MW2
uauauaaccauaguaacaaa

SEQ ID NO: 2108425 - RNA, 19 nt, Staphylococcus aureus subsp. aureus MW2
uauaguguuuuauucgaua

SEQ ID NO: 2108426 - RNA, 23 nt, Staphylococcus aureus subsp. aureus MW2
uauauacgauugaguugaaaaua

SEQ ID NO: 2108427 - RNA, 13 nt, Staphylococcus aureus subsp. aureus MW2
uauauacucacca

SEQ ID NO: 2108428 - RNA, 15 nt, Staphylococcus aureus subsp. aureus MW2
uauauacaaauaaac

SEQ ID NO: 2108429 - RNA, 16 nt, Staphylococcus aureus subsp. aureus MW2
uauauacaaauaaaca

SEQ ID NO: 2108430 - RNA, 17 nt, Staphylococcus aureus subsp. aureus MW2
uauauacaaauaaacac

SEQ ID NO: 2108431 - RNA, 23 nt, Staphylococcus aureus subsp. aureus MW2
uauaucaaauacauuucaaaaaa

SEQ ID NO: 2108432 - RNA, 21 nt, Staphylococcus aureus subsp. aureus MW2
uauauauuccacgcucacauu

SEQ ID NO: 2108433 - RNA, 15 nt, Staphylococcus aureus subsp. aureus MW2
uauauauuuaaauca

SEQ ID NO: 2108434 - RNA, 18 nt, Staphylococcus aureus subsp. aureus MW2
uauagaugacuguagaaa

SEQ ID NO: 2108435 - RNA, 21 nt, Staphylococcus aureus subsp. aureus MW2
uauagaugacuguagaaaaca

SEQ ID NO: 2108436 - RNA, 23 nt, Staphylococcus aureus subsp. aureus MW2
uauagaugacuguagaaaacaug

SEQ ID NO: 2108437 - RNA, 17 nt, Staphylococcus aureus subsp. aureus MW2
uauagacauaagcaaag

SEQ ID NO: 2108438 - RNA, 18 nt, Staphylococcus aureus subsp. aureus MW2
uauagacauaagcaaaga

SEQ ID NO: 2108439 - RNA, 22 nt, Staphylococcus aureus subsp. aureus MW2
uauagaccguugaaauguucaa

SEQ ID NO: 2108440 - RNA, 16 nt, Staphylococcus aureus subsp. aureus MW2
uauagaaugauuaaaa

SEQ ID NO: 2108441 - RNA, 19 nt, Staphylococcus aureus subsp. aureus MW2
uauagaaugauuaaaauua

SEQ ID NO: 2108442 - RNA, 21 nt, Staphylococcus aureus subsp. aureus MW2
uauagccaaaggcaaaaugua

SEQ ID NO: 2108443 - RNA, 21 nt, Staphylococcus aureus subsp. aureus MW2
uauagcacgcuuauugaaaag

SEQ ID NO: 2108444 - RNA, 20 nt, Staphylococcus aureus subsp. aureus MW2
uauagauuuuguauuagcau

SEQ ID NO: 2108445 - RNA, 21 nt, Staphylococcus aureus subsp. aureus MW2
uauagcaaauugauuaaauaa

SEQ ID NO: 2108446 - RNA, 18 nt, Staphylococcus aureus subsp. aureus MW2
uauagauuuuauaaaaag

SEQ ID NO: 2108447 - RNA, 13 nt, Staphylococcus aureus subsp. aureus MW2
uauagccuucauu

SEQ ID NO: 2108448 - RNA, 16 nt, Staphylococcus aureus subsp. aureus MW2
uauacuuuaucuauuu

SEQ ID NO: 2108449 - RNA, 21 nt, Staphylococcus aureus subsp. aureus MW2
uauacuuuaucuauuucuaua

SEQ ID NO: 2108450 - RNA, 19 nt, Staphylococcus aureus subsp. aureus MW2
uauacuugaugaaacugau

SEQ ID NO: 2108451 - RNA, 13 nt, Staphylococcus aureus subsp. aureus MW2
uauacuuuuuaaa

SEQ ID NO: 2108452 - RNA, 14 nt, Staphylococcus aureus subsp. aureus MW2
uauacuuuuuaaau

SEQ ID NO: 2108453 - RNA, 11 nt, Staphylococcus aureus subsp. aureus MW2
uauagaaaaag

SEQ ID NO: 2108454 - RNA, 21 nt, Staphylococcus aureus subsp. aureus MW2
uauagaaaaagggcaaaaaag

SEQ ID NO: 2108455 - RNA, 20 nt, Staphylococcus aureus subsp. aureus MW2
uauacuuuuggucuguugaa

SEQ ID NO: 2108456 - RNA, 15 nt, Staphylococcus aureus subsp. aureus MW2
uauacuuuuggucug

SEQ ID NO: 2108457 - RNA, 18 nt, Staphylococcus aureus subsp. aureus MW2
uauagaaauaauuuaaag

SEQ ID NO: 2108458 - RNA, 19 nt, Staphylococcus aureus subsp. aureus MW2
uauacuaaacuuuuuucaa

SEQ ID NO: 2108459 - RNA, 15 nt, Staphylococcus aureus subsp. aureus MW2
uauacuaaacuuuuu

SEQ ID NO: 2108460 - RNA, 12 nt, Staphylococcus aureus subsp. aureus MW2
uauacuaaauug

SEQ ID NO: 2108461 - RNA, 13 nt, Staphylococcus aureus subsp. aureus MW2
uauacuaaauuga

SEQ ID NO: 2108462 - RNA, 13 nt, Staphylococcus aureus subsp. aureus MW2
uauacuauauaau

SEQ ID NO: 2108463 - RNA, 20 nt, Staphylococcus aureus subsp. aureus MW2
uauacgagaauaugaucuaa

SEQ ID NO: 2108464 - RNA, 14 nt, Staphylococcus aureus subsp. aureus MW2
uauaccaaccaaaa

SEQ ID NO: 2108465 - RNA, 21 nt, Staphylococcus aureus subsp. aureus MW2
uauacauguaacagugugaaa

SEQ ID NO: 2108466 - RNA, 22 nt, Staphylococcus aureus subsp. aureus MW2
uauacauuaacgauuaauauaa

SEQ ID NO: 2108467 - RNA, 15 nt, Staphylococcus aureus subsp. aureus MW2
uauaacuuuaaaaau

SEQ ID NO: 2108468 - RNA, 14 nt, Staphylococcus aureus subsp. aureus MW2
uauaagaaaaagac

SEQ ID NO: 2108469 - RNA, 13 nt, Staphylococcus aureus subsp. aureus MW2
uauaacugcaugu

SEQ ID NO: 2108470 - RNA, 13 nt, Staphylococcus aureus subsp. aureus MW2
uauaacuuuaaaa

SEQ ID NO: 2108471 - RNA, 16 nt, Staphylococcus aureus subsp. aureus MW2
uauaacucuaaauaua

SEQ ID NO: 2108472 - RNA, 13 nt, Staphylococcus aureus subsp. aureus MW2
uagcgucagcaaa

SEQ ID NO: 2108473 - RNA, 20 nt, Staphylococcus aureus subsp. aureus MW2
uagcguagcauuauuuaaag

SEQ ID NO: 2108474 - RNA, 22 nt, Staphylococcus aureus subsp. aureus MW2
uagcgcaagagauaagaaaaua

SEQ ID NO: 2108475 - RNA, 20 nt, Staphylococcus aureus subsp. aureus MW2
uagcgauaagcaugauaaaa

SEQ ID NO: 2108476 - RNA, 22 nt, Staphylococcus aureus subsp. aureus MW2
uagcgauaagcaugauaaaaau

SEQ ID NO: 2108477 - RNA, 20 nt, Staphylococcus aureus subsp. aureus MW2
uagcgaaaguaucuaugaaa

SEQ ID NO: 2108478 - RNA, 14 nt, Staphylococcus aureus subsp. aureus MW2
uagcgaaaacuaaa

SEQ ID NO: 2108479 - RNA, 13 nt, Staphylococcus aureus subsp. aureus MW2
uagccuucauuug

SEQ ID NO: 2108480 - RNA, 16 nt, Staphylococcus aureus subsp. aureus MW2
uagccuagauaccaaa

SEQ ID NO: 2108481 - RNA, 22 nt, Staphylococcus aureus subsp. aureus MW2
uagcccuuuauacaauuuuuug

SEQ ID NO: 2108482 - RNA, 15 nt, Staphylococcus aureus subsp. aureus MW2
uagccauaucauauu

SEQ ID NO: 2108483 - RNA, 17 nt, Staphylococcus aureus subsp. aureus MW2
uagccccaguauagaag

SEQ ID NO: 2108484 - RNA, 12 nt, Staphylococcus aureus subsp. aureus MW2
uagccauuucaa

SEQ ID NO: 2108485 - RNA, 16 nt, Staphylococcus aureus subsp. aureus MW2
uagcgugauuuuucau

SEQ ID NO: 2108486 - RNA, 23 nt, Staphylococcus aureus subsp. aureus MW2
uagcuauaacucuaaauauaaua

SEQ ID NO: 2108487 - RNA, 13 nt, Staphylococcus aureus subsp. aureus MW2
uagcuauuaaaau

SEQ ID NO: 2108488 - RNA, 17 nt, Staphylococcus aureus subsp. aureus MW2
uagcuacaauuaaagug

SEQ ID NO: 2108489 - RNA, 13 nt, Staphylococcus aureus subsp. aureus MW2
uagcuuaauaauu

SEQ ID NO: 2108490 - RNA, 18 nt, Staphylococcus aureus subsp. aureus MW2
uagcuucgucacguaaaa

SEQ ID NO: 2108491 - RNA, 22 nt, Staphylococcus aureus subsp. aureus MW2
uagcuuauuuagaaaguuuuau

SEQ ID NO: 2108492 - RNA, 16 nt, Staphylococcus aureus subsp. aureus MW2
uagcuggcuuuuuaau

SEQ ID NO: 2108493 - RNA, 15 nt, Staphylococcus aureus subsp. aureus MW2
uagcucuuuuuugau

SEQ ID NO: 2108494 - RNA, 21 nt, Staphylococcus aureus subsp. aureus MW2
uagcugcaaucguugaaaaau

SEQ ID NO: 2108495 - RNA, 14 nt, Staphylococcus aureus subsp. aureus MW2
uagcuccuccaaag

SEQ ID NO: 2108496 - RNA, 15 nt, Staphylococcus aureus subsp. aureus MW2
uagcuugaauaauau

SEQ ID NO: 2108497 - RNA, 13 nt, Staphylococcus aureus subsp. aureus MW2
uagcuugaauaau

SEQ ID NO: 2108498 - RNA, 16 nt, Staphylococcus aureus subsp. aureus MW2
uagcuuucuuuuucau

SEQ ID NO: 2108499 - RNA, 18 nt, Staphylococcus aureus subsp. aureus MW2
uagcuuucguuucuuuua

SEQ ID NO: 2108500 - RNA, 22 nt, Staphylococcus aureus subsp. aureus MW2
uagcuuucgggcuaguuuuuug

SEQ ID NO: 2108501 - RNA, 21 nt, Staphylococcus aureus subsp. aureus MW2
uagcuuuuucaacuaauaacu

SEQ ID NO: 2108502 - RNA, 20 nt, Staphylococcus aureus subsp. aureus MW2
uaggaaaacuucaauaaugu

SEQ ID NO: 2108503 - RNA, 19 nt, Staphylococcus aureus subsp. aureus MW2
uaggaaugacauuuaaaga

SEQ ID NO: 2108504 - RNA, 17 nt, Staphylococcus aureus subsp. aureus MW2
uaggauguucaucaaca

SEQ ID NO: 2108505 - RNA, 23 nt, Staphylococcus aureus subsp. aureus MW2
uaggauaauuucaauuuggaaau

SEQ ID NO: 2108506 - RNA, 20 nt, Staphylococcus aureus subsp. aureus MW2
uaggagagauguauaaaacu

SEQ ID NO: 2108507 - RNA, 18 nt, Staphylococcus aureus subsp. aureus MW2
uaggagagauguauaaaa

SEQ ID NO: 2108508 - RNA, 13 nt, Staphylococcus aureus subsp. aureus MW2
uaggagucuggaa

SEQ ID NO: 2108509 - RNA, 16 nt, Staphylococcus aureus subsp. aureus MW2
uaggacuaucuauaau

SEQ ID NO: 2108510 - RNA, 16 nt, Staphylococcus aureus subsp. aureus MW2
uagccaauaucauauu

SEQ ID NO: 2108511 - RNA, 21 nt, Staphylococcus aureus subsp. aureus MW2
uagccaaauaaauuuugacgc

SEQ ID NO: 2108512 - RNA, 12 nt, Staphylococcus aureus subsp. aureus MW2
uagccaaauaaa

SEQ ID NO: 2108513 - RNA, 20 nt, Staphylococcus aureus subsp. aureus MW2
uagcaucuuuaccauauaau

SEQ ID NO: 2108514 - RNA, 21 nt, Staphylococcus aureus subsp. aureus MW2
uagcauucccguauaauaguu

SEQ ID NO: 2108515 - RNA, 22 nt, Staphylococcus aureus subsp. aureus MW2
uagcauuagcaaauauuauuaa

SEQ ID NO: 2108516 - RNA, 17 nt, Staphylococcus aureus subsp. aureus MW2
uagcaucaaaaauaaaa

SEQ ID NO: 2108517 - RNA, 15 nt, Staphylococcus aureus subsp. aureus MW2
uagcacuacaucaag

SEQ ID NO: 2108518 - RNA, 22 nt, Staphylococcus aureus subsp. aureus MW2
uagcacuuggauuuuaauuauu

SEQ ID NO: 2108519 - RNA, 16 nt, Staphylococcus aureus subsp. aureus MW2
uagcauauugauguuc

SEQ ID NO: 2108520 - RNA, 14 nt, Staphylococcus aureus subsp. aureus MW2
uagcauacauuaag

SEQ ID NO: 2108521 - RNA, 18 nt, Staphylococcus aureus subsp. aureus MW2
uagcaguaauauguugcu

SEQ ID NO: 2108522 - RNA, 18 nt, Staphylococcus aureus subsp. aureus MW2
uagcaguguguaucucuu

SEQ ID NO: 2108523 - RNA, 18 nt, Staphylococcus aureus subsp. aureus MW2
uagauuguauuuaauaag

SEQ ID NO: 2108524 - RNA, 15 nt, Staphylococcus aureus subsp. aureus MW2
uagauuuaaaauguc

SEQ ID NO: 2108525 - RNA, 17 nt, Staphylococcus aureus subsp. aureus MW2
uagauuguauuuaauaa

SEQ ID NO: 2108526 - RNA, 19 nt, Staphylococcus aureus subsp. aureus MW2
uagauuuaucaccuuuagg

SEQ ID NO: 2108527 - RNA, 21 nt, Staphylococcus aureus subsp. aureus MW2
uagauuucaaacgauuuucaa

SEQ ID NO: 2108528 - RNA, 16 nt, Staphylococcus aureus subsp. aureus MW2
uagauuucaaaucaau

SEQ ID NO: 2108529 - RNA, 21 nt, Staphylococcus aureus subsp. aureus MW2
uagauuucaaaucaauaccaa

SEQ ID NO: 2108530 - RNA, 18 nt, Staphylococcus aureus subsp. aureus MW2
uagauuuuaugcuuuacu

SEQ ID NO: 2108531 - RNA, 15 nt, Staphylococcus aureus subsp. aureus MW2
uagauuuuauaaaaa

SEQ ID NO: 2108532 - RNA, 17 nt, Staphylococcus aureus subsp. aureus MW2
uagauuuuauaaaaagu

SEQ ID NO: 2108533 - RNA, 14 nt, Staphylococcus aureus subsp. aureus MW2
uagauuuuauauaa

SEQ ID NO: 2108534 - RNA, 14 nt, Staphylococcus aureus subsp. aureus MW2
uagauuuguguguc

SEQ ID NO: 2108535 - RNA, 15 nt, Staphylococcus aureus subsp. aureus MW2
uagcaaauauuucug

SEQ ID NO: 2108536 - RNA, 17 nt, Staphylococcus aureus subsp. aureus MW2
uagcaaauauuucuggc

SEQ ID NO: 2108537 - RNA, 16 nt, Staphylococcus aureus subsp. aureus MW2
uagcaaaauuauguaa

SEQ ID NO: 2108538 - RNA, 15 nt, Staphylococcus aureus subsp. aureus MW2
uagcaaaaauacuuu

SEQ ID NO: 2108539 - RNA, 14 nt, Staphylococcus aureus subsp. aureus MW2
uagauuuuuucaua

SEQ ID NO: 2108540 - RNA, 16 nt, Staphylococcus aureus subsp. aureus MW2
uagcaaugaauuaaua

SEQ ID NO: 2108541 - RNA, 16 nt, Staphylococcus aureus subsp. aureus MW2
uagcacgcuuauugaa

SEQ ID NO: 2108542 - RNA, 18 nt, Staphylococcus aureus subsp. aureus MW2
uagauagcggauuuauuu

SEQ ID NO: 2108543 - RNA, 18 nt, Staphylococcus aureus subsp. aureus MW2
uagauaucuuaaucuaaa

SEQ ID NO: 2108544 - RNA, 21 nt, Staphylococcus aureus subsp. aureus MW2
uagaucuaucgguauaucuaa

SEQ ID NO: 2108545 - RNA, 20 nt, Staphylococcus aureus subsp. aureus MW2
uagaucgaacugauggaaaa

SEQ ID NO: 2108546 - RNA, 14 nt, Staphylococcus aureus subsp. aureus MW2
uagauucuuuucug

SEQ ID NO: 2108547 - RNA, 12 nt, Staphylococcus aureus subsp. aureus MW2
uagauucuuuuc

SEQ ID NO: 2108548 - RNA, 18 nt, Staphylococcus aureus subsp. aureus MW2
uagauugacuaaguuugu

SEQ ID NO: 2108549 - RNA, 16 nt, Staphylococcus aureus subsp. aureus MW2
uagauugauaucccua

SEQ ID NO: 2108550 - RNA, 20 nt, Staphylococcus aureus subsp. aureus MW2
uagauucugauacagaacca

SEQ ID NO: 2108551 - RNA, 20 nt, Staphylococcus aureus subsp. aureus MW2
uagaugugucuuuuguuaug

SEQ ID NO: 2108552 - RNA, 20 nt, Staphylococcus aureus subsp. aureus MW2
uagauucacuguauaaauaa

SEQ ID NO: 2108553 - RNA, 14 nt, Staphylococcus aureus subsp. aureus MW2
uagaugauacauuc

SEQ ID NO: 2108554 - RNA, 19 nt, Staphylococcus aureus subsp. aureus MW2
uagaugcuggcuuaguaag

SEQ ID NO: 2108555 - RNA, 19 nt, Staphylococcus aureus subsp. aureus MW2
uagaugcauaaaaaaagaa

SEQ ID NO: 2108556 - RNA, 16 nt, Staphylococcus aureus subsp. aureus MW2
uagagguauaauuaaa

SEQ ID NO: 2108557 - RNA, 14 nt, Staphylococcus aureus subsp. aureus MW2
uagagcguuuugcu

SEQ ID NO: 2108558 - RNA, 17 nt, Staphylococcus aureus subsp. aureus MW2
uagagagcauaguuuuc

SEQ ID NO: 2108559 - RNA, 23 nt, Staphylococcus aureus subsp. aureus MW2
uagagcccgagacauaaauuaau

SEQ ID NO: 2108560 - RNA, 22 nt, Staphylococcus aureus subsp. aureus MW2
uagagccgugaaagaaaaaacu

SEQ ID NO: 2108561 - RNA, 19 nt, Staphylococcus aureus subsp. aureus MW2
uagauaaaucgauaaaaug

SEQ ID NO: 2108562 - RNA, 12 nt, Staphylococcus aureus subsp. aureus MW2
uagauaaaaaau

SEQ ID NO: 2108563 - RNA, 14 nt, Staphylococcus aureus subsp. aureus MW2
uagauaaaaaauac

SEQ ID NO: 2108564 - RNA, 21 nt, Staphylococcus aureus subsp. aureus MW2
uagaguuuaggacauugauuu

SEQ ID NO: 2108565 - RNA, 23 nt, Staphylococcus aureus subsp. aureus MW2
uagauaaucucauucuuuaauau

SEQ ID NO: 2108566 - RNA, 14 nt, Staphylococcus aureus subsp. aureus MW2
uagauaaucucauu

SEQ ID NO: 2108567 - RNA, 12 nt, Staphylococcus aureus subsp. aureus MW2
uagauaauauau

SEQ ID NO: 2108568 - RNA, 19 nt, Staphylococcus aureus subsp. aureus MW2
uagauagaaauugugcuuu

SEQ ID NO: 2108569 - RNA, 15 nt, Staphylococcus aureus subsp. aureus MW2
uagauaccaaacugc

SEQ ID NO: 2108570 - RNA, 13 nt, Staphylococcus aureus subsp. aureus MW2
uagauacauagaa

SEQ ID NO: 2108571 - RNA, 18 nt, Staphylococcus aureus subsp. aureus MW2
uagauacauauaagaauu

SEQ ID NO: 2108572 - RNA, 17 nt, Staphylococcus aureus subsp. aureus MW2
uaccaauugauuuugcu

SEQ ID NO: 2108573 - RNA, 22 nt, Staphylococcus aureus subsp. aureus MW2
uaccaaugaauaaauugauauu

SEQ ID NO: 2108574 - RNA, 20 nt, Staphylococcus aureus subsp. aureus MW2
uaccacgaacaagucuugca

SEQ ID NO: 2108575 - RNA, 20 nt, Staphylococcus aureus subsp. aureus MW2
uaccaaugaauaaauugaua

SEQ ID NO: 2108576 - RNA, 18 nt, Staphylococcus aureus subsp. aureus MW2
uaccuaaagcuaauacac

SEQ ID NO: 2108577 - RNA, 18 nt, Staphylococcus aureus subsp. aureus MW2
uaccuaagcugauuaaaa

SEQ ID NO: 2108578 - RNA, 15 nt, Staphylococcus aureus subsp. aureus MW2
uaccuaaauuaaauu

SEQ ID NO: 2108579 - RNA, 15 nt, Staphylococcus aureus subsp. aureus MW2
uaccuaauaggauuu

SEQ ID NO: 2108580 - RNA, 19 nt, Staphylococcus aureus subsp. aureus MW2
uaccuacacggucccaaga

SEQ ID NO: 2108581 - RNA, 14 nt, Staphylococcus aureus subsp. aureus MW2
uaccuacaaauaug

SEQ ID NO: 2108582 - RNA, 15 nt, Staphylococcus aureus subsp. aureus MW2
uaccuacagaaugga

SEQ ID NO: 2108583 - RNA, 20 nt, Staphylococcus aureus subsp. aureus MW2
uaccuauuugauuaaauuaa

SEQ ID NO: 2108584 - RNA, 23 nt, Staphylococcus aureus subsp. aureus MW2
uaccuguuggcuuuaaagguauu

SEQ ID NO: 2108585 - RNA, 20 nt, Staphylococcus aureus subsp. aureus MW2
uaccugguucgauuguaaua

SEQ ID NO: 2108586 - RNA, 16 nt, Staphylococcus aureus subsp. aureus MW2
uaccucuugauaaaau

SEQ ID NO: 2108587 - RNA, 22 nt, Staphylococcus aureus subsp. aureus MW2
uaccuucuucuacccauaauuu

SEQ ID NO: 2108588 - RNA, 18 nt, Staphylococcus aureus subsp. aureus MW2
uaccuuuaaaucuacuuu

SEQ ID NO: 2108589 - RNA, 17 nt, Staphylococcus aureus subsp. aureus MW2
uaccuuauggaaaauuu

SEQ ID NO: 2108590 - RNA, 13 nt, Staphylococcus aureus subsp. aureus MW2
uaccuucaucuuu

SEQ ID NO: 2108591 - RNA, 18 nt, Staphylococcus aureus subsp. aureus MW2
uaccuuuaauaauauuga

SEQ ID NO: 2108592 - RNA, 15 nt, Staphylococcus aureus subsp. aureus MW2
uaccuuuaauaucua

SEQ ID NO: 2108593 - RNA, 19 nt, Staphylococcus aureus subsp. aureus MW2
uaccuuucaaauauaucua

SEQ ID NO: 2108594 - RNA, 15 nt, Staphylococcus aureus subsp. aureus MW2
uaccuuuacuuucau

SEQ ID NO: 2108595 - RNA, 14 nt, Staphylococcus aureus subsp. aureus MW2
uaccuuuauuauuu

SEQ ID NO: 2108596 - RNA, 18 nt, Staphylococcus aureus subsp. aureus MW2
uacgaacaacuaacacgu

SEQ ID NO: 2108597 - RNA, 17 nt, Staphylococcus aureus subsp. aureus MW2
uacucauauugaauacu

SEQ ID NO: 2108598 - RNA, 17 nt, Staphylococcus aureus subsp. aureus MW2
uacuauggcauuauugc

SEQ ID NO: 2108599 - RNA, 15 nt, Staphylococcus aureus subsp. aureus MW2
uacuauggcauuauu

SEQ ID NO: 2108600 - RNA, 16 nt, Staphylococcus aureus subsp. aureus MW2
uacuauuaaauaaucg

SEQ ID NO: 2108601 - RNA, 17 nt, Staphylococcus aureus subsp. aureus MW2
uacguuugcauauccuu

SEQ ID NO: 2108602 - RNA, 14 nt, Staphylococcus aureus subsp. aureus MW2
uacguuuuaaauaa

SEQ ID NO: 2108603 - RNA, 19 nt, Staphylococcus aureus subsp. aureus MW2
uacguuuuuuuaaauacau

SEQ ID NO: 2108604 - RNA, 15 nt, Staphylococcus aureus subsp. aureus MW2
uacguuuuuuuaaau

SEQ ID NO: 2108605 - RNA, 19 nt, Staphylococcus aureus subsp. aureus MW2
uacguuuaauaaugguucu

SEQ ID NO: 2108606 - RNA, 21 nt, Staphylococcus aureus subsp. aureus MW2
uacguuuauccuuuaaaucau

SEQ ID NO: 2108607 - RNA, 19 nt, Staphylococcus aureus subsp. aureus MW2
uacguuauuucaauaauaa

SEQ ID NO: 2108608 - RNA, 14 nt, Staphylococcus aureus subsp. aureus MW2
uacguucuaauaau

SEQ ID NO: 2108609 - RNA, 16 nt, Staphylococcus aureus subsp. aureus MW2
uacguucuaauaauuu

SEQ ID NO: 2108610 - RNA, 19 nt, Staphylococcus aureus subsp. aureus MW2
uacuaucuucaucauauuc

SEQ ID NO: 2108611 - RNA, 16 nt, Staphylococcus aureus subsp. aureus MW2
uacuaucuucaucaua

SEQ ID NO: 2108612 - RNA, 13 nt, Staphylococcus aureus subsp. aureus MW2
uacuauacuuuga

SEQ ID NO: 2108613 - RNA, 13 nt, Staphylococcus aureus subsp. aureus MW2
uacuauaugaaaa

SEQ ID NO: 2108614 - RNA, 16 nt, Staphylococcus aureus subsp. aureus MW2
uacuauauuuaaauug

SEQ ID NO: 2108615 - RNA, 13 nt, Staphylococcus aureus subsp. aureus MW2
uacuauacugaug

SEQ ID NO: 2108616 - RNA, 11 nt, Staphylococcus aureus subsp. aureus MW2
uacuaaaacau

SEQ ID NO: 2108617 - RNA, 12 nt, Staphylococcus aureus subsp. aureus MW2
uacuaaaacaug

SEQ ID NO: 2108618 - RNA, 22 nt, Staphylococcus aureus subsp. aureus MW2
uacuauaaauacgucaucuuua

SEQ ID NO: 2108619 - RNA, 15 nt, Staphylococcus aureus subsp. aureus MW2
uacuauaauaauuaa

SEQ ID NO: 2108620 - RNA, 13 nt, Staphylococcus aureus subsp. aureus MW2
uacuauacaaugu

SEQ ID NO: 2108621 - RNA, 21 nt, Staphylococcus aureus subsp. aureus MW2
uacuauacaauguauuuugau

SEQ ID NO: 2108622 - RNA, 15 nt, Staphylococcus aureus subsp. aureus MW2
uacgcuuuuuaaaaa

SEQ ID NO: 2108623 - RNA, 20 nt, Staphylococcus aureus subsp. aureus MW2
uacgauugaguugaaaauaa

SEQ ID NO: 2108624 - RNA, 15 nt, Staphylococcus aureus subsp. aureus MW2
uacgcucauaugucu

SEQ ID NO: 2108625 - RNA, 16 nt, Staphylococcus aureus subsp. aureus MW2
uacgauauagugcuug

SEQ ID NO: 2108626 - RNA, 22 nt, Staphylococcus aureus subsp. aureus MW2
uacgaaucacaguuauauauua

SEQ ID NO: 2108627 - RNA, 22 nt, Staphylococcus aureus subsp. aureus MW2
uacgguuauuuaauaaugcuuu

SEQ ID NO: 2108628 - RNA, 18 nt, Staphylococcus aureus subsp. aureus MW2
uacguuauuucaauaaua

SEQ ID NO: 2108629 - RNA, 16 nt, Staphylococcus aureus subsp. aureus MW2
uacgcuuuuuaaaaaa

SEQ ID NO: 2108630 - RNA, 19 nt, Staphylococcus aureus subsp. aureus MW2
uagaaucuacgauuuucaa

SEQ ID NO: 2108631 - RNA, 18 nt, Staphylococcus aureus subsp. aureus MW2
uagaauucuaaaagaauu

SEQ ID NO: 2108632 - RNA, 17 nt, Staphylococcus aureus subsp. aureus MW2
uagaauucuaaaagaau

SEQ ID NO: 2108633 - RNA, 15 nt, Staphylococcus aureus subsp. aureus MW2
uagaauucauuaauc

SEQ ID NO: 2108634 - RNA, 20 nt, Staphylococcus aureus subsp. aureus MW2
uagaauucgagguugaccua

SEQ ID NO: 2108635 - RNA, 19 nt, Staphylococcus aureus subsp. aureus MW2
uagaaugucgauauuucua

SEQ ID NO: 2108636 - RNA, 15 nt, Staphylococcus aureus subsp. aureus MW2
uagaaguuuuuugau

SEQ ID NO: 2108637 - RNA, 14 nt, Staphylococcus aureus subsp. aureus MW2
uagaaguucuuaug

SEQ ID NO: 2108638 - RNA, 22 nt, Staphylococcus aureus subsp. aureus MW2
uagaaguucuuaugcaguuuua

SEQ ID NO: 2108639 - RNA, 19 nt, Staphylococcus aureus subsp. aureus MW2
uagaauaacuugauauuau

SEQ ID NO: 2108640 - RNA, 20 nt, Staphylococcus aureus subsp. aureus MW2
uagaagcuggcggaaaguca

SEQ ID NO: 2108641 - RNA, 22 nt, Staphylococcus aureus subsp. aureus MW2
uagaagcuggcggaaagucagg

SEQ ID NO: 2108642 - RNA, 20 nt, Staphylococcus aureus subsp. aureus MW2
uagaaucaaccguuuuauug

SEQ ID NO: 2108643 - RNA, 19 nt, Staphylococcus aureus subsp. aureus MW2
uagaauaguuaccaaaauu

SEQ ID NO: 2108644 - RNA, 17 nt, Staphylococcus aureus subsp. aureus MW2
uagaauagucaauuaau

SEQ ID NO: 2108645 - RNA, 19 nt, Staphylococcus aureus subsp. aureus MW2
uagaauagucaauuaauga

SEQ ID NO: 2108646 - RNA, 14 nt, Staphylococcus aureus subsp. aureus MW2
uagaaccaucauuu

SEQ ID NO: 2108647 - RNA, 22 nt, Staphylococcus aureus subsp. aureus MW2
uagaagaacaauaauugaugaa

SEQ ID NO: 2108648 - RNA, 15 nt, Staphylococcus aureus subsp. aureus MW2
uagaagaaaagaaca

SEQ ID NO: 2108649 - RNA, 17 nt, Staphylococcus aureus subsp. aureus MW2
uagaagaaaagaacauu

SEQ ID NO: 2108650 - RNA, 14 nt, Staphylococcus aureus subsp. aureus MW2
uagaagauuagaug

SEQ ID NO: 2108651 - RNA, 18 nt, Staphylococcus aureus subsp. aureus MW2
uagacauaaaaaaagaga

SEQ ID NO: 2108652 - RNA, 23 nt, Staphylococcus aureus subsp. aureus MW2
uagacauaaauauggauuuugaa

SEQ ID NO: 2108653 - RNA, 16 nt, Staphylococcus aureus subsp. aureus MW2
uagacauuguuaaacu

SEQ ID NO: 2108654 - RNA, 20 nt, Staphylococcus aureus subsp. aureus MW2
uagacaauuguaguaaugaa

SEQ ID NO: 2108655 - RNA, 13 nt, Staphylococcus aureus subsp. aureus MW2
uagacaccaaaaa

SEQ ID NO: 2108656 - RNA, 16 nt, Staphylococcus aureus subsp. aureus MW2
uagacaacugcaagug

SEQ ID NO: 2108657 - RNA, 20 nt, Staphylococcus aureus subsp. aureus MW2
uagacaauauuuuuacauau

SEQ ID NO: 2108658 - RNA, 15 nt, Staphylococcus aureus subsp. aureus MW2
uagaauuuaacauuu

SEQ ID NO: 2108659 - RNA, 12 nt, Staphylococcus aureus subsp. aureus MW2
uagaauuucuuu

SEQ ID NO: 2108660 - RNA, 17 nt, Staphylococcus aureus subsp. aureus MW2
uagaauuucuuuucgaa

SEQ ID NO: 2108661 - RNA, 15 nt, Staphylococcus aureus subsp. aureus MW2
uagacgguaucaucu

SEQ ID NO: 2108662 - RNA, 21 nt, Staphylococcus aureus subsp. aureus MW2
uagacuuauuugaaugcaaau

SEQ ID NO: 2108663 - RNA, 20 nt, Staphylococcus aureus subsp. aureus MW2
uagagaaauuugauuuucaa

SEQ ID NO: 2108664 - RNA, 16 nt, Staphylococcus aureus subsp. aureus MW2
uagagaaaaaauaaau

SEQ ID NO: 2108665 - RNA, 22 nt, Staphylococcus aureus subsp. aureus MW2
uagagaaaaaauaaauguuaaa

SEQ ID NO: 2108666 - RNA, 13 nt, Staphylococcus aureus subsp. aureus MW2
uagagaauuucaa

SEQ ID NO: 2108667 - RNA, 14 nt, Staphylococcus aureus subsp. aureus MW2
uagagaauuucaaa

SEQ ID NO: 2108668 - RNA, 12 nt, Staphylococcus aureus subsp. aureus MW2
uagaaaauuaac

SEQ ID NO: 2108669 - RNA, 16 nt, Staphylococcus aureus subsp. aureus MW2
uagaaacaccuuucgc

SEQ ID NO: 2108670 - RNA, 14 nt, Staphylococcus aureus subsp. aureus MW2
uagaaaauaugacg

SEQ ID NO: 2108671 - RNA, 14 nt, Staphylococcus aureus subsp. aureus MW2
uagaaacgaaauua

SEQ ID NO: 2108672 - RNA, 15 nt, Staphylococcus aureus subsp. aureus MW2
uagaaaggcaggcau

SEQ ID NO: 2108673 - RNA, 18 nt, Staphylococcus aureus subsp. aureus MW2
uagaaagugauucccaaa

SEQ ID NO: 2108674 - RNA, 21 nt, Staphylococcus aureus subsp. aureus MW2
uagaaaucagcuuuucuucaa

SEQ ID NO: 2108675 - RNA, 19 nt, Staphylococcus aureus subsp. aureus MW2
uagaaaaagggcaaaaaag

SEQ ID NO: 2108676 - RNA, 22 nt, Staphylococcus aureus subsp. aureus MW2
uagaaaaagggcaaaaaaggau

SEQ ID NO: 2108677 - RNA, 12 nt, Staphylococcus aureus subsp. aureus MW2
uagaaaaaguuu

SEQ ID NO: 2108678 - RNA, 18 nt, Staphylococcus aureus subsp. aureus MW2
uagaaaaauaugauugca

SEQ ID NO: 2108679 - RNA, 13 nt, Staphylococcus aureus subsp. aureus MW2
uacuuuuuuaaug

SEQ ID NO: 2108680 - RNA, 12 nt, Staphylococcus aureus subsp. aureus MW2
uacuuuucuaaa

SEQ ID NO: 2108681 - RNA, 15 nt, Staphylococcus aureus subsp. aureus MW2
uacuuuuauagaaaa

SEQ ID NO: 2108682 - RNA, 13 nt, Staphylococcus aureus subsp. aureus MW2
uacuuuucuuuuu

SEQ ID NO: 2108683 - RNA, 17 nt, Staphylococcus aureus subsp. aureus MW2
uacuuuucuuuuuacuu

SEQ ID NO: 2108684 - RNA, 11 nt, Staphylococcus aureus subsp. aureus MW2
uacuuuucauc

SEQ ID NO: 2108685 - RNA, 15 nt, Staphylococcus aureus subsp. aureus MW2
uacuuuuuauauaau

SEQ ID NO: 2108686 - RNA, 23 nt, Staphylococcus aureus subsp. aureus MW2
uacuuuggcagacguaucaucaa

SEQ ID NO: 2108687 - RNA, 22 nt, Staphylococcus aureus subsp. aureus MW2
uacuuuggaaauuuauuauaaa

SEQ ID NO: 2108688 - RNA, 20 nt, Staphylococcus aureus subsp. aureus MW2
uacuucuauuuuauaauaaa

SEQ ID NO: 2108689 - RNA, 15 nt, Staphylococcus aureus subsp. aureus MW2
uacuucuaauuugca

SEQ ID NO: 2108690 - RNA, 18 nt, Staphylococcus aureus subsp. aureus MW2
uacuucucccuuaaauac

SEQ ID NO: 2108691 - RNA, 17 nt, Staphylococcus aureus subsp. aureus MW2
uacuucuccauggcuua

SEQ ID NO: 2108692 - RNA, 14 nt, Staphylococcus aureus subsp. aureus MW2
uacuuccauugcuu

SEQ ID NO: 2108693 - RNA, 20 nt, Staphylococcus aureus subsp. aureus MW2
uacuuccuuacagacaaaca

SEQ ID NO: 2108694 - RNA, 20 nt, Staphylococcus aureus subsp. aureus MW2
uacuuguaauuaauacauca

SEQ ID NO: 2108695 - RNA, 22 nt, Staphylococcus aureus subsp. aureus MW2
uacuuguccuaacgcuaauuuu

SEQ ID NO: 2108696 - RNA, 18 nt, Staphylococcus aureus subsp. aureus MW2
uacuugucguauucuuca

SEQ ID NO: 2108697 - RNA, 18 nt, Staphylococcus aureus subsp. aureus MW2
uacuuguaauuaauacau

SEQ ID NO: 2108698 - RNA, 19 nt, Staphylococcus aureus subsp. aureus MW2
uacuuguaauuaauacauc

SEQ ID NO: 2108699 - RNA, 15 nt, Staphylococcus aureus subsp. aureus MW2
uacuuuaaaauugua

SEQ ID NO: 2108700 - RNA, 15 nt, Staphylococcus aureus subsp. aureus MW2
uacuuucuaagauac

SEQ ID NO: 2108701 - RNA, 18 nt, Staphylococcus aureus subsp. aureus MW2
uacuuucgaguaauacuu

SEQ ID NO: 2108702 - RNA, 16 nt, Staphylococcus aureus subsp. aureus MW2
uacuuucugcccacuu

SEQ ID NO: 2108703 - RNA, 18 nt, Staphylococcus aureus subsp. aureus MW2
uacuuuagaaacaccuuu

SEQ ID NO: 2108704 - RNA, 12 nt, Staphylococcus aureus subsp. aureus MW2
uacuuaauauag

SEQ ID NO: 2108705 - RNA, 21 nt, Staphylococcus aureus subsp. aureus MW2
uacuguaguacuauagucauu

SEQ ID NO: 2108706 - RNA, 17 nt, Staphylococcus aureus subsp. aureus MW2
uacuguaguacuauagu

SEQ ID NO: 2108707 - RNA, 19 nt, Staphylococcus aureus subsp. aureus MW2
uacuuaguaaggaauauuu

SEQ ID NO: 2108708 - RNA, 18 nt, Staphylococcus aureus subsp. aureus MW2
uacuuacgaauagaaaau

SEQ ID NO: 2108709 - RNA, 17 nt, Staphylococcus aureus subsp. aureus MW2
uacuuacgccaaucaca

SEQ ID NO: 2108710 - RNA, 16 nt, Staphylococcus aureus subsp. aureus MW2
uacuuaauuaauaauu

SEQ ID NO: 2108711 - RNA, 18 nt, Staphylococcus aureus subsp. aureus MW2
uacuuaaagcuaauaaug

SEQ ID NO: 2108712 - RNA, 16 nt, Staphylococcus aureus subsp. aureus MW2
uaauuguaaucuauuu

SEQ ID NO: 2108713 - RNA, 17 nt, Staphylococcus aureus subsp. aureus MW2
uaauuguugcauuacuu

SEQ ID NO: 2108714 - RNA, 23 nt, Staphylococcus aureus subsp. aureus MW2
uaauuguugagaaacuuuuucga

SEQ ID NO: 2108715 - RNA, 19 nt, Staphylococcus aureus subsp. aureus MW2
uaauucuuguaaaucauag

SEQ ID NO: 2108716 - RNA, 18 nt, Staphylococcus aureus subsp. aureus MW2
uaauucuuuaccauucaa

SEQ ID NO: 2108717 - RNA, 13 nt, Staphylococcus aureus subsp. aureus MW2
uaauucuucauca

SEQ ID NO: 2108718 - RNA, 18 nt, Staphylococcus aureus subsp. aureus MW2
uaauucuguuucaaagcu

SEQ ID NO: 2108719 - RNA, 20 nt, Staphylococcus aureus subsp. aureus MW2
uaauucuuaaucgagugauu

SEQ ID NO: 2108720 - RNA, 13 nt, Staphylococcus aureus subsp. aureus MW2
uaauugaaaauaa

SEQ ID NO: 2108721 - RNA, 13 nt, Staphylococcus aureus subsp. aureus MW2
uaauugaaaugau

SEQ ID NO: 2108722 - RNA, 20 nt, Staphylococcus aureus subsp. aureus MW2
uaauugaaucguauugaaaa

SEQ ID NO: 2108723 - RNA, 18 nt, Staphylococcus aureus subsp. aureus MW2
uaauuguuguaauucuuu

SEQ ID NO: 2108724 - RNA, 14 nt, Staphylococcus aureus subsp. aureus MW2
uaauuguuuaauaa

SEQ ID NO: 2108725 - RNA, 21 nt, Staphylococcus aureus subsp. aureus MW2
uaauuuaaaucuguacuucua

SEQ ID NO: 2108726 - RNA, 20 nt, Staphylococcus aureus subsp. aureus MW2
uaauuuaaagcaucauauac

SEQ ID NO: 2108727 - RNA, 14 nt, Staphylococcus aureus subsp. aureus MW2
uaauuuaaaugcuu

SEQ ID NO: 2108728 - RNA, 15 nt, Staphylococcus aureus subsp. aureus MW2
uaauuuauaaaaaga

SEQ ID NO: 2108729 - RNA, 16 nt, Staphylococcus aureus subsp. aureus MW2
uaauuuaguuuuaaua

SEQ ID NO: 2108730 - RNA, 21 nt, Staphylococcus aureus subsp. aureus MW2
uaauuuaguuuuaauauaauu

SEQ ID NO: 2108731 - RNA, 16 nt, Staphylococcus aureus subsp. aureus MW2
uaauuuaguacucaau

SEQ ID NO: 2108732 - RNA, 18 nt, Staphylococcus aureus subsp. aureus MW2
uaauuucugguaaaaaaa

SEQ ID NO: 2108733 - RNA, 17 nt, Staphylococcus aureus subsp. aureus MW2
uaauuucuaugaaaaaa

SEQ ID NO: 2108734 - RNA, 16 nt, Staphylococcus aureus subsp. aureus MW2
uaauuuaaauuaaaau

SEQ ID NO: 2108735 - RNA, 19 nt, Staphylococcus aureus subsp. aureus MW2
uaauuuaucaauuucuauu

SEQ ID NO: 2108736 - RNA, 22 nt, Staphylococcus aureus subsp. aureus MW2
uaauucugaaaucaguuuuuga

SEQ ID NO: 2108737 - RNA, 13 nt, Staphylococcus aureus subsp. aureus MW2
uaauucuaagucu

SEQ ID NO: 2108738 - RNA, 13 nt, Staphylococcus aureus subsp. aureus MW2
uaauucauauuca

SEQ ID NO: 2108739 - RNA, 18 nt, Staphylococcus aureus subsp. aureus MW2
uaauucauuuauuuucuu

SEQ ID NO: 2108740 - RNA, 18 nt, Staphylococcus aureus subsp. aureus MW2
uaauucguugauuuagca

SEQ ID NO: 2108741 - RNA, 11 nt, Staphylococcus aureus subsp. aureus MW2
uaauuaucauu

SEQ ID NO: 2108742 - RNA, 14 nt, Staphylococcus aureus subsp. aureus MW2
uaauuaaugccauu

SEQ ID NO: 2108743 - RNA, 15 nt, Staphylococcus aureus subsp. aureus MW2
uaauuaauuaaaagc

SEQ ID NO: 2108744 - RNA, 21 nt, Staphylococcus aureus subsp. aureus MW2
uaauuaauacaucaauaucuu

SEQ ID NO: 2108745 - RNA, 20 nt, Staphylococcus aureus subsp. aureus MW2
uaauuaagaaaaucauucau

SEQ ID NO: 2108746 - RNA, 21 nt, Staphylococcus aureus subsp. aureus MW2
uaauuaauuaucauaaauaua

SEQ ID NO: 2108747 - RNA, 17 nt, Staphylococcus aureus subsp. aureus MW2
uaauuaggauuuccgga

SEQ ID NO: 2108748 - RNA, 18 nt, Staphylococcus aureus subsp. aureus MW2
uaauuagucauugaaaau

SEQ ID NO: 2108749 - RNA, 22 nt, Staphylococcus aureus subsp. aureus MW2
uaauuagucauugaaaauauuu

SEQ ID NO: 2108750 - RNA, 23 nt, Staphylococcus aureus subsp. aureus MW2
uaauuaggauuuccggaacaaua

SEQ ID NO: 2108751 - RNA, 22 nt, Staphylococcus aureus subsp. aureus MW2
uaaugguugaauaacacuagaa

SEQ ID NO: 2108752 - RNA, 16 nt, Staphylococcus aureus subsp. aureus MW2
uaaugguuucaaaauc

SEQ ID NO: 2108753 - RNA, 16 nt, Staphylococcus aureus subsp. aureus MW2
uaauuaaauaaaaaua

SEQ ID NO: 2108754 - RNA, 16 nt, Staphylococcus aureus subsp. aureus MW2
uaauggcgugcuuuuc

SEQ ID NO: 2108755 - RNA, 16 nt, Staphylococcus aureus subsp. aureus MW2
uaaugacugacacuuu

SEQ ID NO: 2108756 - RNA, 17 nt, Staphylococcus aureus subsp. aureus MW2
uaaugacacgcucaggc

SEQ ID NO: 2108757 - RNA, 21 nt, Staphylococcus aureus subsp. aureus MW2
uaaugcagauucuucaccaac

SEQ ID NO: 2108758 - RNA, 16 nt, Staphylococcus aureus subsp. aureus MW2
uaaugcaugugaaauu

SEQ ID NO: 2108759 - RNA, 21 nt, Staphylococcus aureus subsp. aureus MW2
uaaugcaucaguauuaggauu

SEQ ID NO: 2108760 - RNA, 14 nt, Staphylococcus aureus subsp. aureus MW2
uaauggcaauuaaa

SEQ ID NO: 2108761 - RNA, 18 nt, Staphylococcus aureus subsp. aureus MW2
uaauggcacuuaauauaa

SEQ ID NO: 2108762 - RNA, 16 nt, Staphylococcus aureus subsp. aureus MW2
uaaugaacaacaaauu

SEQ ID NO: 2108763 - RNA, 21 nt, Staphylococcus aureus subsp. aureus MW2
uaaucuuuuuuacuaaaauca

SEQ ID NO: 2108764 - RNA, 18 nt, Staphylococcus aureus subsp. aureus MW2
uaaucuuuuuuacuaaaa

SEQ ID NO: 2108765 - RNA, 15 nt, Staphylococcus aureus subsp. aureus MW2
uaaugaauaaauaau

SEQ ID NO: 2108766 - RNA, 13 nt, Staphylococcus aureus subsp. aureus MW2
uaaugaauaguaa

SEQ ID NO: 2108767 - RNA, 16 nt, Staphylococcus aureus subsp. aureus MW2
uaaugaaguuaugaag

SEQ ID NO: 2108768 - RNA, 19 nt, Staphylococcus aureus subsp. aureus MW2
uaaugaagguaagugcuca

SEQ ID NO: 2108769 - RNA, 22 nt, Staphylococcus aureus subsp. aureus MW2
uaaucuuacugcuuuuuuaaau

SEQ ID NO: 2108770 - RNA, 15 nt, Staphylococcus aureus subsp. aureus MW2
uaaucuucacgcuua

SEQ ID NO: 2108771 - RNA, 20 nt, Staphylococcus aureus subsp. aureus MW2
uaaucuggguuguaaucuca

SEQ ID NO: 2108772 - RNA, 18 nt, Staphylococcus aureus subsp. aureus MW2
uaaucuuuaacauuuauu

SEQ ID NO: 2108773 - RNA, 17 nt, Staphylococcus aureus subsp. aureus MW2
uaaucuuuaacauuuau

SEQ ID NO: 2108774 - RNA, 22 nt, Staphylococcus aureus subsp. aureus MW2
uaaucuuguuuucauuuaaaag

SEQ ID NO: 2108775 - RNA, 15 nt, Staphylococcus aureus subsp. aureus MW2
uaaucuauaaauuau

SEQ ID NO: 2108776 - RNA, 16 nt, Staphylococcus aureus subsp. aureus MW2
uaaucuauuuucugcc

SEQ ID NO: 2108777 - RNA, 19 nt, Staphylococcus aureus subsp. aureus MW2
uaaucucaugccaaaaaca

SEQ ID NO: 2108778 - RNA, 14 nt, Staphylococcus aureus subsp. aureus MW2
uaaucucuuuacac

SEQ ID NO: 2108779 - RNA, 18 nt, Staphylococcus aureus subsp. aureus MW2
uaaucucuuuacaccauu

SEQ ID NO: 2108780 - RNA, 14 nt, Staphylococcus aureus subsp. aureus MW2
uaaucucauucuuu

SEQ ID NO: 2108781 - RNA, 16 nt, Staphylococcus aureus subsp. aureus MW2
uaaucuaaauucaguu

SEQ ID NO: 2108782 - RNA, 14 nt, Staphylococcus aureus subsp. aureus MW2
uaaucguucccauu

SEQ ID NO: 2108783 - RNA, 19 nt, Staphylococcus aureus subsp. aureus MW2
uaaucguauucauaucauu

SEQ ID NO: 2108784 - RNA, 15 nt, Staphylococcus aureus subsp. aureus MW2
uaaucguauuuuuaa

SEQ ID NO: 2108785 - RNA, 15 nt, Staphylococcus aureus subsp. aureus MW2
uaaucgaacagaaaa

SEQ ID NO: 2108786 - RNA, 14 nt, Staphylococcus aureus subsp. aureus MW2
uaacgauagacauu

SEQ ID NO: 2108787 - RNA, 15 nt, Staphylococcus aureus subsp. aureus MW2
uaacgaguuuucagu

SEQ ID NO: 2108788 - RNA, 19 nt, Staphylococcus aureus subsp. aureus MW2
uaacgauagauuuuuucau

SEQ ID NO: 2108789 - RNA, 22 nt, Staphylococcus aureus subsp. aureus MW2
uaacgagugaaaauaagauuau

SEQ ID NO: 2108790 - RNA, 23 nt, Staphylococcus aureus subsp. aureus MW2
uaacgaugguugcuucacuguuu

SEQ ID NO: 2108791 - RNA, 13 nt, Staphylococcus aureus subsp. aureus MW2
uaacgauuaauau

SEQ ID NO: 2108792 - RNA, 17 nt, Staphylococcus aureus subsp. aureus MW2
uacauuuugcucuaaac

SEQ ID NO: 2108793 - RNA, 21 nt, Staphylococcus aureus subsp. aureus MW2
uacauuuugaaacaucuaaau

SEQ ID NO: 2108794 - RNA, 21 nt, Staphylococcus aureus subsp. aureus MW2
uacauuuauuuucaauaaaua

SEQ ID NO: 2108795 - RNA, 23 nt, Staphylococcus aureus subsp. aureus MW2
uacauuuaguuggacaaauucua

SEQ ID NO: 2108796 - RNA, 19 nt, Staphylococcus aureus subsp. aureus MW2
uacauuuauuuaaugugca

SEQ ID NO: 2108797 - RNA, 20 nt, Staphylococcus aureus subsp. aureus MW2
uacauuuauuuucaauaaau

SEQ ID NO: 2108798 - RNA, 16 nt, Staphylococcus aureus subsp. aureus MW2
uacauuguaaauauag

SEQ ID NO: 2108799 - RNA, 19 nt, Staphylococcus aureus subsp. aureus MW2
uaccaagugcuuuuuuacc

SEQ ID NO: 2108800 - RNA, 22 nt, Staphylococcus aureus subsp. aureus MW2
uaccaagugcuuuuuuaccagc

SEQ ID NO: 2108801 - RNA, 17 nt, Staphylococcus aureus subsp. aureus MW2
uaccaaaaaguauugcc

SEQ ID NO: 2108802 - RNA, 14 nt, Staphylococcus aureus subsp. aureus MW2
uaccaaacaauaca

SEQ ID NO: 2108803 - RNA, 14 nt, Staphylococcus aureus subsp. aureus MW2
uacauauguguaug

SEQ ID NO: 2108804 - RNA, 16 nt, Staphylococcus aureus subsp. aureus MW2
uacauauguuguuucu

SEQ ID NO: 2108805 - RNA, 14 nt, Staphylococcus aureus subsp. aureus MW2
uacaucuuuaagcu

SEQ ID NO: 2108806 - RNA, 14 nt, Staphylococcus aureus subsp. aureus MW2
uacauauaguacuu

SEQ ID NO: 2108807 - RNA, 17 nt, Staphylococcus aureus subsp. aureus MW2
uacaugacauucauuua

SEQ ID NO: 2108808 - RNA, 14 nt, Staphylococcus aureus subsp. aureus MW2
uacaugauauaaau

SEQ ID NO: 2108809 - RNA, 16 nt, Staphylococcus aureus subsp. aureus MW2
uacauguauaaaagau

SEQ ID NO: 2108810 - RNA, 12 nt, Staphylococcus aureus subsp. aureus MW2
uacauuaaaaau

SEQ ID NO: 2108811 - RNA, 17 nt, Staphylococcus aureus subsp. aureus MW2
uacaugcccaaauugcc

SEQ ID NO: 2108812 - RNA, 22 nt, Staphylococcus aureus subsp. aureus MW2
uacauguaacagugugaaauaa

SEQ ID NO: 2108813 - RNA, 17 nt, Staphylococcus aureus subsp. aureus MW2
uacauauaauaugugca

SEQ ID NO: 2108814 - RNA, 13 nt, Staphylococcus aureus subsp. aureus MW2
uacauauacaaau

SEQ ID NO: 2108815 - RNA, 16 nt, Staphylococcus aureus subsp. aureus MW2
uacauauaucaacaug

SEQ ID NO: 2108816 - RNA, 15 nt, Staphylococcus aureus subsp. aureus MW2
uacauauauucuaau

SEQ ID NO: 2108817 - RNA, 14 nt, Staphylococcus aureus subsp. aureus MW2
uacauaugaaaaau

SEQ ID NO: 2108818 - RNA, 17 nt, Staphylococcus aureus subsp. aureus MW2
uacauaugaaaaauguc

SEQ ID NO: 2108819 - RNA, 18 nt, Staphylococcus aureus subsp. aureus MW2
uacauaaaauggcaucug

SEQ ID NO: 2108820 - RNA, 12 nt, Staphylococcus aureus subsp. aureus MW2
uacauaaaaaua

SEQ ID NO: 2108821 - RNA, 13 nt, Staphylococcus aureus subsp. aureus MW2
uacauaaaaauaa

SEQ ID NO: 2108822 - RNA, 15 nt, Staphylococcus aureus subsp. aureus MW2
uacauaaaucuaaua

SEQ ID NO: 2108823 - RNA, 22 nt, Staphylococcus aureus subsp. aureus MW2
uacauaaaugcuaaaaguauaa

SEQ ID NO: 2108824 - RNA, 17 nt, Staphylococcus aureus subsp. aureus MW2
uacagauuuuaaaaauu

SEQ ID NO: 2108825 - RNA, 19 nt, Staphylococcus aureus subsp. aureus MW2
uacagauuuuaaaaauuca

SEQ ID NO: 2108826 - RNA, 20 nt, Staphylococcus aureus subsp. aureus MW2
uacagauuuuaaaaauucau

SEQ ID NO: 2108827 - RNA, 20 nt, Staphylococcus aureus subsp. aureus MW2
uacagcgugauucaucuauu

SEQ ID NO: 2108828 - RNA, 18 nt, Staphylococcus aureus subsp. aureus MW2
uacagcuagcaagaauag

SEQ ID NO: 2108829 - RNA, 13 nt, Staphylococcus aureus subsp. aureus MW2
uacacaaaguauu

SEQ ID NO: 2108830 - RNA, 14 nt, Staphylococcus aureus subsp. aureus MW2
uacacaaaguauuu

SEQ ID NO: 2108831 - RNA, 16 nt, Staphylococcus aureus subsp. aureus MW2
uacaauuauauguagg

SEQ ID NO: 2108832 - RNA, 14 nt, Staphylococcus aureus subsp. aureus MW2
uacaauuauggaua

SEQ ID NO: 2108833 - RNA, 18 nt, Staphylococcus aureus subsp. aureus MW2
uacaauuauggauaaaau

SEQ ID NO: 2108834 - RNA, 17 nt, Staphylococcus aureus subsp. aureus MW2
uacacaaugauuauaaa

SEQ ID NO: 2108835 - RNA, 19 nt, Staphylococcus aureus subsp. aureus MW2
uacacaaugccuuuaaagc

SEQ ID NO: 2108836 - RNA, 16 nt, Staphylococcus aureus subsp. aureus MW2
uacaauuauaaaugau

SEQ ID NO: 2108837 - RNA, 21 nt, Staphylococcus aureus subsp. aureus MW2
uacaaugaauuucuaauuuag

SEQ ID NO: 2108838 - RNA, 18 nt, Staphylococcus aureus subsp. aureus MW2
uacaauaguauaaauauc

SEQ ID NO: 2108839 - RNA, 15 nt, Staphylococcus aureus subsp. aureus MW2
uacaaucaaaaaacg

SEQ ID NO: 2108840 - RNA, 17 nt, Staphylococcus aureus subsp. aureus MW2
uacaauauagaaaauga

SEQ ID NO: 2108841 - RNA, 17 nt, Staphylococcus aureus subsp. aureus MW2
uaauuuuauuuugugcu

SEQ ID NO: 2108842 - RNA, 21 nt, Staphylococcus aureus subsp. aureus MW2
uaauuuucacuuucaaugaca

SEQ ID NO: 2108843 - RNA, 14 nt, Staphylococcus aureus subsp. aureus MW2
uacaacauacaugc

SEQ ID NO: 2108844 - RNA, 17 nt, Staphylococcus aureus subsp. aureus MW2
uaauuuuaacuuuauag

SEQ ID NO: 2108845 - RNA, 16 nt, Staphylococcus aureus subsp. aureus MW2
uaauuuuacucuguau

SEQ ID NO: 2108846 - RNA, 15 nt, Staphylococcus aureus subsp. aureus MW2
uaauuuuaaaaauaa

SEQ ID NO: 2108847 - RNA, 22 nt, Staphylococcus aureus subsp. aureus MW2
uacaauaaugugcaaguugggg

SEQ ID NO: 2108848 - RNA, 13 nt, Staphylococcus aureus subsp. aureus MW2
uacaauaaucacu

SEQ ID NO: 2108849 - RNA, 15 nt, Staphylococcus aureus subsp. aureus MW2
uacaauaaugugcaa

SEQ ID NO: 2108850 - RNA, 17 nt, Staphylococcus aureus subsp. aureus MW2
uacaauaguauaaauau

SEQ ID NO: 2108851 - RNA, 18 nt, Staphylococcus aureus subsp. aureus MW2
uacaaguuuauaaucuuu

SEQ ID NO: 2108852 - RNA, 21 nt, Staphylococcus aureus subsp. aureus MW2
uacaacgacacgaacaacauu

SEQ ID NO: 2108853 - RNA, 23 nt, Staphylococcus aureus subsp. aureus MW2
uacaacgacacgaacaacauuag

SEQ ID NO: 2108854 - RNA, 16 nt, Staphylococcus aureus subsp. aureus MW2
uacacuuuugauuguu

SEQ ID NO: 2108855 - RNA, 12 nt, Staphylococcus aureus subsp. aureus MW2
uacacuuuugau

SEQ ID NO: 2108856 - RNA, 12 nt, Staphylococcus aureus subsp. aureus MW2
uacacuuaauau

SEQ ID NO: 2108857 - RNA, 14 nt, Staphylococcus aureus subsp. aureus MW2
uacacuuuaaauac

SEQ ID NO: 2108858 - RNA, 15 nt, Staphylococcus aureus subsp. aureus MW2
uacagauaauuauuu

SEQ ID NO: 2108859 - RNA, 19 nt, Staphylococcus aureus subsp. aureus MW2
uacagauaggaaacuuaaa

SEQ ID NO: 2108860 - RNA, 16 nt, Staphylococcus aureus subsp. aureus MW2
uacagacaaacauuac

SEQ ID NO: 2108861 - RNA, 17 nt, Staphylococcus aureus subsp. aureus MW2
uacagagaaucaauuau

SEQ ID NO: 2108862 - RNA, 18 nt, Staphylococcus aureus subsp. aureus MW2
uacacugcacaucauaau

SEQ ID NO: 2108863 - RNA, 20 nt, Staphylococcus aureus subsp. aureus MW2
uacacuccccuuaucaaaac

SEQ ID NO: 2108864 - RNA, 14 nt, Staphylococcus aureus subsp. aureus MW2
uacacuagucuuuu

SEQ ID NO: 2108865 - RNA, 24 nt, Staphylococcus aureus subsp. aureus MW2
uacacuaucauuaucaaauaaccu

SEQ ID NO: 2108866 - RNA, 15 nt, Staphylococcus aureus subsp. aureus MW2
uacacgucuaauuuu

SEQ ID NO: 2108867 - RNA, 17 nt, Staphylococcus aureus subsp. aureus MW2
uauuugaaagguaagua

SEQ ID NO: 2108868 - RNA, 14 nt, Staphylococcus aureus subsp. aureus MW2
uauuugaaaauauu

SEQ ID NO: 2108869 - RNA, 12 nt, Staphylococcus aureus subsp. aureus MW2
uauuugaaauaa

SEQ ID NO: 2108870 - RNA, 15 nt, Staphylococcus aureus subsp. aureus MW2
uauuugaaauaauau

SEQ ID NO: 2108871 - RNA, 18 nt, Staphylococcus aureus subsp. aureus MW2
uauuugaaagcauuuaaa

SEQ ID NO: 2108872 - RNA, 21 nt, Staphylococcus aureus subsp. aureus MW2
uauuugaaagcauuuaaauau

SEQ ID NO: 2108873 - RNA, 15 nt, Staphylococcus aureus subsp. aureus MW2
uauuugauauuucau

SEQ ID NO: 2108874 - RNA, 12 nt, Staphylococcus aureus subsp. aureus MW2
uauuugauuaaa

SEQ ID NO: 2108875 - RNA, 15 nt, Staphylococcus aureus subsp. aureus MW2
uauuugauuaaauua

SEQ ID NO: 2108876 - RNA, 17 nt, Staphylococcus aureus subsp. aureus MW2
uauuugauuauguaaau

SEQ ID NO: 2108877 - RNA, 21 nt, Staphylococcus aureus subsp. aureus MW2
uauuugauuauucguauucaa

SEQ ID NO: 2108878 - RNA, 13 nt, Staphylococcus aureus subsp. aureus MW2
uauuugauacaac

SEQ ID NO: 2108879 - RNA, 15 nt, Staphylococcus aureus subsp. aureus MW2
uauuugauaacaaaa

SEQ ID NO: 2108880 - RNA, 15 nt, Staphylococcus aureus subsp. aureus MW2
uauuugauaauauug

SEQ ID NO: 2108881 - RNA, 16 nt, Staphylococcus aureus subsp. aureus MW2
uauuugauaaauaaaa

SEQ ID NO: 2108882 - RNA, 14 nt, Staphylococcus aureus subsp. aureus MW2
uauuugaauacuuu

SEQ ID NO: 2108883 - RNA, 14 nt, Staphylococcus aureus subsp. aureus MW2
uauuugcugaauga

SEQ ID NO: 2108884 - RNA, 23 nt, Staphylococcus aureus subsp. aureus MW2
uauuugcugaaugaagcauuuua

SEQ ID NO: 2108885 - RNA, 19 nt, Staphylococcus aureus subsp. aureus MW2
uauuugcuagucauaauuu

SEQ ID NO: 2108886 - RNA, 21 nt, Staphylococcus aureus subsp. aureus MW2
uauuuggaugguaaguauaau

SEQ ID NO: 2108887 - RNA, 17 nt, Staphylococcus aureus subsp. aureus MW2
uauuugauuauucuuca

SEQ ID NO: 2108888 - RNA, 18 nt, Staphylococcus aureus subsp. aureus MW2
uauuugccuuuugaauaa

SEQ ID NO: 2108889 - RNA, 14 nt, Staphylococcus aureus subsp. aureus MW2
uauuugauucuuca

SEQ ID NO: 2108890 - RNA, 15 nt, Staphylococcus aureus subsp. aureus MW2
uauuucuguuuuccu

SEQ ID NO: 2108891 - RNA, 16 nt, Staphylococcus aureus subsp. aureus MW2
uauuucuuaccauuua

SEQ ID NO: 2108892 - RNA, 19 nt, Staphylococcus aureus subsp. aureus MW2
uauuucuauaucuauuuau

SEQ ID NO: 2108893 - RNA, 21 nt, Staphylococcus aureus subsp. aureus MW2
uauuucuaaauuauuuauuca

SEQ ID NO: 2108894 - RNA, 20 nt, Staphylococcus aureus subsp. aureus MW2
uauuucgguuagucuuaauc

SEQ ID NO: 2108895 - RNA, 17 nt, Staphylococcus aureus subsp. aureus MW2
uauuucgucgucccacc

SEQ ID NO: 2108896 - RNA, 21 nt, Staphylococcus aureus subsp. aureus MW2
uauuuccguuuuagaauuuaa

SEQ ID NO: 2108897 - RNA, 15 nt, Staphylococcus aureus subsp. aureus MW2
uauuucauuagaaaa

SEQ ID NO: 2108898 - RNA, 16 nt, Staphylococcus aureus subsp. aureus MW2
uauuuucaauuagaaa

SEQ ID NO: 2108899 - RNA, 14 nt, Staphylococcus aureus subsp. aureus MW2
uauuuucaaaugug

SEQ ID NO: 2108900 - RNA, 16 nt, Staphylococcus aureus subsp. aureus MW2
uauuuucaauaaauuu

SEQ ID NO: 2108901 - RNA, 15 nt, Staphylococcus aureus subsp. aureus MW2
uauuuuauuuaaaaa

SEQ ID NO: 2108902 - RNA, 16 nt, Staphylococcus aureus subsp. aureus MW2
uauuuuauuuaaaaau

SEQ ID NO: 2108903 - RNA, 17 nt, Staphylococcus aureus subsp. aureus MW2
uauuuuauuuaaaaaua

SEQ ID NO: 2108904 - RNA, 13 nt, Staphylococcus aureus subsp. aureus MW2
uauuuuauuuaaa

SEQ ID NO: 2108905 - RNA, 20 nt, Staphylococcus aureus subsp. aureus MW2
uauuuuaugacguaauuaau

SEQ ID NO: 2108906 - RNA, 12 nt, Staphylococcus aureus subsp. aureus MW2
uauuuuaugauu

SEQ ID NO: 2108907 - RNA, 12 nt, Staphylococcus aureus subsp. aureus MW2
uauuuuaucugu

SEQ ID NO: 2108908 - RNA, 19 nt, Staphylococcus aureus subsp. aureus MW2
uauuuuaucaucuauucaa

SEQ ID NO: 2108909 - RNA, 14 nt, Staphylococcus aureus subsp. aureus MW2
uauuuuacucuuuu

SEQ ID NO: 2108910 - RNA, 23 nt, Staphylococcus aureus subsp. aureus MW2
uauuuuaucaagagguaaaucug

SEQ ID NO: 2108911 - RNA, 14 nt, Staphylococcus aureus subsp. aureus MW2
uauuuuauaauaaa

SEQ ID NO: 2108912 - RNA, 17 nt, Staphylococcus aureus subsp. aureus MW2
uauuuuauaauaaauuu

SEQ ID NO: 2108913 - RNA, 13 nt, Staphylococcus aureus subsp. aureus MW2
uauuuuauacaua

SEQ ID NO: 2108914 - RNA, 22 nt, Staphylococcus aureus subsp. aureus MW2
uauuuuaguacuuaauacuaau

SEQ ID NO: 2108915 - RNA, 17 nt, Staphylococcus aureus subsp. aureus MW2
uauuuuaaaauauuaau

SEQ ID NO: 2108916 - RNA, 20 nt, Staphylococcus aureus subsp. aureus MW2
uauuuuaaaauauuaaucaa

SEQ ID NO: 2108917 - RNA, 22 nt, Staphylococcus aureus subsp. aureus MW2
uauuuuaaacguaucauuuaaa

SEQ ID NO: 2108918 - RNA, 15 nt, Staphylococcus aureus subsp. aureus MW2
uauuuuaaauuuaau

SEQ ID NO: 2108919 - RNA, 10 nt, Staphylococcus aureus subsp. aureus MW2
uauuuuaaac

SEQ ID NO: 2108920 - RNA, 19 nt, Staphylococcus aureus subsp. aureus MW2
uauuuuagcucuuguucaa

SEQ ID NO: 2108921 - RNA, 14 nt, Staphylococcus aureus subsp. aureus MW2
uauuuugacguuuu

SEQ ID NO: 2108922 - RNA, 12 nt, Staphylococcus aureus subsp. aureus MW2
uauuuuguaguu

SEQ ID NO: 2108923 - RNA, 14 nt, Staphylococcus aureus subsp. aureus MW2
uauuuuguauuuuu

SEQ ID NO: 2108924 - RNA, 15 nt, Staphylococcus aureus subsp. aureus MW2
uauuuuguuaauaag

SEQ ID NO: 2108925 - RNA, 16 nt, Staphylococcus aureus subsp. aureus MW2
uauuuuguuuuaaaaa

SEQ ID NO: 2108926 - RNA, 13 nt, Staphylococcus aureus subsp. aureus MW2
uauuuuuaaucuu

SEQ ID NO: 2108927 - RNA, 23 nt, Staphylococcus aureus subsp. aureus MW2
uauuuuuaaucuucaucuaaaaa

SEQ ID NO: 2108928 - RNA, 14 nt, Staphylococcus aureus subsp. aureus MW2
uauuuucauuuuag

SEQ ID NO: 2108929 - RNA, 16 nt, Staphylococcus aureus subsp. aureus MW2
uauuuucauuuuucuu

SEQ ID NO: 2108930 - RNA, 20 nt, Staphylococcus aureus subsp. aureus MW2
uauuuucauaaacucuuaua

SEQ ID NO: 2108931 - RNA, 13 nt, Staphylococcus aureus subsp. aureus MW2
uauuuucuugugu

SEQ ID NO: 2108932 - RNA, 13 nt, Staphylococcus aureus subsp. aureus MW2
uauuuucuuuuuc

SEQ ID NO: 2108933 - RNA, 20 nt, Staphylococcus aureus subsp. aureus MW2
uauuuucuuuuucuaaauaa

SEQ ID NO: 2108934 - RNA, 21 nt, Staphylococcus aureus subsp. aureus MW2
uauuuucuuuuucuaaauaaa

SEQ ID NO: 2108935 - RNA, 17 nt, Staphylococcus aureus subsp. aureus MW2
uauuuucucuauaauuu

SEQ ID NO: 2108936 - RNA, 13 nt, Staphylococcus aureus subsp. aureus MW2
uauuuucucuaua

SEQ ID NO: 2108937 - RNA, 12 nt, Staphylococcus aureus subsp. aureus MW2
uauuuucuuaga

SEQ ID NO: 2108938 - RNA, 12 nt, Staphylococcus aureus subsp. aureus MW2
ucaaagaaaaag

SEQ ID NO: 2108939 - RNA, 13 nt, Staphylococcus aureus subsp. aureus MW2
ucaaacuuuucaa

SEQ ID NO: 2108940 - RNA, 14 nt, Staphylococcus aureus subsp. aureus MW2
ucaaaccuguuugg

SEQ ID NO: 2108941 - RNA, 23 nt, Staphylococcus aureus subsp. aureus MW2
ucaaaccuguuuggaaaaucccu

SEQ ID NO: 2108942 - RNA, 13 nt, Staphylococcus aureus subsp. aureus MW2
ucaaaauauaaaa

SEQ ID NO: 2108943 - RNA, 12 nt, Staphylococcus aureus subsp. aureus MW2
ucaaaguagaca

SEQ ID NO: 2108944 - RNA, 23 nt, Staphylococcus aureus subsp. aureus MW2
ucaaagauacaccaauauuuuuc

SEQ ID NO: 2108945 - RNA, 21 nt, Staphylococcus aureus subsp. aureus MW2
ucaaaguuuucauuuaacaug

SEQ ID NO: 2108946 - RNA, 19 nt, Staphylococcus aureus subsp. aureus MW2
ucaaaguuuucauuuaaca

SEQ ID NO: 2108947 - RNA, 14 nt, Staphylococcus aureus subsp. aureus MW2
ucaaaguuuucauu

SEQ ID NO: 2108948 - RNA, 15 nt, Staphylococcus aureus subsp. aureus MW2
ucaaaguuuucauuu

SEQ ID NO: 2108949 - RNA, 17 nt, Staphylococcus aureus subsp. aureus MW2
ucaaauaaccuauuaau

SEQ ID NO: 2108950 - RNA, 17 nt, Staphylococcus aureus subsp. aureus MW2
ucaaauaacugaguuaa

SEQ ID NO: 2108951 - RNA, 21 nt, Staphylococcus aureus subsp. aureus MW2
ucaaauaaugugaaaaaucuu

SEQ ID NO: 2108952 - RNA, 22 nt, Staphylococcus aureus subsp. aureus MW2
ucaaauaaugugaaaaaucuuc

SEQ ID NO: 2108953 - RNA, 18 nt, Staphylococcus aureus subsp. aureus MW2
ucaaauaaugugaaaaau

SEQ ID NO: 2108954 - RNA, 14 nt, Staphylococcus aureus subsp. aureus MW2
ucaaauaauauaaa

SEQ ID NO: 2108955 - RNA, 16 nt, Staphylococcus aureus subsp. aureus MW2
ucaaauccaaaaucuu

SEQ ID NO: 2108956 - RNA, 21 nt, Staphylococcus aureus subsp. aureus MW2
ucaaauacauuucaaaaaaag

SEQ ID NO: 2108957 - RNA, 18 nt, Staphylococcus aureus subsp. aureus MW2
uauuuuugucaucaugau

SEQ ID NO: 2108958 - RNA, 12 nt, Staphylococcus aureus subsp. aureus MW2
uauuuuuuaaug

SEQ ID NO: 2108959 - RNA, 14 nt, Staphylococcus aureus subsp. aureus MW2
uauuuuuuaaaugc

SEQ ID NO: 2108960 - RNA, 23 nt, Staphylococcus aureus subsp. aureus MW2
uauuuuugauagugguagccaau

SEQ ID NO: 2108961 - RNA, 20 nt, Staphylococcus aureus subsp. aureus MW2
uauuuuugacuguuaaacaa

SEQ ID NO: 2108962 - RNA, 11 nt, Staphylococcus aureus subsp. aureus MW2
uauuuuucuuu

SEQ ID NO: 2108963 - RNA, 14 nt, Staphylococcus aureus subsp. aureus MW2
uauuuuucaaauaa

SEQ ID NO: 2108964 - RNA, 21 nt, Staphylococcus aureus subsp. aureus MW2
uauuuuuugagcacuuaauaa

SEQ ID NO: 2108965 - RNA, 17 nt, Staphylococcus aureus subsp. aureus MW2
uauuuuuuauguuuuaa

SEQ ID NO: 2108966 - RNA, 13 nt, Staphylococcus aureus subsp. aureus MW2
uauuuuuuuaaau

SEQ ID NO: 2108967 - RNA, 12 nt, Staphylococcus aureus subsp. aureus MW2
uauuuuuuuaau

SEQ ID NO: 2108968 - RNA, 22 nt, Staphylococcus aureus subsp. aureus MW2
uauuuuuuuguccaauaaauuu

SEQ ID NO: 2108969 - RNA, 12 nt, Staphylococcus aureus subsp. aureus MW2
ucaaaaaaauau

SEQ ID NO: 2108970 - RNA, 20 nt, Staphylococcus aureus subsp. aureus MW2
ucaaaaaauauguuuaaugu

SEQ ID NO: 2108971 - RNA, 12 nt, Staphylococcus aureus subsp. aureus MW2
ucaaaaaugagc

SEQ ID NO: 2108972 - RNA, 12 nt, Staphylococcus aureus subsp. aureus MW2
ucaaaaaucaua

SEQ ID NO: 2108973 - RNA, 21 nt, Staphylococcus aureus subsp. aureus MW2
ucaaaacaauuuaaaaagcag

SEQ ID NO: 2108974 - RNA, 19 nt, Staphylococcus aureus subsp. aureus MW2
ucaaaacaauuuaaaaagc

SEQ ID NO: 2108975 - RNA, 17 nt, Staphylococcus aureus subsp. aureus MW2
ucaaaaauuguuaauac

SEQ ID NO: 2108976 - RNA, 18 nt, Staphylococcus aureus subsp. aureus MW2
ucaaaaccgcuauaaaau

SEQ ID NO: 2108977 - RNA, 12 nt, Staphylococcus aureus subsp. aureus MW2
uauuuauuuaau

SEQ ID NO: 2108978 - RNA, 15 nt, Staphylococcus aureus subsp. aureus MW2
uauuuauuuuauaau

SEQ ID NO: 2108979 - RNA, 17 nt, Staphylococcus aureus subsp. aureus MW2
uauuuauuuuauaauaa

SEQ ID NO: 2108980 - RNA, 13 nt, Staphylococcus aureus subsp. aureus MW2
uauuuauuuugau

SEQ ID NO: 2108981 - RNA, 19 nt, Staphylococcus aureus subsp. aureus MW2
uauuuauucuaaucuaaau

SEQ ID NO: 2108982 - RNA, 23 nt, Staphylococcus aureus subsp. aureus MW2
uauuuauucuaaucuaaauucag

SEQ ID NO: 2108983 - RNA, 13 nt, Staphylococcus aureus subsp. aureus MW2
uauuucaaaugua

SEQ ID NO: 2108984 - RNA, 19 nt, Staphylococcus aureus subsp. aureus MW2
uauuucaacuuuuuaauaa

SEQ ID NO: 2108985 - RNA, 16 nt, Staphylococcus aureus subsp. aureus MW2
uauuucagcuuauuaa

SEQ ID NO: 2108986 - RNA, 14 nt, Staphylococcus aureus subsp. aureus MW2
uauuucauauaugu

SEQ ID NO: 2108987 - RNA, 15 nt, Staphylococcus aureus subsp. aureus MW2
uauuuagauugguca

SEQ ID NO: 2108988 - RNA, 14 nt, Staphylococcus aureus subsp. aureus MW2
uauuuagauucuuu

SEQ ID NO: 2108989 - RNA, 16 nt, Staphylococcus aureus subsp. aureus MW2
uauuuagauuuauaac

SEQ ID NO: 2108990 - RNA, 15 nt, Staphylococcus aureus subsp. aureus MW2
uauuuagauaaaaaa

SEQ ID NO: 2108991 - RNA, 22 nt, Staphylococcus aureus subsp. aureus MW2
uauuuaggacgugccuuaacuu

SEQ ID NO: 2108992 - RNA, 14 nt, Staphylococcus aureus subsp. aureus MW2
uauuuauaaaauaa

SEQ ID NO: 2108993 - RNA, 15 nt, Staphylococcus aureus subsp. aureus MW2
uauuuauaaacaaua

SEQ ID NO: 2108994 - RNA, 18 nt, Staphylococcus aureus subsp. aureus MW2
uauuuauacuaaauugag

SEQ ID NO: 2108995 - RNA, 17 nt, Staphylococcus aureus subsp. aureus MW2
uauuuauauuaaauacu

SEQ ID NO: 2108996 - RNA, 15 nt, Staphylococcus aureus subsp. aureus MW2
uauuuauauuaaaua

SEQ ID NO: 2108997 - RNA, 16 nt, Staphylococcus aureus subsp. aureus MW2
uauuuagaauaaacuu

SEQ ID NO: 2108998 - RNA, 16 nt, Staphylococcus aureus subsp. aureus MW2
uauuuagaauauuaac

SEQ ID NO: 2108999 - RNA, 14 nt, Staphylococcus aureus subsp. aureus MW2
uauuuagaauaaac

SEQ ID NO: 2109000 - RNA, 21 nt, Staphylococcus aureus subsp. aureus MW2
uauuuagaaaguuuuauuuaa

SEQ ID NO: 2109001 - RNA, 22 nt, Staphylococcus aureus subsp. aureus MW2
uauuuagaaaguuuuauuuaaa

SEQ ID NO: 2109002 - RNA, 22 nt, Staphylococcus aureus subsp. aureus MW2
uauuuacaauguuaucuugcuu

SEQ ID NO: 2109003 - RNA, 23 nt, Staphylococcus aureus subsp. aureus MW2
uauuuaaaucaauauucucuuua

SEQ ID NO: 2109004 - RNA, 16 nt, Staphylococcus aureus subsp. aureus MW2
uauuuaaauuuuaagu

SEQ ID NO: 2109005 - RNA, 14 nt, Staphylococcus aureus subsp. aureus MW2
uauugguuauauau

SEQ ID NO: 2109006 - RNA, 20 nt, Staphylococcus aureus subsp. aureus MW2
uauuguaaucacuauuuguu

SEQ ID NO: 2109007 - RNA, 22 nt, Staphylococcus aureus subsp. aureus MW2
uauugcuacccaccuuucuuua

SEQ ID NO: 2109008 - RNA, 23 nt, Staphylococcus aureus subsp. aureus MW2
uauugccguuauuuucaauaaau

SEQ ID NO: 2109009 - RNA, 21 nt, Staphylococcus aureus subsp. aureus MW2
uauuuaaacuaguaauagaau

SEQ ID NO: 2109010 - RNA, 16 nt, Staphylococcus aureus subsp. aureus MW2
uauuuaaacucauaau

SEQ ID NO: 2109011 - RNA, 22 nt, Staphylococcus aureus subsp. aureus MW2
uauuuaaacucauaauuuucua

SEQ ID NO: 2109012 - RNA, 20 nt, Staphylococcus aureus subsp. aureus MW2
uauuuaaacgguaacaaaga

SEQ ID NO: 2109013 - RNA, 19 nt, Staphylococcus aureus subsp. aureus MW2
uauuuaaacucucuaaaaa

SEQ ID NO: 2109014 - RNA, 16 nt, Staphylococcus aureus subsp. aureus MW2
uauuuaaacuaguaau

SEQ ID NO: 2109015 - RNA, 21 nt, Staphylococcus aureus subsp. aureus MW2
uauuuaaauagaagaaaagaa

SEQ ID NO: 2109016 - RNA, 19 nt, Staphylococcus aureus subsp. aureus MW2
uauuuaaaauauuauuuuu

SEQ ID NO: 2109017 - RNA, 23 nt, Staphylococcus aureus subsp. aureus MW2
uauuuaaaauauuauuuuuaagu

SEQ ID NO: 2109018 - RNA, 12 nt, Staphylococcus aureus subsp. aureus MW2
uauuuaaaauca

SEQ ID NO: 2109019 - RNA, 20 nt, Staphylococcus aureus subsp. aureus MW2
uauugucuucucaacaaauc

SEQ ID NO: 2109020 - RNA, 16 nt, Staphylococcus aureus subsp. aureus MW2
uauugugccgcuucua

SEQ ID NO: 2109021 - RNA, 13 nt, Staphylococcus aureus subsp. aureus MW2
uauugauuauucu

SEQ ID NO: 2109022 - RNA, 23 nt, Staphylococcus aureus subsp. aureus MW2
uauugauuauucuuuaauuaaau

SEQ ID NO: 2109023 - RNA, 13 nt, Staphylococcus aureus subsp. aureus MW2
uauugaugaucaa

SEQ ID NO: 2109024 - RNA, 21 nt, Staphylococcus aureus subsp. aureus MW2
uauugaugaauaaauagauaa

SEQ ID NO: 2109025 - RNA, 15 nt, Staphylococcus aureus subsp. aureus MW2
uauugagaauauuaa

SEQ ID NO: 2109026 - RNA, 17 nt, Staphylococcus aureus subsp. aureus MW2
uauugaauaaaaaaaca

SEQ ID NO: 2109027 - RNA, 13 nt, Staphylococcus aureus subsp. aureus MW2
uauugaaugaagu

SEQ ID NO: 2109028 - RNA, 14 nt, Staphylococcus aureus subsp. aureus MW2
uauugaauugaaaa

SEQ ID NO: 2109029 - RNA, 14 nt, Staphylococcus aureus subsp. aureus MW2
aaaucgaacaaaug

SEQ ID NO: 2109030 - RNA, 14 nt, Staphylococcus aureus subsp. aureus MW2
aaaucgaaauuucc

SEQ ID NO: 2109031 - RNA, 20 nt, Staphylococcus aureus subsp. aureus MW2
uauucugcaccuguuuuaau

SEQ ID NO: 2109032 - RNA, 15 nt, Staphylococcus aureus subsp. aureus MW2
uauuacuuauuucuu

SEQ ID NO: 2109033 - RNA, 13 nt, Staphylococcus aureus subsp. aureus MW2
uauuacuucucau

SEQ ID NO: 2109034 - RNA, 14 nt, Staphylococcus aureus subsp. aureus MW2
uauuacuugaaaau

SEQ ID NO: 2109035 - RNA, 16 nt, Staphylococcus aureus subsp. aureus MW2
uauuacuuauuucuuu

SEQ ID NO: 2109036 - RNA, 20 nt, Staphylococcus aureus subsp. aureus MW2
uauuacuuauuucuuuucau

SEQ ID NO: 2109037 - RNA, 21 nt, Staphylococcus aureus subsp. aureus MW2
uauuacuuauuucuuuucauu

SEQ ID NO: 2109038 - RNA, 22 nt, Staphylococcus aureus subsp. aureus MW2
uauuacuacauaauuuaucaau

SEQ ID NO: 2109039 - RNA, 19 nt, Staphylococcus aureus subsp. aureus MW2
uauuacuauaaaaaacagc

SEQ ID NO: 2109040 - RNA, 21 nt, Staphylococcus aureus subsp. aureus MW2
uauuacuaaccuauuaaaaua

SEQ ID NO: 2109041 - RNA, 24 nt, Staphylococcus aureus subsp. aureus MW2
uauccgcaucuuuugguuuaucug

SEQ ID NO: 2109042 - RNA, 16 nt, Staphylococcus aureus subsp. aureus MW2
uauccauucuuuuuca

SEQ ID NO: 2109043 - RNA, 14 nt, Staphylococcus aureus subsp. aureus MW2
uauccauuaugaug

SEQ ID NO: 2109044 - RNA, 14 nt, Staphylococcus aureus subsp. aureus MW2
uauuauaauuuugu

SEQ ID NO: 2109045 - RNA, 16 nt, Staphylococcus aureus subsp. aureus MW2
uauuaggcuuaaauau

SEQ ID NO: 2109046 - RNA, 14 nt, Staphylococcus aureus subsp. aureus MW2
uauuaggauuuacu

SEQ ID NO: 2109047 - RNA, 22 nt, Staphylococcus aureus subsp. aureus MW2
uauuauacugcucuuuauauau

SEQ ID NO: 2109048 - RNA, 20 nt, Staphylococcus aureus subsp. aureus MW2
uauuauagaaagcaaugucu

SEQ ID NO: 2109049 - RNA, 14 nt, Staphylococcus aureus subsp. aureus MW2
uauuauauaaaagu

SEQ ID NO: 2109050 - RNA, 15 nt, Staphylococcus aureus subsp. aureus MW2
uauuauaguuuagau

SEQ ID NO: 2109051 - RNA, 22 nt, Staphylococcus aureus subsp. aureus MW2
uauuauagggcuguuuuuuaau

SEQ ID NO: 2109052 - RNA, 17 nt, Staphylococcus aureus subsp. aureus MW2
uauuagauacuucuuua

SEQ ID NO: 2109053 - RNA, 22 nt, Staphylococcus aureus subsp. aureus MW2
uauuauaauaucgacuuuucua

SEQ ID NO: 2109054 - RNA, 19 nt, Staphylococcus aureus subsp. aureus MW2
uauuagccaauaaaauguc

SEQ ID NO: 2109055 - RNA, 18 nt, Staphylococcus aureus subsp. aureus MW2
uauuagccaauaaaaugu

SEQ ID NO: 2109056 - RNA, 14 nt, Staphylococcus aureus subsp. aureus MW2
uauuagcuuuuuca

SEQ ID NO: 2109057 - RNA, 13 nt, Staphylococcus aureus subsp. aureus MW2
uauuauucucuca

SEQ ID NO: 2109058 - RNA, 21 nt, Staphylococcus aureus subsp. aureus MW2
uauuauugaaacuaauaauuu

SEQ ID NO: 2109059 - RNA, 16 nt, Staphylococcus aureus subsp. aureus MW2
uauuauucguuucuuu

SEQ ID NO: 2109060 - RNA, 15 nt, Staphylococcus aureus subsp. aureus MW2
uauuauuauguuaau

SEQ ID NO: 2109061 - RNA, 14 nt, Staphylococcus aureus subsp. aureus MW2
uauuauuauaauuu

SEQ ID NO: 2109062 - RNA, 15 nt, Staphylococcus aureus subsp. aureus MW2
uauuauuauugaaau

SEQ ID NO: 2109063 - RNA, 17 nt, Staphylococcus aureus subsp. aureus MW2
uauuauccaaggauguu

SEQ ID NO: 2109064 - RNA, 22 nt, Staphylococcus aureus subsp. aureus MW2
uauucucugcuucuaaaacauc

SEQ ID NO: 2109065 - RNA, 17 nt, Staphylococcus aureus subsp. aureus MW2
uauucugaaaaauauuu

SEQ ID NO: 2109066 - RNA, 19 nt, Staphylococcus aureus subsp. aureus MW2
uauucucagucucuuugaa

SEQ ID NO: 2109067 - RNA, 21 nt, Staphylococcus aureus subsp. aureus MW2
uauucuauuuuucaauucgcu

SEQ ID NO: 2109068 - RNA, 12 nt, Staphylococcus aureus subsp. aureus MW2
uauucuauuuuu

SEQ ID NO: 2109069 - RNA, 15 nt, Staphylococcus aureus subsp. aureus MW2
uauucgcuuacauua

SEQ ID NO: 2109070 - RNA, 16 nt, Staphylococcus aureus subsp. aureus MW2
uauucuauuuuucaau

SEQ ID NO: 2109071 - RNA, 20 nt, Staphylococcus aureus subsp. aureus MW2
uauucgauacauaaaacauc

SEQ ID NO: 2109072 - RNA, 13 nt, Staphylococcus aureus subsp. aureus MW2
uauucauuuuaaa

SEQ ID NO: 2109073 - RNA, 16 nt, Staphylococcus aureus subsp. aureus MW2
uauucauuuuaaauuu

SEQ ID NO: 2109074 - RNA, 14 nt, Staphylococcus aureus subsp. aureus MW2
uauucgauaauaua

SEQ ID NO: 2109075 - RNA, 21 nt, Staphylococcus aureus subsp. aureus MW2
uauucgaaaaagguauucaaa

SEQ ID NO: 2109076 - RNA, 23 nt, Staphylococcus aureus subsp. aureus MW2
uauucauagaccuaugaauuuag

SEQ ID NO: 2109077 - RNA, 21 nt, Staphylococcus aureus subsp. aureus MW2
uauucaguugguauaucgaaa

SEQ ID NO: 2109078 - RNA, 15 nt, Staphylococcus aureus subsp. aureus MW2
uauucaucauauaua

SEQ ID NO: 2109079 - RNA, 14 nt, Staphylococcus aureus subsp. aureus MW2
uauucaauucugug

SEQ ID NO: 2109080 - RNA, 19 nt, Staphylococcus aureus subsp. aureus MW2
uauucaaugauuaguaaug

SEQ ID NO: 2109081 - RNA, 23 nt, Staphylococcus aureus subsp. aureus MW2
uauucacauagccucuuaaaaua

SEQ ID NO: 2109082 - RNA, 15 nt, Staphylococcus aureus subsp. aureus MW2
uauucaauaauucau

SEQ ID NO: 2109083 - RNA, 16 nt, Staphylococcus aureus subsp. aureus MW2
uauuauugugaaaucu

SEQ ID NO: 2109084 - RNA, 16 nt, Staphylococcus aureus subsp. aureus MW2
uauuauugucaucaug

SEQ ID NO: 2109085 - RNA, 16 nt, Staphylococcus aureus subsp. aureus MW2
ucaagaauauaaauga

SEQ ID NO: 2109086 - RNA, 19 nt, Staphylococcus aureus subsp. aureus MW2
ucaagaccaaauauuuuau

SEQ ID NO: 2109087 - RNA, 16 nt, Staphylococcus aureus subsp. aureus MW2
ucaagagguaaaucug

SEQ ID NO: 2109088 - RNA, 14 nt, Staphylococcus aureus subsp. aureus MW2
ucaagaacuuuaaa

SEQ ID NO: 2109089 - RNA, 18 nt, Staphylococcus aureus subsp. aureus MW2
ucaagaacuuuaaaaauu

SEQ ID NO: 2109090 - RNA, 12 nt, Staphylococcus aureus subsp. aureus MW2
ucaagaauauaa

SEQ ID NO: 2109091 - RNA, 19 nt, Staphylococcus aureus subsp. aureus MW2
ucaagaaauucgcaagccu

SEQ ID NO: 2109092 - RNA, 20 nt, Staphylococcus aureus subsp. aureus MW2
ucaagaaauguuaaauuaaa

SEQ ID NO: 2109093 - RNA, 17 nt, Staphylococcus aureus subsp. aureus MW2
ucaacuuagaauuuaca

SEQ ID NO: 2109094 - RNA, 14 nt, Staphylococcus aureus subsp. aureus MW2
ucaacuuaaauauc

SEQ ID NO: 2109095 - RNA, 15 nt, Staphylococcus aureus subsp. aureus MW2
ucaagaaauguuaaa

SEQ ID NO: 2109096 - RNA, 16 nt, Staphylococcus aureus subsp. aureus MW2
ucaacgucaucugcuu

SEQ ID NO: 2109097 - RNA, 15 nt, Staphylococcus aureus subsp. aureus MW2
ucaacgucaucugcu

SEQ ID NO: 2109098 - RNA, 21 nt, Staphylococcus aureus subsp. aureus MW2
ucaacguauauaaguuaaaau

SEQ ID NO: 2109099 - RNA, 20 nt, Staphylococcus aureus subsp. aureus MW2
ucaaaugacauuuuaaaucu

SEQ ID NO: 2109100 - RNA, 17 nt, Staphylococcus aureus subsp. aureus MW2
ucaaaugacauuuuaaa

SEQ ID NO: 2109101 - RNA, 16 nt, Staphylococcus aureus subsp. aureus MW2
ucaacgggaacaucau

SEQ ID NO: 2109102 - RNA, 21 nt, Staphylococcus aureus subsp. aureus MW2
ucaaaugacauuuuaaaucua

SEQ ID NO: 2109103 - RNA, 22 nt, Staphylococcus aureus subsp. aureus MW2
ucaagcuuugcugcuuuuccau

SEQ ID NO: 2109104 - RNA, 16 nt, Staphylococcus aureus subsp. aureus MW2
ucaagcuagcaucaug

SEQ ID NO: 2109105 - RNA, 17 nt, Staphylococcus aureus subsp. aureus MW2
ucaagguauacacaaau

SEQ ID NO: 2109106 - RNA, 15 nt, Staphylococcus aureus subsp. aureus MW2
ucaagguguccuuuu

SEQ ID NO: 2109107 - RNA, 20 nt, Staphylococcus aureus subsp. aureus MW2
ucaaguauauccgcaucuuu

SEQ ID NO: 2109108 - RNA, 15 nt, Staphylococcus aureus subsp. aureus MW2
ucaaguaaugauauu

SEQ ID NO: 2109109 - RNA, 21 nt, Staphylococcus aureus subsp. aureus MW2
ucaauccuaaauuauaaauag

SEQ ID NO: 2109110 - RNA, 22 nt, Staphylococcus aureus subsp. aureus MW2
ucaauccaucaauaccauaauu

SEQ ID NO: 2109111 - RNA, 18 nt, Staphylococcus aureus subsp. aureus MW2
ucaauauugucuucauua

SEQ ID NO: 2109112 - RNA, 22 nt, Staphylococcus aureus subsp. aureus MW2
ucaauauuacuuuaucucauug

SEQ ID NO: 2109113 - RNA, 14 nt, Staphylococcus aureus subsp. aureus MW2
ucaauguuauuaaa

SEQ ID NO: 2109114 - RNA, 15 nt, Staphylococcus aureus subsp. aureus MW2
ucaaucguuaauuuc

SEQ ID NO: 2109115 - RNA, 14 nt, Staphylococcus aureus subsp. aureus MW2
ucaauuucuauuuc

SEQ ID NO: 2109116 - RNA, 14 nt, Staphylococcus aureus subsp. aureus MW2
ucaauuuggaaaua

SEQ ID NO: 2109117 - RNA, 19 nt, Staphylococcus aureus subsp. aureus MW2
ucaauuaauuuaaaugcuu

SEQ ID NO: 2109118 - RNA, 23 nt, Staphylococcus aureus subsp. aureus MW2
ucaauuaauuuagucauuacaaa

SEQ ID NO: 2109119 - RNA, 14 nt, Staphylococcus aureus subsp. aureus MW2
ucaauuaauuuaaa

SEQ ID NO: 2109120 - RNA, 17 nt, Staphylococcus aureus subsp. aureus MW2
ucaauguuauuaaacgc

SEQ ID NO: 2109121 - RNA, 19 nt, Staphylococcus aureus subsp. aureus MW2
ucaauuaaacuuaagaaua

SEQ ID NO: 2109122 - RNA, 15 nt, Staphylococcus aureus subsp. aureus MW2
ucacaacacauaaau

SEQ ID NO: 2109123 - RNA, 19 nt, Staphylococcus aureus subsp. aureus MW2
ucacaacaguauuaauuac

SEQ ID NO: 2109124 - RNA, 18 nt, Staphylococcus aureus subsp. aureus MW2
ucacaaauuugaauauac

SEQ ID NO: 2109125 - RNA, 16 nt, Staphylococcus aureus subsp. aureus MW2
ucacaacggcauaaua

SEQ ID NO: 2109126 - RNA, 22 nt, Staphylococcus aureus subsp. aureus MW2
ucacaaauucuuuuacagcaag

SEQ ID NO: 2109127 - RNA, 23 nt, Staphylococcus aureus subsp. aureus MW2
ucacaauacgaaaccaaaaauaa

SEQ ID NO: 2109128 - RNA, 15 nt, Staphylococcus aureus subsp. aureus MW2
ucacaauauacauuu

SEQ ID NO: 2109129 - RNA, 15 nt, Staphylococcus aureus subsp. aureus MW2
ucacaaguucaggau

SEQ ID NO: 2109130 - RNA, 23 nt, Staphylococcus aureus subsp. aureus MW2
ucacacgacauguagguaauugc

SEQ ID NO: 2109131 - RNA, 16 nt, Staphylococcus aureus subsp. aureus MW2
ucacauuuucaaauuu

SEQ ID NO: 2109132 - RNA, 18 nt, Staphylococcus aureus subsp. aureus MW2
ucaccaauccgauucacu

SEQ ID NO: 2109133 - RNA, 21 nt, Staphylococcus aureus subsp. aureus MW2
ucaccaaguuggcgcaacagc

SEQ ID NO: 2109134 - RNA, 19 nt, Staphylococcus aureus subsp. aureus MW2
ucacauucuugaauaaauu

SEQ ID NO: 2109135 - RNA, 18 nt, Staphylococcus aureus subsp. aureus MW2
ucacauucuugaauaaau

SEQ ID NO: 2109136 - RNA, 13 nt, Staphylococcus aureus subsp. aureus MW2
ucacauuauacaa

SEQ ID NO: 2109137 - RNA, 22 nt, Staphylococcus aureus subsp. aureus MW2
ucacauugucuacaaaguuaau

SEQ ID NO: 2109138 - RNA, 17 nt, Staphylococcus aureus subsp. aureus MW2
ucacagaaaauacauuu

SEQ ID NO: 2109139 - RNA, 19 nt, Staphylococcus aureus subsp. aureus MW2
ucaccguaaucuuuuaacu

SEQ ID NO: 2109140 - RNA, 14 nt, Staphylococcus aureus subsp. aureus MW2
ucaccguaaucuuu

SEQ ID NO: 2109141 - RNA, 21 nt, Staphylococcus aureus subsp. aureus MW2
ucacgauuacgcucauauguc

SEQ ID NO: 2109142 - RNA, 20 nt, Staphylococcus aureus subsp. aureus MW2
ucacgauuaauaaaauucua

SEQ ID NO: 2109143 - RNA, 13 nt, Staphylococcus aureus subsp. aureus MW2
ucacgaucuuuaa

SEQ ID NO: 2109144 - RNA, 19 nt, Staphylococcus aureus subsp. aureus MW2
ucacgauauaacauuaaaa

SEQ ID NO: 2109145 - RNA, 14 nt, Staphylococcus aureus subsp. aureus MW2
ucacgauauaacau

SEQ ID NO: 2109146 - RNA, 21 nt, Staphylococcus aureus subsp. aureus MW2
ucaccuuuaggcaaauaaccu

SEQ ID NO: 2109147 - RNA, 18 nt, Staphylococcus aureus subsp. aureus MW2
ucaccuuuuuuaacuuua

SEQ ID NO: 2109148 - RNA, 14 nt, Staphylococcus aureus subsp. aureus MW2
ucaccuuuuuuaac

SEQ ID NO: 2109149 - RNA, 14 nt, Staphylococcus aureus subsp. aureus MW2
ucaccuuuaggcaa

SEQ ID NO: 2109150 - RNA, 15 nt, Staphylococcus aureus subsp. aureus MW2
ucaccuacaacacca

SEQ ID NO: 2109151 - RNA, 17 nt, Staphylococcus aureus subsp. aureus MW2
ucaccuacuacaaauuu

SEQ ID NO: 2109152 - RNA, 17 nt, Staphylococcus aureus subsp. aureus MW2
ucaccugaugaauagau

SEQ ID NO: 2109153 - RNA, 14 nt, Staphylococcus aureus subsp. aureus MW2
ucaccuucccaguc

SEQ ID NO: 2109154 - RNA, 13 nt, Staphylococcus aureus subsp. aureus MW2
ucaccuucccagu

SEQ ID NO: 2109155 - RNA, 23 nt, Staphylococcus aureus subsp. aureus MW2
ucaccuucagggucgugacggaa

SEQ ID NO: 2109156 - RNA, 15 nt, Staphylococcus aureus subsp. aureus MW2
ucaccuuaucaugac

SEQ ID NO: 2109157 - RNA, 24 nt, Staphylococcus aureus subsp. aureus MW2
ucaccuguagacaauuguaguaau

SEQ ID NO: 2109158 - RNA, 22 nt, Staphylococcus aureus subsp. aureus MW2
ucaccugcagcauccuuaccuu

SEQ ID NO: 2109159 - RNA, 15 nt, Staphylococcus aureus subsp. aureus MW2
ucacgauuuuuaaaa

SEQ ID NO: 2109160 - RNA, 16 nt, Staphylococcus aureus subsp. aureus MW2
ucacgauuuuuaaaau

SEQ ID NO: 2109161 - RNA, 14 nt, Staphylococcus aureus subsp. aureus MW2
ucacgauuaauaaa

SEQ ID NO: 2109162 - RNA, 16 nt, Staphylococcus aureus subsp. aureus MW2
ucacuaaugcauaauu

SEQ ID NO: 2109163 - RNA, 14 nt, Staphylococcus aureus subsp. aureus MW2
ucacuaauauauuu

SEQ ID NO: 2109164 - RNA, 19 nt, Staphylococcus aureus subsp. aureus MW2
ucacuaaucauuuuuucaa

SEQ ID NO: 2109165 - RNA, 12 nt, Staphylococcus aureus subsp. aureus MW2
ucacuaaaaauc

SEQ ID NO: 2109166 - RNA, 14 nt, Staphylococcus aureus subsp. aureus MW2
ucacuauuuuagcu

SEQ ID NO: 2109167 - RNA, 23 nt, Staphylococcus aureus subsp. aureus MW2
ucacuccucuauuuuaugauuug

SEQ ID NO: 2109168 - RNA, 17 nt, Staphylococcus aureus subsp. aureus MW2
ucauaaugaucaaguag

SEQ ID NO: 2109169 - RNA, 18 nt, Staphylococcus aureus subsp. aureus MW2
ucauaaucaagucugcau

SEQ ID NO: 2109170 - RNA, 17 nt, Staphylococcus aureus subsp. aureus MW2
ucauaaucauaaaaauc

SEQ ID NO: 2109171 - RNA, 17 nt, Staphylococcus aureus subsp. aureus MW2
ucauaauauauuaacaa

SEQ ID NO: 2109172 - RNA, 13 nt, Staphylococcus aureus subsp. aureus MW2
ucauaaucaaguc

SEQ ID NO: 2109173 - RNA, 16 nt, Staphylococcus aureus subsp. aureus MW2
ucauaaucaagucugc

SEQ ID NO: 2109174 - RNA, 15 nt, Staphylococcus aureus subsp. aureus MW2
ucauaauucaguguu

SEQ ID NO: 2109175 - RNA, 16 nt, Staphylococcus aureus subsp. aureus MW2
ucauaauuaauaacau

SEQ ID NO: 2109176 - RNA, 14 nt, Staphylococcus aureus subsp. aureus MW2
ucauaauuaauaac

SEQ ID NO: 2109177 - RNA, 13 nt, Staphylococcus aureus subsp. aureus MW2
ucauaauuccaua

SEQ ID NO: 2109178 - RNA, 22 nt, Staphylococcus aureus subsp. aureus MW2
ucauaauuuccugaugaggcua

SEQ ID NO: 2109179 - RNA, 11 nt, Staphylococcus aureus subsp. aureus MW2
ucauaauuaau

SEQ ID NO: 2109180 - RNA, 21 nt, Staphylococcus aureus subsp. aureus MW2
ucauaauuaaauagcuuuacu

SEQ ID NO: 2109181 - RNA, 21 nt, Staphylococcus aureus subsp. aureus MW2
ucauaaugugaugguucaaau

SEQ ID NO: 2109182 - RNA, 22 nt, Staphylococcus aureus subsp. aureus MW2
ucauacacaaugauuauaaaua

SEQ ID NO: 2109183 - RNA, 21 nt, Staphylococcus aureus subsp. aureus MW2
ucauacacuaucauuaucaaa

SEQ ID NO: 2109184 - RNA, 16 nt, Staphylococcus aureus subsp. aureus MW2
ucauaccuuuuaauuu

SEQ ID NO: 2109185 - RNA, 16 nt, Staphylococcus aureus subsp. aureus MW2
ucauaguucaaauuga

SEQ ID NO: 2109186 - RNA, 20 nt, Staphylococcus aureus subsp. aureus MW2
ucauaguucaaauugaacuu

SEQ ID NO: 2109187 - RNA, 13 nt, Staphylococcus aureus subsp. aureus MW2
ucauauaaauagc

SEQ ID NO: 2109188 - RNA, 15 nt, Staphylococcus aureus subsp. aureus MW2
ucauauaugauaaau

SEQ ID NO: 2109189 - RNA, 17 nt, Staphylococcus aureus subsp. aureus MW2
ucauacuucaaacguua

SEQ ID NO: 2109190 - RNA, 21 nt, Staphylococcus aureus subsp. aureus MW2
ucauagcaaauaaaacgcuuc

SEQ ID NO: 2109191 - RNA, 11 nt, Staphylococcus aureus subsp. aureus MW2
ucauagccuau

SEQ ID NO: 2109192 - RNA, 13 nt, Staphylococcus aureus subsp. aureus MW2
ucaucaauuggca

SEQ ID NO: 2109193 - RNA, 12 nt, Staphylococcus aureus subsp. aureus MW2
ucaucaauaauu

SEQ ID NO: 2109194 - RNA, 23 nt, Staphylococcus aureus subsp. aureus MW2
ucaucaacacacacaguuuauaa

SEQ ID NO: 2109195 - RNA, 14 nt, Staphylococcus aureus subsp. aureus MW2
ucauaucuuucaau

SEQ ID NO: 2109196 - RNA, 11 nt, Staphylococcus aureus subsp. aureus MW2
ucauaugcaua

SEQ ID NO: 2109197 - RNA, 15 nt, Staphylococcus aureus subsp. aureus MW2
ucauaugcaucaaca

SEQ ID NO: 2109198 - RNA, 17 nt, Staphylococcus aureus subsp. aureus MW2
ucauaugugccauaugu

SEQ ID NO: 2109199 - RNA, 16 nt, Staphylococcus aureus subsp. aureus MW2
ucauauaugucucucu

SEQ ID NO: 2109200 - RNA, 22 nt, Staphylococcus aureus subsp. aureus MW2
ucauaucauaccaaaaaguauu

SEQ ID NO: 2109201 - RNA, 12 nt, Staphylococcus aureus subsp. aureus MW2
ucauauuuaaug

SEQ ID NO: 2109202 - RNA, 13 nt, Staphylococcus aureus subsp. aureus MW2
ucauauucacauc

SEQ ID NO: 2109203 - RNA, 16 nt, Staphylococcus aureus subsp. aureus MW2
ucauauucacaucuuu

SEQ ID NO: 2109204 - RNA, 18 nt, Staphylococcus aureus subsp. aureus MW2
ucauauguuuuauaauaa

SEQ ID NO: 2109205 - RNA, 20 nt, Staphylococcus aureus subsp. aureus MW2
ucauauguuuuauaauaaau

SEQ ID NO: 2109206 - RNA, 16 nt, Staphylococcus aureus subsp. aureus MW2
ucaucgcuaauacuuu

SEQ ID NO: 2109207 - RNA, 17 nt, Staphylococcus aureus subsp. aureus MW2
ucaucaugacuauuuuc

SEQ ID NO: 2109208 - RNA, 20 nt, Staphylococcus aureus subsp. aureus MW2
ucaucaugacuauuuuccau

SEQ ID NO: 2109209 - RNA, 20 nt, Staphylococcus aureus subsp. aureus MW2
ucaucauuaguuuuuaaaau

SEQ ID NO: 2109210 - RNA, 16 nt, Staphylococcus aureus subsp. aureus MW2
ucaucauuuaaauauu

SEQ ID NO: 2109211 - RNA, 23 nt, Staphylococcus aureus subsp. aureus MW2
ucaucauuguaaaacaaauuaca

SEQ ID NO: 2109212 - RNA, 18 nt, Staphylococcus aureus subsp. aureus MW2
ucaucacuuuuuaaacgu

SEQ ID NO: 2109213 - RNA, 21 nt, Staphylococcus aureus subsp. aureus MW2
ucaucauaaucuacugcuguu

SEQ ID NO: 2109214 - RNA, 13 nt, Staphylococcus aureus subsp. aureus MW2
ucaucauaaucaa

SEQ ID NO: 2109215 - RNA, 19 nt, Staphylococcus aureus subsp. aureus MW2
ucaucauaaucaagaauau

SEQ ID NO: 2109216 - RNA, 22 nt, Staphylococcus aureus subsp. aureus MW2
ucauaagucuuaacaaauuaaa

SEQ ID NO: 2109217 - RNA, 13 nt, Staphylococcus aureus subsp. aureus MW2
ucauaauaauuca

SEQ ID NO: 2109218 - RNA, 18 nt, Staphylococcus aureus subsp. aureus MW2
ucauaagaugcaugccaa

SEQ ID NO: 2109219 - RNA, 21 nt, Staphylococcus aureus subsp. aureus MW2
ucauaaccgcuucuuuuaagu

SEQ ID NO: 2109220 - RNA, 20 nt, Staphylococcus aureus subsp. aureus MW2
ucauaaauguuagauuucaa

SEQ ID NO: 2109221 - RNA, 22 nt, Staphylococcus aureus subsp. aureus MW2
ucauaaccgcuucuuuuaaguu

SEQ ID NO: 2109222 - RNA, 14 nt, Staphylococcus aureus subsp. aureus MW2
ucauaaaugacuga

SEQ ID NO: 2109223 - RNA, 19 nt, Staphylococcus aureus subsp. aureus MW2
ucauaaaucaugaaauuaa

SEQ ID NO: 2109224 - RNA, 18 nt, Staphylococcus aureus subsp. aureus MW2
ucauaaauauaaaauaug

SEQ ID NO: 2109225 - RNA, 12 nt, Staphylococcus aureus subsp. aureus MW2
ucauaaauauaa

SEQ ID NO: 2109226 - RNA, 16 nt, Staphylococcus aureus subsp. aureus MW2
ucauaaauauaaaaua

SEQ ID NO: 2109227 - RNA, 18 nt, Staphylococcus aureus subsp. aureus MW2
ucauaaaguuuauuuaug

SEQ ID NO: 2109228 - RNA, 15 nt, Staphylococcus aureus subsp. aureus MW2
ucauaaaguuuauuu

SEQ ID NO: 2109229 - RNA, 13 nt, Staphylococcus aureus subsp. aureus MW2
ucauaaaauuuaa

SEQ ID NO: 2109230 - RNA, 13 nt, Staphylococcus aureus subsp. aureus MW2
ucauaaaauacca

SEQ ID NO: 2109231 - RNA, 19 nt, Staphylococcus aureus subsp. aureus MW2
ucauaaacgaaaauacuca

SEQ ID NO: 2109232 - RNA, 16 nt, Staphylococcus aureus subsp. aureus MW2
ucagucaguaaaaaua

SEQ ID NO: 2109233 - RNA, 15 nt, Staphylococcus aureus subsp. aureus MW2
ucagucaguaaaaau

SEQ ID NO: 2109234 - RNA, 15 nt, Staphylococcus aureus subsp. aureus MW2
ucagucauucacaua

SEQ ID NO: 2109235 - RNA, 15 nt, Staphylococcus aureus subsp. aureus MW2
ucaguaccauguuuu

SEQ ID NO: 2109236 - RNA, 19 nt, Staphylococcus aureus subsp. aureus MW2
ucagucaacuacugucaau

SEQ ID NO: 2109237 - RNA, 20 nt, Staphylococcus aureus subsp. aureus MW2
ucaguccgcuuuuucauaga

SEQ ID NO: 2109238 - RNA, 16 nt, Staphylococcus aureus subsp. aureus MW2
ucaguuaaaucuuuaa

SEQ ID NO: 2109239 - RNA, 13 nt, Staphylococcus aureus subsp. aureus MW2
ucaguuaauaauu

SEQ ID NO: 2109240 - RNA, 13 nt, Staphylococcus aureus subsp. aureus MW2
ucaguuaggauga

SEQ ID NO: 2109241 - RNA, 18 nt, Staphylococcus aureus subsp. aureus MW2
ucaguuauaccauauuua

SEQ ID NO: 2109242 - RNA, 18 nt, Staphylococcus aureus subsp. aureus MW2
ucaguucaaacagaaauu

SEQ ID NO: 2109243 - RNA, 20 nt, Staphylococcus aureus subsp. aureus MW2
ucauaaaaaucauaaauaac

SEQ ID NO: 2109244 - RNA, 19 nt, Staphylococcus aureus subsp. aureus MW2
ucauaaaaaucauaaauaa

SEQ ID NO: 2109245 - RNA, 14 nt, Staphylococcus aureus subsp. aureus MW2
ucagggaaaucauc

SEQ ID NO: 2109246 - RNA, 18 nt, Staphylococcus aureus subsp. aureus MW2
ucaggcuuuguuuuucac

SEQ ID NO: 2109247 - RNA, 17 nt, Staphylococcus aureus subsp. aureus MW2
ucagggacaaaaauucu

SEQ ID NO: 2109248 - RNA, 16 nt, Staphylococcus aureus subsp. aureus MW2
ucaguaaucuuguuuu

SEQ ID NO: 2109249 - RNA, 14 nt, Staphylococcus aureus subsp. aureus MW2
ucaguaacauguaa

SEQ ID NO: 2109250 - RNA, 16 nt, Staphylococcus aureus subsp. aureus MW2
ucaggguuuaagauuu

SEQ ID NO: 2109251 - RNA, 14 nt, Staphylococcus aureus subsp. aureus MW2
ucagcuaaauauuu

SEQ ID NO: 2109252 - RNA, 17 nt, Staphylococcus aureus subsp. aureus MW2
ucagcuaaguuaaauau

SEQ ID NO: 2109253 - RNA, 13 nt, Staphylococcus aureus subsp. aureus MW2
ucagcuauaaaag

SEQ ID NO: 2109254 - RNA, 15 nt, Staphylococcus aureus subsp. aureus MW2
ucagcuuacaauaau

SEQ ID NO: 2109255 - RNA, 15 nt, Staphylococcus aureus subsp. aureus MW2
ucagcuuuaauaaua

SEQ ID NO: 2109256 - RNA, 18 nt, Staphylococcus aureus subsp. aureus MW2
ucagcuuuggcgacauaa

SEQ ID NO: 2109257 - RNA, 22 nt, Staphylococcus aureus subsp. aureus MW2
ucaggaucacguuuuucuuuaa

SEQ ID NO: 2109258 - RNA, 16 nt, Staphylococcus aureus subsp. aureus MW2
ucaggaauagauguca

SEQ ID NO: 2109259 - RNA, 14 nt, Staphylococcus aureus subsp. aureus MW2
ucaggaauagaugu

SEQ ID NO: 2109260 - RNA, 23 nt, Staphylococcus aureus subsp. aureus MW2
ucacugaaugcuaauacuaauca

SEQ ID NO: 2109261 - RNA, 19 nt, Staphylococcus aureus subsp. aureus MW2
ucacucuguaauaaagaau

SEQ ID NO: 2109262 - RNA, 14 nt, Staphylococcus aureus subsp. aureus MW2
ucacugaaugcuaa

SEQ ID NO: 2109263 - RNA, 12 nt, Staphylococcus aureus subsp. aureus MW2
ucacucuuuuag

SEQ ID NO: 2109264 - RNA, 17 nt, Staphylococcus aureus subsp. aureus MW2
ucacuuaauaaauaauu

SEQ ID NO: 2109265 - RNA, 20 nt, Staphylococcus aureus subsp. aureus MW2
ucacuuacugugaaaauacc

SEQ ID NO: 2109266 - RNA, 17 nt, Staphylococcus aureus subsp. aureus MW2
ucagccacugucaugug

SEQ ID NO: 2109267 - RNA, 14 nt, Staphylococcus aureus subsp. aureus MW2
ucagccacugucau

SEQ ID NO: 2109268 - RNA, 22 nt, Staphylococcus aureus subsp. aureus MW2
ucagccauaauaucuuuuaaug

SEQ ID NO: 2109269 - RNA, 15 nt, Staphylococcus aureus subsp. aureus MW2
ucauuuauaacauuu

SEQ ID NO: 2109270 - RNA, 18 nt, Staphylococcus aureus subsp. aureus MW2
ucauuuaguuaaauacaa

SEQ ID NO: 2109271 - RNA, 19 nt, Staphylococcus aureus subsp. aureus MW2
ucauuucaauauuaaaaua

SEQ ID NO: 2109272 - RNA, 16 nt, Staphylococcus aureus subsp. aureus MW2
ucauuucgauuaauuu

SEQ ID NO: 2109273 - RNA, 17 nt, Staphylococcus aureus subsp. aureus MW2
ucauuucaguauauuuu

SEQ ID NO: 2109274 - RNA, 24 nt, Staphylococcus aureus subsp. aureus MW2
ucauuuguguuuuuaauguuugcu

SEQ ID NO: 2109275 - RNA, 17 nt, Staphylococcus aureus subsp. aureus MW2
ucauuuguguuuuuaau

SEQ ID NO: 2109276 - RNA, 14 nt, Staphylococcus aureus subsp. aureus MW2
ucauuuguauagau

SEQ ID NO: 2109277 - RNA, 20 nt, Staphylococcus aureus subsp. aureus MW2
ucauuggauagguaacuaaa

SEQ ID NO: 2109278 - RNA, 14 nt, Staphylococcus aureus subsp. aureus MW2
ucauucuucaucgc

SEQ ID NO: 2109279 - RNA, 16 nt, Staphylococcus aureus subsp. aureus MW2
ucauuuuuauaaauuu

SEQ ID NO: 2109280 - RNA, 12 nt, Staphylococcus aureus subsp. aureus MW2
ucauuuuucuuc

SEQ ID NO: 2109281 - RNA, 22 nt, Staphylococcus aureus subsp. aureus MW2
ucauuuuauccaaaccaauuuu

SEQ ID NO: 2109282 - RNA, 14 nt, Staphylococcus aureus subsp. aureus MW2
ucauuuucaaauaa

SEQ ID NO: 2109283 - RNA, 19 nt, Staphylococcus aureus subsp. aureus MW2
uccaaaaccgaaaauaccu

SEQ ID NO: 2109284 - RNA, 13 nt, Staphylococcus aureus subsp. aureus MW2
uccaaaauccuga

SEQ ID NO: 2109285 - RNA, 22 nt, Staphylococcus aureus subsp. aureus MW2
ucauuuuuucgagaugauauua

SEQ ID NO: 2109286 - RNA, 17 nt, Staphylococcus aureus subsp. aureus MW2
ucauuuuuuuaauuauu

SEQ ID NO: 2109287 - RNA, 12 nt, Staphylococcus aureus subsp. aureus MW2
ucauuuuuucaa

SEQ ID NO: 2109288 - RNA, 13 nt, Staphylococcus aureus subsp. aureus MW2
ucauuuuuucaau

SEQ ID NO: 2109289 - RNA, 18 nt, Staphylococcus aureus subsp. aureus MW2
ucauuuuuugcaaaauuu

SEQ ID NO: 2109290 - RNA, 13 nt, Staphylococcus aureus subsp. aureus MW2
ucauuaacagucu

SEQ ID NO: 2109291 - RNA, 13 nt, Staphylococcus aureus subsp. aureus MW2
ucauuaaaucuga

SEQ ID NO: 2109292 - RNA, 12 nt, Staphylococcus aureus subsp. aureus MW2
ucauuaauacaa

SEQ ID NO: 2109293 - RNA, 14 nt, Staphylococcus aureus subsp. aureus MW2
ucauuaauaauuaa

SEQ ID NO: 2109294 - RNA, 14 nt, Staphylococcus aureus subsp. aureus MW2
ucauuaauaaauug

SEQ ID NO: 2109295 - RNA, 24 nt, Staphylococcus aureus subsp. aureus MW2
ucauuaacuuucucaaauuagaua

SEQ ID NO: 2109296 - RNA, 20 nt, Staphylococcus aureus subsp. aureus MW2
ucauguaaugcuuaaaaaca

SEQ ID NO: 2109297 - RNA, 20 nt, Staphylococcus aureus subsp. aureus MW2
ucauguauauggcaucauca

SEQ ID NO: 2109298 - RNA, 13 nt, Staphylococcus aureus subsp. aureus MW2
ucauuauuuaaau

SEQ ID NO: 2109299 - RNA, 18 nt, Staphylococcus aureus subsp. aureus MW2
ucauuauuguuguaucau

SEQ ID NO: 2109300 - RNA, 18 nt, Staphylococcus aureus subsp. aureus MW2
ucauuauuugauaaauaa

SEQ ID NO: 2109301 - RNA, 21 nt, Staphylococcus aureus subsp. aureus MW2
ucauuauuugauaaauaaaau

SEQ ID NO: 2109302 - RNA, 16 nt, Staphylococcus aureus subsp. aureus MW2
ucauuaauuuuuucgu

SEQ ID NO: 2109303 - RNA, 15 nt, Staphylococcus aureus subsp. aureus MW2
ucauuacaaacauaa

SEQ ID NO: 2109304 - RNA, 23 nt, Staphylococcus aureus subsp. aureus MW2
ucauuaugcccgauaauucuaac

SEQ ID NO: 2109305 - RNA, 13 nt, Staphylococcus aureus subsp. aureus MW2
ucaugccuucaug

SEQ ID NO: 2109306 - RNA, 13 nt, Staphylococcus aureus subsp. aureus MW2
ucaugcauucuau

SEQ ID NO: 2109307 - RNA, 14 nt, Staphylococcus aureus subsp. aureus MW2
ucaugcuuuuuaau

SEQ ID NO: 2109308 - RNA, 16 nt, Staphylococcus aureus subsp. aureus MW2
ucaugaugauaaauug

SEQ ID NO: 2109309 - RNA, 18 nt, Staphylococcus aureus subsp. aureus MW2
ucaugcacuuuauuaaaa

SEQ ID NO: 2109310 - RNA, 23 nt, Staphylococcus aureus subsp. aureus MW2
ucaucuauuuaauaauguaucau

SEQ ID NO: 2109311 - RNA, 19 nt, Staphylococcus aureus subsp. aureus MW2
ucaucuauauuuaauuuug

SEQ ID NO: 2109312 - RNA, 23 nt, Staphylococcus aureus subsp. aureus MW2
ucaucuauuauuauguuauaaau

SEQ ID NO: 2109313 - RNA, 14 nt, Staphylococcus aureus subsp. aureus MW2
ucaucuacuuaaaa

SEQ ID NO: 2109314 - RNA, 17 nt, Staphylococcus aureus subsp. aureus MW2
ucaucguucauauauuu

SEQ ID NO: 2109315 - RNA, 20 nt, Staphylococcus aureus subsp. aureus MW2
ucaucuaaaaagucuuuaau

SEQ ID NO: 2109316 - RNA, 12 nt, Staphylococcus aureus subsp. aureus MW2
ucaucguauuuc

SEQ ID NO: 2109317 - RNA, 19 nt, Staphylococcus aureus subsp. aureus MW2
ucaucuguccgauuuaaua

SEQ ID NO: 2109318 - RNA, 15 nt, Staphylococcus aureus subsp. aureus MW2
ucaucugguauuuua

SEQ ID NO: 2109319 - RNA, 22 nt, Staphylococcus aureus subsp. aureus MW2
ucaucugaugaggcaauauuaa

SEQ ID NO: 2109320 - RNA, 19 nt, Staphylococcus aureus subsp. aureus MW2
ucaucuuaaugcuaugauu

SEQ ID NO: 2109321 - RNA, 18 nt, Staphylococcus aureus subsp. aureus MW2
ucaucuuaucaagaauau

SEQ ID NO: 2109322 - RNA, 22 nt, Staphylococcus aureus subsp. aureus MW2
ucaucuugcaaguauuuucuua

SEQ ID NO: 2109323 - RNA, 14 nt, Staphylococcus aureus subsp. aureus MW2
ucaucuuuauuuac

SEQ ID NO: 2109324 - RNA, 17 nt, Staphylococcus aureus subsp. aureus MW2
ucaucuuuuuuaucaug

SEQ ID NO: 2109325 - RNA, 21 nt, Staphylococcus aureus subsp. aureus MW2
ucaucuuuuucacuaaucauu

SEQ ID NO: 2109326 - RNA, 17 nt, Staphylococcus aureus subsp. aureus MW2
ucaucuuucaaaugcuu

SEQ ID NO: 2109327 - RNA, 18 nt, Staphylococcus aureus subsp. aureus MW2
ucaucuuucaaaugcuua

SEQ ID NO: 2109328 - RNA, 22 nt, Staphylococcus aureus subsp. aureus MW2
ucaucuuucacaauuguauaau

SEQ ID NO: 2109329 - RNA, 16 nt, Staphylococcus aureus subsp. aureus MW2
uccaaaauccugaaau

SEQ ID NO: 2109330 - RNA, 14 nt, Staphylococcus aureus subsp. aureus MW2
uccaaauauuaaaa

SEQ ID NO: 2109331 - RNA, 15 nt, Staphylococcus aureus subsp. aureus MW2
uccacaaauaacacc

SEQ ID NO: 2109332 - RNA, 11 nt, Staphylococcus aureus subsp. aureus MW2
uccaauuucuc

SEQ ID NO: 2109333 - RNA, 15 nt, Staphylococcus aureus subsp. aureus MW2
uccaauuuauaauga

SEQ ID NO: 2109334 - RNA, 16 nt, Staphylococcus aureus subsp. aureus MW2
uccaauuuauaaugau

SEQ ID NO: 2109335 - RNA, 18 nt, Staphylococcus aureus subsp. aureus MW2
uccaauuuauaaugauua

SEQ ID NO: 2109336 - RNA, 19 nt, Staphylococcus aureus subsp. aureus MW2
uccaauuuauaaugauuaa

SEQ ID NO: 2109337 - RNA, 22 nt, Staphylococcus aureus subsp. aureus MW2
uccaccugauaacgagcuaaua

SEQ ID NO: 2109338 - RNA, 16 nt, Staphylococcus aureus subsp. aureus MW2
uccaguuuucaauuua

SEQ ID NO: 2109339 - RNA, 18 nt, Staphylococcus aureus subsp. aureus MW2
uccauaaucuuuauuaau

SEQ ID NO: 2109340 - RNA, 21 nt, Staphylococcus aureus subsp. aureus MW2
uccauaaucuuuauuaauaaa

SEQ ID NO: 2109341 - RNA, 18 nt, Staphylococcus aureus subsp. aureus MW2
uccauaaauaaaaugcua

SEQ ID NO: 2109342 - RNA, 17 nt, Staphylococcus aureus subsp. aureus MW2
uccauaaauauuaaauu

SEQ ID NO: 2109343 - RNA, 19 nt, Staphylococcus aureus subsp. aureus MW2
ugauuuguuacuucuaaua

SEQ ID NO: 2109344 - RNA, 22 nt, Staphylococcus aureus subsp. aureus MW2
ugauuuggaauacuuuucuucc

SEQ ID NO: 2109345 - RNA, 17 nt, Staphylococcus aureus subsp. aureus MW2
ugauuugauauuucaaa

SEQ ID NO: 2109346 - RNA, 21 nt, Staphylococcus aureus subsp. aureus MW2
ugauuugccaaaaguuauaua

SEQ ID NO: 2109347 - RNA, 21 nt, Staphylococcus aureus subsp. aureus MW2
ugcaggcaucauaucauacca

SEQ ID NO: 2109348 - RNA, 18 nt, Staphylococcus aureus subsp. aureus MW2
ugcagauaauugaaaauc

SEQ ID NO: 2109349 - RNA, 14 nt, Staphylococcus aureus subsp. aureus MW2
ugcagagaauauag

SEQ ID NO: 2109350 - RNA, 20 nt, Staphylococcus aureus subsp. aureus MW2
ugcagauaauugaaaaucua

SEQ ID NO: 2109351 - RNA, 22 nt, Staphylococcus aureus subsp. aureus MW2
ugcaucccgaaaguuagacuaa

SEQ ID NO: 2109352 - RNA, 17 nt, Staphylococcus aureus subsp. aureus MW2
ugcaugacgauaaugaa

SEQ ID NO: 2109353 - RNA, 16 nt, Staphylococcus aureus subsp. aureus MW2
ugcaugacgauaauga

SEQ ID NO: 2109354 - RNA, 20 nt, Staphylococcus aureus subsp. aureus MW2
ugcaugacagcaaauuuucu

SEQ ID NO: 2109355 - RNA, 17 nt, Staphylococcus aureus subsp. aureus MW2
ugcaugcuucucaauuu

SEQ ID NO: 2109356 - RNA, 13 nt, Staphylococcus aureus subsp. aureus MW2
ugcaugaugaacu

SEQ ID NO: 2109357 - RNA, 16 nt, Staphylococcus aureus subsp. aureus MW2
ugcaugaugaacuuaa

SEQ ID NO: 2109358 - RNA, 15 nt, Staphylococcus aureus subsp. aureus MW2
ugcaugugaaauuaa

SEQ ID NO: 2109359 - RNA, 20 nt, Staphylococcus aureus subsp. aureus MW2
ugcauagcucuugcuaaagu

SEQ ID NO: 2109360 - RNA, 17 nt, Staphylococcus aureus subsp. aureus MW2
ugcauagcuaaauaaau

SEQ ID NO: 2109361 - RNA, 14 nt, Staphylococcus aureus subsp. aureus MW2
ugcauauucuaucg

SEQ ID NO: 2109362 - RNA, 23 nt, Staphylococcus aureus subsp. aureus MW2
ugcauauugugccgcuucuacaa

SEQ ID NO: 2109363 - RNA, 15 nt, Staphylococcus aureus subsp. aureus MW2
ugcauauucaucaua

SEQ ID NO: 2109364 - RNA, 14 nt, Staphylococcus aureus subsp. aureus MW2
ugcauuacgcuguc

SEQ ID NO: 2109365 - RNA, 18 nt, Staphylococcus aureus subsp. aureus MW2
ugcauuacuacuuuauaa

SEQ ID NO: 2109366 - RNA, 22 nt, Staphylococcus aureus subsp. aureus MW2
ugcauuacuacuuuauaaauau

SEQ ID NO: 2109367 - RNA, 12 nt, Staphylococcus aureus subsp. aureus MW2
ugcauuaauuuc

SEQ ID NO: 2109368 - RNA, 18 nt, Staphylococcus aureus subsp. aureus MW2
ugccaaaaugguuaaaau

SEQ ID NO: 2109369 - RNA, 16 nt, Staphylococcus aureus subsp. aureus MW2
ugccaaaguaauaaug

SEQ ID NO: 2109370 - RNA, 17 nt, Staphylococcus aureus subsp. aureus MW2
ugccaauauaacauuua

SEQ ID NO: 2109371 - RNA, 21 nt, Staphylococcus aureus subsp. aureus MW2
ugccauuuuuaaauuacuaua

SEQ ID NO: 2109372 - RNA, 18 nt, Staphylococcus aureus subsp. aureus MW2
ugccauucauuaagcuuu

SEQ ID NO: 2109373 - RNA, 16 nt, Staphylococcus aureus subsp. aureus MW2
ugccauauguuuuaga

SEQ ID NO: 2109374 - RNA, 13 nt, Staphylococcus aureus subsp. aureus MW2
ugccuaauuuugu

SEQ ID NO: 2109375 - RNA, 21 nt, Staphylococcus aureus subsp. aureus MW2
ugccuauuuuuuuauguuaua

SEQ ID NO: 2109376 - RNA, 16 nt, Staphylococcus aureus subsp. aureus MW2
ugccguccauuuccau

SEQ ID NO: 2109377 - RNA, 20 nt, Staphylococcus aureus subsp. aureus MW2
ugccgccuaauaauaaaaua

SEQ ID NO: 2109378 - RNA, 19 nt, Staphylococcus aureus subsp. aureus MW2
ugcccucauaaaucaugaa

SEQ ID NO: 2109379 - RNA, 19 nt, Staphylococcus aureus subsp. aureus MW2
ugccuggcaacguucuacu

SEQ ID NO: 2109380 - RNA, 19 nt, Staphylococcus aureus subsp. aureus MW2
ugccugguaacguucuacu

SEQ ID NO: 2109381 - RNA, 23 nt, Staphylococcus aureus subsp. aureus MW2
ugcgauuucuucugcuaacucug

SEQ ID NO: 2109382 - RNA, 19 nt, Staphylococcus aureus subsp. aureus MW2
ugcggauuaucuaacucau

SEQ ID NO: 2109383 - RNA, 21 nt, Staphylococcus aureus subsp. aureus MW2
ugcguaagguauuucauugau

SEQ ID NO: 2109384 - RNA, 15 nt, Staphylococcus aureus subsp. aureus MW2
ugagcacaaacuaaa

SEQ ID NO: 2109385 - RNA, 19 nt, Staphylococcus aureus subsp. aureus MW2
ugagauuaucuuuagacau

SEQ ID NO: 2109386 - RNA, 13 nt, Staphylococcus aureus subsp. aureus MW2
ugagauuaucuuu

SEQ ID NO: 2109387 - RNA, 16 nt, Staphylococcus aureus subsp. aureus MW2
ugagauuauuuuuuua

SEQ ID NO: 2109388 - RNA, 23 nt, Staphylococcus aureus subsp. aureus MW2
ugagauuauuuuuuuaaaucuau

SEQ ID NO: 2109389 - RNA, 14 nt, Staphylococcus aureus subsp. aureus MW2
ugacuuuuaaaaaa

SEQ ID NO: 2109390 - RNA, 23 nt, Staphylococcus aureus subsp. aureus MW2
ugacuuuuaaaaaacauaccugc

SEQ ID NO: 2109391 - RNA, 21 nt, Staphylococcus aureus subsp. aureus MW2
ugagaaaaagguuaauauuaa

SEQ ID NO: 2109392 - RNA, 15 nt, Staphylococcus aureus subsp. aureus MW2
ugagaaucuuggaag

SEQ ID NO: 2109393 - RNA, 15 nt, Staphylococcus aureus subsp. aureus MW2
ugagaauagacauug

SEQ ID NO: 2109394 - RNA, 14 nt, Staphylococcus aureus subsp. aureus MW2
ugaccuucaguuuc

SEQ ID NO: 2109395 - RNA, 21 nt, Staphylococcus aureus subsp. aureus MW2
ugaccuuauauuuuauuuaaa

SEQ ID NO: 2109396 - RNA, 17 nt, Staphylococcus aureus subsp. aureus MW2
ugaccuuauauuuuauu

SEQ ID NO: 2109397 - RNA, 21 nt, Staphylococcus aureus subsp. aureus MW2
ugacgaacgauagauucugau

SEQ ID NO: 2109398 - RNA, 19 nt, Staphylococcus aureus subsp. aureus MW2
ugacugccugacauucauc

SEQ ID NO: 2109399 - RNA, 14 nt, Staphylococcus aureus subsp. aureus MW2
ugacuuuaaaucuu

SEQ ID NO: 2109400 - RNA, 16 nt, Staphylococcus aureus subsp. aureus MW2
ugacuguagaaaacau

SEQ ID NO: 2109401 - RNA, 16 nt, Staphylococcus aureus subsp. aureus MW2
ugagcuuaauaaauug

SEQ ID NO: 2109402 - RNA, 17 nt, Staphylococcus aureus subsp. aureus MW2
ugagcuuaauaaauugu

SEQ ID NO: 2109403 - RNA, 23 nt, Staphylococcus aureus subsp. aureus MW2
ugagcuguuacacuuuucuuauc

SEQ ID NO: 2109404 - RNA, 18 nt, Staphylococcus aureus subsp. aureus MW2
ugagcuuuucuaaugcua

SEQ ID NO: 2109405 - RNA, 17 nt, Staphylococcus aureus subsp. aureus MW2
ugagcuuuguuagcauc

SEQ ID NO: 2109406 - RNA, 19 nt, Staphylococcus aureus subsp. aureus MW2
ugaggcccauaaauuacuu

SEQ ID NO: 2109407 - RNA, 20 nt, Staphylococcus aureus subsp. aureus MW2
ugaggcccauaaauuacuug

SEQ ID NO: 2109408 - RNA, 11 nt, Staphylococcus aureus subsp. aureus MW2
ugaguacaaca

SEQ ID NO: 2109409 - RNA, 14 nt, Staphylococcus aureus subsp. aureus MW2
ugaguacaacauag

SEQ ID NO: 2109410 - RNA, 21 nt, Staphylococcus aureus subsp. aureus MW2
ugaguacuaaucaauacuaaa

SEQ ID NO: 2109411 - RNA, 18 nt, Staphylococcus aureus subsp. aureus MW2
ugaguauauucaaaagga

SEQ ID NO: 2109412 - RNA, 15 nt, Staphylococcus aureus subsp. aureus MW2
ugaguauccaauacu

SEQ ID NO: 2109413 - RNA, 14 nt, Staphylococcus aureus subsp. aureus MW2
ugaguaucaugcuu

SEQ ID NO: 2109414 - RNA, 16 nt, Staphylococcus aureus subsp. aureus MW2
ugaguaggcucuuaau

SEQ ID NO: 2109415 - RNA, 14 nt, Staphylococcus aureus subsp. aureus MW2
ugauaauucuucaa

SEQ ID NO: 2109416 - RNA, 22 nt, Staphylococcus aureus subsp. aureus MW2
ugauaauuuuucuucuuuuuua

SEQ ID NO: 2109417 - RNA, 15 nt, Staphylococcus aureus subsp. aureus MW2
ugauaauuuaauaau

SEQ ID NO: 2109418 - RNA, 14 nt, Staphylococcus aureus subsp. aureus MW2
ugauacauuauuaa

SEQ ID NO: 2109419 - RNA, 18 nt, Staphylococcus aureus subsp. aureus MW2
ugauacacguacaaaaua

SEQ ID NO: 2109420 - RNA, 19 nt, Staphylococcus aureus subsp. aureus MW2
ugauacagaaccaacaaua

SEQ ID NO: 2109421 - RNA, 20 nt, Staphylococcus aureus subsp. aureus MW2
ugauacagaaccaacaauaa

SEQ ID NO: 2109422 - RNA, 12 nt, Staphylococcus aureus subsp. aureus MW2
ugauaaauuaaa

SEQ ID NO: 2109423 - RNA, 22 nt, Staphylococcus aureus subsp. aureus MW2
ugauaaccauuaugauuaaucc

SEQ ID NO: 2109424 - RNA, 15 nt, Staphylococcus aureus subsp. aureus MW2
ugauaauccaccaaa

SEQ ID NO: 2109425 - RNA, 16 nt, Staphylococcus aureus subsp. aureus MW2
ugauaauguaaaauga

SEQ ID NO: 2109426 - RNA, 18 nt, Staphylococcus aureus subsp. aureus MW2
ugauaauguaaaaugaug

SEQ ID NO: 2109427 - RNA, 13 nt, Staphylococcus aureus subsp. aureus MW2
ugaguuuaaaaau

SEQ ID NO: 2109428 - RNA, 22 nt, Staphylococcus aureus subsp. aureus MW2
ugaguugaacaacuaugucaua

SEQ ID NO: 2109429 - RNA, 15 nt, Staphylococcus aureus subsp. aureus MW2
ugauaaauaaugcau

SEQ ID NO: 2109430 - RNA, 13 nt, Staphylococcus aureus subsp. aureus MW2
ugauaaauagaaa

SEQ ID NO: 2109431 - RNA, 23 nt, Staphylococcus aureus subsp. aureus MW2
ugagucaauuucuuuaaagucuu

SEQ ID NO: 2109432 - RNA, 17 nt, Staphylococcus aureus subsp. aureus MW2
ugaguaugauagaaauc

SEQ ID NO: 2109433 - RNA, 17 nt, Staphylococcus aureus subsp. aureus MW2
ugaguauuacuugaaaa

SEQ ID NO: 2109434 - RNA, 24 nt, Staphylococcus aureus subsp. aureus MW2
ugaucaaauugcguuguuucauua

SEQ ID NO: 2109435 - RNA, 14 nt, Staphylococcus aureus subsp. aureus MW2
ugaucaauuaacac

SEQ ID NO: 2109436 - RNA, 12 nt, Staphylococcus aureus subsp. aureus MW2
ugaucaauaaga

SEQ ID NO: 2109437 - RNA, 19 nt, Staphylococcus aureus subsp. aureus MW2
ugaucaauaagauuuugcu

SEQ ID NO: 2109438 - RNA, 19 nt, Staphylococcus aureus subsp. aureus MW2
ugauauugaucugauuuca

SEQ ID NO: 2109439 - RNA, 14 nt, Staphylococcus aureus subsp. aureus MW2
ugauauugaaagug

SEQ ID NO: 2109440 - RNA, 13 nt, Staphylococcus aureus subsp. aureus MW2
ugauauuaauaua

SEQ ID NO: 2109441 - RNA, 14 nt, Staphylococcus aureus subsp. aureus MW2
ugauauuaauauau

SEQ ID NO: 2109442 - RNA, 16 nt, Staphylococcus aureus subsp. aureus MW2
ugauauuaauauauuu

SEQ ID NO: 2109443 - RNA, 20 nt, Staphylococcus aureus subsp. aureus MW2
ugauacauuauuaaauagau

SEQ ID NO: 2109444 - RNA, 18 nt, Staphylococcus aureus subsp. aureus MW2
ugaucauuuacuuuagaa

SEQ ID NO: 2109445 - RNA, 19 nt, Staphylococcus aureus subsp. aureus MW2
ugaugcuugaauguuugaa

SEQ ID NO: 2109446 - RNA, 23 nt, Staphylococcus aureus subsp. aureus MW2
ugaugcuagcuuucuuuuucauc

SEQ ID NO: 2109447 - RNA, 18 nt, Staphylococcus aureus subsp. aureus MW2
ugauggaaucauuuucuu

SEQ ID NO: 2109448 - RNA, 20 nt, Staphylococcus aureus subsp. aureus MW2
ugaugaaguaguuucauugc

SEQ ID NO: 2109449 - RNA, 17 nt, Staphylococcus aureus subsp. aureus MW2
ugaugaacuuaaugcuu

SEQ ID NO: 2109450 - RNA, 16 nt, Staphylococcus aureus subsp. aureus MW2
ugaucuuuaaauauac

SEQ ID NO: 2109451 - RNA, 18 nt, Staphylococcus aureus subsp. aureus MW2
ugaucuuuaaauauacuu

SEQ ID NO: 2109452 - RNA, 21 nt, Staphylococcus aureus subsp. aureus MW2
ugauuggcagugaucuuuuuu

SEQ ID NO: 2109453 - RNA, 13 nt, Staphylococcus aureus subsp. aureus MW2
ugauuuauaaaaa

SEQ ID NO: 2109454 - RNA, 12 nt, Staphylococcus aureus subsp. aureus MW2
ugauuucacuac

SEQ ID NO: 2109455 - RNA, 17 nt, Staphylococcus aureus subsp. aureus MW2
ugauuauaaugauuguc

SEQ ID NO: 2109456 - RNA, 22 nt, Staphylococcus aureus subsp. aureus MW2
ugauuagcauaccuuuauuauu

SEQ ID NO: 2109457 - RNA, 14 nt, Staphylococcus aureus subsp. aureus MW2
ugauuauauauauu

SEQ ID NO: 2109458 - RNA, 17 nt, Staphylococcus aureus subsp. aureus MW2
ugauuauaaauacauga

SEQ ID NO: 2109459 - RNA, 18 nt, Staphylococcus aureus subsp. aureus MW2
ugauuauucuucauuuau

SEQ ID NO: 2109460 - RNA, 23 nt, Staphylococcus aureus subsp. aureus MW2
ugauuauucuuuaauuaaaucuu

SEQ ID NO: 2109461 - RNA, 22 nt, Staphylococcus aureus subsp. aureus MW2
ugauucaaauaaaucaaacuuu

SEQ ID NO: 2109462 - RNA, 14 nt, Staphylococcus aureus subsp. aureus MW2
ugauucuagugaaa

SEQ ID NO: 2109463 - RNA, 18 nt, Staphylococcus aureus subsp. aureus MW2
ugauucuaaauaaucgaa

SEQ ID NO: 2109464 - RNA, 22 nt, Staphylococcus aureus subsp. aureus MW2
ugauucauuucgauuaauuuaa

SEQ ID NO: 2109465 - RNA, 20 nt, Staphylococcus aureus subsp. aureus MW2
ugauuaaaaaucaaagaggc

SEQ ID NO: 2109466 - RNA, 23 nt, Staphylococcus aureus subsp. aureus MW2
ugauuaaaguguuucaacauauu

SEQ ID NO: 2109467 - RNA, 12 nt, Staphylococcus aureus subsp. aureus MW2
ugauuaaaagug

SEQ ID NO: 2109468 - RNA, 22 nt, Staphylococcus aureus subsp. aureus MW2
ugauuaaaguguuucaacauau

SEQ ID NO: 2109469 - RNA, 22 nt, Staphylococcus aureus subsp. aureus MW2
ugauuaaauucuuuucaagaaa

SEQ ID NO: 2109470 - RNA, 23 nt, Staphylococcus aureus subsp. aureus MW2
ugauuaauuauugagaauauuua

SEQ ID NO: 2109471 - RNA, 18 nt, Staphylococcus aureus subsp. aureus MW2
ugauuaauuaaagauuaa

SEQ ID NO: 2109472 - RNA, 18 nt, Staphylococcus aureus subsp. aureus MW2
ugauuacaacuuauucuu

SEQ ID NO: 2109473 - RNA, 21 nt, Staphylococcus aureus subsp. aureus MW2
ugauuacaacuuauucuucac

SEQ ID NO: 2109474 - RNA, 22 nt, Staphylococcus aureus subsp. aureus MW2
ugauuacauucuauacuuuuaa

SEQ ID NO: 2109475 - RNA, 16 nt, Staphylococcus aureus subsp. aureus MW2
ugauguguugcauuac

SEQ ID NO: 2109476 - RNA, 13 nt, Staphylococcus aureus subsp. aureus MW2
ugauguuaaaaaa

SEQ ID NO: 2109477 - RNA, 13 nt, Staphylococcus aureus subsp. aureus MW2
ugaugugaaaauu

SEQ ID NO: 2109478 - RNA, 17 nt, Staphylococcus aureus subsp. aureus MW2
ugauguaacguuucuuu

SEQ ID NO: 2109479 - RNA, 16 nt, Staphylococcus aureus subsp. aureus MW2
ugaugguacuaaaguu

SEQ ID NO: 2109480 - RNA, 23 nt, Staphylococcus aureus subsp. aureus MW2
ugaauuuagcaucaaaaauaaaa

SEQ ID NO: 2109481 - RNA, 14 nt, Staphylococcus aureus subsp. aureus MW2
ugaauuuagaugca

SEQ ID NO: 2109482 - RNA, 17 nt, Staphylococcus aureus subsp. aureus MW2
ugaauuuagaugcauaa

SEQ ID NO: 2109483 - RNA, 21 nt, Staphylococcus aureus subsp. aureus MW2
ugaauuuauuuuguaguuccu

SEQ ID NO: 2109484 - RNA, 14 nt, Staphylococcus aureus subsp. aureus MW2
ugaauuuauuuugu

SEQ ID NO: 2109485 - RNA, 15 nt, Staphylococcus aureus subsp. aureus MW2
ugaauuguaaaagug

SEQ ID NO: 2109486 - RNA, 19 nt, Staphylococcus aureus subsp. aureus MW2
ugaauuuucagcaucuacu

SEQ ID NO: 2109487 - RNA, 14 nt, Staphylococcus aureus subsp. aureus MW2
ugaauuuucaucau

SEQ ID NO: 2109488 - RNA, 17 nt, Staphylococcus aureus subsp. aureus MW2
ugaauuuucguucaauu

SEQ ID NO: 2109489 - RNA, 23 nt, Staphylococcus aureus subsp. aureus MW2
ugaauuuuauuagguaauacuuu

SEQ ID NO: 2109490 - RNA, 16 nt, Staphylococcus aureus subsp. aureus MW2
ugaauugacugacuuc

SEQ ID NO: 2109491 - RNA, 14 nt, Staphylococcus aureus subsp. aureus MW2
ugaauugauuauaa

SEQ ID NO: 2109492 - RNA, 15 nt, Staphylococcus aureus subsp. aureus MW2
ugaauugauuauaau

SEQ ID NO: 2109493 - RNA, 18 nt, Staphylococcus aureus subsp. aureus MW2
ugaauugaaaaauuaaaa

SEQ ID NO: 2109494 - RNA, 19 nt, Staphylococcus aureus subsp. aureus MW2
ugaauuauuuaaaaugcuu

SEQ ID NO: 2109495 - RNA, 15 nt, Staphylococcus aureus subsp. aureus MW2
ugaauuauuuaaaau

SEQ ID NO: 2109496 - RNA, 15 nt, Staphylococcus aureus subsp. aureus MW2
ugaauuaucuauaua

SEQ ID NO: 2109497 - RNA, 21 nt, Staphylococcus aureus subsp. aureus MW2
ugaauguuacucguaacaucu

SEQ ID NO: 2109498 - RNA, 23 nt, Staphylococcus aureus subsp. aureus MW2
ugaauguuacucguaacaucugu

SEQ ID NO: 2109499 - RNA, 12 nt, Staphylococcus aureus subsp. aureus MW2
ugaauuaaaaaa

SEQ ID NO: 2109500 - RNA, 23 nt, Staphylococcus aureus subsp. aureus MW2
ugaauguuggaucggcauuguaa

SEQ ID NO: 2109501 - RNA, 20 nt, Staphylococcus aureus subsp. aureus MW2
ugaauuaaacugaucaugau

SEQ ID NO: 2109502 - RNA, 18 nt, Staphylococcus aureus subsp. aureus MW2
ugaauuaaaucuuuauaa

SEQ ID NO: 2109503 - RNA, 19 nt, Staphylococcus aureus subsp. aureus MW2
ugaaugggucauuaaauga

SEQ ID NO: 2109504 - RNA, 23 nt, Staphylococcus aureus subsp. aureus MW2
ugaauggcaaucuauauaaaugu

SEQ ID NO: 2109505 - RNA, 14 nt, Staphylococcus aureus subsp. aureus MW2
ugaauggcaaauau

SEQ ID NO: 2109506 - RNA, 22 nt, Staphylococcus aureus subsp. aureus MW2
ugaauggcaaucuauauaaaug

SEQ ID NO: 2109507 - RNA, 16 nt, Staphylococcus aureus subsp. aureus MW2
ugaauggcaaauauga

SEQ ID NO: 2109508 - RNA, 23 nt, Staphylococcus aureus subsp. aureus MW2
ugaaucuuguugaacucugauau

SEQ ID NO: 2109509 - RNA, 20 nt, Staphylococcus aureus subsp. aureus MW2
ugaaugaaccuuuacucaua

SEQ ID NO: 2109510 - RNA, 22 nt, Staphylococcus aureus subsp. aureus MW2
ugaaugaaccuuuacucauauu

SEQ ID NO: 2109511 - RNA, 14 nt, Staphylococcus aureus subsp. aureus MW2
ugaaugagugucau

SEQ ID NO: 2109512 - RNA, 16 nt, Staphylococcus aureus subsp. aureus MW2
ugaaugauugcauuga

SEQ ID NO: 2109513 - RNA, 14 nt, Staphylococcus aureus subsp. aureus MW2
ugaaugaaguaaua

SEQ ID NO: 2109514 - RNA, 13 nt, Staphylococcus aureus subsp. aureus MW2
ugaaucacauuaa

SEQ ID NO: 2109515 - RNA, 16 nt, Staphylococcus aureus subsp. aureus MW2
ugaaucacauuaacaa

SEQ ID NO: 2109516 - RNA, 19 nt, Staphylococcus aureus subsp. aureus MW2
ugaaucaaaucaauaucau

SEQ ID NO: 2109517 - RNA, 22 nt, Staphylococcus aureus subsp. aureus MW2
ugaaucaaaucaauaucauuca

SEQ ID NO: 2109518 - RNA, 17 nt, Staphylococcus aureus subsp. aureus MW2
ugaauccaaauauuaaa

SEQ ID NO: 2109519 - RNA, 14 nt, Staphylococcus aureus subsp. aureus MW2
ugaaucgcauuuaa

SEQ ID NO: 2109520 - RNA, 18 nt, Staphylococcus aureus subsp. aureus MW2
ugaaucuaaacuauaaua

SEQ ID NO: 2109521 - RNA, 14 nt, Staphylococcus aureus subsp. aureus MW2
ugaaucuaaacuau

SEQ ID NO: 2109522 - RNA, 21 nt, Staphylococcus aureus subsp. aureus MW2
ugaaucuaaacuauaauaauu

SEQ ID NO: 2109523 - RNA, 14 nt, Staphylococcus aureus subsp. aureus MW2
ugacaaauuaucac

SEQ ID NO: 2109524 - RNA, 14 nt, Staphylococcus aureus subsp. aureus MW2
ugacaaauuaaaaa

SEQ ID NO: 2109525 - RNA, 17 nt, Staphylococcus aureus subsp. aureus MW2
ugacacacccaaauuua

SEQ ID NO: 2109526 - RNA, 20 nt, Staphylococcus aureus subsp. aureus MW2
ugacacaaugauucaucagu

SEQ ID NO: 2109527 - RNA, 17 nt, Staphylococcus aureus subsp. aureus MW2
ugacaauuuaaauuaag

SEQ ID NO: 2109528 - RNA, 18 nt, Staphylococcus aureus subsp. aureus MW2
ugacaaucgcuugcuucu

SEQ ID NO: 2109529 - RNA, 22 nt, Staphylococcus aureus subsp. aureus MW2
ugacaaguugcugaauaaaaua

SEQ ID NO: 2109530 - RNA, 15 nt, Staphylococcus aureus subsp. aureus MW2
ugacacauuauugaa

SEQ ID NO: 2109531 - RNA, 21 nt, Staphylococcus aureus subsp. aureus MW2
ugacacgcucaggcuggaaca

SEQ ID NO: 2109532 - RNA, 22 nt, Staphylococcus aureus subsp. aureus MW2
ugaccauuaucaagaacuuuaa

SEQ ID NO: 2109533 - RNA, 17 nt, Staphylococcus aureus subsp. aureus MW2
ugaccauugucaugccu

SEQ ID NO: 2109534 - RNA, 21 nt, Staphylococcus aureus subsp. aureus MW2
ugacauauuuuuuaaauuuaa

SEQ ID NO: 2109535 - RNA, 17 nt, Staphylococcus aureus subsp. aureus MW2
ugacauauuuuuuaaau

SEQ ID NO: 2109536 - RNA, 23 nt, Staphylococcus aureus subsp. aureus MW2
ugacaguuuccauaaauaaaaug

SEQ ID NO: 2109537 - RNA, 14 nt, Staphylococcus aureus subsp. aureus MW2
ugaaaccauacuaa

SEQ ID NO: 2109538 - RNA, 14 nt, Staphylococcus aureus subsp. aureus MW2
ugaaacaucuugau

SEQ ID NO: 2109539 - RNA, 17 nt, Staphylococcus aureus subsp. aureus MW2
ugaaacuguaucaacau

SEQ ID NO: 2109540 - RNA, 17 nt, Staphylococcus aureus subsp. aureus MW2
ugaaaccguauuauuag

SEQ ID NO: 2109541 - RNA, 21 nt, Staphylococcus aureus subsp. aureus MW2
ucuucggcuuuguaaaauugu

SEQ ID NO: 2109542 - RNA, 23 nt, Staphylococcus aureus subsp. aureus MW2
ugaaaguaccgguuuuucauaua

SEQ ID NO: 2109543 - RNA, 22 nt, Staphylococcus aureus subsp. aureus MW2
ugaaagucguuguugaaauuaa

SEQ ID NO: 2109544 - RNA, 13 nt, Staphylococcus aureus subsp. aureus MW2
ugaaaguauuaga

SEQ ID NO: 2109545 - RNA, 20 nt, Staphylococcus aureus subsp. aureus MW2
ugaaauauaccaaccaaaac

SEQ ID NO: 2109546 - RNA, 14 nt, Staphylococcus aureus subsp. aureus MW2
ugaaauaucaagau

SEQ ID NO: 2109547 - RNA, 16 nt, Staphylococcus aureus subsp. aureus MW2
ugaaauauaccaacca

SEQ ID NO: 2109548 - RNA, 12 nt, Staphylococcus aureus subsp. aureus MW2
ugaaauagcuuu

SEQ ID NO: 2109549 - RNA, 19 nt, Staphylococcus aureus subsp. aureus MW2
ugaaagaaaagugaaaacu

SEQ ID NO: 2109550 - RNA, 20 nt, Staphylococcus aureus subsp. aureus MW2
ugaaagacugacuaauaaaa

SEQ ID NO: 2109551 - RNA, 15 nt, Staphylococcus aureus subsp. aureus MW2
ugaaauauuuaucuu

SEQ ID NO: 2109552 - RNA, 22 nt, Staphylococcus aureus subsp. aureus MW2
ugaaaugauacauuauuaaaua

SEQ ID NO: 2109553 - RNA, 15 nt, Staphylococcus aureus subsp. aureus MW2
ugaaaugagcuuaag

SEQ ID NO: 2109554 - RNA, 20 nt, Staphylococcus aureus subsp. aureus MW2
ugaaaugauacauuauuaaa

SEQ ID NO: 2109555 - RNA, 17 nt, Staphylococcus aureus subsp. aureus MW2
ugaaauguuuaucaauu

SEQ ID NO: 2109556 - RNA, 22 nt, Staphylococcus aureus subsp. aureus MW2
ugaaauguagacaauaaaucuu

SEQ ID NO: 2109557 - RNA, 20 nt, Staphylococcus aureus subsp. aureus MW2
ugaaauguuuauaauaauau

SEQ ID NO: 2109558 - RNA, 20 nt, Staphylococcus aureus subsp. aureus MW2
ugaaauguucccuucaaagu

SEQ ID NO: 2109559 - RNA, 17 nt, Staphylococcus aureus subsp. aureus MW2
ugaaauuauuauuuaaa

SEQ ID NO: 2109560 - RNA, 19 nt, Staphylococcus aureus subsp. aureus MW2
ugaaauuagauuuuaugcu

SEQ ID NO: 2109561 - RNA, 22 nt, Staphylococcus aureus subsp. aureus MW2
ugaaauuauuauuuaaauuuuc

SEQ ID NO: 2109562 - RNA, 23 nt, Staphylococcus aureus subsp. aureus MW2
ugaaauuaacgucaacagcauaa

SEQ ID NO: 2109563 - RNA, 23 nt, Staphylococcus aureus subsp. aureus MW2
ugaaauucgaacuaucaauauaa

SEQ ID NO: 2109564 - RNA, 22 nt, Staphylococcus aureus subsp. aureus MW2
ugaaauucuuuuguaauugaaa

SEQ ID NO: 2109565 - RNA, 19 nt, Staphylococcus aureus subsp. aureus MW2
ugaaauuugguaggcauuu

SEQ ID NO: 2109566 - RNA, 22 nt, Staphylococcus aureus subsp. aureus MW2
ugaaauuugguaggcauuuuau

SEQ ID NO: 2109567 - RNA, 14 nt, Staphylococcus aureus subsp. aureus MW2
ugaaauuucauaaa

SEQ ID NO: 2109568 - RNA, 18 nt, Staphylococcus aureus subsp. aureus MW2
ugaacaucauuuaauuga

SEQ ID NO: 2109569 - RNA, 15 nt, Staphylococcus aureus subsp. aureus MW2
ugaacagauucaccu

SEQ ID NO: 2109570 - RNA, 22 nt, Staphylococcus aureus subsp. aureus MW2
ugaacagauucaccuaaucuug

SEQ ID NO: 2109571 - RNA, 20 nt, Staphylococcus aureus subsp. aureus MW2
ugaaccagcuaaccaaauaa

SEQ ID NO: 2109572 - RNA, 21 nt, Staphylococcus aureus subsp. aureus MW2
ugaacaaaaauaaaaacuucu

SEQ ID NO: 2109573 - RNA, 19 nt, Staphylococcus aureus subsp. aureus MW2
ugaacaaucagauaaguua

SEQ ID NO: 2109574 - RNA, 13 nt, Staphylococcus aureus subsp. aureus MW2
ugaacaauucuuc

SEQ ID NO: 2109575 - RNA, 19 nt, Staphylococcus aureus subsp. aureus MW2
ugaacaauucuucaucaug

SEQ ID NO: 2109576 - RNA, 15 nt, Staphylococcus aureus subsp. aureus MW2
ugaauaauuccagua

SEQ ID NO: 2109577 - RNA, 13 nt, Staphylococcus aureus subsp. aureus MW2
ugaauaauucuuu

SEQ ID NO: 2109578 - RNA, 15 nt, Staphylococcus aureus subsp. aureus MW2
ugaauaauucuuuua

SEQ ID NO: 2109579 - RNA, 22 nt, Staphylococcus aureus subsp. aureus MW2
ugaauaauaaacuuaaaagaga

SEQ ID NO: 2109580 - RNA, 13 nt, Staphylococcus aureus subsp. aureus MW2
ugaaguugaagcc

SEQ ID NO: 2109581 - RNA, 16 nt, Staphylococcus aureus subsp. aureus MW2
ugaaguuacuauauuu

SEQ ID NO: 2109582 - RNA, 17 nt, Staphylococcus aureus subsp. aureus MW2
ugaagugaaaaauuucu

SEQ ID NO: 2109583 - RNA, 13 nt, Staphylococcus aureus subsp. aureus MW2
ugaauauaaugac

SEQ ID NO: 2109584 - RNA, 21 nt, Staphylococcus aureus subsp. aureus MW2
ugaauaguaaucagcuuuuuc

SEQ ID NO: 2109585 - RNA, 17 nt, Staphylococcus aureus subsp. aureus MW2
ugaauauggaaaaugua

SEQ ID NO: 2109586 - RNA, 20 nt, Staphylococcus aureus subsp. aureus MW2
ugaauauggaaaauguauua

SEQ ID NO: 2109587 - RNA, 21 nt, Staphylococcus aureus subsp. aureus MW2
ugaauauggaaaauguauuau

SEQ ID NO: 2109588 - RNA, 15 nt, Staphylococcus aureus subsp. aureus MW2
ugaauaugauauuaa

SEQ ID NO: 2109589 - RNA, 16 nt, Staphylococcus aureus subsp. aureus MW2
ugaauaugauauuaag

SEQ ID NO: 2109590 - RNA, 13 nt, Staphylococcus aureus subsp. aureus MW2
ugaauauagcugu

SEQ ID NO: 2109591 - RNA, 15 nt, Staphylococcus aureus subsp. aureus MW2
ugaauauaauuuuaa

SEQ ID NO: 2109592 - RNA, 15 nt, Staphylococcus aureus subsp. aureus MW2
ugaagggacaaugaa

SEQ ID NO: 2109593 - RNA, 17 nt, Staphylococcus aureus subsp. aureus MW2
ugaagggagcauuucau

SEQ ID NO: 2109594 - RNA, 18 nt, Staphylococcus aureus subsp. aureus MW2
ugaagggagcauuucauu

SEQ ID NO: 2109595 - RNA, 19 nt, Staphylococcus aureus subsp. aureus MW2
ugaagggagcauuucauua

SEQ ID NO: 2109596 - RNA, 14 nt, Staphylococcus aureus subsp. aureus MW2
ugaagguaauuuaa

SEQ ID NO: 2109597 - RNA, 23 nt, Staphylococcus aureus subsp. aureus MW2
ugaagcgcuuggauuuuuugguu

SEQ ID NO: 2109598 - RNA, 20 nt, Staphylococcus aureus subsp. aureus MW2
ugaagcgcuuggauuuuuug

SEQ ID NO: 2109599 - RNA, 21 nt, Staphylococcus aureus subsp. aureus MW2
ugaagcggguugaagcaauuu

SEQ ID NO: 2109600 - RNA, 22 nt, Staphylococcus aureus subsp. aureus MW2
ugaagcguucgugauagaaguu

SEQ ID NO: 2109601 - RNA, 23 nt, Staphylococcus aureus subsp. aureus MW2
ugaagcuaaguauauaagcaaag

SEQ ID NO: 2109602 - RNA, 14 nt, Staphylococcus aureus subsp. aureus MW2
ugaagcuaauucau

SEQ ID NO: 2109603 - RNA, 12 nt, Staphylococcus aureus subsp. aureus MW2
ugaacuuuuauu

SEQ ID NO: 2109604 - RNA, 15 nt, Staphylococcus aureus subsp. aureus MW2
ugaacuuuguaucuu

SEQ ID NO: 2109605 - RNA, 16 nt, Staphylococcus aureus subsp. aureus MW2
ugaagagaaaauuugu

SEQ ID NO: 2109606 - RNA, 20 nt, Staphylococcus aureus subsp. aureus MW2
ugaagaggucuccaauacuu

SEQ ID NO: 2109607 - RNA, 22 nt, Staphylococcus aureus subsp. aureus MW2
ugaagagcuuuuaguaaauaau

SEQ ID NO: 2109608 - RNA, 12 nt, Staphylococcus aureus subsp. aureus MW2
ugaacuucuuuu

SEQ ID NO: 2109609 - RNA, 18 nt, Staphylococcus aureus subsp. aureus MW2
ugaacgaaucuauaacga

SEQ ID NO: 2109610 - RNA, 15 nt, Staphylococcus aureus subsp. aureus MW2
ugaacgaaagagaaa

SEQ ID NO: 2109611 - RNA, 17 nt, Staphylococcus aureus subsp. aureus MW2
ugaacgaaagagaaaag

SEQ ID NO: 2109612 - RNA, 17 nt, Staphylococcus aureus subsp. aureus MW2
ugaaccuuuacucauau

SEQ ID NO: 2109613 - RNA, 17 nt, Staphylococcus aureus subsp. aureus MW2
ugaacgagagagaaaag

SEQ ID NO: 2109614 - RNA, 18 nt, Staphylococcus aureus subsp. aureus MW2
ugaacgauaacaauuuau

SEQ ID NO: 2109615 - RNA, 15 nt, Staphylococcus aureus subsp. aureus MW2
ucgccaacuaaauca

SEQ ID NO: 2109616 - RNA, 17 nt, Staphylococcus aureus subsp. aureus MW2
ucgcugcuacaccaccu

SEQ ID NO: 2109617 - RNA, 15 nt, Staphylococcus aureus subsp. aureus MW2
ucgcugcuacaccac

SEQ ID NO: 2109618 - RNA, 21 nt, Staphylococcus aureus subsp. aureus MW2
ucgcucacaugugaaauaauc

SEQ ID NO: 2109619 - RNA, 23 nt, Staphylococcus aureus subsp. aureus MW2
ucgcuugcuucuuuccucuccuu

SEQ ID NO: 2109620 - RNA, 13 nt, Staphylococcus aureus subsp. aureus MW2
ucggaauaaaaua

SEQ ID NO: 2109621 - RNA, 14 nt, Staphylococcus aureus subsp. aureus MW2
ucggaauaaaauaa

SEQ ID NO: 2109622 - RNA, 11 nt, Staphylococcus aureus subsp. aureus MW2
ucgcuuuucua

SEQ ID NO: 2109623 - RNA, 18 nt, Staphylococcus aureus subsp. aureus MW2
ucggaugagaaauguuaa

SEQ ID NO: 2109624 - RNA, 16 nt, Staphylococcus aureus subsp. aureus MW2
ucggauccaaucuaaa

SEQ ID NO: 2109625 - RNA, 16 nt, Staphylococcus aureus subsp. aureus MW2
ucggauuaucuguaau

SEQ ID NO: 2109626 - RNA, 16 nt, Staphylococcus aureus subsp. aureus MW2
ucggcacucaauuuaa

SEQ ID NO: 2109627 - RNA, 14 nt, Staphylococcus aureus subsp. aureus MW2
ucgguauucaauuc

SEQ ID NO: 2109628 - RNA, 18 nt, Staphylococcus aureus subsp. aureus MW2
ucgguauaucuaaaugau

SEQ ID NO: 2109629 - RNA, 15 nt, Staphylococcus aureus subsp. aureus MW2
ucgguucaucuaaaa

SEQ ID NO: 2109630 - RNA, 17 nt, Staphylococcus aureus subsp. aureus MW2
ucgguucaucuaaaauu

SEQ ID NO: 2109631 - RNA, 15 nt, Staphylococcus aureus subsp. aureus MW2
ucgguuuuauuuuug

SEQ ID NO: 2109632 - RNA, 23 nt, Staphylococcus aureus subsp. aureus MW2
ucgguuuuauuuuugucaucaug

SEQ ID NO: 2109633 - RNA, 16 nt, Staphylococcus aureus subsp. aureus MW2
ucgguuauuacaaaau

SEQ ID NO: 2109634 - RNA, 20 nt, Staphylococcus aureus subsp. aureus MW2
ucggcuuuggauuucuuuuu

SEQ ID NO: 2109635 - RNA, 13 nt, Staphylococcus aureus subsp. aureus MW2
ucggcuuucuaag

SEQ ID NO: 2109636 - RNA, 14 nt, Staphylococcus aureus subsp. aureus MW2
ucggcuuuguaaaa

SEQ ID NO: 2109637 - RNA, 15 nt, Staphylococcus aureus subsp. aureus MW2
ucgucacguaaaaua

SEQ ID NO: 2109638 - RNA, 13 nt, Staphylococcus aureus subsp. aureus MW2
ucgucauuaugug

SEQ ID NO: 2109639 - RNA, 14 nt, Staphylococcus aureus subsp. aureus MW2
ucgucgaaaugccu

SEQ ID NO: 2109640 - RNA, 14 nt, Staphylococcus aureus subsp. aureus MW2
ucguacuuucaaau

SEQ ID NO: 2109641 - RNA, 13 nt, Staphylococcus aureus subsp. aureus MW2
ucguacuuucaaa

SEQ ID NO: 2109642 - RNA, 23 nt, Staphylococcus aureus subsp. aureus MW2
ucguacguuuagugaaaauacca

SEQ ID NO: 2109643 - RNA, 14 nt, Staphylococcus aureus subsp. aureus MW2
ucguaccugcucuu

SEQ ID NO: 2109644 - RNA, 20 nt, Staphylococcus aureus subsp. aureus MW2
ucguaccugcucuuuccaca

SEQ ID NO: 2109645 - RNA, 17 nt, Staphylococcus aureus subsp. aureus MW2
ucguaacauuuaaaaaa

SEQ ID NO: 2109646 - RNA, 18 nt, Staphylococcus aureus subsp. aureus MW2
ucguaacgaagauuuugu

SEQ ID NO: 2109647 - RNA, 15 nt, Staphylococcus aureus subsp. aureus MW2
ucguaacauuuaaaa

SEQ ID NO: 2109648 - RNA, 17 nt, Staphylococcus aureus subsp. aureus MW2
ucguaacucuuuaauuu

SEQ ID NO: 2109649 - RNA, 22 nt, Staphylococcus aureus subsp. aureus MW2
ucguaaugaugacaucaauauc

SEQ ID NO: 2109650 - RNA, 15 nt, Staphylococcus aureus subsp. aureus MW2
ucguauucuuuuaau

SEQ ID NO: 2109651 - RNA, 16 nt, Staphylococcus aureus subsp. aureus MW2
ucguauucaaaguuuu

SEQ ID NO: 2109652 - RNA, 21 nt, Staphylococcus aureus subsp. aureus MW2
ucguauugaaaaugagcugaa

SEQ ID NO: 2109653 - RNA, 13 nt, Staphylococcus aureus subsp. aureus MW2
ucgucaaauucaa

SEQ ID NO: 2109654 - RNA, 22 nt, Staphylococcus aureus subsp. aureus MW2
ucgucaaacggcacuaauauuu

SEQ ID NO: 2109655 - RNA, 23 nt, Staphylococcus aureus subsp. aureus MW2
ucgucaaacggcacuaauauuua

SEQ ID NO: 2109656 - RNA, 19 nt, Staphylococcus aureus subsp. aureus MW2
ucguauaguacuaaaagua

SEQ ID NO: 2109657 - RNA, 20 nt, Staphylococcus aureus subsp. aureus MW2
ucguaguaaccuaauucuaa

SEQ ID NO: 2109658 - RNA, 21 nt, Staphylococcus aureus subsp. aureus MW2
ucguaguaaccuaauucuaag

SEQ ID NO: 2109659 - RNA, 18 nt, Staphylococcus aureus subsp. aureus MW2
ucgucucacuuaauaaau

SEQ ID NO: 2109660 - RNA, 19 nt, Staphylococcus aureus subsp. aureus MW2
ucgucuucaauuaaugauu

SEQ ID NO: 2109661 - RNA, 16 nt, Staphylococcus aureus subsp. aureus MW2
ucgugauagaaguuuu

SEQ ID NO: 2109662 - RNA, 15 nt, Staphylococcus aureus subsp. aureus MW2
ucguguuccaauuuu

SEQ ID NO: 2109663 - RNA, 23 nt, Staphylococcus aureus subsp. aureus MW2
ucguguuaauaaccgaaauauug

SEQ ID NO: 2109664 - RNA, 19 nt, Staphylococcus aureus subsp. aureus MW2
ucgugauuuggaauacuuu

SEQ ID NO: 2109665 - RNA, 21 nt, Staphylococcus aureus subsp. aureus MW2
ucguuaaggaaagcuucauau

SEQ ID NO: 2109666 - RNA, 13 nt, Staphylococcus aureus subsp. aureus MW2
ucguuaauaaacc

SEQ ID NO: 2109667 - RNA, 14 nt, Staphylococcus aureus subsp. aureus MW2
ucguuaauuuccaa

SEQ ID NO: 2109668 - RNA, 22 nt, Staphylococcus aureus subsp. aureus MW2
ucguuauaaguacaaauaauac

SEQ ID NO: 2109669 - RNA, 23 nt, Staphylococcus aureus subsp. aureus MW2
ucguuaccuuuuaaggcagcuaa

SEQ ID NO: 2109670 - RNA, 11 nt, Staphylococcus aureus subsp. aureus MW2
ucguuccuuug

SEQ ID NO: 2109671 - RNA, 17 nt, Staphylococcus aureus subsp. aureus MW2
ucguucauauauuuugu

SEQ ID NO: 2109672 - RNA, 20 nt, Staphylococcus aureus subsp. aureus MW2
ucguucaucgcuaauacuuu

SEQ ID NO: 2109673 - RNA, 18 nt, Staphylococcus aureus subsp. aureus MW2
ucguuugaauuauuuaau

SEQ ID NO: 2109674 - RNA, 19 nt, Staphylococcus aureus subsp. aureus MW2
ucguuguacaguaauauuc

SEQ ID NO: 2109675 - RNA, 20 nt, Staphylococcus aureus subsp. aureus MW2
ucguuguacaguaauauuca

SEQ ID NO: 2109676 - RNA, 15 nt, Staphylococcus aureus subsp. aureus MW2
ucguuuaaugggauu

SEQ ID NO: 2109677 - RNA, 14 nt, Staphylococcus aureus subsp. aureus MW2
ucguuuauuuuaaa

SEQ ID NO: 2109678 - RNA, 13 nt, Staphylococcus aureus subsp. aureus MW2
ucucauuaucacc

SEQ ID NO: 2109679 - RNA, 19 nt, Staphylococcus aureus subsp. aureus MW2
ucucauuagcgaaaacuaa

SEQ ID NO: 2109680 - RNA, 12 nt, Staphylococcus aureus subsp. aureus MW2
ucucauuaaccu

SEQ ID NO: 2109681 - RNA, 21 nt, Staphylococcus aureus subsp. aureus MW2
ucucauucuuuaauauaaauu

SEQ ID NO: 2109682 - RNA, 14 nt, Staphylococcus aureus subsp. aureus MW2
ucucaucuucuaaa

SEQ ID NO: 2109683 - RNA, 20 nt, Staphylococcus aureus subsp. aureus MW2
ucucaugccaaaaacauuaa

SEQ ID NO: 2109684 - RNA, 21 nt, Staphylococcus aureus subsp. aureus MW2
ucucaugccaaaaacauuaac

SEQ ID NO: 2109685 - RNA, 22 nt, Staphylococcus aureus subsp. aureus MW2
ucucccuuaaauacaauuucuu

SEQ ID NO: 2109686 - RNA, 14 nt, Staphylococcus aureus subsp. aureus MW2
ucuccaguuuucaa

SEQ ID NO: 2109687 - RNA, 23 nt, Staphylococcus aureus subsp. aureus MW2
ucuccaguuuucaauuuauuaac

SEQ ID NO: 2109688 - RNA, 13 nt, Staphylococcus aureus subsp. aureus MW2
ucuccauuuaagg

SEQ ID NO: 2109689 - RNA, 16 nt, Staphylococcus aureus subsp. aureus MW2
ucuccguauuuaccuu

SEQ ID NO: 2109690 - RNA, 20 nt, Staphylococcus aureus subsp. aureus MW2
ucuccuugcucaugagcaca

SEQ ID NO: 2109691 - RNA, 23 nt, Staphylococcus aureus subsp. aureus MW2
ucucuaucaguccgcuuuuucau

SEQ ID NO: 2109692 - RNA, 22 nt, Staphylococcus aureus subsp. aureus MW2
ucucuaucaguccgcuuuuuca

SEQ ID NO: 2109693 - RNA, 18 nt, Staphylococcus aureus subsp. aureus MW2
ucucuauuaauuuucuca

SEQ ID NO: 2109694 - RNA, 17 nt, Staphylococcus aureus subsp. aureus MW2
ucucucgcuaaauuuau

SEQ ID NO: 2109695 - RNA, 18 nt, Staphylococcus aureus subsp. aureus MW2
ucucguguaaaaugcaau

SEQ ID NO: 2109696 - RNA, 17 nt, Staphylococcus aureus subsp. aureus MW2
ucucuaaaacuuuuuca

SEQ ID NO: 2109697 - RNA, 19 nt, Staphylococcus aureus subsp. aureus MW2
ucucugcuuuaauauaauu

SEQ ID NO: 2109698 - RNA, 22 nt, Staphylococcus aureus subsp. aureus MW2
aaaugcuuaauuuguuuuaaau

SEQ ID NO: 2109699 - RNA, 20 nt, Staphylococcus aureus subsp. aureus MW2
aaaugcuuaauaaaaucaaa

SEQ ID NO: 2109700 - RNA, 21 nt, Staphylococcus aureus subsp. aureus MW2
aaaugcuucucuauacccuuu

SEQ ID NO: 2109701 - RNA, 18 nt, Staphylococcus aureus subsp. aureus MW2
aaaugcuuaagaaauuuu

SEQ ID NO: 2109702 - RNA, 17 nt, Staphylococcus aureus subsp. aureus MW2
ucucugaaaaacuucuu

SEQ ID NO: 2109703 - RNA, 12 nt, Staphylococcus aureus subsp. aureus MW2
aaaugcuuuaaa

SEQ ID NO: 2109704 - RNA, 12 nt, Staphylococcus aureus subsp. aureus MW2
aaauggagcaac

SEQ ID NO: 2109705 - RNA, 16 nt, Staphylococcus aureus subsp. aureus MW2
ucucuucugucuaaaa

SEQ ID NO: 2109706 - RNA, 12 nt, Staphylococcus aureus subsp. aureus MW2
ucucuucuggag

SEQ ID NO: 2109707 - RNA, 20 nt, Staphylococcus aureus subsp. aureus MW2
ucugacauuguugcuaaucu

SEQ ID NO: 2109708 - RNA, 14 nt, Staphylococcus aureus subsp. aureus MW2
ucugacauuuaaag

SEQ ID NO: 2109709 - RNA, 22 nt, Staphylococcus aureus subsp. aureus MW2
ucugacauuucaucaauaauuu

SEQ ID NO: 2109710 - RNA, 19 nt, Staphylococcus aureus subsp. aureus MW2
ucugaaacuuuaauacuac

SEQ ID NO: 2109711 - RNA, 18 nt, Staphylococcus aureus subsp. aureus MW2
ucucuuuacaccauugca

SEQ ID NO: 2109712 - RNA, 14 nt, Staphylococcus aureus subsp. aureus MW2
ucugaaaacuuaau

SEQ ID NO: 2109713 - RNA, 19 nt, Staphylococcus aureus subsp. aureus MW2
ucugaaaacuuaauagaaa

SEQ ID NO: 2109714 - RNA, 22 nt, Staphylococcus aureus subsp. aureus MW2
ucugaaaauaucacugaaugcu

SEQ ID NO: 2109715 - RNA, 22 nt, Staphylococcus aureus subsp. aureus MW2
ucugauacagaaccaacaauaa

SEQ ID NO: 2109716 - RNA, 22 nt, Staphylococcus aureus subsp. aureus MW2
ucugauacuucaccaucuuuaa

SEQ ID NO: 2109717 - RNA, 17 nt, Staphylococcus aureus subsp. aureus MW2
ucuuaucaagaauauaa

SEQ ID NO: 2109718 - RNA, 16 nt, Staphylococcus aureus subsp. aureus MW2
ucuuauaaaagucagc

SEQ ID NO: 2109719 - RNA, 22 nt, Staphylococcus aureus subsp. aureus MW2
ucuuauaaagacaccuucaaua

SEQ ID NO: 2109720 - RNA, 13 nt, Staphylococcus aureus subsp. aureus MW2
ucuuaucaacaac

SEQ ID NO: 2109721 - RNA, 13 nt, Staphylococcus aureus subsp. aureus MW2
ucuucaauauuua

SEQ ID NO: 2109722 - RNA, 23 nt, Staphylococcus aureus subsp. aureus MW2
ucuuaucgaaagaugauauauuc

SEQ ID NO: 2109723 - RNA, 22 nt, Staphylococcus aureus subsp. aureus MW2
ucuuaucgaaagaugauauauu

SEQ ID NO: 2109724 - RNA, 15 nt, Staphylococcus aureus subsp. aureus MW2
ucuuacuacuuaauu

SEQ ID NO: 2109725 - RNA, 18 nt, Staphylococcus aureus subsp. aureus MW2
ucuuagugaaucuucuaa

SEQ ID NO: 2109726 - RNA, 18 nt, Staphylococcus aureus subsp. aureus MW2
ucuguuaacugaauuucg

SEQ ID NO: 2109727 - RNA, 23 nt, Staphylococcus aureus subsp. aureus MW2
ucuguuacagguuuuaaaauuaa

SEQ ID NO: 2109728 - RNA, 22 nt, Staphylococcus aureus subsp. aureus MW2
ucuucaauucuuacaccugcaa

SEQ ID NO: 2109729 - RNA, 14 nt, Staphylococcus aureus subsp. aureus MW2
ucuucaauuuauuu

SEQ ID NO: 2109730 - RNA, 17 nt, Staphylococcus aureus subsp. aureus MW2
ucuucaauucuuacacc

SEQ ID NO: 2109731 - RNA, 9 nt, Staphylococcus aureus subsp. aureus MW2
ucuucacca

SEQ ID NO: 2109732 - RNA, 13 nt, Staphylococcus aureus subsp. aureus MW2
ucuucaccaucug

SEQ ID NO: 2109733 - RNA, 22 nt, Staphylococcus aureus subsp. aureus MW2
ucuuccaaucaacuucauauaa

SEQ ID NO: 2109734 - RNA, 15 nt, Staphylococcus aureus subsp. aureus MW2
ucuuccaaucaacuu

SEQ ID NO: 2109735 - RNA, 13 nt, Staphylococcus aureus subsp. aureus MW2
ucuguacuucuaa

SEQ ID NO: 2109736 - RNA, 22 nt, Staphylococcus aureus subsp. aureus MW2
ucuguaauaugaaggcuuuuug

SEQ ID NO: 2109737 - RNA, 19 nt, Staphylococcus aureus subsp. aureus MW2
ucuguagcgauaccuuuaa

SEQ ID NO: 2109738 - RNA, 22 nt, Staphylococcus aureus subsp. aureus MW2
ucuguagcgauaccuuuaauau

SEQ ID NO: 2109739 - RNA, 19 nt, Staphylococcus aureus subsp. aureus MW2
ucuguagguuuaauguuua

SEQ ID NO: 2109740 - RNA, 20 nt, Staphylococcus aureus subsp. aureus MW2
ucuguauauggcgauaacaa

SEQ ID NO: 2109741 - RNA, 21 nt, Staphylococcus aureus subsp. aureus MW2
ucuguauccucaguauuuaau

SEQ ID NO: 2109742 - RNA, 18 nt, Staphylococcus aureus subsp. aureus MW2
ucugucuaaaaacauaaa

SEQ ID NO: 2109743 - RNA, 20 nt, Staphylococcus aureus subsp. aureus MW2
ucugucuaaaaacauaaaaa

SEQ ID NO: 2109744 - RNA, 18 nt, Staphylococcus aureus subsp. aureus MW2
ucuguccgauuuuuaaug

SEQ ID NO: 2109745 - RNA, 13 nt, Staphylococcus aureus subsp. aureus MW2
ucuguccaaaaag

SEQ ID NO: 2109746 - RNA, 16 nt, Staphylococcus aureus subsp. aureus MW2
ucuguccaaaaagguu

SEQ ID NO: 2109747 - RNA, 20 nt, Staphylococcus aureus subsp. aureus MW2
ucuguccgauaucuuuuaau

SEQ ID NO: 2109748 - RNA, 21 nt, Staphylococcus aureus subsp. aureus MW2
ucuguccgauaucuuuuaauu

SEQ ID NO: 2109749 - RNA, 16 nt, Staphylococcus aureus subsp. aureus MW2
ucuguccgauuuuuaa

SEQ ID NO: 2109750 - RNA, 15 nt, Staphylococcus aureus subsp. aureus MW2
ucuguccgauuuaau

SEQ ID NO: 2109751 - RNA, 17 nt, Staphylococcus aureus subsp. aureus MW2
ucuguauuauuauaauu

SEQ ID NO: 2109752 - RNA, 19 nt, Staphylococcus aureus subsp. aureus MW2
ucugcauagcgcucuggau

SEQ ID NO: 2109753 - RNA, 14 nt, Staphylococcus aureus subsp. aureus MW2
ucugcuucuuuuaa

SEQ ID NO: 2109754 - RNA, 14 nt, Staphylococcus aureus subsp. aureus MW2
ucugcuucuaaaac

SEQ ID NO: 2109755 - RNA, 22 nt, Staphylococcus aureus subsp. aureus MW2
ucugguauuuuaugacguaauu

SEQ ID NO: 2109756 - RNA, 12 nt, Staphylococcus aureus subsp. aureus MW2
ucuaaaauaacu

SEQ ID NO: 2109757 - RNA, 13 nt, Staphylococcus aureus subsp. aureus MW2
ucuaaacaauucc

SEQ ID NO: 2109758 - RNA, 19 nt, Staphylococcus aureus subsp. aureus MW2
ucuaaaccuuuuuuaaguu

SEQ ID NO: 2109759 - RNA, 18 nt, Staphylococcus aureus subsp. aureus MW2
ucuaaaaacauaaaaauc

SEQ ID NO: 2109760 - RNA, 13 nt, Staphylococcus aureus subsp. aureus MW2
ucuaaaacauguu

SEQ ID NO: 2109761 - RNA, 13 nt, Staphylococcus aureus subsp. aureus MW2
ucuaaaaacauaa

SEQ ID NO: 2109762 - RNA, 18 nt, Staphylococcus aureus subsp. aureus MW2
ucuaaaaaauuaaaaauu

SEQ ID NO: 2109763 - RNA, 21 nt, Staphylococcus aureus subsp. aureus MW2
ucuaaaaacaaaacgcaauaa

SEQ ID NO: 2109764 - RNA, 13 nt, Staphylococcus aureus subsp. aureus MW2
ucuaaaaaauuaa

SEQ ID NO: 2109765 - RNA, 16 nt, Staphylococcus aureus subsp. aureus MW2
ucguuuuaauaaauug

SEQ ID NO: 2109766 - RNA, 23 nt, Staphylococcus aureus subsp. aureus MW2
ucguuuucuuaaacgcucuucuu

SEQ ID NO: 2109767 - RNA, 13 nt, Staphylococcus aureus subsp. aureus MW2
ucguuuuauuaau

SEQ ID NO: 2109768 - RNA, 21 nt, Staphylococcus aureus subsp. aureus MW2
ucguuuuauuaaugaagcugu

SEQ ID NO: 2109769 - RNA, 13 nt, Staphylococcus aureus subsp. aureus MW2
ucguuuuaauaau

SEQ ID NO: 2109770 - RNA, 21 nt, Staphylococcus aureus subsp. aureus MW2
ucuaaaugguuaucuaaaauu

SEQ ID NO: 2109771 - RNA, 21 nt, Staphylococcus aureus subsp. aureus MW2
ucuaaauguaaaaucauuaau

SEQ ID NO: 2109772 - RNA, 14 nt, Staphylococcus aureus subsp. aureus MW2
ucuaacaguuaaua

SEQ ID NO: 2109773 - RNA, 20 nt, Staphylococcus aureus subsp. aureus MW2
ucuaaauaaaauuaaaacag

SEQ ID NO: 2109774 - RNA, 17 nt, Staphylococcus aureus subsp. aureus MW2
ucuaaauaguuuuucau

SEQ ID NO: 2109775 - RNA, 23 nt, Staphylococcus aureus subsp. aureus MW2
ucuaaauauaauagaaauaauca

SEQ ID NO: 2109776 - RNA, 16 nt, Staphylococcus aureus subsp. aureus MW2
ucuaaaucuauacuuu

SEQ ID NO: 2109777 - RNA, 18 nt, Staphylococcus aureus subsp. aureus MW2
ucuaaacuauaauaauug

SEQ ID NO: 2109778 - RNA, 15 nt, Staphylococcus aureus subsp. aureus MW2
ucuaaagcuauaaaa

SEQ ID NO: 2109779 - RNA, 17 nt, Staphylococcus aureus subsp. aureus MW2
ucuaaacuucuauuaau

SEQ ID NO: 2109780 - RNA, 19 nt, Staphylococcus aureus subsp. aureus MW2
aaaucuuuaacauuugucc

SEQ ID NO: 2109781 - RNA, 14 nt, Staphylococcus aureus subsp. aureus MW2
aaaucuuuaaaugu

SEQ ID NO: 2109782 - RNA, 13 nt, Staphylococcus aureus subsp. aureus MW2
aaaucuuuaaaug

SEQ ID NO: 2109783 - RNA, 20 nt, Staphylococcus aureus subsp. aureus MW2
aaaucuuuuagcuuuuguaa

SEQ ID NO: 2109784 - RNA, 21 nt, Staphylococcus aureus subsp. aureus MW2
aaaucuuuuacuaaaugaauu

SEQ ID NO: 2109785 - RNA, 14 nt, Staphylococcus aureus subsp. aureus MW2
aaaugaaaaaguaa

SEQ ID NO: 2109786 - RNA, 16 nt, Staphylococcus aureus subsp. aureus MW2
aaaugaaauucuuuug

SEQ ID NO: 2109787 - RNA, 15 nt, Staphylococcus aureus subsp. aureus MW2
ucuaauacauacuga

SEQ ID NO: 2109788 - RNA, 16 nt, Staphylococcus aureus subsp. aureus MW2
ucuaauaauuuaaugu

SEQ ID NO: 2109789 - RNA, 13 nt, Staphylococcus aureus subsp. aureus MW2
ucuaagucuuuug

SEQ ID NO: 2109790 - RNA, 14 nt, Staphylococcus aureus subsp. aureus MW2
ucuaaguaauauaa

SEQ ID NO: 2109791 - RNA, 19 nt, Staphylococcus aureus subsp. aureus MW2
ucuaacggcguuuguuucu

SEQ ID NO: 2109792 - RNA, 16 nt, Staphylococcus aureus subsp. aureus MW2
ucuaacgcaacugaaa

SEQ ID NO: 2109793 - RNA, 21 nt, Staphylococcus aureus subsp. aureus MW2
ucuaacuuuaccaauaucaug

SEQ ID NO: 2109794 - RNA, 21 nt, Staphylococcus aureus subsp. aureus MW2
ucuaacuuguuuauucagaua

SEQ ID NO: 2109795 - RNA, 16 nt, Staphylococcus aureus subsp. aureus MW2
ucuaacuuaccaugau

SEQ ID NO: 2109796 - RNA, 22 nt, Staphylococcus aureus subsp. aureus MW2
aaaucuuguuggauuuuaacaa

SEQ ID NO: 2109797 - RNA, 13 nt, Staphylococcus aureus subsp. aureus MW2
aaaucuuguucua

SEQ ID NO: 2109798 - RNA, 23 nt, Staphylococcus aureus subsp. aureus MW2
aaaucuuacauugauaaaauaau

SEQ ID NO: 2109799 - RNA, 22 nt, Staphylococcus aureus subsp. aureus MW2
aaaucuucaagugccauuuuua

SEQ ID NO: 2109800 - RNA, 19 nt, Staphylococcus aureus subsp. aureus MW2
aaaucuuauagauuuuuca

SEQ ID NO: 2109801 - RNA, 21 nt, Staphylococcus aureus subsp. aureus MW2
aaaucuuaugaugucauguau

SEQ ID NO: 2109802 - RNA, 21 nt, Staphylococcus aureus subsp. aureus MW2
aaaugacauggaaaauauauu

SEQ ID NO: 2109803 - RNA, 16 nt, Staphylococcus aureus subsp. aureus MW2
aaaugacuaccuguug

SEQ ID NO: 2109804 - RNA, 18 nt, Staphylococcus aureus subsp. aureus MW2
aaaugacugaauuaauau

SEQ ID NO: 2109805 - RNA, 21 nt, Staphylococcus aureus subsp. aureus MW2
aaaugaauuauuuaaaaugcu

SEQ ID NO: 2109806 - RNA, 13 nt, Staphylococcus aureus subsp. aureus MW2
aaaugaauaauua

SEQ ID NO: 2109807 - RNA, 18 nt, Staphylococcus aureus subsp. aureus MW2
aaaugacuucacauuuau

SEQ ID NO: 2109808 - RNA, 22 nt, Staphylococcus aureus subsp. aureus MW2
ucuaccaauaauucccuaggaa

SEQ ID NO: 2109809 - RNA, 16 nt, Staphylococcus aureus subsp. aureus MW2
ucuaccaauacguuuc

SEQ ID NO: 2109810 - RNA, 13 nt, Staphylococcus aureus subsp. aureus MW2
ucuacuuuguucu

SEQ ID NO: 2109811 - RNA, 22 nt, Staphylococcus aureus subsp. aureus MW2
ucuacucgaaaccagcuuacug

SEQ ID NO: 2109812 - RNA, 14 nt, Staphylococcus aureus subsp. aureus MW2
ucuacuuaaaauaa

SEQ ID NO: 2109813 - RNA, 21 nt, Staphylococcus aureus subsp. aureus MW2
aaaugagcugaacuuucuuua

SEQ ID NO: 2109814 - RNA, 16 nt, Staphylococcus aureus subsp. aureus MW2
ucuacuaaauaacuau

SEQ ID NO: 2109815 - RNA, 17 nt, Staphylococcus aureus subsp. aureus MW2
ucuacuaaaucaaauug

SEQ ID NO: 2109816 - RNA, 18 nt, Staphylococcus aureus subsp. aureus MW2
ucuacgaucaaaaucaug

SEQ ID NO: 2109817 - RNA, 20 nt, Staphylococcus aureus subsp. aureus MW2
ucuacagcgucaccuaaugc

SEQ ID NO: 2109818 - RNA, 18 nt, Staphylococcus aureus subsp. aureus MW2
ucuacaggcaaugcaagu

SEQ ID NO: 2109819 - RNA, 22 nt, Staphylococcus aureus subsp. aureus MW2
ucuacaggcaaugcaaguuggg

SEQ ID NO: 2109820 - RNA, 14 nt, Staphylococcus aureus subsp. aureus MW2
ucuacaguuuuaug

SEQ ID NO: 2109821 - RNA, 21 nt, Staphylococcus aureus subsp. aureus MW2
ucuacauauuggcuugcuuca

SEQ ID NO: 2109822 - RNA, 13 nt, Staphylococcus aureus subsp. aureus MW2
ucuacauauacaa

SEQ ID NO: 2109823 - RNA, 23 nt, Staphylococcus aureus subsp. aureus MW2
ucuacaugaaucaacaauauaaa

SEQ ID NO: 2109824 - RNA, 18 nt, Staphylococcus aureus subsp. aureus MW2
aaaugaagguguugaaaa

SEQ ID NO: 2109825 - RNA, 22 nt, Staphylococcus aureus subsp. aureus MW2
aaaugaagucuuucaacaaaau

SEQ ID NO: 2109826 - RNA, 20 nt, Staphylococcus aureus subsp. aureus MW2
ucuacaacuucauuaguugc

SEQ ID NO: 2109827 - RNA, 15 nt, Staphylococcus aureus subsp. aureus MW2
ucuacaaaguuaauc

SEQ ID NO: 2109828 - RNA, 11 nt, Staphylococcus aureus subsp. aureus MW2
ucuaauuuuuc

SEQ ID NO: 2109829 - RNA, 22 nt, Staphylococcus aureus subsp. aureus MW2
ucuaauuuuuccaacuucuuuu

SEQ ID NO: 2109830 - RNA, 15 nt, Staphylococcus aureus subsp. aureus MW2
ucuaauuuuucuuua

SEQ ID NO: 2109831 - RNA, 16 nt, Staphylococcus aureus subsp. aureus MW2
ucuaauuuuucuuuaa

SEQ ID NO: 2109832 - RNA, 18 nt, Staphylococcus aureus subsp. aureus MW2
ucuaauuuuucuuuaagc

SEQ ID NO: 2109833 - RNA, 19 nt, Staphylococcus aureus subsp. aureus MW2
ucuacaauauuaaaauuaa

SEQ ID NO: 2109834 - RNA, 22 nt, Staphylococcus aureus subsp. aureus MW2
ucuacaauauuaaaauuaaaac

SEQ ID NO: 2109835 - RNA, 22 nt, Staphylococcus aureus subsp. aureus MW2
ucuacagacaaugcaaguuggg

SEQ ID NO: 2109836 - RNA, 20 nt, Staphylococcus aureus subsp. aureus MW2
ucuaauuugcaaaaucaacc

SEQ ID NO: 2109837 - RNA, 21 nt, Staphylococcus aureus subsp. aureus MW2
ucuaauuucuuagauuuuaua

SEQ ID NO: 2109838 - RNA, 15 nt, Staphylococcus aureus subsp. aureus MW2
ucuaauuguuguaau

SEQ ID NO: 2109839 - RNA, 13 nt, Staphylococcus aureus subsp. aureus MW2
ucuaauucguaau

SEQ ID NO: 2109840 - RNA, 14 nt, Staphylococcus aureus subsp. aureus MW2
ucuaauucugaaau

SEQ ID NO: 2109841 - RNA, 12 nt, Staphylococcus aureus subsp. aureus MW2
ucuaauucuucu

SEQ ID NO: 2109842 - RNA, 14 nt, Staphylococcus aureus subsp. aureus MW2
ucuaauucuucuaa

SEQ ID NO: 2109843 - RNA, 14 nt, Staphylococcus aureus subsp. aureus MW2
ucuaauucaaugau

SEQ ID NO: 2109844 - RNA, 22 nt, Staphylococcus aureus subsp. aureus MW2
ucuaauucaaugauuuuuaaaa

SEQ ID NO: 2109845 - RNA, 17 nt, Staphylococcus aureus subsp. aureus MW2
ucuaauuauucaugaau

SEQ ID NO: 2109846 - RNA, 18 nt, Staphylococcus aureus subsp. aureus MW2
ucuaauacuuucaaacaa

SEQ ID NO: 2109847 - RNA, 15 nt, Staphylococcus aureus subsp. aureus MW2
ucuaauacuuucacu

SEQ ID NO: 2109848 - RNA, 20 nt, Staphylococcus aureus subsp. aureus MW2
ucuaauacuuucaaacaaau

SEQ ID NO: 2109849 - RNA, 17 nt, Staphylococcus aureus subsp. aureus MW2
ucuaaugcuaauuuaac

SEQ ID NO: 2109850 - RNA, 20 nt, Staphylococcus aureus subsp. aureus MW2
ucuaaugggucaaugacuga

SEQ ID NO: 2109851 - RNA, 22 nt, Staphylococcus aureus subsp. aureus MW2
ucucaauccaauuaaauauuua

SEQ ID NO: 2109852 - RNA, 20 nt, Staphylococcus aureus subsp. aureus MW2
ucuauuuuaugauuugauuu

SEQ ID NO: 2109853 - RNA, 23 nt, Staphylococcus aureus subsp. aureus MW2
ucucaaacuaucuuauauuuaug

SEQ ID NO: 2109854 - RNA, 12 nt, Staphylococcus aureus subsp. aureus MW2
ucuauuucuaua

SEQ ID NO: 2109855 - RNA, 22 nt, Staphylococcus aureus subsp. aureus MW2
ucuauuucacucuacaauccua

SEQ ID NO: 2109856 - RNA, 18 nt, Staphylococcus aureus subsp. aureus MW2
ucuauuuacggcauaauu

SEQ ID NO: 2109857 - RNA, 17 nt, Staphylococcus aureus subsp. aureus MW2
ucuauugcaauauaguu

SEQ ID NO: 2109858 - RNA, 18 nt, Staphylococcus aureus subsp. aureus MW2
ucuauuauuuuacuuugu

SEQ ID NO: 2109859 - RNA, 19 nt, Staphylococcus aureus subsp. aureus MW2
ucuauuaaacauuuuugau

SEQ ID NO: 2109860 - RNA, 23 nt, Staphylococcus aureus subsp. aureus MW2
ucuauuauauugaauugaaaaau

SEQ ID NO: 2109861 - RNA, 15 nt, Staphylococcus aureus subsp. aureus MW2
ucuauucaaauauaa

SEQ ID NO: 2109862 - RNA, 20 nt, Staphylococcus aureus subsp. aureus MW2
ucuauucaaaugauuuuagu

SEQ ID NO: 2109863 - RNA, 21 nt, Staphylococcus aureus subsp. aureus MW2
ucuauuagggggcauauuaau

SEQ ID NO: 2109864 - RNA, 20 nt, Staphylococcus aureus subsp. aureus MW2
aaaugcgcuuccaauuuaaa

SEQ ID NO: 2109865 - RNA, 23 nt, Staphylococcus aureus subsp. aureus MW2
ucucacugcuguucuuuuuauuu

SEQ ID NO: 2109866 - RNA, 21 nt, Staphylococcus aureus subsp. aureus MW2
aaaugccucugcaacgccuuu

SEQ ID NO: 2109867 - RNA, 14 nt, Staphylococcus aureus subsp. aureus MW2
aaaugccucuuuug

SEQ ID NO: 2109868 - RNA, 21 nt, Staphylococcus aureus subsp. aureus MW2
ucucagauucauaucuuucaa

SEQ ID NO: 2109869 - RNA, 13 nt, Staphylococcus aureus subsp. aureus MW2
ucucauaauaauu

SEQ ID NO: 2109870 - RNA, 19 nt, Staphylococcus aureus subsp. aureus MW2
ucucaucauuuucaauacu

SEQ ID NO: 2109871 - RNA, 17 nt, Staphylococcus aureus subsp. aureus MW2
ucucaucgaauucauuu

SEQ ID NO: 2109872 - RNA, 19 nt, Staphylococcus aureus subsp. aureus MW2
ucucaucuacuauuuaauc

SEQ ID NO: 2109873 - RNA, 18 nt, Staphylococcus aureus subsp. aureus MW2
aaaugauuguuuuaagug

SEQ ID NO: 2109874 - RNA, 19 nt, Staphylococcus aureus subsp. aureus MW2
aaaugauugguaaacauaa

SEQ ID NO: 2109875 - RNA, 16 nt, Staphylococcus aureus subsp. aureus MW2
aaaugauuaauaacau

SEQ ID NO: 2109876 - RNA, 23 nt, Staphylococcus aureus subsp. aureus MW2
aaaugauggguaguuaauauaau

SEQ ID NO: 2109877 - RNA, 20 nt, Staphylococcus aureus subsp. aureus MW2
aaaugauguaacguuucuuu

SEQ ID NO: 2109878 - RNA, 13 nt, Staphylococcus aureus subsp. aureus MW2
aaaugcaauaugu

SEQ ID NO: 2109879 - RNA, 14 nt, Staphylococcus aureus subsp. aureus MW2
aaaugcaauuuuuc

SEQ ID NO: 2109880 - RNA, 21 nt, Staphylococcus aureus subsp. aureus MW2
aaaugcaauuuuucacuuaua

SEQ ID NO: 2109881 - RNA, 22 nt, Staphylococcus aureus subsp. aureus MW2
aaaugcaauacaccuauuacac

SEQ ID NO: 2109882 - RNA, 13 nt, Staphylococcus aureus subsp. aureus MW2
aaaugcauuacua

SEQ ID NO: 2109883 - RNA, 16 nt, Staphylococcus aureus subsp. aureus MW2
aaaugcauaauauauu

SEQ ID NO: 2109884 - RNA, 19 nt, Staphylococcus aureus subsp. aureus MW2
aaaugcacugagcaacaaa

SEQ ID NO: 2109885 - RNA, 19 nt, Staphylococcus aureus subsp. aureus MW2
aaaugcagcuguauaacca

SEQ ID NO: 2109886 - RNA, 19 nt, Staphylococcus aureus subsp. aureus MW2
ucuaggcuccuaaauguua

SEQ ID NO: 2109887 - RNA, 20 nt, Staphylococcus aureus subsp. aureus MW2
ucuaguagcuagaacagaua

SEQ ID NO: 2109888 - RNA, 19 nt, Staphylococcus aureus subsp. aureus MW2
aaaugaugcaguaaaacca

SEQ ID NO: 2109889 - RNA, 17 nt, Staphylococcus aureus subsp. aureus MW2
ucuagagauaacuagaa

SEQ ID NO: 2109890 - RNA, 15 nt, Staphylococcus aureus subsp. aureus MW2
ucuagagauaacuag

SEQ ID NO: 2109891 - RNA, 16 nt, Staphylococcus aureus subsp. aureus MW2
aaaugauaauuuaaua

SEQ ID NO: 2109892 - RNA, 19 nt, Staphylococcus aureus subsp. aureus MW2
aaaugauagauucaaaauu

SEQ ID NO: 2109893 - RNA, 17 nt, Staphylococcus aureus subsp. aureus MW2
ucuaucgccuaaaaaua

SEQ ID NO: 2109894 - RNA, 16 nt, Staphylococcus aureus subsp. aureus MW2
ucuaucgccuaaaaau

SEQ ID NO: 2109895 - RNA, 21 nt, Staphylococcus aureus subsp. aureus MW2
ucuaucgccuaaaaauaaaau

SEQ ID NO: 2109896 - RNA, 18 nt, Staphylococcus aureus subsp. aureus MW2
ucuaucgguauaucuaaa

SEQ ID NO: 2109897 - RNA, 14 nt, Staphylococcus aureus subsp. aureus MW2
ucuaucgccuaaaa

SEQ ID NO: 2109898 - RNA, 12 nt, Staphylococcus aureus subsp. aureus MW2
ucuaucaaauua

SEQ ID NO: 2109899 - RNA, 18 nt, Staphylococcus aureus subsp. aureus MW2
ucuauauuaauaaucuuc

SEQ ID NO: 2109900 - RNA, 21 nt, Staphylococcus aureus subsp. aureus MW2
ucuaucaaauuacuuauucaa

SEQ ID NO: 2109901 - RNA, 13 nt, Staphylococcus aureus subsp. aureus MW2
ucuauauuuaauu

SEQ ID NO: 2109902 - RNA, 14 nt, Staphylococcus aureus subsp. aureus MW2
ucuauauuuuauua

SEQ ID NO: 2109903 - RNA, 23 nt, Staphylococcus aureus subsp. aureus MW2
ucuauccaaagacauacagucaa

SEQ ID NO: 2109904 - RNA, 19 nt, Staphylococcus aureus subsp. aureus MW2
ucuaucaguaugaaguugc

SEQ ID NO: 2109905 - RNA, 17 nt, Staphylococcus aureus subsp. aureus MW2
ucuaucuauaaacguca

SEQ ID NO: 2109906 - RNA, 16 nt, Staphylococcus aureus subsp. aureus MW2
ucuaucuauucaaaua

SEQ ID NO: 2109907 - RNA, 16 nt, Staphylococcus aureus subsp. aureus MW2
ucuaugaauaauguuu

SEQ ID NO: 2109908 - RNA, 14 nt, Staphylococcus aureus subsp. aureus MW2
ucuaugaaauuuuu

SEQ ID NO: 2109909 - RNA, 16 nt, Staphylococcus aureus subsp. aureus MW2
ucuaugucaaauugaa

SEQ ID NO: 2109910 - RNA, 14 nt, Staphylococcus aureus subsp. aureus MW2
ucuaucuuguucuu

SEQ ID NO: 2109911 - RNA, 21 nt, Staphylococcus aureus subsp. aureus MW2
ucuauauaacgcuuuaaauca

SEQ ID NO: 2109912 - RNA, 19 nt, Staphylococcus aureus subsp. aureus MW2
ucuauagucaucuguuaau

SEQ ID NO: 2109913 - RNA, 15 nt, Staphylococcus aureus subsp. aureus MW2
ucuauagcacugaaa

SEQ ID NO: 2109914 - RNA, 19 nt, Staphylococcus aureus subsp. aureus MW2
ucuauagcacugaaaucua

SEQ ID NO: 2109915 - RNA, 13 nt, Staphylococcus aureus subsp. aureus MW2
ucuauauauauuu

SEQ ID NO: 2109916 - RNA, 16 nt, Staphylococcus aureus subsp. aureus MW2
ucuauauauauuuaaa

SEQ ID NO: 2109917 - RNA, 21 nt, Staphylococcus aureus subsp. aureus MW2
ucuauaucgucgauuucauua

SEQ ID NO: 2109918 - RNA, 23 nt, Staphylococcus aureus subsp. aureus MW2
ucuauaucgucgauuucauuaau

SEQ ID NO: 2109919 - RNA, 16 nt, Staphylococcus aureus subsp. aureus MW2
ucuauaugcauauauu

SEQ ID NO: 2109920 - RNA, 15 nt, Staphylococcus aureus subsp. aureus MW2
ucuauaucuauuuau

SEQ ID NO: 2109921 - RNA, 23 nt, Staphylococcus aureus subsp. aureus MW2
ucuauacauuccaaaguaccauc

SEQ ID NO: 2109922 - RNA, 15 nt, Staphylococcus aureus subsp. aureus MW2
ucuauaaauuauuuu

SEQ ID NO: 2109923 - RNA, 14 nt, Staphylococcus aureus subsp. aureus MW2
ucuauaacaccaua

SEQ ID NO: 2109924 - RNA, 14 nt, Staphylococcus aureus subsp. aureus MW2
ucuauaaccuuaau

SEQ ID NO: 2109925 - RNA, 18 nt, Staphylococcus aureus subsp. aureus MW2
ucuauaagauuucucagu

SEQ ID NO: 2109926 - RNA, 19 nt, Staphylococcus aureus subsp. aureus MW2
ucuauaauauucaauaauu

SEQ ID NO: 2109927 - RNA, 21 nt, Staphylococcus aureus subsp. aureus MW2
ucuauaauauucaauaauuca

SEQ ID NO: 2109928 - RNA, 14 nt, Staphylococcus aureus subsp. aureus MW2
ucuauaaagaauga

SEQ ID NO: 2109929 - RNA, 13 nt, Staphylococcus aureus subsp. aureus MW2
ucuauaaauauca

SEQ ID NO: 2109930 - RNA, 13 nt, Staphylococcus aureus subsp. aureus MW2
ucuauaaauacuu

SEQ ID NO: 2109931 - RNA, 15 nt, Staphylococcus aureus subsp. aureus MW2
uuaacaaauuaaaaa

SEQ ID NO: 2109932 - RNA, 18 nt, Staphylococcus aureus subsp. aureus MW2
uuaaauuuaauuuuauuu

SEQ ID NO: 2109933 - RNA, 12 nt, Staphylococcus aureus subsp. aureus MW2
uuaaauuucaaa

SEQ ID NO: 2109934 - RNA, 17 nt, Staphylococcus aureus subsp. aureus MW2
uuaaauuucaaauauaa

SEQ ID NO: 2109935 - RNA, 18 nt, Staphylococcus aureus subsp. aureus MW2
uuaacaagugaugaaaaa

SEQ ID NO: 2109936 - RNA, 13 nt, Staphylococcus aureus subsp. aureus MW2
uuaacaauaucau

SEQ ID NO: 2109937 - RNA, 20 nt, Staphylococcus aureus subsp. aureus MW2
uuaacaaugcgauuaaacuc

SEQ ID NO: 2109938 - RNA, 19 nt, Staphylococcus aureus subsp. aureus MW2
uuaacaauuuuaucugaau

SEQ ID NO: 2109939 - RNA, 21 nt, Staphylococcus aureus subsp. aureus MW2
uuaaauucuuauaaaauaaaa

SEQ ID NO: 2109940 - RNA, 19 nt, Staphylococcus aureus subsp. aureus MW2
uuaaauucuuauaaaauaa

SEQ ID NO: 2109941 - RNA, 22 nt, Staphylococcus aureus subsp. aureus MW2
uuaaauuccaugucaauuuuuu

SEQ ID NO: 2109942 - RNA, 18 nt, Staphylococcus aureus subsp. aureus MW2
uuaaauucggaaaauauc

SEQ ID NO: 2109943 - RNA, 13 nt, Staphylococcus aureus subsp. aureus MW2
uuaaauuuaaaag

SEQ ID NO: 2109944 - RNA, 15 nt, Staphylococcus aureus subsp. aureus MW2
uuaaauuuaaaagaa

SEQ ID NO: 2109945 - RNA, 12 nt, Staphylococcus aureus subsp. aureus MW2
uuaaauucauuu

SEQ ID NO: 2109946 - RNA, 21 nt, Staphylococcus aureus subsp. aureus MW2
uuaaauuacuauauuuaaauu

SEQ ID NO: 2109947 - RNA, 22 nt, Staphylococcus aureus subsp. aureus MW2
uuaaauguacauuguaaauaua

SEQ ID NO: 2109948 - RNA, 13 nt, Staphylococcus aureus subsp. aureus MW2
uuaaauuaaaaua

SEQ ID NO: 2109949 - RNA, 14 nt, Staphylococcus aureus subsp. aureus MW2
uuaaauuaaaauaa

SEQ ID NO: 2109950 - RNA, 21 nt, Staphylococcus aureus subsp. aureus MW2
uuaaauguacauuguaaauau

SEQ ID NO: 2109951 - RNA, 13 nt, Staphylococcus aureus subsp. aureus MW2
uuaaaugcuuuaa

SEQ ID NO: 2109952 - RNA, 16 nt, Staphylococcus aureus subsp. aureus MW2
uuaaaugcuuuaaaua

SEQ ID NO: 2109953 - RNA, 12 nt, Staphylococcus aureus subsp. aureus MW2
uuaaaugcuuuc

SEQ ID NO: 2109954 - RNA, 22 nt, Staphylococcus aureus subsp. aureus MW2
uuaaaugauuucacuucauaaa

SEQ ID NO: 2109955 - RNA, 18 nt, Staphylococcus aureus subsp. aureus MW2
uuaaaugcauaauauauu

SEQ ID NO: 2109956 - RNA, 21 nt, Staphylococcus aureus subsp. aureus MW2
uuaaaugaugcaguaaaacca

SEQ ID NO: 2109957 - RNA, 15 nt, Staphylococcus aureus subsp. aureus MW2
uuaaaucuauauaaa

SEQ ID NO: 2109958 - RNA, 20 nt, Staphylococcus aureus subsp. aureus MW2
uuaaaucuucaagugccauu

SEQ ID NO: 2109959 - RNA, 22 nt, Staphylococcus aureus subsp. aureus MW2
uuaaaucugcuugugugucauu

SEQ ID NO: 2109960 - RNA, 20 nt, Staphylococcus aureus subsp. aureus MW2
uuaaaucuuuauaaaauugu

SEQ ID NO: 2109961 - RNA, 23 nt, Staphylococcus aureus subsp. aureus MW2
uuaaaucuuuuacuaaaugaauu

SEQ ID NO: 2109962 - RNA, 16 nt, Staphylococcus aureus subsp. aureus MW2
uuaaauaaaaauauug

SEQ ID NO: 2109963 - RNA, 15 nt, Staphylococcus aureus subsp. aureus MW2
uuaaauaaaugacuu

SEQ ID NO: 2109964 - RNA, 22 nt, Staphylococcus aureus subsp. aureus MW2
uuaaaguguuucaacauauuau

SEQ ID NO: 2109965 - RNA, 14 nt, Staphylococcus aureus subsp. aureus MW2
uuaaaguguuucaa

SEQ ID NO: 2109966 - RNA, 23 nt, Staphylococcus aureus subsp. aureus MW2
uuaaagucuguugguuuaucagc

SEQ ID NO: 2109967 - RNA, 16 nt, Staphylococcus aureus subsp. aureus MW2
uuaaagucuguauaug

SEQ ID NO: 2109968 - RNA, 22 nt, Staphylococcus aureus subsp. aureus MW2
uuaaaguaaaauauacuugaag

SEQ ID NO: 2109969 - RNA, 21 nt, Staphylococcus aureus subsp. aureus MW2
uuaaaggucuuaaucauugcu

SEQ ID NO: 2109970 - RNA, 15 nt, Staphylococcus aureus subsp. aureus MW2
uuaaaggcauaauaa

SEQ ID NO: 2109971 - RNA, 23 nt, Staphylococcus aureus subsp. aureus MW2
uuaaaucaaagaguaaaguuaaa

SEQ ID NO: 2109972 - RNA, 20 nt, Staphylococcus aureus subsp. aureus MW2
uuaaauaucaugcaaaacua

SEQ ID NO: 2109973 - RNA, 22 nt, Staphylococcus aureus subsp. aureus MW2
uuaaauaucgacaaauuaaaaa

SEQ ID NO: 2109974 - RNA, 14 nt, Staphylococcus aureus subsp. aureus MW2
uuaaauauauauua

SEQ ID NO: 2109975 - RNA, 20 nt, Staphylococcus aureus subsp. aureus MW2
uuaaaucguauauuaaauuu

SEQ ID NO: 2109976 - RNA, 23 nt, Staphylococcus aureus subsp. aureus MW2
uuaaaucguauauuaaauuuaca

SEQ ID NO: 2109977 - RNA, 17 nt, Staphylococcus aureus subsp. aureus MW2
uuaaaucaauauucucu

SEQ ID NO: 2109978 - RNA, 13 nt, Staphylococcus aureus subsp. aureus MW2
uuaaaucauugcg

SEQ ID NO: 2109979 - RNA, 21 nt, Staphylococcus aureus subsp. aureus MW2
uuaaaucauugcguaacauca

SEQ ID NO: 2109980 - RNA, 14 nt, Staphylococcus aureus subsp. aureus MW2
uuaaauacuauaua

SEQ ID NO: 2109981 - RNA, 17 nt, Staphylococcus aureus subsp. aureus MW2
uuaaauacuugcucuaa

SEQ ID NO: 2109982 - RNA, 21 nt, Staphylococcus aureus subsp. aureus MW2
uuaaauaggugauuauauaua

SEQ ID NO: 2109983 - RNA, 15 nt, Staphylococcus aureus subsp. aureus MW2
uuaaauagaagaaaa

SEQ ID NO: 2109984 - RNA, 15 nt, Staphylococcus aureus subsp. aureus MW2
uuaaauauaaccuaa

SEQ ID NO: 2109985 - RNA, 18 nt, Staphylococcus aureus subsp. aureus MW2
uuaaauauacuucuauua

SEQ ID NO: 2109986 - RNA, 21 nt, Staphylococcus aureus subsp. aureus MW2
uuaaauauacuuuuauagaaa

SEQ ID NO: 2109987 - RNA, 23 nt, Staphylococcus aureus subsp. aureus MW2
uuaaauauacuuuuauagaaaau

SEQ ID NO: 2109988 - RNA, 18 nt, Staphylococcus aureus subsp. aureus MW2
uuaaauaagcuacuaagc

SEQ ID NO: 2109989 - RNA, 15 nt, Staphylococcus aureus subsp. aureus MW2
uuaaauaagcuacua

SEQ ID NO: 2109990 - RNA, 20 nt, Staphylococcus aureus subsp. aureus MW2
uuaaauaaauucucuaauuu

SEQ ID NO: 2109991 - RNA, 15 nt, Staphylococcus aureus subsp. aureus MW2
uuaaauaaugauaaa

SEQ ID NO: 2109992 - RNA, 22 nt, Staphylococcus aureus subsp. aureus MW2
uuaauaaaauuacgcaaagaaa

SEQ ID NO: 2109993 - RNA, 17 nt, Staphylococcus aureus subsp. aureus MW2
uuaauaaaaucaucuua

SEQ ID NO: 2109994 - RNA, 13 nt, Staphylococcus aureus subsp. aureus MW2
uuaauaaaacugc

SEQ ID NO: 2109995 - RNA, 18 nt, Staphylococcus aureus subsp. aureus MW2
uuaauaauuaaacaaaac

SEQ ID NO: 2109996 - RNA, 22 nt, Staphylococcus aureus subsp. aureus MW2
uuaauaaauuguuaucguucaa

SEQ ID NO: 2109997 - RNA, 14 nt, Staphylococcus aureus subsp. aureus MW2
uuaauaaugcuuua

SEQ ID NO: 2109998 - RNA, 13 nt, Staphylococcus aureus subsp. aureus MW2
uuaauaauguaca

SEQ ID NO: 2109999 - RNA, 14 nt, Staphylococcus aureus subsp. aureus MW2
uuaaguacagcaua

SEQ ID NO: 2110000 - RNA, 16 nt, Staphylococcus aureus subsp. aureus MW2
uuaaguacuauuaaaa

SEQ ID NO: 2110001 - RNA, 23 nt, Staphylococcus aureus subsp. aureus MW2
uuaaguaaucugcaaaugccucu

SEQ ID NO: 2110002 - RNA, 14 nt, Staphylococcus aureus subsp. aureus MW2
uuaauauaauuaau

SEQ ID NO: 2110003 - RNA, 14 nt, Staphylococcus aureus subsp. aureus MW2
uuaauauaauuauu

SEQ ID NO: 2110004 - RNA, 20 nt, Staphylococcus aureus subsp. aureus MW2
uuaauacaagucuuuacucu

SEQ ID NO: 2110005 - RNA, 20 nt, Staphylococcus aureus subsp. aureus MW2
uuaauacaucaauaucuucu

SEQ ID NO: 2110006 - RNA, 22 nt, Staphylococcus aureus subsp. aureus MW2
uuaauaccuaucccuguaaaac

SEQ ID NO: 2110007 - RNA, 19 nt, Staphylococcus aureus subsp. aureus MW2
uuaaucauuguuuuaaauu

SEQ ID NO: 2110008 - RNA, 20 nt, Staphylococcus aureus subsp. aureus MW2
uuaaucauuguuuuaaauuu

SEQ ID NO: 2110009 - RNA, 17 nt, Staphylococcus aureus subsp. aureus MW2
uuaauaucauauucaaa

SEQ ID NO: 2110010 - RNA, 21 nt, Staphylococcus aureus subsp. aureus MW2
uuaauaucauauucaaaauaa

SEQ ID NO: 2110011 - RNA, 23 nt, Staphylococcus aureus subsp. aureus MW2
uuaauaucacgaucuuuaaaguc

SEQ ID NO: 2110012 - RNA, 17 nt, Staphylococcus aureus subsp. aureus MW2
uuaauaucacgaucuuu

SEQ ID NO: 2110013 - RNA, 14 nt, Staphylococcus aureus subsp. aureus MW2
uuaauauauuuauu

SEQ ID NO: 2110014 - RNA, 13 nt, Staphylococcus aureus subsp. aureus MW2
uuaauauauuuau

SEQ ID NO: 2110015 - RNA, 15 nt, Staphylococcus aureus subsp. aureus MW2
uuaauauauuuauuu

SEQ ID NO: 2110016 - RNA, 19 nt, Staphylococcus aureus subsp. aureus MW2
uuaaucagcuauaaaagua

SEQ ID NO: 2110017 - RNA, 18 nt, Staphylococcus aureus subsp. aureus MW2
uuaaucagcuauaaaagu

SEQ ID NO: 2110018 - RNA, 16 nt, Staphylococcus aureus subsp. aureus MW2
uuaauaugaacaaaaa

SEQ ID NO: 2110019 - RNA, 20 nt, Staphylococcus aureus subsp. aureus MW2
uuaacauccugcuuauuaau

SEQ ID NO: 2110020 - RNA, 12 nt, Staphylococcus aureus subsp. aureus MW2
uuaacauuuuuu

SEQ ID NO: 2110021 - RNA, 13 nt, Staphylococcus aureus subsp. aureus MW2
uuaacauuuuuuu

SEQ ID NO: 2110022 - RNA, 21 nt, Staphylococcus aureus subsp. aureus MW2
uuaacauuuauuuuuucucua

SEQ ID NO: 2110023 - RNA, 12 nt, Staphylococcus aureus subsp. aureus MW2
uuaaccaacaug

SEQ ID NO: 2110024 - RNA, 18 nt, Staphylococcus aureus subsp. aureus MW2
uuaaccuugauuuaauuu

SEQ ID NO: 2110025 - RNA, 15 nt, Staphylococcus aureus subsp. aureus MW2
uuaacaucugaaucu

SEQ ID NO: 2110026 - RNA, 14 nt, Staphylococcus aureus subsp. aureus MW2
uuaacauaaaauga

SEQ ID NO: 2110027 - RNA, 13 nt, Staphylococcus aureus subsp. aureus MW2
uuaacaucugaau

SEQ ID NO: 2110028 - RNA, 16 nt, Staphylococcus aureus subsp. aureus MW2
uuaacauguauuuagu

SEQ ID NO: 2110029 - RNA, 23 nt, Staphylococcus aureus subsp. aureus MW2
uuaacauguauuuaguaucauaa

SEQ ID NO: 2110030 - RNA, 19 nt, Staphylococcus aureus subsp. aureus MW2
uuaacgaaaauuaagauga

SEQ ID NO: 2110031 - RNA, 15 nt, Staphylococcus aureus subsp. aureus MW2
uuaacgcuuauacua

SEQ ID NO: 2110032 - RNA, 17 nt, Staphylococcus aureus subsp. aureus MW2
uuaacucuugaaacaca

SEQ ID NO: 2110033 - RNA, 17 nt, Staphylococcus aureus subsp. aureus MW2
uuaagaaacgucuuaau

SEQ ID NO: 2110034 - RNA, 20 nt, Staphylococcus aureus subsp. aureus MW2
uuaacuuuccgccuucaauc

SEQ ID NO: 2110035 - RNA, 12 nt, Staphylococcus aureus subsp. aureus MW2
uuaacuuuaaua

SEQ ID NO: 2110036 - RNA, 14 nt, Staphylococcus aureus subsp. aureus MW2
uuaacuuucucaaa

SEQ ID NO: 2110037 - RNA, 21 nt, Staphylococcus aureus subsp. aureus MW2
uuaacuuuuuugugauuauua

SEQ ID NO: 2110038 - RNA, 14 nt, Staphylococcus aureus subsp. aureus MW2
uuaacuuuaacauc

SEQ ID NO: 2110039 - RNA, 17 nt, Staphylococcus aureus subsp. aureus MW2
uuaacuucauaauauau

SEQ ID NO: 2110040 - RNA, 14 nt, Staphylococcus aureus subsp. aureus MW2
uuaacuuauauacg

SEQ ID NO: 2110041 - RNA, 14 nt, Staphylococcus aureus subsp. aureus MW2
uuaacuucauaaua

SEQ ID NO: 2110042 - RNA, 20 nt, Staphylococcus aureus subsp. aureus MW2
uuaacuguacgauucaauuu

SEQ ID NO: 2110043 - RNA, 19 nt, Staphylococcus aureus subsp. aureus MW2
uuaacuuaaaauuuaaaua

SEQ ID NO: 2110044 - RNA, 14 nt, Staphylococcus aureus subsp. aureus MW2
uuaacugccauaua

SEQ ID NO: 2110045 - RNA, 19 nt, Staphylococcus aureus subsp. aureus MW2
uuaacugggcgucucgaug

SEQ ID NO: 2110046 - RNA, 15 nt, Staphylococcus aureus subsp. aureus MW2
uuacuacuuaauuaa

SEQ ID NO: 2110047 - RNA, 15 nt, Staphylococcus aureus subsp. aureus MW2
uuacuacucauuauu

SEQ ID NO: 2110048 - RNA, 20 nt, Staphylococcus aureus subsp. aureus MW2
uuacggcauaauuuuuuaau

SEQ ID NO: 2110049 - RNA, 17 nt, Staphylococcus aureus subsp. aureus MW2
uuacuuccauugcuucu

SEQ ID NO: 2110050 - RNA, 11 nt, Staphylococcus aureus subsp. aureus MW2
uuacuucaguu

SEQ ID NO: 2110051 - RNA, 15 nt, Staphylococcus aureus subsp. aureus MW2
uuacuauuaaaggaa

SEQ ID NO: 2110052 - RNA, 18 nt, Staphylococcus aureus subsp. aureus MW2
uuacuauggcauuauugc

SEQ ID NO: 2110053 - RNA, 22 nt, Staphylococcus aureus subsp. aureus MW2
uuacuauauucaaugauuagua

SEQ ID NO: 2110054 - RNA, 13 nt, Staphylococcus aureus subsp. aureus MW2
uuacuauaaaaaa

SEQ ID NO: 2110055 - RNA, 16 nt, Staphylococcus aureus subsp. aureus MW2
uuacuaguuuguaaua

SEQ ID NO: 2110056 - RNA, 16 nt, Staphylococcus aureus subsp. aureus MW2
uuacuacuuaauuaau

SEQ ID NO: 2110057 - RNA, 21 nt, Staphylococcus aureus subsp. aureus MW2
uuacucguauauaccuugaug

SEQ ID NO: 2110058 - RNA, 15 nt, Staphylococcus aureus subsp. aureus MW2
uuagauaaaacaaaa

SEQ ID NO: 2110059 - RNA, 21 nt, Staphylococcus aureus subsp. aureus MW2
uuagauacuucuuuagcaaaa

SEQ ID NO: 2110060 - RNA, 13 nt, Staphylococcus aureus subsp. aureus MW2
uuagacauuaaaa

SEQ ID NO: 2110061 - RNA, 19 nt, Staphylococcus aureus subsp. aureus MW2
uuagaauuaguacuugaaa

SEQ ID NO: 2110062 - RNA, 15 nt, Staphylococcus aureus subsp. aureus MW2
uuagaauuuaacauu

SEQ ID NO: 2110063 - RNA, 18 nt, Staphylococcus aureus subsp. aureus MW2
uuagaauaguuaccaaaa

SEQ ID NO: 2110064 - RNA, 14 nt, Staphylococcus aureus subsp. aureus MW2
uuagaaaaauauga

SEQ ID NO: 2110065 - RNA, 15 nt, Staphylococcus aureus subsp. aureus MW2
uuacuucauaaguca

SEQ ID NO: 2110066 - RNA, 20 nt, Staphylococcus aureus subsp. aureus MW2
uuagaaaaaaaucuguuucu

SEQ ID NO: 2110067 - RNA, 14 nt, Staphylococcus aureus subsp. aureus MW2
uuagauuucauaau

SEQ ID NO: 2110068 - RNA, 15 nt, Staphylococcus aureus subsp. aureus MW2
uuagcuauuuaaaau

SEQ ID NO: 2110069 - RNA, 15 nt, Staphylococcus aureus subsp. aureus MW2
uuagcgucauuuuua

SEQ ID NO: 2110070 - RNA, 16 nt, Staphylococcus aureus subsp. aureus MW2
uuagcuaauucacuuu

SEQ ID NO: 2110071 - RNA, 18 nt, Staphylococcus aureus subsp. aureus MW2
uuagauuuuauauaaaaa

SEQ ID NO: 2110072 - RNA, 21 nt, Staphylococcus aureus subsp. aureus MW2
uuagauuuuauauaaaaagaa

SEQ ID NO: 2110073 - RNA, 21 nt, Staphylococcus aureus subsp. aureus MW2
uuagcaaaacgcauuucaugu

SEQ ID NO: 2110074 - RNA, 21 nt, Staphylococcus aureus subsp. aureus MW2
uuagaugugcgugguuuauuu

SEQ ID NO: 2110075 - RNA, 17 nt, Staphylococcus aureus subsp. aureus MW2
uuagauucacuguauaa

SEQ ID NO: 2110076 - RNA, 17 nt, Staphylococcus aureus subsp. aureus MW2
uuagauauaauaaaaac

SEQ ID NO: 2110077 - RNA, 15 nt, Staphylococcus aureus subsp. aureus MW2
uuagauaucuuaauc

SEQ ID NO: 2110078 - RNA, 19 nt, Staphylococcus aureus subsp. aureus MW2
uuagaugcauaaaaaaaga

SEQ ID NO: 2110079 - RNA, 16 nt, Staphylococcus aureus subsp. aureus MW2
uuagaugcauaaaaaa

SEQ ID NO: 2110080 - RNA, 14 nt, Staphylococcus aureus subsp. aureus MW2
uuaccuuuccauuc

SEQ ID NO: 2110081 - RNA, 18 nt, Staphylococcus aureus subsp. aureus MW2
uuaccuguuucuauauua

SEQ ID NO: 2110082 - RNA, 23 nt, Staphylococcus aureus subsp. aureus MW2
uuaccuguuucuauauuaauaau

SEQ ID NO: 2110083 - RNA, 21 nt, Staphylococcus aureus subsp. aureus MW2
uuaccguguucagguguaucu

SEQ ID NO: 2110084 - RNA, 21 nt, Staphylococcus aureus subsp. aureus MW2
uuacgaaguuuaaaugugcaa

SEQ ID NO: 2110085 - RNA, 20 nt, Staphylococcus aureus subsp. aureus MW2
uuacgauugggcaacuuuug

SEQ ID NO: 2110086 - RNA, 15 nt, Staphylococcus aureus subsp. aureus MW2
uuacgaucauaaaua

SEQ ID NO: 2110087 - RNA, 12 nt, Staphylococcus aureus subsp. aureus MW2
uuacccaaaaaa

SEQ ID NO: 2110088 - RNA, 12 nt, Staphylococcus aureus subsp. aureus MW2
uuaccaucuuua

SEQ ID NO: 2110089 - RNA, 14 nt, Staphylococcus aureus subsp. aureus MW2
uuaccaucuuuaau

SEQ ID NO: 2110090 - RNA, 18 nt, Staphylococcus aureus subsp. aureus MW2
uuaauuguuuaauaacaa

SEQ ID NO: 2110091 - RNA, 18 nt, Staphylococcus aureus subsp. aureus MW2
uuaauugcuguaaauauu

SEQ ID NO: 2110092 - RNA, 17 nt, Staphylococcus aureus subsp. aureus MW2
uuaauuuaauugaagua

SEQ ID NO: 2110093 - RNA, 14 nt, Staphylococcus aureus subsp. aureus MW2
uuaauuuuauuuua

SEQ ID NO: 2110094 - RNA, 22 nt, Staphylococcus aureus subsp. aureus MW2
uuaauuucacuuuaacuucuuu

SEQ ID NO: 2110095 - RNA, 18 nt, Staphylococcus aureus subsp. aureus MW2
uuaauuuucuaaagauau

SEQ ID NO: 2110096 - RNA, 16 nt, Staphylococcus aureus subsp. aureus MW2
uuaauuucaacauuac

SEQ ID NO: 2110097 - RNA, 13 nt, Staphylococcus aureus subsp. aureus MW2
uuaauuucacuuu

SEQ ID NO: 2110098 - RNA, 20 nt, Staphylococcus aureus subsp. aureus MW2
uuaaucuguauguaagcaga

SEQ ID NO: 2110099 - RNA, 19 nt, Staphylococcus aureus subsp. aureus MW2
uuaauccaucuacacccau

SEQ ID NO: 2110100 - RNA, 14 nt, Staphylococcus aureus subsp. aureus MW2
uuaaucuuaauauu

SEQ ID NO: 2110101 - RNA, 22 nt, Staphylococcus aureus subsp. aureus MW2
uuaaugacuucuuuauauuuau

SEQ ID NO: 2110102 - RNA, 18 nt, Staphylococcus aureus subsp. aureus MW2
uuaaugaccuaacuguuu

SEQ ID NO: 2110103 - RNA, 22 nt, Staphylococcus aureus subsp. aureus MW2
uuacacccuuuaaauuuaacuc

SEQ ID NO: 2110104 - RNA, 15 nt, Staphylococcus aureus subsp. aureus MW2
uuacaccuuuggcac

SEQ ID NO: 2110105 - RNA, 14 nt, Staphylococcus aureus subsp. aureus MW2
uuacaacuuauucu

SEQ ID NO: 2110106 - RNA, 18 nt, Staphylococcus aureus subsp. aureus MW2
uuacaacuuuaguuguua

SEQ ID NO: 2110107 - RNA, 20 nt, Staphylococcus aureus subsp. aureus MW2
uuacaacuuuaguuguuagg

SEQ ID NO: 2110108 - RNA, 16 nt, Staphylococcus aureus subsp. aureus MW2
uuacacaaauuaaaac

SEQ ID NO: 2110109 - RNA, 14 nt, Staphylococcus aureus subsp. aureus MW2
uuaauuuuucauua

SEQ ID NO: 2110110 - RNA, 12 nt, Staphylococcus aureus subsp. aureus MW2
uuaauuuuucaa

SEQ ID NO: 2110111 - RNA, 20 nt, Staphylococcus aureus subsp. aureus MW2
uuaauuuuucauuaauacaa

SEQ ID NO: 2110112 - RNA, 13 nt, Staphylococcus aureus subsp. aureus MW2
uuacaaaaacuau

SEQ ID NO: 2110113 - RNA, 14 nt, Staphylococcus aureus subsp. aureus MW2
uuaauuuuuuuggu

SEQ ID NO: 2110114 - RNA, 16 nt, Staphylococcus aureus subsp. aureus MW2
uuacaaacuucacauu

SEQ ID NO: 2110115 - RNA, 19 nt, Staphylococcus aureus subsp. aureus MW2
uuacaaacuucacauuaug

SEQ ID NO: 2110116 - RNA, 13 nt, Staphylococcus aureus subsp. aureus MW2
uuacaaacuucac

SEQ ID NO: 2110117 - RNA, 21 nt, Staphylococcus aureus subsp. aureus MW2
uuacaaagugauuuaaaaaaa

SEQ ID NO: 2110118 - RNA, 21 nt, Staphylococcus aureus subsp. aureus MW2
uuacaaaucaugacauaaaac

SEQ ID NO: 2110119 - RNA, 13 nt, Staphylococcus aureus subsp. aureus MW2
uuacaaauauacu

SEQ ID NO: 2110120 - RNA, 19 nt, Staphylococcus aureus subsp. aureus MW2
uuacaacaguaaucaugca

SEQ ID NO: 2110121 - RNA, 22 nt, Staphylococcus aureus subsp. aureus MW2
uuacaaaugaagguguugaaaa

SEQ ID NO: 2110122 - RNA, 15 nt, Staphylococcus aureus subsp. aureus MW2
uguuucuaaauucuu

SEQ ID NO: 2110123 - RNA, 16 nt, Staphylococcus aureus subsp. aureus MW2
uguuucuaaugcucau

SEQ ID NO: 2110124 - RNA, 23 nt, Staphylococcus aureus subsp. aureus MW2
uguuucuauauuaauaaucuucu

SEQ ID NO: 2110125 - RNA, 14 nt, Staphylococcus aureus subsp. aureus MW2
uguuucuuguucua

SEQ ID NO: 2110126 - RNA, 18 nt, Staphylococcus aureus subsp. aureus MW2
uguuucuuuuauuuucau

SEQ ID NO: 2110127 - RNA, 17 nt, Staphylococcus aureus subsp. aureus MW2
uguuucuucaauuuaau

SEQ ID NO: 2110128 - RNA, 14 nt, Staphylococcus aureus subsp. aureus MW2
uguuugauuuugag

SEQ ID NO: 2110129 - RNA, 17 nt, Staphylococcus aureus subsp. aureus MW2
uguuugcaacauauuuu

SEQ ID NO: 2110130 - RNA, 21 nt, Staphylococcus aureus subsp. aureus MW2
uguuugagauauauuaauauu

SEQ ID NO: 2110131 - RNA, 18 nt, Staphylococcus aureus subsp. aureus MW2
uguuugaauggcaaauau

SEQ ID NO: 2110132 - RNA, 14 nt, Staphylococcus aureus subsp. aureus MW2
uguuugagauauau

SEQ ID NO: 2110133 - RNA, 17 nt, Staphylococcus aureus subsp. aureus MW2
uguuugaagaccuucua

SEQ ID NO: 2110134 - RNA, 12 nt, Staphylococcus aureus subsp. aureus MW2
uguuucagcuug

SEQ ID NO: 2110135 - RNA, 14 nt, Staphylococcus aureus subsp. aureus MW2
uguuucaacauauu

SEQ ID NO: 2110136 - RNA, 15 nt, Staphylococcus aureus subsp. aureus MW2
uguuucauauauauu

SEQ ID NO: 2110137 - RNA, 14 nt, Staphylococcus aureus subsp. aureus MW2
uguuuccucuuuaa

SEQ ID NO: 2110138 - RNA, 23 nt, Staphylococcus aureus subsp. aureus MW2
uguuucaacauauuauauauauu

SEQ ID NO: 2110139 - RNA, 12 nt, Staphylococcus aureus subsp. aureus MW2
uguuucaacaua

SEQ ID NO: 2110140 - RNA, 20 nt, Staphylococcus aureus subsp. aureus MW2
uguuuauuacauaauuuauc

SEQ ID NO: 2110141 - RNA, 15 nt, Staphylococcus aureus subsp. aureus MW2
uguuuauuauagaaa

SEQ ID NO: 2110142 - RNA, 13 nt, Staphylococcus aureus subsp. aureus MW2
uguuuauucagau

SEQ ID NO: 2110143 - RNA, 15 nt, Staphylococcus aureus subsp. aureus MW2
uguuuauuuuuaauc

SEQ ID NO: 2110144 - RNA, 14 nt, Staphylococcus aureus subsp. aureus MW2
uguuuauuuagaau

SEQ ID NO: 2110145 - RNA, 19 nt, Staphylococcus aureus subsp. aureus MW2
uguuucaaaauaauuuuau

SEQ ID NO: 2110146 - RNA, 16 nt, Staphylococcus aureus subsp. aureus MW2
uguuuauuacauaauu

SEQ ID NO: 2110147 - RNA, 17 nt, Staphylococcus aureus subsp. aureus MW2
uguuuauaucuuuuaua

SEQ ID NO: 2110148 - RNA, 15 nt, Staphylococcus aureus subsp. aureus MW2
uguuuauauugcaaa

SEQ ID NO: 2110149 - RNA, 13 nt, Staphylococcus aureus subsp. aureus MW2
uguuuauaauaau

SEQ ID NO: 2110150 - RNA, 20 nt, Staphylococcus aureus subsp. aureus MW2
uguuuuggaaaaauuguggc

SEQ ID NO: 2110151 - RNA, 12 nt, Staphylococcus aureus subsp. aureus MW2
uguuuuuaaaau

SEQ ID NO: 2110152 - RNA, 20 nt, Staphylococcus aureus subsp. aureus MW2
uguuuugcgguuuuuuugau

SEQ ID NO: 2110153 - RNA, 21 nt, Staphylococcus aureus subsp. aureus MW2
uguuuugagagauuauuuaaa

SEQ ID NO: 2110154 - RNA, 16 nt, Staphylococcus aureus subsp. aureus MW2
uguuuuccuuuugaau

SEQ ID NO: 2110155 - RNA, 21 nt, Staphylococcus aureus subsp. aureus MW2
uguuuuccuuuugaauaauaa

SEQ ID NO: 2110156 - RNA, 19 nt, Staphylococcus aureus subsp. aureus MW2
uguuuuuaacagcuuuuuc

SEQ ID NO: 2110157 - RNA, 21 nt, Staphylococcus aureus subsp. aureus MW2
uguuuuuaacagcuuuuucua

SEQ ID NO: 2110158 - RNA, 19 nt, Staphylococcus aureus subsp. aureus MW2
uguuuuuaauguuugcuuu

SEQ ID NO: 2110159 - RNA, 19 nt, Staphylococcus aureus subsp. aureus MW2
uguuuuucaucauuaaaau

SEQ ID NO: 2110160 - RNA, 20 nt, Staphylococcus aureus subsp. aureus MW2
uguuuuugauaguaauaguu

SEQ ID NO: 2110161 - RNA, 13 nt, Staphylococcus aureus subsp. aureus MW2
uguuuuuuaagua

SEQ ID NO: 2110162 - RNA, 16 nt, Staphylococcus aureus subsp. aureus MW2
uguuuggcauaauaau

SEQ ID NO: 2110163 - RNA, 24 nt, Staphylococcus aureus subsp. aureus MW2
uguuuguaaugucgaucuaacaau

SEQ ID NO: 2110164 - RNA, 16 nt, Staphylococcus aureus subsp. aureus MW2
uguuuguaagucgcuc

SEQ ID NO: 2110165 - RNA, 14 nt, Staphylococcus aureus subsp. aureus MW2
uguuuguuuuuaua

SEQ ID NO: 2110166 - RNA, 14 nt, Staphylococcus aureus subsp. aureus MW2
uguuuuaaauacuu

SEQ ID NO: 2110167 - RNA, 21 nt, Staphylococcus aureus subsp. aureus MW2
uguuuuaacgaagccuaauuu

SEQ ID NO: 2110168 - RNA, 12 nt, Staphylococcus aureus subsp. aureus MW2
uguuuuaaauuu

SEQ ID NO: 2110169 - RNA, 21 nt, Staphylococcus aureus subsp. aureus MW2
uguuuucaacaguuuuaaaga

SEQ ID NO: 2110170 - RNA, 16 nt, Staphylococcus aureus subsp. aureus MW2
uguuuucauuuaaaag

SEQ ID NO: 2110171 - RNA, 10 nt, Staphylococcus aureus subsp. aureus MW2
uguuuucacu

SEQ ID NO: 2110172 - RNA, 13 nt, Staphylococcus aureus subsp. aureus MW2
uguuuuauucaau

SEQ ID NO: 2110173 - RNA, 22 nt, Staphylococcus aureus subsp. aureus MW2
uguuuucaaacuuuucaauauu

SEQ ID NO: 2110174 - RNA, 15 nt, Staphylococcus aureus subsp. aureus MW2
uguuuuaucaauauu

SEQ ID NO: 2110175 - RNA, 14 nt, Staphylococcus aureus subsp. aureus MW2
uguuuuaucaauau

SEQ ID NO: 2110176 - RNA, 22 nt, Staphylococcus aureus subsp. aureus MW2
uguuuuaaguuguugauuuaaa

SEQ ID NO: 2110177 - RNA, 21 nt, Staphylococcus aureus subsp. aureus MW2
uuaaagaaaauaucugaaaaa

SEQ ID NO: 2110178 - RNA, 21 nt, Staphylococcus aureus subsp. aureus MW2
uuaaagaaaauuucaguacca

SEQ ID NO: 2110179 - RNA, 18 nt, Staphylococcus aureus subsp. aureus MW2
uuaaagauggcugcauca

SEQ ID NO: 2110180 - RNA, 20 nt, Staphylococcus aureus subsp. aureus MW2
uuaaagacugaaccguauaa

SEQ ID NO: 2110181 - RNA, 23 nt, Staphylococcus aureus subsp. aureus MW2
uuaaagaggcaguaucucaaaua

SEQ ID NO: 2110182 - RNA, 13 nt, Staphylococcus aureus subsp. aureus MW2
uuaaagauuauua

SEQ ID NO: 2110183 - RNA, 15 nt, Staphylococcus aureus subsp. aureus MW2
uuaaagcaucuucaa

SEQ ID NO: 2110184 - RNA, 14 nt, Staphylococcus aureus subsp. aureus MW2
uuaaagauuaaaau

SEQ ID NO: 2110185 - RNA, 16 nt, Staphylococcus aureus subsp. aureus MW2
uuaaacauuuagauuu

SEQ ID NO: 2110186 - RNA, 12 nt, Staphylococcus aureus subsp. aureus MW2
uuaaacuuauua

SEQ ID NO: 2110187 - RNA, 21 nt, Staphylococcus aureus subsp. aureus MW2
uuaaacuguccagcuuaauuu

SEQ ID NO: 2110188 - RNA, 14 nt, Staphylococcus aureus subsp. aureus MW2
uuaaaccuuaauaa

SEQ ID NO: 2110189 - RNA, 23 nt, Staphylococcus aureus subsp. aureus MW2
uuaaaccgcacuucuauauuaau

SEQ ID NO: 2110190 - RNA, 16 nt, Staphylococcus aureus subsp. aureus MW2
uuaaacaguuuaauuc

SEQ ID NO: 2110191 - RNA, 15 nt, Staphylococcus aureus subsp. aureus MW2
uuaaacaguuuaauu

SEQ ID NO: 2110192 - RNA, 20 nt, Staphylococcus aureus subsp. aureus MW2
uuaaacauccaauuauguuu

SEQ ID NO: 2110193 - RNA, 13 nt, Staphylococcus aureus subsp. aureus MW2
uuaaaauuauuga

SEQ ID NO: 2110194 - RNA, 18 nt, Staphylococcus aureus subsp. aureus MW2
uuaaaauuaaaccuacaa

SEQ ID NO: 2110195 - RNA, 18 nt, Staphylococcus aureus subsp. aureus MW2
uuaaaaugcuuuuuugaa

SEQ ID NO: 2110196 - RNA, 19 nt, Staphylococcus aureus subsp. aureus MW2
uuaaaaugauaucugacau

SEQ ID NO: 2110197 - RNA, 13 nt, Staphylococcus aureus subsp. aureus MW2
uuaaaauguguuu

SEQ ID NO: 2110198 - RNA, 22 nt, Staphylococcus aureus subsp. aureus MW2
uuaaaaugauagcuaaacauuu

SEQ ID NO: 2110199 - RNA, 20 nt, Staphylococcus aureus subsp. aureus MW2
uuaaaaugauaucugacauu

SEQ ID NO: 2110200 - RNA, 12 nt, Staphylococcus aureus subsp. aureus MW2
uuaaacaaauaa

SEQ ID NO: 2110201 - RNA, 16 nt, Staphylococcus aureus subsp. aureus MW2
uuaaacaaauaaaaaa

SEQ ID NO: 2110202 - RNA, 22 nt, Staphylococcus aureus subsp. aureus MW2
uuaaacaaguugauaacuauuu

SEQ ID NO: 2110203 - RNA, 16 nt, Staphylococcus aureus subsp. aureus MW2
uuaaacaagcaucaug

SEQ ID NO: 2110204 - RNA, 22 nt, Staphylococcus aureus subsp. aureus MW2
uuaaaauugguuuggauaaaau

SEQ ID NO: 2110205 - RNA, 14 nt, Staphylococcus aureus subsp. aureus MW2
uuaaaauuuaaaua

SEQ ID NO: 2110206 - RNA, 14 nt, Staphylococcus aureus subsp. aureus MW2
uuaaacaaaaauaa

SEQ ID NO: 2110207 - RNA, 13 nt, Staphylococcus aureus subsp. aureus MW2
uuaaacaaaacuu

SEQ ID NO: 2110208 - RNA, 19 nt, Staphylococcus aureus subsp. aureus MW2
uuaaaaacaauauugacuu

SEQ ID NO: 2110209 - RNA, 12 nt, Staphylococcus aureus subsp. aureus MW2
uuaaaaaauaug

SEQ ID NO: 2110210 - RNA, 17 nt, Staphylococcus aureus subsp. aureus MW2
uuaaaaauacagcuaca

SEQ ID NO: 2110211 - RNA, 16 nt, Staphylococcus aureus subsp. aureus MW2
uuaaaaauauguguua

SEQ ID NO: 2110212 - RNA, 18 nt, Staphylococcus aureus subsp. aureus MW2
uuaaaaauagccuucaaa

SEQ ID NO: 2110213 - RNA, 22 nt, Staphylococcus aureus subsp. aureus MW2
uuaaaaauaguaaagugaaaua

SEQ ID NO: 2110214 - RNA, 21 nt, Staphylococcus aureus subsp. aureus MW2
uuaaaaagcaugauacucaau

SEQ ID NO: 2110215 - RNA, 14 nt, Staphylococcus aureus subsp. aureus MW2
uuaaaaaacaaaac

SEQ ID NO: 2110216 - RNA, 15 nt, Staphylococcus aureus subsp. aureus MW2
uuaaaaaacagugua

SEQ ID NO: 2110217 - RNA, 19 nt, Staphylococcus aureus subsp. aureus MW2
uuaaaaaacauaccugcau

SEQ ID NO: 2110218 - RNA, 21 nt, Staphylococcus aureus subsp. aureus MW2
uuaaaaaacaauaaaauuacu

SEQ ID NO: 2110219 - RNA, 15 nt, Staphylococcus aureus subsp. aureus MW2
uguuuuuuuuauuaa

SEQ ID NO: 2110220 - RNA, 17 nt, Staphylococcus aureus subsp. aureus MW2
uguuuuuuuuauuaauu

SEQ ID NO: 2110221 - RNA, 23 nt, Staphylococcus aureus subsp. aureus MW2
uguuuuuuuuauuaauuuaaaaa

SEQ ID NO: 2110222 - RNA, 12 nt, Staphylococcus aureus subsp. aureus MW2
uguuuuuuucuu

SEQ ID NO: 2110223 - RNA, 13 nt, Staphylococcus aureus subsp. aureus MW2
uuaaaagugcaag

SEQ ID NO: 2110224 - RNA, 21 nt, Staphylococcus aureus subsp. aureus MW2
uuaaaagugcaaguccaaaua

SEQ ID NO: 2110225 - RNA, 16 nt, Staphylococcus aureus subsp. aureus MW2
uuaaaauaaagaaaac

SEQ ID NO: 2110226 - RNA, 15 nt, Staphylococcus aureus subsp. aureus MW2
uuaaaauauauuugu

SEQ ID NO: 2110227 - RNA, 15 nt, Staphylococcus aureus subsp. aureus MW2
uuaaaauauuaauca

SEQ ID NO: 2110228 - RNA, 16 nt, Staphylococcus aureus subsp. aureus MW2
uuaaaauauuuaacuu

SEQ ID NO: 2110229 - RNA, 15 nt, Staphylococcus aureus subsp. aureus MW2
uuaaaaaugaaauga

SEQ ID NO: 2110230 - RNA, 19 nt, Staphylococcus aureus subsp. aureus MW2
uuaaaacaaugauuaaaau

SEQ ID NO: 2110231 - RNA, 12 nt, Staphylococcus aureus subsp. aureus MW2
uuaaaacaucau

SEQ ID NO: 2110232 - RNA, 21 nt, Staphylococcus aureus subsp. aureus MW2
uuaaaagagaauauaaaauaa

SEQ ID NO: 2110233 - RNA, 20 nt, Staphylococcus aureus subsp. aureus MW2
uuaaaagacauccacagaau

SEQ ID NO: 2110234 - RNA, 14 nt, Staphylococcus aureus subsp. aureus MW2
uuaaaacuuguaaa

SEQ ID NO: 2110235 - RNA, 13 nt, Staphylococcus aureus subsp. aureus MW2
uuaaaacuauaau

SEQ ID NO: 2110236 - RNA, 17 nt, Staphylococcus aureus subsp. aureus MW2
uuaaaacuauaaccuau

SEQ ID NO: 2110237 - RNA, 15 nt, Staphylococcus aureus subsp. aureus MW2
uuaaaaccuuuucaa

SEQ ID NO: 2110238 - RNA, 13 nt, Staphylococcus aureus subsp. aureus MW2
uguuauugaauga

SEQ ID NO: 2110239 - RNA, 22 nt, Staphylococcus aureus subsp. aureus MW2
uguuauuaucguaaaaaaacgu

SEQ ID NO: 2110240 - RNA, 24 nt, Staphylococcus aureus subsp. aureus MW2
uguuauuagauacuucuuuagcaa

SEQ ID NO: 2110241 - RNA, 15 nt, Staphylococcus aureus subsp. aureus MW2
uguuauaucuaauuc

SEQ ID NO: 2110242 - RNA, 13 nt, Staphylococcus aureus subsp. aureus MW2
uguuauauuauga

SEQ ID NO: 2110243 - RNA, 23 nt, Staphylococcus aureus subsp. aureus MW2
uguuauauuggcaguguuugacu

SEQ ID NO: 2110244 - RNA, 16 nt, Staphylococcus aureus subsp. aureus MW2
uguuauauaaagaggc

SEQ ID NO: 2110245 - RNA, 17 nt, Staphylococcus aureus subsp. aureus MW2
uguuauagcguuuaaga

SEQ ID NO: 2110246 - RNA, 18 nt, Staphylococcus aureus subsp. aureus MW2
uguuauaauuaaguguau

SEQ ID NO: 2110247 - RNA, 21 nt, Staphylococcus aureus subsp. aureus MW2
uguuauaauuaaguguauaua

SEQ ID NO: 2110248 - RNA, 16 nt, Staphylococcus aureus subsp. aureus MW2
uguuaggggcuuuuau

SEQ ID NO: 2110249 - RNA, 20 nt, Staphylococcus aureus subsp. aureus MW2
uguuaggagagauguauaaa

SEQ ID NO: 2110250 - RNA, 23 nt, Staphylococcus aureus subsp. aureus MW2
uguuagaggauggauacuuaaag

SEQ ID NO: 2110251 - RNA, 16 nt, Staphylococcus aureus subsp. aureus MW2
uguucaguuguuuuuu

SEQ ID NO: 2110252 - RNA, 19 nt, Staphylococcus aureus subsp. aureus MW2
uguucaguuguuuuuuugu

SEQ ID NO: 2110253 - RNA, 21 nt, Staphylococcus aureus subsp. aureus MW2
uguucaguuguuuuuuuguca

SEQ ID NO: 2110254 - RNA, 20 nt, Staphylococcus aureus subsp. aureus MW2
uguucagguguaucuuugau

SEQ ID NO: 2110255 - RNA, 14 nt, Staphylococcus aureus subsp. aureus MW2
uguucacuaaaugu

SEQ ID NO: 2110256 - RNA, 22 nt, Staphylococcus aureus subsp. aureus MW2
uguucagaacuacaauucauaa

SEQ ID NO: 2110257 - RNA, 16 nt, Staphylococcus aureus subsp. aureus MW2
uguucaauacuuucag

SEQ ID NO: 2110258 - RNA, 16 nt, Staphylococcus aureus subsp. aureus MW2
uguucaaugauuugau

SEQ ID NO: 2110259 - RNA, 23 nt, Staphylococcus aureus subsp. aureus MW2
uguucaaugauuugauaauauua

SEQ ID NO: 2110260 - RNA, 17 nt, Staphylococcus aureus subsp. aureus MW2
uguucaauuguuacuuu

SEQ ID NO: 2110261 - RNA, 17 nt, Staphylococcus aureus subsp. aureus MW2
uguucaacuaaauuuuc

SEQ ID NO: 2110262 - RNA, 16 nt, Staphylococcus aureus subsp. aureus MW2
uguucauuggcaauau

SEQ ID NO: 2110263 - RNA, 19 nt, Staphylococcus aureus subsp. aureus MW2
uguuccaaucuuuuuaauu

SEQ ID NO: 2110264 - RNA, 18 nt, Staphylococcus aureus subsp. aureus MW2
uguuccaaucuuuuuaau

SEQ ID NO: 2110265 - RNA, 23 nt, Staphylococcus aureus subsp. aureus MW2
uguucauaaucauaauaagauuu

SEQ ID NO: 2110266 - RNA, 16 nt, Staphylococcus aureus subsp. aureus MW2
uguucauguuuaaaau

SEQ ID NO: 2110267 - RNA, 20 nt, Staphylococcus aureus subsp. aureus MW2
uguuccuccaccaccugcaa

SEQ ID NO: 2110268 - RNA, 16 nt, Staphylococcus aureus subsp. aureus MW2
uguucuaauuguugua

SEQ ID NO: 2110269 - RNA, 15 nt, Staphylococcus aureus subsp. aureus MW2
uguucucuauuuaua

SEQ ID NO: 2110270 - RNA, 23 nt, Staphylococcus aureus subsp. aureus MW2
uguucucuauuuauaacacuucg

SEQ ID NO: 2110271 - RNA, 15 nt, Staphylococcus aureus subsp. aureus MW2
uguucucauuauaau

SEQ ID NO: 2110272 - RNA, 17 nt, Staphylococcus aureus subsp. aureus MW2
uguucucgucuuuuguc

SEQ ID NO: 2110273 - RNA, 18 nt, Staphylococcus aureus subsp. aureus MW2
uguucuuucuuucuuuuc

SEQ ID NO: 2110274 - RNA, 14 nt, Staphylococcus aureus subsp. aureus MW2
uguucuuuuuuaau

SEQ ID NO: 2110275 - RNA, 19 nt, Staphylococcus aureus subsp. aureus MW2
uguucuugaaaacaauaaa

SEQ ID NO: 2110276 - RNA, 15 nt, Staphylococcus aureus subsp. aureus MW2
uguucuugaaaacaa

SEQ ID NO: 2110277 - RNA, 20 nt, Staphylococcus aureus subsp. aureus MW2
uguucuuaacaauaucaucu

SEQ ID NO: 2110278 - RNA, 18 nt, Staphylococcus aureus subsp. aureus MW2
uguucugcuuuuucuuua

SEQ ID NO: 2110279 - RNA, 14 nt, Staphylococcus aureus subsp. aureus MW2
uguugauaaaaagg

SEQ ID NO: 2110280 - RNA, 17 nt, Staphylococcus aureus subsp. aureus MW2
uguugagaaacuuuuuc

SEQ ID NO: 2110281 - RNA, 18 nt, Staphylococcus aureus subsp. aureus MW2
uguugaccaccugauaau

SEQ ID NO: 2110282 - RNA, 15 nt, Staphylococcus aureus subsp. aureus MW2
uguugaauuuaaaaa

SEQ ID NO: 2110283 - RNA, 19 nt, Staphylococcus aureus subsp. aureus MW2
uguugaaaaguauaugaau

SEQ ID NO: 2110284 - RNA, 14 nt, Staphylococcus aureus subsp. aureus MW2
uguugaaaaugacu

SEQ ID NO: 2110285 - RNA, 20 nt, Staphylococcus aureus subsp. aureus MW2
uguugaaauuaaauucaaau

SEQ ID NO: 2110286 - RNA, 15 nt, Staphylococcus aureus subsp. aureus MW2
uguugcaaaauacga

SEQ ID NO: 2110287 - RNA, 14 nt, Staphylococcus aureus subsp. aureus MW2
uguugcaaaauuaa

SEQ ID NO: 2110288 - RNA, 23 nt, Staphylococcus aureus subsp. aureus MW2
uguugauaaugcuacuauuaaau

SEQ ID NO: 2110289 - RNA, 15 nt, Staphylococcus aureus subsp. aureus MW2
uguugcauuagauca

SEQ ID NO: 2110290 - RNA, 17 nt, Staphylococcus aureus subsp. aureus MW2
uguugcuaaucucagau

SEQ ID NO: 2110291 - RNA, 20 nt, Staphylococcus aureus subsp. aureus MW2
uguuguuaacgguuaauaag

SEQ ID NO: 2110292 - RNA, 15 nt, Staphylococcus aureus subsp. aureus MW2
uguugguuuuuaaaa

SEQ ID NO: 2110293 - RNA, 20 nt, Staphylococcus aureus subsp. aureus MW2
uguuggugaguguuucauaa

SEQ ID NO: 2110294 - RNA, 22 nt, Staphylococcus aureus subsp. aureus MW2
uguuggaagccuucaauaguuu

SEQ ID NO: 2110295 - RNA, 20 nt, Staphylococcus aureus subsp. aureus MW2
uguuggaauaccuuuuucua

SEQ ID NO: 2110296 - RNA, 13 nt, Staphylococcus aureus subsp. aureus MW2
uguuuaaauuuaa

SEQ ID NO: 2110297 - RNA, 14 nt, Staphylococcus aureus subsp. aureus MW2
uguuuaaauuucaa

SEQ ID NO: 2110298 - RNA, 11 nt, Staphylococcus aureus subsp. aureus MW2
uguuuaacaau

SEQ ID NO: 2110299 - RNA, 15 nt, Staphylococcus aureus subsp. aureus MW2
uguuuaacaauaaua

SEQ ID NO: 2110300 - RNA, 15 nt, Staphylococcus aureus subsp. aureus MW2
uguuuaaauaaaauu

SEQ ID NO: 2110301 - RNA, 22 nt, Staphylococcus aureus subsp. aureus MW2
uguugugcuuuucgcuuuucua

SEQ ID NO: 2110302 - RNA, 11 nt, Staphylococcus aureus subsp. aureus MW2
uguuguuuuaa

SEQ ID NO: 2110303 - RNA, 13 nt, Staphylococcus aureus subsp. aureus MW2
uguuguuuuugau

SEQ ID NO: 2110304 - RNA, 16 nt, Staphylococcus aureus subsp. aureus MW2
uguuuaaaaaacuacu

SEQ ID NO: 2110305 - RNA, 16 nt, Staphylococcus aureus subsp. aureus MW2
uguuuaaacauguaca

SEQ ID NO: 2110306 - RNA, 20 nt, Staphylococcus aureus subsp. aureus MW2
uguuuaguauggaauaaaug

SEQ ID NO: 2110307 - RNA, 18 nt, Staphylococcus aureus subsp. aureus MW2
uguuuacuauacuuugag

SEQ ID NO: 2110308 - RNA, 17 nt, Staphylococcus aureus subsp. aureus MW2
uguuuacugucaucuuu

SEQ ID NO: 2110309 - RNA, 14 nt, Staphylococcus aureus subsp. aureus MW2
uguuuaauuuucua

SEQ ID NO: 2110310 - RNA, 12 nt, Staphylococcus aureus subsp. aureus MW2
uguuuaauuauc

SEQ ID NO: 2110311 - RNA, 22 nt, Staphylococcus aureus subsp. aureus MW2
uguuuacgccauaagaaaauac

SEQ ID NO: 2110312 - RNA, 16 nt, Staphylococcus aureus subsp. aureus MW2
uguacuuuucuuuuua

SEQ ID NO: 2110313 - RNA, 23 nt, Staphylococcus aureus subsp. aureus MW2
uguagaaacacaaggaauauaca

SEQ ID NO: 2110314 - RNA, 16 nt, Staphylococcus aureus subsp. aureus MW2
uguaccuuuuuauuga

SEQ ID NO: 2110315 - RNA, 23 nt, Staphylococcus aureus subsp. aureus MW2
uguacaaccuuugcuuaaaccuu

SEQ ID NO: 2110316 - RNA, 17 nt, Staphylococcus aureus subsp. aureus MW2
uguacaaucauuaguca

SEQ ID NO: 2110317 - RNA, 22 nt, Staphylococcus aureus subsp. aureus MW2
uguacacuaucguuuuuauuau

SEQ ID NO: 2110318 - RNA, 14 nt, Staphylococcus aureus subsp. aureus MW2
uguaccaucaauaa

SEQ ID NO: 2110319 - RNA, 19 nt, Staphylococcus aureus subsp. aureus MW2
uguaccaucacuaaaguaa

SEQ ID NO: 2110320 - RNA, 13 nt, Staphylococcus aureus subsp. aureus MW2
uguaccaaauuug

SEQ ID NO: 2110321 - RNA, 16 nt, Staphylococcus aureus subsp. aureus MW2
uguaccgaauccuuca

SEQ ID NO: 2110322 - RNA, 15 nt, Staphylococcus aureus subsp. aureus MW2
uguaaugcuuaaaaa

SEQ ID NO: 2110323 - RNA, 18 nt, Staphylococcus aureus subsp. aureus MW2
uguaaugcuuaaaaacaa

SEQ ID NO: 2110324 - RNA, 16 nt, Staphylococcus aureus subsp. aureus MW2
uguaauccuugagcuc

SEQ ID NO: 2110325 - RNA, 21 nt, Staphylococcus aureus subsp. aureus MW2
uguaaucacuucugaaaauaa

SEQ ID NO: 2110326 - RNA, 17 nt, Staphylococcus aureus subsp. aureus MW2
uguaauaucuaaagauu

SEQ ID NO: 2110327 - RNA, 16 nt, Staphylococcus aureus subsp. aureus MW2
uguaaccuaaaaacaa

SEQ ID NO: 2110328 - RNA, 21 nt, Staphylococcus aureus subsp. aureus MW2
uguaacucuauccaaagacau

SEQ ID NO: 2110329 - RNA, 18 nt, Staphylococcus aureus subsp. aureus MW2
uguaacuugucuuuuuua

SEQ ID NO: 2110330 - RNA, 21 nt, Staphylococcus aureus subsp. aureus MW2
uguaacuuuagacauaaaaaa

SEQ ID NO: 2110331 - RNA, 14 nt, Staphylococcus aureus subsp. aureus MW2
uguaauauauuaau

SEQ ID NO: 2110332 - RNA, 19 nt, Staphylococcus aureus subsp. aureus MW2
uguaauauaacaaguauaa

SEQ ID NO: 2110333 - RNA, 21 nt, Staphylococcus aureus subsp. aureus MW2
uguaacgugaggcccauaaau

SEQ ID NO: 2110334 - RNA, 12 nt, Staphylococcus aureus subsp. aureus MW2
ugguuuuuaaaa

SEQ ID NO: 2110335 - RNA, 20 nt, Staphylococcus aureus subsp. aureus MW2
ugguuuaaugagcuuuucua

SEQ ID NO: 2110336 - RNA, 19 nt, Staphylococcus aureus subsp. aureus MW2
ugguuuaccuaguuuuacu

SEQ ID NO: 2110337 - RNA, 14 nt, Staphylococcus aureus subsp. aureus MW2
ugguuuauuuuaau

SEQ ID NO: 2110338 - RNA, 15 nt, Staphylococcus aureus subsp. aureus MW2
ugguuuauuuuaaua

SEQ ID NO: 2110339 - RNA, 22 nt, Staphylococcus aureus subsp. aureus MW2
ugguuucaaaaucaauugaaaa

SEQ ID NO: 2110340 - RNA, 21 nt, Staphylococcus aureus subsp. aureus MW2
uggugacacugcuuuuaaauc

SEQ ID NO: 2110341 - RNA, 22 nt, Staphylococcus aureus subsp. aureus MW2
ugguuuaaaaagucaaagagga

SEQ ID NO: 2110342 - RNA, 21 nt, Staphylococcus aureus subsp. aureus MW2
uguaaaccagcuaaaccaucu

SEQ ID NO: 2110343 - RNA, 20 nt, Staphylococcus aureus subsp. aureus MW2
uguaaauuuauuuuuaauuu

SEQ ID NO: 2110344 - RNA, 12 nt, Staphylococcus aureus subsp. aureus MW2
uguaaaaugcuc

SEQ ID NO: 2110345 - RNA, 20 nt, Staphylococcus aureus subsp. aureus MW2
uguaaaaugaugauuuaaag

SEQ ID NO: 2110346 - RNA, 18 nt, Staphylococcus aureus subsp. aureus MW2
uguaacacacuuauaauc

SEQ ID NO: 2110347 - RNA, 14 nt, Staphylococcus aureus subsp. aureus MW2
uguaacaauauaau

SEQ ID NO: 2110348 - RNA, 17 nt, Staphylococcus aureus subsp. aureus MW2
uguaaauuuuuaagaag

SEQ ID NO: 2110349 - RNA, 23 nt, Staphylococcus aureus subsp. aureus MW2
uguaacauuacguucuaauaauu

SEQ ID NO: 2110350 - RNA, 15 nt, Staphylococcus aureus subsp. aureus MW2
uguaacaaaugcgua

SEQ ID NO: 2110351 - RNA, 21 nt, Staphylococcus aureus subsp. aureus MW2
uguaacagugugaaauaauaa

SEQ ID NO: 2110352 - RNA, 16 nt, Staphylococcus aureus subsp. aureus MW2
uguaaaaaauaucuug

SEQ ID NO: 2110353 - RNA, 22 nt, Staphylococcus aureus subsp. aureus MW2
uguaaaaccuuacccaaaaaau

SEQ ID NO: 2110354 - RNA, 21 nt, Staphylococcus aureus subsp. aureus MW2
uguaaaaccuuacccaaaaaa

SEQ ID NO: 2110355 - RNA, 21 nt, Staphylococcus aureus subsp. aureus MW2
uguaguuaagauaccuuuuuc

SEQ ID NO: 2110356 - RNA, 22 nt, Staphylococcus aureus subsp. aureus MW2
uguaguaguuccguugaauuaa

SEQ ID NO: 2110357 - RNA, 13 nt, Staphylococcus aureus subsp. aureus MW2
uguauaaauguca

SEQ ID NO: 2110358 - RNA, 14 nt, Staphylococcus aureus subsp. aureus MW2
uguauaauacauga

SEQ ID NO: 2110359 - RNA, 16 nt, Staphylococcus aureus subsp. aureus MW2
uguauaauacaugaua

SEQ ID NO: 2110360 - RNA, 15 nt, Staphylococcus aureus subsp. aureus MW2
uguauaacgcuuugu

SEQ ID NO: 2110361 - RNA, 23 nt, Staphylococcus aureus subsp. aureus MW2
uguauaacgcuuuguuuuuagua

SEQ ID NO: 2110362 - RNA, 13 nt, Staphylococcus aureus subsp. aureus MW2
uguaucaaagucu

SEQ ID NO: 2110363 - RNA, 21 nt, Staphylococcus aureus subsp. aureus MW2
uguaucaaagucucuaguauc

SEQ ID NO: 2110364 - RNA, 15 nt, Staphylococcus aureus subsp. aureus MW2
uguauauggcauuaa

SEQ ID NO: 2110365 - RNA, 10 nt, Staphylococcus aureus subsp. aureus MW2
uguauaucug

SEQ ID NO: 2110366 - RNA, 15 nt, Staphylococcus aureus subsp. aureus MW2
uguauaucuguauaa

SEQ ID NO: 2110367 - RNA, 20 nt, Staphylococcus aureus subsp. aureus MW2
uguauaugaauuuuauaaau

SEQ ID NO: 2110368 - RNA, 15 nt, Staphylococcus aureus subsp. aureus MW2
uguauauauauguaa

SEQ ID NO: 2110369 - RNA, 20 nt, Staphylococcus aureus subsp. aureus MW2
uguauagauuguauuuaaua

SEQ ID NO: 2110370 - RNA, 20 nt, Staphylococcus aureus subsp. aureus MW2
ugucacuaauggauaugaua

SEQ ID NO: 2110371 - RNA, 16 nt, Staphylococcus aureus subsp. aureus MW2
ugucaauaaauuguuu

SEQ ID NO: 2110372 - RNA, 22 nt, Staphylococcus aureus subsp. aureus MW2
ugucaauaaauuguuuacuaua

SEQ ID NO: 2110373 - RNA, 13 nt, Staphylococcus aureus subsp. aureus MW2
uguauuuuuauuu

SEQ ID NO: 2110374 - RNA, 14 nt, Staphylococcus aureus subsp. aureus MW2
uguauuuuucaaau

SEQ ID NO: 2110375 - RNA, 15 nt, Staphylococcus aureus subsp. aureus MW2
uguauguugaaagug

SEQ ID NO: 2110376 - RNA, 19 nt, Staphylococcus aureus subsp. aureus MW2
uguaucaaggucaacaaug

SEQ ID NO: 2110377 - RNA, 22 nt, Staphylococcus aureus subsp. aureus MW2
uguaugacaggcguguugaaau

SEQ ID NO: 2110378 - RNA, 18 nt, Staphylococcus aureus subsp. aureus MW2
uguaugagucuuuuugau

SEQ ID NO: 2110379 - RNA, 19 nt, Staphylococcus aureus subsp. aureus MW2
uguaugagucuuuuugauu

SEQ ID NO: 2110380 - RNA, 21 nt, Staphylococcus aureus subsp. aureus MW2
uguaugagucuuuuugauuaa

SEQ ID NO: 2110381 - RNA, 17 nt, Staphylococcus aureus subsp. aureus MW2
ugucauaccuuuuaauu

SEQ ID NO: 2110382 - RNA, 19 nt, Staphylococcus aureus subsp. aureus MW2
ugucauaauccauucuucu

SEQ ID NO: 2110383 - RNA, 20 nt, Staphylococcus aureus subsp. aureus MW2
ugucauaguauacauaauuc

SEQ ID NO: 2110384 - RNA, 20 nt, Staphylococcus aureus subsp. aureus MW2
ugucauaauagauaaugcac

SEQ ID NO: 2110385 - RNA, 23 nt, Staphylococcus aureus subsp. aureus MW2
ugucacuggguguuuuuuucuua

SEQ ID NO: 2110386 - RNA, 13 nt, Staphylococcus aureus subsp. aureus MW2
ugucaucuuuaua

SEQ ID NO: 2110387 - RNA, 20 nt, Staphylococcus aureus subsp. aureus MW2
ugucaugaaguaauuucucu

SEQ ID NO: 2110388 - RNA, 14 nt, Staphylococcus aureus subsp. aureus MW2
ugucaugaauuuuc

SEQ ID NO: 2110389 - RNA, 20 nt, Staphylococcus aureus subsp. aureus MW2
ugucauguguucaaauaacg

SEQ ID NO: 2110390 - RNA, 15 nt, Staphylococcus aureus subsp. aureus MW2
ugucauguguucaaa

SEQ ID NO: 2110391 - RNA, 16 nt, Staphylococcus aureus subsp. aureus MW2
ugucauguguucaaau

SEQ ID NO: 2110392 - RNA, 23 nt, Staphylococcus aureus subsp. aureus MW2
ugucuagacuuauuugaaugcaa

SEQ ID NO: 2110393 - RNA, 16 nt, Staphylococcus aureus subsp. aureus MW2
ugucuagauuucaaau

SEQ ID NO: 2110394 - RNA, 17 nt, Staphylococcus aureus subsp. aureus MW2
ugucuagacuuauuuga

SEQ ID NO: 2110395 - RNA, 21 nt, Staphylococcus aureus subsp. aureus MW2
ugucuaaucgacuuuuacaau

SEQ ID NO: 2110396 - RNA, 20 nt, Staphylococcus aureus subsp. aureus MW2
ugucuaaucgacuuuuacaa

SEQ ID NO: 2110397 - RNA, 21 nt, Staphylococcus aureus subsp. aureus MW2
ugucuaguucgauuuuuuaau

SEQ ID NO: 2110398 - RNA, 19 nt, Staphylococcus aureus subsp. aureus MW2
ugucucaaauuaaaucacc

SEQ ID NO: 2110399 - RNA, 23 nt, Staphylococcus aureus subsp. aureus MW2
ugucucaauaauguuacgcugug

SEQ ID NO: 2110400 - RNA, 15 nt, Staphylococcus aureus subsp. aureus MW2
ugucgguucaucuaa

SEQ ID NO: 2110401 - RNA, 14 nt, Staphylococcus aureus subsp. aureus MW2
ugucauuaacauaa

SEQ ID NO: 2110402 - RNA, 15 nt, Staphylococcus aureus subsp. aureus MW2
ugucauuaacauaau

SEQ ID NO: 2110403 - RNA, 18 nt, Staphylococcus aureus subsp. aureus MW2
ugucauuaacauaauaau

SEQ ID NO: 2110404 - RNA, 17 nt, Staphylococcus aureus subsp. aureus MW2
ugugauaauucuucaac

SEQ ID NO: 2110405 - RNA, 20 nt, Staphylococcus aureus subsp. aureus MW2
ugugauaacuuguaauauaa

SEQ ID NO: 2110406 - RNA, 20 nt, Staphylococcus aureus subsp. aureus MW2
ugugccuuugcuuuuuauuu

SEQ ID NO: 2110407 - RNA, 19 nt, Staphylococcus aureus subsp. aureus MW2
ugugaauaugcuuuuaaua

SEQ ID NO: 2110408 - RNA, 18 nt, Staphylococcus aureus subsp. aureus MW2
ugugaauguuuucuaaau

SEQ ID NO: 2110409 - RNA, 19 nt, Staphylococcus aureus subsp. aureus MW2
ugucuuaauucauuccaaa

SEQ ID NO: 2110410 - RNA, 12 nt, Staphylococcus aureus subsp. aureus MW2
ugugacauacca

SEQ ID NO: 2110411 - RNA, 15 nt, Staphylococcus aureus subsp. aureus MW2
ugugacaauuuaaau

SEQ ID NO: 2110412 - RNA, 17 nt, Staphylococcus aureus subsp. aureus MW2
ugugacuuguaucaucg

SEQ ID NO: 2110413 - RNA, 22 nt, Staphylococcus aureus subsp. aureus MW2
uguuacuuucacauuuucaaau

SEQ ID NO: 2110414 - RNA, 18 nt, Staphylococcus aureus subsp. aureus MW2
uguuacuaguuuguaaua

SEQ ID NO: 2110415 - RNA, 17 nt, Staphylococcus aureus subsp. aureus MW2
uguuacucuuagguaua

SEQ ID NO: 2110416 - RNA, 15 nt, Staphylococcus aureus subsp. aureus MW2
uguuacacaaauuaa

SEQ ID NO: 2110417 - RNA, 16 nt, Staphylococcus aureus subsp. aureus MW2
uguuaacugauaaaag

SEQ ID NO: 2110418 - RNA, 14 nt, Staphylococcus aureus subsp. aureus MW2
uguuaaucaaaauu

SEQ ID NO: 2110419 - RNA, 14 nt, Staphylococcus aureus subsp. aureus MW2
uguuaacugaauuu

SEQ ID NO: 2110420 - RNA, 18 nt, Staphylococcus aureus subsp. aureus MW2
uguuaaucaaaauucuga

SEQ ID NO: 2110421 - RNA, 16 nt, Staphylococcus aureus subsp. aureus MW2
uguuaaugucuucaua

SEQ ID NO: 2110422 - RNA, 13 nt, Staphylococcus aureus subsp. aureus MW2
uguuaauuuaaua

SEQ ID NO: 2110423 - RNA, 16 nt, Staphylococcus aureus subsp. aureus MW2
uguuaaauucuaaaac

SEQ ID NO: 2110424 - RNA, 14 nt, Staphylococcus aureus subsp. aureus MW2
uguuaaaaaauuaa

SEQ ID NO: 2110425 - RNA, 18 nt, Staphylococcus aureus subsp. aureus MW2
uguuaaaaaauuaaaauc

SEQ ID NO: 2110426 - RNA, 21 nt, Staphylococcus aureus subsp. aureus MW2
uguguuucuuuuauuuucaua

SEQ ID NO: 2110427 - RNA, 16 nt, Staphylococcus aureus subsp. aureus MW2
uguguuucuuuuauuu

SEQ ID NO: 2110428 - RNA, 12 nt, Staphylococcus aureus subsp. aureus MW2
uguguuugcuuu

SEQ ID NO: 2110429 - RNA, 17 nt, Staphylococcus aureus subsp. aureus MW2
uguguuugcuuuuauuu

SEQ ID NO: 2110430 - RNA, 21 nt, Staphylococcus aureus subsp. aureus MW2
uguguuuaggaggaauaccca

SEQ ID NO: 2110431 - RNA, 17 nt, Staphylococcus aureus subsp. aureus MW2
uguguuggugcuauuaa

SEQ ID NO: 2110432 - RNA, 14 nt, Staphylococcus aureus subsp. aureus MW2
uguguuaaaauaua

SEQ ID NO: 2110433 - RNA, 17 nt, Staphylococcus aureus subsp. aureus MW2
uguggcggugguauggu

SEQ ID NO: 2110434 - RNA, 15 nt, Staphylococcus aureus subsp. aureus MW2
uguguaugagucuuu

SEQ ID NO: 2110435 - RNA, 18 nt, Staphylococcus aureus subsp. aureus MW2
uguguauuuauuuuuuua

SEQ ID NO: 2110436 - RNA, 21 nt, Staphylococcus aureus subsp. aureus MW2
uguguaucaguuauuuuaaua

SEQ ID NO: 2110437 - RNA, 22 nt, Staphylococcus aureus subsp. aureus MW2
ugugucauaauccauucuucuu

SEQ ID NO: 2110438 - RNA, 18 nt, Staphylococcus aureus subsp. aureus MW2
ugugucaaacaggcuuag

SEQ ID NO: 2110439 - RNA, 15 nt, Staphylococcus aureus subsp. aureus MW2
uguguauuuuuauug

SEQ ID NO: 2110440 - RNA, 12 nt, Staphylococcus aureus subsp. aureus MW2
uguguaacauua

SEQ ID NO: 2110441 - RNA, 17 nt, Staphylococcus aureus subsp. aureus MW2
uguguaccuuuuuauug

SEQ ID NO: 2110442 - RNA, 11 nt, Staphylococcus aureus subsp. aureus MW2
ugugguaaaag

SEQ ID NO: 2110443 - RNA, 12 nt, Staphylococcus aureus subsp. aureus MW2
ugugggccccaa

SEQ ID NO: 2110444 - RNA, 16 nt, Staphylococcus aureus subsp. aureus MW2
ugugggcguucugcua

SEQ ID NO: 2110445 - RNA, 17 nt, Staphylococcus aureus subsp. aureus MW2
ugugggcguucugcuaa

SEQ ID NO: 2110446 - RNA, 22 nt, Staphylococcus aureus subsp. aureus MW2
ugugguaugacugcaaauacga

SEQ ID NO: 2110447 - RNA, 18 nt, Staphylococcus aureus subsp. aureus MW2
uggggagccaauuucuac

SEQ ID NO: 2110448 - RNA, 19 nt, Staphylococcus aureus subsp. aureus MW2
uggggcccauccccaacuu

SEQ ID NO: 2110449 - RNA, 15 nt, Staphylococcus aureus subsp. aureus MW2
ugggcguucugcuaa

SEQ ID NO: 2110450 - RNA, 15 nt, Staphylococcus aureus subsp. aureus MW2
uggcguugcaccaag

SEQ ID NO: 2110451 - RNA, 14 nt, Staphylococcus aureus subsp. aureus MW2
uggcuuacugucac

SEQ ID NO: 2110452 - RNA, 21 nt, Staphylococcus aureus subsp. aureus MW2
uggcuuagguuuaauuuuaaa

SEQ ID NO: 2110453 - RNA, 18 nt, Staphylococcus aureus subsp. aureus MW2
uggcuuuuuuauuuuaua

SEQ ID NO: 2110454 - RNA, 19 nt, Staphylococcus aureus subsp. aureus MW2
ugggauaauuuguauuaua

SEQ ID NO: 2110455 - RNA, 16 nt, Staphylococcus aureus subsp. aureus MW2
uggucaacuuuuuuaa

SEQ ID NO: 2110456 - RNA, 16 nt, Staphylococcus aureus subsp. aureus MW2
uggucauguguugcaa

SEQ ID NO: 2110457 - RNA, 15 nt, Staphylococcus aureus subsp. aureus MW2
ugguaauuuaacaac

SEQ ID NO: 2110458 - RNA, 19 nt, Staphylococcus aureus subsp. aureus MW2
ugguaauucaccaucauau

SEQ ID NO: 2110459 - RNA, 15 nt, Staphylococcus aureus subsp. aureus MW2
ugguacauaaagcuu

SEQ ID NO: 2110460 - RNA, 18 nt, Staphylococcus aureus subsp. aureus MW2
ugguaaaaaaauaacguu

SEQ ID NO: 2110461 - RNA, 16 nt, Staphylococcus aureus subsp. aureus MW2
ugguaaaaaugaacca

SEQ ID NO: 2110462 - RNA, 16 nt, Staphylococcus aureus subsp. aureus MW2
ugguauagauuuuaua

SEQ ID NO: 2110463 - RNA, 18 nt, Staphylococcus aureus subsp. aureus MW2
ugguauugauuauucuuu

SEQ ID NO: 2110464 - RNA, 18 nt, Staphylococcus aureus subsp. aureus MW2
ugguauucgcaucauucc

SEQ ID NO: 2110465 - RNA, 19 nt, Staphylococcus aureus subsp. aureus MW2
ugguauuagaacuucucuu

SEQ ID NO: 2110466 - RNA, 18 nt, Staphylococcus aureus subsp. aureus MW2
ugguauuauucuuucaua

SEQ ID NO: 2110467 - RNA, 20 nt, Staphylococcus aureus subsp. aureus MW2
ugguaugacugcaaauacga

SEQ ID NO: 2110468 - RNA, 19 nt, Staphylococcus aureus subsp. aureus MW2
ugguacuacuauccagucc

SEQ ID NO: 2110469 - RNA, 16 nt, Staphylococcus aureus subsp. aureus MW2
ugguagcauuuuagau

SEQ ID NO: 2110470 - RNA, 14 nt, Staphylococcus aureus subsp. aureus MW2
uggcggggccccaa

SEQ ID NO: 2110471 - RNA, 21 nt, Staphylococcus aureus subsp. aureus MW2
uggcggggccccaacaaagaa

SEQ ID NO: 2110472 - RNA, 17 nt, Staphylococcus aureus subsp. aureus MW2
uggcggggcccaaacau

SEQ ID NO: 2110473 - RNA, 13 nt, Staphylococcus aureus subsp. aureus MW2
uggcgggccccaa

SEQ ID NO: 2110474 - RNA, 18 nt, Staphylococcus aureus subsp. aureus MW2
uggcggaaagucagcuua

SEQ ID NO: 2110475 - RNA, 14 nt, Staphylococcus aureus subsp. aureus MW2
uggcgaggccccaa

SEQ ID NO: 2110476 - RNA, 15 nt, Staphylococcus aureus subsp. aureus MW2
uggccuuuuaaacaa

SEQ ID NO: 2110477 - RNA, 18 nt, Staphylococcus aureus subsp. aureus MW2
uggcauuuaauacuaaua

SEQ ID NO: 2110478 - RNA, 20 nt, Staphylococcus aureus subsp. aureus MW2
uggcauuuaauacuaauaac

SEQ ID NO: 2110479 - RNA, 13 nt, Staphylococcus aureus subsp. aureus MW2
uggauuucuuauu

SEQ ID NO: 2110480 - RNA, 14 nt, Staphylococcus aureus subsp. aureus MW2
uggauuucuuuuua

SEQ ID NO: 2110481 - RNA, 14 nt, Staphylococcus aureus subsp. aureus MW2
uggcaaaucaaaca

SEQ ID NO: 2110482 - RNA, 13 nt, Staphylococcus aureus subsp. aureus MW2
ugcguuaauaauu

SEQ ID NO: 2110483 - RNA, 13 nt, Staphylococcus aureus subsp. aureus MW2
ugcguuaaauaua

SEQ ID NO: 2110484 - RNA, 16 nt, Staphylococcus aureus subsp. aureus MW2
uggcacauaaaucaau

SEQ ID NO: 2110485 - RNA, 23 nt, Staphylococcus aureus subsp. aureus MW2
uggcaccacauacauaucuuuug

SEQ ID NO: 2110486 - RNA, 14 nt, Staphylococcus aureus subsp. aureus MW2
uggcacaaaugcua

SEQ ID NO: 2110487 - RNA, 16 nt, Staphylococcus aureus subsp. aureus MW2
uggcacaaaugcuaca

SEQ ID NO: 2110488 - RNA, 21 nt, Staphylococcus aureus subsp. aureus MW2
uggcaauuaaaacuauaauaa

SEQ ID NO: 2110489 - RNA, 20 nt, Staphylococcus aureus subsp. aureus MW2
uggcaauauacuuuuuaaau

SEQ ID NO: 2110490 - RNA, 16 nt, Staphylococcus aureus subsp. aureus MW2
uucaaauaauauaaaa

SEQ ID NO: 2110491 - RNA, 13 nt, Staphylococcus aureus subsp. aureus MW2
uucaaauaaagau

SEQ ID NO: 2110492 - RNA, 19 nt, Staphylococcus aureus subsp. aureus MW2
uucaaagcugucaacuugu

SEQ ID NO: 2110493 - RNA, 17 nt, Staphylococcus aureus subsp. aureus MW2
uucaaagcugucaacuu

SEQ ID NO: 2110494 - RNA, 23 nt, Staphylococcus aureus subsp. aureus MW2
uuauuuucauauaaauagcuucu

SEQ ID NO: 2110495 - RNA, 14 nt, Staphylococcus aureus subsp. aureus MW2
uuauuuuaauagcg

SEQ ID NO: 2110496 - RNA, 22 nt, Staphylococcus aureus subsp. aureus MW2
uuauuuucgacuaguuuggaga

SEQ ID NO: 2110497 - RNA, 17 nt, Staphylococcus aureus subsp. aureus MW2
uuauuuugauagacuaa

SEQ ID NO: 2110498 - RNA, 23 nt, Staphylococcus aureus subsp. aureus MW2
uucaaagacacggccugcaaguc

SEQ ID NO: 2110499 - RNA, 16 nt, Staphylococcus aureus subsp. aureus MW2
uuauuuuuaaauauga

SEQ ID NO: 2110500 - RNA, 16 nt, Staphylococcus aureus subsp. aureus MW2
uucaacuuauuauuua

SEQ ID NO: 2110501 - RNA, 18 nt, Staphylococcus aureus subsp. aureus MW2
uucaacuuguuuccuaca

SEQ ID NO: 2110502 - RNA, 14 nt, Staphylococcus aureus subsp. aureus MW2
uucaacuucaucua

SEQ ID NO: 2110503 - RNA, 18 nt, Staphylococcus aureus subsp. aureus MW2
uucaacuucaucuaaaug

SEQ ID NO: 2110504 - RNA, 15 nt, Staphylococcus aureus subsp. aureus MW2
uucaacuaauuuaaa

SEQ ID NO: 2110505 - RNA, 16 nt, Staphylococcus aureus subsp. aureus MW2
uucaacgucaucugcu

SEQ ID NO: 2110506 - RNA, 16 nt, Staphylococcus aureus subsp. aureus MW2
uucaacauauaaauca

SEQ ID NO: 2110507 - RNA, 22 nt, Staphylococcus aureus subsp. aureus MW2
uucaacaguaauuuuuaaacaa

SEQ ID NO: 2110508 - RNA, 21 nt, Staphylococcus aureus subsp. aureus MW2
uucaaaugcuuaauaaaauca

SEQ ID NO: 2110509 - RNA, 14 nt, Staphylococcus aureus subsp. aureus MW2
uucaaauuaauuaa

SEQ ID NO: 2110510 - RNA, 14 nt, Staphylococcus aureus subsp. aureus MW2
uucaacaaaaugcg

SEQ ID NO: 2110511 - RNA, 16 nt, Staphylococcus aureus subsp. aureus MW2
uuaggcuuauuaacuu

SEQ ID NO: 2110512 - RNA, 19 nt, Staphylococcus aureus subsp. aureus MW2
uuauuaucuuuguaaauuu

SEQ ID NO: 2110513 - RNA, 17 nt, Staphylococcus aureus subsp. aureus MW2
uuaggcgcuacaauguu

SEQ ID NO: 2110514 - RNA, 22 nt, Staphylococcus aureus subsp. aureus MW2
uuaggauguucagcuaacucuu

SEQ ID NO: 2110515 - RNA, 17 nt, Staphylococcus aureus subsp. aureus MW2
uuaggauucgauugguu

SEQ ID NO: 2110516 - RNA, 20 nt, Staphylococcus aureus subsp. aureus MW2
uuaggauccaauuuauaaug

SEQ ID NO: 2110517 - RNA, 13 nt, Staphylococcus aureus subsp. aureus MW2
uuauucaauauuu

SEQ ID NO: 2110518 - RNA, 14 nt, Staphylococcus aureus subsp. aureus MW2
uuauucaaaucaua

SEQ ID NO: 2110519 - RNA, 20 nt, Staphylococcus aureus subsp. aureus MW2
uuauuauuuuguauuuuuca

SEQ ID NO: 2110520 - RNA, 13 nt, Staphylococcus aureus subsp. aureus MW2
uuauuauugaaau

SEQ ID NO: 2110521 - RNA, 17 nt, Staphylococcus aureus subsp. aureus MW2
uuauucaauugauuaca

SEQ ID NO: 2110522 - RNA, 18 nt, Staphylococcus aureus subsp. aureus MW2
uuauuuauacuaaauuga

SEQ ID NO: 2110523 - RNA, 17 nt, Staphylococcus aureus subsp. aureus MW2
uuauugguugaaauuaa

SEQ ID NO: 2110524 - RNA, 15 nt, Staphylococcus aureus subsp. aureus MW2
uuauuguaaccugac

SEQ ID NO: 2110525 - RNA, 16 nt, Staphylococcus aureus subsp. aureus MW2
uuauuuauucagcauu

SEQ ID NO: 2110526 - RNA, 12 nt, Staphylococcus aureus subsp. aureus MW2
uuauuucagcuu

SEQ ID NO: 2110527 - RNA, 21 nt, Staphylococcus aureus subsp. aureus MW2
uuauuucuauaucuauuuauc

SEQ ID NO: 2110528 - RNA, 23 nt, Staphylococcus aureus subsp. aureus MW2
uuauugccuaacguguuugagau

SEQ ID NO: 2110529 - RNA, 24 nt, Staphylococcus aureus subsp. aureus MW2
uuauugccuaacguguuugagaua

SEQ ID NO: 2110530 - RNA, 15 nt, Staphylococcus aureus subsp. aureus MW2
uuauuggguaauauu

SEQ ID NO: 2110531 - RNA, 14 nt, Staphylococcus aureus subsp. aureus MW2
uuauucguuucuuu

SEQ ID NO: 2110532 - RNA, 17 nt, Staphylococcus aureus subsp. aureus MW2
uuauucuaaguuaaaac

SEQ ID NO: 2110533 - RNA, 19 nt, Staphylococcus aureus subsp. aureus MW2
uuauugauauuaauauauu

SEQ ID NO: 2110534 - RNA, 15 nt, Staphylococcus aureus subsp. aureus MW2
uuauucguauucaaa

SEQ ID NO: 2110535 - RNA, 19 nt, Staphylococcus aureus subsp. aureus MW2
uucaauguaucaccuaauu

SEQ ID NO: 2110536 - RNA, 14 nt, Staphylococcus aureus subsp. aureus MW2
uucaaugucugcau

SEQ ID NO: 2110537 - RNA, 17 nt, Staphylococcus aureus subsp. aureus MW2
uucaaugcuuucaucuu

SEQ ID NO: 2110538 - RNA, 19 nt, Staphylococcus aureus subsp. aureus MW2
uucaaguaaucauuuuucg

SEQ ID NO: 2110539 - RNA, 14 nt, Staphylococcus aureus subsp. aureus MW2
uucaagcguuucuu

SEQ ID NO: 2110540 - RNA, 15 nt, Staphylococcus aureus subsp. aureus MW2
uucaaucguuucuuc

SEQ ID NO: 2110541 - RNA, 13 nt, Staphylococcus aureus subsp. aureus MW2
uucaaucgucaca

SEQ ID NO: 2110542 - RNA, 16 nt, Staphylococcus aureus subsp. aureus MW2
uucaaucgucacauca

SEQ ID NO: 2110543 - RNA, 16 nt, Staphylococcus aureus subsp. aureus MW2
uucaaucgcauuuugu

SEQ ID NO: 2110544 - RNA, 23 nt, Staphylococcus aureus subsp. aureus MW2
uucaauugacauuaaugauagca

SEQ ID NO: 2110545 - RNA, 13 nt, Staphylococcus aureus subsp. aureus MW2
uucaauugcacuu

SEQ ID NO: 2110546 - RNA, 22 nt, Staphylococcus aureus subsp. aureus MW2
uucaauuucauuuuugauaacu

SEQ ID NO: 2110547 - RNA, 12 nt, Staphylococcus aureus subsp. aureus MW2
uucaauuuaugu

SEQ ID NO: 2110548 - RNA, 19 nt, Staphylococcus aureus subsp. aureus MW2
uucaauugucucaauaaug

SEQ ID NO: 2110549 - RNA, 20 nt, Staphylococcus aureus subsp. aureus MW2
uucaauugucguuuaauaau

SEQ ID NO: 2110550 - RNA, 15 nt, Staphylococcus aureus subsp. aureus MW2
uucaauugucucaau

SEQ ID NO: 2110551 - RNA, 18 nt, Staphylococcus aureus subsp. aureus MW2
uucaauguuuaauuuucu

SEQ ID NO: 2110552 - RNA, 21 nt, Staphylococcus aureus subsp. aureus MW2
uucaauguuuaauuuucuaaa

SEQ ID NO: 2110553 - RNA, 11 nt, Staphylococcus aureus subsp. aureus MW2
uucaauguuug

SEQ ID NO: 2110554 - RNA, 22 nt, Staphylococcus aureus subsp. aureus MW2
uucaauuaaguacuucaaagca

SEQ ID NO: 2110555 - RNA, 17 nt, Staphylococcus aureus subsp. aureus MW2
uucaauuagaaaauuuc

SEQ ID NO: 2110556 - RNA, 14 nt, Staphylococcus aureus subsp. aureus MW2
uucaauuucucacc

SEQ ID NO: 2110557 - RNA, 21 nt, Staphylococcus aureus subsp. aureus MW2
uucagaacuacaauucauaag

SEQ ID NO: 2110558 - RNA, 14 nt, Staphylococcus aureus subsp. aureus MW2
uucagaugaauaau

SEQ ID NO: 2110559 - RNA, 23 nt, Staphylococcus aureus subsp. aureus MW2
uucagaugaauaauguuuccauu

SEQ ID NO: 2110560 - RNA, 13 nt, Staphylococcus aureus subsp. aureus MW2
uucacuguuuuau

SEQ ID NO: 2110561 - RNA, 14 nt, Staphylococcus aureus subsp. aureus MW2
uucacuguuuuauc

SEQ ID NO: 2110562 - RNA, 12 nt, Staphylococcus aureus subsp. aureus MW2
uucacuucauaa

SEQ ID NO: 2110563 - RNA, 16 nt, Staphylococcus aureus subsp. aureus MW2
uucacuguauaaauaa

SEQ ID NO: 2110564 - RNA, 14 nt, Staphylococcus aureus subsp. aureus MW2
uucaccaacuuuuu

SEQ ID NO: 2110565 - RNA, 18 nt, Staphylococcus aureus subsp. aureus MW2
uucaucauaaucuacugc

SEQ ID NO: 2110566 - RNA, 19 nt, Staphylococcus aureus subsp. aureus MW2
uucaucauaaucuacugcu

SEQ ID NO: 2110567 - RNA, 22 nt, Staphylococcus aureus subsp. aureus MW2
uucaucauauucgccuucuaau

SEQ ID NO: 2110568 - RNA, 14 nt, Staphylococcus aureus subsp. aureus MW2
uucaucauuaaaau

SEQ ID NO: 2110569 - RNA, 16 nt, Staphylococcus aureus subsp. aureus MW2
uucaucauuaaaauca

SEQ ID NO: 2110570 - RNA, 17 nt, Staphylococcus aureus subsp. aureus MW2
uucaucaaguugauaau

SEQ ID NO: 2110571 - RNA, 23 nt, Staphylococcus aureus subsp. aureus MW2
uucaucgaagauguuaaacuguc

SEQ ID NO: 2110572 - RNA, 16 nt, Staphylococcus aureus subsp. aureus MW2
uucauauggugaacug

SEQ ID NO: 2110573 - RNA, 17 nt, Staphylococcus aureus subsp. aureus MW2
uucaucaaacaacauca

SEQ ID NO: 2110574 - RNA, 14 nt, Staphylococcus aureus subsp. aureus MW2
uucauauuaacugu

SEQ ID NO: 2110575 - RNA, 19 nt, Staphylococcus aureus subsp. aureus MW2
uucaucaaacaacaucacu

SEQ ID NO: 2110576 - RNA, 15 nt, Staphylococcus aureus subsp. aureus MW2
uucaucaauaacuau

SEQ ID NO: 2110577 - RNA, 15 nt, Staphylococcus aureus subsp. aureus MW2
uucauagaaauuguc

SEQ ID NO: 2110578 - RNA, 18 nt, Staphylococcus aureus subsp. aureus MW2
uucauaguguuuguaaug

SEQ ID NO: 2110579 - RNA, 23 nt, Staphylococcus aureus subsp. aureus MW2
uucauauaauuuuaauauuaugu

SEQ ID NO: 2110580 - RNA, 15 nt, Staphylococcus aureus subsp. aureus MW2
uucauaguuuaugug

SEQ ID NO: 2110581 - RNA, 22 nt, Staphylococcus aureus subsp. aureus MW2
uucagcgauaacguacaaugua

SEQ ID NO: 2110582 - RNA, 21 nt, Staphylococcus aureus subsp. aureus MW2
uucaguauauuuuaacaauga

SEQ ID NO: 2110583 - RNA, 20 nt, Staphylococcus aureus subsp. aureus MW2
uucaguaacaguauaaauau

SEQ ID NO: 2110584 - RNA, 15 nt, Staphylococcus aureus subsp. aureus MW2
uucaguauacucauc

SEQ ID NO: 2110585 - RNA, 18 nt, Staphylococcus aureus subsp. aureus MW2
uucauaaaugacugaauu

SEQ ID NO: 2110586 - RNA, 20 nt, Staphylococcus aureus subsp. aureus MW2
uucauaaaugacugaauuaa

SEQ ID NO: 2110587 - RNA, 14 nt, Staphylococcus aureus subsp. aureus MW2
uucauaaauuguuu

SEQ ID NO: 2110588 - RNA, 11 nt, Staphylococcus aureus subsp. aureus MW2
uucauaacaac

SEQ ID NO: 2110589 - RNA, 13 nt, Staphylococcus aureus subsp. aureus MW2
uucauaaauauuu

SEQ ID NO: 2110590 - RNA, 19 nt, Staphylococcus aureus subsp. aureus MW2
uucauaagaaaaauguguu

SEQ ID NO: 2110591 - RNA, 21 nt, Staphylococcus aureus subsp. aureus MW2
uucauacacuaucauuaucaa

SEQ ID NO: 2110592 - RNA, 15 nt, Staphylococcus aureus subsp. aureus MW2
uucauaaucauaaua

SEQ ID NO: 2110593 - RNA, 14 nt, Staphylococcus aureus subsp. aureus MW2
uucaguuaaaccuu

SEQ ID NO: 2110594 - RNA, 17 nt, Staphylococcus aureus subsp. aureus MW2
uucaguuuucacuaaau

SEQ ID NO: 2110595 - RNA, 17 nt, Staphylococcus aureus subsp. aureus MW2
uucaguuuguuggucuu

SEQ ID NO: 2110596 - RNA, 13 nt, Staphylococcus aureus subsp. aureus MW2
uucaguuguuuuu

SEQ ID NO: 2110597 - RNA, 21 nt, Staphylococcus aureus subsp. aureus MW2
uucaucguucauauauuuugu

SEQ ID NO: 2110598 - RNA, 13 nt, Staphylococcus aureus subsp. aureus MW2
uucaucuaaauga

SEQ ID NO: 2110599 - RNA, 15 nt, Staphylococcus aureus subsp. aureus MW2
uucaucuaaaugaug

SEQ ID NO: 2110600 - RNA, 13 nt, Staphylococcus aureus subsp. aureus MW2
uucaucuaaaaag

SEQ ID NO: 2110601 - RNA, 14 nt, Staphylococcus aureus subsp. aureus MW2
uucaucuaaaauua

SEQ ID NO: 2110602 - RNA, 20 nt, Staphylococcus aureus subsp. aureus MW2
uucaucgucucacuuaauaa

SEQ ID NO: 2110603 - RNA, 12 nt, Staphylococcus aureus subsp. aureus MW2
uucaucuucaac

SEQ ID NO: 2110604 - RNA, 21 nt, Staphylococcus aureus subsp. aureus MW2
uucaucuggagacgaaccauu

SEQ ID NO: 2110605 - RNA, 15 nt, Staphylococcus aureus subsp. aureus MW2
uucaucuguccgacu

SEQ ID NO: 2110606 - RNA, 12 nt, Staphylococcus aureus subsp. aureus MW2
uucaucuugcaa

SEQ ID NO: 2110607 - RNA, 12 nt, Staphylococcus aureus subsp. aureus MW2
uucaucuuucaa

SEQ ID NO: 2110608 - RNA, 21 nt, Staphylococcus aureus subsp. aureus MW2
uucaugaauaaauacaauguu

SEQ ID NO: 2110609 - RNA, 13 nt, Staphylococcus aureus subsp. aureus MW2
uucaugaauaauu

SEQ ID NO: 2110610 - RNA, 18 nt, Staphylococcus aureus subsp. aureus MW2
uucaucuuuuuuaucaug

SEQ ID NO: 2110611 - RNA, 12 nt, Staphylococcus aureus subsp. aureus MW2
uucaugaacagc

SEQ ID NO: 2110612 - RNA, 21 nt, Staphylococcus aureus subsp. aureus MW2
uucauguucuuaacaauauca

SEQ ID NO: 2110613 - RNA, 17 nt, Staphylococcus aureus subsp. aureus MW2
uucaugugucacaauga

SEQ ID NO: 2110614 - RNA, 22 nt, Staphylococcus aureus subsp. aureus MW2
uucaugugcaagugguaaaaau

SEQ ID NO: 2110615 - RNA, 16 nt, Staphylococcus aureus subsp. aureus MW2
uucauguaugaaguaa

SEQ ID NO: 2110616 - RNA, 16 nt, Staphylococcus aureus subsp. aureus MW2
uucauguacgaaaauu

SEQ ID NO: 2110617 - RNA, 17 nt, Staphylococcus aureus subsp. aureus MW2
uucauguuugauucuaa

SEQ ID NO: 2110618 - RNA, 17 nt, Staphylococcus aureus subsp. aureus MW2
uucauuaauuuuuucgu

SEQ ID NO: 2110619 - RNA, 15 nt, Staphylococcus aureus subsp. aureus MW2
uucauuacaaacaua

SEQ ID NO: 2110620 - RNA, 14 nt, Staphylococcus aureus subsp. aureus MW2
uucauguuuaaaau

SEQ ID NO: 2110621 - RNA, 16 nt, Staphylococcus aureus subsp. aureus MW2
uucauuaacagucuuu

SEQ ID NO: 2110622 - RNA, 15 nt, Staphylococcus aureus subsp. aureus MW2
uucaugauuuacuaa

SEQ ID NO: 2110623 - RNA, 18 nt, Staphylococcus aureus subsp. aureus MW2
uucaugaugcgaaaccuu

SEQ ID NO: 2110624 - RNA, 20 nt, Staphylococcus aureus subsp. aureus MW2
uucauuuugguacaaaaaau

SEQ ID NO: 2110625 - RNA, 13 nt, Staphylococcus aureus subsp. aureus MW2
uucauuuuuucaa

SEQ ID NO: 2110626 - RNA, 20 nt, Staphylococcus aureus subsp. aureus MW2
uucauuuuuucaaugucuac

SEQ ID NO: 2110627 - RNA, 16 nt, Staphylococcus aureus subsp. aureus MW2
uuccaaaaauuguaaa

SEQ ID NO: 2110628 - RNA, 21 nt, Staphylococcus aureus subsp. aureus MW2
uucauuuuucuuccuaaauaa

SEQ ID NO: 2110629 - RNA, 22 nt, Staphylococcus aureus subsp. aureus MW2
uucauuuuucuuccuaaauaau

SEQ ID NO: 2110630 - RNA, 21 nt, Staphylococcus aureus subsp. aureus MW2
uuccaaacacacuguugaaaa

SEQ ID NO: 2110631 - RNA, 20 nt, Staphylococcus aureus subsp. aureus MW2
uuccaaauuggaaaucaacu

SEQ ID NO: 2110632 - RNA, 16 nt, Staphylococcus aureus subsp. aureus MW2
uucauuacaguauuug

SEQ ID NO: 2110633 - RNA, 12 nt, Staphylococcus aureus subsp. aureus MW2
uucauuaucauu

SEQ ID NO: 2110634 - RNA, 14 nt, Staphylococcus aureus subsp. aureus MW2
uucauuaucauuaa

SEQ ID NO: 2110635 - RNA, 19 nt, Staphylococcus aureus subsp. aureus MW2
uucauuaguugcauaauca

SEQ ID NO: 2110636 - RNA, 17 nt, Staphylococcus aureus subsp. aureus MW2
uucauuaguuuaugucu

SEQ ID NO: 2110637 - RNA, 21 nt, Staphylococcus aureus subsp. aureus MW2
uucauuauauaauucuucaaa

SEQ ID NO: 2110638 - RNA, 16 nt, Staphylococcus aureus subsp. aureus MW2
uucauuauuuaaauaa

SEQ ID NO: 2110639 - RNA, 17 nt, Staphylococcus aureus subsp. aureus MW2
uucauugaagaauauaa

SEQ ID NO: 2110640 - RNA, 16 nt, Staphylococcus aureus subsp. aureus MW2
uucauuguuaaacauu

SEQ ID NO: 2110641 - RNA, 12 nt, Staphylococcus aureus subsp. aureus MW2
uucauuuaacau

SEQ ID NO: 2110642 - RNA, 17 nt, Staphylococcus aureus subsp. aureus MW2
uucauuuaguuaaauac

SEQ ID NO: 2110643 - RNA, 19 nt, Staphylococcus aureus subsp. aureus MW2
uucauuuguauuaauuuga

SEQ ID NO: 2110644 - RNA, 18 nt, Staphylococcus aureus subsp. aureus MW2
uuccuaaaccucuaaaua

SEQ ID NO: 2110645 - RNA, 18 nt, Staphylococcus aureus subsp. aureus MW2
uuccguugaauuaacaau

SEQ ID NO: 2110646 - RNA, 16 nt, Staphylococcus aureus subsp. aureus MW2
uucgaacguuugaaaa

SEQ ID NO: 2110647 - RNA, 17 nt, Staphylococcus aureus subsp. aureus MW2
uucgaacguuugaaaaa

SEQ ID NO: 2110648 - RNA, 21 nt, Staphylococcus aureus subsp. aureus MW2
uucgaacguuugaaaaauuuc

SEQ ID NO: 2110649 - RNA, 17 nt, Staphylococcus aureus subsp. aureus MW2
uucgaacuaucaauaua

SEQ ID NO: 2110650 - RNA, 22 nt, Staphylococcus aureus subsp. aureus MW2
uuccuucauugaagaauauaaa

SEQ ID NO: 2110651 - RNA, 17 nt, Staphylococcus aureus subsp. aureus MW2
uucccuguuaugaagua

SEQ ID NO: 2110652 - RNA, 22 nt, Staphylococcus aureus subsp. aureus MW2
uuccgcacaagcaucuauaaua

SEQ ID NO: 2110653 - RNA, 15 nt, Staphylococcus aureus subsp. aureus MW2
uucccuaugaaauaa

SEQ ID NO: 2110654 - RNA, 16 nt, Staphylococcus aureus subsp. aureus MW2
uucccuaucauacaua

SEQ ID NO: 2110655 - RNA, 17 nt, Staphylococcus aureus subsp. aureus MW2
uuccaaucaacuucaua

SEQ ID NO: 2110656 - RNA, 19 nt, Staphylococcus aureus subsp. aureus MW2
uucgauucuccuuuuguuu

SEQ ID NO: 2110657 - RNA, 17 nt, Staphylococcus aureus subsp. aureus MW2
uucgauugguuuaaaaa

SEQ ID NO: 2110658 - RNA, 18 nt, Staphylococcus aureus subsp. aureus MW2
uucgauugguuuaaaaag

SEQ ID NO: 2110659 - RNA, 16 nt, Staphylococcus aureus subsp. aureus MW2
uucgauuuagaagaac

SEQ ID NO: 2110660 - RNA, 15 nt, Staphylococcus aureus subsp. aureus MW2
uucgcccuuccauuc

SEQ ID NO: 2110661 - RNA, 18 nt, Staphylococcus aureus subsp. aureus MW2
uucgacuguauacgacgu

SEQ ID NO: 2110662 - RNA, 21 nt, Staphylococcus aureus subsp. aureus MW2
uucgacuaguuuggagaauuu

SEQ ID NO: 2110663 - RNA, 19 nt, Staphylococcus aureus subsp. aureus MW2
uucgacucaaacaauaaag

SEQ ID NO: 2110664 - RNA, 15 nt, Staphylococcus aureus subsp. aureus MW2
uucgauuauucuuaa

SEQ ID NO: 2110665 - RNA, 12 nt, Staphylococcus aureus subsp. aureus MW2
uucgauggcugc

SEQ ID NO: 2110666 - RNA, 19 nt, Staphylococcus aureus subsp. aureus MW2
uucgaugcauauucaucau

SEQ ID NO: 2110667 - RNA, 14 nt, Staphylococcus aureus subsp. aureus MW2
uucgauauuuguuu

SEQ ID NO: 2110668 - RNA, 19 nt, Staphylococcus aureus subsp. aureus MW2
uucgauaauauaacugcau

SEQ ID NO: 2110669 - RNA, 17 nt, Staphylococcus aureus subsp. aureus MW2
uucgucuguauccucag

SEQ ID NO: 2110670 - RNA, 20 nt, Staphylococcus aureus subsp. aureus MW2
uucgcguaaucuauaauaca

SEQ ID NO: 2110671 - RNA, 13 nt, Staphylococcus aureus subsp. aureus MW2
uucugucuguaaa

SEQ ID NO: 2110672 - RNA, 23 nt, Staphylococcus aureus subsp. aureus MW2
uucugugaccaauagaauucauu

SEQ ID NO: 2110673 - RNA, 19 nt, Staphylococcus aureus subsp. aureus MW2
uucuguacguuuuaaauaa

SEQ ID NO: 2110674 - RNA, 16 nt, Staphylococcus aureus subsp. aureus MW2
uucugguucuucacua

SEQ ID NO: 2110675 - RNA, 16 nt, Staphylococcus aureus subsp. aureus MW2
uucuguaauaauauca

SEQ ID NO: 2110676 - RNA, 22 nt, Staphylococcus aureus subsp. aureus MW2
uucuuaacaauaucaucuaaau

SEQ ID NO: 2110677 - RNA, 20 nt, Staphylococcus aureus subsp. aureus MW2
uucuuaaacgcucuucuucu

SEQ ID NO: 2110678 - RNA, 18 nt, Staphylococcus aureus subsp. aureus MW2
uucuuaacauaaaaugag

SEQ ID NO: 2110679 - RNA, 13 nt, Staphylococcus aureus subsp. aureus MW2
uucuuaauuauca

SEQ ID NO: 2110680 - RNA, 15 nt, Staphylococcus aureus subsp. aureus MW2
uucuuaauuuaaaaa

SEQ ID NO: 2110681 - RNA, 18 nt, Staphylococcus aureus subsp. aureus MW2
uucuuaauuuaaaaauag

SEQ ID NO: 2110682 - RNA, 21 nt, Staphylococcus aureus subsp. aureus MW2
uucuuaugcaguuuuaauuaa

SEQ ID NO: 2110683 - RNA, 24 nt, Staphylococcus aureus subsp. aureus MW2
uucuuaugcggucuaaaugcucua

SEQ ID NO: 2110684 - RNA, 13 nt, Staphylococcus aureus subsp. aureus MW2
uucuuaucaguuu

SEQ ID NO: 2110685 - RNA, 17 nt, Staphylococcus aureus subsp. aureus MW2
uucuuaucauuucaaau

SEQ ID NO: 2110686 - RNA, 13 nt, Staphylococcus aureus subsp. aureus MW2
uucuuauaaaaau

SEQ ID NO: 2110687 - RNA, 14 nt, Staphylococcus aureus subsp. aureus MW2
uucuuauaaaaauc

SEQ ID NO: 2110688 - RNA, 16 nt, Staphylococcus aureus subsp. aureus MW2
uucuuauaaaaaucuu

SEQ ID NO: 2110689 - RNA, 18 nt, Staphylococcus aureus subsp. aureus MW2
uucuuaguuugacaucua

SEQ ID NO: 2110690 - RNA, 22 nt, Staphylococcus aureus subsp. aureus MW2
uucuuagauuuuauauaaaaag

SEQ ID NO: 2110691 - RNA, 16 nt, Staphylococcus aureus subsp. aureus MW2
uucuucaaaaaauaau

SEQ ID NO: 2110692 - RNA, 18 nt, Staphylococcus aureus subsp. aureus MW2
uucuucaaccauuuguuc

SEQ ID NO: 2110693 - RNA, 23 nt, Staphylococcus aureus subsp. aureus MW2
uucuucaacaauuucaaugucug

SEQ ID NO: 2110694 - RNA, 15 nt, Staphylococcus aureus subsp. aureus MW2
uucuucaacaauuuc

SEQ ID NO: 2110695 - RNA, 21 nt, Staphylococcus aureus subsp. aureus MW2
uucuucaacaauuucaauguc

SEQ ID NO: 2110696 - RNA, 17 nt, Staphylococcus aureus subsp. aureus MW2
uucuucacuaaaaauau

SEQ ID NO: 2110697 - RNA, 13 nt, Staphylococcus aureus subsp. aureus MW2
uucuucaauuguc

SEQ ID NO: 2110698 - RNA, 15 nt, Staphylococcus aureus subsp. aureus MW2
uucuucauaguucaa

SEQ ID NO: 2110699 - RNA, 17 nt, Staphylococcus aureus subsp. aureus MW2
uucuucaguuaaaucuu

SEQ ID NO: 2110700 - RNA, 18 nt, Staphylococcus aureus subsp. aureus MW2
uucuucacuaaaaauaua

SEQ ID NO: 2110701 - RNA, 12 nt, Staphylococcus aureus subsp. aureus MW2
uucuucaucuuu

SEQ ID NO: 2110702 - RNA, 22 nt, Staphylococcus aureus subsp. aureus MW2
uucuuccaacacccauauaauu

SEQ ID NO: 2110703 - RNA, 17 nt, Staphylococcus aureus subsp. aureus MW2
uucuucgcauuguuucu

SEQ ID NO: 2110704 - RNA, 17 nt, Staphylococcus aureus subsp. aureus MW2
uucuuccuaaauaauua

SEQ ID NO: 2110705 - RNA, 16 nt, Staphylococcus aureus subsp. aureus MW2
uucuucuaauucugaa

SEQ ID NO: 2110706 - RNA, 23 nt, Staphylococcus aureus subsp. aureus MW2
uucuucuaauuuaguuuuaauau

SEQ ID NO: 2110707 - RNA, 24 nt, Staphylococcus aureus subsp. aureus MW2
uucucuuugaacgaaagagaaaag

SEQ ID NO: 2110708 - RNA, 18 nt, Staphylococcus aureus subsp. aureus MW2
uucucuuugaacgagaga

SEQ ID NO: 2110709 - RNA, 20 nt, Staphylococcus aureus subsp. aureus MW2
uucugcuguauggaaaguug

SEQ ID NO: 2110710 - RNA, 10 nt, Staphylococcus aureus subsp. aureus MW2
uucugcuucu

SEQ ID NO: 2110711 - RNA, 23 nt, Staphylococcus aureus subsp. aureus MW2
uucugcuucgugguuaguaagau

SEQ ID NO: 2110712 - RNA, 18 nt, Staphylococcus aureus subsp. aureus MW2
uucuauauaguaaaauaa

SEQ ID NO: 2110713 - RNA, 17 nt, Staphylococcus aureus subsp. aureus MW2
uucuauauaauuuauuu

SEQ ID NO: 2110714 - RNA, 12 nt, Staphylococcus aureus subsp. aureus MW2
uucuauauuaau

SEQ ID NO: 2110715 - RNA, 18 nt, Staphylococcus aureus subsp. aureus MW2
uucuaucugaguaugaua

SEQ ID NO: 2110716 - RNA, 21 nt, Staphylococcus aureus subsp. aureus MW2
uucuaucugaguaugauagaa

SEQ ID NO: 2110717 - RNA, 19 nt, Staphylococcus aureus subsp. aureus MW2
uucucaucuauuuaauaau

SEQ ID NO: 2110718 - RNA, 23 nt, Staphylococcus aureus subsp. aureus MW2
uucucaacaaaucuauaaauauc

SEQ ID NO: 2110719 - RNA, 17 nt, Staphylococcus aureus subsp. aureus MW2
uucucaaauuagauaaa

SEQ ID NO: 2110720 - RNA, 19 nt, Staphylococcus aureus subsp. aureus MW2
uucuaaaaaauuaaaaauu

SEQ ID NO: 2110721 - RNA, 14 nt, Staphylococcus aureus subsp. aureus MW2
uucguuuuaauaau

SEQ ID NO: 2110722 - RNA, 17 nt, Staphylococcus aureus subsp. aureus MW2
uucguuuuguuauugaa

SEQ ID NO: 2110723 - RNA, 22 nt, Staphylococcus aureus subsp. aureus MW2
uucuagcaacugaucauuuuca

SEQ ID NO: 2110724 - RNA, 21 nt, Staphylococcus aureus subsp. aureus MW2
uucuagcaucgauguuaucga

SEQ ID NO: 2110725 - RNA, 20 nt, Staphylococcus aureus subsp. aureus MW2
uucuauacuuuuaauuguau

SEQ ID NO: 2110726 - RNA, 21 nt, Staphylococcus aureus subsp. aureus MW2
uucuauagcacugaaaucuag

SEQ ID NO: 2110727 - RNA, 23 nt, Staphylococcus aureus subsp. aureus MW2
uucuaaagcgauuuccaucauuu

SEQ ID NO: 2110728 - RNA, 18 nt, Staphylococcus aureus subsp. aureus MW2
uucuacuuaguaauaaga

SEQ ID NO: 2110729 - RNA, 16 nt, Staphylococcus aureus subsp. aureus MW2
uucuacugacaaugca

SEQ ID NO: 2110730 - RNA, 23 nt, Staphylococcus aureus subsp. aureus MW2
uugugaugauaauuaaugccauu

SEQ ID NO: 2110731 - RNA, 13 nt, Staphylococcus aureus subsp. aureus MW2
uugugauuuuuug

SEQ ID NO: 2110732 - RNA, 14 nt, Staphylococcus aureus subsp. aureus MW2
uugugcuuuuucau

SEQ ID NO: 2110733 - RNA, 15 nt, Staphylococcus aureus subsp. aureus MW2
uugucuuuuauauuu

SEQ ID NO: 2110734 - RNA, 20 nt, Staphylococcus aureus subsp. aureus MW2
uugucuuacuaauuaaagca

SEQ ID NO: 2110735 - RNA, 14 nt, Staphylococcus aureus subsp. aureus MW2
uugugacaauuuaa

SEQ ID NO: 2110736 - RNA, 18 nt, Staphylococcus aureus subsp. aureus MW2
uugugaaguaaugugcau

SEQ ID NO: 2110737 - RNA, 23 nt, Staphylococcus aureus subsp. aureus MW2
uugucuacaaaguuaaucauaca

SEQ ID NO: 2110738 - RNA, 19 nt, Staphylococcus aureus subsp. aureus MW2
uuguguaucuguaacauaa

SEQ ID NO: 2110739 - RNA, 18 nt, Staphylococcus aureus subsp. aureus MW2
uuguguaucguuuuacuu

SEQ ID NO: 2110740 - RNA, 12 nt, Staphylococcus aureus subsp. aureus MW2
uuguguauuuau

SEQ ID NO: 2110741 - RNA, 24 nt, Staphylococcus aureus subsp. aureus MW2
uuguguauuuuuauuguuuuggcu

SEQ ID NO: 2110742 - RNA, 19 nt, Staphylococcus aureus subsp. aureus MW2
uugugguaaucauguaaug

SEQ ID NO: 2110743 - RNA, 12 nt, Staphylococcus aureus subsp. aureus MW2
uuguguaauaaa

SEQ ID NO: 2110744 - RNA, 12 nt, Staphylococcus aureus subsp. aureus MW2
uuguucagauuu

SEQ ID NO: 2110745 - RNA, 20 nt, Staphylococcus aureus subsp. aureus MW2
uuguucccauuuuuaaaauu

SEQ ID NO: 2110746 - RNA, 20 nt, Staphylococcus aureus subsp. aureus MW2
uuguucaauucagcaaugag

SEQ ID NO: 2110747 - RNA, 22 nt, Staphylococcus aureus subsp. aureus MW2
uuguucaacuaaauuuucuaaa

SEQ ID NO: 2110748 - RNA, 17 nt, Staphylococcus aureus subsp. aureus MW2
uuguucaacuaaauuuu

SEQ ID NO: 2110749 - RNA, 16 nt, Staphylococcus aureus subsp. aureus MW2
uuguuaacgauauugc

SEQ ID NO: 2110750 - RNA, 20 nt, Staphylococcus aureus subsp. aureus MW2
uuguguuuuuaauguuugcu

SEQ ID NO: 2110751 - RNA, 13 nt, Staphylococcus aureus subsp. aureus MW2
uuguguuugcuuu

SEQ ID NO: 2110752 - RNA, 18 nt, Staphylococcus aureus subsp. aureus MW2
uuguguuuuuauuaaucu

SEQ ID NO: 2110753 - RNA, 22 nt, Staphylococcus aureus subsp. aureus MW2
uuuaaaaauaaaaaaccaauaa

SEQ ID NO: 2110754 - RNA, 21 nt, Staphylococcus aureus subsp. aureus MW2
uuuaaaaauagccuucaaaau

SEQ ID NO: 2110755 - RNA, 20 nt, Staphylococcus aureus subsp. aureus MW2
uuuaaaaauaguaaagugaa

SEQ ID NO: 2110756 - RNA, 16 nt, Staphylococcus aureus subsp. aureus MW2
uuuaaaaagucaaaga

SEQ ID NO: 2110757 - RNA, 21 nt, Staphylococcus aureus subsp. aureus MW2
uuuaaaaaguaauuaauuccu

SEQ ID NO: 2110758 - RNA, 20 nt, Staphylococcus aureus subsp. aureus MW2
uuguuuugaauguuucuccu

SEQ ID NO: 2110759 - RNA, 18 nt, Staphylococcus aureus subsp. aureus MW2
uuguuuuaacgaagccua

SEQ ID NO: 2110760 - RNA, 12 nt, Staphylococcus aureus subsp. aureus MW2
uuguuuucacug

SEQ ID NO: 2110761 - RNA, 16 nt, Staphylococcus aureus subsp. aureus MW2
uuguuuuccaauaaua

SEQ ID NO: 2110762 - RNA, 22 nt, Staphylococcus aureus subsp. aureus MW2
uuguugaauaauuaauguuucu

SEQ ID NO: 2110763 - RNA, 21 nt, Staphylococcus aureus subsp. aureus MW2
uuguuugaagugaaaaauuuc

SEQ ID NO: 2110764 - RNA, 22 nt, Staphylococcus aureus subsp. aureus MW2
uuguuugaagugaaaaauuucu

SEQ ID NO: 2110765 - RNA, 12 nt, Staphylococcus aureus subsp. aureus MW2
uuguucggcuuu

SEQ ID NO: 2110766 - RNA, 21 nt, Staphylococcus aureus subsp. aureus MW2
uuguucuccgaucaugccuuc

SEQ ID NO: 2110767 - RNA, 22 nt, Staphylococcus aureus subsp. aureus MW2
uuguucuccgaucaugccuuca

SEQ ID NO: 2110768 - RNA, 20 nt, Staphylococcus aureus subsp. aureus MW2
uuguaaauuuauuuuuaauu

SEQ ID NO: 2110769 - RNA, 15 nt, Staphylococcus aureus subsp. aureus MW2
uuguaaauccuccau

SEQ ID NO: 2110770 - RNA, 18 nt, Staphylococcus aureus subsp. aureus MW2
uuguaaccccauuuuaaa

SEQ ID NO: 2110771 - RNA, 14 nt, Staphylococcus aureus subsp. aureus MW2
uuguaaaagugaau

SEQ ID NO: 2110772 - RNA, 15 nt, Staphylococcus aureus subsp. aureus MW2
uugguuuuuaaaagu

SEQ ID NO: 2110773 - RNA, 17 nt, Staphylococcus aureus subsp. aureus MW2
uugguuuagacaaccag

SEQ ID NO: 2110774 - RNA, 23 nt, Staphylococcus aureus subsp. aureus MW2
uuguaacucuauccaaagacaua

SEQ ID NO: 2110775 - RNA, 21 nt, Staphylococcus aureus subsp. aureus MW2
uuguaagcucaugaaucagau

SEQ ID NO: 2110776 - RNA, 14 nt, Staphylococcus aureus subsp. aureus MW2
uuguaaucauacca

SEQ ID NO: 2110777 - RNA, 16 nt, Staphylococcus aureus subsp. aureus MW2
uuguaauugaaaugau

SEQ ID NO: 2110778 - RNA, 21 nt, Staphylococcus aureus subsp. aureus MW2
uuguacaaaaaauuguaaguc

SEQ ID NO: 2110779 - RNA, 23 nt, Staphylococcus aureus subsp. aureus MW2
uuguagggaguauuguuuuauau

SEQ ID NO: 2110780 - RNA, 20 nt, Staphylococcus aureus subsp. aureus MW2
uuguauaaaaauguauuaaa

SEQ ID NO: 2110781 - RNA, 16 nt, Staphylococcus aureus subsp. aureus MW2
uuguacuucuuugguc

SEQ ID NO: 2110782 - RNA, 18 nt, Staphylococcus aureus subsp. aureus MW2
uuguacaucauuaaauau

SEQ ID NO: 2110783 - RNA, 19 nt, Staphylococcus aureus subsp. aureus MW2
uuguacaucauuaaauauu

SEQ ID NO: 2110784 - RNA, 16 nt, Staphylococcus aureus subsp. aureus MW2
uuguacauauguguau

SEQ ID NO: 2110785 - RNA, 14 nt, Staphylococcus aureus subsp. aureus MW2
uuguaccaaugaau

SEQ ID NO: 2110786 - RNA, 23 nt, Staphylococcus aureus subsp. aureus MW2
uuguacaguaauauucaacuugu

SEQ ID NO: 2110787 - RNA, 14 nt, Staphylococcus aureus subsp. aureus MW2
uuguacaaucaaag

SEQ ID NO: 2110788 - RNA, 20 nt, Staphylococcus aureus subsp. aureus MW2
uugucaguuuuuuuauaagc

SEQ ID NO: 2110789 - RNA, 22 nt, Staphylococcus aureus subsp. aureus MW2
uugucaguaacuuugucuguau

SEQ ID NO: 2110790 - RNA, 19 nt, Staphylococcus aureus subsp. aureus MW2
uugucacgauagauuuauc

SEQ ID NO: 2110791 - RNA, 22 nt, Staphylococcus aureus subsp. aureus MW2
uugucacaggcugggacauaaa

SEQ ID NO: 2110792 - RNA, 21 nt, Staphylococcus aureus subsp. aureus MW2
uugucaaaauugaacuuugua

SEQ ID NO: 2110793 - RNA, 14 nt, Staphylococcus aureus subsp. aureus MW2
uuguauuuaaaauc

SEQ ID NO: 2110794 - RNA, 20 nt, Staphylococcus aureus subsp. aureus MW2
uuguauuauuauuauguuaa

SEQ ID NO: 2110795 - RNA, 18 nt, Staphylococcus aureus subsp. aureus MW2
uuguauuuaauaaguuaa

SEQ ID NO: 2110796 - RNA, 15 nt, Staphylococcus aureus subsp. aureus MW2
uuguauuaaucaaau

SEQ ID NO: 2110797 - RNA, 22 nt, Staphylococcus aureus subsp. aureus MW2
uuguauuaaucaaauauuuuau

SEQ ID NO: 2110798 - RNA, 22 nt, Staphylococcus aureus subsp. aureus MW2
uuguauagauuguauuuaauaa

SEQ ID NO: 2110799 - RNA, 17 nt, Staphylococcus aureus subsp. aureus MW2
uuguauagaauguguau

SEQ ID NO: 2110800 - RNA, 18 nt, Staphylococcus aureus subsp. aureus MW2
uuguauagaauguguaug

SEQ ID NO: 2110801 - RNA, 15 nt, Staphylococcus aureus subsp. aureus MW2
uuguaguauuuuuug

SEQ ID NO: 2110802 - RNA, 16 nt, Staphylococcus aureus subsp. aureus MW2
uuguaucaacauuaau

SEQ ID NO: 2110803 - RNA, 23 nt, Staphylococcus aureus subsp. aureus MW2
uuguccuuuaagaacauaaccua

SEQ ID NO: 2110804 - RNA, 20 nt, Staphylococcus aureus subsp. aureus MW2
uuguccuaacgcuaauuuua

SEQ ID NO: 2110805 - RNA, 19 nt, Staphylococcus aureus subsp. aureus MW2
uuguccguucgcaucuuug

SEQ ID NO: 2110806 - RNA, 17 nt, Staphylococcus aureus subsp. aureus MW2
uuguccaugccuuaugu

SEQ ID NO: 2110807 - RNA, 14 nt, Staphylococcus aureus subsp. aureus MW2
uuguccaugccuua

SEQ ID NO: 2110808 - RNA, 14 nt, Staphylococcus aureus subsp. aureus MW2
uugucaugccuuca

SEQ ID NO: 2110809 - RNA, 13 nt, Staphylococcus aureus subsp. aureus MW2
uugucaugccuuc

SEQ ID NO: 2110810 - RNA, 15 nt, Staphylococcus aureus subsp. aureus MW2
uuuaagcuuaucaac

SEQ ID NO: 2110811 - RNA, 12 nt, Staphylococcus aureus subsp. aureus MW2
uuuaagcugcuc

SEQ ID NO: 2110812 - RNA, 19 nt, Staphylococcus aureus subsp. aureus MW2
uuuaagugaugaccaauau

SEQ ID NO: 2110813 - RNA, 18 nt, Staphylococcus aureus subsp. aureus MW2
uuuaagauagguuuauuu

SEQ ID NO: 2110814 - RNA, 15 nt, Staphylococcus aureus subsp. aureus MW2
uuuaaaacaaugauu

SEQ ID NO: 2110815 - RNA, 21 nt, Staphylococcus aureus subsp. aureus MW2
uuuaauaauguaucauuucag

SEQ ID NO: 2110816 - RNA, 21 nt, Staphylococcus aureus subsp. aureus MW2
uuuaauacuauaguaagaaaa

SEQ ID NO: 2110817 - RNA, 17 nt, Staphylococcus aureus subsp. aureus MW2
uuuaauagguucuucuu

SEQ ID NO: 2110818 - RNA, 19 nt, Staphylococcus aureus subsp. aureus MW2
uuuaauagguucuucuuuc

SEQ ID NO: 2110819 - RNA, 16 nt, Staphylococcus aureus subsp. aureus MW2
uuuaauacuaauaacu

SEQ ID NO: 2110820 - RNA, 15 nt, Staphylococcus aureus subsp. aureus MW2
uuuaauagcuuguuu

SEQ ID NO: 2110821 - RNA, 16 nt, Staphylococcus aureus subsp. aureus MW2
uuuaauauuuuuauca

SEQ ID NO: 2110822 - RNA, 18 nt, Staphylococcus aureus subsp. aureus MW2
uuuaauauuuuuaucauc

SEQ ID NO: 2110823 - RNA, 19 nt, Staphylococcus aureus subsp. aureus MW2
uuuaauauuugauaacaaa

SEQ ID NO: 2110824 - RNA, 16 nt, Staphylococcus aureus subsp. aureus MW2
uuuaauauuuuuuuca

SEQ ID NO: 2110825 - RNA, 18 nt, Staphylococcus aureus subsp. aureus MW2
uuuaauauugaauaaaaa

SEQ ID NO: 2110826 - RNA, 21 nt, Staphylococcus aureus subsp. aureus MW2
uuuaaucguauuagccaauaa

SEQ ID NO: 2110827 - RNA, 16 nt, Staphylococcus aureus subsp. aureus MW2
uuuaaucuguauguaa

SEQ ID NO: 2110828 - RNA, 13 nt, Staphylococcus aureus subsp. aureus MW2
uuuaaugaaguaa

SEQ ID NO: 2110829 - RNA, 18 nt, Staphylococcus aureus subsp. aureus MW2
uuuagaaaaggauuauag

SEQ ID NO: 2110830 - RNA, 18 nt, Staphylococcus aureus subsp. aureus MW2
uuuagaaagaauacaguu

SEQ ID NO: 2110831 - RNA, 21 nt, Staphylococcus aureus subsp. aureus MW2
uuuacuugcuuuuucaaauaa

SEQ ID NO: 2110832 - RNA, 17 nt, Staphylococcus aureus subsp. aureus MW2
uuuacuuacuuuucuaa

SEQ ID NO: 2110833 - RNA, 13 nt, Staphylococcus aureus subsp. aureus MW2
uuuacuucauaag

SEQ ID NO: 2110834 - RNA, 15 nt, Staphylococcus aureus subsp. aureus MW2
uuuacgugcauugua

SEQ ID NO: 2110835 - RNA, 16 nt, Staphylococcus aureus subsp. aureus MW2
uuuacguucugauuca

SEQ ID NO: 2110836 - RNA, 14 nt, Staphylococcus aureus subsp. aureus MW2
uuuacauucguuua

SEQ ID NO: 2110837 - RNA, 21 nt, Staphylococcus aureus subsp. aureus MW2
uuuacauuuaacauuucaauu

SEQ ID NO: 2110838 - RNA, 20 nt, Staphylococcus aureus subsp. aureus MW2
uuuaccucuugauaaaauaa

SEQ ID NO: 2110839 - RNA, 13 nt, Staphylococcus aureus subsp. aureus MW2
uuuaccuucaucu

SEQ ID NO: 2110840 - RNA, 15 nt, Staphylococcus aureus subsp. aureus MW2
uuuacgcuuacuuau

SEQ ID NO: 2110841 - RNA, 15 nt, Staphylococcus aureus subsp. aureus MW2
uuuacggauuuuucu

SEQ ID NO: 2110842 - RNA, 17 nt, Staphylococcus aureus subsp. aureus MW2
uuuacggauuuuucuca

SEQ ID NO: 2110843 - RNA, 17 nt, Staphylococcus aureus subsp. aureus MW2
uuuacaucuauccuugu

SEQ ID NO: 2110844 - RNA, 17 nt, Staphylococcus aureus subsp. aureus MW2
uuuaaugggauuucuac

SEQ ID NO: 2110845 - RNA, 19 nt, Staphylococcus aureus subsp. aureus MW2
uuuacacgucuaauuuuaa

SEQ ID NO: 2110846 - RNA, 16 nt, Staphylococcus aureus subsp. aureus MW2
uuuaauguuaaacaau

SEQ ID NO: 2110847 - RNA, 11 nt, Staphylococcus aureus subsp. aureus MW2
uuuaauguuau

SEQ ID NO: 2110848 - RNA, 14 nt, Staphylococcus aureus subsp. aureus MW2
uuuauucuucaguu

SEQ ID NO: 2110849 - RNA, 12 nt, Staphylococcus aureus subsp. aureus MW2
uuuauuacuuau

SEQ ID NO: 2110850 - RNA, 21 nt, Staphylococcus aureus subsp. aureus MW2
uuuauugagcuuuguuugaaa

SEQ ID NO: 2110851 - RNA, 16 nt, Staphylococcus aureus subsp. aureus MW2
uuuauuggguaauauu

SEQ ID NO: 2110852 - RNA, 21 nt, Staphylococcus aureus subsp. aureus MW2
uuuauuuuugaaaaaaauuuu

SEQ ID NO: 2110853 - RNA, 20 nt, Staphylococcus aureus subsp. aureus MW2
uuuauuuaacacuucaguua

SEQ ID NO: 2110854 - RNA, 13 nt, Staphylococcus aureus subsp. aureus MW2
uuuauuuaacacu

SEQ ID NO: 2110855 - RNA, 21 nt, Staphylococcus aureus subsp. aureus MW2
uuuaugguguggugugaugua

SEQ ID NO: 2110856 - RNA, 22 nt, Staphylococcus aureus subsp. aureus MW2
uuuauguauaucuuuauuuuuu

SEQ ID NO: 2110857 - RNA, 13 nt, Staphylococcus aureus subsp. aureus MW2
uuuaugguguggu

SEQ ID NO: 2110858 - RNA, 17 nt, Staphylococcus aureus subsp. aureus MW2
uuuauggugcuaaaaaa

SEQ ID NO: 2110859 - RNA, 21 nt, Staphylococcus aureus subsp. aureus MW2
uuuauggucuugaguacuaau

SEQ ID NO: 2110860 - RNA, 17 nt, Staphylococcus aureus subsp. aureus MW2
uuuauguuuuaauuucu

SEQ ID NO: 2110861 - RNA, 19 nt, Staphylococcus aureus subsp. aureus MW2
uuuaugugguuuugauuaa

SEQ ID NO: 2110862 - RNA, 12 nt, Staphylococcus aureus subsp. aureus MW2
uuuauuaaauaa

SEQ ID NO: 2110863 - RNA, 21 nt, Staphylococcus aureus subsp. aureus MW2
uuuauuaaaucguauauuaaa

SEQ ID NO: 2110864 - RNA, 16 nt, Staphylococcus aureus subsp. aureus MW2
uuuauuaauucugauu

SEQ ID NO: 2110865 - RNA, 18 nt, Staphylococcus aureus subsp. aureus MW2
uuuauguuuuaauuucuu

SEQ ID NO: 2110866 - RNA, 18 nt, Staphylococcus aureus subsp. aureus MW2
uuuauuaauaaauucucu

SEQ ID NO: 2110867 - RNA, 15 nt, Staphylococcus aureus subsp. aureus MW2
uuuaucuauuucuau

SEQ ID NO: 2110868 - RNA, 18 nt, Staphylococcus aureus subsp. aureus MW2
uuuaucgaucgguauuuu

SEQ ID NO: 2110869 - RNA, 20 nt, Staphylococcus aureus subsp. aureus MW2
uuuaugacaaaguucugcaa

SEQ ID NO: 2110870 - RNA, 16 nt, Staphylococcus aureus subsp. aureus MW2
uuuaugacaaaguucu

SEQ ID NO: 2110871 - RNA, 22 nt, Staphylococcus aureus subsp. aureus MW2
uuuaugagcuucuuuaaauaca

SEQ ID NO: 2110872 - RNA, 20 nt, Staphylococcus aureus subsp. aureus MW2
uuuauccaaaccaauuuuaa

SEQ ID NO: 2110873 - RNA, 22 nt, Staphylococcus aureus subsp. aureus MW2
uuuauccaagucuaaaugcaau

SEQ ID NO: 2110874 - RNA, 13 nt, Staphylococcus aureus subsp. aureus MW2
uuuaucauuauuu

SEQ ID NO: 2110875 - RNA, 20 nt, Staphylococcus aureus subsp. aureus MW2
uuuaucauuauuugauaaau

SEQ ID NO: 2110876 - RNA, 19 nt, Staphylococcus aureus subsp. aureus MW2
uuuaucaugaugauaaauu

SEQ ID NO: 2110877 - RNA, 14 nt, Staphylococcus aureus subsp. aureus MW2
uuuaucauaucuau

SEQ ID NO: 2110878 - RNA, 20 nt, Staphylococcus aureus subsp. aureus MW2
uuuauccgucgaauauaauu

SEQ ID NO: 2110879 - RNA, 18 nt, Staphylococcus aureus subsp. aureus MW2
uuuauccgucgaauauaa

SEQ ID NO: 2110880 - RNA, 15 nt, Staphylococcus aureus subsp. aureus MW2
uuuauauuuuaagau

SEQ ID NO: 2110881 - RNA, 16 nt, Staphylococcus aureus subsp. aureus MW2
uuuauauuuuaagaua

SEQ ID NO: 2110882 - RNA, 23 nt, Staphylococcus aureus subsp. aureus MW2
uuuauauuuuaguucacaugaau

SEQ ID NO: 2110883 - RNA, 20 nt, Staphylococcus aureus subsp. aureus MW2
uuuauauggaauacuacacu

SEQ ID NO: 2110884 - RNA, 17 nt, Staphylococcus aureus subsp. aureus MW2
uuuauauuuuuaucauc

SEQ ID NO: 2110885 - RNA, 16 nt, Staphylococcus aureus subsp. aureus MW2
uuuauauuauuucaau

SEQ ID NO: 2110886 - RNA, 16 nt, Staphylococcus aureus subsp. aureus MW2
uuuaucaacaaauuuu

SEQ ID NO: 2110887 - RNA, 14 nt, Staphylococcus aureus subsp. aureus MW2
uuuaucaauuucua

SEQ ID NO: 2110888 - RNA, 17 nt, Staphylococcus aureus subsp. aureus MW2
uuuaucaacaaauuuaa

SEQ ID NO: 2110889 - RNA, 21 nt, Staphylococcus aureus subsp. aureus MW2
uuuaucaauuucuauuucacu

SEQ ID NO: 2110890 - RNA, 18 nt, Staphylococcus aureus subsp. aureus MW2
uuuaucaccauaaaaaua

SEQ ID NO: 2110891 - RNA, 21 nt, Staphylococcus aureus subsp. aureus MW2
uuuaucaccauaaaaauagaa

SEQ ID NO: 2110892 - RNA, 19 nt, Staphylococcus aureus subsp. aureus MW2
uuuagagccccuuacaacu

SEQ ID NO: 2110893 - RNA, 22 nt, Staphylococcus aureus subsp. aureus MW2
uuuagagauuguaagaauuaau

SEQ ID NO: 2110894 - RNA, 17 nt, Staphylococcus aureus subsp. aureus MW2
uuuagacauuaaaaaau

SEQ ID NO: 2110895 - RNA, 15 nt, Staphylococcus aureus subsp. aureus MW2
uuuagacaauauuuu

SEQ ID NO: 2110896 - RNA, 16 nt, Staphylococcus aureus subsp. aureus MW2
uuuagauauaauaaaa

SEQ ID NO: 2110897 - RNA, 17 nt, Staphylococcus aureus subsp. aureus MW2
uuuagauucuuuucuga

SEQ ID NO: 2110898 - RNA, 22 nt, Staphylococcus aureus subsp. aureus MW2
uuuagcauacauuaagcuaugc

SEQ ID NO: 2110899 - RNA, 21 nt, Staphylococcus aureus subsp. aureus MW2
uuuagcaacaguauuugccuu

SEQ ID NO: 2110900 - RNA, 13 nt, Staphylococcus aureus subsp. aureus MW2
uuuauacauaaau

SEQ ID NO: 2110901 - RNA, 16 nt, Staphylococcus aureus subsp. aureus MW2
uuuauaauuggaauaa

SEQ ID NO: 2110902 - RNA, 14 nt, Staphylococcus aureus subsp. aureus MW2
uuuauaauuuaauu

SEQ ID NO: 2110903 - RNA, 17 nt, Staphylococcus aureus subsp. aureus MW2
uuuauacaauuuuuugg

SEQ ID NO: 2110904 - RNA, 17 nt, Staphylococcus aureus subsp. aureus MW2
uuuauauauagaaauaa

SEQ ID NO: 2110905 - RNA, 22 nt, Staphylococcus aureus subsp. aureus MW2
uuuauaucuuaaguacauaaau

SEQ ID NO: 2110906 - RNA, 15 nt, Staphylococcus aureus subsp. aureus MW2
uuuauauuaaauaaa

SEQ ID NO: 2110907 - RNA, 13 nt, Staphylococcus aureus subsp. aureus MW2
uuuauaugaugaa

SEQ ID NO: 2110908 - RNA, 15 nt, Staphylococcus aureus subsp. aureus MW2
uuuauaauaaauguc

SEQ ID NO: 2110909 - RNA, 22 nt, Staphylococcus aureus subsp. aureus MW2
uuuauaagccuuuucaaacaua

SEQ ID NO: 2110910 - RNA, 18 nt, Staphylococcus aureus subsp. aureus MW2
uuuauaacauuuaagaaa

SEQ ID NO: 2110911 - RNA, 13 nt, Staphylococcus aureus subsp. aureus MW2
uucuugaaaacaa

SEQ ID NO: 2110912 - RNA, 15 nt, Staphylococcus aureus subsp. aureus MW2
uucuugaaauaaaca

SEQ ID NO: 2110913 - RNA, 13 nt, Staphylococcus aureus subsp. aureus MW2
uucuuguucuaaa

SEQ ID NO: 2110914 - RNA, 19 nt, Staphylococcus aureus subsp. aureus MW2
uugagcuaaccacaucauu

SEQ ID NO: 2110915 - RNA, 22 nt, Staphylococcus aureus subsp. aureus MW2
uugagcaucuugucuaguucga

SEQ ID NO: 2110916 - RNA, 19 nt, Staphylococcus aureus subsp. aureus MW2
uugaguacuaaucaauacu

SEQ ID NO: 2110917 - RNA, 17 nt, Staphylococcus aureus subsp. aureus MW2
uugaguccauucgacuc

SEQ ID NO: 2110918 - RNA, 21 nt, Staphylococcus aureus subsp. aureus MW2
uugaguguguccaucauuugu

SEQ ID NO: 2110919 - RNA, 13 nt, Staphylococcus aureus subsp. aureus MW2
uugauaagucuug

SEQ ID NO: 2110920 - RNA, 18 nt, Staphylococcus aureus subsp. aureus MW2
uugaguugaaaauaaucg

SEQ ID NO: 2110921 - RNA, 23 nt, Staphylococcus aureus subsp. aureus MW2
uugauaaugcuacuauuaaauaa

SEQ ID NO: 2110922 - RNA, 18 nt, Staphylococcus aureus subsp. aureus MW2
uugauaauguaaaaugau

SEQ ID NO: 2110923 - RNA, 19 nt, Staphylococcus aureus subsp. aureus MW2
uugauaauguaaaaugaug

SEQ ID NO: 2110924 - RNA, 14 nt, Staphylococcus aureus subsp. aureus MW2
uugauguguugcau

SEQ ID NO: 2110925 - RNA, 15 nt, Staphylococcus aureus subsp. aureus MW2
uugauguaauucugu

SEQ ID NO: 2110926 - RNA, 14 nt, Staphylococcus aureus subsp. aureus MW2
uugauuaaaagugu

SEQ ID NO: 2110927 - RNA, 15 nt, Staphylococcus aureus subsp. aureus MW2
uugauuaaaaguguu

SEQ ID NO: 2110928 - RNA, 12 nt, Staphylococcus aureus subsp. aureus MW2
uugauuaaacug

SEQ ID NO: 2110929 - RNA, 18 nt, Staphylococcus aureus subsp. aureus MW2
uugauguucuugaaaaca

SEQ ID NO: 2110930 - RNA, 15 nt, Staphylococcus aureus subsp. aureus MW2
uugaugucacauaug

SEQ ID NO: 2110931 - RNA, 19 nt, Staphylococcus aureus subsp. aureus MW2
uugauuaacacaauccuuu

SEQ ID NO: 2110932 - RNA, 18 nt, Staphylococcus aureus subsp. aureus MW2
uugauuauucuuuaauua

SEQ ID NO: 2110933 - RNA, 19 nt, Staphylococcus aureus subsp. aureus MW2
uugauuauucuuuaauuaa

SEQ ID NO: 2110934 - RNA, 15 nt, Staphylococcus aureus subsp. aureus MW2
uugauuauguaaauu

SEQ ID NO: 2110935 - RNA, 17 nt, Staphylococcus aureus subsp. aureus MW2
uugauuuagcauacauu

SEQ ID NO: 2110936 - RNA, 13 nt, Staphylococcus aureus subsp. aureus MW2
uugauuucauuug

SEQ ID NO: 2110937 - RNA, 15 nt, Staphylococcus aureus subsp. aureus MW2
uugauagacuaauua

SEQ ID NO: 2110938 - RNA, 22 nt, Staphylococcus aureus subsp. aureus MW2
uugauacguaaacacuuuagua

SEQ ID NO: 2110939 - RNA, 22 nt, Staphylococcus aureus subsp. aureus MW2
uugauagugguagccaauauca

SEQ ID NO: 2110940 - RNA, 11 nt, Staphylococcus aureus subsp. aureus MW2
uugauagucac

SEQ ID NO: 2110941 - RNA, 23 nt, Staphylococcus aureus subsp. aureus MW2
uugauauagucaaugaauaauga

SEQ ID NO: 2110942 - RNA, 17 nt, Staphylococcus aureus subsp. aureus MW2
uugauaguuuuauaauu

SEQ ID NO: 2110943 - RNA, 15 nt, Staphylococcus aureus subsp. aureus MW2
uugauagcuaaugca

SEQ ID NO: 2110944 - RNA, 22 nt, Staphylococcus aureus subsp. aureus MW2
uugauaguaaucucucgcuaaa

SEQ ID NO: 2110945 - RNA, 19 nt, Staphylococcus aureus subsp. aureus MW2
uugauaguagcuuaaugca

SEQ ID NO: 2110946 - RNA, 18 nt, Staphylococcus aureus subsp. aureus MW2
uugaucgauuguuuauua

SEQ ID NO: 2110947 - RNA, 16 nt, Staphylococcus aureus subsp. aureus MW2
uugaucuuugacaugu

SEQ ID NO: 2110948 - RNA, 13 nt, Staphylococcus aureus subsp. aureus MW2
uugaucugugcuu

SEQ ID NO: 2110949 - RNA, 13 nt, Staphylococcus aureus subsp. aureus MW2
uugaucuuuaaau

SEQ ID NO: 2110950 - RNA, 14 nt, Staphylococcus aureus subsp. aureus MW2
uugauuuucuaaag

SEQ ID NO: 2110951 - RNA, 19 nt, Staphylococcus aureus subsp. aureus MW2
uugcaugacagcaaauuuu

SEQ ID NO: 2110952 - RNA, 14 nt, Staphylococcus aureus subsp. aureus MW2
uugcauugauuuca

SEQ ID NO: 2110953 - RNA, 14 nt, Staphylococcus aureus subsp. aureus MW2
uugcauuguauaug

SEQ ID NO: 2110954 - RNA, 21 nt, Staphylococcus aureus subsp. aureus MW2
uugcauuagaucauacauuag

SEQ ID NO: 2110955 - RNA, 19 nt, Staphylococcus aureus subsp. aureus MW2
uugcauacguaaaugguaa

SEQ ID NO: 2110956 - RNA, 19 nt, Staphylococcus aureus subsp. aureus MW2
uugcauacgaauuaaaaua

SEQ ID NO: 2110957 - RNA, 21 nt, Staphylococcus aureus subsp. aureus MW2
uugcauaaucaauuucaccuu

SEQ ID NO: 2110958 - RNA, 22 nt, Staphylococcus aureus subsp. aureus MW2
uugcauauccuucaaagauuuu

SEQ ID NO: 2110959 - RNA, 16 nt, Staphylococcus aureus subsp. aureus MW2
uugcaugaaaauuaaa

SEQ ID NO: 2110960 - RNA, 23 nt, Staphylococcus aureus subsp. aureus MW2
uugcaugaaaauuaaaaaaugcu

SEQ ID NO: 2110961 - RNA, 16 nt, Staphylococcus aureus subsp. aureus MW2
uugccuuuugaauaau

SEQ ID NO: 2110962 - RNA, 20 nt, Staphylococcus aureus subsp. aureus MW2
uugccaucaauuucuguaau

SEQ ID NO: 2110963 - RNA, 12 nt, Staphylococcus aureus subsp. aureus MW2
uuggaagucugc

SEQ ID NO: 2110964 - RNA, 17 nt, Staphylococcus aureus subsp. aureus MW2
uuggaaguauuuaugag

SEQ ID NO: 2110965 - RNA, 18 nt, Staphylococcus aureus subsp. aureus MW2
uuggaaauuuauuauaaa

SEQ ID NO: 2110966 - RNA, 18 nt, Staphylococcus aureus subsp. aureus MW2
uuggaacauauucauaau

SEQ ID NO: 2110967 - RNA, 13 nt, Staphylococcus aureus subsp. aureus MW2
uugcuuuuuacua

SEQ ID NO: 2110968 - RNA, 14 nt, Staphylococcus aureus subsp. aureus MW2
uuggaaaaauugug

SEQ ID NO: 2110969 - RNA, 22 nt, Staphylococcus aureus subsp. aureus MW2
uuggacaaauucuaugagaaua

SEQ ID NO: 2110970 - RNA, 14 nt, Staphylococcus aureus subsp. aureus MW2
uuggaauagauguu

SEQ ID NO: 2110971 - RNA, 14 nt, Staphylococcus aureus subsp. aureus MW2
uuggaaucaucuuu

SEQ ID NO: 2110972 - RNA, 15 nt, Staphylococcus aureus subsp. aureus MW2
uuggcacauaaauca

SEQ ID NO: 2110973 - RNA, 17 nt, Staphylococcus aureus subsp. aureus MW2
uuggcacauaaaucaau

SEQ ID NO: 2110974 - RNA, 18 nt, Staphylococcus aureus subsp. aureus MW2
uuggauaauuucuucuuc

SEQ ID NO: 2110975 - RNA, 17 nt, Staphylococcus aureus subsp. aureus MW2
uuggauagguaacuaaa

SEQ ID NO: 2110976 - RNA, 21 nt, Staphylococcus aureus subsp. aureus MW2
uuggauagguaacuaaaaugu

SEQ ID NO: 2110977 - RNA, 19 nt, Staphylococcus aureus subsp. aureus MW2
uugcuuguacgauaacuac

SEQ ID NO: 2110978 - RNA, 17 nt, Staphylococcus aureus subsp. aureus MW2
uugcuuggauaauugca

SEQ ID NO: 2110979 - RNA, 13 nt, Staphylococcus aureus subsp. aureus MW2
uugcuugaaauua

SEQ ID NO: 2110980 - RNA, 17 nt, Staphylococcus aureus subsp. aureus MW2
uugcuucuuaucaacaa

SEQ ID NO: 2110981 - RNA, 21 nt, Staphylococcus aureus subsp. aureus MW2
uugcuuuaauuugauuaaauu

SEQ ID NO: 2110982 - RNA, 14 nt, Staphylococcus aureus subsp. aureus MW2
uugcuuuaauuuga

SEQ ID NO: 2110983 - RNA, 13 nt, Staphylococcus aureus subsp. aureus MW2
uugcuuuaauuug

SEQ ID NO: 2110984 - RNA, 16 nt, Staphylococcus aureus subsp. aureus MW2
uugcuuuagcucuuuu

SEQ ID NO: 2110985 - RNA, 20 nt, Staphylococcus aureus subsp. aureus MW2
uugcuuuuauuuuuaauguu

SEQ ID NO: 2110986 - RNA, 22 nt, Staphylococcus aureus subsp. aureus MW2
uugcuuaaaccuuaauaaugaa

SEQ ID NO: 2110987 - RNA, 19 nt, Staphylococcus aureus subsp. aureus MW2
uugcuguuuaguuaaugua

SEQ ID NO: 2110988 - RNA, 17 nt, Staphylococcus aureus subsp. aureus MW2
uugcuguccaucgucau

SEQ ID NO: 2110989 - RNA, 18 nt, Staphylococcus aureus subsp. aureus MW2
uugcuucauaaauguuag

SEQ ID NO: 2110990 - RNA, 16 nt, Staphylococcus aureus subsp. aureus MW2
uugcgguuggcucuuu

SEQ ID NO: 2110991 - RNA, 21 nt, Staphylococcus aureus subsp. aureus MW2
uugcuaaccaucauaaauguu

SEQ ID NO: 2110992 - RNA, 16 nt, Staphylococcus aureus subsp. aureus MW2
uugcuauauuaguaua

SEQ ID NO: 2110993 - RNA, 20 nt, Staphylococcus aureus subsp. aureus MW2
uugcuagucauaauuuagaa

SEQ ID NO: 2110994 - RNA, 21 nt, Staphylococcus aureus subsp. aureus MW2
uugcuaaugcuaguaacuuau

SEQ ID NO: 2110995 - RNA, 21 nt, Staphylococcus aureus subsp. aureus MW2
uugcugcuguacaauuucgcu

SEQ ID NO: 2110996 - RNA, 22 nt, Staphylococcus aureus subsp. aureus MW2
uugcuguaugacaggcguguug

SEQ ID NO: 2110997 - RNA, 15 nt, Staphylococcus aureus subsp. aureus MW2
uuggcggggccccaa

SEQ ID NO: 2110998 - RNA, 18 nt, Staphylococcus aureus subsp. aureus MW2
uuggcguauuuuuuguuc

SEQ ID NO: 2110999 - RNA, 15 nt, Staphylococcus aureus subsp. aureus MW2
uugggaauugaccac

SEQ ID NO: 2111000 - RNA, 14 nt, Staphylococcus aureus subsp. aureus MW2
uugggcaacuuuug

SEQ ID NO: 2111001 - RNA, 19 nt, Staphylococcus aureus subsp. aureus MW2
uuggcauuagcuucuacuu

SEQ ID NO: 2111002 - RNA, 18 nt, Staphylococcus aureus subsp. aureus MW2
uuggggugagggccccaa

SEQ ID NO: 2111003 - RNA, 18 nt, Staphylococcus aureus subsp. aureus MW2
uuggggugugggccccaa

SEQ ID NO: 2111004 - RNA, 20 nt, Staphylococcus aureus subsp. aureus MW2
uuggggccccgacuauuuuu

SEQ ID NO: 2111005 - RNA, 20 nt, Staphylococcus aureus subsp. aureus MW2
uugguaagcuaauuucuaau

SEQ ID NO: 2111006 - RNA, 18 nt, Staphylococcus aureus subsp. aureus MW2
uugguaauugaucuaaau

SEQ ID NO: 2111007 - RNA, 20 nt, Staphylococcus aureus subsp. aureus MW2
uugguaaaaaucucaaaauu

SEQ ID NO: 2111008 - RNA, 20 nt, Staphylococcus aureus subsp. aureus MW2
uugguauuuauccugaccaa

SEQ ID NO: 2111009 - RNA, 14 nt, Staphylococcus aureus subsp. aureus MW2
uugguaggcauuuu

SEQ ID NO: 2111010 - RNA, 14 nt, Staphylococcus aureus subsp. aureus MW2
uugguuacuuagua

SEQ ID NO: 2111011 - RNA, 21 nt, Staphylococcus aureus subsp. aureus MW2
uugguuacgugaccuuuguaa

SEQ ID NO: 2111012 - RNA, 15 nt, Staphylococcus aureus subsp. aureus MW2
uugguugaacuguuu

SEQ ID NO: 2111013 - RNA, 19 nt, Staphylococcus aureus subsp. aureus MW2
uuggucaccuacagauaaa

SEQ ID NO: 2111014 - RNA, 16 nt, Staphylococcus aureus subsp. aureus MW2
uuggucaaguaaaugu

SEQ ID NO: 2111015 - RNA, 23 nt, Staphylococcus aureus subsp. aureus MW2
uuggugccgaaauuguucuaaua

SEQ ID NO: 2111016 - RNA, 19 nt, Staphylococcus aureus subsp. aureus MW2
uuggugaguguuucauaau

SEQ ID NO: 2111017 - RNA, 19 nt, Staphylococcus aureus subsp. aureus MW2
uuggucuaucguuuuagcu

SEQ ID NO: 2111018 - RNA, 16 nt, Staphylococcus aureus subsp. aureus MW2
aauaauuagauuuaaa

SEQ ID NO: 2111019 - RNA, 12 nt, Staphylococcus aureus subsp. aureus MW2
aauaauuaaaua

SEQ ID NO: 2111020 - RNA, 23 nt, Staphylococcus aureus subsp. aureus MW2
aauaauguuuccugauauuucaa

SEQ ID NO: 2111021 - RNA, 16 nt, Staphylococcus aureus subsp. aureus MW2
aauaauuaaacaaaac

SEQ ID NO: 2111022 - RNA, 20 nt, Staphylococcus aureus subsp. aureus MW2
aauaauuaaacaaaacuuaa

SEQ ID NO: 2111023 - RNA, 23 nt, Staphylococcus aureus subsp. aureus MW2
aauaaugggaauuguauuagcaa

SEQ ID NO: 2111024 - RNA, 11 nt, Staphylococcus aureus subsp. aureus MW2
aauaauguuuc

SEQ ID NO: 2111025 - RNA, 17 nt, Staphylococcus aureus subsp. aureus MW2
aauaauguuuccauuua

SEQ ID NO: 2111026 - RNA, 18 nt, Staphylococcus aureus subsp. aureus MW2
aauaaugugcaaguuggc

SEQ ID NO: 2111027 - RNA, 13 nt, Staphylococcus aureus subsp. aureus MW2
aauaauucuuuua

SEQ ID NO: 2111028 - RNA, 14 nt, Staphylococcus aureus subsp. aureus MW2
aauaauugaugaaa

SEQ ID NO: 2111029 - RNA, 17 nt, Staphylococcus aureus subsp. aureus MW2
aauaauuggaaucaucu

SEQ ID NO: 2111030 - RNA, 16 nt, Staphylococcus aureus subsp. aureus MW2
aauaauugagaaaaag

SEQ ID NO: 2111031 - RNA, 20 nt, Staphylococcus aureus subsp. aureus MW2
aauaauuggaaucaucuuuu

SEQ ID NO: 2111032 - RNA, 19 nt, Staphylococcus aureus subsp. aureus MW2
aauaauugcuuuagaaagu

SEQ ID NO: 2111033 - RNA, 14 nt, Staphylococcus aureus subsp. aureus MW2
aauaauuuaaauua

SEQ ID NO: 2111034 - RNA, 18 nt, Staphylococcus aureus subsp. aureus MW2
aauaauuuaaauuaaaau

SEQ ID NO: 2111035 - RNA, 20 nt, Staphylococcus aureus subsp. aureus MW2
aauaauuuaauguugcaaaa

SEQ ID NO: 2111036 - RNA, 17 nt, Staphylococcus aureus subsp. aureus MW2
aauaauuggcugaugaa

SEQ ID NO: 2111037 - RNA, 18 nt, Staphylococcus aureus subsp. aureus MW2
aauaauucauaaaugcuu

SEQ ID NO: 2111038 - RNA, 19 nt, Staphylococcus aureus subsp. aureus MW2
aauaauucauaaaugcuuc

SEQ ID NO: 2111039 - RNA, 17 nt, Staphylococcus aureus subsp. aureus MW2
aauaauuagauuuaaaa

SEQ ID NO: 2111040 - RNA, 19 nt, Staphylococcus aureus subsp. aureus MW2
aauaauuagucauugaaaa

SEQ ID NO: 2111041 - RNA, 20 nt, Staphylococcus aureus subsp. aureus MW2
aauaaucgguaauuacuugu

SEQ ID NO: 2111042 - RNA, 21 nt, Staphylococcus aureus subsp. aureus MW2
aauaaucguaaacacuauaaa

SEQ ID NO: 2111043 - RNA, 18 nt, Staphylococcus aureus subsp. aureus MW2
aauaaucgguaauuacuu

SEQ ID NO: 2111044 - RNA, 18 nt, Staphylococcus aureus subsp. aureus MW2
aauaauccgagucauacu

SEQ ID NO: 2111045 - RNA, 23 nt, Staphylococcus aureus subsp. aureus MW2
aauaaucccaaccauucuaccag

SEQ ID NO: 2111046 - RNA, 14 nt, Staphylococcus aureus subsp. aureus MW2
aauaaugacugaca

SEQ ID NO: 2111047 - RNA, 19 nt, Staphylococcus aureus subsp. aureus MW2
aauaaugacgagaauuaaa

SEQ ID NO: 2111048 - RNA, 20 nt, Staphylococcus aureus subsp. aureus MW2
aauaaugauauauuacauca

SEQ ID NO: 2111049 - RNA, 21 nt, Staphylococcus aureus subsp. aureus MW2
aauaaucuuuaacauuuauuu

SEQ ID NO: 2111050 - RNA, 18 nt, Staphylococcus aureus subsp. aureus MW2
aauaaugcuuauuaaaau

SEQ ID NO: 2111051 - RNA, 13 nt, Staphylococcus aureus subsp. aureus MW2
aauaaguugucau

SEQ ID NO: 2111052 - RNA, 17 nt, Staphylococcus aureus subsp. aureus MW2
aauaaguaauaauuuau

SEQ ID NO: 2111053 - RNA, 11 nt, Staphylococcus aureus subsp. aureus MW2
aauaaguaugg

SEQ ID NO: 2111054 - RNA, 17 nt, Staphylococcus aureus subsp. aureus MW2
aauaagcguaaaaucau

SEQ ID NO: 2111055 - RNA, 12 nt, Staphylococcus aureus subsp. aureus MW2
aauaagcuaaua

SEQ ID NO: 2111056 - RNA, 20 nt, Staphylococcus aureus subsp. aureus MW2
aauaauauaaauaaaagcca

SEQ ID NO: 2111057 - RNA, 16 nt, Staphylococcus aureus subsp. aureus MW2
aauaauauaaaacgau

SEQ ID NO: 2111058 - RNA, 19 nt, Staphylococcus aureus subsp. aureus MW2
aauaauauaaaaacaaaag

SEQ ID NO: 2111059 - RNA, 17 nt, Staphylococcus aureus subsp. aureus MW2
aauaauacauucauuaa

SEQ ID NO: 2111060 - RNA, 14 nt, Staphylococcus aureus subsp. aureus MW2
aauaauaaugggaa

SEQ ID NO: 2111061 - RNA, 12 nt, Staphylococcus aureus subsp. aureus MW2
aauaauaaaaua

SEQ ID NO: 2111062 - RNA, 11 nt, Staphylococcus aureus subsp. aureus MW2
aauaauaaaau

SEQ ID NO: 2111063 - RNA, 16 nt, Staphylococcus aureus subsp. aureus MW2
aauaauaaacuuaaaa

SEQ ID NO: 2111064 - RNA, 19 nt, Staphylococcus aureus subsp. aureus MW2
aauaauccaccuaaaaagu

SEQ ID NO: 2111065 - RNA, 21 nt, Staphylococcus aureus subsp. aureus MW2
aauaauccagucacaaacaag

SEQ ID NO: 2111066 - RNA, 16 nt, Staphylococcus aureus subsp. aureus MW2
aauaauaucaccuuuu

SEQ ID NO: 2111067 - RNA, 16 nt, Staphylococcus aureus subsp. aureus MW2
aaguugcauauaaaaa

SEQ ID NO: 2111068 - RNA, 17 nt, Staphylococcus aureus subsp. aureus MW2
aaguugcacauuauaaa

SEQ ID NO: 2111069 - RNA, 14 nt, Staphylococcus aureus subsp. aureus MW2
aaguugauuaaaag

SEQ ID NO: 2111070 - RNA, 21 nt, Staphylococcus aureus subsp. aureus MW2
aaguugauaacuauuuaauua

SEQ ID NO: 2111071 - RNA, 19 nt, Staphylococcus aureus subsp. aureus MW2
aaguucagcguuaucuuua

SEQ ID NO: 2111072 - RNA, 16 nt, Staphylococcus aureus subsp. aureus MW2
aauaaauacaauguua

SEQ ID NO: 2111073 - RNA, 13 nt, Staphylococcus aureus subsp. aureus MW2
aauaaauacaaua

SEQ ID NO: 2111074 - RNA, 19 nt, Staphylococcus aureus subsp. aureus MW2
aauaaauaagcaaucauaa

SEQ ID NO: 2111075 - RNA, 16 nt, Staphylococcus aureus subsp. aureus MW2
aaguugcugaauaaaa

SEQ ID NO: 2111076 - RNA, 18 nt, Staphylococcus aureus subsp. aureus MW2
aaguugcugaauaaaaua

SEQ ID NO: 2111077 - RNA, 21 nt, Staphylococcus aureus subsp. aureus MW2
aauaaaucauuaguuguauca

SEQ ID NO: 2111078 - RNA, 21 nt, Staphylococcus aureus subsp. aureus MW2
aauaaaugacuucacauuuau

SEQ ID NO: 2111079 - RNA, 17 nt, Staphylococcus aureus subsp. aureus MW2
aauaaaucuaucuauuc

SEQ ID NO: 2111080 - RNA, 19 nt, Staphylococcus aureus subsp. aureus MW2
aauaaaucuaucuauucaa

SEQ ID NO: 2111081 - RNA, 13 nt, Staphylococcus aureus subsp. aureus MW2
aauaaaucuuucc

SEQ ID NO: 2111082 - RNA, 21 nt, Staphylococcus aureus subsp. aureus MW2
aauaaauuaugaaagugaauu

SEQ ID NO: 2111083 - RNA, 14 nt, Staphylococcus aureus subsp. aureus MW2
aauaaauguccgau

SEQ ID NO: 2111084 - RNA, 12 nt, Staphylococcus aureus subsp. aureus MW2
aauaaaugguuu

SEQ ID NO: 2111085 - RNA, 19 nt, Staphylococcus aureus subsp. aureus MW2
aauaaauuuugagaaaaua

SEQ ID NO: 2111086 - RNA, 15 nt, Staphylococcus aureus subsp. aureus MW2
aauaaauuuuauaua

SEQ ID NO: 2111087 - RNA, 21 nt, Staphylococcus aureus subsp. aureus MW2
aauaaauuuagauauaauaaa

SEQ ID NO: 2111088 - RNA, 18 nt, Staphylococcus aureus subsp. aureus MW2
aauaaauuguaugaauaa

SEQ ID NO: 2111089 - RNA, 19 nt, Staphylococcus aureus subsp. aureus MW2
aauaaauuguaugaauaau

SEQ ID NO: 2111090 - RNA, 24 nt, Staphylococcus aureus subsp. aureus MW2
aauaaauuguaauauauuaauauu

SEQ ID NO: 2111091 - RNA, 22 nt, Staphylococcus aureus subsp. aureus MW2
aauaaauuguacugauauauac

SEQ ID NO: 2111092 - RNA, 23 nt, Staphylococcus aureus subsp. aureus MW2
aauaacaccuuucauuuggaaac

SEQ ID NO: 2111093 - RNA, 18 nt, Staphylococcus aureus subsp. aureus MW2
aauaacaccuuucauuug

SEQ ID NO: 2111094 - RNA, 22 nt, Staphylococcus aureus subsp. aureus MW2
aauaacaccaauugaauauuuu

SEQ ID NO: 2111095 - RNA, 15 nt, Staphylococcus aureus subsp. aureus MW2
aauaacguuaauaua

SEQ ID NO: 2111096 - RNA, 24 nt, Staphylococcus aureus subsp. aureus MW2
aauaacuaguauccuuuauaaaua

SEQ ID NO: 2111097 - RNA, 16 nt, Staphylococcus aureus subsp. aureus MW2
aauaacuggcaaauca

SEQ ID NO: 2111098 - RNA, 19 nt, Staphylococcus aureus subsp. aureus MW2
aauaacuggcaaaucaaac

SEQ ID NO: 2111099 - RNA, 15 nt, Staphylococcus aureus subsp. aureus MW2
aauaacugaguuaaa

SEQ ID NO: 2111100 - RNA, 23 nt, Staphylococcus aureus subsp. aureus MW2
aauaacucuucuaaguuauuaca

SEQ ID NO: 2111101 - RNA, 11 nt, Staphylococcus aureus subsp. aureus MW2
aauaagauuau

SEQ ID NO: 2111102 - RNA, 16 nt, Staphylococcus aureus subsp. aureus MW2
aauaagauuuugcuuu

SEQ ID NO: 2111103 - RNA, 18 nt, Staphylococcus aureus subsp. aureus MW2
aauaagagggaagugaag

SEQ ID NO: 2111104 - RNA, 19 nt, Staphylococcus aureus subsp. aureus MW2
aauaagaauguguuaauca

SEQ ID NO: 2111105 - RNA, 22 nt, Staphylococcus aureus subsp. aureus MW2
aauaacuucguuuuaauaaauu

SEQ ID NO: 2111106 - RNA, 20 nt, Staphylococcus aureus subsp. aureus MW2
aauaacuggcaaaucaaaca

SEQ ID NO: 2111107 - RNA, 16 nt, Staphylococcus aureus subsp. aureus MW2
aauaacuguuuaucau

SEQ ID NO: 2111108 - RNA, 15 nt, Staphylococcus aureus subsp. aureus MW2
aauaacuguucuuuc

SEQ ID NO: 2111109 - RNA, 17 nt, Staphylococcus aureus subsp. aureus MW2
aauaaccuuuaaaacau

SEQ ID NO: 2111110 - RNA, 23 nt, Staphylococcus aureus subsp. aureus MW2
aauaaccuuuaaaacaucauuca

SEQ ID NO: 2111111 - RNA, 19 nt, Staphylococcus aureus subsp. aureus MW2
aauaaccuagguuaaagau

SEQ ID NO: 2111112 - RNA, 17 nt, Staphylococcus aureus subsp. aureus MW2
aauaaccuacauuaauu

SEQ ID NO: 2111113 - RNA, 12 nt, Staphylococcus aureus subsp. aureus MW2
aauaacaucuaa

SEQ ID NO: 2111114 - RNA, 19 nt, Staphylococcus aureus subsp. aureus MW2
aauaacauccccaaaaaua

SEQ ID NO: 2111115 - RNA, 17 nt, Staphylococcus aureus subsp. aureus MW2
aauaacacgauuugguu

SEQ ID NO: 2111116 - RNA, 22 nt, Staphylococcus aureus subsp. aureus MW2
aauaacacgauuugguugaacu

SEQ ID NO: 2111117 - RNA, 21 nt, Staphylococcus aureus subsp. aureus MW2
aauaaccaccaucccauuaaa

SEQ ID NO: 2111118 - RNA, 23 nt, Staphylococcus aureus subsp. aureus MW2
aauaaccauguaaaauuagcaag

SEQ ID NO: 2111119 - RNA, 22 nt, Staphylococcus aureus subsp. aureus MW2
aauaaccauucacuuauagaau

SEQ ID NO: 2111120 - RNA, 14 nt, Staphylococcus aureus subsp. aureus MW2
aauaaccauguaaa

SEQ ID NO: 2111121 - RNA, 20 nt, Staphylococcus aureus subsp. aureus MW2
aauagcauuuguaaacagua

SEQ ID NO: 2111122 - RNA, 18 nt, Staphylococcus aureus subsp. aureus MW2
aauagaugaaaauuuaau

SEQ ID NO: 2111123 - RNA, 15 nt, Staphylococcus aureus subsp. aureus MW2
aauagauaauauaua

SEQ ID NO: 2111124 - RNA, 16 nt, Staphylococcus aureus subsp. aureus MW2
aauagauaaugcaccu

SEQ ID NO: 2111125 - RNA, 16 nt, Staphylococcus aureus subsp. aureus MW2
aauagauugaaaaaau

SEQ ID NO: 2111126 - RNA, 15 nt, Staphylococcus aureus subsp. aureus MW2
aauacuguauuuuag

SEQ ID NO: 2111127 - RNA, 17 nt, Staphylococcus aureus subsp. aureus MW2
aauagauaaugcaccug

SEQ ID NO: 2111128 - RNA, 13 nt, Staphylococcus aureus subsp. aureus MW2
aauacuuuucuuc

SEQ ID NO: 2111129 - RNA, 12 nt, Staphylococcus aureus subsp. aureus MW2
aauacuuuuuga

SEQ ID NO: 2111130 - RNA, 13 nt, Staphylococcus aureus subsp. aureus MW2
aauacuuuuuaua

SEQ ID NO: 2111131 - RNA, 15 nt, Staphylococcus aureus subsp. aureus MW2
aauacuuuuuauaua

SEQ ID NO: 2111132 - RNA, 19 nt, Staphylococcus aureus subsp. aureus MW2
aauacuuuuuauauaauuc

SEQ ID NO: 2111133 - RNA, 15 nt, Staphylococcus aureus subsp. aureus MW2
aauacuuuuuaacug

SEQ ID NO: 2111134 - RNA, 17 nt, Staphylococcus aureus subsp. aureus MW2
aauacuuucacuuuuua

SEQ ID NO: 2111135 - RNA, 23 nt, Staphylococcus aureus subsp. aureus MW2
aauaccuaucccuguaaaaccau

SEQ ID NO: 2111136 - RNA, 18 nt, Staphylococcus aureus subsp. aureus MW2
aauaccgccuacuguuuc

SEQ ID NO: 2111137 - RNA, 17 nt, Staphylococcus aureus subsp. aureus MW2
aauaccuccccaacuua

SEQ ID NO: 2111138 - RNA, 14 nt, Staphylococcus aureus subsp. aureus MW2
aauacgcaaaccaa

SEQ ID NO: 2111139 - RNA, 11 nt, Staphylococcus aureus subsp. aureus MW2
aauaauugucc

SEQ ID NO: 2111140 - RNA, 17 nt, Staphylococcus aureus subsp. aureus MW2
aauaauuuguaauuccu

SEQ ID NO: 2111141 - RNA, 20 nt, Staphylococcus aureus subsp. aureus MW2
aauaauuuuaaaaauaaaaa

SEQ ID NO: 2111142 - RNA, 16 nt, Staphylococcus aureus subsp. aureus MW2
aauaccacuuaaucgu

SEQ ID NO: 2111143 - RNA, 22 nt, Staphylococcus aureus subsp. aureus MW2
aauaccaacugucgguucaucu

SEQ ID NO: 2111144 - RNA, 18 nt, Staphylococcus aureus subsp. aureus MW2
aauaucauaccguacaaa

SEQ ID NO: 2111145 - RNA, 16 nt, Staphylococcus aureus subsp. aureus MW2
aauaucauaaaugcau

SEQ ID NO: 2111146 - RNA, 23 nt, Staphylococcus aureus subsp. aureus MW2
aauauauagcacgcuuauugaaa

SEQ ID NO: 2111147 - RNA, 23 nt, Staphylococcus aureus subsp. aureus MW2
aauauauccugccaauauauuca

SEQ ID NO: 2111148 - RNA, 21 nt, Staphylococcus aureus subsp. aureus MW2
aauauauccugccaauauauu

SEQ ID NO: 2111149 - RNA, 16 nt, Staphylococcus aureus subsp. aureus MW2
aauauaucaucucuau

SEQ ID NO: 2111150 - RNA, 16 nt, Staphylococcus aureus subsp. aureus MW2
aauaucauauucaaaa

SEQ ID NO: 2111151 - RNA, 19 nt, Staphylococcus aureus subsp. aureus MW2
aauaucauauuugaauacu

SEQ ID NO: 2111152 - RNA, 20 nt, Staphylococcus aureus subsp. aureus MW2
aauaucaucauuuaaauauu

SEQ ID NO: 2111153 - RNA, 12 nt, Staphylococcus aureus subsp. aureus MW2
aauaucauucau

SEQ ID NO: 2111154 - RNA, 15 nt, Staphylococcus aureus subsp. aureus MW2
aauauccaaaauccu

SEQ ID NO: 2111155 - RNA, 12 nt, Staphylococcus aureus subsp. aureus MW2
aauauccaaaau

SEQ ID NO: 2111156 - RNA, 22 nt, Staphylococcus aureus subsp. aureus MW2
aauaucuguugcauuaagugca

SEQ ID NO: 2111157 - RNA, 16 nt, Staphylococcus aureus subsp. aureus MW2
aauaucugaaaaacca

SEQ ID NO: 2111158 - RNA, 14 nt, Staphylococcus aureus subsp. aureus MW2
aauaucuaaagauu

SEQ ID NO: 2111159 - RNA, 15 nt, Staphylococcus aureus subsp. aureus MW2
aauaucuaaagauuu

SEQ ID NO: 2111160 - RNA, 17 nt, Staphylococcus aureus subsp. aureus MW2
aauaucuuaaagaauua

SEQ ID NO: 2111161 - RNA, 19 nt, Staphylococcus aureus subsp. aureus MW2
aauagguacaacuaaauau

SEQ ID NO: 2111162 - RNA, 20 nt, Staphylococcus aureus subsp. aureus MW2
aauagguuauuugauaauga

SEQ ID NO: 2111163 - RNA, 18 nt, Staphylococcus aureus subsp. aureus MW2
aauagucggggccccaac

SEQ ID NO: 2111164 - RNA, 23 nt, Staphylococcus aureus subsp. aureus MW2
aauagucggggccccaacacaga

SEQ ID NO: 2111165 - RNA, 13 nt, Staphylococcus aureus subsp. aureus MW2
aauaggauuuccu

SEQ ID NO: 2111166 - RNA, 15 nt, Staphylococcus aureus subsp. aureus MW2
aauagcgauuuuaaa

SEQ ID NO: 2111167 - RNA, 13 nt, Staphylococcus aureus subsp. aureus MW2
aauauaauuuuaa

SEQ ID NO: 2111168 - RNA, 13 nt, Staphylococcus aureus subsp. aureus MW2
aauauaauuuuuu

SEQ ID NO: 2111169 - RNA, 15 nt, Staphylococcus aureus subsp. aureus MW2
aauauaauuauuaaa

SEQ ID NO: 2111170 - RNA, 17 nt, Staphylococcus aureus subsp. aureus MW2
aauauaauuauuaaacu

SEQ ID NO: 2111171 - RNA, 16 nt, Staphylococcus aureus subsp. aureus MW2
aauauaauauauacaa

SEQ ID NO: 2111172 - RNA, 20 nt, Staphylococcus aureus subsp. aureus MW2
aauauaauguauaaaacaga

SEQ ID NO: 2111173 - RNA, 15 nt, Staphylococcus aureus subsp. aureus MW2
aauaguuaagauuuu

SEQ ID NO: 2111174 - RNA, 23 nt, Staphylococcus aureus subsp. aureus MW2
aauaguuaccaaaauuugaaaua

SEQ ID NO: 2111175 - RNA, 14 nt, Staphylococcus aureus subsp. aureus MW2
aauaguucaaaaua

SEQ ID NO: 2111176 - RNA, 20 nt, Staphylococcus aureus subsp. aureus MW2
aauauacuuaauuuaaaucu

SEQ ID NO: 2111177 - RNA, 17 nt, Staphylococcus aureus subsp. aureus MW2
aauauacuuaauuuaaa

SEQ ID NO: 2111178 - RNA, 18 nt, Staphylococcus aureus subsp. aureus MW2
aauauacauuuacauauu

SEQ ID NO: 2111179 - RNA, 16 nt, Staphylococcus aureus subsp. aureus MW2
aauauagcugugauuu

SEQ ID NO: 2111180 - RNA, 22 nt, Staphylococcus aureus subsp. aureus MW2
aauauagcuauuacuauaaaaa

SEQ ID NO: 2111181 - RNA, 15 nt, Staphylococcus aureus subsp. aureus MW2
aauauagcuauuaga

SEQ ID NO: 2111182 - RNA, 11 nt, Staphylococcus aureus subsp. aureus MW2
aauauacuuuu

SEQ ID NO: 2111183 - RNA, 18 nt, Staphylococcus aureus subsp. aureus MW2
aauauacuuuuauagaaa

SEQ ID NO: 2111184 - RNA, 23 nt, Staphylococcus aureus subsp. aureus MW2
aauauacuuuuuaaaugauuuaa

SEQ ID NO: 2111185 - RNA, 15 nt, Staphylococcus aureus subsp. aureus MW2
aauauagauuuugua

SEQ ID NO: 2111186 - RNA, 21 nt, Staphylococcus aureus subsp. aureus MW2
aauauagaagugcgguuuaau

SEQ ID NO: 2111187 - RNA, 17 nt, Staphylococcus aureus subsp. aureus MW2
aagccuguuugacacau

SEQ ID NO: 2111188 - RNA, 20 nt, Staphylococcus aureus subsp. aureus MW2
aagccuucaauaguuucaau

SEQ ID NO: 2111189 - RNA, 20 nt, Staphylococcus aureus subsp. aureus MW2
aagcgacgauuggaaaguuu

SEQ ID NO: 2111190 - RNA, 14 nt, Staphylococcus aureus subsp. aureus MW2
aagccaucuuucuu

SEQ ID NO: 2111191 - RNA, 13 nt, Staphylococcus aureus subsp. aureus MW2
aagccaucaauau

SEQ ID NO: 2111192 - RNA, 16 nt, Staphylococcus aureus subsp. aureus MW2
aagaaguaauguuaaa

SEQ ID NO: 2111193 - RNA, 14 nt, Staphylococcus aureus subsp. aureus MW2
aagccccuuacaac

SEQ ID NO: 2111194 - RNA, 22 nt, Staphylococcus aureus subsp. aureus MW2
aagccccuuuuaaauucuuaua

SEQ ID NO: 2111195 - RNA, 18 nt, Staphylococcus aureus subsp. aureus MW2
aagcggguugaagcaauu

SEQ ID NO: 2111196 - RNA, 21 nt, Staphylococcus aureus subsp. aureus MW2
aagcguucgugauagaaguuu

SEQ ID NO: 2111197 - RNA, 15 nt, Staphylococcus aureus subsp. aureus MW2
aagcuaaauguuaau

SEQ ID NO: 2111198 - RNA, 20 nt, Staphylococcus aureus subsp. aureus MW2
aagcuaaauguuaaugcuuc

SEQ ID NO: 2111199 - RNA, 13 nt, Staphylococcus aureus subsp. aureus MW2
aagcguaauauuu

SEQ ID NO: 2111200 - RNA, 14 nt, Staphylococcus aureus subsp. aureus MW2
aagcguaauauuua

SEQ ID NO: 2111201 - RNA, 15 nt, Staphylococcus aureus subsp. aureus MW2
aagcucaugaaucag

SEQ ID NO: 2111202 - RNA, 22 nt, Staphylococcus aureus subsp. aureus MW2
aagcucaugaaucagaugauuu

SEQ ID NO: 2111203 - RNA, 20 nt, Staphylococcus aureus subsp. aureus MW2
aagcucaugaaucagaugau

SEQ ID NO: 2111204 - RNA, 20 nt, Staphylococcus aureus subsp. aureus MW2
aagcucauuucaauauuaaa

SEQ ID NO: 2111205 - RNA, 16 nt, Staphylococcus aureus subsp. aureus MW2
aagcuaaguuugaagg

SEQ ID NO: 2111206 - RNA, 18 nt, Staphylococcus aureus subsp. aureus MW2
aagcuaucguaaacaaca

SEQ ID NO: 2111207 - RNA, 17 nt, Staphylococcus aureus subsp. aureus MW2
aagcuaucuucagauuc

SEQ ID NO: 2111208 - RNA, 11 nt, Staphylococcus aureus subsp. aureus MW2
aaggaagaaca

SEQ ID NO: 2111209 - RNA, 21 nt, Staphylococcus aureus subsp. aureus MW2
aagcuuuuuugcuuuuauaau

SEQ ID NO: 2111210 - RNA, 18 nt, Staphylococcus aureus subsp. aureus MW2
aagcuugcgauaaguuca

SEQ ID NO: 2111211 - RNA, 12 nt, Staphylococcus aureus subsp. aureus MW2
aaggaaccuguc

SEQ ID NO: 2111212 - RNA, 19 nt, Staphylococcus aureus subsp. aureus MW2
aagcugacgaaaagucagc

SEQ ID NO: 2111213 - RNA, 23 nt, Staphylococcus aureus subsp. aureus MW2
aagcugacaaaccaauuuuaaua

SEQ ID NO: 2111214 - RNA, 13 nt, Staphylococcus aureus subsp. aureus MW2
aagcuuauuaaau

SEQ ID NO: 2111215 - RNA, 24 nt, Staphylococcus aureus subsp. aureus MW2
aagcuucauauuuagguaauacau

SEQ ID NO: 2111216 - RNA, 16 nt, Staphylococcus aureus subsp. aureus MW2
aagcuggcggaaaguc

SEQ ID NO: 2111217 - RNA, 18 nt, Staphylococcus aureus subsp. aureus MW2
aagcuggcggaaagucag

SEQ ID NO: 2111218 - RNA, 19 nt, Staphylococcus aureus subsp. aureus MW2
aagcuggcggaaagucagc

SEQ ID NO: 2111219 - RNA, 20 nt, Staphylococcus aureus subsp. aureus MW2
aagcuggcggaaagucaggu

SEQ ID NO: 2111220 - RNA, 14 nt, Staphylococcus aureus subsp. aureus MW2
aagugauaauuaaa

SEQ ID NO: 2111221 - RNA, 15 nt, Staphylococcus aureus subsp. aureus MW2
aagugaugaccaaua

SEQ ID NO: 2111222 - RNA, 12 nt, Staphylococcus aureus subsp. aureus MW2
aagugaugaaaa

SEQ ID NO: 2111223 - RNA, 20 nt, Staphylococcus aureus subsp. aureus MW2
aagucugcugguaacucuuc

SEQ ID NO: 2111224 - RNA, 17 nt, Staphylococcus aureus subsp. aureus MW2
aagucucuugucauuuc

SEQ ID NO: 2111225 - RNA, 17 nt, Staphylococcus aureus subsp. aureus MW2
aagucugaugucgaaaa

SEQ ID NO: 2111226 - RNA, 19 nt, Staphylococcus aureus subsp. aureus MW2
aagucugaugucgaaaaua

SEQ ID NO: 2111227 - RNA, 13 nt, Staphylococcus aureus subsp. aureus MW2
aagugacacugua

SEQ ID NO: 2111228 - RNA, 21 nt, Staphylococcus aureus subsp. aureus MW2
aagucuguugguuuaucagcu

SEQ ID NO: 2111229 - RNA, 23 nt, Staphylococcus aureus subsp. aureus MW2
aagucuguugguuuaucagcuuu

SEQ ID NO: 2111230 - RNA, 23 nt, Staphylococcus aureus subsp. aureus MW2
aagugacuuaauaucauauucaa

SEQ ID NO: 2111231 - RNA, 17 nt, Staphylococcus aureus subsp. aureus MW2
aagugcgguuauuuaua

SEQ ID NO: 2111232 - RNA, 13 nt, Staphylococcus aureus subsp. aureus MW2
aagugguaaaaau

SEQ ID NO: 2111233 - RNA, 19 nt, Staphylococcus aureus subsp. aureus MW2
aaguguagccaaauaaauu

SEQ ID NO: 2111234 - RNA, 17 nt, Staphylococcus aureus subsp. aureus MW2
aagugguuguucccauu

SEQ ID NO: 2111235 - RNA, 23 nt, Staphylococcus aureus subsp. aureus MW2
aagugcgguuuaaucuauauaua

SEQ ID NO: 2111236 - RNA, 19 nt, Staphylococcus aureus subsp. aureus MW2
aaguuauuuaaguucuucu

SEQ ID NO: 2111237 - RNA, 21 nt, Staphylococcus aureus subsp. aureus MW2
aaguuauaucauaacuuaacu

SEQ ID NO: 2111238 - RNA, 18 nt, Staphylococcus aureus subsp. aureus MW2
aaguuaggcgacuuaacu

SEQ ID NO: 2111239 - RNA, 16 nt, Staphylococcus aureus subsp. aureus MW2
aagucauuaaauguac

SEQ ID NO: 2111240 - RNA, 23 nt, Staphylococcus aureus subsp. aureus MW2
aagucauacacaaugauuauaaa

SEQ ID NO: 2111241 - RNA, 13 nt, Staphylococcus aureus subsp. aureus MW2
aaguauuuuccuu

SEQ ID NO: 2111242 - RNA, 15 nt, Staphylococcus aureus subsp. aureus MW2
aaguauuuuccuuca

SEQ ID NO: 2111243 - RNA, 22 nt, Staphylococcus aureus subsp. aureus MW2
aaguaguucaauaaauuuuuaa

SEQ ID NO: 2111244 - RNA, 12 nt, Staphylococcus aureus subsp. aureus MW2
aaguauuuuaau

SEQ ID NO: 2111245 - RNA, 12 nt, Staphylococcus aureus subsp. aureus MW2
aaguauuuaaac

SEQ ID NO: 2111246 - RNA, 16 nt, Staphylococcus aureus subsp. aureus MW2
aaguauuugaaguauu

SEQ ID NO: 2111247 - RNA, 17 nt, Staphylococcus aureus subsp. aureus MW2
aaguauuaugauugcuu

SEQ ID NO: 2111248 - RNA, 17 nt, Staphylococcus aureus subsp. aureus MW2
aaguauacuaaacuuuu

SEQ ID NO: 2111249 - RNA, 14 nt, Staphylococcus aureus subsp. aureus MW2
aaguauaucuuuga

SEQ ID NO: 2111250 - RNA, 21 nt, Staphylococcus aureus subsp. aureus MW2
aaguauaugaaucgauauaau

SEQ ID NO: 2111251 - RNA, 17 nt, Staphylococcus aureus subsp. aureus MW2
aaguauauaagcaaaga

SEQ ID NO: 2111252 - RNA, 22 nt, Staphylococcus aureus subsp. aureus MW2
aaguacgcaauuuaauauuaua

SEQ ID NO: 2111253 - RNA, 16 nt, Staphylococcus aureus subsp. aureus MW2
aaguacuuacaaauau

SEQ ID NO: 2111254 - RNA, 14 nt, Staphylococcus aureus subsp. aureus MW2
aaguacuuacaaau

SEQ ID NO: 2111255 - RNA, 20 nt, Staphylococcus aureus subsp. aureus MW2
aaguacuuuaaaauuguaua

SEQ ID NO: 2111256 - RNA, 13 nt, Staphylococcus aureus subsp. aureus MW2
aaguacuuuacca

SEQ ID NO: 2111257 - RNA, 17 nt, Staphylococcus aureus subsp. aureus MW2
aaguacuuacaaauaua

SEQ ID NO: 2111258 - RNA, 14 nt, Staphylococcus aureus subsp. aureus MW2
aaguagaagcaaaa

SEQ ID NO: 2111259 - RNA, 17 nt, Staphylococcus aureus subsp. aureus MW2
aaguacaaauaauacag

SEQ ID NO: 2111260 - RNA, 13 nt, Staphylococcus aureus subsp. aureus MW2
aaguaauguuaaa

SEQ ID NO: 2111261 - RNA, 18 nt, Staphylococcus aureus subsp. aureus MW2
aaguaaugugcauugcuu

SEQ ID NO: 2111262 - RNA, 19 nt, Staphylococcus aureus subsp. aureus MW2
aaguaauguuaaacacuca

SEQ ID NO: 2111263 - RNA, 14 nt, Staphylococcus aureus subsp. aureus MW2
aaguaauuaaauac

SEQ ID NO: 2111264 - RNA, 13 nt, Staphylococcus aureus subsp. aureus MW2
aaguaauuaaaua

SEQ ID NO: 2111265 - RNA, 21 nt, Staphylococcus aureus subsp. aureus MW2
aaguacauaaaugcuaaaagu

SEQ ID NO: 2111266 - RNA, 22 nt, Staphylococcus aureus subsp. aureus MW2
aaggguguuuagauagcucuau

SEQ ID NO: 2111267 - RNA, 14 nt, Staphylococcus aureus subsp. aureus MW2
aaguaaaaguuuug

SEQ ID NO: 2111268 - RNA, 14 nt, Staphylococcus aureus subsp. aureus MW2
aaguaaaauaaaaa

SEQ ID NO: 2111269 - RNA, 16 nt, Staphylococcus aureus subsp. aureus MW2
aaguaaucauuuuucg

SEQ ID NO: 2111270 - RNA, 15 nt, Staphylococcus aureus subsp. aureus MW2
aaguaauauauaaaa

SEQ ID NO: 2111271 - RNA, 20 nt, Staphylococcus aureus subsp. aureus MW2
aaggaugaugugaauguuuu

SEQ ID NO: 2111272 - RNA, 15 nt, Staphylococcus aureus subsp. aureus MW2
aaggaugaguuuaaa

SEQ ID NO: 2111273 - RNA, 20 nt, Staphylococcus aureus subsp. aureus MW2
aaggagauauugucuucuca

SEQ ID NO: 2111274 - RNA, 16 nt, Staphylococcus aureus subsp. aureus MW2
aaggauguuauaaaau

SEQ ID NO: 2111275 - RNA, 20 nt, Staphylococcus aureus subsp. aureus MW2
aaggcuagcuaaaauuugcu

SEQ ID NO: 2111276 - RNA, 14 nt, Staphylococcus aureus subsp. aureus MW2
aaggcucauuuguu

SEQ ID NO: 2111277 - RNA, 15 nt, Staphylococcus aureus subsp. aureus MW2
aaggggguaauacua

SEQ ID NO: 2111278 - RNA, 20 nt, Staphylococcus aureus subsp. aureus MW2
aagggaucguucuuugauua

SEQ ID NO: 2111279 - RNA, 21 nt, Staphylococcus aureus subsp. aureus MW2
aauugcuugaaauuauuauuu

SEQ ID NO: 2111280 - RNA, 21 nt, Staphylococcus aureus subsp. aureus MW2
aauuggaaucaucuuuuugaa

SEQ ID NO: 2111281 - RNA, 22 nt, Staphylococcus aureus subsp. aureus MW2
aauuggaaucaucuuuuugaaa

SEQ ID NO: 2111282 - RNA, 20 nt, Staphylococcus aureus subsp. aureus MW2
aauugcuuuuucuuaauuau

SEQ ID NO: 2111283 - RNA, 22 nt, Staphylococcus aureus subsp. aureus MW2
aauuggcaacggcacauucaua

SEQ ID NO: 2111284 - RNA, 18 nt, Staphylococcus aureus subsp. aureus MW2
aauuggauaauuucuucu

SEQ ID NO: 2111285 - RNA, 22 nt, Staphylococcus aureus subsp. aureus MW2
aauuggcuccccaauuucucug

SEQ ID NO: 2111286 - RNA, 15 nt, Staphylococcus aureus subsp. aureus MW2
aauugcuaaaaaaau

SEQ ID NO: 2111287 - RNA, 19 nt, Staphylococcus aureus subsp. aureus MW2
aauugcuaaaaaaauuaaa

SEQ ID NO: 2111288 - RNA, 14 nt, Staphylococcus aureus subsp. aureus MW2
aauugcuguaaaua

SEQ ID NO: 2111289 - RNA, 17 nt, Staphylococcus aureus subsp. aureus MW2
aauugcucuuuaacaau

SEQ ID NO: 2111290 - RNA, 18 nt, Staphylococcus aureus subsp. aureus MW2
aauugauuacaccacuua

SEQ ID NO: 2111291 - RNA, 21 nt, Staphylococcus aureus subsp. aureus MW2
aauugaucuaaauuaguuaau

SEQ ID NO: 2111292 - RNA, 23 nt, Staphylococcus aureus subsp. aureus MW2
aauugauauuuaccgucuuauga

SEQ ID NO: 2111293 - RNA, 13 nt, Staphylococcus aureus subsp. aureus MW2
aauugauuuugaa

SEQ ID NO: 2111294 - RNA, 19 nt, Staphylococcus aureus subsp. aureus MW2
aauugauuucuaauugaaa

SEQ ID NO: 2111295 - RNA, 20 nt, Staphylococcus aureus subsp. aureus MW2
aauugauuguggugaaauaa

SEQ ID NO: 2111296 - RNA, 23 nt, Staphylococcus aureus subsp. aureus MW2
aauugcauuacuacaaacuugau

SEQ ID NO: 2111297 - RNA, 15 nt, Staphylococcus aureus subsp. aureus MW2
aauugcaauggcaac

SEQ ID NO: 2111298 - RNA, 21 nt, Staphylococcus aureus subsp. aureus MW2
aauugcaugucuuaaauucuu

SEQ ID NO: 2111299 - RNA, 22 nt, Staphylococcus aureus subsp. aureus MW2
aauugcaugucuuaaauucuua

SEQ ID NO: 2111300 - RNA, 14 nt, Staphylococcus aureus subsp. aureus MW2
aauucugguuuaau

SEQ ID NO: 2111301 - RNA, 20 nt, Staphylococcus aureus subsp. aureus MW2
aauucugguuuaaugagcuu

SEQ ID NO: 2111302 - RNA, 15 nt, Staphylococcus aureus subsp. aureus MW2
aauucuuaaaaagca

SEQ ID NO: 2111303 - RNA, 17 nt, Staphylococcus aureus subsp. aureus MW2
aauucugugagguaaaa

SEQ ID NO: 2111304 - RNA, 20 nt, Staphylococcus aureus subsp. aureus MW2
aauucuguuucaaagcuguc

SEQ ID NO: 2111305 - RNA, 16 nt, Staphylococcus aureus subsp. aureus MW2
aauucuucaucuucuu

SEQ ID NO: 2111306 - RNA, 12 nt, Staphylococcus aureus subsp. aureus MW2
aauucuucauca

SEQ ID NO: 2111307 - RNA, 15 nt, Staphylococcus aureus subsp. aureus MW2
aauucuuauaaaaua

SEQ ID NO: 2111308 - RNA, 23 nt, Staphylococcus aureus subsp. aureus MW2
aauucuuaaucgagugauucagg

SEQ ID NO: 2111309 - RNA, 15 nt, Staphylococcus aureus subsp. aureus MW2
aauucuuuuguaauu

SEQ ID NO: 2111310 - RNA, 18 nt, Staphylococcus aureus subsp. aureus MW2
aauucuuuuucagcuaau

SEQ ID NO: 2111311 - RNA, 20 nt, Staphylococcus aureus subsp. aureus MW2
aauucuuuauguuggggccu

SEQ ID NO: 2111312 - RNA, 22 nt, Staphylococcus aureus subsp. aureus MW2
aauucuuucuuuuuuacauuua

SEQ ID NO: 2111313 - RNA, 16 nt, Staphylococcus aureus subsp. aureus MW2
aauucuuuuagaauuc

SEQ ID NO: 2111314 - RNA, 24 nt, Staphylococcus aureus subsp. aureus MW2
aauucuuuuagaauucuaaauaau

SEQ ID NO: 2111315 - RNA, 13 nt, Staphylococcus aureus subsp. aureus MW2
aauucuuguaaau

SEQ ID NO: 2111316 - RNA, 16 nt, Staphylococcus aureus subsp. aureus MW2
aauucuuguuugauuu

SEQ ID NO: 2111317 - RNA, 14 nt, Staphylococcus aureus subsp. aureus MW2
aauugaauuaaauc

SEQ ID NO: 2111318 - RNA, 19 nt, Staphylococcus aureus subsp. aureus MW2
aauugaaucguauugaaaa

SEQ ID NO: 2111319 - RNA, 22 nt, Staphylococcus aureus subsp. aureus MW2
aauugaaggccauuuuuauuua

SEQ ID NO: 2111320 - RNA, 19 nt, Staphylococcus aureus subsp. aureus MW2
aauugacgcauuaaugauu

SEQ ID NO: 2111321 - RNA, 18 nt, Staphylococcus aureus subsp. aureus MW2
aauugaaauuaacuguau

SEQ ID NO: 2111322 - RNA, 15 nt, Staphylococcus aureus subsp. aureus MW2
aauugaaaugauaaa

SEQ ID NO: 2111323 - RNA, 22 nt, Staphylococcus aureus subsp. aureus MW2
aauugaguuguugcaacuugug

SEQ ID NO: 2111324 - RNA, 22 nt, Staphylococcus aureus subsp. aureus MW2
aauugacuuacauuuuaauaaa

SEQ ID NO: 2111325 - RNA, 19 nt, Staphylococcus aureus subsp. aureus MW2
aauugagaaguauuaugau

SEQ ID NO: 2111326 - RNA, 19 nt, Staphylococcus aureus subsp. aureus MW2
aauugacuuuaauugcucu

SEQ ID NO: 2111327 - RNA, 16 nt, Staphylococcus aureus subsp. aureus MW2
aauugagaaguauuau

SEQ ID NO: 2111328 - RNA, 17 nt, Staphylococcus aureus subsp. aureus MW2
aauuuauaaaaagagau

SEQ ID NO: 2111329 - RNA, 17 nt, Staphylococcus aureus subsp. aureus MW2
aauuuaguuuuaauaua

SEQ ID NO: 2111330 - RNA, 17 nt, Staphylococcus aureus subsp. aureus MW2
aauuuauaaugauuaaa

SEQ ID NO: 2111331 - RNA, 15 nt, Staphylococcus aureus subsp. aureus MW2
aauuuauaauuucua

SEQ ID NO: 2111332 - RNA, 15 nt, Staphylococcus aureus subsp. aureus MW2
aauuuaucaauuucu

SEQ ID NO: 2111333 - RNA, 18 nt, Staphylococcus aureus subsp. aureus MW2
aauuuaucaauuucuauu

SEQ ID NO: 2111334 - RNA, 15 nt, Staphylococcus aureus subsp. aureus MW2
aauuuaguauaaaua

SEQ ID NO: 2111335 - RNA, 24 nt, Staphylococcus aureus subsp. aureus MW2
aauuuagguggagauuuaacaaua

SEQ ID NO: 2111336 - RNA, 18 nt, Staphylococcus aureus subsp. aureus MW2
aauuuaguacucaauguu

SEQ ID NO: 2111337 - RNA, 17 nt, Staphylococcus aureus subsp. aureus MW2
aauuuaggcaugucaaa

SEQ ID NO: 2111338 - RNA, 16 nt, Staphylococcus aureus subsp. aureus MW2
aauuuaggaaugaaua

SEQ ID NO: 2111339 - RNA, 12 nt, Staphylococcus aureus subsp. aureus MW2
aauuuagaugca

SEQ ID NO: 2111340 - RNA, 15 nt, Staphylococcus aureus subsp. aureus MW2
aauuuagcaaauauu

SEQ ID NO: 2111341 - RNA, 19 nt, Staphylococcus aureus subsp. aureus MW2
aauuuagcaucaaaaauaa

SEQ ID NO: 2111342 - RNA, 16 nt, Staphylococcus aureus subsp. aureus MW2
aauuuaauuaagaaaa

SEQ ID NO: 2111343 - RNA, 17 nt, Staphylococcus aureus subsp. aureus MW2
aauuuaauguugcaaaa

SEQ ID NO: 2111344 - RNA, 18 nt, Staphylococcus aureus subsp. aureus MW2
aauuuaauagguucuucu

SEQ ID NO: 2111345 - RNA, 14 nt, Staphylococcus aureus subsp. aureus MW2
aauuuaauaugcua

SEQ ID NO: 2111346 - RNA, 13 nt, Staphylococcus aureus subsp. aureus MW2
aauuuaauaauua

SEQ ID NO: 2111347 - RNA, 16 nt, Staphylococcus aureus subsp. aureus MW2
aauuuaauaauuaaau

SEQ ID NO: 2111348 - RNA, 19 nt, Staphylococcus aureus subsp. aureus MW2
aauuuaauugcuguaaaua

SEQ ID NO: 2111349 - RNA, 22 nt, Staphylococcus aureus subsp. aureus MW2
aauuuacaaaaacuauuuuuua

SEQ ID NO: 2111350 - RNA, 16 nt, Staphylococcus aureus subsp. aureus MW2
aauuuaccaguuugau

SEQ ID NO: 2111351 - RNA, 16 nt, Staphylococcus aureus subsp. aureus MW2
aauuuauuauaaaaua

SEQ ID NO: 2111352 - RNA, 12 nt, Staphylococcus aureus subsp. aureus MW2
aauuuauuauaa

SEQ ID NO: 2111353 - RNA, 22 nt, Staphylococcus aureus subsp. aureus MW2
aauuuauuaaaacgaaguuauu

SEQ ID NO: 2111354 - RNA, 12 nt, Staphylococcus aureus subsp. aureus MW2
aauuuauauaua

SEQ ID NO: 2111355 - RNA, 13 nt, Staphylococcus aureus subsp. aureus MW2
aauuuaucauuau

SEQ ID NO: 2111356 - RNA, 16 nt, Staphylococcus aureus subsp. aureus MW2
aauuuaucauuauuua

SEQ ID NO: 2111357 - RNA, 12 nt, Staphylococcus aureus subsp. aureus MW2
aauuucaaaaau

SEQ ID NO: 2111358 - RNA, 23 nt, Staphylococcus aureus subsp. aureus MW2
aauuuauuuuuaauuucugguaa

SEQ ID NO: 2111359 - RNA, 13 nt, Staphylococcus aureus subsp. aureus MW2
aauuuauuuugua

SEQ ID NO: 2111360 - RNA, 19 nt, Staphylococcus aureus subsp. aureus MW2
aauuuauuuauuuugauuu

SEQ ID NO: 2111361 - RNA, 23 nt, Staphylococcus aureus subsp. aureus MW2
aauuuauuuauuuugauuugauu

SEQ ID NO: 2111362 - RNA, 15 nt, Staphylococcus aureus subsp. aureus MW2
aauuucaaugucugc

SEQ ID NO: 2111363 - RNA, 21 nt, Staphylococcus aureus subsp. aureus MW2
aauuucaagguauacacaaau

SEQ ID NO: 2111364 - RNA, 22 nt, Staphylococcus aureus subsp. aureus MW2
aauuucaaacgcaccuggcaca

SEQ ID NO: 2111365 - RNA, 18 nt, Staphylococcus aureus subsp. aureus MW2
aauuucaaugucugcauc

SEQ ID NO: 2111366 - RNA, 22 nt, Staphylococcus aureus subsp. aureus MW2
aauuuaaagcaucauauacaua

SEQ ID NO: 2111367 - RNA, 13 nt, Staphylococcus aureus subsp. aureus MW2
aauuuaaagcauc

SEQ ID NO: 2111368 - RNA, 20 nt, Staphylococcus aureus subsp. aureus MW2
aauuuaaagucuucaucuuu

SEQ ID NO: 2111369 - RNA, 11 nt, Staphylococcus aureus subsp. aureus MW2
aauuuaaauaa

SEQ ID NO: 2111370 - RNA, 17 nt, Staphylococcus aureus subsp. aureus MW2
aauuuaacuaugaaauu

SEQ ID NO: 2111371 - RNA, 17 nt, Staphylococcus aureus subsp. aureus MW2
aauuuaacguuuugaug

SEQ ID NO: 2111372 - RNA, 17 nt, Staphylococcus aureus subsp. aureus MW2
aauuuaacguguaauga

SEQ ID NO: 2111373 - RNA, 19 nt, Staphylococcus aureus subsp. aureus MW2
aauuuaaaugcuuaauuug

SEQ ID NO: 2111374 - RNA, 14 nt, Staphylococcus aureus subsp. aureus MW2
aauuuaacauuuuu

SEQ ID NO: 2111375 - RNA, 19 nt, Staphylococcus aureus subsp. aureus MW2
aauuuaaaacaaugauuaa

SEQ ID NO: 2111376 - RNA, 15 nt, Staphylococcus aureus subsp. aureus MW2
aauuuaaaaaugaua

SEQ ID NO: 2111377 - RNA, 12 nt, Staphylococcus aureus subsp. aureus MW2
aauuuaaaacaa

SEQ ID NO: 2111378 - RNA, 16 nt, Staphylococcus aureus subsp. aureus MW2
aauuuaaaacaaugau

SEQ ID NO: 2111379 - RNA, 16 nt, Staphylococcus aureus subsp. aureus MW2
aauuuaaaaagcagua

SEQ ID NO: 2111380 - RNA, 17 nt, Staphylococcus aureus subsp. aureus MW2
aauuguuguacauguau

SEQ ID NO: 2111381 - RNA, 18 nt, Staphylococcus aureus subsp. aureus MW2
aauuguugcauuacuuuc

SEQ ID NO: 2111382 - RNA, 22 nt, Staphylococcus aureus subsp. aureus MW2
aauuguugcauuacuuucugcc

SEQ ID NO: 2111383 - RNA, 14 nt, Staphylococcus aureus subsp. aureus MW2
aauuguuuacuaua

SEQ ID NO: 2111384 - RNA, 16 nt, Staphylococcus aureus subsp. aureus MW2
aauuguguugaaucaa

SEQ ID NO: 2111385 - RNA, 16 nt, Staphylococcus aureus subsp. aureus MW2
aauuguguuucuuuua

SEQ ID NO: 2111386 - RNA, 20 nt, Staphylococcus aureus subsp. aureus MW2
aauuguuaaucccguuauau

SEQ ID NO: 2111387 - RNA, 20 nt, Staphylococcus aureus subsp. aureus MW2
aauuguuagauaaucucauu

SEQ ID NO: 2111388 - RNA, 23 nt, Staphylococcus aureus subsp. aureus MW2
aauuguucuaauacaccaaaucc

SEQ ID NO: 2111389 - RNA, 17 nt, Staphylococcus aureus subsp. aureus MW2
aauuguucucgucuuuu

SEQ ID NO: 2111390 - RNA, 18 nt, Staphylococcus aureus subsp. aureus MW2
aauuguucucgucuuuug

SEQ ID NO: 2111391 - RNA, 11 nt, Staphylococcus aureus subsp. aureus MW2
aauuguuaucg

SEQ ID NO: 2111392 - RNA, 23 nt, Staphylococcus aureus subsp. aureus MW2
aauugucguucucguguaaaaug

SEQ ID NO: 2111393 - RNA, 14 nt, Staphylococcus aureus subsp. aureus MW2
aauugucguuuaau

SEQ ID NO: 2111394 - RNA, 23 nt, Staphylococcus aureus subsp. aureus MW2
aauugugacgcggguaauauuuu

SEQ ID NO: 2111395 - RNA, 20 nt, Staphylococcus aureus subsp. aureus MW2
aauugucuagguuagaauua

SEQ ID NO: 2111396 - RNA, 20 nt, Staphylococcus aureus subsp. aureus MW2
aauugugccauuuguaacaa

SEQ ID NO: 2111397 - RNA, 17 nt, Staphylococcus aureus subsp. aureus MW2
aauuguacuuaaaccua

SEQ ID NO: 2111398 - RNA, 21 nt, Staphylococcus aureus subsp. aureus MW2
aauugguuuucaugugucaua

SEQ ID NO: 2111399 - RNA, 16 nt, Staphylococcus aureus subsp. aureus MW2
aauuguaaucuauuuu

SEQ ID NO: 2111400 - RNA, 12 nt, Staphylococcus aureus subsp. aureus MW2
aauuguaaaucu

SEQ ID NO: 2111401 - RNA, 18 nt, Staphylococcus aureus subsp. aureus MW2
aauucaaaaugccaagaa

SEQ ID NO: 2111402 - RNA, 19 nt, Staphylococcus aureus subsp. aureus MW2
aauucaacgucaucaaaac

SEQ ID NO: 2111403 - RNA, 19 nt, Staphylococcus aureus subsp. aureus MW2
aauucaaccaauuauuaaa

SEQ ID NO: 2111404 - RNA, 22 nt, Staphylococcus aureus subsp. aureus MW2
aauuauuuuugauggucagcaa

SEQ ID NO: 2111405 - RNA, 18 nt, Staphylococcus aureus subsp. aureus MW2
aauucaauugcuaaauca

SEQ ID NO: 2111406 - RNA, 16 nt, Staphylococcus aureus subsp. aureus MW2
aauucaauaaucuuag

SEQ ID NO: 2111407 - RNA, 15 nt, Staphylococcus aureus subsp. aureus MW2
aauucaauaaucuua

SEQ ID NO: 2111408 - RNA, 22 nt, Staphylococcus aureus subsp. aureus MW2
aauuauuauugcugugauuguc

SEQ ID NO: 2111409 - RNA, 21 nt, Staphylococcus aureus subsp. aureus MW2
aauuauuccuucauugaagaa

SEQ ID NO: 2111410 - RNA, 19 nt, Staphylococcus aureus subsp. aureus MW2
aauuauuuauucauuauag

SEQ ID NO: 2111411 - RNA, 16 nt, Staphylococcus aureus subsp. aureus MW2
aauuauuuauuguucu

SEQ ID NO: 2111412 - RNA, 14 nt, Staphylococcus aureus subsp. aureus MW2
aauuauuucccugg

SEQ ID NO: 2111413 - RNA, 23 nt, Staphylococcus aureus subsp. aureus MW2
aauuauuucccuggaaaaugauu

SEQ ID NO: 2111414 - RNA, 16 nt, Staphylococcus aureus subsp. aureus MW2
aauuauuuaaaaugcu

SEQ ID NO: 2111415 - RNA, 24 nt, Staphylococcus aureus subsp. aureus MW2
aauuauuuauucauuauagucuua

SEQ ID NO: 2111416 - RNA, 17 nt, Staphylococcus aureus subsp. aureus MW2
aauuauuugauagaaau

SEQ ID NO: 2111417 - RNA, 15 nt, Staphylococcus aureus subsp. aureus MW2
aauuaucuuaaguca

SEQ ID NO: 2111418 - RNA, 15 nt, Staphylococcus aureus subsp. aureus MW2
aauuaucuucaucau

SEQ ID NO: 2111419 - RNA, 12 nt, Staphylococcus aureus subsp. aureus MW2
aauuaucauuac

SEQ ID NO: 2111420 - RNA, 18 nt, Staphylococcus aureus subsp. aureus MW2
aauuauccuacugcuguc

SEQ ID NO: 2111421 - RNA, 23 nt, Staphylococcus aureus subsp. aureus MW2
aauuaucauaaauauaagauagu

SEQ ID NO: 2111422 - RNA, 19 nt, Staphylococcus aureus subsp. aureus MW2
aauuaucauuaaauugcuu

SEQ ID NO: 2111423 - RNA, 19 nt, Staphylococcus aureus subsp. aureus MW2
aauuaugaucaauaagauu

SEQ ID NO: 2111424 - RNA, 20 nt, Staphylococcus aureus subsp. aureus MW2
aauuaugaucaauaagauuu

SEQ ID NO: 2111425 - RNA, 18 nt, Staphylococcus aureus subsp. aureus MW2
aauuauuauaguuuagau

SEQ ID NO: 2111426 - RNA, 19 nt, Staphylococcus aureus subsp. aureus MW2
aauuauuauaauaaauaga

SEQ ID NO: 2111427 - RNA, 12 nt, Staphylococcus aureus subsp. aureus MW2
aauuauuauaau

SEQ ID NO: 2111428 - RNA, 17 nt, Staphylococcus aureus subsp. aureus MW2
aauuauggauaaaauuu

SEQ ID NO: 2111429 - RNA, 14 nt, Staphylococcus aureus subsp. aureus MW2
aauuaauuaucuua

SEQ ID NO: 2111430 - RNA, 17 nt, Staphylococcus aureus subsp. aureus MW2
aauuaauucuuugaaaa

SEQ ID NO: 2111431 - RNA, 16 nt, Staphylococcus aureus subsp. aureus MW2
aauuacaaaaguauga

SEQ ID NO: 2111432 - RNA, 19 nt, Staphylococcus aureus subsp. aureus MW2
aauuaaccuugauuuaauu

SEQ ID NO: 2111433 - RNA, 23 nt, Staphylococcus aureus subsp. aureus MW2
aauuaaccuugauuuaauuuuua

SEQ ID NO: 2111434 - RNA, 21 nt, Staphylococcus aureus subsp. aureus MW2
aauguaccgaauccuucauca

SEQ ID NO: 2111435 - RNA, 21 nt, Staphylococcus aureus subsp. aureus MW2
aauguaagcaacauaugauuu

SEQ ID NO: 2111436 - RNA, 21 nt, Staphylococcus aureus subsp. aureus MW2
aauguaauuauugcaucauaa

SEQ ID NO: 2111437 - RNA, 11 nt, Staphylococcus aureus subsp. aureus MW2
aauuaacaaua

SEQ ID NO: 2111438 - RNA, 16 nt, Staphylococcus aureus subsp. aureus MW2
aauuaacaauauuaaa

SEQ ID NO: 2111439 - RNA, 13 nt, Staphylococcus aureus subsp. aureus MW2
aauuacuauauuu

SEQ ID NO: 2111440 - RNA, 19 nt, Staphylococcus aureus subsp. aureus MW2
aauuacuaaccuaaagaua

SEQ ID NO: 2111441 - RNA, 21 nt, Staphylococcus aureus subsp. aureus MW2
aauuacuaaccuaaagauaau

SEQ ID NO: 2111442 - RNA, 18 nt, Staphylococcus aureus subsp. aureus MW2
aauuacacccuuuaaauu

SEQ ID NO: 2111443 - RNA, 18 nt, Staphylococcus aureus subsp. aureus MW2
aauuacgcaaagaaaaac

SEQ ID NO: 2111444 - RNA, 12 nt, Staphylococcus aureus subsp. aureus MW2
aauuagauaaaa

SEQ ID NO: 2111445 - RNA, 18 nt, Staphylococcus aureus subsp. aureus MW2
aauuagauaaaacaaaac

SEQ ID NO: 2111446 - RNA, 17 nt, Staphylococcus aureus subsp. aureus MW2
aauuagaucuaugguua

SEQ ID NO: 2111447 - RNA, 17 nt, Staphylococcus aureus subsp. aureus MW2
aauuagaugaaauggaa

SEQ ID NO: 2111448 - RNA, 22 nt, Staphylococcus aureus subsp. aureus MW2
aauuagcgauacuuuuaaaauc

SEQ ID NO: 2111449 - RNA, 22 nt, Staphylococcus aureus subsp. aureus MW2
aauuagggguggaaauaugaaa

SEQ ID NO: 2111450 - RNA, 15 nt, Staphylococcus aureus subsp. aureus MW2
aauuauagccuucau

SEQ ID NO: 2111451 - RNA, 17 nt, Staphylococcus aureus subsp. aureus MW2
aauuauaggaauuuuuu

SEQ ID NO: 2111452 - RNA, 18 nt, Staphylococcus aureus subsp. aureus MW2
aauuccucccuuuacuuu

SEQ ID NO: 2111453 - RNA, 21 nt, Staphylococcus aureus subsp. aureus MW2
aauuccucccuuuacuuuaua

SEQ ID NO: 2111454 - RNA, 13 nt, Staphylococcus aureus subsp. aureus MW2
aauucguugauuu

SEQ ID NO: 2111455 - RNA, 17 nt, Staphylococcus aureus subsp. aureus MW2
aauucgucuguuucaua

SEQ ID NO: 2111456 - RNA, 22 nt, Staphylococcus aureus subsp. aureus MW2
aauucgcucacaugugaaauaa

SEQ ID NO: 2111457 - RNA, 21 nt, Staphylococcus aureus subsp. aureus MW2
aauucgccuaaaugguuuuga

SEQ ID NO: 2111458 - RNA, 22 nt, Staphylococcus aureus subsp. aureus MW2
aauucgccuaaaugguuuugaa

SEQ ID NO: 2111459 - RNA, 15 nt, Staphylococcus aureus subsp. aureus MW2
aauucgccaucuuuu

SEQ ID NO: 2111460 - RNA, 19 nt, Staphylococcus aureus subsp. aureus MW2
aauucuagucaggggcccc

SEQ ID NO: 2111461 - RNA, 13 nt, Staphylococcus aureus subsp. aureus MW2
aauucuacagaca

SEQ ID NO: 2111462 - RNA, 13 nt, Staphylococcus aureus subsp. aureus MW2
aauucuacaggca

SEQ ID NO: 2111463 - RNA, 13 nt, Staphylococcus aureus subsp. aureus MW2
aauucguuucacu

SEQ ID NO: 2111464 - RNA, 21 nt, Staphylococcus aureus subsp. aureus MW2
aauucuaagucuuuugaaguu

SEQ ID NO: 2111465 - RNA, 23 nt, Staphylococcus aureus subsp. aureus MW2
aauucuaagucuuuugaaguuug

SEQ ID NO: 2111466 - RNA, 17 nt, Staphylococcus aureus subsp. aureus MW2
aauucugaaaucaguuu

SEQ ID NO: 2111467 - RNA, 16 nt, Staphylococcus aureus subsp. aureus MW2
aauucugauuauguuc

SEQ ID NO: 2111468 - RNA, 20 nt, Staphylococcus aureus subsp. aureus MW2
aauucucuguguuggggccc

SEQ ID NO: 2111469 - RNA, 18 nt, Staphylococcus aureus subsp. aureus MW2
aauucucuaacuuuacca

SEQ ID NO: 2111470 - RNA, 14 nt, Staphylococcus aureus subsp. aureus MW2
aauucuaacuugaa

SEQ ID NO: 2111471 - RNA, 17 nt, Staphylococcus aureus subsp. aureus MW2
aauuccauguauucuua

SEQ ID NO: 2111472 - RNA, 15 nt, Staphylococcus aureus subsp. aureus MW2
aauucacgagcugcu

SEQ ID NO: 2111473 - RNA, 15 nt, Staphylococcus aureus subsp. aureus MW2
aauucagaugaauaa

SEQ ID NO: 2111474 - RNA, 14 nt, Staphylococcus aureus subsp. aureus MW2
aauucauaaaugcu

SEQ ID NO: 2111475 - RNA, 16 nt, Staphylococcus aureus subsp. aureus MW2
aauucauaagaaaaau

SEQ ID NO: 2111476 - RNA, 17 nt, Staphylococcus aureus subsp. aureus MW2
aauucauaagaaaaaug

SEQ ID NO: 2111477 - RNA, 20 nt, Staphylococcus aureus subsp. aureus MW2
aauucaucuuaucaagaaua

SEQ ID NO: 2111478 - RNA, 21 nt, Staphylococcus aureus subsp. aureus MW2
aauucaucuuaucaagaauau

SEQ ID NO: 2111479 - RNA, 16 nt, Staphylococcus aureus subsp. aureus MW2
aaugcuuaaaaacaau

SEQ ID NO: 2111480 - RNA, 18 nt, Staphylococcus aureus subsp. aureus MW2
aaugcuucuucuacagau

SEQ ID NO: 2111481 - RNA, 22 nt, Staphylococcus aureus subsp. aureus MW2
aaugcuucuucuacagauuuau

SEQ ID NO: 2111482 - RNA, 20 nt, Staphylococcus aureus subsp. aureus MW2
aaugcguaucgagagauuau

SEQ ID NO: 2111483 - RNA, 18 nt, Staphylococcus aureus subsp. aureus MW2
aaugcuugaauuuuauua

SEQ ID NO: 2111484 - RNA, 14 nt, Staphylococcus aureus subsp. aureus MW2
aaugcuugaauuuu

SEQ ID NO: 2111485 - RNA, 21 nt, Staphylococcus aureus subsp. aureus MW2
aaugcuuuaucgaauucuucu

SEQ ID NO: 2111486 - RNA, 13 nt, Staphylococcus aureus subsp. aureus MW2
aaugcuuuuuuga

SEQ ID NO: 2111487 - RNA, 22 nt, Staphylococcus aureus subsp. aureus MW2
aaugcuuucgcauuauuugcug

SEQ ID NO: 2111488 - RNA, 13 nt, Staphylococcus aureus subsp. aureus MW2
aaugguuucaaaa

SEQ ID NO: 2111489 - RNA, 15 nt, Staphylococcus aureus subsp. aureus MW2
aaugguuucaaaauc

SEQ ID NO: 2111490 - RNA, 24 nt, Staphylococcus aureus subsp. aureus MW2
aauguaaaaucauuaauaauuaaa

SEQ ID NO: 2111491 - RNA, 14 nt, Staphylococcus aureus subsp. aureus MW2
aauguaaaaugaug

SEQ ID NO: 2111492 - RNA, 20 nt, Staphylococcus aureus subsp. aureus MW2
aauguaaaaugaugauuuaa

SEQ ID NO: 2111493 - RNA, 21 nt, Staphylococcus aureus subsp. aureus MW2
aauguaaaaugaugauuuaaa

SEQ ID NO: 2111494 - RNA, 14 nt, Staphylococcus aureus subsp. aureus MW2
aaugguucuaaaau

SEQ ID NO: 2111495 - RNA, 16 nt, Staphylococcus aureus subsp. aureus MW2
aaugguucuaaaauag

SEQ ID NO: 2111496 - RNA, 19 nt, Staphylococcus aureus subsp. aureus MW2
aaugguugauuugauuuaa

SEQ ID NO: 2111497 - RNA, 20 nt, Staphylococcus aureus subsp. aureus MW2
aaugguugauuugauuuaaa

SEQ ID NO: 2111498 - RNA, 15 nt, Staphylococcus aureus subsp. aureus MW2
aauggaugaauauau

SEQ ID NO: 2111499 - RNA, 16 nt, Staphylococcus aureus subsp. aureus MW2
aauggaugaauauauu

SEQ ID NO: 2111500 - RNA, 20 nt, Staphylococcus aureus subsp. aureus MW2
aaugcagcuguauaaccaua

SEQ ID NO: 2111501 - RNA, 21 nt, Staphylococcus aureus subsp. aureus MW2
aaugcaucaguauuaggauuu

SEQ ID NO: 2111502 - RNA, 17 nt, Staphylococcus aureus subsp. aureus MW2
aaugcauuacuacuuua

SEQ ID NO: 2111503 - RNA, 16 nt, Staphylococcus aureus subsp. aureus MW2
aaugcaugugaaauua

SEQ ID NO: 2111504 - RNA, 16 nt, Staphylococcus aureus subsp. aureus MW2
aaugcgaguuggggug

SEQ ID NO: 2111505 - RNA, 15 nt, Staphylococcus aureus subsp. aureus MW2
aaugaauuauuuaaa

SEQ ID NO: 2111506 - RNA, 17 nt, Staphylococcus aureus subsp. aureus MW2
aaugaauucuauccuaa

SEQ ID NO: 2111507 - RNA, 15 nt, Staphylococcus aureus subsp. aureus MW2
aaugaccuggaauau

SEQ ID NO: 2111508 - RNA, 12 nt, Staphylococcus aureus subsp. aureus MW2
aaugaauaauua

SEQ ID NO: 2111509 - RNA, 18 nt, Staphylococcus aureus subsp. aureus MW2
aaugaaccagcuaaccaa

SEQ ID NO: 2111510 - RNA, 16 nt, Staphylococcus aureus subsp. aureus MW2
aaugaauaaauugaua

SEQ ID NO: 2111511 - RNA, 18 nt, Staphylococcus aureus subsp. aureus MW2
aaugaauaaugacaaauu

SEQ ID NO: 2111512 - RNA, 21 nt, Staphylococcus aureus subsp. aureus MW2
aaugaauaauuacuaaaauau

SEQ ID NO: 2111513 - RNA, 19 nt, Staphylococcus aureus subsp. aureus MW2
aaugaauaguaaucagcuu

SEQ ID NO: 2111514 - RNA, 19 nt, Staphylococcus aureus subsp. aureus MW2
aaugaauccaaauauuaaa

SEQ ID NO: 2111515 - RNA, 16 nt, Staphylococcus aureus subsp. aureus MW2
aaugaaugaagacgaa

SEQ ID NO: 2111516 - RNA, 20 nt, Staphylococcus aureus subsp. aureus MW2
aaugagcccguuaaaaagac

SEQ ID NO: 2111517 - RNA, 14 nt, Staphylococcus aureus subsp. aureus MW2
aaugacuaccuguu

SEQ ID NO: 2111518 - RNA, 13 nt, Staphylococcus aureus subsp. aureus MW2
aaugacuaaaucg

SEQ ID NO: 2111519 - RNA, 16 nt, Staphylococcus aureus subsp. aureus MW2
aaugcaacuaaaacua

SEQ ID NO: 2111520 - RNA, 13 nt, Staphylococcus aureus subsp. aureus MW2
aaugauuuugcuu

SEQ ID NO: 2111521 - RNA, 22 nt, Staphylococcus aureus subsp. aureus MW2
aaugauuuuuauuauugucauc

SEQ ID NO: 2111522 - RNA, 17 nt, Staphylococcus aureus subsp. aureus MW2
aaugauggguaguuaau

SEQ ID NO: 2111523 - RNA, 22 nt, Staphylococcus aureus subsp. aureus MW2
aaugauuuaauuuguuauacca

SEQ ID NO: 2111524 - RNA, 23 nt, Staphylococcus aureus subsp. aureus MW2
aaugauuuaauaaacaccaauau

SEQ ID NO: 2111525 - RNA, 15 nt, Staphylococcus aureus subsp. aureus MW2
aaugauuugugguaa

SEQ ID NO: 2111526 - RNA, 13 nt, Staphylococcus aureus subsp. aureus MW2
aaugauuugauaa

SEQ ID NO: 2111527 - RNA, 19 nt, Staphylococcus aureus subsp. aureus MW2
aaugauuugauaauauuau

SEQ ID NO: 2111528 - RNA, 16 nt, Staphylococcus aureus subsp. aureus MW2
aaugaugaauuguaaa

SEQ ID NO: 2111529 - RNA, 20 nt, Staphylococcus aureus subsp. aureus MW2
aaugaucaucguauagaugu

SEQ ID NO: 2111530 - RNA, 17 nt, Staphylococcus aureus subsp. aureus MW2
aaugaaccagcuaacca

SEQ ID NO: 2111531 - RNA, 20 nt, Staphylococcus aureus subsp. aureus MW2
aaugaaaugaaguauggaag

SEQ ID NO: 2111532 - RNA, 19 nt, Staphylococcus aureus subsp. aureus MW2
aaugaaagcaccuaaaaua

SEQ ID NO: 2111533 - RNA, 23 nt, Staphylococcus aureus subsp. aureus MW2
aaugaaagcaccuaaaauagaaa

SEQ ID NO: 2111534 - RNA, 13 nt, Staphylococcus aureus subsp. aureus MW2
aaucuuuuaacuu

SEQ ID NO: 2111535 - RNA, 18 nt, Staphylococcus aureus subsp. aureus MW2
aaugaaaacagguggaag

SEQ ID NO: 2111536 - RNA, 22 nt, Staphylococcus aureus subsp. aureus MW2
aaucuuauuuuguuuuaaaaaa

SEQ ID NO: 2111537 - RNA, 21 nt, Staphylococcus aureus subsp. aureus MW2
aaucuauauaacgcuuuaaau

SEQ ID NO: 2111538 - RNA, 21 nt, Staphylococcus aureus subsp. aureus MW2
aaucuauaccauuccaaaaau

SEQ ID NO: 2111539 - RNA, 14 nt, Staphylococcus aureus subsp. aureus MW2
aaucuauaauacau

SEQ ID NO: 2111540 - RNA, 13 nt, Staphylococcus aureus subsp. aureus MW2
aaucuauaaauau

SEQ ID NO: 2111541 - RNA, 14 nt, Staphylococcus aureus subsp. aureus MW2
aaucuauaaauauc

SEQ ID NO: 2111542 - RNA, 15 nt, Staphylococcus aureus subsp. aureus MW2
aaucuauaaauauca

SEQ ID NO: 2111543 - RNA, 13 nt, Staphylococcus aureus subsp. aureus MW2
aaucuauauaaag

SEQ ID NO: 2111544 - RNA, 19 nt, Staphylococcus aureus subsp. aureus MW2
aaucuauuuucugccauaa

SEQ ID NO: 2111545 - RNA, 14 nt, Staphylococcus aureus subsp. aureus MW2
aaucuuaauugucu

SEQ ID NO: 2111546 - RNA, 21 nt, Staphylococcus aureus subsp. aureus MW2
aaucuguuuaaauuuaaaaga

SEQ ID NO: 2111547 - RNA, 17 nt, Staphylococcus aureus subsp. aureus MW2
aaucuguuuaaauuuaa

SEQ ID NO: 2111548 - RNA, 17 nt, Staphylococcus aureus subsp. aureus MW2
aaucccuucaacaguaa

SEQ ID NO: 2111549 - RNA, 21 nt, Staphylococcus aureus subsp. aureus MW2
aauccgcuuuauuuuaucauc

SEQ ID NO: 2111550 - RNA, 21 nt, Staphylococcus aureus subsp. aureus MW2
aauccuauggcgcaauuuuua

SEQ ID NO: 2111551 - RNA, 22 nt, Staphylococcus aureus subsp. aureus MW2
aauccuaugaauaaauuguaau

SEQ ID NO: 2111552 - RNA, 13 nt, Staphylococcus aureus subsp. aureus MW2
aauccugauucca

SEQ ID NO: 2111553 - RNA, 15 nt, Staphylococcus aureus subsp. aureus MW2
aaucgcauuuaaaua

SEQ ID NO: 2111554 - RNA, 17 nt, Staphylococcus aureus subsp. aureus MW2
aaucgcauuuaaauaua

SEQ ID NO: 2111555 - RNA, 14 nt, Staphylococcus aureus subsp. aureus MW2
aauccuucaucaau

SEQ ID NO: 2111556 - RNA, 14 nt, Staphylococcus aureus subsp. aureus MW2
aaucgccauugucc

SEQ ID NO: 2111557 - RNA, 15 nt, Staphylococcus aureus subsp. aureus MW2
aaucgccuacuauaa

SEQ ID NO: 2111558 - RNA, 14 nt, Staphylococcus aureus subsp. aureus MW2
aaucguauauuaaa

SEQ ID NO: 2111559 - RNA, 15 nt, Staphylococcus aureus subsp. aureus MW2
aaucuagaccuucaa

SEQ ID NO: 2111560 - RNA, 18 nt, Staphylococcus aureus subsp. aureus MW2
aauccauucuucuuguuu

SEQ ID NO: 2111561 - RNA, 21 nt, Staphylococcus aureus subsp. aureus MW2
aaucauuguggcuuuuuuuau

SEQ ID NO: 2111562 - RNA, 19 nt, Staphylococcus aureus subsp. aureus MW2
aauccaaagcugaauuuua

SEQ ID NO: 2111563 - RNA, 19 nt, Staphylococcus aureus subsp. aureus MW2
aaucauuuucuugauuuua

SEQ ID NO: 2111564 - RNA, 21 nt, Staphylococcus aureus subsp. aureus MW2
aaucauuuuucgccaaaaacu

SEQ ID NO: 2111565 - RNA, 13 nt, Staphylococcus aureus subsp. aureus MW2
aauccaaugauga

SEQ ID NO: 2111566 - RNA, 17 nt, Staphylococcus aureus subsp. aureus MW2
aauccaagugacaacau

SEQ ID NO: 2111567 - RNA, 16 nt, Staphylococcus aureus subsp. aureus MW2
aauccaagcaaucuua

SEQ ID NO: 2111568 - RNA, 17 nt, Staphylococcus aureus subsp. aureus MW2
aauccaagcaaucuuag

SEQ ID NO: 2111569 - RNA, 18 nt, Staphylococcus aureus subsp. aureus MW2
aauccaauuaaauauuua

SEQ ID NO: 2111570 - RNA, 17 nt, Staphylococcus aureus subsp. aureus MW2
aauauguaaucagguuu

SEQ ID NO: 2111571 - RNA, 17 nt, Staphylococcus aureus subsp. aureus MW2
aauaugugcaugagacu

SEQ ID NO: 2111572 - RNA, 23 nt, Staphylococcus aureus subsp. aureus MW2
aauauguggcgcucuuauaaaga

SEQ ID NO: 2111573 - RNA, 12 nt, Staphylococcus aureus subsp. aureus MW2
aauauuaaaauc

SEQ ID NO: 2111574 - RNA, 24 nt, Staphylococcus aureus subsp. aureus MW2
aaucagcuuuuucacauugccuaa

SEQ ID NO: 2111575 - RNA, 17 nt, Staphylococcus aureus subsp. aureus MW2
aaucagcuuuuucacau

SEQ ID NO: 2111576 - RNA, 15 nt, Staphylococcus aureus subsp. aureus MW2
aaucagcuuuucuuc

SEQ ID NO: 2111577 - RNA, 17 nt, Staphylococcus aureus subsp. aureus MW2
aaucaguaauaucaagg

SEQ ID NO: 2111578 - RNA, 15 nt, Staphylococcus aureus subsp. aureus MW2
aaucaggaauguuug

SEQ ID NO: 2111579 - RNA, 20 nt, Staphylococcus aureus subsp. aureus MW2
aaucagggacaaaaauucuu

SEQ ID NO: 2111580 - RNA, 20 nt, Staphylococcus aureus subsp. aureus MW2
aaucauagcaacaucggcac

SEQ ID NO: 2111581 - RNA, 16 nt, Staphylococcus aureus subsp. aureus MW2
aaucauagcaacaucg

SEQ ID NO: 2111582 - RNA, 18 nt, Staphylococcus aureus subsp. aureus MW2
aaucauaccggcaaauaa

SEQ ID NO: 2111583 - RNA, 23 nt, Staphylococcus aureus subsp. aureus MW2
aaucauaccggcaaauaacaaug

SEQ ID NO: 2111584 - RNA, 15 nt, Staphylococcus aureus subsp. aureus MW2
aaucaugcauucuau

SEQ ID NO: 2111585 - RNA, 15 nt, Staphylococcus aureus subsp. aureus MW2
aaucaucuuuuugaa

SEQ ID NO: 2111586 - RNA, 20 nt, Staphylococcus aureus subsp. aureus MW2
aaucaugaaauuaaaaacac

SEQ ID NO: 2111587 - RNA, 21 nt, Staphylococcus aureus subsp. aureus MW2
aaucaucuuaacaauuuuaau

SEQ ID NO: 2111588 - RNA, 17 nt, Staphylococcus aureus subsp. aureus MW2
aaucauagcauuaagau

SEQ ID NO: 2111589 - RNA, 22 nt, Staphylococcus aureus subsp. aureus MW2
aaucauguaaugcuuaaaaaca

SEQ ID NO: 2111590 - RNA, 23 nt, Staphylococcus aureus subsp. aureus MW2
aaucauguaaugcuuaaaaacaa

SEQ ID NO: 2111591 - RNA, 18 nt, Staphylococcus aureus subsp. aureus MW2
aaucauuagcgaaaaccu

SEQ ID NO: 2111592 - RNA, 18 nt, Staphylococcus aureus subsp. aureus MW2
aaucauuaguuaugugcu

SEQ ID NO: 2111593 - RNA, 13 nt, Staphylococcus aureus subsp. aureus MW2
aaucauuauagca

SEQ ID NO: 2111594 - RNA, 14 nt, Staphylococcus aureus subsp. aureus MW2
aaucauucacuuca

SEQ ID NO: 2111595 - RNA, 17 nt, Staphylococcus aureus subsp. aureus MW2
aaccuuacccaaaaaau

SEQ ID NO: 2111596 - RNA, 13 nt, Staphylococcus aureus subsp. aureus MW2
aaccuucaguaac

SEQ ID NO: 2111597 - RNA, 14 nt, Staphylococcus aureus subsp. aureus MW2
aaccuuuaaaacau

SEQ ID NO: 2111598 - RNA, 20 nt, Staphylococcus aureus subsp. aureus MW2
aaccuugauuuaauuuuuaa

SEQ ID NO: 2111599 - RNA, 15 nt, Staphylococcus aureus subsp. aureus MW2
aacgaaaauuaagau

SEQ ID NO: 2111600 - RNA, 20 nt, Staphylococcus aureus subsp. aureus MW2
aacgaaaauuaagaugaaau

SEQ ID NO: 2111601 - RNA, 21 nt, Staphylococcus aureus subsp. aureus MW2
aacgaaaauuaagaugaaaua

SEQ ID NO: 2111602 - RNA, 21 nt, Staphylococcus aureus subsp. aureus MW2
aacgaagucagucaauucaaa

SEQ ID NO: 2111603 - RNA, 18 nt, Staphylococcus aureus subsp. aureus MW2
aacgaaggucuacuaaau

SEQ ID NO: 2111604 - RNA, 22 nt, Staphylococcus aureus subsp. aureus MW2
aacgaaucgccuacuauaaaua

SEQ ID NO: 2111605 - RNA, 21 nt, Staphylococcus aureus subsp. aureus MW2
aacgaaucgccuacuauaaau

SEQ ID NO: 2111606 - RNA, 17 nt, Staphylococcus aureus subsp. aureus MW2
aacgaauguuccuuguu

SEQ ID NO: 2111607 - RNA, 23 nt, Staphylococcus aureus subsp. aureus MW2
aacgaaucuauaacgauagauuu

SEQ ID NO: 2111608 - RNA, 22 nt, Staphylococcus aureus subsp. aureus MW2
aacgacaacuugaacuaaaaca

SEQ ID NO: 2111609 - RNA, 22 nt, Staphylococcus aureus subsp. aureus MW2
aaccugagccauaacugaauaa

SEQ ID NO: 2111610 - RNA, 22 nt, Staphylococcus aureus subsp. aureus MW2
aaccucuguuuuguugguguuu

SEQ ID NO: 2111611 - RNA, 17 nt, Staphylococcus aureus subsp. aureus MW2
aaccuaaagauaauauu

SEQ ID NO: 2111612 - RNA, 20 nt, Staphylococcus aureus subsp. aureus MW2
aaccuaaagauaauauuaaa

SEQ ID NO: 2111613 - RNA, 12 nt, Staphylococcus aureus subsp. aureus MW2
aaccuacaauau

SEQ ID NO: 2111614 - RNA, 18 nt, Staphylococcus aureus subsp. aureus MW2
aaccuaccuauuugauua

SEQ ID NO: 2111615 - RNA, 23 nt, Staphylococcus aureus subsp. aureus MW2
aaccuagggauaauuuuauugac

SEQ ID NO: 2111616 - RNA, 21 nt, Staphylococcus aureus subsp. aureus MW2
aaccuacacgaccaagacgaa

SEQ ID NO: 2111617 - RNA, 13 nt, Staphylococcus aureus subsp. aureus MW2
aaccuauuaauua

SEQ ID NO: 2111618 - RNA, 15 nt, Staphylococcus aureus subsp. aureus MW2
aaccuauuaaaauaa

SEQ ID NO: 2111619 - RNA, 14 nt, Staphylococcus aureus subsp. aureus MW2
aaccuaaaaacaaa

SEQ ID NO: 2111620 - RNA, 17 nt, Staphylococcus aureus subsp. aureus MW2
aacgaugcuacuuaaag

SEQ ID NO: 2111621 - RNA, 14 nt, Staphylococcus aureus subsp. aureus MW2
aacgagagagaaaa

SEQ ID NO: 2111622 - RNA, 18 nt, Staphylococcus aureus subsp. aureus MW2
aacgagagagaaaagcua

SEQ ID NO: 2111623 - RNA, 23 nt, Staphylococcus aureus subsp. aureus MW2
aacgauagauucugauacagaac

SEQ ID NO: 2111624 - RNA, 20 nt, Staphylococcus aureus subsp. aureus MW2
aacgauaccuuuaauaauau

SEQ ID NO: 2111625 - RNA, 13 nt, Staphylococcus aureus subsp. aureus MW2
aacgauauagacc

SEQ ID NO: 2111626 - RNA, 13 nt, Staphylococcus aureus subsp. aureus MW2
aacgauauuuuaa

SEQ ID NO: 2111627 - RNA, 22 nt, Staphylococcus aureus subsp. aureus MW2
aacgagcuggugagaaauugaa

SEQ ID NO: 2111628 - RNA, 18 nt, Staphylococcus aureus subsp. aureus MW2
aacgauaagaauuaacaa

SEQ ID NO: 2111629 - RNA, 21 nt, Staphylococcus aureus subsp. aureus MW2
aacgauaacaauuuauuaaaa

SEQ ID NO: 2111630 - RNA, 18 nt, Staphylococcus aureus subsp. aureus MW2
aacgccucaacacuuucu

SEQ ID NO: 2111631 - RNA, 16 nt, Staphylococcus aureus subsp. aureus MW2
aacgccucaacacuuu

SEQ ID NO: 2111632 - RNA, 16 nt, Staphylococcus aureus subsp. aureus MW2
aacgccgaauaaucca

SEQ ID NO: 2111633 - RNA, 22 nt, Staphylococcus aureus subsp. aureus MW2
aacgcuuugcagauugauauaa

SEQ ID NO: 2111634 - RNA, 19 nt, Staphylococcus aureus subsp. aureus MW2
aacguacaauguauuaccu

SEQ ID NO: 2111635 - RNA, 21 nt, Staphylococcus aureus subsp. aureus MW2
aacguacuguguaauaccaau

SEQ ID NO: 2111636 - RNA, 20 nt, Staphylococcus aureus subsp. aureus MW2
aacgguacagauaagaauau

SEQ ID NO: 2111637 - RNA, 18 nt, Staphylococcus aureus subsp. aureus MW2
aacgguaaauaaccacuu

SEQ ID NO: 2111638 - RNA, 14 nt, Staphylococcus aureus subsp. aureus MW2
aacgguagaauaaa

SEQ ID NO: 2111639 - RNA, 23 nt, Staphylococcus aureus subsp. aureus MW2
aacguugccauacccauauuaaa

SEQ ID NO: 2111640 - RNA, 17 nt, Staphylococcus aureus subsp. aureus MW2
aacguugaguauuacuu

SEQ ID NO: 2111641 - RNA, 17 nt, Staphylococcus aureus subsp. aureus MW2
aacguucauauaugaua

SEQ ID NO: 2111642 - RNA, 18 nt, Staphylococcus aureus subsp. aureus MW2
aacguucauauaugauaa

SEQ ID NO: 2111643 - RNA, 13 nt, Staphylococcus aureus subsp. aureus MW2
aacguuugaaaaa

SEQ ID NO: 2111644 - RNA, 15 nt, Staphylococcus aureus subsp. aureus MW2
aacguuugaagaaug

SEQ ID NO: 2111645 - RNA, 17 nt, Staphylococcus aureus subsp. aureus MW2
aacguuuugaccaaucg

SEQ ID NO: 2111646 - RNA, 20 nt, Staphylococcus aureus subsp. aureus MW2
aacguucaaucguuucuucc

SEQ ID NO: 2111647 - RNA, 16 nt, Staphylococcus aureus subsp. aureus MW2
aacguuauuuucaaua

SEQ ID NO: 2111648 - RNA, 18 nt, Staphylococcus aureus subsp. aureus MW2
aacguauauaaguuaaaa

SEQ ID NO: 2111649 - RNA, 15 nt, Staphylococcus aureus subsp. aureus MW2
aacguaucauuuaaa

SEQ ID NO: 2111650 - RNA, 17 nt, Staphylococcus aureus subsp. aureus MW2
aacgucccaacaacaua

SEQ ID NO: 2111651 - RNA, 17 nt, Staphylococcus aureus subsp. aureus MW2
aacgucacaacggcaua

SEQ ID NO: 2111652 - RNA, 13 nt, Staphylococcus aureus subsp. aureus MW2
aacguccaaacac

SEQ ID NO: 2111653 - RNA, 13 nt, Staphylococcus aureus subsp. aureus MW2
aacuacuucauca

SEQ ID NO: 2111654 - RNA, 16 nt, Staphylococcus aureus subsp. aureus MW2
aacuacugcuaaaaua

SEQ ID NO: 2111655 - RNA, 15 nt, Staphylococcus aureus subsp. aureus MW2
aacuagaaugauuaa

SEQ ID NO: 2111656 - RNA, 19 nt, Staphylococcus aureus subsp. aureus MW2
aacuauaauaaagauuaua

SEQ ID NO: 2111657 - RNA, 19 nt, Staphylococcus aureus subsp. aureus MW2
aacuauaaccuauuaaauc

SEQ ID NO: 2111658 - RNA, 21 nt, Staphylococcus aureus subsp. aureus MW2
aacuauaaccgcuacaauuau

SEQ ID NO: 2111659 - RNA, 22 nt, Staphylococcus aureus subsp. aureus MW2
aacuaguguaaugucucuuuuc

SEQ ID NO: 2111660 - RNA, 15 nt, Staphylococcus aureus subsp. aureus MW2
aacuaguauccuuua

SEQ ID NO: 2111661 - RNA, 22 nt, Staphylococcus aureus subsp. aureus MW2
aacuaguauccuuuauaaauaa

SEQ ID NO: 2111662 - RNA, 20 nt, Staphylococcus aureus subsp. aureus MW2
aacuacgauaccggcaacug

SEQ ID NO: 2111663 - RNA, 18 nt, Staphylococcus aureus subsp. aureus MW2
aacuacaauucauaagaa

SEQ ID NO: 2111664 - RNA, 23 nt, Staphylococcus aureus subsp. aureus MW2
aacuacaauucauaagaaaaaug

SEQ ID NO: 2111665 - RNA, 22 nt, Staphylococcus aureus subsp. aureus MW2
aacuacacacguagaaagaugu

SEQ ID NO: 2111666 - RNA, 21 nt, Staphylococcus aureus subsp. aureus MW2
aacuaauuuaaagcaucauau

SEQ ID NO: 2111667 - RNA, 16 nt, Staphylococcus aureus subsp. aureus MW2
aacuaauguuaaaaua

SEQ ID NO: 2111668 - RNA, 16 nt, Staphylococcus aureus subsp. aureus MW2
aacuaauaugauuggu

SEQ ID NO: 2111669 - RNA, 20 nt, Staphylococcus aureus subsp. aureus MW2
aacuaaucguguauuauuga

SEQ ID NO: 2111670 - RNA, 15 nt, Staphylococcus aureus subsp. aureus MW2
aacuaagauauuuag

SEQ ID NO: 2111671 - RNA, 17 nt, Staphylococcus aureus subsp. aureus MW2
aacuaagauauuuagua

SEQ ID NO: 2111672 - RNA, 16 nt, Staphylococcus aureus subsp. aureus MW2
aacuaacuaauaacuc

SEQ ID NO: 2111673 - RNA, 22 nt, Staphylococcus aureus subsp. aureus MW2
aacuaaauacgaguguugguaa

SEQ ID NO: 2111674 - RNA, 20 nt, Staphylococcus aureus subsp. aureus MW2
aacuaaagguauucuauuuu

SEQ ID NO: 2111675 - RNA, 15 nt, Staphylococcus aureus subsp. aureus MW2
aacuaaaccauugaa

SEQ ID NO: 2111676 - RNA, 11 nt, Staphylococcus aureus subsp. aureus MW2
aacuaaaaugu

SEQ ID NO: 2111677 - RNA, 22 nt, Staphylococcus aureus subsp. aureus MW2
aacuaaaaugucuuugaaaaau

SEQ ID NO: 2111678 - RNA, 23 nt, Staphylococcus aureus subsp. aureus MW2
aacuaaaaugucuuugaaaaauu

SEQ ID NO: 2111679 - RNA, 21 nt, Staphylococcus aureus subsp. aureus MW2
aacuaaaauuuguaauuuaaa

SEQ ID NO: 2111680 - RNA, 14 nt, Staphylococcus aureus subsp. aureus MW2
aacuaaaacaauaa

SEQ ID NO: 2111681 - RNA, 17 nt, Staphylococcus aureus subsp. aureus MW2
aacuaaaacaauaauaa

SEQ ID NO: 2111682 - RNA, 19 nt, Staphylococcus aureus subsp. aureus MW2
aacuaaaacaauaauaaua

SEQ ID NO: 2111683 - RNA, 14 nt, Staphylococcus aureus subsp. aureus MW2
aacucauaauuuuc

SEQ ID NO: 2111684 - RNA, 16 nt, Staphylococcus aureus subsp. aureus MW2
aacucauaauuuucua

SEQ ID NO: 2111685 - RNA, 17 nt, Staphylococcus aureus subsp. aureus MW2
aacucauaauuuucuau

SEQ ID NO: 2111686 - RNA, 16 nt, Staphylococcus aureus subsp. aureus MW2
aacucauacaaauuuu

SEQ ID NO: 2111687 - RNA, 18 nt, Staphylococcus aureus subsp. aureus MW2
aacucaguaaauuuauua

SEQ ID NO: 2111688 - RNA, 22 nt, Staphylococcus aureus subsp. aureus MW2
aacucaguaaauuuauuauucg

SEQ ID NO: 2111689 - RNA, 17 nt, Staphylococcus aureus subsp. aureus MW2
aacucauccauugaucu

SEQ ID NO: 2111690 - RNA, 14 nt, Staphylococcus aureus subsp. aureus MW2
aacuaucugauuaa

SEQ ID NO: 2111691 - RNA, 22 nt, Staphylococcus aureus subsp. aureus MW2
aacuaucgauacuaaacgauaa

SEQ ID NO: 2111692 - RNA, 19 nt, Staphylococcus aureus subsp. aureus MW2
aacuauuaauagcaccaua

SEQ ID NO: 2111693 - RNA, 17 nt, Staphylococcus aureus subsp. aureus MW2
aacucaaaaagccaaca

SEQ ID NO: 2111694 - RNA, 15 nt, Staphylococcus aureus subsp. aureus MW2
aacucaacuuaaaua

SEQ ID NO: 2111695 - RNA, 22 nt, Staphylococcus aureus subsp. aureus MW2
aacucuaaauauaauagaaaua

SEQ ID NO: 2111696 - RNA, 14 nt, Staphylococcus aureus subsp. aureus MW2
aacucuaacagcuu

SEQ ID NO: 2111697 - RNA, 22 nt, Staphylococcus aureus subsp. aureus MW2
aacucugauauugaucugauuu

SEQ ID NO: 2111698 - RNA, 17 nt, Staphylococcus aureus subsp. aureus MW2
aacucugauauugaucu

SEQ ID NO: 2111699 - RNA, 15 nt, Staphylococcus aureus subsp. aureus MW2
aacucucuaaaaagc

SEQ ID NO: 2111700 - RNA, 18 nt, Staphylococcus aureus subsp. aureus MW2
aacucuuuaauuuuacca

SEQ ID NO: 2111701 - RNA, 21 nt, Staphylococcus aureus subsp. aureus MW2
aacucguugcgcucuuuucuu

SEQ ID NO: 2111702 - RNA, 14 nt, Staphylococcus aureus subsp. aureus MW2
aacugcuaauuuuu

SEQ ID NO: 2111703 - RNA, 14 nt, Staphylococcus aureus subsp. aureus MW2
aacugcaauaauua

SEQ ID NO: 2111704 - RNA, 20 nt, Staphylococcus aureus subsp. aureus MW2
aacugcaaaaccauguguag

SEQ ID NO: 2111705 - RNA, 20 nt, Staphylococcus aureus subsp. aureus MW2
aacugcauguacaucuuuag

SEQ ID NO: 2111706 - RNA, 23 nt, Staphylococcus aureus subsp. aureus MW2
aacugaguucaauuaaauuauau

SEQ ID NO: 2111707 - RNA, 17 nt, Staphylococcus aureus subsp. aureus MW2
aacugauaaaaggggaa

SEQ ID NO: 2111708 - RNA, 17 nt, Staphylococcus aureus subsp. aureus MW2
aacugaucauuuucauu

SEQ ID NO: 2111709 - RNA, 23 nt, Staphylococcus aureus subsp. aureus MW2
aacugaucauuuucauuuaaccc

SEQ ID NO: 2111710 - RNA, 21 nt, Staphylococcus aureus subsp. aureus MW2
aacugaguucaauuaaauuau

SEQ ID NO: 2111711 - RNA, 23 nt, Staphylococcus aureus subsp. aureus MW2
aacuguucuuucgucuuguaaac

SEQ ID NO: 2111712 - RNA, 15 nt, Staphylococcus aureus subsp. aureus MW2
aacuguuuaucauga

SEQ ID NO: 2111713 - RNA, 23 nt, Staphylococcus aureus subsp. aureus MW2
aacuguucuaaaauuaaccauuu

SEQ ID NO: 2111714 - RNA, 13 nt, Staphylococcus aureus subsp. aureus MW2
aacuuaaaaauga

SEQ ID NO: 2111715 - RNA, 19 nt, Staphylococcus aureus subsp. aureus MW2
aacuuaaaagagaauauaa

SEQ ID NO: 2111716 - RNA, 23 nt, Staphylococcus aureus subsp. aureus MW2
aacuuaaaagagaauauaaaaua

SEQ ID NO: 2111717 - RNA, 16 nt, Staphylococcus aureus subsp. aureus MW2
aacuuaaaauauuuaa

SEQ ID NO: 2111718 - RNA, 20 nt, Staphylococcus aureus subsp. aureus MW2
aacuuaaauaucgacaaauu

SEQ ID NO: 2111719 - RNA, 11 nt, Staphylococcus aureus subsp. aureus MW2
aacuuaaauau

SEQ ID NO: 2111720 - RNA, 20 nt, Staphylococcus aureus subsp. aureus MW2
aacugugauauuaauugaaa

SEQ ID NO: 2111721 - RNA, 21 nt, Staphylococcus aureus subsp. aureus MW2
aacugugcaugacgauaauga

SEQ ID NO: 2111722 - RNA, 23 nt, Staphylococcus aureus subsp. aureus MW2
aacugugcaugacgauaaugaaa

SEQ ID NO: 2111723 - RNA, 23 nt, Staphylococcus aureus subsp. aureus MW2
aacuguaacgugaggcccauaaa

SEQ ID NO: 2111724 - RNA, 23 nt, Staphylococcus aureus subsp. aureus MW2
aacuguaugccgccuaauaauaa

SEQ ID NO: 2111725 - RNA, 14 nt, Staphylococcus aureus subsp. aureus MW2
aacugggauauaga

SEQ ID NO: 2111726 - RNA, 13 nt, Staphylococcus aureus subsp. aureus MW2
aacuguaaaacau

SEQ ID NO: 2111727 - RNA, 14 nt, Staphylococcus aureus subsp. aureus MW2
aacuggaacuuaca

SEQ ID NO: 2111728 - RNA, 12 nt, Staphylococcus aureus subsp. aureus MW2
aacuucuacagu

SEQ ID NO: 2111729 - RNA, 22 nt, Staphylococcus aureus subsp. aureus MW2
aacuucugaaacgccucaacac

SEQ ID NO: 2111730 - RNA, 13 nt, Staphylococcus aureus subsp. aureus MW2
aacuucucuuagu

SEQ ID NO: 2111731 - RNA, 22 nt, Staphylococcus aureus subsp. aureus MW2
aacuucuucuccguauuuaccu

SEQ ID NO: 2111732 - RNA, 16 nt, Staphylococcus aureus subsp. aureus MW2
aacuucauaauauauc

SEQ ID NO: 2111733 - RNA, 13 nt, Staphylococcus aureus subsp. aureus MW2
aacuucaucuaaa

SEQ ID NO: 2111734 - RNA, 15 nt, Staphylococcus aureus subsp. aureus MW2
aacuuaccaugauga

SEQ ID NO: 2111735 - RNA, 18 nt, Staphylococcus aureus subsp. aureus MW2
aacuuacauuacauauau

SEQ ID NO: 2111736 - RNA, 21 nt, Staphylococcus aureus subsp. aureus MW2
aacuuaccgcugcuuuuacuc

SEQ ID NO: 2111737 - RNA, 22 nt, Staphylococcus aureus subsp. aureus MW2
aacuuaccaugaugagauaaaa

SEQ ID NO: 2111738 - RNA, 21 nt, Staphylococcus aureus subsp. aureus MW2
aacuuagaccccuaauuaaaa

SEQ ID NO: 2111739 - RNA, 14 nt, Staphylococcus aureus subsp. aureus MW2
aacuuacuuuugua

SEQ ID NO: 2111740 - RNA, 15 nt, Staphylococcus aureus subsp. aureus MW2
aacuuacuuuuguaa

SEQ ID NO: 2111741 - RNA, 20 nt, Staphylococcus aureus subsp. aureus MW2
aacuuauauacguugauuaa

SEQ ID NO: 2111742 - RNA, 12 nt, Staphylococcus aureus subsp. aureus MW2
aacuuauaauau

SEQ ID NO: 2111743 - RNA, 14 nt, Staphylococcus aureus subsp. aureus MW2
aacuucaauaaugu

SEQ ID NO: 2111744 - RNA, 13 nt, Staphylococcus aureus subsp. aureus MW2
aacuuauuauuua

SEQ ID NO: 2111745 - RNA, 13 nt, Staphylococcus aureus subsp. aureus MW2
aacuuauucuuca

SEQ ID NO: 2111746 - RNA, 18 nt, Staphylococcus aureus subsp. aureus MW2
aacuuauucaaacagucc

SEQ ID NO: 2111747 - RNA, 19 nt, Staphylococcus aureus subsp. aureus MW2
aacuuuuuaacugccauau

SEQ ID NO: 2111748 - RNA, 17 nt, Staphylococcus aureus subsp. aureus MW2
aacuuuuuaacugccau

SEQ ID NO: 2111749 - RNA, 19 nt, Staphylococcus aureus subsp. aureus MW2
aacuuugucuguauuauua

SEQ ID NO: 2111750 - RNA, 15 nt, Staphylococcus aureus subsp. aureus MW2
aacuuucucaaauua

SEQ ID NO: 2111751 - RNA, 22 nt, Staphylococcus aureus subsp. aureus MW2
aacuuucucaaauuagauaaaa

SEQ ID NO: 2111752 - RNA, 16 nt, Staphylococcus aureus subsp. aureus MW2
aacuuucccuacugcu

SEQ ID NO: 2111753 - RNA, 20 nt, Staphylococcus aureus subsp. aureus MW2
aacuuuaccaauaucaugca

SEQ ID NO: 2111754 - RNA, 16 nt, Staphylococcus aureus subsp. aureus MW2
aacuuuagacauaaaa

SEQ ID NO: 2111755 - RNA, 20 nt, Staphylococcus aureus subsp. aureus MW2
aacuuuaguuguuaggggcu

SEQ ID NO: 2111756 - RNA, 21 nt, Staphylococcus aureus subsp. aureus MW2
aacuugaucauuauaaaaugg

SEQ ID NO: 2111757 - RNA, 19 nt, Staphylococcus aureus subsp. aureus MW2
aacuugaucauuauaaaau

SEQ ID NO: 2111758 - RNA, 17 nt, Staphylococcus aureus subsp. aureus MW2
aacuugaucauuauaaa

SEQ ID NO: 2111759 - RNA, 18 nt, Staphylococcus aureus subsp. aureus MW2
aacuugccugguaacguu

SEQ ID NO: 2111760 - RNA, 15 nt, Staphylococcus aureus subsp. aureus MW2
aacuugcuuuguucu

SEQ ID NO: 2111761 - RNA, 21 nt, Staphylococcus aureus subsp. aureus MW2
aacuugcauugccuguagaau

SEQ ID NO: 2111762 - RNA, 21 nt, Staphylococcus aureus subsp. aureus MW2
aacuugcauugucuguagaaa

SEQ ID NO: 2111763 - RNA, 12 nt, Staphylococcus aureus subsp. aureus MW2
aacuugcacauu

SEQ ID NO: 2111764 - RNA, 17 nt, Staphylococcus aureus subsp. aureus MW2
aacuugcacauuauugu

SEQ ID NO: 2111765 - RNA, 22 nt, Staphylococcus aureus subsp. aureus MW2
aacuucuuuuguuuuaccauca

SEQ ID NO: 2111766 - RNA, 21 nt, Staphylococcus aureus subsp. aureus MW2
aacuucuuuuguuuuaccauc

SEQ ID NO: 2111767 - RNA, 12 nt, Staphylococcus aureus subsp. aureus MW2
aacuugggauuu

SEQ ID NO: 2111768 - RNA, 20 nt, Staphylococcus aureus subsp. aureus MW2
aacuugugauauauaaccau

SEQ ID NO: 2111769 - RNA, 22 nt, Staphylococcus aureus subsp. aureus MW2
aacuuuaauuaaagcaucuuca

SEQ ID NO: 2111770 - RNA, 20 nt, Staphylococcus aureus subsp. aureus MW2
aacuuuaauuaaagcaucuu

SEQ ID NO: 2111771 - RNA, 13 nt, Staphylococcus aureus subsp. aureus MW2
aacuuuaauacua

SEQ ID NO: 2111772 - RNA, 20 nt, Staphylococcus aureus subsp. aureus MW2
aacuuuaauauaaguauaau

SEQ ID NO: 2111773 - RNA, 23 nt, Staphylococcus aureus subsp. aureus MW2
aacuuguuguuauuuauuugauu

SEQ ID NO: 2111774 - RNA, 12 nt, Staphylococcus aureus subsp. aureus MW2
aacuuuaacauc

SEQ ID NO: 2111775 - RNA, 14 nt, Staphylococcus aureus subsp. aureus MW2
aagaaauuuuuucu

SEQ ID NO: 2111776 - RNA, 13 nt, Staphylococcus aureus subsp. aureus MW2
aagaaauuguguu

SEQ ID NO: 2111777 - RNA, 17 nt, Staphylococcus aureus subsp. aureus MW2
aagaacguguuugaaug

SEQ ID NO: 2111778 - RNA, 19 nt, Staphylococcus aureus subsp. aureus MW2
aagaaggaugaguuuaaaa

SEQ ID NO: 2111779 - RNA, 21 nt, Staphylococcus aureus subsp. aureus MW2
aagaaggaugaguuuaaaaau

SEQ ID NO: 2111780 - RNA, 22 nt, Staphylococcus aureus subsp. aureus MW2
aagaagcuggcggaaagucagg

SEQ ID NO: 2111781 - RNA, 18 nt, Staphylococcus aureus subsp. aureus MW2
aagaagauuaugaaaaca

SEQ ID NO: 2111782 - RNA, 15 nt, Staphylococcus aureus subsp. aureus MW2
aagaacuuuaaaaau

SEQ ID NO: 2111783 - RNA, 15 nt, Staphylococcus aureus subsp. aureus MW2
aagaacuugcuuuuc

SEQ ID NO: 2111784 - RNA, 15 nt, Staphylococcus aureus subsp. aureus MW2
aagaacuuaauguuc

SEQ ID NO: 2111785 - RNA, 13 nt, Staphylococcus aureus subsp. aureus MW2
aagaaaauacuaa

SEQ ID NO: 2111786 - RNA, 15 nt, Staphylococcus aureus subsp. aureus MW2
aagaaaauacuaaca

SEQ ID NO: 2111787 - RNA, 21 nt, Staphylococcus aureus subsp. aureus MW2
aagaaaaauuuucuugguuug

SEQ ID NO: 2111788 - RNA, 20 nt, Staphylococcus aureus subsp. aureus MW2
aagaaaacagguuaucacaa

SEQ ID NO: 2111789 - RNA, 22 nt, Staphylococcus aureus subsp. aureus MW2
aagaaaacagguuaucacaaca

SEQ ID NO: 2111790 - RNA, 18 nt, Staphylococcus aureus subsp. aureus MW2
aagaaaauacuaacaauu

SEQ ID NO: 2111791 - RNA, 20 nt, Staphylococcus aureus subsp. aureus MW2
aagaaaaagugauaauuaaa

SEQ ID NO: 2111792 - RNA, 24 nt, Staphylococcus aureus subsp. aureus MW2
aagaaaaauguguuaaaauauauu

SEQ ID NO: 2111793 - RNA, 15 nt, Staphylococcus aureus subsp. aureus MW2
aacuuuuuuaacagc

SEQ ID NO: 2111794 - RNA, 13 nt, Staphylococcus aureus subsp. aureus MW2
aacuuuuuuaacu

SEQ ID NO: 2111795 - RNA, 14 nt, Staphylococcus aureus subsp. aureus MW2
aacuuuuuuaacuu

SEQ ID NO: 2111796 - RNA, 13 nt, Staphylococcus aureus subsp. aureus MW2
aacuuuuuuaaca

SEQ ID NO: 2111797 - RNA, 15 nt, Staphylococcus aureus subsp. aureus MW2
aacuuuuuuaacuuu

SEQ ID NO: 2111798 - RNA, 16 nt, Staphylococcus aureus subsp. aureus MW2
aagaaaucaacaacuu

SEQ ID NO: 2111799 - RNA, 14 nt, Staphylococcus aureus subsp. aureus MW2
aagaaaucaacaac

SEQ ID NO: 2111800 - RNA, 17 nt, Staphylococcus aureus subsp. aureus MW2
aagaaauucgcaagccu

SEQ ID NO: 2111801 - RNA, 11 nt, Staphylococcus aureus subsp. aureus MW2
uuucaaaaaua

SEQ ID NO: 2111802 - RNA, 23 nt, Staphylococcus aureus subsp. aureus MW2
uuucaaaaaggaauucuacagaa

SEQ ID NO: 2111803 - RNA, 23 nt, Staphylococcus aureus subsp. aureus MW2
uuucaaaaaaagcugauuucuau

SEQ ID NO: 2111804 - RNA, 18 nt, Staphylococcus aureus subsp. aureus MW2
aaauugcuugaaauuauu

SEQ ID NO: 2111805 - RNA, 17 nt, Staphylococcus aureus subsp. aureus MW2
aaauugccuuucauuuu

SEQ ID NO: 2111806 - RNA, 17 nt, Staphylococcus aureus subsp. aureus MW2
aaauugcguuguuucau

SEQ ID NO: 2111807 - RNA, 19 nt, Staphylococcus aureus subsp. aureus MW2
aaauugcguuguuucauua

SEQ ID NO: 2111808 - RNA, 19 nt, Staphylococcus aureus subsp. aureus MW2
aaauugcuaaaaaaauuaa

SEQ ID NO: 2111809 - RNA, 14 nt, Staphylococcus aureus subsp. aureus MW2
aaauuuaaaauaau

SEQ ID NO: 2111810 - RNA, 16 nt, Staphylococcus aureus subsp. aureus MW2
aaauuuaaauauugaa

SEQ ID NO: 2111811 - RNA, 15 nt, Staphylococcus aureus subsp. aureus MW2
aaauuuaauauuguu

SEQ ID NO: 2111812 - RNA, 13 nt, Staphylococcus aureus subsp. aureus MW2
aaauuuacaaaaa

SEQ ID NO: 2111813 - RNA, 15 nt, Staphylococcus aureus subsp. aureus MW2
aaauuuacaaaaacu

SEQ ID NO: 2111814 - RNA, 22 nt, Staphylococcus aureus subsp. aureus MW2
aaauuuauauagucuaugaaua

SEQ ID NO: 2111815 - RNA, 23 nt, Staphylococcus aureus subsp. aureus MW2
aaauuguguugaaucaacaguuu

SEQ ID NO: 2111816 - RNA, 20 nt, Staphylococcus aureus subsp. aureus MW2
aaauuguuuacuauacuuug

SEQ ID NO: 2111817 - RNA, 18 nt, Staphylococcus aureus subsp. aureus MW2
aaauuguguuucuuuuau

SEQ ID NO: 2111818 - RNA, 15 nt, Staphylococcus aureus subsp. aureus MW2
aaauugguuuggaua

SEQ ID NO: 2111819 - RNA, 14 nt, Staphylococcus aureus subsp. aureus MW2
aaauuguaugaaua

SEQ ID NO: 2111820 - RNA, 23 nt, Staphylococcus aureus subsp. aureus MW2
aaauugguuuggauaaaaugaua

SEQ ID NO: 2111821 - RNA, 20 nt, Staphylococcus aureus subsp. aureus MW2
aaauuguggcguaguuugaa

SEQ ID NO: 2111822 - RNA, 16 nt, Staphylococcus aureus subsp. aureus MW2
aaauuguguugaauca

SEQ ID NO: 2111823 - RNA, 21 nt, Staphylococcus aureus subsp. aureus MW2
aaauuuccucaccuucauuuu

SEQ ID NO: 2111824 - RNA, 18 nt, Staphylococcus aureus subsp. aureus MW2
aaauuuccacuuugaucu

SEQ ID NO: 2111825 - RNA, 21 nt, Staphylococcus aureus subsp. aureus MW2
aaauuucugaacauaaaaaaa

SEQ ID NO: 2111826 - RNA, 18 nt, Staphylococcus aureus subsp. aureus MW2
aaauuuauuauaaaauag

SEQ ID NO: 2111827 - RNA, 13 nt, Staphylococcus aureus subsp. aureus MW2
aaauuuauuauuc

SEQ ID NO: 2111828 - RNA, 22 nt, Staphylococcus aureus subsp. aureus MW2
aaauuuauuauucguuucuuua

SEQ ID NO: 2111829 - RNA, 14 nt, Staphylococcus aureus subsp. aureus MW2
aaauuuauuauaaa

SEQ ID NO: 2111830 - RNA, 19 nt, Staphylococcus aureus subsp. aureus MW2
aaauuuauaauuuguauaa

SEQ ID NO: 2111831 - RNA, 17 nt, Staphylococcus aureus subsp. aureus MW2
aaauuuauuuuuaauuu

SEQ ID NO: 2111832 - RNA, 21 nt, Staphylococcus aureus subsp. aureus MW2
aaauuucaagguauacacaaa

SEQ ID NO: 2111833 - RNA, 22 nt, Staphylococcus aureus subsp. aureus MW2
aaauuuauuauaaaauagaagu

SEQ ID NO: 2111834 - RNA, 12 nt, Staphylococcus aureus subsp. aureus MW2
aaauuuugaaga

SEQ ID NO: 2111835 - RNA, 17 nt, Staphylococcus aureus subsp. aureus MW2
aaauuuucauuuuggua

SEQ ID NO: 2111836 - RNA, 19 nt, Staphylococcus aureus subsp. aureus MW2
aaauuuucuaaauguguua

SEQ ID NO: 2111837 - RNA, 13 nt, Staphylococcus aureus subsp. aureus MW2
aaauuuugauuua

SEQ ID NO: 2111838 - RNA, 21 nt, Staphylococcus aureus subsp. aureus MW2
aaauuuuggcgucaucauuag

SEQ ID NO: 2111839 - RNA, 17 nt, Staphylococcus aureus subsp. aureus MW2
aaauuuuuaagaagcuu

SEQ ID NO: 2111840 - RNA, 22 nt, Staphylococcus aureus subsp. aureus MW2
aaauuuuaucaauuucuucccc

SEQ ID NO: 2111841 - RNA, 14 nt, Staphylococcus aureus subsp. aureus MW2
aaauuuuaugaauc

SEQ ID NO: 2111842 - RNA, 17 nt, Staphylococcus aureus subsp. aureus MW2
aaauuugaaauauacca

SEQ ID NO: 2111843 - RNA, 15 nt, Staphylococcus aureus subsp. aureus MW2
aaauuugcaugaaaa

SEQ ID NO: 2111844 - RNA, 19 nt, Staphylococcus aureus subsp. aureus MW2
aaauuugauuuucaauuuc

SEQ ID NO: 2111845 - RNA, 23 nt, Staphylococcus aureus subsp. aureus MW2
aacaaccguuuuaaguacagcau

SEQ ID NO: 2111846 - RNA, 15 nt, Staphylococcus aureus subsp. aureus MW2
aacaaccuauuaauu

SEQ ID NO: 2111847 - RNA, 19 nt, Staphylococcus aureus subsp. aureus MW2
aacaaccuauuaauugaaa

SEQ ID NO: 2111848 - RNA, 12 nt, Staphylococcus aureus subsp. aureus MW2
aacaacaucaaa

SEQ ID NO: 2111849 - RNA, 19 nt, Staphylococcus aureus subsp. aureus MW2
aacaacugcaauagcuaua

SEQ ID NO: 2111850 - RNA, 23 nt, Staphylococcus aureus subsp. aureus MW2
aacaacugcaauagcuauaacuc

SEQ ID NO: 2111851 - RNA, 12 nt, Staphylococcus aureus subsp. aureus MW2
aacaacuaagau

SEQ ID NO: 2111852 - RNA, 17 nt, Staphylococcus aureus subsp. aureus MW2
aacaagaaguuuccaac

SEQ ID NO: 2111853 - RNA, 12 nt, Staphylococcus aureus subsp. aureus MW2
aacaagaauaaa

SEQ ID NO: 2111854 - RNA, 17 nt, Staphylococcus aureus subsp. aureus MW2
aacaagccuuaaaauau

SEQ ID NO: 2111855 - RNA, 19 nt, Staphylococcus aureus subsp. aureus MW2
aacaagauuccuaaagaau

SEQ ID NO: 2111856 - RNA, 20 nt, Staphylococcus aureus subsp. aureus MW2
aacaagcuuuucauuuuuau

SEQ ID NO: 2111857 - RNA, 18 nt, Staphylococcus aureus subsp. aureus MW2
aacaaguugauaacuauu

SEQ ID NO: 2111858 - RNA, 14 nt, Staphylococcus aureus subsp. aureus MW2
aacaaguucauuuc

SEQ ID NO: 2111859 - RNA, 18 nt, Staphylococcus aureus subsp. aureus MW2
aacaaaauauacuaaauu

SEQ ID NO: 2111860 - RNA, 14 nt, Staphylococcus aureus subsp. aureus MW2
aacaaaagaaaguu

SEQ ID NO: 2111861 - RNA, 16 nt, Staphylococcus aureus subsp. aureus MW2
aacaaaagugaauguu

SEQ ID NO: 2111862 - RNA, 13 nt, Staphylococcus aureus subsp. aureus MW2
aacaaaaggcugg

SEQ ID NO: 2111863 - RNA, 17 nt, Staphylococcus aureus subsp. aureus MW2
aacaaaacuuaaaauau

SEQ ID NO: 2111864 - RNA, 22 nt, Staphylococcus aureus subsp. aureus MW2
aacaaaacuugagcuauucaua

SEQ ID NO: 2111865 - RNA, 15 nt, Staphylococcus aureus subsp. aureus MW2
aacaaaaugauuggu

SEQ ID NO: 2111866 - RNA, 14 nt, Staphylococcus aureus subsp. aureus MW2
aacaaaauuaaaua

SEQ ID NO: 2111867 - RNA, 13 nt, Staphylococcus aureus subsp. aureus MW2
aacaaaauuaaau

SEQ ID NO: 2111868 - RNA, 15 nt, Staphylococcus aureus subsp. aureus MW2
aacaaauaguucaaa

SEQ ID NO: 2111869 - RNA, 14 nt, Staphylococcus aureus subsp. aureus MW2
aacaaauauaauac

SEQ ID NO: 2111870 - RNA, 12 nt, Staphylococcus aureus subsp. aureus MW2
aacaaauaaaaa

SEQ ID NO: 2111871 - RNA, 23 nt, Staphylococcus aureus subsp. aureus MW2
aacaaaguaauccccgaagcaca

SEQ ID NO: 2111872 - RNA, 17 nt, Staphylococcus aureus subsp. aureus MW2
aacaaaucuuuuaaauu

SEQ ID NO: 2111873 - RNA, 21 nt, Staphylococcus aureus subsp. aureus MW2
aacaaauauaauguauaaaac

SEQ ID NO: 2111874 - RNA, 22 nt, Staphylococcus aureus subsp. aureus MW2
aacaaauauaauguauaaaaca

SEQ ID NO: 2111875 - RNA, 17 nt, Staphylococcus aureus subsp. aureus MW2
aacaaauucauauuaac

SEQ ID NO: 2111876 - RNA, 12 nt, Staphylococcus aureus subsp. aureus MW2
aacaaauuaaaa

SEQ ID NO: 2111877 - RNA, 20 nt, Staphylococcus aureus subsp. aureus MW2
aacaaauucauauuaacugu

SEQ ID NO: 2111878 - RNA, 19 nt, Staphylococcus aureus subsp. aureus MW2
aacaaaugaaaaaguaaaa

SEQ ID NO: 2111879 - RNA, 19 nt, Staphylococcus aureus subsp. aureus MW2
aacaaauucauauuaacug

SEQ ID NO: 2111880 - RNA, 15 nt, Staphylococcus aureus subsp. aureus MW2
aacaacaaucaaauu

SEQ ID NO: 2111881 - RNA, 17 nt, Staphylococcus aureus subsp. aureus MW2
aacaauugauugcucua

SEQ ID NO: 2111882 - RNA, 16 nt, Staphylococcus aureus subsp. aureus MW2
aacaauucuucaucau

SEQ ID NO: 2111883 - RNA, 14 nt, Staphylococcus aureus subsp. aureus MW2
aacaauucauuaau

SEQ ID NO: 2111884 - RNA, 20 nt, Staphylococcus aureus subsp. aureus MW2
aacaauugguuguuucaauu

SEQ ID NO: 2111885 - RNA, 21 nt, Staphylococcus aureus subsp. aureus MW2
aacaauugguuguuucaauuc

SEQ ID NO: 2111886 - RNA, 16 nt, Staphylococcus aureus subsp. aureus MW2
aacaauuuaaaaagca

SEQ ID NO: 2111887 - RNA, 15 nt, Staphylococcus aureus subsp. aureus MW2
aacaauuuauuaaaa

SEQ ID NO: 2111888 - RNA, 12 nt, Staphylococcus aureus subsp. aureus MW2
aacaauuuuaaa

SEQ ID NO: 2111889 - RNA, 22 nt, Staphylococcus aureus subsp. aureus MW2
aacaauuugaggauacauaaau

SEQ ID NO: 2111890 - RNA, 18 nt, Staphylococcus aureus subsp. aureus MW2
aacaauuugcauaacauu

SEQ ID NO: 2111891 - RNA, 16 nt, Staphylococcus aureus subsp. aureus MW2
aacaauuuuaucugaa

SEQ ID NO: 2111892 - RNA, 18 nt, Staphylococcus aureus subsp. aureus MW2
aacacaaaaaugaagaau

SEQ ID NO: 2111893 - RNA, 19 nt, Staphylococcus aureus subsp. aureus MW2
aacacaaaaaugaagaaua

SEQ ID NO: 2111894 - RNA, 22 nt, Staphylococcus aureus subsp. aureus MW2
aacaauuuuaauuuuucauuaa

SEQ ID NO: 2111895 - RNA, 20 nt, Staphylococcus aureus subsp. aureus MW2
aacacaaggaauauacaaua

SEQ ID NO: 2111896 - RNA, 14 nt, Staphylococcus aureus subsp. aureus MW2
aacaauauaauaua

SEQ ID NO: 2111897 - RNA, 17 nt, Staphylococcus aureus subsp. aureus MW2
aacaauauaauauauac

SEQ ID NO: 2111898 - RNA, 21 nt, Staphylococcus aureus subsp. aureus MW2
aacaauauaauauauacaaau

SEQ ID NO: 2111899 - RNA, 13 nt, Staphylococcus aureus subsp. aureus MW2
aacaauaucaucu

SEQ ID NO: 2111900 - RNA, 21 nt, Staphylococcus aureus subsp. aureus MW2
aacaauagguacaacuaaaua

SEQ ID NO: 2111901 - RNA, 22 nt, Staphylococcus aureus subsp. aureus MW2
aacaauagguacaacuaaauau

SEQ ID NO: 2111902 - RNA, 13 nt, Staphylococcus aureus subsp. aureus MW2
aacaaucagauaa

SEQ ID NO: 2111903 - RNA, 19 nt, Staphylococcus aureus subsp. aureus MW2
aacaaucagauaaguuacu

SEQ ID NO: 2111904 - RNA, 16 nt, Staphylococcus aureus subsp. aureus MW2
aacaaucaaauuacaa

SEQ ID NO: 2111905 - RNA, 21 nt, Staphylococcus aureus subsp. aureus MW2
aacaauauuaaauuucugaac

SEQ ID NO: 2111906 - RNA, 19 nt, Staphylococcus aureus subsp. aureus MW2
aacaauagguacaacuaaa

SEQ ID NO: 2111907 - RNA, 14 nt, Staphylococcus aureus subsp. aureus MW2
aacaauaauaauaa

SEQ ID NO: 2111908 - RNA, 13 nt, Staphylococcus aureus subsp. aureus MW2
aacaauaauaugc

SEQ ID NO: 2111909 - RNA, 13 nt, Staphylococcus aureus subsp. aureus MW2
aacaauaauugau

SEQ ID NO: 2111910 - RNA, 13 nt, Staphylococcus aureus subsp. aureus MW2
aacaauaaucaau

SEQ ID NO: 2111911 - RNA, 19 nt, Staphylococcus aureus subsp. aureus MW2
aacaaugcgaagaaaucau

SEQ ID NO: 2111912 - RNA, 15 nt, Staphylococcus aureus subsp. aureus MW2
aacaaugcaaguugg

SEQ ID NO: 2111913 - RNA, 15 nt, Staphylococcus aureus subsp. aureus MW2
aacaaucguuuuaau

SEQ ID NO: 2111914 - RNA, 18 nt, Staphylococcus aureus subsp. aureus MW2
aacaaucuccgguuuaau

SEQ ID NO: 2111915 - RNA, 18 nt, Staphylococcus aureus subsp. aureus MW2
aacaaucggaagcauauu

SEQ ID NO: 2111916 - RNA, 20 nt, Staphylococcus aureus subsp. aureus MW2
aacacgaacugcauagguaa

SEQ ID NO: 2111917 - RNA, 22 nt, Staphylococcus aureus subsp. aureus MW2
aacacgaaauugugaacuaaau

SEQ ID NO: 2111918 - RNA, 20 nt, Staphylococcus aureus subsp. aureus MW2
aacaccgcaaugccacauca

SEQ ID NO: 2111919 - RNA, 11 nt, Staphylococcus aureus subsp. aureus MW2
aacacagagaa

SEQ ID NO: 2111920 - RNA, 12 nt, Staphylococcus aureus subsp. aureus MW2
aacacagagaaa

SEQ ID NO: 2111921 - RNA, 18 nt, Staphylococcus aureus subsp. aureus MW2
aacacagagaauuucgaa

SEQ ID NO: 2111922 - RNA, 12 nt, Staphylococcus aureus subsp. aureus MW2
aacacagagaau

SEQ ID NO: 2111923 - RNA, 14 nt, Staphylococcus aureus subsp. aureus MW2
aacacagaagcuga

SEQ ID NO: 2111924 - RNA, 16 nt, Staphylococcus aureus subsp. aureus MW2
aacacaguacaaauaa

SEQ ID NO: 2111925 - RNA, 21 nt, Staphylococcus aureus subsp. aureus MW2
aacacaucuauguggcuacuu

SEQ ID NO: 2111926 - RNA, 11 nt, Staphylococcus aureus subsp. aureus MW2
aacacaucuau

SEQ ID NO: 2111927 - RNA, 20 nt, Staphylococcus aureus subsp. aureus MW2
aacacauauuccgagaauua

SEQ ID NO: 2111928 - RNA, 22 nt, Staphylococcus aureus subsp. aureus MW2
aacaccagauaucauaauauug

SEQ ID NO: 2111929 - RNA, 21 nt, Staphylococcus aureus subsp. aureus MW2
aacaccacacagcauuuucaa

SEQ ID NO: 2111930 - RNA, 16 nt, Staphylococcus aureus subsp. aureus MW2
aacaccacacagcauu

SEQ ID NO: 2111931 - RNA, 18 nt, Staphylococcus aureus subsp. aureus MW2
aacacauguauucaacug

SEQ ID NO: 2111932 - RNA, 14 nt, Staphylococcus aureus subsp. aureus MW2
aacaccaauauuuc

SEQ ID NO: 2111933 - RNA, 18 nt, Staphylococcus aureus subsp. aureus MW2
aacagaaccgaaaauaau

SEQ ID NO: 2111934 - RNA, 19 nt, Staphylococcus aureus subsp. aureus MW2
aacagaaccgaaaauaauc

SEQ ID NO: 2111935 - RNA, 19 nt, Staphylococcus aureus subsp. aureus MW2
aacacuucguauugaauga

SEQ ID NO: 2111936 - RNA, 13 nt, Staphylococcus aureus subsp. aureus MW2
aacagacuuuguu

SEQ ID NO: 2111937 - RNA, 21 nt, Staphylococcus aureus subsp. aureus MW2
aacagacuuuguuaaaaaauu

SEQ ID NO: 2111938 - RNA, 21 nt, Staphylococcus aureus subsp. aureus MW2
aacacguucuugguauuuuuu

SEQ ID NO: 2111939 - RNA, 17 nt, Staphylococcus aureus subsp. aureus MW2
aacacuagguacauaaa

SEQ ID NO: 2111940 - RNA, 16 nt, Staphylococcus aureus subsp. aureus MW2
aacacucggaaacaug

SEQ ID NO: 2111941 - RNA, 22 nt, Staphylococcus aureus subsp. aureus MW2
aacacucaaaauguuuaacaau

SEQ ID NO: 2111942 - RNA, 21 nt, Staphylococcus aureus subsp. aureus MW2
aacacuggcguuaaagcuuuu

SEQ ID NO: 2111943 - RNA, 21 nt, Staphylococcus aureus subsp. aureus MW2
aacacggucgccaacaguaau

SEQ ID NO: 2111944 - RNA, 18 nt, Staphylococcus aureus subsp. aureus MW2
aacagcaguaagauuauu

SEQ ID NO: 2111945 - RNA, 18 nt, Staphylococcus aureus subsp. aureus MW2
aacagcgcaucauaacuu

SEQ ID NO: 2111946 - RNA, 15 nt, Staphylococcus aureus subsp. aureus MW2
aacagcuuuuucuac

SEQ ID NO: 2111947 - RNA, 18 nt, Staphylococcus aureus subsp. aureus MW2
aacagcugcuucucuuug

SEQ ID NO: 2111948 - RNA, 15 nt, Staphylococcus aureus subsp. aureus MW2
aacagcuacaaauaa

SEQ ID NO: 2111949 - RNA, 14 nt, Staphylococcus aureus subsp. aureus MW2
aacagcuaaaaauu

SEQ ID NO: 2111950 - RNA, 18 nt, Staphylococcus aureus subsp. aureus MW2
aacagcgugaauauaagu

SEQ ID NO: 2111951 - RNA, 24 nt, Staphylococcus aureus subsp. aureus MW2
aacauaacaugaccuaauauauua

SEQ ID NO: 2111952 - RNA, 22 nt, Staphylococcus aureus subsp. aureus MW2
aacauaacaaagucgaaggcua

SEQ ID NO: 2111953 - RNA, 16 nt, Staphylococcus aureus subsp. aureus MW2
aacauaaccuugcuuu

SEQ ID NO: 2111954 - RNA, 14 nt, Staphylococcus aureus subsp. aureus MW2
aacauaaaaauauu

SEQ ID NO: 2111955 - RNA, 17 nt, Staphylococcus aureus subsp. aureus MW2
aacaguuagaaacagaa

SEQ ID NO: 2111956 - RNA, 18 nt, Staphylococcus aureus subsp. aureus MW2
aacaguuagaaacagaau

SEQ ID NO: 2111957 - RNA, 16 nt, Staphylococcus aureus subsp. aureus MW2
aacaguauuaauuaca

SEQ ID NO: 2111958 - RNA, 15 nt, Staphylococcus aureus subsp. aureus MW2
aacaguauaaauauu

SEQ ID NO: 2111959 - RNA, 16 nt, Staphylococcus aureus subsp. aureus MW2
aacaguguagcacaag

SEQ ID NO: 2111960 - RNA, 14 nt, Staphylococcus aureus subsp. aureus MW2
aacaguaauuuuua

SEQ ID NO: 2111961 - RNA, 20 nt, Staphylococcus aureus subsp. aureus MW2
aacagcuuuuucuacaccua

SEQ ID NO: 2111962 - RNA, 20 nt, Staphylococcus aureus subsp. aureus MW2
aacagggaacccaggugcau

SEQ ID NO: 2111963 - RNA, 13 nt, Staphylococcus aureus subsp. aureus MW2
aacaucauucaca

SEQ ID NO: 2111964 - RNA, 15 nt, Staphylococcus aureus subsp. aureus MW2
aacaucauuaacuuu

SEQ ID NO: 2111965 - RNA, 20 nt, Staphylococcus aureus subsp. aureus MW2
aacaucauuaacuuucucaa

SEQ ID NO: 2111966 - RNA, 14 nt, Staphylococcus aureus subsp. aureus MW2
aacaucaucuaugc

SEQ ID NO: 2111967 - RNA, 21 nt, Staphylococcus aureus subsp. aureus MW2
aacauauuuuaacuaugaaug

SEQ ID NO: 2111968 - RNA, 17 nt, Staphylococcus aureus subsp. aureus MW2
aacauauuuuuugauau

SEQ ID NO: 2111969 - RNA, 19 nt, Staphylococcus aureus subsp. aureus MW2
aacaucacagaaaauacau

SEQ ID NO: 2111970 - RNA, 21 nt, Staphylococcus aureus subsp. aureus MW2
aacaucacuuuaggguucauu

SEQ ID NO: 2111971 - RNA, 19 nt, Staphylococcus aureus subsp. aureus MW2
aacauauuauauauauucc

SEQ ID NO: 2111972 - RNA, 16 nt, Staphylococcus aureus subsp. aureus MW2
aacauauuauauauau

SEQ ID NO: 2111973 - RNA, 18 nt, Staphylococcus aureus subsp. aureus MW2
aacauauucauaauaucg

SEQ ID NO: 2111974 - RNA, 16 nt, Staphylococcus aureus subsp. aureus MW2
aacauauuauaaaagu

SEQ ID NO: 2111975 - RNA, 15 nt, Staphylococcus aureus subsp. aureus MW2
aacauauagauaucu

SEQ ID NO: 2111976 - RNA, 18 nt, Staphylococcus aureus subsp. aureus MW2
aacauagcuuaauaauua

SEQ ID NO: 2111977 - RNA, 24 nt, Staphylococcus aureus subsp. aureus MW2
aacauagaagcuggcggaaaguca

SEQ ID NO: 2111978 - RNA, 16 nt, Staphylococcus aureus subsp. aureus MW2
aacauagagaaauuug

SEQ ID NO: 2111979 - RNA, 15 nt, Staphylococcus aureus subsp. aureus MW2
aacauaauauuuuga

SEQ ID NO: 2111980 - RNA, 13 nt, Staphylococcus aureus subsp. aureus MW2
aacauaaucauaa

SEQ ID NO: 2111981 - RNA, 17 nt, Staphylococcus aureus subsp. aureus MW2
aacauaaucauugugua

SEQ ID NO: 2111982 - RNA, 18 nt, Staphylococcus aureus subsp. aureus MW2
aacauaauaauaauacaa

SEQ ID NO: 2111983 - RNA, 20 nt, Staphylococcus aureus subsp. aureus MW2
aacauaauaauaauacaauu

SEQ ID NO: 2111984 - RNA, 19 nt, Staphylococcus aureus subsp. aureus MW2
aacauucccuuaauaauaa

SEQ ID NO: 2111985 - RNA, 18 nt, Staphylococcus aureus subsp. aureus MW2
aacauuauuuauauuuag

SEQ ID NO: 2111986 - RNA, 20 nt, Staphylococcus aureus subsp. aureus MW2
aacauugagauuaucuuuag

SEQ ID NO: 2111987 - RNA, 17 nt, Staphylococcus aureus subsp. aureus MW2
aacauucuucaaaaaau

SEQ ID NO: 2111988 - RNA, 15 nt, Staphylococcus aureus subsp. aureus MW2
aacauugagauuauc

SEQ ID NO: 2111989 - RNA, 23 nt, Staphylococcus aureus subsp. aureus MW2
aacauuguagcgccuaagacaua

SEQ ID NO: 2111990 - RNA, 19 nt, Staphylococcus aureus subsp. aureus MW2
aacauuggcgaggccccaa

SEQ ID NO: 2111991 - RNA, 22 nt, Staphylococcus aureus subsp. aureus MW2
aacauuuugauacguaaacacu

SEQ ID NO: 2111992 - RNA, 14 nt, Staphylococcus aureus subsp. aureus MW2
aacauuuuugauuu

SEQ ID NO: 2111993 - RNA, 14 nt, Staphylococcus aureus subsp. aureus MW2
aacauuuaaaaaau

SEQ ID NO: 2111994 - RNA, 18 nt, Staphylococcus aureus subsp. aureus MW2
aacauuuacacgucuaau

SEQ ID NO: 2111995 - RNA, 22 nt, Staphylococcus aureus subsp. aureus MW2
aacauuuguuggaagccuucaa

SEQ ID NO: 2111996 - RNA, 22 nt, Staphylococcus aureus subsp. aureus MW2
aacauuuuuuucaaugcuuuca

SEQ ID NO: 2111997 - RNA, 19 nt, Staphylococcus aureus subsp. aureus MW2
aaccaaaccauuaauaaaa

SEQ ID NO: 2111998 - RNA, 18 nt, Staphylococcus aureus subsp. aureus MW2
aaccaaaucggaauaaaa

SEQ ID NO: 2111999 - RNA, 20 nt, Staphylococcus aureus subsp. aureus MW2
aaccaaaucggaauaaaaua

SEQ ID NO: 2112000 - RNA, 21 nt, Staphylococcus aureus subsp. aureus MW2
aaccaauuuuaacuuauauac

SEQ ID NO: 2112001 - RNA, 19 nt, Staphylococcus aureus subsp. aureus MW2
aaccaaugauuguuaauac

SEQ ID NO: 2112002 - RNA, 22 nt, Staphylococcus aureus subsp. aureus MW2
aaccaaguaauucuuuaccauu

SEQ ID NO: 2112003 - RNA, 19 nt, Staphylococcus aureus subsp. aureus MW2
aacaugauacugaaauuuc

SEQ ID NO: 2112004 - RNA, 20 nt, Staphylococcus aureus subsp. aureus MW2
aacaugggguuuuauuuuug

SEQ ID NO: 2112005 - RNA, 20 nt, Staphylococcus aureus subsp. aureus MW2
aacauuaaaauaauuaaaua

SEQ ID NO: 2112006 - RNA, 18 nt, Staphylococcus aureus subsp. aureus MW2
aacauuaaaauaauuaaa

SEQ ID NO: 2112007 - RNA, 17 nt, Staphylococcus aureus subsp. aureus MW2
aacauuaaaauguguuu

SEQ ID NO: 2112008 - RNA, 12 nt, Staphylococcus aureus subsp. aureus MW2
aacauuaaaaau

SEQ ID NO: 2112009 - RNA, 17 nt, Staphylococcus aureus subsp. aureus MW2
aacauguacaauuuuua

SEQ ID NO: 2112010 - RNA, 18 nt, Staphylococcus aureus subsp. aureus MW2
aacauguacaauuuuuaa

SEQ ID NO: 2112011 - RNA, 23 nt, Staphylococcus aureus subsp. aureus MW2
aacauguacaauuuuuaaaaacc

SEQ ID NO: 2112012 - RNA, 22 nt, Staphylococcus aureus subsp. aureus MW2
aacauguacuuguaacaaguuc

SEQ ID NO: 2112013 - RNA, 23 nt, Staphylococcus aureus subsp. aureus MW2
aacaugguuuucuuuuuaucaug

SEQ ID NO: 2112014 - RNA, 20 nt, Staphylococcus aureus subsp. aureus MW2
aacauguuccgcuacaaaac

SEQ ID NO: 2112015 - RNA, 17 nt, Staphylococcus aureus subsp. aureus MW2
aacauuaauaaauaaua

SEQ ID NO: 2112016 - RNA, 20 nt, Staphylococcus aureus subsp. aureus MW2
aacauuaaucuauauaaaaa

SEQ ID NO: 2112017 - RNA, 14 nt, Staphylococcus aureus subsp. aureus MW2
aacauuaaguucuu

SEQ ID NO: 2112018 - RNA, 23 nt, Staphylococcus aureus subsp. aureus MW2
aacauuaaucuauauaaaaacug

SEQ ID NO: 2112019 - RNA, 22 nt, Staphylococcus aureus subsp. aureus MW2
aacauuacaugcaccuuuacaa

SEQ ID NO: 2112020 - RNA, 18 nt, Staphylococcus aureus subsp. aureus MW2
aacauuaggauguucagc

SEQ ID NO: 2112021 - RNA, 19 nt, Staphylococcus aureus subsp. aureus MW2
aacauuagcaugauaaagu

SEQ ID NO: 2112022 - RNA, 20 nt, Staphylococcus aureus subsp. aureus MW2
aacauuacuaauugaucagc

SEQ ID NO: 2112023 - RNA, 18 nt, Staphylococcus aureus subsp. aureus MW2
aacauuacuguuugcuuu

SEQ ID NO: 2112024 - RNA, 12 nt, Staphylococcus aureus subsp. aureus MW2
aacauuacuacu

SEQ ID NO: 2112025 - RNA, 17 nt, Staphylococcus aureus subsp. aureus MW2
aacauuagcaugauaaa

SEQ ID NO: 2112026 - RNA, 22 nt, Staphylococcus aureus subsp. aureus MW2
aacauccugcuuauuaauuguu

SEQ ID NO: 2112027 - RNA, 20 nt, Staphylococcus aureus subsp. aureus MW2
aacaucgauuuaucauuauu

SEQ ID NO: 2112028 - RNA, 19 nt, Staphylococcus aureus subsp. aureus MW2
aacaucuaaauaguuuuuc

SEQ ID NO: 2112029 - RNA, 17 nt, Staphylococcus aureus subsp. aureus MW2
aacaugaacaaucagau

SEQ ID NO: 2112030 - RNA, 23 nt, Staphylococcus aureus subsp. aureus MW2
aacaugaacaaucagauaaguua

SEQ ID NO: 2112031 - RNA, 23 nt, Staphylococcus aureus subsp. aureus MW2
aacaugaccuaauauauuacuaa

SEQ ID NO: 2112032 - RNA, 14 nt, Staphylococcus aureus subsp. aureus MW2
aacaucugaaaaaa

SEQ ID NO: 2112033 - RNA, 15 nt, Staphylococcus aureus subsp. aureus MW2
aacaucugaaaaaau

SEQ ID NO: 2112034 - RNA, 17 nt, Staphylococcus aureus subsp. aureus MW2
aacaucuucuucaucau

SEQ ID NO: 2112035 - RNA, 18 nt, Staphylococcus aureus subsp. aureus MW2
aacaucuucuucaucaua

SEQ ID NO: 2112036 - RNA, 13 nt, Staphylococcus aureus subsp. aureus MW2
aacaucuucaaca

SEQ ID NO: 2112037 - RNA, 22 nt, Staphylococcus aureus subsp. aureus MW2
aacccuaauguguggauuuaau

SEQ ID NO: 2112038 - RNA, 18 nt, Staphylococcus aureus subsp. aureus MW2
aaccgaaauaucaacaga

SEQ ID NO: 2112039 - RNA, 12 nt, Staphylococcus aureus subsp. aureus MW2
aaccgaaaauac

SEQ ID NO: 2112040 - RNA, 20 nt, Staphylococcus aureus subsp. aureus MW2
aaccccuucaaaauuuugac

SEQ ID NO: 2112041 - RNA, 20 nt, Staphylococcus aureus subsp. aureus MW2
aacccauuuucaaaacuagc

SEQ ID NO: 2112042 - RNA, 21 nt, Staphylococcus aureus subsp. aureus MW2
aaccgccaacuaauguuaaaa

SEQ ID NO: 2112043 - RNA, 16 nt, Staphylococcus aureus subsp. aureus MW2
aaccgauuaauauaau

SEQ ID NO: 2112044 - RNA, 19 nt, Staphylococcus aureus subsp. aureus MW2
aaccgcuugggcugacauu

SEQ ID NO: 2112045 - RNA, 15 nt, Staphylococcus aureus subsp. aureus MW2
aaccggaaauuaaau

SEQ ID NO: 2112046 - RNA, 18 nt, Staphylococcus aureus subsp. aureus MW2
aaccguaacuauaugaaa

SEQ ID NO: 2112047 - RNA, 18 nt, Staphylococcus aureus subsp. aureus MW2
aaccagcuaacaaaagug

SEQ ID NO: 2112048 - RNA, 16 nt, Staphylococcus aureus subsp. aureus MW2
aaccagcuaaccaaau

SEQ ID NO: 2112049 - RNA, 15 nt, Staphylococcus aureus subsp. aureus MW2
aaccaccugauaaua

SEQ ID NO: 2112050 - RNA, 23 nt, Staphylococcus aureus subsp. aureus MW2
aaccacuccuuaaacaaauaaau

SEQ ID NO: 2112051 - RNA, 13 nt, Staphylococcus aureus subsp. aureus MW2
aaccaguuugauu

SEQ ID NO: 2112052 - RNA, 21 nt, Staphylococcus aureus subsp. aureus MW2
aaccauacucuaacuuaccau

SEQ ID NO: 2112053 - RNA, 14 nt, Staphylococcus aureus subsp. aureus MW2
aaccagugcaacua

SEQ ID NO: 2112054 - RNA, 14 nt, Staphylococcus aureus subsp. aureus MW2
aaccauauuuacac

SEQ ID NO: 2112055 - RNA, 21 nt, Staphylococcus aureus subsp. aureus MW2
aaccauagauaauugcuauaa

SEQ ID NO: 2112056 - RNA, 23 nt, Staphylococcus aureus subsp. aureus MW2
aaccaucugugucagcauucaua

SEQ ID NO: 2112057 - RNA, 20 nt, Staphylococcus aureus subsp. aureus MW2
aaccauuuccgaauaaaggu

SEQ ID NO: 2112058 - RNA, 16 nt, Staphylococcus aureus subsp. aureus MW2
aaccauuuaaaaauug

SEQ ID NO: 2112059 - RNA, 22 nt, Staphylococcus aureus subsp. aureus MW2
aaccauuuuuuuaucuguagaa

SEQ ID NO: 2112060 - RNA, 21 nt, Staphylococcus aureus subsp. aureus MW2
aaccauucacuuauagaauga

SEQ ID NO: 2112061 - RNA, 17 nt, Staphylococcus aureus subsp. aureus MW2
aaccauuaauaaaacug

SEQ ID NO: 2112062 - RNA, 21 nt, Staphylococcus aureus subsp. aureus MW2
accgcacuuucuauuaauaua

SEQ ID NO: 2112063 - RNA, 19 nt, Staphylococcus aureus subsp. aureus MW2
accgcacuucuauauuaau

SEQ ID NO: 2112064 - RNA, 21 nt, Staphylococcus aureus subsp. aureus MW2
accccuccuggugcugcacca

SEQ ID NO: 2112065 - RNA, 13 nt, Staphylococcus aureus subsp. aureus MW2
accccuaauuaaa

SEQ ID NO: 2112066 - RNA, 15 nt, Staphylococcus aureus subsp. aureus MW2
accccuaauuaaaau

SEQ ID NO: 2112067 - RNA, 16 nt, Staphylococcus aureus subsp. aureus MW2
accgcugcucuucucu

SEQ ID NO: 2112068 - RNA, 20 nt, Staphylococcus aureus subsp. aureus MW2
accgcugcucuucucuuuac

SEQ ID NO: 2112069 - RNA, 16 nt, Staphylococcus aureus subsp. aureus MW2
accguaacauauguac

SEQ ID NO: 2112070 - RNA, 14 nt, Staphylococcus aureus subsp. aureus MW2
accguaaucuuuua

SEQ ID NO: 2112071 - RNA, 19 nt, Staphylococcus aureus subsp. aureus MW2
accguaacuauaugaaaug

SEQ ID NO: 2112072 - RNA, 15 nt, Staphylococcus aureus subsp. aureus MW2
accguaaucuuuuaa

SEQ ID NO: 2112073 - RNA, 19 nt, Staphylococcus aureus subsp. aureus MW2
accgucaaacuuaaaacua

SEQ ID NO: 2112074 - RNA, 15 nt, Staphylococcus aureus subsp. aureus MW2
accgucaaacuuaaa

SEQ ID NO: 2112075 - RNA, 22 nt, Staphylococcus aureus subsp. aureus MW2
accguauuauuaguuuugaagu

SEQ ID NO: 2112076 - RNA, 19 nt, Staphylococcus aureus subsp. aureus MW2
accuagggauaauuuuauu

SEQ ID NO: 2112077 - RNA, 19 nt, Staphylococcus aureus subsp. aureus MW2
accuacuuugauauguuuc

SEQ ID NO: 2112078 - RNA, 21 nt, Staphylococcus aureus subsp. aureus MW2
accuacgauucgaaauaggua

SEQ ID NO: 2112079 - RNA, 17 nt, Staphylococcus aureus subsp. aureus MW2
accuacacggucccaag

SEQ ID NO: 2112080 - RNA, 15 nt, Staphylococcus aureus subsp. aureus MW2
accuacagauaaagc

SEQ ID NO: 2112081 - RNA, 19 nt, Staphylococcus aureus subsp. aureus MW2
accuacaacaccaauugaa

SEQ ID NO: 2112082 - RNA, 21 nt, Staphylococcus aureus subsp. aureus MW2
accuacacgaccaagacgaac

SEQ ID NO: 2112083 - RNA, 14 nt, Staphylococcus aureus subsp. aureus MW2
accuacaacaccaa

SEQ ID NO: 2112084 - RNA, 23 nt, Staphylococcus aureus subsp. aureus MW2
accuacagauuuuaaaaauucau

SEQ ID NO: 2112085 - RNA, 14 nt, Staphylococcus aureus subsp. aureus MW2
accuacaaauauuu

SEQ ID NO: 2112086 - RNA, 19 nt, Staphylococcus aureus subsp. aureus MW2
accuaagcugauuaaaaua

SEQ ID NO: 2112087 - RNA, 18 nt, Staphylococcus aureus subsp. aureus MW2
accuaagcaagauaauag

SEQ ID NO: 2112088 - RNA, 19 nt, Staphylococcus aureus subsp. aureus MW2
accuaaaugauuaauaaca

SEQ ID NO: 2112089 - RNA, 21 nt, Staphylococcus aureus subsp. aureus MW2
accuaaaugauuaauaacaua

SEQ ID NO: 2112090 - RNA, 16 nt, Staphylococcus aureus subsp. aureus MW2
accuauuaauaucaua

SEQ ID NO: 2112091 - RNA, 18 nt, Staphylococcus aureus subsp. aureus MW2
accuauuaaaauaaacca

SEQ ID NO: 2112092 - RNA, 17 nt, Staphylococcus aureus subsp. aureus MW2
accuauuuuuugagcac

SEQ ID NO: 2112093 - RNA, 17 nt, Staphylococcus aureus subsp. aureus MW2
accuauuugauuaaauu

SEQ ID NO: 2112094 - RNA, 12 nt, Staphylococcus aureus subsp. aureus MW2
accucuuuuguu

SEQ ID NO: 2112095 - RNA, 16 nt, Staphylococcus aureus subsp. aureus MW2
accucuugauaaaaua

SEQ ID NO: 2112096 - RNA, 23 nt, Staphylococcus aureus subsp. aureus MW2
accucuaaauaaaauuaaaacag

SEQ ID NO: 2112097 - RNA, 23 nt, Staphylococcus aureus subsp. aureus MW2
accucuaaguucaccuaaaugau

SEQ ID NO: 2112098 - RNA, 15 nt, Staphylococcus aureus subsp. aureus MW2
accucguuacauuua

SEQ ID NO: 2112099 - RNA, 19 nt, Staphylococcus aureus subsp. aureus MW2
accucggauaccaaaacuc

SEQ ID NO: 2112100 - RNA, 19 nt, Staphylococcus aureus subsp. aureus MW2
accuuaucaguguaaguuu

SEQ ID NO: 2112101 - RNA, 15 nt, Staphylococcus aureus subsp. aureus MW2
accuuauauuuuauu

SEQ ID NO: 2112102 - RNA, 22 nt, Staphylococcus aureus subsp. aureus MW2
accuuauauuuuauuuaaaaau

SEQ ID NO: 2112103 - RNA, 13 nt, Staphylococcus aureus subsp. aureus MW2
accuucaauaucu

SEQ ID NO: 2112104 - RNA, 19 nt, Staphylococcus aureus subsp. aureus MW2
accuuacuacucauuauua

SEQ ID NO: 2112105 - RNA, 21 nt, Staphylococcus aureus subsp. aureus MW2
accuuacuacucauuauuaag

SEQ ID NO: 2112106 - RNA, 18 nt, Staphylococcus aureus subsp. aureus MW2
accuuaauaaugaauucu

SEQ ID NO: 2112107 - RNA, 15 nt, Staphylococcus aureus subsp. aureus MW2
accuuacccaaaaaa

SEQ ID NO: 2112108 - RNA, 18 nt, Staphylococcus aureus subsp. aureus MW2
accuuacauaggauaucu

SEQ ID NO: 2112109 - RNA, 20 nt, Staphylococcus aureus subsp. aureus MW2
accuuacauaggauaucuac

SEQ ID NO: 2112110 - RNA, 13 nt, Staphylococcus aureus subsp. aureus MW2
accuuaauaauga

SEQ ID NO: 2112111 - RNA, 22 nt, Staphylococcus aureus subsp. aureus MW2
accuuaaauauaguugccaugu

SEQ ID NO: 2112112 - RNA, 12 nt, Staphylococcus aureus subsp. aureus MW2
accugugauaac

SEQ ID NO: 2112113 - RNA, 13 nt, Staphylococcus aureus subsp. aureus MW2
accugucuuaauu

SEQ ID NO: 2112114 - RNA, 20 nt, Staphylococcus aureus subsp. aureus MW2
accugucuuaauucauucca

SEQ ID NO: 2112115 - RNA, 17 nt, Staphylococcus aureus subsp. aureus MW2
accuggcacaaaugcua

SEQ ID NO: 2112116 - RNA, 16 nt, Staphylococcus aureus subsp. aureus MW2
accugcauauguguuu

SEQ ID NO: 2112117 - RNA, 17 nt, Staphylococcus aureus subsp. aureus MW2
accuucgcauacuuuuu

SEQ ID NO: 2112118 - RNA, 16 nt, Staphylococcus aureus subsp. aureus MW2
accuucagaugcuaca

SEQ ID NO: 2112119 - RNA, 12 nt, Staphylococcus aureus subsp. aureus MW2
accuucaucuuu

SEQ ID NO: 2112120 - RNA, 17 nt, Staphylococcus aureus subsp. aureus MW2
accuucaucuuuuuuau

SEQ ID NO: 2112121 - RNA, 19 nt, Staphylococcus aureus subsp. aureus MW2
accuuuguaaguauuuaaa

SEQ ID NO: 2112122 - RNA, 22 nt, Staphylococcus aureus subsp. aureus MW2
accuuuugauguuuaugacaaa

SEQ ID NO: 2112123 - RNA, 19 nt, Staphylococcus aureus subsp. aureus MW2
accuuugcuaaauauuaua

SEQ ID NO: 2112124 - RNA, 20 nt, Staphylococcus aureus subsp. aureus MW2
accuuugcuaaauauuauaa

SEQ ID NO: 2112125 - RNA, 21 nt, Staphylococcus aureus subsp. aureus MW2
accuuugcuaaauauuauaaa

SEQ ID NO: 2112126 - RNA, 14 nt, Staphylococcus aureus subsp. aureus MW2
accuuucgauaaac

SEQ ID NO: 2112127 - RNA, 22 nt, Staphylococcus aureus subsp. aureus MW2
accuuucgcagcuucuuuaaca

SEQ ID NO: 2112128 - RNA, 18 nt, Staphylococcus aureus subsp. aureus MW2
accuuucaaauauaucua

SEQ ID NO: 2112129 - RNA, 16 nt, Staphylococcus aureus subsp. aureus MW2
accuuuauuauuuaau

SEQ ID NO: 2112130 - RNA, 14 nt, Staphylococcus aureus subsp. aureus MW2
accuuuauuauuua

SEQ ID NO: 2112131 - RNA, 17 nt, Staphylococcus aureus subsp. aureus MW2
accuuuauuaccagcuu

SEQ ID NO: 2112132 - RNA, 20 nt, Staphylococcus aureus subsp. aureus MW2
accuuuaugugcaucauuua

SEQ ID NO: 2112133 - RNA, 14 nt, Staphylococcus aureus subsp. aureus MW2
accuuuacuuucau

SEQ ID NO: 2112134 - RNA, 13 nt, Staphylococcus aureus subsp. aureus MW2
accuuuaauaucu

SEQ ID NO: 2112135 - RNA, 13 nt, Staphylococcus aureus subsp. aureus MW2
accuuuaauuaca

SEQ ID NO: 2112136 - RNA, 18 nt, Staphylococcus aureus subsp. aureus MW2
acgaaaagucagcuuaca

SEQ ID NO: 2112137 - RNA, 22 nt, Staphylococcus aureus subsp. aureus MW2
acgaaaagucagcuuacaauaa

SEQ ID NO: 2112138 - RNA, 13 nt, Staphylococcus aureus subsp. aureus MW2
acgaaaagucagc

SEQ ID NO: 2112139 - RNA, 21 nt, Staphylococcus aureus subsp. aureus MW2
acgaaaauuaagaugaaauac

SEQ ID NO: 2112140 - RNA, 23 nt, Staphylococcus aureus subsp. aureus MW2
acgaaaauuaagaugaaauacuu

SEQ ID NO: 2112141 - RNA, 12 nt, Staphylococcus aureus subsp. aureus MW2
accuuuuuuaag

SEQ ID NO: 2112142 - RNA, 21 nt, Staphylococcus aureus subsp. aureus MW2
accuuuuuauugauauuaaua

SEQ ID NO: 2112143 - RNA, 17 nt, Staphylococcus aureus subsp. aureus MW2
accuuuuuuaacuuuaa

SEQ ID NO: 2112144 - RNA, 19 nt, Staphylococcus aureus subsp. aureus MW2
accuuuuuuaacuuuaaca

SEQ ID NO: 2112145 - RNA, 21 nt, Staphylococcus aureus subsp. aureus MW2
accuuuuuuaacuuuaacauc

SEQ ID NO: 2112146 - RNA, 23 nt, Staphylococcus aureus subsp. aureus MW2
acgaacaagucuugcaauaccuc

SEQ ID NO: 2112147 - RNA, 14 nt, Staphylococcus aureus subsp. aureus MW2
acgaaauugugaac

SEQ ID NO: 2112148 - RNA, 16 nt, Staphylococcus aureus subsp. aureus MW2
acgaaauaaauuuuga

SEQ ID NO: 2112149 - RNA, 15 nt, Staphylococcus aureus subsp. aureus MW2
acgaaauaguucaaa

SEQ ID NO: 2112150 - RNA, 22 nt, Staphylococcus aureus subsp. aureus MW2
acgaccagucgcauauuuugau

SEQ ID NO: 2112151 - RNA, 22 nt, Staphylococcus aureus subsp. aureus MW2
acgacauuuuuagacauuaaaa

SEQ ID NO: 2112152 - RNA, 18 nt, Staphylococcus aureus subsp. aureus MW2
acgacguccagcuaauaa

SEQ ID NO: 2112153 - RNA, 17 nt, Staphylococcus aureus subsp. aureus MW2
acgacguuuuuuuaugu

SEQ ID NO: 2112154 - RNA, 14 nt, Staphylococcus aureus subsp. aureus MW2
acgagagagaaaag

SEQ ID NO: 2112155 - RNA, 13 nt, Staphylococcus aureus subsp. aureus MW2
acgaagauuuugu

SEQ ID NO: 2112156 - RNA, 19 nt, Staphylococcus aureus subsp. aureus MW2
acgaaggucuacuaaauaa

SEQ ID NO: 2112157 - RNA, 14 nt, Staphylococcus aureus subsp. aureus MW2
acgaagccuaauuu

SEQ ID NO: 2112158 - RNA, 21 nt, Staphylococcus aureus subsp. aureus MW2
acgacaacuugaacuaaaaca

SEQ ID NO: 2112159 - RNA, 14 nt, Staphylococcus aureus subsp. aureus MW2
acgauuaauaaaau

SEQ ID NO: 2112160 - RNA, 17 nt, Staphylococcus aureus subsp. aureus MW2
acgauuguugcaaugau

SEQ ID NO: 2112161 - RNA, 14 nt, Staphylococcus aureus subsp. aureus MW2
acgauuuucaaaac

SEQ ID NO: 2112162 - RNA, 17 nt, Staphylococcus aureus subsp. aureus MW2
acgcaaaaauacuccuu

SEQ ID NO: 2112163 - RNA, 15 nt, Staphylococcus aureus subsp. aureus MW2
acgcaaagaaaaaca

SEQ ID NO: 2112164 - RNA, 16 nt, Staphylococcus aureus subsp. aureus MW2
acgcaaagaaaaacau

SEQ ID NO: 2112165 - RNA, 20 nt, Staphylococcus aureus subsp. aureus MW2
acgauaaauagugauugcuu

SEQ ID NO: 2112166 - RNA, 19 nt, Staphylococcus aureus subsp. aureus MW2
acgauaacaauuuauuaaa

SEQ ID NO: 2112167 - RNA, 20 nt, Staphylococcus aureus subsp. aureus MW2
acgaguguuuuaaucuuauu

SEQ ID NO: 2112168 - RNA, 19 nt, Staphylococcus aureus subsp. aureus MW2
acgagcuugggacagaaaa

SEQ ID NO: 2112169 - RNA, 17 nt, Staphylococcus aureus subsp. aureus MW2
acgaucauaaauauuuu

SEQ ID NO: 2112170 - RNA, 20 nt, Staphylococcus aureus subsp. aureus MW2
acgaucaguugagucaauuu

SEQ ID NO: 2112171 - RNA, 20 nt, Staphylococcus aureus subsp. aureus MW2
acgaucaacugcuucacgau

SEQ ID NO: 2112172 - RNA, 18 nt, Staphylococcus aureus subsp. aureus MW2
acgauaccggcaacuggu

SEQ ID NO: 2112173 - RNA, 18 nt, Staphylococcus aureus subsp. aureus MW2
acgauaccuuuaauaaua

SEQ ID NO: 2112174 - RNA, 17 nt, Staphylococcus aureus subsp. aureus MW2
acgauauaacauuaaaa

SEQ ID NO: 2112175 - RNA, 22 nt, Staphylococcus aureus subsp. aureus MW2
acauuuuuuauagcaaauugau

SEQ ID NO: 2112176 - RNA, 14 nt, Staphylococcus aureus subsp. aureus MW2
acauuuuuggcuug

SEQ ID NO: 2112177 - RNA, 23 nt, Staphylococcus aureus subsp. aureus MW2
acauuuuuggcuuguuaagcagc

SEQ ID NO: 2112178 - RNA, 18 nt, Staphylococcus aureus subsp. aureus MW2
acauuuuugugcaaaagu

SEQ ID NO: 2112179 - RNA, 16 nt, Staphylococcus aureus subsp. aureus MW2
acauuuuugugcaaaa

SEQ ID NO: 2112180 - RNA, 14 nt, Staphylococcus aureus subsp. aureus MW2
acauuuauuuucaa

SEQ ID NO: 2112181 - RNA, 17 nt, Staphylococcus aureus subsp. aureus MW2
acauuuauuuuuucucu

SEQ ID NO: 2112182 - RNA, 21 nt, Staphylococcus aureus subsp. aureus MW2
acauuuauuuuuucucuauua

SEQ ID NO: 2112183 - RNA, 15 nt, Staphylococcus aureus subsp. aureus MW2
acauuucaauugcau

SEQ ID NO: 2112184 - RNA, 12 nt, Staphylococcus aureus subsp. aureus MW2
acauuuaacauu

SEQ ID NO: 2112185 - RNA, 18 nt, Staphylococcus aureus subsp. aureus MW2
acauuuacuuaagaacua

SEQ ID NO: 2112186 - RNA, 23 nt, Staphylococcus aureus subsp. aureus MW2
acauuuacacgucuaauuuuaau

SEQ ID NO: 2112187 - RNA, 20 nt, Staphylococcus aureus subsp. aureus MW2
acauuuaggagccuagaaca

SEQ ID NO: 2112188 - RNA, 18 nt, Staphylococcus aureus subsp. aureus MW2
acauguauuggccaaaca

SEQ ID NO: 2112189 - RNA, 15 nt, Staphylococcus aureus subsp. aureus MW2
acaugugggauaucu

SEQ ID NO: 2112190 - RNA, 22 nt, Staphylococcus aureus subsp. aureus MW2
acaugguugauucgauaugaau

SEQ ID NO: 2112191 - RNA, 16 nt, Staphylococcus aureus subsp. aureus MW2
acaugguuuucaccag

SEQ ID NO: 2112192 - RNA, 14 nt, Staphylococcus aureus subsp. aureus MW2
accaauauuuuucg

SEQ ID NO: 2112193 - RNA, 20 nt, Staphylococcus aureus subsp. aureus MW2
accaauauaaacaucuucuu

SEQ ID NO: 2112194 - RNA, 15 nt, Staphylococcus aureus subsp. aureus MW2
accaauuagcaugac

SEQ ID NO: 2112195 - RNA, 12 nt, Staphylococcus aureus subsp. aureus MW2
accaauuaggau

SEQ ID NO: 2112196 - RNA, 13 nt, Staphylococcus aureus subsp. aureus MW2
accaauuaggauu

SEQ ID NO: 2112197 - RNA, 15 nt, Staphylococcus aureus subsp. aureus MW2
accaauugaaauuaa

SEQ ID NO: 2112198 - RNA, 12 nt, Staphylococcus aureus subsp. aureus MW2
accaauuuuuag

SEQ ID NO: 2112199 - RNA, 22 nt, Staphylococcus aureus subsp. aureus MW2
accaacugucgguucaucuaaa

SEQ ID NO: 2112200 - RNA, 21 nt, Staphylococcus aureus subsp. aureus MW2
accaacugucgguucaucuaa

SEQ ID NO: 2112201 - RNA, 20 nt, Staphylococcus aureus subsp. aureus MW2
accaaguaauucuuuaccau

SEQ ID NO: 2112202 - RNA, 21 nt, Staphylococcus aureus subsp. aureus MW2
accaaguaauucuuuaccauu

SEQ ID NO: 2112203 - RNA, 24 nt, Staphylococcus aureus subsp. aureus MW2
accaagugcuuuuuuaccagcaug

SEQ ID NO: 2112204 - RNA, 14 nt, Staphylococcus aureus subsp. aureus MW2
accaaguucacuaa

SEQ ID NO: 2112205 - RNA, 19 nt, Staphylococcus aureus subsp. aureus MW2
accaaccaaaaccaaauga

SEQ ID NO: 2112206 - RNA, 20 nt, Staphylococcus aureus subsp. aureus MW2
accaaccaaaaccaaaugaa

SEQ ID NO: 2112207 - RNA, 22 nt, Staphylococcus aureus subsp. aureus MW2
accaacucaggcuuaauuaaua

SEQ ID NO: 2112208 - RNA, 19 nt, Staphylococcus aureus subsp. aureus MW2
accacuggccuuuaaugau

SEQ ID NO: 2112209 - RNA, 20 nt, Staphylococcus aureus subsp. aureus MW2
accacucaauucucuaacuu

SEQ ID NO: 2112210 - RNA, 15 nt, Staphylococcus aureus subsp. aureus MW2
accacgguucaccau

SEQ ID NO: 2112211 - RNA, 14 nt, Staphylococcus aureus subsp. aureus MW2
accaguuucuggua

SEQ ID NO: 2112212 - RNA, 19 nt, Staphylococcus aureus subsp. aureus MW2
accagugggcuccaaacau

SEQ ID NO: 2112213 - RNA, 20 nt, Staphylococcus aureus subsp. aureus MW2
accagugggcuccaaacaua

SEQ ID NO: 2112214 - RNA, 15 nt, Staphylococcus aureus subsp. aureus MW2
accaguaacagcuaa

SEQ ID NO: 2112215 - RNA, 14 nt, Staphylococcus aureus subsp. aureus MW2
accagucguaauga

SEQ ID NO: 2112216 - RNA, 15 nt, Staphylococcus aureus subsp. aureus MW2
accauacucuaacuu

SEQ ID NO: 2112217 - RNA, 18 nt, Staphylococcus aureus subsp. aureus MW2
accauaguaacaaaauga

SEQ ID NO: 2112218 - RNA, 16 nt, Staphylococcus aureus subsp. aureus MW2
accauaauuaaauaac

SEQ ID NO: 2112219 - RNA, 13 nt, Staphylococcus aureus subsp. aureus MW2
accauaaaaauag

SEQ ID NO: 2112220 - RNA, 18 nt, Staphylococcus aureus subsp. aureus MW2
accauaaauuuauauaua

SEQ ID NO: 2112221 - RNA, 13 nt, Staphylococcus aureus subsp. aureus MW2
acccaaucuuguu

SEQ ID NO: 2112222 - RNA, 19 nt, Staphylococcus aureus subsp. aureus MW2
accauugugaugauaauua

SEQ ID NO: 2112223 - RNA, 22 nt, Staphylococcus aureus subsp. aureus MW2
accauucgaaagccaauuaaua

SEQ ID NO: 2112224 - RNA, 18 nt, Staphylococcus aureus subsp. aureus MW2
accauuccaaaaauugua

SEQ ID NO: 2112225 - RNA, 14 nt, Staphylococcus aureus subsp. aureus MW2
accauugaaugaau

SEQ ID NO: 2112226 - RNA, 14 nt, Staphylococcus aureus subsp. aureus MW2
accauuccaaaaau

SEQ ID NO: 2112227 - RNA, 22 nt, Staphylococcus aureus subsp. aureus MW2
accauucaucgucucacuuaau

SEQ ID NO: 2112228 - RNA, 19 nt, Staphylococcus aureus subsp. aureus MW2
accauuauagacauaagca

SEQ ID NO: 2112229 - RNA, 20 nt, Staphylococcus aureus subsp. aureus MW2
accauuauagacauaagcaa

SEQ ID NO: 2112230 - RNA, 17 nt, Staphylococcus aureus subsp. aureus MW2
accaucauauauucauu

SEQ ID NO: 2112231 - RNA, 23 nt, Staphylococcus aureus subsp. aureus MW2
accaucauauauucauugauugu

SEQ ID NO: 2112232 - RNA, 20 nt, Staphylococcus aureus subsp. aureus MW2
accccaacuugcacauuauu

SEQ ID NO: 2112233 - RNA, 17 nt, Staphylococcus aureus subsp. aureus MW2
accccaacuugcacauu

SEQ ID NO: 2112234 - RNA, 13 nt, Staphylococcus aureus subsp. aureus MW2
acagcuucaaaau

SEQ ID NO: 2112235 - RNA, 23 nt, Staphylococcus aureus subsp. aureus MW2
acagcuuaauuuuauuauuaauc

SEQ ID NO: 2112236 - RNA, 19 nt, Staphylococcus aureus subsp. aureus MW2
acagcuuguucaauacuuu

SEQ ID NO: 2112237 - RNA, 20 nt, Staphylococcus aureus subsp. aureus MW2
acagcuuguucaauacuuuc

SEQ ID NO: 2112238 - RNA, 15 nt, Staphylococcus aureus subsp. aureus MW2
acagcuacaaauaau

SEQ ID NO: 2112239 - RNA, 21 nt, Staphylococcus aureus subsp. aureus MW2
acagcugcuucucuuugaacg

SEQ ID NO: 2112240 - RNA, 16 nt, Staphylococcus aureus subsp. aureus MW2
acaggccacacuugag

SEQ ID NO: 2112241 - RNA, 15 nt, Staphylococcus aureus subsp. aureus MW2
acagcgauuguuaaa

SEQ ID NO: 2112242 - RNA, 13 nt, Staphylococcus aureus subsp. aureus MW2
acagcuaaggcug

SEQ ID NO: 2112243 - RNA, 21 nt, Staphylococcus aureus subsp. aureus MW2
acagcuaaggcugauucaaaa

SEQ ID NO: 2112244 - RNA, 21 nt, Staphylococcus aureus subsp. aureus MW2
acagcgucaccuaaugcuuua

SEQ ID NO: 2112245 - RNA, 20 nt, Staphylococcus aureus subsp. aureus MW2
acagcaauucacuuauacau

SEQ ID NO: 2112246 - RNA, 22 nt, Staphylococcus aureus subsp. aureus MW2
acagcaauucacuuauacaugu

SEQ ID NO: 2112247 - RNA, 17 nt, Staphylococcus aureus subsp. aureus MW2
acagcacgagacaauaa

SEQ ID NO: 2112248 - RNA, 16 nt, Staphylococcus aureus subsp. aureus MW2
acacucggaaacaugu

SEQ ID NO: 2112249 - RNA, 20 nt, Staphylococcus aureus subsp. aureus MW2
aauuucauaaaguuuauuua

SEQ ID NO: 2112250 - RNA, 21 nt, Staphylococcus aureus subsp. aureus MW2
aauuucacuuuaacuucuuuu

SEQ ID NO: 2112251 - RNA, 15 nt, Staphylococcus aureus subsp. aureus MW2
acacugcacaucaua

SEQ ID NO: 2112252 - RNA, 23 nt, Staphylococcus aureus subsp. aureus MW2
acacugcuaaaauuguauuauua

SEQ ID NO: 2112253 - RNA, 14 nt, Staphylococcus aureus subsp. aureus MW2
acacugccaauaua

SEQ ID NO: 2112254 - RNA, 21 nt, Staphylococcus aureus subsp. aureus MW2
acacugcuuuuaaaucauuaa

SEQ ID NO: 2112255 - RNA, 18 nt, Staphylococcus aureus subsp. aureus MW2
acacuggcguuaaagcuu

SEQ ID NO: 2112256 - RNA, 16 nt, Staphylococcus aureus subsp. aureus MW2
acagaauuucaucaaa

SEQ ID NO: 2112257 - RNA, 14 nt, Staphylococcus aureus subsp. aureus MW2
acagacaaacauua

SEQ ID NO: 2112258 - RNA, 22 nt, Staphylococcus aureus subsp. aureus MW2
acacuguuuuauaaaugaauua

SEQ ID NO: 2112259 - RNA, 14 nt, Staphylococcus aureus subsp. aureus MW2
acacuguugaaaau

SEQ ID NO: 2112260 - RNA, 16 nt, Staphylococcus aureus subsp. aureus MW2
acacuuuaguauuaua

SEQ ID NO: 2112261 - RNA, 14 nt, Staphylococcus aureus subsp. aureus MW2
acacuuuaaauaca

SEQ ID NO: 2112262 - RNA, 20 nt, Staphylococcus aureus subsp. aureus MW2
acauaauuaacuuucuuuug

SEQ ID NO: 2112263 - RNA, 16 nt, Staphylococcus aureus subsp. aureus MW2
acauaauuuaucugcg

SEQ ID NO: 2112264 - RNA, 16 nt, Staphylococcus aureus subsp. aureus MW2
acauacaccuucagau

SEQ ID NO: 2112265 - RNA, 16 nt, Staphylococcus aureus subsp. aureus MW2
acauacagucaauaca

SEQ ID NO: 2112266 - RNA, 21 nt, Staphylococcus aureus subsp. aureus MW2
acauaccacacuuuaaacaag

SEQ ID NO: 2112267 - RNA, 14 nt, Staphylococcus aureus subsp. aureus MW2
acauauucauaaua

SEQ ID NO: 2112268 - RNA, 18 nt, Staphylococcus aureus subsp. aureus MW2
acauauucaguauaugua

SEQ ID NO: 2112269 - RNA, 20 nt, Staphylococcus aureus subsp. aureus MW2
acauauuccgagaauuauua

SEQ ID NO: 2112270 - RNA, 19 nt, Staphylococcus aureus subsp. aureus MW2
acauauuuauacugaucaa

SEQ ID NO: 2112271 - RNA, 15 nt, Staphylococcus aureus subsp. aureus MW2
acauauuuauauuuu

SEQ ID NO: 2112272 - RNA, 15 nt, Staphylococcus aureus subsp. aureus MW2
acauauuuauacuga

SEQ ID NO: 2112273 - RNA, 19 nt, Staphylococcus aureus subsp. aureus MW2
acauauuuuaacuaugaau

SEQ ID NO: 2112274 - RNA, 15 nt, Staphylococcus aureus subsp. aureus MW2
acauauuuucacaau

SEQ ID NO: 2112275 - RNA, 19 nt, Staphylococcus aureus subsp. aureus MW2
acaucaaauagacaccaaa

SEQ ID NO: 2112276 - RNA, 18 nt, Staphylococcus aureus subsp. aureus MW2
acaucaaauagacaccaa

SEQ ID NO: 2112277 - RNA, 16 nt, Staphylococcus aureus subsp. aureus MW2
acauauuuuuugauau

SEQ ID NO: 2112278 - RNA, 21 nt, Staphylococcus aureus subsp. aureus MW2
acaucacuauacgcaaucauu

SEQ ID NO: 2112279 - RNA, 15 nt, Staphylococcus aureus subsp. aureus MW2
acaucauuaaauauu

SEQ ID NO: 2112280 - RNA, 17 nt, Staphylococcus aureus subsp. aureus MW2
acaucauuaaauauuua

SEQ ID NO: 2112281 - RNA, 13 nt, Staphylococcus aureus subsp. aureus MW2
acaucauuaaaua

SEQ ID NO: 2112282 - RNA, 14 nt, Staphylococcus aureus subsp. aureus MW2
acaucacuugcugu

SEQ ID NO: 2112283 - RNA, 19 nt, Staphylococcus aureus subsp. aureus MW2
acaucgcauaauaucuuac

SEQ ID NO: 2112284 - RNA, 22 nt, Staphylococcus aureus subsp. aureus MW2
acaucgauugauaauguaaaau

SEQ ID NO: 2112285 - RNA, 23 nt, Staphylococcus aureus subsp. aureus MW2
acauccaauuauguuuaucuacu

SEQ ID NO: 2112286 - RNA, 20 nt, Staphylococcus aureus subsp. aureus MW2
acaucauuguuauagcguuu

SEQ ID NO: 2112287 - RNA, 15 nt, Staphylococcus aureus subsp. aureus MW2
acaucauuuuuggau

SEQ ID NO: 2112288 - RNA, 17 nt, Staphylococcus aureus subsp. aureus MW2
acaucauuuuuggauga

SEQ ID NO: 2112289 - RNA, 15 nt, Staphylococcus aureus subsp. aureus MW2
acaucauucacaagu

SEQ ID NO: 2112290 - RNA, 22 nt, Staphylococcus aureus subsp. aureus MW2
acaucauugauagauagaaauu

SEQ ID NO: 2112291 - RNA, 20 nt, Staphylococcus aureus subsp. aureus MW2
acaugauacugaaauuucau

SEQ ID NO: 2112292 - RNA, 14 nt, Staphylococcus aureus subsp. aureus MW2
acaugauauaaaua

SEQ ID NO: 2112293 - RNA, 19 nt, Staphylococcus aureus subsp. aureus MW2
acaugauucaugauauguu

SEQ ID NO: 2112294 - RNA, 14 nt, Staphylococcus aureus subsp. aureus MW2
acaugccaauggaa

SEQ ID NO: 2112295 - RNA, 17 nt, Staphylococcus aureus subsp. aureus MW2
acauggaaaauauauua

SEQ ID NO: 2112296 - RNA, 19 nt, Staphylococcus aureus subsp. aureus MW2
acaugcuuggacauauacu

SEQ ID NO: 2112297 - RNA, 17 nt, Staphylococcus aureus subsp. aureus MW2
acaugaaucaacaauau

SEQ ID NO: 2112298 - RNA, 22 nt, Staphylococcus aureus subsp. aureus MW2
acaugacauucauuuaguuaaa

SEQ ID NO: 2112299 - RNA, 13 nt, Staphylococcus aureus subsp. aureus MW2
acaucugaaaaaa

SEQ ID NO: 2112300 - RNA, 22 nt, Staphylococcus aureus subsp. aureus MW2
acaucgccaauuugauuaguaa

SEQ ID NO: 2112301 - RNA, 22 nt, Staphylococcus aureus subsp. aureus MW2
acaucguugcuuuuauuuuuaa

SEQ ID NO: 2112302 - RNA, 14 nt, Staphylococcus aureus subsp. aureus MW2
acaucuauuucuug

SEQ ID NO: 2112303 - RNA, 15 nt, Staphylococcus aureus subsp. aureus MW2
acaucuauccuuguu

SEQ ID NO: 2112304 - RNA, 21 nt, Staphylococcus aureus subsp. aureus MW2
acaucuauguggcuacuugaa

SEQ ID NO: 2112305 - RNA, 22 nt, Staphylococcus aureus subsp. aureus MW2
acaucuagaugaaauuguguug

SEQ ID NO: 2112306 - RNA, 22 nt, Staphylococcus aureus subsp. aureus MW2
acaucuaaauaguuuuucauau

SEQ ID NO: 2112307 - RNA, 19 nt, Staphylococcus aureus subsp. aureus MW2
acaucuaagugauauacga

SEQ ID NO: 2112308 - RNA, 12 nt, Staphylococcus aureus subsp. aureus MW2
acauaaaucaau

SEQ ID NO: 2112309 - RNA, 23 nt, Staphylococcus aureus subsp. aureus MW2
acauaaaucuaauacuuucaaac

SEQ ID NO: 2112310 - RNA, 21 nt, Staphylococcus aureus subsp. aureus MW2
acauaacaaacauaccccuuu

SEQ ID NO: 2112311 - RNA, 18 nt, Staphylococcus aureus subsp. aureus MW2
acauaaccgaugugauuu

SEQ ID NO: 2112312 - RNA, 16 nt, Staphylococcus aureus subsp. aureus MW2
acauaaacaauaauuu

SEQ ID NO: 2112313 - RNA, 15 nt, Staphylococcus aureus subsp. aureus MW2
acauaaaauuaacuu

SEQ ID NO: 2112314 - RNA, 18 nt, Staphylococcus aureus subsp. aureus MW2
acauaaagcuuugacaua

SEQ ID NO: 2112315 - RNA, 13 nt, Staphylococcus aureus subsp. aureus MW2
acauaaagaauuu

SEQ ID NO: 2112316 - RNA, 23 nt, Staphylococcus aureus subsp. aureus MW2
acaguuacuuucgcuugcaaaga

SEQ ID NO: 2112317 - RNA, 22 nt, Staphylococcus aureus subsp. aureus MW2
acaguuacuuucgcuugcaaag

SEQ ID NO: 2112318 - RNA, 13 nt, Staphylococcus aureus subsp. aureus MW2
acaguuaauucug

SEQ ID NO: 2112319 - RNA, 17 nt, Staphylococcus aureus subsp. aureus MW2
acagugacugauucacc

SEQ ID NO: 2112320 - RNA, 20 nt, Staphylococcus aureus subsp. aureus MW2
acagucaaugacuuaacauc

SEQ ID NO: 2112321 - RNA, 16 nt, Staphylococcus aureus subsp. aureus MW2
acagucaacuacugcu

SEQ ID NO: 2112322 - RNA, 18 nt, Staphylococcus aureus subsp. aureus MW2
acagucauaaauugauuu

SEQ ID NO: 2112323 - RNA, 17 nt, Staphylococcus aureus subsp. aureus MW2
acaguacaaauaacaaa

SEQ ID NO: 2112324 - RNA, 19 nt, Staphylococcus aureus subsp. aureus MW2
acaguaauuuuuaaacaaa

SEQ ID NO: 2112325 - RNA, 14 nt, Staphylococcus aureus subsp. aureus MW2
acaguaucuucagu

SEQ ID NO: 2112326 - RNA, 18 nt, Staphylococcus aureus subsp. aureus MW2
acagguuacuuuuuuaau

SEQ ID NO: 2112327 - RNA, 15 nt, Staphylococcus aureus subsp. aureus MW2
acagggguaaaacuu

SEQ ID NO: 2112328 - RNA, 19 nt, Staphylococcus aureus subsp. aureus MW2
agaagcaaaagaugaaaau

SEQ ID NO: 2112329 - RNA, 16 nt, Staphylococcus aureus subsp. aureus MW2
agaagaaacuuaauca

SEQ ID NO: 2112330 - RNA, 23 nt, Staphylococcus aureus subsp. aureus MW2
agaacuuuaaaaauugcaaugcu

SEQ ID NO: 2112331 - RNA, 14 nt, Staphylococcus aureus subsp. aureus MW2
agaacuucucuuug

SEQ ID NO: 2112332 - RNA, 14 nt, Staphylococcus aureus subsp. aureus MW2
agaauacaaauauu

SEQ ID NO: 2112333 - RNA, 17 nt, Staphylococcus aureus subsp. aureus MW2
agaagcuggcggaaagu

SEQ ID NO: 2112334 - RNA, 20 nt, Staphylococcus aureus subsp. aureus MW2
agaagcuggcggaaagucag

SEQ ID NO: 2112335 - RNA, 22 nt, Staphylococcus aureus subsp. aureus MW2
agaagcuggcggaaagucaggu

SEQ ID NO: 2112336 - RNA, 17 nt, Staphylococcus aureus subsp. aureus MW2
agaagcugacgaaaagu

SEQ ID NO: 2112337 - RNA, 20 nt, Staphylococcus aureus subsp. aureus MW2
agaagcugacgaaaagucag

SEQ ID NO: 2112338 - RNA, 23 nt, Staphylococcus aureus subsp. aureus MW2
agaaucuuggaaguaucugugaa

SEQ ID NO: 2112339 - RNA, 18 nt, Staphylococcus aureus subsp. aureus MW2
agaaugaauaauuccagu

SEQ ID NO: 2112340 - RNA, 18 nt, Staphylococcus aureus subsp. aureus MW2
agaaugaacuucucuuag

SEQ ID NO: 2112341 - RNA, 20 nt, Staphylococcus aureus subsp. aureus MW2
agaaugaaaccguauuauua

SEQ ID NO: 2112342 - RNA, 22 nt, Staphylococcus aureus subsp. aureus MW2
agaaugaaaccguauuauuagu

SEQ ID NO: 2112343 - RNA, 16 nt, Staphylococcus aureus subsp. aureus MW2
agaauucuaaaagaau

SEQ ID NO: 2112344 - RNA, 16 nt, Staphylococcus aureus subsp. aureus MW2
agaauucaauuucuca

SEQ ID NO: 2112345 - RNA, 17 nt, Staphylococcus aureus subsp. aureus MW2
agaauucaauuucucac

SEQ ID NO: 2112346 - RNA, 16 nt, Staphylococcus aureus subsp. aureus MW2
agaauacuaaaagugu

SEQ ID NO: 2112347 - RNA, 11 nt, Staphylococcus aureus subsp. aureus MW2
agaauauuaac

SEQ ID NO: 2112348 - RNA, 22 nt, Staphylococcus aureus subsp. aureus MW2
agaauauuaagauguauaugaa

SEQ ID NO: 2112349 - RNA, 17 nt, Staphylococcus aureus subsp. aureus MW2
agaaucaaguaauucau

SEQ ID NO: 2112350 - RNA, 15 nt, Staphylococcus aureus subsp. aureus MW2
agaaucaauuauuga

SEQ ID NO: 2112351 - RNA, 19 nt, Staphylococcus aureus subsp. aureus MW2
agaccauuuuauauuuuag

SEQ ID NO: 2112352 - RNA, 17 nt, Staphylococcus aureus subsp. aureus MW2
agacguuuuugaaucag

SEQ ID NO: 2112353 - RNA, 20 nt, Staphylococcus aureus subsp. aureus MW2
agacguaaguguaaaugaaa

SEQ ID NO: 2112354 - RNA, 12 nt, Staphylococcus aureus subsp. aureus MW2
agacaauauuuu

SEQ ID NO: 2112355 - RNA, 13 nt, Staphylococcus aureus subsp. aureus MW2
agacaaucaucuu

SEQ ID NO: 2112356 - RNA, 17 nt, Staphylococcus aureus subsp. aureus MW2
agacacggccugcaagu

SEQ ID NO: 2112357 - RNA, 14 nt, Staphylococcus aureus subsp. aureus MW2
agacaauaaaucuu

SEQ ID NO: 2112358 - RNA, 21 nt, Staphylococcus aureus subsp. aureus MW2
agaauugcaacgcaucacaaa

SEQ ID NO: 2112359 - RNA, 16 nt, Staphylococcus aureus subsp. aureus MW2
agaauuucgaaaagaa

SEQ ID NO: 2112360 - RNA, 14 nt, Staphylococcus aureus subsp. aureus MW2
agaauuucaucaaa

SEQ ID NO: 2112361 - RNA, 15 nt, Staphylococcus aureus subsp. aureus MW2
agaauuuaguuuucg

SEQ ID NO: 2112362 - RNA, 19 nt, Staphylococcus aureus subsp. aureus MW2
agacaucaucuauuuuuaa

SEQ ID NO: 2112363 - RNA, 20 nt, Staphylococcus aureus subsp. aureus MW2
agacauaaggucuuggacua

SEQ ID NO: 2112364 - RNA, 17 nt, Staphylococcus aureus subsp. aureus MW2
agacauaaauauggauu

SEQ ID NO: 2112365 - RNA, 13 nt, Staphylococcus aureus subsp. aureus MW2
agacauaaaaaaa

SEQ ID NO: 2112366 - RNA, 14 nt, Staphylococcus aureus subsp. aureus MW2
agacacuuaacuug

SEQ ID NO: 2112367 - RNA, 17 nt, Staphylococcus aureus subsp. aureus MW2
agaacagcacauuuuua

SEQ ID NO: 2112368 - RNA, 18 nt, Staphylococcus aureus subsp. aureus MW2
agaaccacgcaucaugua

SEQ ID NO: 2112369 - RNA, 21 nt, Staphylococcus aureus subsp. aureus MW2
agaaccaucauuuauauggaa

SEQ ID NO: 2112370 - RNA, 15 nt, Staphylococcus aureus subsp. aureus MW2
agaaccaacaauaaa

SEQ ID NO: 2112371 - RNA, 22 nt, Staphylococcus aureus subsp. aureus MW2
agaacaugauacugaaauuuca

SEQ ID NO: 2112372 - RNA, 23 nt, Staphylococcus aureus subsp. aureus MW2
agaacaugauacugaaauuucau

SEQ ID NO: 2112373 - RNA, 20 nt, Staphylococcus aureus subsp. aureus MW2
agaaauuguguuucuuuuau

SEQ ID NO: 2112374 - RNA, 17 nt, Staphylococcus aureus subsp. aureus MW2
agaaauuguaguauuuu

SEQ ID NO: 2112375 - RNA, 17 nt, Staphylococcus aureus subsp. aureus MW2
agaaauuugauuuucaa

SEQ ID NO: 2112376 - RNA, 20 nt, Staphylococcus aureus subsp. aureus MW2
agaaauuugauuuucaauuu

SEQ ID NO: 2112377 - RNA, 16 nt, Staphylococcus aureus subsp. aureus MW2
agaaauugaauucucg

SEQ ID NO: 2112378 - RNA, 18 nt, Staphylococcus aureus subsp. aureus MW2
agaaauuggcuccccaau

SEQ ID NO: 2112379 - RNA, 14 nt, Staphylococcus aureus subsp. aureus MW2
agaacgagaauuuc

SEQ ID NO: 2112380 - RNA, 21 nt, Staphylococcus aureus subsp. aureus MW2
agaaccuugaaugauauuaac

SEQ ID NO: 2112381 - RNA, 18 nt, Staphylococcus aureus subsp. aureus MW2
agaacuaauggcaacgau

SEQ ID NO: 2112382 - RNA, 13 nt, Staphylococcus aureus subsp. aureus MW2
agaacuacaauuc

SEQ ID NO: 2112383 - RNA, 23 nt, Staphylococcus aureus subsp. aureus MW2
acuucgccaagccauuuuucuuu

SEQ ID NO: 2112384 - RNA, 14 nt, Staphylococcus aureus subsp. aureus MW2
acuuuugcaucaca

SEQ ID NO: 2112385 - RNA, 24 nt, Staphylococcus aureus subsp. aureus MW2
acuuuugcaucacagauaaugcau

SEQ ID NO: 2112386 - RNA, 20 nt, Staphylococcus aureus subsp. aureus MW2
acuuuuggucuguugaaguc

SEQ ID NO: 2112387 - RNA, 12 nt, Staphylococcus aureus subsp. aureus MW2
acuuuucuucca

SEQ ID NO: 2112388 - RNA, 14 nt, Staphylococcus aureus subsp. aureus MW2
acuuuuuaaaggac

SEQ ID NO: 2112389 - RNA, 17 nt, Staphylococcus aureus subsp. aureus MW2
acuuuuuaauuccaaag

SEQ ID NO: 2112390 - RNA, 22 nt, Staphylococcus aureus subsp. aureus MW2
acuuuuugacauauuuuuuaaa

SEQ ID NO: 2112391 - RNA, 18 nt, Staphylococcus aureus subsp. aureus MW2
acuuuuuuaacuuuaaca

SEQ ID NO: 2112392 - RNA, 19 nt, Staphylococcus aureus subsp. aureus MW2
acuuuuucgauuaauucuu

SEQ ID NO: 2112393 - RNA, 14 nt, Staphylococcus aureus subsp. aureus MW2
acuuuuucaucuuu

SEQ ID NO: 2112394 - RNA, 17 nt, Staphylococcus aureus subsp. aureus MW2
acuuuuucaucuuucac

SEQ ID NO: 2112395 - RNA, 20 nt, Staphylococcus aureus subsp. aureus MW2
agaaaaagguuaauauuaaa

SEQ ID NO: 2112396 - RNA, 18 nt, Staphylococcus aureus subsp. aureus MW2
agaaaaagggcaaaaaag

SEQ ID NO: 2112397 - RNA, 13 nt, Staphylococcus aureus subsp. aureus MW2
agaaaaauaugau

SEQ ID NO: 2112398 - RNA, 14 nt, Staphylococcus aureus subsp. aureus MW2
agaaaaagugauaa

SEQ ID NO: 2112399 - RNA, 19 nt, Staphylococcus aureus subsp. aureus MW2
acuuuuuuguucaaucacu

SEQ ID NO: 2112400 - RNA, 18 nt, Staphylococcus aureus subsp. aureus MW2
agaaagcuaauaucaaua

SEQ ID NO: 2112401 - RNA, 16 nt, Staphylococcus aureus subsp. aureus MW2
agaaagcuaauaucaa

SEQ ID NO: 2112402 - RNA, 20 nt, Staphylococcus aureus subsp. aureus MW2
agaaagcgucuuuuuauacu

SEQ ID NO: 2112403 - RNA, 19 nt, Staphylococcus aureus subsp. aureus MW2
agaaaggcuagcuaaaauu

SEQ ID NO: 2112404 - RNA, 13 nt, Staphylococcus aureus subsp. aureus MW2
agaaaauaucauu

SEQ ID NO: 2112405 - RNA, 14 nt, Staphylococcus aureus subsp. aureus MW2
agaaaauaucauuu

SEQ ID NO: 2112406 - RNA, 22 nt, Staphylococcus aureus subsp. aureus MW2
agaaaaucguuauaaguacaaa

SEQ ID NO: 2112407 - RNA, 18 nt, Staphylococcus aureus subsp. aureus MW2
agaaaaugaguacaacau

SEQ ID NO: 2112408 - RNA, 14 nt, Staphylococcus aureus subsp. aureus MW2
agaaacgaaauuau

SEQ ID NO: 2112409 - RNA, 19 nt, Staphylococcus aureus subsp. aureus MW2
agaaaauuuguaacaggau

SEQ ID NO: 2112410 - RNA, 17 nt, Staphylococcus aureus subsp. aureus MW2
agacuaauuaucuucau

SEQ ID NO: 2112411 - RNA, 18 nt, Staphylococcus aureus subsp. aureus MW2
agacuaaaaugaaugaag

SEQ ID NO: 2112412 - RNA, 15 nt, Staphylococcus aureus subsp. aureus MW2
agacucaauuucauu

SEQ ID NO: 2112413 - RNA, 14 nt, Staphylococcus aureus subsp. aureus MW2
agacuauuauaauu

SEQ ID NO: 2112414 - RNA, 23 nt, Staphylococcus aureus subsp. aureus MW2
agacuauaaugaauaaauaauuu

SEQ ID NO: 2112415 - RNA, 17 nt, Staphylococcus aureus subsp. aureus MW2
agagagaaaagcuagaa

SEQ ID NO: 2112416 - RNA, 13 nt, Staphylococcus aureus subsp. aureus MW2
agagaugaaagau

SEQ ID NO: 2112417 - RNA, 17 nt, Staphylococcus aureus subsp. aureus MW2
agaguaguucggaugag

SEQ ID NO: 2112418 - RNA, 17 nt, Staphylococcus aureus subsp. aureus MW2
agagguacuagaauuaa

SEQ ID NO: 2112419 - RNA, 17 nt, Staphylococcus aureus subsp. aureus MW2
agagguaaaucuguuua

SEQ ID NO: 2112420 - RNA, 14 nt, Staphylococcus aureus subsp. aureus MW2
agauacguuauuuc

SEQ ID NO: 2112421 - RNA, 22 nt, Staphylococcus aureus subsp. aureus MW2
agauacugcuucuacccuugca

SEQ ID NO: 2112422 - RNA, 23 nt, Staphylococcus aureus subsp. aureus MW2
agauacuucaguacgguuauuua

SEQ ID NO: 2112423 - RNA, 22 nt, Staphylococcus aureus subsp. aureus MW2
agauagacuuucuugaugaauu

SEQ ID NO: 2112424 - RNA, 20 nt, Staphylococcus aureus subsp. aureus MW2
agauaggaaacuuaaauauu

SEQ ID NO: 2112425 - RNA, 15 nt, Staphylococcus aureus subsp. aureus MW2
agauaggaaacuuaa

SEQ ID NO: 2112426 - RNA, 17 nt, Staphylococcus aureus subsp. aureus MW2
agauagauaaaucaaga

SEQ ID NO: 2112427 - RNA, 19 nt, Staphylococcus aureus subsp. aureus MW2
agauaauuuuuaacaucau

SEQ ID NO: 2112428 - RNA, 22 nt, Staphylococcus aureus subsp. aureus MW2
agauaucuuaaucuaaaaauag

SEQ ID NO: 2112429 - RNA, 16 nt, Staphylococcus aureus subsp. aureus MW2
agauaucuuauaacaa

SEQ ID NO: 2112430 - RNA, 21 nt, Staphylococcus aureus subsp. aureus MW2
agauaucuuauaacaaaaauu

SEQ ID NO: 2112431 - RNA, 21 nt, Staphylococcus aureus subsp. aureus MW2
agauauuauugugaaaucuau

SEQ ID NO: 2112432 - RNA, 13 nt, Staphylococcus aureus subsp. aureus MW2
agauaugccuaua

SEQ ID NO: 2112433 - RNA, 21 nt, Staphylococcus aureus subsp. aureus MW2
agauauuucggacaauaacag

SEQ ID NO: 2112434 - RNA, 18 nt, Staphylococcus aureus subsp. aureus MW2
agauauuucuguuuuccu

SEQ ID NO: 2112435 - RNA, 18 nt, Staphylococcus aureus subsp. aureus MW2
agauauauaauaccccaa

SEQ ID NO: 2112436 - RNA, 19 nt, Staphylococcus aureus subsp. aureus MW2
agauauauuaauauuugau

SEQ ID NO: 2112437 - RNA, 17 nt, Staphylococcus aureus subsp. aureus MW2
agauauaaacauuuaua

SEQ ID NO: 2112438 - RNA, 15 nt, Staphylococcus aureus subsp. aureus MW2
agauauaagaaaaag

SEQ ID NO: 2112439 - RNA, 16 nt, Staphylococcus aureus subsp. aureus MW2
agauauaagaaaaaga

SEQ ID NO: 2112440 - RNA, 22 nt, Staphylococcus aureus subsp. aureus MW2
agauauaauaaaaacagcagug

SEQ ID NO: 2112441 - RNA, 17 nt, Staphylococcus aureus subsp. aureus MW2
agauaguuugagaaaau

SEQ ID NO: 2112442 - RNA, 22 nt, Staphylococcus aureus subsp. aureus MW2
agauaguuugagaaaauuaaua

SEQ ID NO: 2112443 - RNA, 16 nt, Staphylococcus aureus subsp. aureus MW2
agaugauugucuagca

SEQ ID NO: 2112444 - RNA, 15 nt, Staphylococcus aureus subsp. aureus MW2
agaugcauaaaaaaa

SEQ ID NO: 2112445 - RNA, 16 nt, Staphylococcus aureus subsp. aureus MW2
agaugcauaaaaaaag

SEQ ID NO: 2112446 - RNA, 16 nt, Staphylococcus aureus subsp. aureus MW2
agaugauacauucuau

SEQ ID NO: 2112447 - RNA, 19 nt, Staphylococcus aureus subsp. aureus MW2
agaugaggcgauaaaagaa

SEQ ID NO: 2112448 - RNA, 17 nt, Staphylococcus aureus subsp. aureus MW2
agaugagauuucguuag

SEQ ID NO: 2112449 - RNA, 16 nt, Staphylococcus aureus subsp. aureus MW2
agaugaggcgauaaaa

SEQ ID NO: 2112450 - RNA, 13 nt, Staphylococcus aureus subsp. aureus MW2
agaugaauaaugu

SEQ ID NO: 2112451 - RNA, 21 nt, Staphylococcus aureus subsp. aureus MW2
agaugaaugccuaauuuugug

SEQ ID NO: 2112452 - RNA, 20 nt, Staphylococcus aureus subsp. aureus MW2
agaucauacauuagaacaau

SEQ ID NO: 2112453 - RNA, 21 nt, Staphylococcus aureus subsp. aureus MW2
agaucgauguguaacauuacg

SEQ ID NO: 2112454 - RNA, 19 nt, Staphylococcus aureus subsp. aureus MW2
agaugcuugaccuucaguu

SEQ ID NO: 2112455 - RNA, 17 nt, Staphylococcus aureus subsp. aureus MW2
agauggcugcaucaaua

SEQ ID NO: 2112456 - RNA, 15 nt, Staphylococcus aureus subsp. aureus MW2
agauguauaaaacua

SEQ ID NO: 2112457 - RNA, 18 nt, Staphylococcus aureus subsp. aureus MW2
agaugugaugcuugaaug

SEQ ID NO: 2112458 - RNA, 17 nt, Staphylococcus aureus subsp. aureus MW2
agauguauaaaacuaau

SEQ ID NO: 2112459 - RNA, 16 nt, Staphylococcus aureus subsp. aureus MW2
agauguucacauucuu

SEQ ID NO: 2112460 - RNA, 18 nt, Staphylococcus aureus subsp. aureus MW2
agauguugaaaaguauau

SEQ ID NO: 2112461 - RNA, 16 nt, Staphylococcus aureus subsp. aureus MW2
agauguugaugaagua

SEQ ID NO: 2112462 - RNA, 19 nt, Staphylococcus aureus subsp. aureus MW2
agauuaaaauaugacacau

SEQ ID NO: 2112463 - RNA, 16 nt, Staphylococcus aureus subsp. aureus MW2
agauugaaaaaauaac

SEQ ID NO: 2112464 - RNA, 20 nt, Staphylococcus aureus subsp. aureus MW2
agauucggaaaauaugauaa

SEQ ID NO: 2112465 - RNA, 15 nt, Staphylococcus aureus subsp. aureus MW2
agauuggaagggcau

SEQ ID NO: 2112466 - RNA, 18 nt, Staphylococcus aureus subsp. aureus MW2
agauugaguguaugcaua

SEQ ID NO: 2112467 - RNA, 23 nt, Staphylococcus aureus subsp. aureus MW2
agauuauuuaaaacuuguaaauu

SEQ ID NO: 2112468 - RNA, 19 nt, Staphylococcus aureus subsp. aureus MW2
agauuauuuaaaacuugua

SEQ ID NO: 2112469 - RNA, 22 nt, Staphylococcus aureus subsp. aureus MW2
agauuauugguugaaauuaauu

SEQ ID NO: 2112470 - RNA, 18 nt, Staphylococcus aureus subsp. aureus MW2
agauuauugguugaaauu

SEQ ID NO: 2112471 - RNA, 16 nt, Staphylococcus aureus subsp. aureus MW2
agauuauugaaauuug

SEQ ID NO: 2112472 - RNA, 24 nt, Staphylococcus aureus subsp. aureus MW2
agauuaguguagggggcauuauua

SEQ ID NO: 2112473 - RNA, 15 nt, Staphylococcus aureus subsp. aureus MW2
agauuauauuaucau

SEQ ID NO: 2112474 - RNA, 20 nt, Staphylococcus aureus subsp. aureus MW2
agauucauaucuuucaauua

SEQ ID NO: 2112475 - RNA, 15 nt, Staphylococcus aureus subsp. aureus MW2
agauucaaaauuaua

SEQ ID NO: 2112476 - RNA, 15 nt, Staphylococcus aureus subsp. aureus MW2
agauucaaauugguu

SEQ ID NO: 2112477 - RNA, 18 nt, Staphylococcus aureus subsp. aureus MW2
agauucacuguauaaaua

SEQ ID NO: 2112478 - RNA, 17 nt, Staphylococcus aureus subsp. aureus MW2
agauucaauuaaugcau

SEQ ID NO: 2112479 - RNA, 15 nt, Staphylococcus aureus subsp. aureus MW2
acuccuuauuuuucg

SEQ ID NO: 2112480 - RNA, 15 nt, Staphylococcus aureus subsp. aureus MW2
acuccuuaaacaaau

SEQ ID NO: 2112481 - RNA, 15 nt, Staphylococcus aureus subsp. aureus MW2
acuccuuacaauaaa

SEQ ID NO: 2112482 - RNA, 15 nt, Staphylococcus aureus subsp. aureus MW2
acuccucuauuuuau

SEQ ID NO: 2112483 - RNA, 22 nt, Staphylococcus aureus subsp. aureus MW2
acucaaugauuguaauaucuaa

SEQ ID NO: 2112484 - RNA, 13 nt, Staphylococcus aureus subsp. aureus MW2
acucaauaaaauu

SEQ ID NO: 2112485 - RNA, 17 nt, Staphylococcus aureus subsp. aureus MW2
acucaacugaugaaaag

SEQ ID NO: 2112486 - RNA, 15 nt, Staphylococcus aureus subsp. aureus MW2
acucaauucucuaac

SEQ ID NO: 2112487 - RNA, 22 nt, Staphylococcus aureus subsp. aureus MW2
acucugauauugaucugauuuc

SEQ ID NO: 2112488 - RNA, 19 nt, Staphylococcus aureus subsp. aureus MW2
acucugaucuaaaaccaua

SEQ ID NO: 2112489 - RNA, 20 nt, Staphylococcus aureus subsp. aureus MW2
acucuagcggaacguaaguu

SEQ ID NO: 2112490 - RNA, 17 nt, Staphylococcus aureus subsp. aureus MW2
acucuaauuacauauac

SEQ ID NO: 2112491 - RNA, 14 nt, Staphylococcus aureus subsp. aureus MW2
acucgacuugguau

SEQ ID NO: 2112492 - RNA, 22 nt, Staphylococcus aureus subsp. aureus MW2
acucgacuugguauuuauccug

SEQ ID NO: 2112493 - RNA, 16 nt, Staphylococcus aureus subsp. aureus MW2
acugcaaauacaccag

SEQ ID NO: 2112494 - RNA, 20 nt, Staphylococcus aureus subsp. aureus MW2
acugcaauggcuaaugacuu

SEQ ID NO: 2112495 - RNA, 23 nt, Staphylococcus aureus subsp. aureus MW2
acugcaauaauuacuaaccuaaa

SEQ ID NO: 2112496 - RNA, 21 nt, Staphylococcus aureus subsp. aureus MW2
acugaugaaaacuuaaaaaug

SEQ ID NO: 2112497 - RNA, 22 nt, Staphylococcus aureus subsp. aureus MW2
acugauucaccagguuuuuuau

SEQ ID NO: 2112498 - RNA, 13 nt, Staphylococcus aureus subsp. aureus MW2
acugauuaaacug

SEQ ID NO: 2112499 - RNA, 19 nt, Staphylococcus aureus subsp. aureus MW2
acugagcaacaaaagaugu

SEQ ID NO: 2112500 - RNA, 16 nt, Staphylococcus aureus subsp. aureus MW2
acugauaaaaggggaa

SEQ ID NO: 2112501 - RNA, 16 nt, Staphylococcus aureus subsp. aureus MW2
acugccuuuuuguaau

SEQ ID NO: 2112502 - RNA, 22 nt, Staphylococcus aureus subsp. aureus MW2
acugcgaacagcugcuucucuu

SEQ ID NO: 2112503 - RNA, 16 nt, Staphylococcus aureus subsp. aureus MW2
acugcgacauguccau

SEQ ID NO: 2112504 - RNA, 17 nt, Staphylococcus aureus subsp. aureus MW2
acugccauauguuuuag

SEQ ID NO: 2112505 - RNA, 16 nt, Staphylococcus aureus subsp. aureus MW2
acugccauauguuuua

SEQ ID NO: 2112506 - RNA, 16 nt, Staphylococcus aureus subsp. aureus MW2
acugcauauaaaguca

SEQ ID NO: 2112507 - RNA, 14 nt, Staphylococcus aureus subsp. aureus MW2
acugcaccuccaac

SEQ ID NO: 2112508 - RNA, 19 nt, Staphylococcus aureus subsp. aureus MW2
acugcacaucauaauaaau

SEQ ID NO: 2112509 - RNA, 16 nt, Staphylococcus aureus subsp. aureus MW2
acuggcaaaucaaaca

SEQ ID NO: 2112510 - RNA, 16 nt, Staphylococcus aureus subsp. aureus MW2
acugcuaauuuuuuca

SEQ ID NO: 2112511 - RNA, 20 nt, Staphylococcus aureus subsp. aureus MW2
acugcucuuuauauauaaaa

SEQ ID NO: 2112512 - RNA, 15 nt, Staphylococcus aureus subsp. aureus MW2
acugcuguucuuuuu

SEQ ID NO: 2112513 - RNA, 20 nt, Staphylococcus aureus subsp. aureus MW2
acugcugcuucggcaccuuu

SEQ ID NO: 2112514 - RNA, 22 nt, Staphylococcus aureus subsp. aureus MW2
acugcuuuggacacaauaccuu

SEQ ID NO: 2112515 - RNA, 19 nt, Staphylococcus aureus subsp. aureus MW2
acugcuuuuuuaaauuuaa

SEQ ID NO: 2112516 - RNA, 23 nt, Staphylococcus aureus subsp. aureus MW2
acugcuuuuuuauucuaauacaa

SEQ ID NO: 2112517 - RNA, 19 nt, Staphylococcus aureus subsp. aureus MW2
acuuagcaaucucuuuaga

SEQ ID NO: 2112518 - RNA, 16 nt, Staphylococcus aureus subsp. aureus MW2
acuuaacuuguguuau

SEQ ID NO: 2112519 - RNA, 13 nt, Staphylococcus aureus subsp. aureus MW2
acuuaauaucaua

SEQ ID NO: 2112520 - RNA, 13 nt, Staphylococcus aureus subsp. aureus MW2
acuuaaaauuuaa

SEQ ID NO: 2112521 - RNA, 18 nt, Staphylococcus aureus subsp. aureus MW2
acuuaaaagagaauauaa

SEQ ID NO: 2112522 - RNA, 14 nt, Staphylococcus aureus subsp. aureus MW2
acuuaaaauauuua

SEQ ID NO: 2112523 - RNA, 15 nt, Staphylococcus aureus subsp. aureus MW2
acuuaaaauauuuaa

SEQ ID NO: 2112524 - RNA, 14 nt, Staphylococcus aureus subsp. aureus MW2
acuuaacaucuuuu

SEQ ID NO: 2112525 - RNA, 20 nt, Staphylococcus aureus subsp. aureus MW2
acuuaacaucuuuuucaccu

SEQ ID NO: 2112526 - RNA, 15 nt, Staphylococcus aureus subsp. aureus MW2
acuuaaaaaugaaau

SEQ ID NO: 2112527 - RNA, 18 nt, Staphylococcus aureus subsp. aureus MW2
acuguuuuauuaugaauu

SEQ ID NO: 2112528 - RNA, 14 nt, Staphylococcus aureus subsp. aureus MW2
acuguuuucauuug

SEQ ID NO: 2112529 - RNA, 15 nt, Staphylococcus aureus subsp. aureus MW2
acuguuuucauuugu

SEQ ID NO: 2112530 - RNA, 19 nt, Staphylococcus aureus subsp. aureus MW2
acugguugauaaauaaacu

SEQ ID NO: 2112531 - RNA, 14 nt, Staphylococcus aureus subsp. aureus MW2
acugguugauaaau

SEQ ID NO: 2112532 - RNA, 16 nt, Staphylococcus aureus subsp. aureus MW2
acugucgcucauccuc

SEQ ID NO: 2112533 - RNA, 20 nt, Staphylococcus aureus subsp. aureus MW2
acugucgguucaucuaaaau

SEQ ID NO: 2112534 - RNA, 16 nt, Staphylococcus aureus subsp. aureus MW2
acugucgguucaucua

SEQ ID NO: 2112535 - RNA, 15 nt, Staphylococcus aureus subsp. aureus MW2
acugucucaucuucu

SEQ ID NO: 2112536 - RNA, 23 nt, Staphylococcus aureus subsp. aureus MW2
acugucucaucuucuaaaucaau

SEQ ID NO: 2112537 - RNA, 15 nt, Staphylococcus aureus subsp. aureus MW2
acuuauaacugauaa

SEQ ID NO: 2112538 - RNA, 18 nt, Staphylococcus aureus subsp. aureus MW2
acuuagugucacauuaua

SEQ ID NO: 2112539 - RNA, 19 nt, Staphylococcus aureus subsp. aureus MW2
acuucacauuuauccuuua

SEQ ID NO: 2112540 - RNA, 14 nt, Staphylococcus aureus subsp. aureus MW2
acguaaugaaucaa

SEQ ID NO: 2112541 - RNA, 14 nt, Staphylococcus aureus subsp. aureus MW2
acguacaaaauaau

SEQ ID NO: 2112542 - RNA, 18 nt, Staphylococcus aureus subsp. aureus MW2
acgugcauuguaauacca

SEQ ID NO: 2112543 - RNA, 10 nt, Staphylococcus aureus subsp. aureus MW2
acgucuaccu

SEQ ID NO: 2112544 - RNA, 11 nt, Staphylococcus aureus subsp. aureus MW2
acguuuucuag

SEQ ID NO: 2112545 - RNA, 17 nt, Staphylococcus aureus subsp. aureus MW2
acguuuucacuucgcca

SEQ ID NO: 2112546 - RNA, 15 nt, Staphylococcus aureus subsp. aureus MW2
acguuuuuuuaaaua

SEQ ID NO: 2112547 - RNA, 15 nt, Staphylococcus aureus subsp. aureus MW2
acguuuuuuuauaaa

SEQ ID NO: 2112548 - RNA, 16 nt, Staphylococcus aureus subsp. aureus MW2
acguuuucuagguaau

SEQ ID NO: 2112549 - RNA, 14 nt, Staphylococcus aureus subsp. aureus MW2
acguuuugaccaau

SEQ ID NO: 2112550 - RNA, 15 nt, Staphylococcus aureus subsp. aureus MW2
acuaaaaauauauuu

SEQ ID NO: 2112551 - RNA, 16 nt, Staphylococcus aureus subsp. aureus MW2
acguuuuucuuuaaac

SEQ ID NO: 2112552 - RNA, 22 nt, Staphylococcus aureus subsp. aureus MW2
acuaaaaagaagcucccauuaa

SEQ ID NO: 2112553 - RNA, 23 nt, Staphylococcus aureus subsp. aureus MW2
acguuuuuuuauaaauuauagua

SEQ ID NO: 2112554 - RNA, 20 nt, Staphylococcus aureus subsp. aureus MW2
acuaaaaguggccuuuuaaa

SEQ ID NO: 2112555 - RNA, 19 nt, Staphylococcus aureus subsp. aureus MW2
acuaaaacaaauucauauu

SEQ ID NO: 2112556 - RNA, 16 nt, Staphylococcus aureus subsp. aureus MW2
acuaaaacaauaauaa

SEQ ID NO: 2112557 - RNA, 15 nt, Staphylococcus aureus subsp. aureus MW2
acuaaaccauugaau

SEQ ID NO: 2112558 - RNA, 16 nt, Staphylococcus aureus subsp. aureus MW2
acuaaacgauaaauua

SEQ ID NO: 2112559 - RNA, 21 nt, Staphylococcus aureus subsp. aureus MW2
acuaaaccgauuaauauaaua

SEQ ID NO: 2112560 - RNA, 22 nt, Staphylococcus aureus subsp. aureus MW2
acuaaaaugucuuugaaaaauu

SEQ ID NO: 2112561 - RNA, 17 nt, Staphylococcus aureus subsp. aureus MW2
acuaaaauuuguaauuu

SEQ ID NO: 2112562 - RNA, 20 nt, Staphylococcus aureus subsp. aureus MW2
acuaaaauuuguaauuuaaa

SEQ ID NO: 2112563 - RNA, 20 nt, Staphylococcus aureus subsp. aureus MW2
acguugguuuaaaaauugau

SEQ ID NO: 2112564 - RNA, 16 nt, Staphylococcus aureus subsp. aureus MW2
acguuuacguucuuca

SEQ ID NO: 2112565 - RNA, 17 nt, Staphylococcus aureus subsp. aureus MW2
acguuuauccuuuaaau

SEQ ID NO: 2112566 - RNA, 18 nt, Staphylococcus aureus subsp. aureus MW2
acguuuauccuuuaaauc

SEQ ID NO: 2112567 - RNA, 14 nt, Staphylococcus aureus subsp. aureus MW2
acguuuccaaucca

SEQ ID NO: 2112568 - RNA, 18 nt, Staphylococcus aureus subsp. aureus MW2
acguuuccaauccauuaa

SEQ ID NO: 2112569 - RNA, 20 nt, Staphylococcus aureus subsp. aureus MW2
acguuauucguuaacaauca

SEQ ID NO: 2112570 - RNA, 18 nt, Staphylococcus aureus subsp. aureus MW2
acguuauucguuaacaau

SEQ ID NO: 2112571 - RNA, 13 nt, Staphylococcus aureus subsp. aureus MW2
acguuauuuucaa

SEQ ID NO: 2112572 - RNA, 14 nt, Staphylococcus aureus subsp. aureus MW2
acuacuuaauuaau

SEQ ID NO: 2112573 - RNA, 15 nt, Staphylococcus aureus subsp. aureus MW2
acuacuuaauuaaua

SEQ ID NO: 2112574 - RNA, 16 nt, Staphylococcus aureus subsp. aureus MW2
acuacugucaauauaa

SEQ ID NO: 2112575 - RNA, 14 nt, Staphylococcus aureus subsp. aureus MW2
acuaguguauacaa

SEQ ID NO: 2112576 - RNA, 14 nt, Staphylococcus aureus subsp. aureus MW2
acuaguuuggagaa

SEQ ID NO: 2112577 - RNA, 23 nt, Staphylococcus aureus subsp. aureus MW2
acuaguuuggagaauuuauugac

SEQ ID NO: 2112578 - RNA, 13 nt, Staphylococcus aureus subsp. aureus MW2
acuagaauaacuu

SEQ ID NO: 2112579 - RNA, 17 nt, Staphylococcus aureus subsp. aureus MW2
acuacgcauuuuaaaua

SEQ ID NO: 2112580 - RNA, 16 nt, Staphylococcus aureus subsp. aureus MW2
acuaccuguuggcuuu

SEQ ID NO: 2112581 - RNA, 20 nt, Staphylococcus aureus subsp. aureus MW2
acuaccuacuuguucaauac

SEQ ID NO: 2112582 - RNA, 19 nt, Staphylococcus aureus subsp. aureus MW2
acuaaugucgcacuauaaa

SEQ ID NO: 2112583 - RNA, 23 nt, Staphylococcus aureus subsp. aureus MW2
acuaauggauaugauaaccaaac

SEQ ID NO: 2112584 - RNA, 15 nt, Staphylococcus aureus subsp. aureus MW2
acuaauguuaaaaua

SEQ ID NO: 2112585 - RNA, 13 nt, Staphylococcus aureus subsp. aureus MW2
acuaaaucaaauu

SEQ ID NO: 2112586 - RNA, 20 nt, Staphylococcus aureus subsp. aureus MW2
acuaaugauaguacauuuau

SEQ ID NO: 2112587 - RNA, 16 nt, Staphylococcus aureus subsp. aureus MW2
acuaaaggaauuucaa

SEQ ID NO: 2112588 - RNA, 17 nt, Staphylococcus aureus subsp. aureus MW2
acuaaaggaauuucaaa

SEQ ID NO: 2112589 - RNA, 18 nt, Staphylococcus aureus subsp. aureus MW2
acuaaagguauucuauuu

SEQ ID NO: 2112590 - RNA, 17 nt, Staphylococcus aureus subsp. aureus MW2
acuaaaguaaauaacac

SEQ ID NO: 2112591 - RNA, 11 nt, Staphylococcus aureus subsp. aureus MW2
acuaaaucaaa

SEQ ID NO: 2112592 - RNA, 13 nt, Staphylococcus aureus subsp. aureus MW2
acuaucaauauaa

SEQ ID NO: 2112593 - RNA, 19 nt, Staphylococcus aureus subsp. aureus MW2
acuauaaaauucaccaacu

SEQ ID NO: 2112594 - RNA, 17 nt, Staphylococcus aureus subsp. aureus MW2
acuauaaaauucaccaa

SEQ ID NO: 2112595 - RNA, 13 nt, Staphylococcus aureus subsp. aureus MW2
acuauaaauaaaa

SEQ ID NO: 2112596 - RNA, 14 nt, Staphylococcus aureus subsp. aureus MW2
acuaguuuguaaua

SEQ ID NO: 2112597 - RNA, 13 nt, Staphylococcus aureus subsp. aureus MW2
acuauuaaaggaa

SEQ ID NO: 2112598 - RNA, 15 nt, Staphylococcus aureus subsp. aureus MW2
acuauuaaaggaaau

SEQ ID NO: 2112599 - RNA, 15 nt, Staphylococcus aureus subsp. aureus MW2
acuauguuguuuaaa

SEQ ID NO: 2112600 - RNA, 16 nt, Staphylococcus aureus subsp. aureus MW2
acuauguucaauuuau

SEQ ID NO: 2112601 - RNA, 16 nt, Staphylococcus aureus subsp. aureus MW2
acuauuuguuguuaua

SEQ ID NO: 2112602 - RNA, 19 nt, Staphylococcus aureus subsp. aureus MW2
acuauuuuagcucuuguuc

SEQ ID NO: 2112603 - RNA, 22 nt, Staphylococcus aureus subsp. aureus MW2
acuauuuaaucuuaauauuuau

SEQ ID NO: 2112604 - RNA, 17 nt, Staphylococcus aureus subsp. aureus MW2
acuauuuaauuauuccu

SEQ ID NO: 2112605 - RNA, 17 nt, Staphylococcus aureus subsp. aureus MW2
acucaaagauauacuua

SEQ ID NO: 2112606 - RNA, 14 nt, Staphylococcus aureus subsp. aureus MW2
acucaaaauguuua

SEQ ID NO: 2112607 - RNA, 20 nt, Staphylococcus aureus subsp. aureus MW2
acucaaaauguuuaacaaua

SEQ ID NO: 2112608 - RNA, 23 nt, Staphylococcus aureus subsp. aureus MW2
acucaaaauguuuaacaauaaua

SEQ ID NO: 2112609 - RNA, 19 nt, Staphylococcus aureus subsp. aureus MW2
acucaaacaauaaagccau

SEQ ID NO: 2112610 - RNA, 17 nt, Staphylococcus aureus subsp. aureus MW2
acggcacauucauaccg

SEQ ID NO: 2112611 - RNA, 16 nt, Staphylococcus aureus subsp. aureus MW2
acgcuuauacuauaua

SEQ ID NO: 2112612 - RNA, 19 nt, Staphylococcus aureus subsp. aureus MW2
acgcuuauacuauauaaua

SEQ ID NO: 2112613 - RNA, 17 nt, Staphylococcus aureus subsp. aureus MW2
acgcuuacuuauauuuu

SEQ ID NO: 2112614 - RNA, 18 nt, Staphylococcus aureus subsp. aureus MW2
acgcuuacuuauauuuua

SEQ ID NO: 2112615 - RNA, 23 nt, Staphylococcus aureus subsp. aureus MW2
acgcuuuuucuucuacauauaca

SEQ ID NO: 2112616 - RNA, 15 nt, Staphylococcus aureus subsp. aureus MW2
acgcuuuuuaaaaaa

SEQ ID NO: 2112617 - RNA, 14 nt, Staphylococcus aureus subsp. aureus MW2
acggaauaacuuuu

SEQ ID NO: 2112618 - RNA, 16 nt, Staphylococcus aureus subsp. aureus MW2
acggaacuacuacauu

SEQ ID NO: 2112619 - RNA, 17 nt, Staphylococcus aureus subsp. aureus MW2
acgcaauacgaauaucu

SEQ ID NO: 2112620 - RNA, 17 nt, Staphylococcus aureus subsp. aureus MW2
acgcaauuuaauauuau

SEQ ID NO: 2112621 - RNA, 22 nt, Staphylococcus aureus subsp. aureus MW2
acgcaauuaaccuugauuuaau

SEQ ID NO: 2112622 - RNA, 13 nt, Staphylococcus aureus subsp. aureus MW2
acgguauuuucaa

SEQ ID NO: 2112623 - RNA, 12 nt, Staphylococcus aureus subsp. aureus MW2
acgguacagaua

SEQ ID NO: 2112624 - RNA, 16 nt, Staphylococcus aureus subsp. aureus MW2
acggggcuuuuugugu

SEQ ID NO: 2112625 - RNA, 20 nt, Staphylococcus aureus subsp. aureus MW2
acggggugcuuuuuauguua

SEQ ID NO: 2112626 - RNA, 13 nt, Staphylococcus aureus subsp. aureus MW2
acgguuugaaaaa

SEQ ID NO: 2112627 - RNA, 22 nt, Staphylococcus aureus subsp. aureus MW2
aggucaucugaugaggcaauau

SEQ ID NO: 2112628 - RNA, 17 nt, Staphylococcus aureus subsp. aureus MW2
aggucuauguacaauca

SEQ ID NO: 2112629 - RNA, 19 nt, Staphylococcus aureus subsp. aureus MW2
aggugcaguuaaauuaaac

SEQ ID NO: 2112630 - RNA, 20 nt, Staphylococcus aureus subsp. aureus MW2
aggugauuauauauauuaaa

SEQ ID NO: 2112631 - RNA, 15 nt, Staphylococcus aureus subsp. aureus MW2
aggugauuauauaua

SEQ ID NO: 2112632 - RNA, 16 nt, Staphylococcus aureus subsp. aureus MW2
aggugauugaacaaua

SEQ ID NO: 2112633 - RNA, 17 nt, Staphylococcus aureus subsp. aureus MW2
aggugauugaacaauaa

SEQ ID NO: 2112634 - RNA, 21 nt, Staphylococcus aureus subsp. aureus MW2
agguggagauuuaacaauaua

SEQ ID NO: 2112635 - RNA, 18 nt, Staphylococcus aureus subsp. aureus MW2
aggugcuuguaaaauuuu

SEQ ID NO: 2112636 - RNA, 13 nt, Staphylococcus aureus subsp. aureus MW2
agguaauacuuuu

SEQ ID NO: 2112637 - RNA, 17 nt, Staphylococcus aureus subsp. aureus MW2
agguaauuuaacauuuu

SEQ ID NO: 2112638 - RNA, 21 nt, Staphylococcus aureus subsp. aureus MW2
agguauaggugcaguuaaauu

SEQ ID NO: 2112639 - RNA, 23 nt, Staphylococcus aureus subsp. aureus MW2
aggguuugccagucauuguauaa

SEQ ID NO: 2112640 - RNA, 15 nt, Staphylococcus aureus subsp. aureus MW2
agguaaaaauuaaca

SEQ ID NO: 2112641 - RNA, 23 nt, Staphylococcus aureus subsp. aureus MW2
agguaacugcuuuggaguuucuu

SEQ ID NO: 2112642 - RNA, 13 nt, Staphylococcus aureus subsp. aureus MW2
agguaacugcuuu

SEQ ID NO: 2112643 - RNA, 15 nt, Staphylococcus aureus subsp. aureus MW2
agguaacuaaaaugu

SEQ ID NO: 2112644 - RNA, 18 nt, Staphylococcus aureus subsp. aureus MW2
agguaaauuuaaaauaau

SEQ ID NO: 2112645 - RNA, 23 nt, Staphylococcus aureus subsp. aureus MW2
agguaaaucuguuuaaauuuaaa

SEQ ID NO: 2112646 - RNA, 13 nt, Staphylococcus aureus subsp. aureus MW2
agguaaauuuaaa

SEQ ID NO: 2112647 - RNA, 19 nt, Staphylococcus aureus subsp. aureus MW2
agguaaaucuguuuaaauu

SEQ ID NO: 2112648 - RNA, 20 nt, Staphylococcus aureus subsp. aureus MW2
agggucgugacggaaucuug

SEQ ID NO: 2112649 - RNA, 18 nt, Staphylococcus aureus subsp. aureus MW2
agguuucacaaauucuuu

SEQ ID NO: 2112650 - RNA, 23 nt, Staphylococcus aureus subsp. aureus MW2
agguuguuuuucaucauuaaaau

SEQ ID NO: 2112651 - RNA, 21 nt, Staphylococcus aureus subsp. aureus MW2
agguuguuuuucaucauuaaa

SEQ ID NO: 2112652 - RNA, 16 nt, Staphylococcus aureus subsp. aureus MW2
agguuuguaagacaac

SEQ ID NO: 2112653 - RNA, 22 nt, Staphylococcus aureus subsp. aureus MW2
aguaaaccgaggugucaauaaa

SEQ ID NO: 2112654 - RNA, 14 nt, Staphylococcus aureus subsp. aureus MW2
aguaaauaauuuaa

SEQ ID NO: 2112655 - RNA, 15 nt, Staphylococcus aureus subsp. aureus MW2
aguaaauaauuuaaa

SEQ ID NO: 2112656 - RNA, 19 nt, Staphylococcus aureus subsp. aureus MW2
aguaaauaauuuaaauuaa

SEQ ID NO: 2112657 - RNA, 22 nt, Staphylococcus aureus subsp. aureus MW2
aguaaaccuacuaauauauuaa

SEQ ID NO: 2112658 - RNA, 19 nt, Staphylococcus aureus subsp. aureus MW2
aggugugguguaaagauca

SEQ ID NO: 2112659 - RNA, 14 nt, Staphylococcus aureus subsp. aureus MW2
agguguaaaaugug

SEQ ID NO: 2112660 - RNA, 13 nt, Staphylococcus aureus subsp. aureus MW2
agguuaauuaaac

SEQ ID NO: 2112661 - RNA, 17 nt, Staphylococcus aureus subsp. aureus MW2
agguuagaauuauguug

SEQ ID NO: 2112662 - RNA, 16 nt, Staphylococcus aureus subsp. aureus MW2
agguuauauuuaaaug

SEQ ID NO: 2112663 - RNA, 20 nt, Staphylococcus aureus subsp. aureus MW2
agguuauauuuaaaugcuuu

SEQ ID NO: 2112664 - RNA, 18 nt, Staphylococcus aureus subsp. aureus MW2
agguucaucuuuaugcaa

SEQ ID NO: 2112665 - RNA, 16 nt, Staphylococcus aureus subsp. aureus MW2
agguucaucuuuaugc

SEQ ID NO: 2112666 - RNA, 19 nt, Staphylococcus aureus subsp. aureus MW2
aguaaucagcuuuuucaca

SEQ ID NO: 2112667 - RNA, 22 nt, Staphylococcus aureus subsp. aureus MW2
aguaauauguugcuuaucaaca

SEQ ID NO: 2112668 - RNA, 22 nt, Staphylococcus aureus subsp. aureus MW2
aguaaucuuguuuucauuuaaa

SEQ ID NO: 2112669 - RNA, 14 nt, Staphylococcus aureus subsp. aureus MW2
aguaaugaagcuuc

SEQ ID NO: 2112670 - RNA, 20 nt, Staphylococcus aureus subsp. aureus MW2
aguaauuuuuaaacaaaaau

SEQ ID NO: 2112671 - RNA, 22 nt, Staphylococcus aureus subsp. aureus MW2
aguaauuuaauagguucuucuu

SEQ ID NO: 2112672 - RNA, 19 nt, Staphylococcus aureus subsp. aureus MW2
aguaauucuucaucuucuu

SEQ ID NO: 2112673 - RNA, 19 nt, Staphylococcus aureus subsp. aureus MW2
aguaauucuuuaccauuca

SEQ ID NO: 2112674 - RNA, 22 nt, Staphylococcus aureus subsp. aureus MW2
aguacaacaguugcaccuaaac

SEQ ID NO: 2112675 - RNA, 13 nt, Staphylococcus aureus subsp. aureus MW2
aguacaaauaaua

SEQ ID NO: 2112676 - RNA, 15 nt, Staphylococcus aureus subsp. aureus MW2
aguacaacaguugca

SEQ ID NO: 2112677 - RNA, 15 nt, Staphylococcus aureus subsp. aureus MW2
aguacaaauaacaaa

SEQ ID NO: 2112678 - RNA, 21 nt, Staphylococcus aureus subsp. aureus MW2
aguacaaauaacaaacauuaa

SEQ ID NO: 2112679 - RNA, 12 nt, Staphylococcus aureus subsp. aureus MW2
aguacaaauaau

SEQ ID NO: 2112680 - RNA, 12 nt, Staphylococcus aureus subsp. aureus MW2
aguacaauaaua

SEQ ID NO: 2112681 - RNA, 21 nt, Staphylococcus aureus subsp. aureus MW2
aguacaauaauaccuucaauu

SEQ ID NO: 2112682 - RNA, 16 nt, Staphylococcus aureus subsp. aureus MW2
aguacagcgguuugua

SEQ ID NO: 2112683 - RNA, 22 nt, Staphylococcus aureus subsp. aureus MW2
aguacagcgguuuguaugauaa

SEQ ID NO: 2112684 - RNA, 19 nt, Staphylococcus aureus subsp. aureus MW2
aguaccauguuuuuuaagu

SEQ ID NO: 2112685 - RNA, 16 nt, Staphylococcus aureus subsp. aureus MW2
aguaauaauuuauuga

SEQ ID NO: 2112686 - RNA, 18 nt, Staphylococcus aureus subsp. aureus MW2
aguaauaauauaaauaaa

SEQ ID NO: 2112687 - RNA, 23 nt, Staphylococcus aureus subsp. aureus MW2
aguaauaauggcaauuaaaacua

SEQ ID NO: 2112688 - RNA, 16 nt, Staphylococcus aureus subsp. aureus MW2
aguaauauauaaaagu

SEQ ID NO: 2112689 - RNA, 13 nt, Staphylococcus aureus subsp. aureus MW2
aguaauaauauaa

SEQ ID NO: 2112690 - RNA, 21 nt, Staphylococcus aureus subsp. aureus MW2
aguaauaauggcaauuaaaac

SEQ ID NO: 2112691 - RNA, 17 nt, Staphylococcus aureus subsp. aureus MW2
aguaaguacgaggacca

SEQ ID NO: 2112692 - RNA, 20 nt, Staphylococcus aureus subsp. aureus MW2
aguaaguagaagcaaaagau

SEQ ID NO: 2112693 - RNA, 18 nt, Staphylococcus aureus subsp. aureus MW2
aguaaguuguacuucuuu

SEQ ID NO: 2112694 - RNA, 22 nt, Staphylococcus aureus subsp. aureus MW2
aguaaguuguacuucuuugguc

SEQ ID NO: 2112695 - RNA, 17 nt, Staphylococcus aureus subsp. aureus MW2
aguaagaugauuucaaa

SEQ ID NO: 2112696 - RNA, 23 nt, Staphylococcus aureus subsp. aureus MW2
aguaagaugauuucaaaugugaa

SEQ ID NO: 2112697 - RNA, 19 nt, Staphylococcus aureus subsp. aureus MW2
aguaagauuaccuacaaua

SEQ ID NO: 2112698 - RNA, 17 nt, Staphylococcus aureus subsp. aureus MW2
aguaagauuauuuucaa

SEQ ID NO: 2112699 - RNA, 19 nt, Staphylococcus aureus subsp. aureus MW2
aguaagauuauuuucaauu

SEQ ID NO: 2112700 - RNA, 18 nt, Staphylococcus aureus subsp. aureus MW2
aguaagcguaauauuuaa

SEQ ID NO: 2112701 - RNA, 23 nt, Staphylococcus aureus subsp. aureus MW2
aguaacauguaaugaaucaaauc

SEQ ID NO: 2112702 - RNA, 13 nt, Staphylococcus aureus subsp. aureus MW2
aguaaauuuauua

SEQ ID NO: 2112703 - RNA, 11 nt, Staphylococcus aureus subsp. aureus MW2
aguaaaucaaa

SEQ ID NO: 2112704 - RNA, 12 nt, Staphylococcus aureus subsp. aureus MW2
aggcuagauaau

SEQ ID NO: 2112705 - RNA, 15 nt, Staphylococcus aureus subsp. aureus MW2
agggccccaacacag

SEQ ID NO: 2112706 - RNA, 21 nt, Staphylococcus aureus subsp. aureus MW2
agggcggucaauuuuaccaug

SEQ ID NO: 2112707 - RNA, 17 nt, Staphylococcus aureus subsp. aureus MW2
aggggccccaacacaga

SEQ ID NO: 2112708 - RNA, 20 nt, Staphylococcus aureus subsp. aureus MW2
aggggcuucuuucuaaaaua

SEQ ID NO: 2112709 - RNA, 21 nt, Staphylococcus aureus subsp. aureus MW2
aggggcuucuuucuaaaauaa

SEQ ID NO: 2112710 - RNA, 16 nt, Staphylococcus aureus subsp. aureus MW2
agggggcuucuuuguu

SEQ ID NO: 2112711 - RNA, 21 nt, Staphylococcus aureus subsp. aureus MW2
agggcuguuuuuuaaugcuuu

SEQ ID NO: 2112712 - RNA, 19 nt, Staphylococcus aureus subsp. aureus MW2
aggcuuaaauauaaugauc

SEQ ID NO: 2112713 - RNA, 15 nt, Staphylococcus aureus subsp. aureus MW2
aggcuuauuaacuuu

SEQ ID NO: 2112714 - RNA, 13 nt, Staphylococcus aureus subsp. aureus MW2
aggcuuuaaaauu

SEQ ID NO: 2112715 - RNA, 19 nt, Staphylococcus aureus subsp. aureus MW2
aggcuuuaaaauuuuuugg

SEQ ID NO: 2112716 - RNA, 13 nt, Staphylococcus aureus subsp. aureus MW2
agggcaaaaaagg

SEQ ID NO: 2112717 - RNA, 15 nt, Staphylococcus aureus subsp. aureus MW2
agggacgucaucaug

SEQ ID NO: 2112718 - RNA, 22 nt, Staphylococcus aureus subsp. aureus MW2
agcuauucauagaccuaugaau

SEQ ID NO: 2112719 - RNA, 19 nt, Staphylococcus aureus subsp. aureus MW2
agcuaugcuuuuuuuacaa

SEQ ID NO: 2112720 - RNA, 22 nt, Staphylococcus aureus subsp. aureus MW2
agcuaugcuuuuuuuacaauau

SEQ ID NO: 2112721 - RNA, 13 nt, Staphylococcus aureus subsp. aureus MW2
agcuaugaacgaa

SEQ ID NO: 2112722 - RNA, 15 nt, Staphylococcus aureus subsp. aureus MW2
agcuaucguaaacaa

SEQ ID NO: 2112723 - RNA, 22 nt, Staphylococcus aureus subsp. aureus MW2
agcuaugauuugauauuucaaa

SEQ ID NO: 2112724 - RNA, 22 nt, Staphylococcus aureus subsp. aureus MW2
agcuaauuucuaauacauacug

SEQ ID NO: 2112725 - RNA, 13 nt, Staphylococcus aureus subsp. aureus MW2
agcuaucaacgau

SEQ ID NO: 2112726 - RNA, 16 nt, Staphylococcus aureus subsp. aureus MW2
agcuauuuaaaauuau

SEQ ID NO: 2112727 - RNA, 17 nt, Staphylococcus aureus subsp. aureus MW2
agcuaaguauauaagca

SEQ ID NO: 2112728 - RNA, 22 nt, Staphylococcus aureus subsp. aureus MW2
agcuaaguauauaagcaaagac

SEQ ID NO: 2112729 - RNA, 13 nt, Staphylococcus aureus subsp. aureus MW2
agcuaaugcaagc

SEQ ID NO: 2112730 - RNA, 19 nt, Staphylococcus aureus subsp. aureus MW2
agcuaauaucaauaaugcu

SEQ ID NO: 2112731 - RNA, 15 nt, Staphylococcus aureus subsp. aureus MW2
agcuaaccacaucau

SEQ ID NO: 2112732 - RNA, 13 nt, Staphylococcus aureus subsp. aureus MW2
agcuaaccaaaua

SEQ ID NO: 2112733 - RNA, 18 nt, Staphylococcus aureus subsp. aureus MW2
agcguaauggauuauuau

SEQ ID NO: 2112734 - RNA, 18 nt, Staphylococcus aureus subsp. aureus MW2
agcggacugaaagaaaag

SEQ ID NO: 2112735 - RNA, 16 nt, Staphylococcus aureus subsp. aureus MW2
agcucuuuuuugauuu

SEQ ID NO: 2112736 - RNA, 17 nt, Staphylococcus aureus subsp. aureus MW2
agcugugauuugaucaa

SEQ ID NO: 2112737 - RNA, 16 nt, Staphylococcus aureus subsp. aureus MW2
agcugucauaccuuuu

SEQ ID NO: 2112738 - RNA, 21 nt, Staphylococcus aureus subsp. aureus MW2
agcugcuucucuuugaacgaa

SEQ ID NO: 2112739 - RNA, 21 nt, Staphylococcus aureus subsp. aureus MW2
agcugcuucucuuugaacgag

SEQ ID NO: 2112740 - RNA, 19 nt, Staphylococcus aureus subsp. aureus MW2
agcuuaauaaauuguauga

SEQ ID NO: 2112741 - RNA, 20 nt, Staphylococcus aureus subsp. aureus MW2
agcuuaaugcaucuaugacu

SEQ ID NO: 2112742 - RNA, 23 nt, Staphylococcus aureus subsp. aureus MW2
agcuucaacacgacguucuucaa

SEQ ID NO: 2112743 - RNA, 22 nt, Staphylococcus aureus subsp. aureus MW2
agcuuauuaagcuugaaacaag

SEQ ID NO: 2112744 - RNA, 20 nt, Staphylococcus aureus subsp. aureus MW2
agcuucuauguuggggcccc

SEQ ID NO: 2112745 - RNA, 18 nt, Staphylococcus aureus subsp. aureus MW2
agcuugaauaauauauuu

SEQ ID NO: 2112746 - RNA, 18 nt, Staphylococcus aureus subsp. aureus MW2
agcuugaccgccuaugau

SEQ ID NO: 2112747 - RNA, 15 nt, Staphylococcus aureus subsp. aureus MW2
agcuugaauaauaua

SEQ ID NO: 2112748 - RNA, 20 nt, Staphylococcus aureus subsp. aureus MW2
agcuucuuuguuggggcccc

SEQ ID NO: 2112749 - RNA, 22 nt, Staphylococcus aureus subsp. aureus MW2
agcuucuuuguuggggccccgc

SEQ ID NO: 2112750 - RNA, 20 nt, Staphylococcus aureus subsp. aureus MW2
agcuuugcugcuuuuccauu

SEQ ID NO: 2112751 - RNA, 18 nt, Staphylococcus aureus subsp. aureus MW2
agcuuugcucauagauga

SEQ ID NO: 2112752 - RNA, 17 nt, Staphylococcus aureus subsp. aureus MW2
agcuuuuacgccuucuu

SEQ ID NO: 2112753 - RNA, 13 nt, Staphylococcus aureus subsp. aureus MW2
agcuuucuaucuu

SEQ ID NO: 2112754 - RNA, 20 nt, Staphylococcus aureus subsp. aureus MW2
agcuuucgggcuaguuuuuu

SEQ ID NO: 2112755 - RNA, 13 nt, Staphylococcus aureus subsp. aureus MW2
agcuuuuguaaag

SEQ ID NO: 2112756 - RNA, 12 nt, Staphylococcus aureus subsp. aureus MW2
agcuuuucuuca

SEQ ID NO: 2112757 - RNA, 15 nt, Staphylococcus aureus subsp. aureus MW2
agcuuuucauuuuua

SEQ ID NO: 2112758 - RNA, 17 nt, Staphylococcus aureus subsp. aureus MW2
agcuuuguuagcaucug

SEQ ID NO: 2112759 - RNA, 20 nt, Staphylococcus aureus subsp. aureus MW2
agcuuuguuagcaucugcau

SEQ ID NO: 2112760 - RNA, 19 nt, Staphylococcus aureus subsp. aureus MW2
agcuugggacagaaaacaa

SEQ ID NO: 2112761 - RNA, 12 nt, Staphylococcus aureus subsp. aureus MW2
agcuuguaauca

SEQ ID NO: 2112762 - RNA, 15 nt, Staphylococcus aureus subsp. aureus MW2
agcuugauuuaacaa

SEQ ID NO: 2112763 - RNA, 14 nt, Staphylococcus aureus subsp. aureus MW2
aggacacauaaaug

SEQ ID NO: 2112764 - RNA, 16 nt, Staphylococcus aureus subsp. aureus MW2
aggauaagaacgagaa

SEQ ID NO: 2112765 - RNA, 19 nt, Staphylococcus aureus subsp. aureus MW2
aggauacauaaaucuaaua

SEQ ID NO: 2112766 - RNA, 23 nt, Staphylococcus aureus subsp. aureus MW2
aggauauuuauucuaaguuaaaa

SEQ ID NO: 2112767 - RNA, 15 nt, Staphylococcus aureus subsp. aureus MW2
aggauaucuacgccu

SEQ ID NO: 2112768 - RNA, 22 nt, Staphylococcus aureus subsp. aureus MW2
aggaucacguuuuucuuuaaac

SEQ ID NO: 2112769 - RNA, 23 nt, Staphylococcus aureus subsp. aureus MW2
aggauccaauuuauaaugauuaa

SEQ ID NO: 2112770 - RNA, 22 nt, Staphylococcus aureus subsp. aureus MW2
aggagcgagccauuauuauuuu

SEQ ID NO: 2112771 - RNA, 14 nt, Staphylococcus aureus subsp. aureus MW2
aggaaaauaaaaac

SEQ ID NO: 2112772 - RNA, 16 nt, Staphylococcus aureus subsp. aureus MW2
aggaaagccauuaaac

SEQ ID NO: 2112773 - RNA, 13 nt, Staphylococcus aureus subsp. aureus MW2
aggaaacuuaaau

SEQ ID NO: 2112774 - RNA, 17 nt, Staphylococcus aureus subsp. aureus MW2
aggaauaucuuucaaau

SEQ ID NO: 2112775 - RNA, 21 nt, Staphylococcus aureus subsp. aureus MW2
aggaauauuucccuaugaaau

SEQ ID NO: 2112776 - RNA, 20 nt, Staphylococcus aureus subsp. aureus MW2
aggaauguauuuuucauauu

SEQ ID NO: 2112777 - RNA, 20 nt, Staphylococcus aureus subsp. aureus MW2
aggaauucuacagaaguggu

SEQ ID NO: 2112778 - RNA, 22 nt, Staphylococcus aureus subsp. aureus MW2
aggaauucuacagaaguggugc

SEQ ID NO: 2112779 - RNA, 12 nt, Staphylococcus aureus subsp. aureus MW2
aggaauuucaaa

SEQ ID NO: 2112780 - RNA, 21 nt, Staphylococcus aureus subsp. aureus MW2
aggaauaauuuuaaaaauaaa

SEQ ID NO: 2112781 - RNA, 19 nt, Staphylococcus aureus subsp. aureus MW2
aggccauuuuuauuuaaca

SEQ ID NO: 2112782 - RNA, 23 nt, Staphylococcus aureus subsp. aureus MW2
aggcauaauuugugguaugacug

SEQ ID NO: 2112783 - RNA, 17 nt, Staphylococcus aureus subsp. aureus MW2
aggcaggaaugauauac

SEQ ID NO: 2112784 - RNA, 18 nt, Staphylococcus aureus subsp. aureus MW2
aggaugaguuuaaaaaua

SEQ ID NO: 2112785 - RNA, 14 nt, Staphylococcus aureus subsp. aureus MW2
aggaugaguuuaaa

SEQ ID NO: 2112786 - RNA, 23 nt, Staphylococcus aureus subsp. aureus MW2
aggauucgauugguuuaaaaagu

SEQ ID NO: 2112787 - RNA, 17 nt, Staphylococcus aureus subsp. aureus MW2
aggcaaugcaaguuggg

SEQ ID NO: 2112788 - RNA, 15 nt, Staphylococcus aureus subsp. aureus MW2
aggcaauauuaaaau

SEQ ID NO: 2112789 - RNA, 17 nt, Staphylococcus aureus subsp. aureus MW2
aggcaaucuugaacaau

SEQ ID NO: 2112790 - RNA, 12 nt, Staphylococcus aureus subsp. aureus MW2
aggcaaugcaag

SEQ ID NO: 2112791 - RNA, 18 nt, Staphylococcus aureus subsp. aureus MW2
auaagccuuuucaaacau

SEQ ID NO: 2112792 - RNA, 15 nt, Staphylococcus aureus subsp. aureus MW2
auaagauugcuuuuu

SEQ ID NO: 2112793 - RNA, 18 nt, Staphylococcus aureus subsp. aureus MW2
auaagcaugauaaaaaua

SEQ ID NO: 2112794 - RNA, 17 nt, Staphylococcus aureus subsp. aureus MW2
auaagaaucaucuaaau

SEQ ID NO: 2112795 - RNA, 16 nt, Staphylococcus aureus subsp. aureus MW2
auaagaagugcuuaug

SEQ ID NO: 2112796 - RNA, 15 nt, Staphylococcus aureus subsp. aureus MW2
auaagaauuguugau

SEQ ID NO: 2112797 - RNA, 12 nt, Staphylococcus aureus subsp. aureus MW2
auaagaauguga

SEQ ID NO: 2112798 - RNA, 10 nt, Staphylococcus aureus subsp. aureus MW2
auaagaauuu

SEQ ID NO: 2112799 - RNA, 15 nt, Staphylococcus aureus subsp. aureus MW2
auaagaauuuaaaag

SEQ ID NO: 2112800 - RNA, 13 nt, Staphylococcus aureus subsp. aureus MW2
auaagacaauagu

SEQ ID NO: 2112801 - RNA, 15 nt, Staphylococcus aureus subsp. aureus MW2
auaagacaauaguau

SEQ ID NO: 2112802 - RNA, 16 nt, Staphylococcus aureus subsp. aureus MW2
auaagaugcaugccaa

SEQ ID NO: 2112803 - RNA, 20 nt, Staphylococcus aureus subsp. aureus MW2
auaagaugcaugccaauuaa

SEQ ID NO: 2112804 - RNA, 21 nt, Staphylococcus aureus subsp. aureus MW2
auaagauaauuuuuaacauca

SEQ ID NO: 2112805 - RNA, 19 nt, Staphylococcus aureus subsp. aureus MW2
auaagacuucccuauaugu

SEQ ID NO: 2112806 - RNA, 15 nt, Staphylococcus aureus subsp. aureus MW2
auaagauuuugcuuu

SEQ ID NO: 2112807 - RNA, 22 nt, Staphylococcus aureus subsp. aureus MW2
auaagauuuugcuuuaaacauu

SEQ ID NO: 2112808 - RNA, 18 nt, Staphylococcus aureus subsp. aureus MW2
auaagcaaucauaauacu

SEQ ID NO: 2112809 - RNA, 12 nt, Staphylococcus aureus subsp. aureus MW2
auaagcaaagac

SEQ ID NO: 2112810 - RNA, 14 nt, Staphylococcus aureus subsp. aureus MW2
auaaggacucuguu

SEQ ID NO: 2112811 - RNA, 15 nt, Staphylococcus aureus subsp. aureus MW2
auaaggauaucugaa

SEQ ID NO: 2112812 - RNA, 18 nt, Staphylococcus aureus subsp. aureus MW2
auaaggaauguauuuuuc

SEQ ID NO: 2112813 - RNA, 20 nt, Staphylococcus aureus subsp. aureus MW2
auaagguagcguagcauuau

SEQ ID NO: 2112814 - RNA, 21 nt, Staphylococcus aureus subsp. aureus MW2
auaaggaugucgauuugauuu

SEQ ID NO: 2112815 - RNA, 15 nt, Staphylococcus aureus subsp. aureus MW2
auaaggcuauuccua

SEQ ID NO: 2112816 - RNA, 18 nt, Staphylococcus aureus subsp. aureus MW2
auaaguacaaauaauaca

SEQ ID NO: 2112817 - RNA, 22 nt, Staphylococcus aureus subsp. aureus MW2
auaaguagcucaaaacaauuua

SEQ ID NO: 2112818 - RNA, 20 nt, Staphylococcus aureus subsp. aureus MW2
auaaguauggucgugagccc

SEQ ID NO: 2112819 - RNA, 13 nt, Staphylococcus aureus subsp. aureus MW2
auaaguaguucaa

SEQ ID NO: 2112820 - RNA, 18 nt, Staphylococcus aureus subsp. aureus MW2
auaaguaguucaauaaau

SEQ ID NO: 2112821 - RNA, 17 nt, Staphylococcus aureus subsp. aureus MW2
auaaguaauaauuuauu

SEQ ID NO: 2112822 - RNA, 21 nt, Staphylococcus aureus subsp. aureus MW2
auaaguaagcguaauauuuaa

SEQ ID NO: 2112823 - RNA, 14 nt, Staphylococcus aureus subsp. aureus MW2
auaaguacaaauaa

SEQ ID NO: 2112824 - RNA, 17 nt, Staphylococcus aureus subsp. aureus MW2
auaaguuacuagcauua

SEQ ID NO: 2112825 - RNA, 17 nt, Staphylococcus aureus subsp. aureus MW2
auaagucuauuauguac

SEQ ID NO: 2112826 - RNA, 13 nt, Staphylococcus aureus subsp. aureus MW2
auaagugauaaau

SEQ ID NO: 2112827 - RNA, 16 nt, Staphylococcus aureus subsp. aureus MW2
auaaguguuguuuuau

SEQ ID NO: 2112828 - RNA, 17 nt, Staphylococcus aureus subsp. aureus MW2
auaaguugcauauaaaa

SEQ ID NO: 2112829 - RNA, 18 nt, Staphylococcus aureus subsp. aureus MW2
auaaguuuguuuguaaaa

SEQ ID NO: 2112830 - RNA, 14 nt, Staphylococcus aureus subsp. aureus MW2
auaauaaaaaggag

SEQ ID NO: 2112831 - RNA, 20 nt, Staphylococcus aureus subsp. aureus MW2
auaauaaaacuugugauaua

SEQ ID NO: 2112832 - RNA, 12 nt, Staphylococcus aureus subsp. aureus MW2
auaauaaaauag

SEQ ID NO: 2112833 - RNA, 12 nt, Staphylococcus aureus subsp. aureus MW2
auaauaaagauu

SEQ ID NO: 2112834 - RNA, 19 nt, Staphylococcus aureus subsp. aureus MW2
auaaucgguaauuacuugu

SEQ ID NO: 2112835 - RNA, 14 nt, Staphylococcus aureus subsp. aureus MW2
auaaucguuaaaac

SEQ ID NO: 2112836 - RNA, 16 nt, Staphylococcus aureus subsp. aureus MW2
auaaucuuuauuaaua

SEQ ID NO: 2112837 - RNA, 15 nt, Staphylococcus aureus subsp. aureus MW2
auaaucuuuauuaau

SEQ ID NO: 2112838 - RNA, 17 nt, Staphylococcus aureus subsp. aureus MW2
auaaugaauaaauaauu

SEQ ID NO: 2112839 - RNA, 13 nt, Staphylococcus aureus subsp. aureus MW2
auaaucacauuaa

SEQ ID NO: 2112840 - RNA, 15 nt, Staphylococcus aureus subsp. aureus MW2
auaaugacaaauuau

SEQ ID NO: 2112841 - RNA, 14 nt, Staphylococcus aureus subsp. aureus MW2
auaaugaauaguaa

SEQ ID NO: 2112842 - RNA, 11 nt, Staphylococcus aureus subsp. aureus MW2
auaaugcuuua

SEQ ID NO: 2112843 - RNA, 16 nt, Staphylococcus aureus subsp. aureus MW2
auaaugcuuauuaaaa

SEQ ID NO: 2112844 - RNA, 14 nt, Staphylococcus aureus subsp. aureus MW2
auaauggcaauuaa

SEQ ID NO: 2112845 - RNA, 15 nt, Staphylococcus aureus subsp. aureus MW2
auaauuaaauagcuu

SEQ ID NO: 2112846 - RNA, 16 nt, Staphylococcus aureus subsp. aureus MW2
auaauuaaauaaaaau

SEQ ID NO: 2112847 - RNA, 24 nt, Staphylococcus aureus subsp. aureus MW2
auaauuaaacuaauagcauuugua

SEQ ID NO: 2112848 - RNA, 22 nt, Staphylococcus aureus subsp. aureus MW2
auaauuaaacauuuagauuuca

SEQ ID NO: 2112849 - RNA, 12 nt, Staphylococcus aureus subsp. aureus MW2
auaauuaaacua

SEQ ID NO: 2112850 - RNA, 17 nt, Staphylococcus aureus subsp. aureus MW2
auaauuaaauaaaaaua

SEQ ID NO: 2112851 - RNA, 21 nt, Staphylococcus aureus subsp. aureus MW2
auaauuaaaauaagauauaua

SEQ ID NO: 2112852 - RNA, 23 nt, Staphylococcus aureus subsp. aureus MW2
auaauuaaacaaaacuuaaaaua

SEQ ID NO: 2112853 - RNA, 14 nt, Staphylococcus aureus subsp. aureus MW2
auaauaaauaggau

SEQ ID NO: 2112854 - RNA, 14 nt, Staphylococcus aureus subsp. aureus MW2
auaauaauacaauu

SEQ ID NO: 2112855 - RNA, 13 nt, Staphylococcus aureus subsp. aureus MW2
auaauaauauuga

SEQ ID NO: 2112856 - RNA, 15 nt, Staphylococcus aureus subsp. aureus MW2
auaauaauauugaaa

SEQ ID NO: 2112857 - RNA, 16 nt, Staphylococcus aureus subsp. aureus MW2
auaauaaccuacauua

SEQ ID NO: 2112858 - RNA, 11 nt, Staphylococcus aureus subsp. aureus MW2
auaauacacau

SEQ ID NO: 2112859 - RNA, 14 nt, Staphylococcus aureus subsp. aureus MW2
auaauacaauuuua

SEQ ID NO: 2112860 - RNA, 12 nt, Staphylococcus aureus subsp. aureus MW2
auaauacaugau

SEQ ID NO: 2112861 - RNA, 12 nt, Staphylococcus aureus subsp. aureus MW2
auaauaauccac

SEQ ID NO: 2112862 - RNA, 18 nt, Staphylococcus aureus subsp. aureus MW2
auaauaauccaccuaaaa

SEQ ID NO: 2112863 - RNA, 14 nt, Staphylococcus aureus subsp. aureus MW2
auaauaaucuuuaa

SEQ ID NO: 2112864 - RNA, 20 nt, Staphylococcus aureus subsp. aureus MW2
auaauaauucauaaaugcuu

SEQ ID NO: 2112865 - RNA, 16 nt, Staphylococcus aureus subsp. aureus MW2
auaauacuguauuuua

SEQ ID NO: 2112866 - RNA, 15 nt, Staphylococcus aureus subsp. aureus MW2
auaauacuguuuaaa

SEQ ID NO: 2112867 - RNA, 17 nt, Staphylococcus aureus subsp. aureus MW2
auaauacuguuuaaaua

SEQ ID NO: 2112868 - RNA, 13 nt, Staphylococcus aureus subsp. aureus MW2
auaauagaaauaa

SEQ ID NO: 2112869 - RNA, 22 nt, Staphylococcus aureus subsp. aureus MW2
auaauacgcaauugauauuuac

SEQ ID NO: 2112870 - RNA, 14 nt, Staphylococcus aureus subsp. aureus MW2
auaauauaaauaaa

SEQ ID NO: 2112871 - RNA, 17 nt, Staphylococcus aureus subsp. aureus MW2
auaauauaaaaacaaaa

SEQ ID NO: 2112872 - RNA, 13 nt, Staphylococcus aureus subsp. aureus MW2
auaauauaaaaac

SEQ ID NO: 2112873 - RNA, 22 nt, Staphylococcus aureus subsp. aureus MW2
auaauauauccugccaauauau

SEQ ID NO: 2112874 - RNA, 15 nt, Staphylococcus aureus subsp. aureus MW2
auaauauauuaaaaa

SEQ ID NO: 2112875 - RNA, 13 nt, Staphylococcus aureus subsp. aureus MW2
auaauauauuaac

SEQ ID NO: 2112876 - RNA, 16 nt, Staphylococcus aureus subsp. aureus MW2
auaauauauacaaaua

SEQ ID NO: 2112877 - RNA, 17 nt, Staphylococcus aureus subsp. aureus MW2
auaauauauacaaauaa

SEQ ID NO: 2112878 - RNA, 19 nt, Staphylococcus aureus subsp. aureus MW2
auaauauauacaaauaaac

SEQ ID NO: 2112879 - RNA, 22 nt, Staphylococcus aureus subsp. aureus MW2
auaauaucaccuuuuuuaagau

SEQ ID NO: 2112880 - RNA, 19 nt, Staphylococcus aureus subsp. aureus MW2
auaauaugccaaaguaaua

SEQ ID NO: 2112881 - RNA, 23 nt, Staphylococcus aureus subsp. aureus MW2
auaauauuaacgaguuuucagua

SEQ ID NO: 2112882 - RNA, 14 nt, Staphylococcus aureus subsp. aureus MW2
auaaucaacaugug

SEQ ID NO: 2112883 - RNA, 22 nt, Staphylococcus aureus subsp. aureus MW2
auaaucaagaauauaaaugauu

SEQ ID NO: 2112884 - RNA, 15 nt, Staphylococcus aureus subsp. aureus MW2
auaaucaagaauaua

SEQ ID NO: 2112885 - RNA, 19 nt, Staphylococcus aureus subsp. aureus MW2
auaauauugaugaauaaau

SEQ ID NO: 2112886 - RNA, 15 nt, Staphylococcus aureus subsp. aureus MW2
auaauauuggacuuu

SEQ ID NO: 2112887 - RNA, 15 nt, Staphylococcus aureus subsp. aureus MW2
auaauauugaaagau

SEQ ID NO: 2112888 - RNA, 17 nt, Staphylococcus aureus subsp. aureus MW2
auaauauugaugaauaa

SEQ ID NO: 2112889 - RNA, 14 nt, Staphylococcus aureus subsp. aureus MW2
auaaauaaaaugcu

SEQ ID NO: 2112890 - RNA, 12 nt, Staphylococcus aureus subsp. aureus MW2
auaaauaaacaa

SEQ ID NO: 2112891 - RNA, 13 nt, Staphylococcus aureus subsp. aureus MW2
auaaauaaacaua

SEQ ID NO: 2112892 - RNA, 13 nt, Staphylococcus aureus subsp. aureus MW2
auaaauaaacuca

SEQ ID NO: 2112893 - RNA, 12 nt, Staphylococcus aureus subsp. aureus MW2
auaaauaaaauu

SEQ ID NO: 2112894 - RNA, 21 nt, Staphylococcus aureus subsp. aureus MW2
auaaaguaugagagauagaaa

SEQ ID NO: 2112895 - RNA, 19 nt, Staphylococcus aureus subsp. aureus MW2
auaaaggucuauauauauu

SEQ ID NO: 2112896 - RNA, 23 nt, Staphylococcus aureus subsp. aureus MW2
auaaaggucuauauauauuuaaa

SEQ ID NO: 2112897 - RNA, 21 nt, Staphylococcus aureus subsp. aureus MW2
auaaagcugauuuuucauuga

SEQ ID NO: 2112898 - RNA, 20 nt, Staphylococcus aureus subsp. aureus MW2
auaaagcugcgauauaacua

SEQ ID NO: 2112899 - RNA, 17 nt, Staphylococcus aureus subsp. aureus MW2
auaaauaugauguuaaa

SEQ ID NO: 2112900 - RNA, 21 nt, Staphylococcus aureus subsp. aureus MW2
auaaauaugauguuaaaaaau

SEQ ID NO: 2112901 - RNA, 20 nt, Staphylococcus aureus subsp. aureus MW2
auaaauaucauaaaugcaua

SEQ ID NO: 2112902 - RNA, 18 nt, Staphylococcus aureus subsp. aureus MW2
auaaauauggauuuugaa

SEQ ID NO: 2112903 - RNA, 19 nt, Staphylococcus aureus subsp. aureus MW2
auaaauaagugauaaauaa

SEQ ID NO: 2112904 - RNA, 13 nt, Staphylococcus aureus subsp. aureus MW2
auaaauaaagauu

SEQ ID NO: 2112905 - RNA, 20 nt, Staphylococcus aureus subsp. aureus MW2
auaaauaaagauucaauuaa

SEQ ID NO: 2112906 - RNA, 16 nt, Staphylococcus aureus subsp. aureus MW2
auaaauaauuuagaaa

SEQ ID NO: 2112907 - RNA, 19 nt, Staphylococcus aureus subsp. aureus MW2
auaaauacaauagaaauaa

SEQ ID NO: 2112908 - RNA, 20 nt, Staphylococcus aureus subsp. aureus MW2
auaaaucggacugauagaaa

SEQ ID NO: 2112909 - RNA, 18 nt, Staphylococcus aureus subsp. aureus MW2
auaaaucguguuaauucu

SEQ ID NO: 2112910 - RNA, 16 nt, Staphylococcus aureus subsp. aureus MW2
auaaaucuuugauuau

SEQ ID NO: 2112911 - RNA, 13 nt, Staphylococcus aureus subsp. aureus MW2
auaaaucuuuuuu

SEQ ID NO: 2112912 - RNA, 22 nt, Staphylococcus aureus subsp. aureus MW2
auaaaugaauuauuuaaaaugc

SEQ ID NO: 2112913 - RNA, 14 nt, Staphylococcus aureus subsp. aureus MW2
auaaauauuuaaaa

SEQ ID NO: 2112914 - RNA, 13 nt, Staphylococcus aureus subsp. aureus MW2
auaaauauuggaa

SEQ ID NO: 2112915 - RNA, 19 nt, Staphylococcus aureus subsp. aureus MW2
auaaauauuuaaaauauua

SEQ ID NO: 2112916 - RNA, 15 nt, Staphylococcus aureus subsp. aureus MW2
auaaaucgauaaaau

SEQ ID NO: 2112917 - RNA, 16 nt, Staphylococcus aureus subsp. aureus MW2
auaaaucgauaaaaug

SEQ ID NO: 2112918 - RNA, 19 nt, Staphylococcus aureus subsp. aureus MW2
auaaaccuacaauauagaa

SEQ ID NO: 2112919 - RNA, 12 nt, Staphylococcus aureus subsp. aureus MW2
auaaacuacaca

SEQ ID NO: 2112920 - RNA, 16 nt, Staphylococcus aureus subsp. aureus MW2
auaaacucuuauaagu

SEQ ID NO: 2112921 - RNA, 15 nt, Staphylococcus aureus subsp. aureus MW2
auaaacuuaaaagag

SEQ ID NO: 2112922 - RNA, 17 nt, Staphylococcus aureus subsp. aureus MW2
auaaagauuauaucuuu

SEQ ID NO: 2112923 - RNA, 18 nt, Staphylococcus aureus subsp. aureus MW2
auaaagauagaaugaaua

SEQ ID NO: 2112924 - RNA, 13 nt, Staphylococcus aureus subsp. aureus MW2
auaaaaauagaaa

SEQ ID NO: 2112925 - RNA, 18 nt, Staphylococcus aureus subsp. aureus MW2
auaaaaagugaaaguauu

SEQ ID NO: 2112926 - RNA, 16 nt, Staphylococcus aureus subsp. aureus MW2
auaaaaagugaaagua

SEQ ID NO: 2112927 - RNA, 12 nt, Staphylococcus aureus subsp. aureus MW2
auaaaaauaaaa

SEQ ID NO: 2112928 - RNA, 14 nt, Staphylococcus aureus subsp. aureus MW2
auaaaaagaauaug

SEQ ID NO: 2112929 - RNA, 21 nt, Staphylococcus aureus subsp. aureus MW2
auaaaaagauauaagaaaaag

SEQ ID NO: 2112930 - RNA, 14 nt, Staphylococcus aureus subsp. aureus MW2
auaaacaauaacug

SEQ ID NO: 2112931 - RNA, 15 nt, Staphylococcus aureus subsp. aureus MW2
auaaacaauaaaaaa

SEQ ID NO: 2112932 - RNA, 19 nt, Staphylococcus aureus subsp. aureus MW2
auaaacaauaacuguucuu

SEQ ID NO: 2112933 - RNA, 14 nt, Staphylococcus aureus subsp. aureus MW2
auaaaccacgcaca

SEQ ID NO: 2112934 - RNA, 14 nt, Staphylococcus aureus subsp. aureus MW2
auaaaccagcugau

SEQ ID NO: 2112935 - RNA, 20 nt, Staphylococcus aureus subsp. aureus MW2
auaaacaacugcaauagcua

SEQ ID NO: 2112936 - RNA, 12 nt, Staphylococcus aureus subsp. aureus MW2
auaaacaauaaa

SEQ ID NO: 2112937 - RNA, 16 nt, Staphylococcus aureus subsp. aureus MW2
auaaaugucauaguau

SEQ ID NO: 2112938 - RNA, 12 nt, Staphylococcus aureus subsp. aureus MW2
auaaauguuaaa

SEQ ID NO: 2112939 - RNA, 16 nt, Staphylococcus aureus subsp. aureus MW2
auaaauguuuauaucu

SEQ ID NO: 2112940 - RNA, 23 nt, Staphylococcus aureus subsp. aureus MW2
auaaauguuagauuucaaacgau

SEQ ID NO: 2112941 - RNA, 19 nt, Staphylococcus aureus subsp. aureus MW2
auaaauguuaaagauuauu

SEQ ID NO: 2112942 - RNA, 15 nt, Staphylococcus aureus subsp. aureus MW2
auaaauuaauaugaa

SEQ ID NO: 2112943 - RNA, 19 nt, Staphylococcus aureus subsp. aureus MW2
auaaauuaaaugcaauaca

SEQ ID NO: 2112944 - RNA, 16 nt, Staphylococcus aureus subsp. aureus MW2
auaaauuagaugaaau

SEQ ID NO: 2112945 - RNA, 19 nt, Staphylococcus aureus subsp. aureus MW2
auaaauuagccauuucaau

SEQ ID NO: 2112946 - RNA, 21 nt, Staphylococcus aureus subsp. aureus MW2
auaaauuuugaauuacagauu

SEQ ID NO: 2112947 - RNA, 23 nt, Staphylococcus aureus subsp. aureus MW2
auaacaaaaauugcuauauuagu

SEQ ID NO: 2112948 - RNA, 19 nt, Staphylococcus aureus subsp. aureus MW2
auaaauuuugcgaaaauau

SEQ ID NO: 2112949 - RNA, 15 nt, Staphylococcus aureus subsp. aureus MW2
auaaauuuugagaaa

SEQ ID NO: 2112950 - RNA, 17 nt, Staphylococcus aureus subsp. aureus MW2
auaaauuuugagaaaau

SEQ ID NO: 2112951 - RNA, 13 nt, Staphylococcus aureus subsp. aureus MW2
auaacaauuuuaa

SEQ ID NO: 2112952 - RNA, 14 nt, Staphylococcus aureus subsp. aureus MW2
auaacaauuuuaaa

SEQ ID NO: 2112953 - RNA, 20 nt, Staphylococcus aureus subsp. aureus MW2
auaacacaucaugacauuaa

SEQ ID NO: 2112954 - RNA, 21 nt, Staphylococcus aureus subsp. aureus MW2
auaacaauuuuaaaucuuuua

SEQ ID NO: 2112955 - RNA, 15 nt, Staphylococcus aureus subsp. aureus MW2
auaacaccaauuaaa

SEQ ID NO: 2112956 - RNA, 20 nt, Staphylococcus aureus subsp. aureus MW2
auaacacccgucccauaaaa

SEQ ID NO: 2112957 - RNA, 14 nt, Staphylococcus aureus subsp. aureus MW2
auaacaccauaaca

SEQ ID NO: 2112958 - RNA, 15 nt, Staphylococcus aureus subsp. aureus MW2
auaacaccauaacac

SEQ ID NO: 2112959 - RNA, 18 nt, Staphylococcus aureus subsp. aureus MW2
auaacaccuuucauuugg

SEQ ID NO: 2112960 - RNA, 19 nt, Staphylococcus aureus subsp. aureus MW2
auaacauucuucaaaaaau

SEQ ID NO: 2112961 - RNA, 17 nt, Staphylococcus aureus subsp. aureus MW2
auaacauucuucaaaaa

SEQ ID NO: 2112962 - RNA, 18 nt, Staphylococcus aureus subsp. aureus MW2
auaacauucuucaaaaaa

SEQ ID NO: 2112963 - RNA, 20 nt, Staphylococcus aureus subsp. aureus MW2
auaacauucuucaaaaaaua

SEQ ID NO: 2112964 - RNA, 15 nt, Staphylococcus aureus subsp. aureus MW2
auaacauuuaagaaa

SEQ ID NO: 2112965 - RNA, 16 nt, Staphylococcus aureus subsp. aureus MW2
auaaccaaaccauuaa

SEQ ID NO: 2112966 - RNA, 17 nt, Staphylococcus aureus subsp. aureus MW2
auaaccaaguaauucuu

SEQ ID NO: 2112967 - RNA, 20 nt, Staphylococcus aureus subsp. aureus MW2
auaaccaaguaauucuuuac

SEQ ID NO: 2112968 - RNA, 16 nt, Staphylococcus aureus subsp. aureus MW2
auaaccgaugugauuu

SEQ ID NO: 2112969 - RNA, 20 nt, Staphylococcus aureus subsp. aureus MW2
auaaccgcacuuucuauuaa

SEQ ID NO: 2112970 - RNA, 14 nt, Staphylococcus aureus subsp. aureus MW2
auaaccgaaauauu

SEQ ID NO: 2112971 - RNA, 13 nt, Staphylococcus aureus subsp. aureus MW2
auaacccuaauuc

SEQ ID NO: 2112972 - RNA, 18 nt, Staphylococcus aureus subsp. aureus MW2
auaacccuaauucuuuaa

SEQ ID NO: 2112973 - RNA, 22 nt, Staphylococcus aureus subsp. aureus MW2
auaacccuaauucuuuaauaaa

SEQ ID NO: 2112974 - RNA, 22 nt, Staphylococcus aureus subsp. aureus MW2
auaacuguauaccucuuagcac

SEQ ID NO: 2112975 - RNA, 13 nt, Staphylococcus aureus subsp. aureus MW2
auaacuguaaaac

SEQ ID NO: 2112976 - RNA, 20 nt, Staphylococcus aureus subsp. aureus MW2
auaacugcauguacaucuuu

SEQ ID NO: 2112977 - RNA, 23 nt, Staphylococcus aureus subsp. aureus MW2
auaacuguucuuucgucuuguaa

SEQ ID NO: 2112978 - RNA, 21 nt, Staphylococcus aureus subsp. aureus MW2
auaacucgcuucguucuaaaa

SEQ ID NO: 2112979 - RNA, 15 nt, Staphylococcus aureus subsp. aureus MW2
auaacucuaaauaua

SEQ ID NO: 2112980 - RNA, 14 nt, Staphylococcus aureus subsp. aureus MW2
auaacucuucuaag

SEQ ID NO: 2112981 - RNA, 19 nt, Staphylococcus aureus subsp. aureus MW2
auaacucuucuaaguuauu

SEQ ID NO: 2112982 - RNA, 14 nt, Staphylococcus aureus subsp. aureus MW2
auaagaaaauacua

SEQ ID NO: 2112983 - RNA, 24 nt, Staphylococcus aureus subsp. aureus MW2
auaagaaaaagacggauaauuaau

SEQ ID NO: 2112984 - RNA, 13 nt, Staphylococcus aureus subsp. aureus MW2
auaacuuuaaaaa

SEQ ID NO: 2112985 - RNA, 16 nt, Staphylococcus aureus subsp. aureus MW2
auaacuuuaaaaauua

SEQ ID NO: 2112986 - RNA, 15 nt, Staphylococcus aureus subsp. aureus MW2
auaacuugauauuau

SEQ ID NO: 2112987 - RNA, 18 nt, Staphylococcus aureus subsp. aureus MW2
auaacuugauauuauaua

SEQ ID NO: 2112988 - RNA, 21 nt, Staphylococcus aureus subsp. aureus MW2
auaacuugauauuauauaaaa

SEQ ID NO: 2112989 - RNA, 20 nt, Staphylococcus aureus subsp. aureus MW2
auaacuagaacaagaauuau

SEQ ID NO: 2112990 - RNA, 22 nt, Staphylococcus aureus subsp. aureus MW2
auaacuaagugaauuaucuaua

SEQ ID NO: 2112991 - RNA, 19 nt, Staphylococcus aureus subsp. aureus MW2
auaacguucgccaacuaaa

SEQ ID NO: 2112992 - RNA, 16 nt, Staphylococcus aureus subsp. aureus MW2
auaacguucuguuuug

SEQ ID NO: 2112993 - RNA, 15 nt, Staphylococcus aureus subsp. aureus MW2
auaacucaaauaucu

SEQ ID NO: 2112994 - RNA, 17 nt, Staphylococcus aureus subsp. aureus MW2
auaacucaguaaauuua

SEQ ID NO: 2112995 - RNA, 14 nt, Staphylococcus aureus subsp. aureus MW2
auaacuagaaugau

SEQ ID NO: 2112996 - RNA, 21 nt, Staphylococcus aureus subsp. aureus MW2
auaacuaguauccuuuauaaa

SEQ ID NO: 2112997 - RNA, 20 nt, Staphylococcus aureus subsp. aureus MW2
auaaccuaauucgccaucuu

SEQ ID NO: 2112998 - RNA, 14 nt, Staphylococcus aureus subsp. aureus MW2
auaaccuacauuaa

SEQ ID NO: 2112999 - RNA, 15 nt, Staphylococcus aureus subsp. aureus MW2
auaaccuagguuaaa

SEQ ID NO: 2113000 - RNA, 19 nt, Staphylococcus aureus subsp. aureus MW2
auaacguuaauauaauuaa

SEQ ID NO: 2113001 - RNA, 23 nt, Staphylococcus aureus subsp. aureus MW2
auaacguguuugcucaaaauggu

SEQ ID NO: 2113002 - RNA, 19 nt, Staphylococcus aureus subsp. aureus MW2
auaacgugcuuuuuuagaa

SEQ ID NO: 2113003 - RNA, 14 nt, Staphylococcus aureus subsp. aureus MW2
agucuuauuuuuau

SEQ ID NO: 2113004 - RNA, 15 nt, Staphylococcus aureus subsp. aureus MW2
agucuucauguucuu

SEQ ID NO: 2113005 - RNA, 17 nt, Staphylococcus aureus subsp. aureus MW2
agucuucauguucuuau

SEQ ID NO: 2113006 - RNA, 18 nt, Staphylococcus aureus subsp. aureus MW2
agucuucauguucuuaua

SEQ ID NO: 2113007 - RNA, 13 nt, Staphylococcus aureus subsp. aureus MW2
agucuguugguuu

SEQ ID NO: 2113008 - RNA, 21 nt, Staphylococcus aureus subsp. aureus MW2
agucuguauauggcgauaaca

SEQ ID NO: 2113009 - RNA, 22 nt, Staphylococcus aureus subsp. aureus MW2
agucugcucuuuuuguaugagu

SEQ ID NO: 2113010 - RNA, 15 nt, Staphylococcus aureus subsp. aureus MW2
agucuggaacaauaa

SEQ ID NO: 2113011 - RNA, 18 nt, Staphylococcus aureus subsp. aureus MW2
agucuggaacaauaauca

SEQ ID NO: 2113012 - RNA, 21 nt, Staphylococcus aureus subsp. aureus MW2
agucucuuuacggauugcugc

SEQ ID NO: 2113013 - RNA, 15 nt, Staphylococcus aureus subsp. aureus MW2
agugacacuguaacg

SEQ ID NO: 2113014 - RNA, 20 nt, Staphylococcus aureus subsp. aureus MW2
agugaauuaucuauauauga

SEQ ID NO: 2113015 - RNA, 16 nt, Staphylococcus aureus subsp. aureus MW2
agugaauuaucuauau

SEQ ID NO: 2113016 - RNA, 20 nt, Staphylococcus aureus subsp. aureus MW2
agucuugugauaauucuuca

SEQ ID NO: 2113017 - RNA, 22 nt, Staphylococcus aureus subsp. aureus MW2
agucuuggacauuguaaaaugc

SEQ ID NO: 2113018 - RNA, 22 nt, Staphylococcus aureus subsp. aureus MW2
agucuuuuuauuuuaauauuuu

SEQ ID NO: 2113019 - RNA, 16 nt, Staphylococcus aureus subsp. aureus MW2
agucuuuuugauuaaa

SEQ ID NO: 2113020 - RNA, 13 nt, Staphylococcus aureus subsp. aureus MW2
agucuuuuuuaag

SEQ ID NO: 2113021 - RNA, 13 nt, Staphylococcus aureus subsp. aureus MW2
agucuuuaacuuu

SEQ ID NO: 2113022 - RNA, 14 nt, Staphylococcus aureus subsp. aureus MW2
agucgaacaaugau

SEQ ID NO: 2113023 - RNA, 22 nt, Staphylococcus aureus subsp. aureus MW2
aguccgcguguacuuuaccauc

SEQ ID NO: 2113024 - RNA, 16 nt, Staphylococcus aureus subsp. aureus MW2
agucuaugaauaaugu

SEQ ID NO: 2113025 - RNA, 16 nt, Staphylococcus aureus subsp. aureus MW2
agucucuuuugauaaa

SEQ ID NO: 2113026 - RNA, 19 nt, Staphylococcus aureus subsp. aureus MW2
agucguucucuuaaauaug

SEQ ID NO: 2113027 - RNA, 19 nt, Staphylococcus aureus subsp. aureus MW2
agucguuguugaaauuaaa

SEQ ID NO: 2113028 - RNA, 18 nt, Staphylococcus aureus subsp. aureus MW2
aguggaucacgauaaugu

SEQ ID NO: 2113029 - RNA, 18 nt, Staphylococcus aureus subsp. aureus MW2
agugcucuugcaauagca

SEQ ID NO: 2113030 - RNA, 19 nt, Staphylococcus aureus subsp. aureus MW2
agugcgguuauuuauacag

SEQ ID NO: 2113031 - RNA, 13 nt, Staphylococcus aureus subsp. aureus MW2
agugcuaagaggu

SEQ ID NO: 2113032 - RNA, 22 nt, Staphylococcus aureus subsp. aureus MW2
agugcuaauuuugagacaaaaa

SEQ ID NO: 2113033 - RNA, 20 nt, Staphylococcus aureus subsp. aureus MW2
agugcauuuuuuauuuuacu

SEQ ID NO: 2113034 - RNA, 18 nt, Staphylococcus aureus subsp. aureus MW2
agugacgggguuuuauca

SEQ ID NO: 2113035 - RNA, 16 nt, Staphylococcus aureus subsp. aureus MW2
agugagcguauuauua

SEQ ID NO: 2113036 - RNA, 17 nt, Staphylococcus aureus subsp. aureus MW2
aguguauucauuuuaaa

SEQ ID NO: 2113037 - RNA, 13 nt, Staphylococcus aureus subsp. aureus MW2
aguguauacaagg

SEQ ID NO: 2113038 - RNA, 12 nt, Staphylococcus aureus subsp. aureus MW2
aguguauauagu

SEQ ID NO: 2113039 - RNA, 17 nt, Staphylococcus aureus subsp. aureus MW2
aguguagccaaauaaau

SEQ ID NO: 2113040 - RNA, 16 nt, Staphylococcus aureus subsp. aureus MW2
aguguagcacaagauu

SEQ ID NO: 2113041 - RNA, 21 nt, Staphylococcus aureus subsp. aureus MW2
agugucaugcuuaauuuaugu

SEQ ID NO: 2113042 - RNA, 14 nt, Staphylococcus aureus subsp. aureus MW2
agugguaaaaauga

SEQ ID NO: 2113043 - RNA, 20 nt, Staphylococcus aureus subsp. aureus MW2
agugguauuaacuaauaacu

SEQ ID NO: 2113044 - RNA, 17 nt, Staphylococcus aureus subsp. aureus MW2
aguggucguuuauuuua

SEQ ID NO: 2113045 - RNA, 18 nt, Staphylococcus aureus subsp. aureus MW2
agugguuuucuuuauuuu

SEQ ID NO: 2113046 - RNA, 18 nt, Staphylococcus aureus subsp. aureus MW2
agugggacagaaaugaua

SEQ ID NO: 2113047 - RNA, 15 nt, Staphylococcus aureus subsp. aureus MW2
agugggaaacauuuc

SEQ ID NO: 2113048 - RNA, 20 nt, Staphylococcus aureus subsp. aureus MW2
aguucaaagcgauaaaguau

SEQ ID NO: 2113049 - RNA, 15 nt, Staphylococcus aureus subsp. aureus MW2
aguuauaucauaacu

SEQ ID NO: 2113050 - RNA, 19 nt, Staphylococcus aureus subsp. aureus MW2
aguucaacagggguuuuua

SEQ ID NO: 2113051 - RNA, 16 nt, Staphylococcus aureus subsp. aureus MW2
aguucaaauugaacuu

SEQ ID NO: 2113052 - RNA, 23 nt, Staphylococcus aureus subsp. aureus MW2
aguuccucgguauucaauucugu

SEQ ID NO: 2113053 - RNA, 23 nt, Staphylococcus aureus subsp. aureus MW2
aguucgacacguccgacaucaua

SEQ ID NO: 2113054 - RNA, 19 nt, Staphylococcus aureus subsp. aureus MW2
aguucuuaggcaauguaaa

SEQ ID NO: 2113055 - RNA, 20 nt, Staphylococcus aureus subsp. aureus MW2
aguucuuaugcaguuuuaau

SEQ ID NO: 2113056 - RNA, 13 nt, Staphylococcus aureus subsp. aureus MW2
aguguuauauugu

SEQ ID NO: 2113057 - RNA, 17 nt, Staphylococcus aureus subsp. aureus MW2
aguguuuaugaaagucu

SEQ ID NO: 2113058 - RNA, 13 nt, Staphylococcus aureus subsp. aureus MW2
aguguuguuuuau

SEQ ID NO: 2113059 - RNA, 16 nt, Staphylococcus aureus subsp. aureus MW2
aguuagacuaaaaaac

SEQ ID NO: 2113060 - RNA, 17 nt, Staphylococcus aureus subsp. aureus MW2
aguuacuucaguuuggu

SEQ ID NO: 2113061 - RNA, 17 nt, Staphylococcus aureus subsp. aureus MW2
aguuacucaauauaaaa

SEQ ID NO: 2113062 - RNA, 20 nt, Staphylococcus aureus subsp. aureus MW2
aguuaggcgacuuaacuuaa

SEQ ID NO: 2113063 - RNA, 18 nt, Staphylococcus aureus subsp. aureus MW2
aguuaaaaccuuuucaaa

SEQ ID NO: 2113064 - RNA, 16 nt, Staphylococcus aureus subsp. aureus MW2
aguuaaaaauguaaau

SEQ ID NO: 2113065 - RNA, 17 nt, Staphylococcus aureus subsp. aureus MW2
aguuaaaagugguuuua

SEQ ID NO: 2113066 - RNA, 13 nt, Staphylococcus aureus subsp. aureus MW2
aguguuuguaaug

SEQ ID NO: 2113067 - RNA, 15 nt, Staphylococcus aureus subsp. aureus MW2
aguuacgauaucaua

SEQ ID NO: 2113068 - RNA, 14 nt, Staphylococcus aureus subsp. aureus MW2
aguuacguuuucaa

SEQ ID NO: 2113069 - RNA, 13 nt, Staphylococcus aureus subsp. aureus MW2
aguuguugcaaau

SEQ ID NO: 2113070 - RNA, 14 nt, Staphylococcus aureus subsp. aureus MW2
aguuuaacauuacu

SEQ ID NO: 2113071 - RNA, 14 nt, Staphylococcus aureus subsp. aureus MW2
aguugcuucauaaa

SEQ ID NO: 2113072 - RNA, 15 nt, Staphylococcus aureus subsp. aureus MW2
aguugcacauuauaa

SEQ ID NO: 2113073 - RNA, 21 nt, Staphylococcus aureus subsp. aureus MW2
aguugcacauuauaaagcugc

SEQ ID NO: 2113074 - RNA, 24 nt, Staphylococcus aureus subsp. aureus MW2
aguugcacucgguucauaaugauc

SEQ ID NO: 2113075 - RNA, 20 nt, Staphylococcus aureus subsp. aureus MW2
aguugcaaacgcguuauaga

SEQ ID NO: 2113076 - RNA, 14 nt, Staphylococcus aureus subsp. aureus MW2
aguugaaaauaauc

SEQ ID NO: 2113077 - RNA, 13 nt, Staphylococcus aureus subsp. aureus MW2
aguucuuuuugau

SEQ ID NO: 2113078 - RNA, 23 nt, Staphylococcus aureus subsp. aureus MW2
aguugaaaauaaucgaacagaaa

SEQ ID NO: 2113079 - RNA, 14 nt, Staphylococcus aureus subsp. aureus MW2
aguugacaauacaa

SEQ ID NO: 2113080 - RNA, 17 nt, Staphylococcus aureus subsp. aureus MW2
aguugaagcggguugaa

SEQ ID NO: 2113081 - RNA, 23 nt, Staphylococcus aureus subsp. aureus MW2
aguugaagcggguugaagcaauu

SEQ ID NO: 2113082 - RNA, 16 nt, Staphylococcus aureus subsp. aureus MW2
aguuuuuaaaauuauc

SEQ ID NO: 2113083 - RNA, 13 nt, Staphylococcus aureus subsp. aureus MW2
auaaaaaaagaga

SEQ ID NO: 2113084 - RNA, 20 nt, Staphylococcus aureus subsp. aureus MW2
aguuuguuucuaaauucuuu

SEQ ID NO: 2113085 - RNA, 16 nt, Staphylococcus aureus subsp. aureus MW2
aguuuguuuucuuucg

SEQ ID NO: 2113086 - RNA, 15 nt, Staphylococcus aureus subsp. aureus MW2
aguuuguuucuaaau

SEQ ID NO: 2113087 - RNA, 16 nt, Staphylococcus aureus subsp. aureus MW2
aguuuguuucuaaauu

SEQ ID NO: 2113088 - RNA, 19 nt, Staphylococcus aureus subsp. aureus MW2
aguuuguuuacggauuuuu

SEQ ID NO: 2113089 - RNA, 18 nt, Staphylococcus aureus subsp. aureus MW2
aguuuguuggucuuucuu

SEQ ID NO: 2113090 - RNA, 21 nt, Staphylococcus aureus subsp. aureus MW2
aguuuucggcuagauuuuaaa

SEQ ID NO: 2113091 - RNA, 19 nt, Staphylococcus aureus subsp. aureus MW2
aguuuugaagaauaaaaaa

SEQ ID NO: 2113092 - RNA, 20 nt, Staphylococcus aureus subsp. aureus MW2
aguuuacgaucauaaauauu

SEQ ID NO: 2113093 - RNA, 19 nt, Staphylococcus aureus subsp. aureus MW2
aguuucuacuguauaagug

SEQ ID NO: 2113094 - RNA, 17 nt, Staphylococcus aureus subsp. aureus MW2
aguuuguccuuuaagaa

SEQ ID NO: 2113095 - RNA, 19 nt, Staphylococcus aureus subsp. aureus MW2
aguuugaaggugauaaugu

SEQ ID NO: 2113096 - RNA, 14 nt, Staphylococcus aureus subsp. aureus MW2
aguuugacaucuau

SEQ ID NO: 2113097 - RNA, 17 nt, Staphylococcus aureus subsp. aureus MW2
aguuugaaggugauaau

SEQ ID NO: 2113098 - RNA, 15 nt, Staphylococcus aureus subsp. aureus MW2
aucacgccauaaucu

SEQ ID NO: 2113099 - RNA, 15 nt, Staphylococcus aureus subsp. aureus MW2
aucacgauuucagca

SEQ ID NO: 2113100 - RNA, 14 nt, Staphylococcus aureus subsp. aureus MW2
aucacgauuuucaa

SEQ ID NO: 2113101 - RNA, 17 nt, Staphylococcus aureus subsp. aureus MW2
aucaccuuuuuuaacuu

SEQ ID NO: 2113102 - RNA, 14 nt, Staphylococcus aureus subsp. aureus MW2
aucacuccucuauu

SEQ ID NO: 2113103 - RNA, 19 nt, Staphylococcus aureus subsp. aureus MW2
aucacuauauuucacacag

SEQ ID NO: 2113104 - RNA, 13 nt, Staphylococcus aureus subsp. aureus MW2
aucacuauauuuc

SEQ ID NO: 2113105 - RNA, 15 nt, Staphylococcus aureus subsp. aureus MW2
aucacuaauauauuu

SEQ ID NO: 2113106 - RNA, 13 nt, Staphylococcus aureus subsp. aureus MW2
aucacuaaaguaa

SEQ ID NO: 2113107 - RNA, 15 nt, Staphylococcus aureus subsp. aureus MW2
aucacguuuuucuuu

SEQ ID NO: 2113108 - RNA, 20 nt, Staphylococcus aureus subsp. aureus MW2
aucacgugguuucuuuaauu

SEQ ID NO: 2113109 - RNA, 14 nt, Staphylococcus aureus subsp. aureus MW2
aucacauuaacaag

SEQ ID NO: 2113110 - RNA, 15 nt, Staphylococcus aureus subsp. aureus MW2
aucacagcaauaaua

SEQ ID NO: 2113111 - RNA, 17 nt, Staphylococcus aureus subsp. aureus MW2
aucacagcaauaauaau

SEQ ID NO: 2113112 - RNA, 21 nt, Staphylococcus aureus subsp. aureus MW2
aucacaguguugaauuuaaaa

SEQ ID NO: 2113113 - RNA, 14 nt, Staphylococcus aureus subsp. aureus MW2
aucaccauacuaaa

SEQ ID NO: 2113114 - RNA, 17 nt, Staphylococcus aureus subsp. aureus MW2
aucaccauacuaaaaca

SEQ ID NO: 2113115 - RNA, 14 nt, Staphylococcus aureus subsp. aureus MW2
aucaccauaaaaau

SEQ ID NO: 2113116 - RNA, 23 nt, Staphylococcus aureus subsp. aureus MW2
aucagcauuuaaguuaucuaaac

SEQ ID NO: 2113117 - RNA, 19 nt, Staphylococcus aureus subsp. aureus MW2
aucagcaccgccugaaaua

SEQ ID NO: 2113118 - RNA, 13 nt, Staphylococcus aureus subsp. aureus MW2
aucagacuaaaau

SEQ ID NO: 2113119 - RNA, 16 nt, Staphylococcus aureus subsp. aureus MW2
aucagacuaaaaugaa

SEQ ID NO: 2113120 - RNA, 12 nt, Staphylococcus aureus subsp. aureus MW2
aucagacuaaaa

SEQ ID NO: 2113121 - RNA, 22 nt, Staphylococcus aureus subsp. aureus MW2
aucacuugcuguugcaauaaaa

SEQ ID NO: 2113122 - RNA, 17 nt, Staphylococcus aureus subsp. aureus MW2
aucacuugguaaaacau

SEQ ID NO: 2113123 - RNA, 21 nt, Staphylococcus aureus subsp. aureus MW2
aucacuugcuguugcaauaaa

SEQ ID NO: 2113124 - RNA, 16 nt, Staphylococcus aureus subsp. aureus MW2
aucacuucugaaaaua

SEQ ID NO: 2113125 - RNA, 13 nt, Staphylococcus aureus subsp. aureus MW2
aucacuuuuuaaa

SEQ ID NO: 2113126 - RNA, 16 nt, Staphylococcus aureus subsp. aureus MW2
aucaaguauaaauguu

SEQ ID NO: 2113127 - RNA, 22 nt, Staphylococcus aureus subsp. aureus MW2
aucaaguaugcgccauacauau

SEQ ID NO: 2113128 - RNA, 18 nt, Staphylococcus aureus subsp. aureus MW2
aucaagucugcauuaauu

SEQ ID NO: 2113129 - RNA, 22 nt, Staphylococcus aureus subsp. aureus MW2
aucaagguguccuuuuuauuuu

SEQ ID NO: 2113130 - RNA, 19 nt, Staphylococcus aureus subsp. aureus MW2
aucaacgauugaauuguag

SEQ ID NO: 2113131 - RNA, 22 nt, Staphylococcus aureus subsp. aureus MW2
aucaaccuguucuuuauuuaaa

SEQ ID NO: 2113132 - RNA, 19 nt, Staphylococcus aureus subsp. aureus MW2
aucaacgagucauaaauau

SEQ ID NO: 2113133 - RNA, 18 nt, Staphylococcus aureus subsp. aureus MW2
aucaacgccauauuuauu

SEQ ID NO: 2113134 - RNA, 20 nt, Staphylococcus aureus subsp. aureus MW2
aucaaaaccgcuauaaaauu

SEQ ID NO: 2113135 - RNA, 22 nt, Staphylococcus aureus subsp. aureus MW2
aucaaagaaaaagugauaauua

SEQ ID NO: 2113136 - RNA, 14 nt, Staphylococcus aureus subsp. aureus MW2
aucaaccuguucuu

SEQ ID NO: 2113137 - RNA, 15 nt, Staphylococcus aureus subsp. aureus MW2
aucaauauaauuugg

SEQ ID NO: 2113138 - RNA, 19 nt, Staphylococcus aureus subsp. aureus MW2
aucaauaucacuaucagcu

SEQ ID NO: 2113139 - RNA, 16 nt, Staphylococcus aureus subsp. aureus MW2
aucaauaguuuauaau

SEQ ID NO: 2113140 - RNA, 13 nt, Staphylococcus aureus subsp. aureus MW2
aucaauauaaccg

SEQ ID NO: 2113141 - RNA, 14 nt, Staphylococcus aureus subsp. aureus MW2
aucaauauugauau

SEQ ID NO: 2113142 - RNA, 21 nt, Staphylococcus aureus subsp. aureus MW2
aucaauauugucuucauuaac

SEQ ID NO: 2113143 - RNA, 23 nt, Staphylococcus aureus subsp. aureus MW2
aucaauauugucuucauuaacau

SEQ ID NO: 2113144 - RNA, 11 nt, Staphylococcus aureus subsp. aureus MW2
aucaauauuua

SEQ ID NO: 2113145 - RNA, 20 nt, Staphylococcus aureus subsp. aureus MW2
aucaauagaugaaaauuuaa

SEQ ID NO: 2113146 - RNA, 12 nt, Staphylococcus aureus subsp. aureus MW2
aucaauaaaaau

SEQ ID NO: 2113147 - RNA, 22 nt, Staphylococcus aureus subsp. aureus MW2
aucacacgacauguagguaauu

SEQ ID NO: 2113148 - RNA, 22 nt, Staphylococcus aureus subsp. aureus MW2
aucaauuuauuauuaacuguac

SEQ ID NO: 2113149 - RNA, 18 nt, Staphylococcus aureus subsp. aureus MW2
aucaauuucgacuccauu

SEQ ID NO: 2113150 - RNA, 18 nt, Staphylococcus aureus subsp. aureus MW2
aucaauuucuauuucacu

SEQ ID NO: 2113151 - RNA, 19 nt, Staphylococcus aureus subsp. aureus MW2
aucaauuucuguaauaaua

SEQ ID NO: 2113152 - RNA, 18 nt, Staphylococcus aureus subsp. aureus MW2
auauuauuuugcuuuaau

SEQ ID NO: 2113153 - RNA, 12 nt, Staphylococcus aureus subsp. aureus MW2
auauuauuuuua

SEQ ID NO: 2113154 - RNA, 13 nt, Staphylococcus aureus subsp. aureus MW2
auauuauuucaau

SEQ ID NO: 2113155 - RNA, 14 nt, Staphylococcus aureus subsp. aureus MW2
auauuauuuuuaag

SEQ ID NO: 2113156 - RNA, 16 nt, Staphylococcus aureus subsp. aureus MW2
auauucaaauuuacca

SEQ ID NO: 2113157 - RNA, 13 nt, Staphylococcus aureus subsp. aureus MW2
auauucaaugaau

SEQ ID NO: 2113158 - RNA, 14 nt, Staphylococcus aureus subsp. aureus MW2
auauucaaugaauu

SEQ ID NO: 2113159 - RNA, 14 nt, Staphylococcus aureus subsp. aureus MW2
auauucacaucuuu

SEQ ID NO: 2113160 - RNA, 12 nt, Staphylococcus aureus subsp. aureus MW2
auauucaaugaa

SEQ ID NO: 2113161 - RNA, 15 nt, Staphylococcus aureus subsp. aureus MW2
auaugauaaccaaac

SEQ ID NO: 2113162 - RNA, 13 nt, Staphylococcus aureus subsp. aureus MW2
auaugauaaauau

SEQ ID NO: 2113163 - RNA, 14 nt, Staphylococcus aureus subsp. aureus MW2
auauuauuaaauca

SEQ ID NO: 2113164 - RNA, 20 nt, Staphylococcus aureus subsp. aureus MW2
auaugauuacaacuuauucu

SEQ ID NO: 2113165 - RNA, 20 nt, Staphylococcus aureus subsp. aureus MW2
auauugauucuagugaaaua

SEQ ID NO: 2113166 - RNA, 16 nt, Staphylococcus aureus subsp. aureus MW2
auauugcaaaaauaau

SEQ ID NO: 2113167 - RNA, 16 nt, Staphylococcus aureus subsp. aureus MW2
auauugaugaauaaau

SEQ ID NO: 2113168 - RNA, 11 nt, Staphylococcus aureus subsp. aureus MW2
auauugauagc

SEQ ID NO: 2113169 - RNA, 20 nt, Staphylococcus aureus subsp. aureus MW2
auauucugcaccuguuuuaa

SEQ ID NO: 2113170 - RNA, 22 nt, Staphylococcus aureus subsp. aureus MW2
auauucuccaacucuaacagcu

SEQ ID NO: 2113171 - RNA, 15 nt, Staphylococcus aureus subsp. aureus MW2
auauucucuuuacca

SEQ ID NO: 2113172 - RNA, 22 nt, Staphylococcus aureus subsp. aureus MW2
auauuccuuacuaaguaaccaa

SEQ ID NO: 2113173 - RNA, 20 nt, Staphylococcus aureus subsp. aureus MW2
auauucgauacauaaaacau

SEQ ID NO: 2113174 - RNA, 15 nt, Staphylococcus aureus subsp. aureus MW2
auauucgcuuaaaaa

SEQ ID NO: 2113175 - RNA, 19 nt, Staphylococcus aureus subsp. aureus MW2
auauucggauccaaucuaa

SEQ ID NO: 2113176 - RNA, 14 nt, Staphylococcus aureus subsp. aureus MW2
auauucuaaaaaau

SEQ ID NO: 2113177 - RNA, 20 nt, Staphylococcus aureus subsp. aureus MW2
auauucguugauaguuguau

SEQ ID NO: 2113178 - RNA, 12 nt, Staphylococcus aureus subsp. aureus MW2
auauuuuuuaau

SEQ ID NO: 2113179 - RNA, 15 nt, Staphylococcus aureus subsp. aureus MW2
auauuuuuuaaugaa

SEQ ID NO: 2113180 - RNA, 14 nt, Staphylococcus aureus subsp. aureus MW2
auauuuuuucugug

SEQ ID NO: 2113181 - RNA, 20 nt, Staphylococcus aureus subsp. aureus MW2
auauuuuuuguacauuauua

SEQ ID NO: 2113182 - RNA, 21 nt, Staphylococcus aureus subsp. aureus MW2
auauuuuuuguacauuauuaa

SEQ ID NO: 2113183 - RNA, 23 nt, Staphylococcus aureus subsp. aureus MW2
auauuuuuuguacauuauuaaua

SEQ ID NO: 2113184 - RNA, 19 nt, Staphylococcus aureus subsp. aureus MW2
aucaaaaaaacaaaaaaua

SEQ ID NO: 2113185 - RNA, 14 nt, Staphylococcus aureus subsp. aureus MW2
aucaaaaauaaaaa

SEQ ID NO: 2113186 - RNA, 18 nt, Staphylococcus aureus subsp. aureus MW2
auauuuuuacauauuuau

SEQ ID NO: 2113187 - RNA, 13 nt, Staphylococcus aureus subsp. aureus MW2
auauuuuuagaaa

SEQ ID NO: 2113188 - RNA, 14 nt, Staphylococcus aureus subsp. aureus MW2
auauuuuuuaaauu

SEQ ID NO: 2113189 - RNA, 13 nt, Staphylococcus aureus subsp. aureus MW2
auauuuuguuaau

SEQ ID NO: 2113190 - RNA, 14 nt, Staphylococcus aureus subsp. aureus MW2
auauuuuguaugaa

SEQ ID NO: 2113191 - RNA, 12 nt, Staphylococcus aureus subsp. aureus MW2
auauuuugauuu

SEQ ID NO: 2113192 - RNA, 19 nt, Staphylococcus aureus subsp. aureus MW2
auauuuucuuagaaaauca

SEQ ID NO: 2113193 - RNA, 19 nt, Staphylococcus aureus subsp. aureus MW2
auauuguagggaguauugu

SEQ ID NO: 2113194 - RNA, 17 nt, Staphylococcus aureus subsp. aureus MW2
auauuuucgcaaaauuu

SEQ ID NO: 2113195 - RNA, 19 nt, Staphylococcus aureus subsp. aureus MW2
auauuuuauuuaaaaauag

SEQ ID NO: 2113196 - RNA, 18 nt, Staphylococcus aureus subsp. aureus MW2
auauuuuauuuaaaaaua

SEQ ID NO: 2113197 - RNA, 20 nt, Staphylococcus aureus subsp. aureus MW2
auauuugcuagucauaauuu

SEQ ID NO: 2113198 - RNA, 19 nt, Staphylococcus aureus subsp. aureus MW2
auauuuaaacucauaauuu

SEQ ID NO: 2113199 - RNA, 22 nt, Staphylococcus aureus subsp. aureus MW2
auauuuaaacucauaauuuucu

SEQ ID NO: 2113200 - RNA, 12 nt, Staphylococcus aureus subsp. aureus MW2
auauuuaaauag

SEQ ID NO: 2113201 - RNA, 14 nt, Staphylococcus aureus subsp. aureus MW2
auauuuaaaucaau

SEQ ID NO: 2113202 - RNA, 19 nt, Staphylococcus aureus subsp. aureus MW2
auacugccauauguuuuag

SEQ ID NO: 2113203 - RNA, 15 nt, Staphylococcus aureus subsp. aureus MW2
auacugucaucuuuc

SEQ ID NO: 2113204 - RNA, 13 nt, Staphylococcus aureus subsp. aureus MW2
auacuucuauuuu

SEQ ID NO: 2113205 - RNA, 22 nt, Staphylococcus aureus subsp. aureus MW2
auacugucaucuuucaaugcau

SEQ ID NO: 2113206 - RNA, 21 nt, Staphylococcus aureus subsp. aureus MW2
auacuauaugucuuaucaauu

SEQ ID NO: 2113207 - RNA, 19 nt, Staphylococcus aureus subsp. aureus MW2
auacuaucugacauuuaaa

SEQ ID NO: 2113208 - RNA, 16 nt, Staphylococcus aureus subsp. aureus MW2
auacuauaugucuuau

SEQ ID NO: 2113209 - RNA, 13 nt, Staphylococcus aureus subsp. aureus MW2
auacuauauaaua

SEQ ID NO: 2113210 - RNA, 16 nt, Staphylococcus aureus subsp. aureus MW2
auacuauaugaaaaga

SEQ ID NO: 2113211 - RNA, 17 nt, Staphylococcus aureus subsp. aureus MW2
auacguuuaauaauggu

SEQ ID NO: 2113212 - RNA, 19 nt, Staphylococcus aureus subsp. aureus MW2
auacguugauguaauucug

SEQ ID NO: 2113213 - RNA, 20 nt, Staphylococcus aureus subsp. aureus MW2
auacguuauuucaauaauaa

SEQ ID NO: 2113214 - RNA, 20 nt, Staphylococcus aureus subsp. aureus MW2
auacguggcucuaaaaacaa

SEQ ID NO: 2113215 - RNA, 14 nt, Staphylococcus aureus subsp. aureus MW2
auacucuaaaaaag

SEQ ID NO: 2113216 - RNA, 16 nt, Staphylococcus aureus subsp. aureus MW2
auacucuaacuuacca

SEQ ID NO: 2113217 - RNA, 23 nt, Staphylococcus aureus subsp. aureus MW2
auacucgguacuucgcccuucca

SEQ ID NO: 2113218 - RNA, 23 nt, Staphylococcus aureus subsp. aureus MW2
auacucauguaacguaaaaaugu

SEQ ID NO: 2113219 - RNA, 20 nt, Staphylococcus aureus subsp. aureus MW2
auacguaaacacuuuaguau

SEQ ID NO: 2113220 - RNA, 22 nt, Staphylococcus aureus subsp. aureus MW2
auacguauauucggauccaauc

SEQ ID NO: 2113221 - RNA, 15 nt, Staphylococcus aureus subsp. aureus MW2
auaccugcauauuca

SEQ ID NO: 2113222 - RNA, 20 nt, Staphylococcus aureus subsp. aureus MW2
auaccucauccgccaauuaa

SEQ ID NO: 2113223 - RNA, 18 nt, Staphylococcus aureus subsp. aureus MW2
auaauuaauuaaaagccc

SEQ ID NO: 2113224 - RNA, 13 nt, Staphylococcus aureus subsp. aureus MW2
auaauuaauaaca

SEQ ID NO: 2113225 - RNA, 17 nt, Staphylococcus aureus subsp. aureus MW2
auaauuaaguguauaua

SEQ ID NO: 2113226 - RNA, 23 nt, Staphylococcus aureus subsp. aureus MW2
auaauuaccuuuccauucguaua

SEQ ID NO: 2113227 - RNA, 13 nt, Staphylococcus aureus subsp. aureus MW2
auaauuacuaaaa

SEQ ID NO: 2113228 - RNA, 21 nt, Staphylococcus aureus subsp. aureus MW2
auaauuaccuuuccauucgua

SEQ ID NO: 2113229 - RNA, 21 nt, Staphylococcus aureus subsp. aureus MW2
auaauuacuaaccuaaagaua

SEQ ID NO: 2113230 - RNA, 22 nt, Staphylococcus aureus subsp. aureus MW2
auaauuacuaaccuaaagauaa

SEQ ID NO: 2113231 - RNA, 19 nt, Staphylococcus aureus subsp. aureus MW2
auagcacugaaaucuagac

SEQ ID NO: 2113232 - RNA, 22 nt, Staphylococcus aureus subsp. aureus MW2
auagaugacuguagaaaacaug

SEQ ID NO: 2113233 - RNA, 13 nt, Staphylococcus aureus subsp. aureus MW2
auagaucuuugua

SEQ ID NO: 2113234 - RNA, 16 nt, Staphylococcus aureus subsp. aureus MW2
auagaugaaaauuuaa

SEQ ID NO: 2113235 - RNA, 15 nt, Staphylococcus aureus subsp. aureus MW2
auagaugugucuuuu

SEQ ID NO: 2113236 - RNA, 18 nt, Staphylococcus aureus subsp. aureus MW2
auagaugugucuuuuguu

SEQ ID NO: 2113237 - RNA, 15 nt, Staphylococcus aureus subsp. aureus MW2
auagauuauauuauc

SEQ ID NO: 2113238 - RNA, 22 nt, Staphylococcus aureus subsp. aureus MW2
auagacuuucuugaugaauuaa

SEQ ID NO: 2113239 - RNA, 14 nt, Staphylococcus aureus subsp. aureus MW2
auagagaaaaaaua

SEQ ID NO: 2113240 - RNA, 19 nt, Staphylococcus aureus subsp. aureus MW2
auagagaaaaaauaaaugu

SEQ ID NO: 2113241 - RNA, 20 nt, Staphylococcus aureus subsp. aureus MW2
auagagaaaaaauaaauguu

SEQ ID NO: 2113242 - RNA, 11 nt, Staphylococcus aureus subsp. aureus MW2
auacuuuucuu

SEQ ID NO: 2113243 - RNA, 23 nt, Staphylococcus aureus subsp. aureus MW2
auagagccgugaaagaaaaaacu

SEQ ID NO: 2113244 - RNA, 17 nt, Staphylococcus aureus subsp. aureus MW2
auacuugaagcaucgau

SEQ ID NO: 2113245 - RNA, 23 nt, Staphylococcus aureus subsp. aureus MW2
auacuugagcaaguuauaucaua

SEQ ID NO: 2113246 - RNA, 21 nt, Staphylococcus aureus subsp. aureus MW2
auacuugaagcaucgauuuau

SEQ ID NO: 2113247 - RNA, 23 nt, Staphylococcus aureus subsp. aureus MW2
auacuugaagcaucgauuuauua

SEQ ID NO: 2113248 - RNA, 14 nt, Staphylococcus aureus subsp. aureus MW2
auacuuugaaagaa

SEQ ID NO: 2113249 - RNA, 15 nt, Staphylococcus aureus subsp. aureus MW2
auacuucuuuagcaa

SEQ ID NO: 2113250 - RNA, 18 nt, Staphylococcus aureus subsp. aureus MW2
auacuuuaucuauuucua

SEQ ID NO: 2113251 - RNA, 20 nt, Staphylococcus aureus subsp. aureus MW2
auagcagguggcauccauau

SEQ ID NO: 2113252 - RNA, 18 nt, Staphylococcus aureus subsp. aureus MW2
auagccaauauaacaagc

SEQ ID NO: 2113253 - RNA, 15 nt, Staphylococcus aureus subsp. aureus MW2
auagcuaaacauuuu

SEQ ID NO: 2113254 - RNA, 14 nt, Staphylococcus aureus subsp. aureus MW2
auagcgguguuuug

SEQ ID NO: 2113255 - RNA, 17 nt, Staphylococcus aureus subsp. aureus MW2
auagcgguguuuugaga

SEQ ID NO: 2113256 - RNA, 22 nt, Staphylococcus aureus subsp. aureus MW2
auagcuuucguuucuuuuauau

SEQ ID NO: 2113257 - RNA, 18 nt, Staphylococcus aureus subsp. aureus MW2
auagcuaugauuugauau

SEQ ID NO: 2113258 - RNA, 22 nt, Staphylococcus aureus subsp. aureus MW2
auagcuaugauuugauauuuca

SEQ ID NO: 2113259 - RNA, 18 nt, Staphylococcus aureus subsp. aureus MW2
auagcuaaugcauuauua

SEQ ID NO: 2113260 - RNA, 21 nt, Staphylococcus aureus subsp. aureus MW2
auagcucuucuuuuucuugca

SEQ ID NO: 2113261 - RNA, 16 nt, Staphylococcus aureus subsp. aureus MW2
auagcucuauggcuuc

SEQ ID NO: 2113262 - RNA, 22 nt, Staphylococcus aureus subsp. aureus MW2
auagcucuucuuuuucuugcau

SEQ ID NO: 2113263 - RNA, 16 nt, Staphylococcus aureus subsp. aureus MW2
auaucuguauaaaaac

SEQ ID NO: 2113264 - RNA, 23 nt, Staphylococcus aureus subsp. aureus MW2
auaucuuaaucuaaaaauagaug

SEQ ID NO: 2113265 - RNA, 22 nt, Staphylococcus aureus subsp. aureus MW2
auaucuagcugcuucugcugua

SEQ ID NO: 2113266 - RNA, 20 nt, Staphylococcus aureus subsp. aureus MW2
auaucuauaggucuacaaau

SEQ ID NO: 2113267 - RNA, 22 nt, Staphylococcus aureus subsp. aureus MW2
auaucuucuuuuuuauaguggu

SEQ ID NO: 2113268 - RNA, 18 nt, Staphylococcus aureus subsp. aureus MW2
auaucuuuaucauuauuc

SEQ ID NO: 2113269 - RNA, 21 nt, Staphylococcus aureus subsp. aureus MW2
auaucuuucaauuaauuuaaa

SEQ ID NO: 2113270 - RNA, 17 nt, Staphylococcus aureus subsp. aureus MW2
auaugacuuuauuucua

SEQ ID NO: 2113271 - RNA, 20 nt, Staphylococcus aureus subsp. aureus MW2
auaugaaaaaugucuaaaaa

SEQ ID NO: 2113272 - RNA, 21 nt, Staphylococcus aureus subsp. aureus MW2
auaugaaaaaugucuaaaaaa

SEQ ID NO: 2113273 - RNA, 14 nt, Staphylococcus aureus subsp. aureus MW2
auaucuuuguugca

SEQ ID NO: 2113274 - RNA, 16 nt, Staphylococcus aureus subsp. aureus MW2
auaucuuuuaauguuu

SEQ ID NO: 2113275 - RNA, 14 nt, Staphylococcus aureus subsp. aureus MW2
auaucgacaaauua

SEQ ID NO: 2113276 - RNA, 16 nt, Staphylococcus aureus subsp. aureus MW2
auaucgacaccauuua

SEQ ID NO: 2113277 - RNA, 15 nt, Staphylococcus aureus subsp. aureus MW2
auaucauucauguuc

SEQ ID NO: 2113278 - RNA, 21 nt, Staphylococcus aureus subsp. aureus MW2
auauccaaaauccugaaauua

SEQ ID NO: 2113279 - RNA, 17 nt, Staphylococcus aureus subsp. aureus MW2
auauccacgguuuacca

SEQ ID NO: 2113280 - RNA, 21 nt, Staphylococcus aureus subsp. aureus MW2
auaucgaugacuuugucuuua

SEQ ID NO: 2113281 - RNA, 21 nt, Staphylococcus aureus subsp. aureus MW2
auaucgauauucuccaacucu

SEQ ID NO: 2113282 - RNA, 11 nt, Staphylococcus aureus subsp. aureus MW2
auaucuaaguc

SEQ ID NO: 2113283 - RNA, 23 nt, Staphylococcus aureus subsp. aureus MW2
auaucuacagagaaucaauuauu

SEQ ID NO: 2113284 - RNA, 15 nt, Staphylococcus aureus subsp. aureus MW2
auaucaauaaugcug

SEQ ID NO: 2113285 - RNA, 20 nt, Staphylococcus aureus subsp. aureus MW2
auaucaauuguugcaaaaua

SEQ ID NO: 2113286 - RNA, 17 nt, Staphylococcus aureus subsp. aureus MW2
auaucaaauacauuuca

SEQ ID NO: 2113287 - RNA, 14 nt, Staphylococcus aureus subsp. aureus MW2
auaucaaauacauu

SEQ ID NO: 2113288 - RNA, 17 nt, Staphylococcus aureus subsp. aureus MW2
auaucacugaaugcuaa

SEQ ID NO: 2113289 - RNA, 21 nt, Staphylococcus aureus subsp. aureus MW2
auaucagcuuuuucauucacu

SEQ ID NO: 2113290 - RNA, 22 nt, Staphylococcus aureus subsp. aureus MW2
auaucagcuaaguuaaauauca

SEQ ID NO: 2113291 - RNA, 19 nt, Staphylococcus aureus subsp. aureus MW2
auauauuuauuuuugauag

SEQ ID NO: 2113292 - RNA, 16 nt, Staphylococcus aureus subsp. aureus MW2
auauauuuauuuuuga

SEQ ID NO: 2113293 - RNA, 13 nt, Staphylococcus aureus subsp. aureus MW2
auauauuuaaacu

SEQ ID NO: 2113294 - RNA, 16 nt, Staphylococcus aureus subsp. aureus MW2
auauauuuaaaucaau

SEQ ID NO: 2113295 - RNA, 17 nt, Staphylococcus aureus subsp. aureus MW2
auauauuugaaagguaa

SEQ ID NO: 2113296 - RNA, 21 nt, Staphylococcus aureus subsp. aureus MW2
auauauuuggaggugaugaga

SEQ ID NO: 2113297 - RNA, 13 nt, Staphylococcus aureus subsp. aureus MW2
auauauucguuac

SEQ ID NO: 2113298 - RNA, 22 nt, Staphylococcus aureus subsp. aureus MW2
auauauuacuaaccuauuaaaa

SEQ ID NO: 2113299 - RNA, 18 nt, Staphylococcus aureus subsp. aureus MW2
auauauuaggucauguua

SEQ ID NO: 2113300 - RNA, 12 nt, Staphylococcus aureus subsp. aureus MW2
auauauuauaaa

SEQ ID NO: 2113301 - RNA, 17 nt, Staphylococcus aureus subsp. aureus MW2
auauauuauaaaaauag

SEQ ID NO: 2113302 - RNA, 18 nt, Staphylococcus aureus subsp. aureus MW2
auauauucuaauugcaca

SEQ ID NO: 2113303 - RNA, 20 nt, Staphylococcus aureus subsp. aureus MW2
auauagaagauauaacaugu

SEQ ID NO: 2113304 - RNA, 14 nt, Staphylococcus aureus subsp. aureus MW2
auauauuaaaaauc

SEQ ID NO: 2113305 - RNA, 20 nt, Staphylococcus aureus subsp. aureus MW2
auauagaaauaauuuaaagg

SEQ ID NO: 2113306 - RNA, 19 nt, Staphylococcus aureus subsp. aureus MW2
auauauuaacaacuuuauu

SEQ ID NO: 2113307 - RNA, 12 nt, Staphylococcus aureus subsp. aureus MW2
auauauuaauau

SEQ ID NO: 2113308 - RNA, 19 nt, Staphylococcus aureus subsp. aureus MW2
auauacuuuuuaaaugauu

SEQ ID NO: 2113309 - RNA, 11 nt, Staphylococcus aureus subsp. aureus MW2
auauagaaaau

SEQ ID NO: 2113310 - RNA, 11 nt, Staphylococcus aureus subsp. aureus MW2
auauacuuuuu

SEQ ID NO: 2113311 - RNA, 18 nt, Staphylococcus aureus subsp. aureus MW2
auauacuugccuucaaau

SEQ ID NO: 2113312 - RNA, 20 nt, Staphylococcus aureus subsp. aureus MW2
auauacuuuuauagaaaauu

SEQ ID NO: 2113313 - RNA, 17 nt, Staphylococcus aureus subsp. aureus MW2
auauacuuguucaacaa

SEQ ID NO: 2113314 - RNA, 23 nt, Staphylococcus aureus subsp. aureus MW2
auauacuugaagcaucgauuuau

SEQ ID NO: 2113315 - RNA, 16 nt, Staphylococcus aureus subsp. aureus MW2
auauacuuaauuuaaa

SEQ ID NO: 2113316 - RNA, 15 nt, Staphylococcus aureus subsp. aureus MW2
auauacaaauuuaua

SEQ ID NO: 2113317 - RNA, 17 nt, Staphylococcus aureus subsp. aureus MW2
auauacaaauuuauauu

SEQ ID NO: 2113318 - RNA, 19 nt, Staphylococcus aureus subsp. aureus MW2
auaguacauuuauuuucaa

SEQ ID NO: 2113319 - RNA, 18 nt, Staphylococcus aureus subsp. aureus MW2
auaguaacagacuuuguu

SEQ ID NO: 2113320 - RNA, 13 nt, Staphylococcus aureus subsp. aureus MW2
auaguaagaaaag

SEQ ID NO: 2113321 - RNA, 12 nt, Staphylococcus aureus subsp. aureus MW2
auaguaagaaaa

SEQ ID NO: 2113322 - RNA, 12 nt, Staphylococcus aureus subsp. aureus MW2
auaguaaaauaa

SEQ ID NO: 2113323 - RNA, 13 nt, Staphylococcus aureus subsp. aureus MW2
auagguaucuuaa

SEQ ID NO: 2113324 - RNA, 15 nt, Staphylococcus aureus subsp. aureus MW2
auagguauaaucauu

SEQ ID NO: 2113325 - RNA, 17 nt, Staphylococcus aureus subsp. aureus MW2
auaggugauuauauaua

SEQ ID NO: 2113326 - RNA, 19 nt, Staphylococcus aureus subsp. aureus MW2
auagguaaccuuaaauaua

SEQ ID NO: 2113327 - RNA, 14 nt, Staphylococcus aureus subsp. aureus MW2
auagguaacuaaaa

SEQ ID NO: 2113328 - RNA, 17 nt, Staphylococcus aureus subsp. aureus MW2
auaggaaacuuaaauau

SEQ ID NO: 2113329 - RNA, 14 nt, Staphylococcus aureus subsp. aureus MW2
auaggaaucuuguu

SEQ ID NO: 2113330 - RNA, 16 nt, Staphylococcus aureus subsp. aureus MW2
auagugguaaaaaguu

SEQ ID NO: 2113331 - RNA, 19 nt, Staphylococcus aureus subsp. aureus MW2
auagugcuuguuuauuaca

SEQ ID NO: 2113332 - RNA, 18 nt, Staphylococcus aureus subsp. aureus MW2
auaguuuuucauauucac

SEQ ID NO: 2113333 - RNA, 17 nt, Staphylococcus aureus subsp. aureus MW2
auaguuuuucauauuca

SEQ ID NO: 2113334 - RNA, 15 nt, Staphylococcus aureus subsp. aureus MW2
auaguuucaaugccu

SEQ ID NO: 2113335 - RNA, 16 nt, Staphylococcus aureus subsp. aureus MW2
auaguuguuuauuaua

SEQ ID NO: 2113336 - RNA, 23 nt, Staphylococcus aureus subsp. aureus MW2
auaguuuacggggugcuuuuuau

SEQ ID NO: 2113337 - RNA, 20 nt, Staphylococcus aureus subsp. aureus MW2
auaguugucuuuacauucuu

SEQ ID NO: 2113338 - RNA, 19 nt, Staphylococcus aureus subsp. aureus MW2
auauaagauucauauuuau

SEQ ID NO: 2113339 - RNA, 21 nt, Staphylococcus aureus subsp. aureus MW2
auauaaugguugaauaacacu

SEQ ID NO: 2113340 - RNA, 13 nt, Staphylococcus aureus subsp. aureus MW2
auauaagcaaaga

SEQ ID NO: 2113341 - RNA, 20 nt, Staphylococcus aureus subsp. aureus MW2
auauaagaauuguugaucau

SEQ ID NO: 2113342 - RNA, 15 nt, Staphylococcus aureus subsp. aureus MW2
auauaauuaaacauu

SEQ ID NO: 2113343 - RNA, 16 nt, Staphylococcus aureus subsp. aureus MW2
auauaauguauaaaac

SEQ ID NO: 2113344 - RNA, 17 nt, Staphylococcus aureus subsp. aureus MW2
auauaauguauaaaaca

SEQ ID NO: 2113345 - RNA, 14 nt, Staphylococcus aureus subsp. aureus MW2
auauaauuuauuua

SEQ ID NO: 2113346 - RNA, 18 nt, Staphylococcus aureus subsp. aureus MW2
auauaauuuauaaaaaga

SEQ ID NO: 2113347 - RNA, 13 nt, Staphylococcus aureus subsp. aureus MW2
auauaauuuuaau

SEQ ID NO: 2113348 - RNA, 16 nt, Staphylococcus aureus subsp. aureus MW2
auauacaaauaaacac

SEQ ID NO: 2113349 - RNA, 19 nt, Staphylococcus aureus subsp. aureus MW2
auauaauucuuguuugauu

SEQ ID NO: 2113350 - RNA, 16 nt, Staphylococcus aureus subsp. aureus MW2
auauaaaaucauuaau

SEQ ID NO: 2113351 - RNA, 20 nt, Staphylococcus aureus subsp. aureus MW2
auauaaaaucauuaauaauu

SEQ ID NO: 2113352 - RNA, 15 nt, Staphylococcus aureus subsp. aureus MW2
auauaaaauccuaag

SEQ ID NO: 2113353 - RNA, 13 nt, Staphylococcus aureus subsp. aureus MW2
auauaaaaucauu

SEQ ID NO: 2113354 - RNA, 19 nt, Staphylococcus aureus subsp. aureus MW2
auauaaaacgauaagaauu

SEQ ID NO: 2113355 - RNA, 15 nt, Staphylococcus aureus subsp. aureus MW2
auauaaaaagugaaa

SEQ ID NO: 2113356 - RNA, 18 nt, Staphylococcus aureus subsp. aureus MW2
auauaaaaacaaaagaaa

SEQ ID NO: 2113357 - RNA, 19 nt, Staphylococcus aureus subsp. aureus MW2
auauaacgcuuuaaaucau

SEQ ID NO: 2113358 - RNA, 17 nt, Staphylococcus aureus subsp. aureus MW2
auauaacauuaaaauga

SEQ ID NO: 2113359 - RNA, 23 nt, Staphylococcus aureus subsp. aureus MW2
auauaaccauaguaacaaaauga

SEQ ID NO: 2113360 - RNA, 22 nt, Staphylococcus aureus subsp. aureus MW2
auauaaccgugaugaugugcaa

SEQ ID NO: 2113361 - RNA, 16 nt, Staphylococcus aureus subsp. aureus MW2
auauaaccuauuucau

SEQ ID NO: 2113362 - RNA, 18 nt, Staphylococcus aureus subsp. aureus MW2
auauaaauuaucagaauc

SEQ ID NO: 2113363 - RNA, 15 nt, Staphylococcus aureus subsp. aureus MW2
auuaucguaaaaaaa

SEQ ID NO: 2113364 - RNA, 23 nt, Staphylococcus aureus subsp. aureus MW2
auuauccaaggauguuauaaaau

SEQ ID NO: 2113365 - RNA, 21 nt, Staphylococcus aureus subsp. aureus MW2
auuaucaccuucaaacuuuca

SEQ ID NO: 2113366 - RNA, 18 nt, Staphylococcus aureus subsp. aureus MW2
auuaucaccuucaaacuu

SEQ ID NO: 2113367 - RNA, 13 nt, Staphylococcus aureus subsp. aureus MW2
auuaucaaagaaa

SEQ ID NO: 2113368 - RNA, 14 nt, Staphylococcus aureus subsp. aureus MW2
auuaucaacauaau

SEQ ID NO: 2113369 - RNA, 13 nt, Staphylococcus aureus subsp. aureus MW2
auuaucaacuuua

SEQ ID NO: 2113370 - RNA, 14 nt, Staphylococcus aureus subsp. aureus MW2
auuaucaacuuuau

SEQ ID NO: 2113371 - RNA, 22 nt, Staphylococcus aureus subsp. aureus MW2
auuaucauuacagauaauuauu

SEQ ID NO: 2113372 - RNA, 14 nt, Staphylococcus aureus subsp. aureus MW2
auuaucauuaaauu

SEQ ID NO: 2113373 - RNA, 15 nt, Staphylococcus aureus subsp. aureus MW2
auuaucauaaauaua

SEQ ID NO: 2113374 - RNA, 17 nt, Staphylococcus aureus subsp. aureus MW2
auuaucauaaauauaag

SEQ ID NO: 2113375 - RNA, 20 nt, Staphylococcus aureus subsp. aureus MW2
auuaucuauccauuugguuu

SEQ ID NO: 2113376 - RNA, 13 nt, Staphylococcus aureus subsp. aureus MW2
auuaucuaacuca

SEQ ID NO: 2113377 - RNA, 16 nt, Staphylococcus aureus subsp. aureus MW2
auuaucuaauucuucu

SEQ ID NO: 2113378 - RNA, 15 nt, Staphylococcus aureus subsp. aureus MW2
auuaucuaacucaua

SEQ ID NO: 2113379 - RNA, 22 nt, Staphylococcus aureus subsp. aureus MW2
auuaucuaaagaaaucucuauc

SEQ ID NO: 2113380 - RNA, 15 nt, Staphylococcus aureus subsp. aureus MW2
auuaucuaaagaaau

SEQ ID NO: 2113381 - RNA, 14 nt, Staphylococcus aureus subsp. aureus MW2
auuaucuaaagaaa

SEQ ID NO: 2113382 - RNA, 14 nt, Staphylococcus aureus subsp. aureus MW2
auuaucuguaauua

SEQ ID NO: 2113383 - RNA, 13 nt, Staphylococcus aureus subsp. aureus MW2
auuaucuauauau

SEQ ID NO: 2113384 - RNA, 22 nt, Staphylococcus aureus subsp. aureus MW2
auuaucuuucaucaaauucuca

SEQ ID NO: 2113385 - RNA, 17 nt, Staphylococcus aureus subsp. aureus MW2
auuaucuuuaaauuaca

SEQ ID NO: 2113386 - RNA, 22 nt, Staphylococcus aureus subsp. aureus MW2
auuaucuuuaguauuucaucau

SEQ ID NO: 2113387 - RNA, 17 nt, Staphylococcus aureus subsp. aureus MW2
auuaucuuuaguauuuc

SEQ ID NO: 2113388 - RNA, 20 nt, Staphylococcus aureus subsp. aureus MW2
auuaugauacgcuuuuuaaa

SEQ ID NO: 2113389 - RNA, 13 nt, Staphylococcus aureus subsp. aureus MW2
auuaugacaacau

SEQ ID NO: 2113390 - RNA, 19 nt, Staphylococcus aureus subsp. aureus MW2
auuaugauugcuuauuuau

SEQ ID NO: 2113391 - RNA, 17 nt, Staphylococcus aureus subsp. aureus MW2
auuauucuucauuuaua

SEQ ID NO: 2113392 - RNA, 14 nt, Staphylococcus aureus subsp. aureus MW2
auuauucuuuaauu

SEQ ID NO: 2113393 - RNA, 17 nt, Staphylococcus aureus subsp. aureus MW2
auuauucuuuaauuaaa

SEQ ID NO: 2113394 - RNA, 19 nt, Staphylococcus aureus subsp. aureus MW2
auuauucuuaauuuaaaaa

SEQ ID NO: 2113395 - RNA, 20 nt, Staphylococcus aureus subsp. aureus MW2
auuauugaaaucgauacuaa

SEQ ID NO: 2113396 - RNA, 13 nt, Staphylococcus aureus subsp. aureus MW2
auuauugaaauuu

SEQ ID NO: 2113397 - RNA, 12 nt, Staphylococcus aureus subsp. aureus MW2
auuauugaaguu

SEQ ID NO: 2113398 - RNA, 18 nt, Staphylococcus aureus subsp. aureus MW2
auuauugagaauauuuau

SEQ ID NO: 2113399 - RNA, 20 nt, Staphylococcus aureus subsp. aureus MW2
auuauucauaauauauuaac

SEQ ID NO: 2113400 - RNA, 17 nt, Staphylococcus aureus subsp. aureus MW2
auuauucaaguaaaaca

SEQ ID NO: 2113401 - RNA, 15 nt, Staphylococcus aureus subsp. aureus MW2
auuauuauuuaaauu

SEQ ID NO: 2113402 - RNA, 14 nt, Staphylococcus aureus subsp. aureus MW2
auuauucucuuuau

SEQ ID NO: 2113403 - RNA, 14 nt, Staphylococcus aureus subsp. aureus MW2
auuauucguauuca

SEQ ID NO: 2113404 - RNA, 23 nt, Staphylococcus aureus subsp. aureus MW2
auuauucguauucaaaguuuuca

SEQ ID NO: 2113405 - RNA, 16 nt, Staphylococcus aureus subsp. aureus MW2
auuauuuaaaaugcuu

SEQ ID NO: 2113406 - RNA, 16 nt, Staphylococcus aureus subsp. aureus MW2
auuauuuauucauuau

SEQ ID NO: 2113407 - RNA, 18 nt, Staphylococcus aureus subsp. aureus MW2
auuauuuagauaaaaaau

SEQ ID NO: 2113408 - RNA, 21 nt, Staphylococcus aureus subsp. aureus MW2
auuauuuagauaaaaaauacu

SEQ ID NO: 2113409 - RNA, 17 nt, Staphylococcus aureus subsp. aureus MW2
auuauugguugaaauua

SEQ ID NO: 2113410 - RNA, 20 nt, Staphylococcus aureus subsp. aureus MW2
auuauuaaggggguaauacu

SEQ ID NO: 2113411 - RNA, 22 nt, Staphylococcus aureus subsp. aureus MW2
auuauuaacuguaccugcuaca

SEQ ID NO: 2113412 - RNA, 16 nt, Staphylococcus aureus subsp. aureus MW2
auuauuauaauaaaua

SEQ ID NO: 2113413 - RNA, 14 nt, Staphylococcus aureus subsp. aureus MW2
auuauuacaaucaa

SEQ ID NO: 2113414 - RNA, 22 nt, Staphylococcus aureus subsp. aureus MW2
auuauuacaaucaaaaaacgag

SEQ ID NO: 2113415 - RNA, 21 nt, Staphylococcus aureus subsp. aureus MW2
auuauuaaggggguaauacua

SEQ ID NO: 2113416 - RNA, 13 nt, Staphylococcus aureus subsp. aureus MW2
auuauuaccauau

SEQ ID NO: 2113417 - RNA, 18 nt, Staphylococcus aureus subsp. aureus MW2
auuauuaccuuugcuaaa

SEQ ID NO: 2113418 - RNA, 20 nt, Staphylococcus aureus subsp. aureus MW2
auuaugcauauguaauacaa

SEQ ID NO: 2113419 - RNA, 15 nt, Staphylococcus aureus subsp. aureus MW2
auuaugcuucaaagu

SEQ ID NO: 2113420 - RNA, 14 nt, Staphylococcus aureus subsp. aureus MW2
auuaugcugaaacu

SEQ ID NO: 2113421 - RNA, 19 nt, Staphylococcus aureus subsp. aureus MW2
auuauguauuuuuauuuau

SEQ ID NO: 2113422 - RNA, 16 nt, Staphylococcus aureus subsp. aureus MW2
auuauguaccaaauuu

SEQ ID NO: 2113423 - RNA, 13 nt, Staphylococcus aureus subsp. aureus MW2
auuaugugacaua

SEQ ID NO: 2113424 - RNA, 12 nt, Staphylococcus aureus subsp. aureus MW2
auucaaaauuau

SEQ ID NO: 2113425 - RNA, 14 nt, Staphylococcus aureus subsp. aureus MW2
auucaaaauuauau

SEQ ID NO: 2113426 - RNA, 13 nt, Staphylococcus aureus subsp. aureus MW2
auuauuuuucuca

SEQ ID NO: 2113427 - RNA, 23 nt, Staphylococcus aureus subsp. aureus MW2
auuauuuuugauggucagcaaau

SEQ ID NO: 2113428 - RNA, 13 nt, Staphylococcus aureus subsp. aureus MW2
auucaaaaaaaua

SEQ ID NO: 2113429 - RNA, 16 nt, Staphylococcus aureus subsp. aureus MW2
auuauuuuuauagaua

SEQ ID NO: 2113430 - RNA, 16 nt, Staphylococcus aureus subsp. aureus MW2
auucaaaauaacuuau

SEQ ID NO: 2113431 - RNA, 19 nt, Staphylococcus aureus subsp. aureus MW2
auuauuucgccuuuuuuau

SEQ ID NO: 2113432 - RNA, 17 nt, Staphylococcus aureus subsp. aureus MW2
auuauuugcgauaucag

SEQ ID NO: 2113433 - RNA, 22 nt, Staphylococcus aureus subsp. aureus MW2
auuauuucccuggaaaaugauu

SEQ ID NO: 2113434 - RNA, 14 nt, Staphylococcus aureus subsp. aureus MW2
auuauuuaaaaugc

SEQ ID NO: 2113435 - RNA, 16 nt, Staphylococcus aureus subsp. aureus MW2
auuauuucauuagaaa

SEQ ID NO: 2113436 - RNA, 15 nt, Staphylococcus aureus subsp. aureus MW2
auuauuuuacuuugu

SEQ ID NO: 2113437 - RNA, 18 nt, Staphylococcus aureus subsp. aureus MW2
auuauuuuacuuuguaau

SEQ ID NO: 2113438 - RNA, 18 nt, Staphylococcus aureus subsp. aureus MW2
auucaagcaucauuuuuc

SEQ ID NO: 2113439 - RNA, 16 nt, Staphylococcus aureus subsp. aureus MW2
auucaagcaucauuuu

SEQ ID NO: 2113440 - RNA, 14 nt, Staphylococcus aureus subsp. aureus MW2
auucaacuuguuaa

SEQ ID NO: 2113441 - RNA, 21 nt, Staphylococcus aureus subsp. aureus MW2
auucaaauaaaucaaacuuuu

SEQ ID NO: 2113442 - RNA, 23 nt, Staphylococcus aureus subsp. aureus MW2
auucaaauaaaucaaacuuuuca

SEQ ID NO: 2113443 - RNA, 20 nt, Staphylococcus aureus subsp. aureus MW2
auucaaaguuuucauuuaac

SEQ ID NO: 2113444 - RNA, 19 nt, Staphylococcus aureus subsp. aureus MW2
auucaaauaaaucaaacuu

SEQ ID NO: 2113445 - RNA, 13 nt, Staphylococcus aureus subsp. aureus MW2
auucaaaucauaa

SEQ ID NO: 2113446 - RNA, 12 nt, Staphylococcus aureus subsp. aureus MW2
auucaaccaauu

SEQ ID NO: 2113447 - RNA, 22 nt, Staphylococcus aureus subsp. aureus MW2
auucaacguauaagugauauca

SEQ ID NO: 2113448 - RNA, 21 nt, Staphylococcus aureus subsp. aureus MW2
auucaacgaaagugauuuauu

SEQ ID NO: 2113449 - RNA, 22 nt, Staphylococcus aureus subsp. aureus MW2
auucaccaguuaccucgaguuu

SEQ ID NO: 2113450 - RNA, 23 nt, Staphylococcus aureus subsp. aureus MW2
auucaccguaugauggaaucauu

SEQ ID NO: 2113451 - RNA, 21 nt, Staphylococcus aureus subsp. aureus MW2
auucacauagccucuuaaaau

SEQ ID NO: 2113452 - RNA, 22 nt, Staphylococcus aureus subsp. aureus MW2
auucacauagccucuuaaaaua

SEQ ID NO: 2113453 - RNA, 16 nt, Staphylococcus aureus subsp. aureus MW2
auucaccaauuaggau

SEQ ID NO: 2113454 - RNA, 19 nt, Staphylococcus aureus subsp. aureus MW2
auucaccaauuaggauucg

SEQ ID NO: 2113455 - RNA, 14 nt, Staphylococcus aureus subsp. aureus MW2
auucaauguuuaau

SEQ ID NO: 2113456 - RNA, 21 nt, Staphylococcus aureus subsp. aureus MW2
auucaauguaucaccuaauug

SEQ ID NO: 2113457 - RNA, 14 nt, Staphylococcus aureus subsp. aureus MW2
auucaauauuuuuu

SEQ ID NO: 2113458 - RNA, 15 nt, Staphylococcus aureus subsp. aureus MW2
auucaaugauuuuua

SEQ ID NO: 2113459 - RNA, 13 nt, Staphylococcus aureus subsp. aureus MW2
auucaauuucuca

SEQ ID NO: 2113460 - RNA, 14 nt, Staphylococcus aureus subsp. aureus MW2
auucaauuucucac

SEQ ID NO: 2113461 - RNA, 20 nt, Staphylococcus aureus subsp. aureus MW2
auucaauuucucaccagcuc

SEQ ID NO: 2113462 - RNA, 20 nt, Staphylococcus aureus subsp. aureus MW2
auucacgcguucaaauguug

SEQ ID NO: 2113463 - RNA, 22 nt, Staphylococcus aureus subsp. aureus MW2
auucacucuguaauaaagaaua

SEQ ID NO: 2113464 - RNA, 18 nt, Staphylococcus aureus subsp. aureus MW2
auuacacccuuuaaauuu

SEQ ID NO: 2113465 - RNA, 22 nt, Staphylococcus aureus subsp. aureus MW2
auuacacccuuuaaauuuaacu

SEQ ID NO: 2113466 - RNA, 19 nt, Staphylococcus aureus subsp. aureus MW2
auuacacgcauuacuuuag

SEQ ID NO: 2113467 - RNA, 17 nt, Staphylococcus aureus subsp. aureus MW2
auuacacuuuaaauaca

SEQ ID NO: 2113468 - RNA, 15 nt, Staphylococcus aureus subsp. aureus MW2
auuacaaucaaaaaa

SEQ ID NO: 2113469 - RNA, 15 nt, Staphylococcus aureus subsp. aureus MW2
auuacaaaaguauga

SEQ ID NO: 2113470 - RNA, 15 nt, Staphylococcus aureus subsp. aureus MW2
auuacaaacauaauc

SEQ ID NO: 2113471 - RNA, 12 nt, Staphylococcus aureus subsp. aureus MW2
auuacaaacauu

SEQ ID NO: 2113472 - RNA, 21 nt, Staphylococcus aureus subsp. aureus MW2
auuacaaauacaguuaucacc

SEQ ID NO: 2113473 - RNA, 13 nt, Staphylococcus aureus subsp. aureus MW2
auuacaaaucaug

SEQ ID NO: 2113474 - RNA, 23 nt, Staphylococcus aureus subsp. aureus MW2
auuacaugcaccuuuacaacaua

SEQ ID NO: 2113475 - RNA, 21 nt, Staphylococcus aureus subsp. aureus MW2
auuacauguuggcauaaccug

SEQ ID NO: 2113476 - RNA, 18 nt, Staphylococcus aureus subsp. aureus MW2
auuacaucgacaauuuuc

SEQ ID NO: 2113477 - RNA, 21 nt, Staphylococcus aureus subsp. aureus MW2
auuacaguuucuauauuuuau

SEQ ID NO: 2113478 - RNA, 14 nt, Staphylococcus aureus subsp. aureus MW2
auuacauaauuuau

SEQ ID NO: 2113479 - RNA, 22 nt, Staphylococcus aureus subsp. aureus MW2
auuacagcgugauucaucuauu

SEQ ID NO: 2113480 - RNA, 24 nt, Staphylococcus aureus subsp. aureus MW2
auuacaggaaauccgcauaaauua

SEQ ID NO: 2113481 - RNA, 16 nt, Staphylococcus aureus subsp. aureus MW2
auuacaguauuugacg

SEQ ID NO: 2113482 - RNA, 13 nt, Staphylococcus aureus subsp. aureus MW2
auuaauuuaaaaa

SEQ ID NO: 2113483 - RNA, 15 nt, Staphylococcus aureus subsp. aureus MW2
auuaauuuaaaaaug

SEQ ID NO: 2113484 - RNA, 13 nt, Staphylococcus aureus subsp. aureus MW2
auuaauuugauaa

SEQ ID NO: 2113485 - RNA, 14 nt, Staphylococcus aureus subsp. aureus MW2
auuaauuugauaaa

SEQ ID NO: 2113486 - RNA, 11 nt, Staphylococcus aureus subsp. aureus MW2
auuaauuuuuc

SEQ ID NO: 2113487 - RNA, 14 nt, Staphylococcus aureus subsp. aureus MW2
auuaauuuucucaa

SEQ ID NO: 2113488 - RNA, 14 nt, Staphylococcus aureus subsp. aureus MW2
auuaauuaaagauu

SEQ ID NO: 2113489 - RNA, 21 nt, Staphylococcus aureus subsp. aureus MW2
auuaauuauugagaauauuua

SEQ ID NO: 2113490 - RNA, 13 nt, Staphylococcus aureus subsp. aureus MW2
auuaauugaaaaa

SEQ ID NO: 2113491 - RNA, 21 nt, Staphylococcus aureus subsp. aureus MW2
auuaauuacuguaaauaugaa

SEQ ID NO: 2113492 - RNA, 22 nt, Staphylococcus aureus subsp. aureus MW2
auuaauuacuuucauuguaaau

SEQ ID NO: 2113493 - RNA, 12 nt, Staphylococcus aureus subsp. aureus MW2
auuaauuaucau

SEQ ID NO: 2113494 - RNA, 15 nt, Staphylococcus aureus subsp. aureus MW2
auuaauuaucauaaa

SEQ ID NO: 2113495 - RNA, 14 nt, Staphylococcus aureus subsp. aureus MW2
auuaauguaaugau

SEQ ID NO: 2113496 - RNA, 17 nt, Staphylococcus aureus subsp. aureus MW2
auuacgcucauaugucu

SEQ ID NO: 2113497 - RNA, 17 nt, Staphylococcus aureus subsp. aureus MW2
auuacgucauaaaauac

SEQ ID NO: 2113498 - RNA, 16 nt, Staphylococcus aureus subsp. aureus MW2
auuacguaucuuuaca

SEQ ID NO: 2113499 - RNA, 20 nt, Staphylococcus aureus subsp. aureus MW2
auuacguaucuuuacaacag

SEQ ID NO: 2113500 - RNA, 17 nt, Staphylococcus aureus subsp. aureus MW2
auuacuaucuucaucau

SEQ ID NO: 2113501 - RNA, 17 nt, Staphylococcus aureus subsp. aureus MW2
auuacuauauuuaaauu

SEQ ID NO: 2113502 - RNA, 22 nt, Staphylococcus aureus subsp. aureus MW2
auuacuaaccuauuaaaauaaa

SEQ ID NO: 2113503 - RNA, 19 nt, Staphylococcus aureus subsp. aureus MW2
auuacuacauaauuuauca

SEQ ID NO: 2113504 - RNA, 18 nt, Staphylococcus aureus subsp. aureus MW2
auuacuaaaacaaauuca

SEQ ID NO: 2113505 - RNA, 15 nt, Staphylococcus aureus subsp. aureus MW2
auuacuaaaacaaau

SEQ ID NO: 2113506 - RNA, 13 nt, Staphylococcus aureus subsp. aureus MW2
auuacuaaccuau

SEQ ID NO: 2113507 - RNA, 16 nt, Staphylococcus aureus subsp. aureus MW2
auuacguuuacuacaa

SEQ ID NO: 2113508 - RNA, 17 nt, Staphylococcus aureus subsp. aureus MW2
auuacguuuacuacaaa

SEQ ID NO: 2113509 - RNA, 20 nt, Staphylococcus aureus subsp. aureus MW2
auuacguucuaauaauuuaa

SEQ ID NO: 2113510 - RNA, 23 nt, Staphylococcus aureus subsp. aureus MW2
auuacguucuaauaauuuaaugu

SEQ ID NO: 2113511 - RNA, 14 nt, Staphylococcus aureus subsp. aureus MW2
auuacauuuuaugu

SEQ ID NO: 2113512 - RNA, 15 nt, Staphylococcus aureus subsp. aureus MW2
auuaccaaugaauaa

SEQ ID NO: 2113513 - RNA, 13 nt, Staphylococcus aureus subsp. aureus MW2
auuaccagcaauu

SEQ ID NO: 2113514 - RNA, 23 nt, Staphylococcus aureus subsp. aureus MW2
auuaccauucaucgucucacuua

SEQ ID NO: 2113515 - RNA, 21 nt, Staphylococcus aureus subsp. aureus MW2
auuacccacaucuuuuuaaaa

SEQ ID NO: 2113516 - RNA, 22 nt, Staphylococcus aureus subsp. aureus MW2
auuacccacaucuuuuuaaaag

SEQ ID NO: 2113517 - RNA, 15 nt, Staphylococcus aureus subsp. aureus MW2
auuaccuuuccauuc

SEQ ID NO: 2113518 - RNA, 14 nt, Staphylococcus aureus subsp. aureus MW2
auuaccuacaauaa

SEQ ID NO: 2113519 - RNA, 22 nt, Staphylococcus aureus subsp. aureus MW2
auuagauuuuaugcuuuacuug

SEQ ID NO: 2113520 - RNA, 14 nt, Staphylococcus aureus subsp. aureus MW2
auuagcgaaaacua

SEQ ID NO: 2113521 - RNA, 20 nt, Staphylococcus aureus subsp. aureus MW2
auuagcgaaaacuaaaggga

SEQ ID NO: 2113522 - RNA, 15 nt, Staphylococcus aureus subsp. aureus MW2
auuagcgaaaaccuc

SEQ ID NO: 2113523 - RNA, 14 nt, Staphylococcus aureus subsp. aureus MW2
auuagccauuucaa

SEQ ID NO: 2113524 - RNA, 15 nt, Staphylococcus aureus subsp. aureus MW2
auuagcuaauucacu

SEQ ID NO: 2113525 - RNA, 22 nt, Staphylococcus aureus subsp. aureus MW2
auuagcuaugaacgaaucuaua

SEQ ID NO: 2113526 - RNA, 13 nt, Staphylococcus aureus subsp. aureus MW2
auuagauuuuaug

SEQ ID NO: 2113527 - RNA, 16 nt, Staphylococcus aureus subsp. aureus MW2
auuagaugauauuuaa

SEQ ID NO: 2113528 - RNA, 19 nt, Staphylococcus aureus subsp. aureus MW2
auuagauauauuugaaagg

SEQ ID NO: 2113529 - RNA, 18 nt, Staphylococcus aureus subsp. aureus MW2
auuagaugaaauggaaag

SEQ ID NO: 2113530 - RNA, 14 nt, Staphylococcus aureus subsp. aureus MW2
auuagauacuucuu

SEQ ID NO: 2113531 - RNA, 14 nt, Staphylococcus aureus subsp. aureus MW2
auuagauaaaacaa

SEQ ID NO: 2113532 - RNA, 22 nt, Staphylococcus aureus subsp. aureus MW2
auuagacuuucuuaauugaauu

SEQ ID NO: 2113533 - RNA, 14 nt, Staphylococcus aureus subsp. aureus MW2
auuagaauuuaguu

SEQ ID NO: 2113534 - RNA, 21 nt, Staphylococcus aureus subsp. aureus MW2
auuagagggcacgagaaaugu

SEQ ID NO: 2113535 - RNA, 23 nt, Staphylococcus aureus subsp. aureus MW2
auuagagggcacgagaaauguca

SEQ ID NO: 2113536 - RNA, 14 nt, Staphylococcus aureus subsp. aureus MW2
auuagaauauaugu

SEQ ID NO: 2113537 - RNA, 21 nt, Staphylococcus aureus subsp. aureus MW2
auuagaaaaggcucauuuguu

SEQ ID NO: 2113538 - RNA, 17 nt, Staphylococcus aureus subsp. aureus MW2
auuacuuuggaaauuua

SEQ ID NO: 2113539 - RNA, 21 nt, Staphylococcus aureus subsp. aureus MW2
auuacuuucugcccacuuaau

SEQ ID NO: 2113540 - RNA, 17 nt, Staphylococcus aureus subsp. aureus MW2
auuacuugcacaccagu

SEQ ID NO: 2113541 - RNA, 15 nt, Staphylococcus aureus subsp. aureus MW2
auuacuguuugcuuu

SEQ ID NO: 2113542 - RNA, 21 nt, Staphylococcus aureus subsp. aureus MW2
auuacuguuugcuuuaucaau

SEQ ID NO: 2113543 - RNA, 22 nt, Staphylococcus aureus subsp. aureus MW2
auuacuuauuucuuuucauuau

SEQ ID NO: 2113544 - RNA, 17 nt, Staphylococcus aureus subsp. aureus MW2
auuacuuauucaaaugu

SEQ ID NO: 2113545 - RNA, 18 nt, Staphylococcus aureus subsp. aureus MW2
auuacuuauuucuuuuca

SEQ ID NO: 2113546 - RNA, 18 nt, Staphylococcus aureus subsp. aureus MW2
auuacuugaauauuauuc

SEQ ID NO: 2113547 - RNA, 19 nt, Staphylococcus aureus subsp. aureus MW2
auuacuugaauauuauuca

SEQ ID NO: 2113548 - RNA, 13 nt, Staphylococcus aureus subsp. aureus MW2
auuacuugaauau

SEQ ID NO: 2113549 - RNA, 15 nt, Staphylococcus aureus subsp. aureus MW2
auuacugauuguuaa

SEQ ID NO: 2113550 - RNA, 17 nt, Staphylococcus aureus subsp. aureus MW2
auuacuguaaauaugaa

SEQ ID NO: 2113551 - RNA, 19 nt, Staphylococcus aureus subsp. aureus MW2
auuauauacucaccacauu

SEQ ID NO: 2113552 - RNA, 16 nt, Staphylococcus aureus subsp. aureus MW2
auuauauaauucuuca

SEQ ID NO: 2113553 - RNA, 19 nt, Staphylococcus aureus subsp. aureus MW2
auuauagucuuaaacauaa

SEQ ID NO: 2113554 - RNA, 20 nt, Staphylococcus aureus subsp. aureus MW2
auuauagucuuaaacauaac

SEQ ID NO: 2113555 - RNA, 13 nt, Staphylococcus aureus subsp. aureus MW2
auuauauauauua

SEQ ID NO: 2113556 - RNA, 13 nt, Staphylococcus aureus subsp. aureus MW2
auuauacacuuuu

SEQ ID NO: 2113557 - RNA, 16 nt, Staphylococcus aureus subsp. aureus MW2
auuauagacauaagca

SEQ ID NO: 2113558 - RNA, 15 nt, Staphylococcus aureus subsp. aureus MW2
auuauacuuuacauu

SEQ ID NO: 2113559 - RNA, 19 nt, Staphylococcus aureus subsp. aureus MW2
auuauagggcuguuuuuua

SEQ ID NO: 2113560 - RNA, 21 nt, Staphylococcus aureus subsp. aureus MW2
auuauagggcuguuuuuuaau

SEQ ID NO: 2113561 - RNA, 21 nt, Staphylococcus aureus subsp. aureus MW2
auuauagaugacuguagaaaa

SEQ ID NO: 2113562 - RNA, 23 nt, Staphylococcus aureus subsp. aureus MW2
auuauagcagguggcauccauau

SEQ ID NO: 2113563 - RNA, 14 nt, Staphylococcus aureus subsp. aureus MW2
auuauaaaauaaau

SEQ ID NO: 2113564 - RNA, 17 nt, Staphylococcus aureus subsp. aureus MW2
auuauaauuuuguuuca

SEQ ID NO: 2113565 - RNA, 21 nt, Staphylococcus aureus subsp. aureus MW2
auuauaaguugcauauaaaaa

SEQ ID NO: 2113566 - RNA, 20 nt, Staphylococcus aureus subsp. aureus MW2
auuaguacuaaaccgauuaa

SEQ ID NO: 2113567 - RNA, 15 nt, Staphylococcus aureus subsp. aureus MW2
auuaguauaauuuau

SEQ ID NO: 2113568 - RNA, 13 nt, Staphylococcus aureus subsp. aureus MW2
auuaguaaugacu

SEQ ID NO: 2113569 - RNA, 19 nt, Staphylococcus aureus subsp. aureus MW2
auuaguaauuuuuaaaucu

SEQ ID NO: 2113570 - RNA, 20 nt, Staphylococcus aureus subsp. aureus MW2
auuaggucuacgaucaaaau

SEQ ID NO: 2113571 - RNA, 17 nt, Staphylococcus aureus subsp. aureus MW2
auuagggggcauauuaa

SEQ ID NO: 2113572 - RNA, 23 nt, Staphylococcus aureus subsp. aureus MW2
auuaggauuaacauaacuagcaa

SEQ ID NO: 2113573 - RNA, 14 nt, Staphylococcus aureus subsp. aureus MW2
auuaggauguucag

SEQ ID NO: 2113574 - RNA, 15 nt, Staphylococcus aureus subsp. aureus MW2
auuaguuuuuaaaau

SEQ ID NO: 2113575 - RNA, 18 nt, Staphylococcus aureus subsp. aureus MW2
auuaguuugaucauuuac

SEQ ID NO: 2113576 - RNA, 20 nt, Staphylococcus aureus subsp. aureus MW2
auuaguucuguugauauuuc

SEQ ID NO: 2113577 - RNA, 16 nt, Staphylococcus aureus subsp. aureus MW2
auuaguuuaugucuca

SEQ ID NO: 2113578 - RNA, 16 nt, Staphylococcus aureus subsp. aureus MW2
auuaguuuuuaaaauu

SEQ ID NO: 2113579 - RNA, 12 nt, Staphylococcus aureus subsp. aureus MW2
auuauaaaauaa

SEQ ID NO: 2113580 - RNA, 13 nt, Staphylococcus aureus subsp. aureus MW2
auuaguuauacua

SEQ ID NO: 2113581 - RNA, 15 nt, Staphylococcus aureus subsp. aureus MW2
auuagucaucaaccu

SEQ ID NO: 2113582 - RNA, 13 nt, Staphylococcus aureus subsp. aureus MW2
auuaguaugacuu

SEQ ID NO: 2113583 - RNA, 19 nt, Staphylococcus aureus subsp. aureus MW2
auuaguaugacuuaccuaa

SEQ ID NO: 2113584 - RNA, 15 nt, Staphylococcus aureus subsp. aureus MW2
auguucagaaauuua

SEQ ID NO: 2113585 - RNA, 18 nt, Staphylococcus aureus subsp. aureus MW2
auguucagaacuacaauu

SEQ ID NO: 2113586 - RNA, 16 nt, Staphylococcus aureus subsp. aureus MW2
auguuccauauaaccu

SEQ ID NO: 2113587 - RNA, 13 nt, Staphylococcus aureus subsp. aureus MW2
auguuuaaacauu

SEQ ID NO: 2113588 - RNA, 19 nt, Staphylococcus aureus subsp. aureus MW2
auguuguuuaaauuucaaa

SEQ ID NO: 2113589 - RNA, 21 nt, Staphylococcus aureus subsp. aureus MW2
auguuguuuaaauuucaaaau

SEQ ID NO: 2113590 - RNA, 14 nt, Staphylococcus aureus subsp. aureus MW2
auguuuaaaaaacu

SEQ ID NO: 2113591 - RNA, 15 nt, Staphylococcus aureus subsp. aureus MW2
auguuggggccccgc

SEQ ID NO: 2113592 - RNA, 18 nt, Staphylococcus aureus subsp. aureus MW2
auguuugcaacauauuuu

SEQ ID NO: 2113593 - RNA, 19 nt, Staphylococcus aureus subsp. aureus MW2
auguuugauucuaaauaau

SEQ ID NO: 2113594 - RNA, 15 nt, Staphylococcus aureus subsp. aureus MW2
auguuugauucuaaa

SEQ ID NO: 2113595 - RNA, 16 nt, Staphylococcus aureus subsp. aureus MW2
auguuuggaugaacaa

SEQ ID NO: 2113596 - RNA, 20 nt, Staphylococcus aureus subsp. aureus MW2
auguuugcaacauauuuuca

SEQ ID NO: 2113597 - RNA, 18 nt, Staphylococcus aureus subsp. aureus MW2
auguuuguaaaucaagug

SEQ ID NO: 2113598 - RNA, 17 nt, Staphylococcus aureus subsp. aureus MW2
auguuuugguacauaaa

SEQ ID NO: 2113599 - RNA, 21 nt, Staphylococcus aureus subsp. aureus MW2
auguuugaagaccuucuaaaa

SEQ ID NO: 2113600 - RNA, 14 nt, Staphylococcus aureus subsp. aureus MW2
auguuuaaacauuu

SEQ ID NO: 2113601 - RNA, 20 nt, Staphylococcus aureus subsp. aureus MW2
auguuuaagacuauaaugaa

SEQ ID NO: 2113602 - RNA, 21 nt, Staphylococcus aureus subsp. aureus MW2
auguuuaagacuauaaugaau

SEQ ID NO: 2113603 - RNA, 13 nt, Staphylococcus aureus subsp. aureus MW2
auguuuaauguau

SEQ ID NO: 2113604 - RNA, 12 nt, Staphylococcus aureus subsp. aureus MW2
auguuuaauaau

SEQ ID NO: 2113605 - RNA, 20 nt, Staphylococcus aureus subsp. aureus MW2
auguuuaauuugauuaaauu

SEQ ID NO: 2113606 - RNA, 14 nt, Staphylococcus aureus subsp. aureus MW2
auguuuaauuuucu

SEQ ID NO: 2113607 - RNA, 17 nt, Staphylococcus aureus subsp. aureus MW2
auguuuaauuuucuaaa

SEQ ID NO: 2113608 - RNA, 14 nt, Staphylococcus aureus subsp. aureus MW2
auguuuaugacaaa

SEQ ID NO: 2113609 - RNA, 23 nt, Staphylococcus aureus subsp. aureus MW2
auuaaacauauuuuuugauauaa

SEQ ID NO: 2113610 - RNA, 20 nt, Staphylococcus aureus subsp. aureus MW2
auuaaacauuuagauuucau

SEQ ID NO: 2113611 - RNA, 20 nt, Staphylococcus aureus subsp. aureus MW2
auuaaagcaucgaacaaucg

SEQ ID NO: 2113612 - RNA, 20 nt, Staphylococcus aureus subsp. aureus MW2
auuaaacuuaagaauacaug

SEQ ID NO: 2113613 - RNA, 13 nt, Staphylococcus aureus subsp. aureus MW2
auuaaauaacuca

SEQ ID NO: 2113614 - RNA, 20 nt, Staphylococcus aureus subsp. aureus MW2
auuaaagcuaucuucagauu

SEQ ID NO: 2113615 - RNA, 19 nt, Staphylococcus aureus subsp. aureus MW2
auuaaacucaaaaagccaa

SEQ ID NO: 2113616 - RNA, 14 nt, Staphylococcus aureus subsp. aureus MW2
auuaaaguaaaaua

SEQ ID NO: 2113617 - RNA, 20 nt, Staphylococcus aureus subsp. aureus MW2
auuaaauacgccaaauacua

SEQ ID NO: 2113618 - RNA, 11 nt, Staphylococcus aureus subsp. aureus MW2
auuaaauagau

SEQ ID NO: 2113619 - RNA, 22 nt, Staphylococcus aureus subsp. aureus MW2
auuaaauauuuaaccuuuaaaa

SEQ ID NO: 2113620 - RNA, 16 nt, Staphylococcus aureus subsp. aureus MW2
auuaaaucgauuaaga

SEQ ID NO: 2113621 - RNA, 22 nt, Staphylococcus aureus subsp. aureus MW2
auuaaaaaacaauaaaauuacu

SEQ ID NO: 2113622 - RNA, 19 nt, Staphylococcus aureus subsp. aureus MW2
auuaaaaaacaauaaaauu

SEQ ID NO: 2113623 - RNA, 12 nt, Staphylococcus aureus subsp. aureus MW2
auuaaaaacacc

SEQ ID NO: 2113624 - RNA, 15 nt, Staphylococcus aureus subsp. aureus MW2
auuaaaaaucaaaga

SEQ ID NO: 2113625 - RNA, 14 nt, Staphylococcus aureus subsp. aureus MW2
auuaaaaauccuca

SEQ ID NO: 2113626 - RNA, 16 nt, Staphylococcus aureus subsp. aureus MW2
auguuuuuauuauaca

SEQ ID NO: 2113627 - RNA, 16 nt, Staphylococcus aureus subsp. aureus MW2
auuaaaaaacaauaaa

SEQ ID NO: 2113628 - RNA, 17 nt, Staphylococcus aureus subsp. aureus MW2
auuaaaauaauuaaacu

SEQ ID NO: 2113629 - RNA, 21 nt, Staphylococcus aureus subsp. aureus MW2
auuaaaauuacgguuugcuuu

SEQ ID NO: 2113630 - RNA, 13 nt, Staphylococcus aureus subsp. aureus MW2
auuaaaaugcuuu

SEQ ID NO: 2113631 - RNA, 12 nt, Staphylococcus aureus subsp. aureus MW2
auuaaaaugaua

SEQ ID NO: 2113632 - RNA, 23 nt, Staphylococcus aureus subsp. aureus MW2
auuaaaaauuucgccucaucuaa

SEQ ID NO: 2113633 - RNA, 20 nt, Staphylococcus aureus subsp. aureus MW2
auuaaaaguguugacuuuau

SEQ ID NO: 2113634 - RNA, 18 nt, Staphylococcus aureus subsp. aureus MW2
auuaaaagaguacauuua

SEQ ID NO: 2113635 - RNA, 17 nt, Staphylococcus aureus subsp. aureus MW2
auuaaguacuuuuacaa

SEQ ID NO: 2113636 - RNA, 17 nt, Staphylococcus aureus subsp. aureus MW2
auuaaguaauagcaacc

SEQ ID NO: 2113637 - RNA, 15 nt, Staphylococcus aureus subsp. aureus MW2
auuaaguucuuaggc

SEQ ID NO: 2113638 - RNA, 19 nt, Staphylococcus aureus subsp. aureus MW2
auuaagcuugaaacaaggu

SEQ ID NO: 2113639 - RNA, 14 nt, Staphylococcus aureus subsp. aureus MW2
auuaagcuuuguuu

SEQ ID NO: 2113640 - RNA, 16 nt, Staphylococcus aureus subsp. aureus MW2
auuaaggcuuuaguag

SEQ ID NO: 2113641 - RNA, 12 nt, Staphylococcus aureus subsp. aureus MW2
auuaauagagac

SEQ ID NO: 2113642 - RNA, 18 nt, Staphylococcus aureus subsp. aureus MW2
auuaauaacauccccaaa

SEQ ID NO: 2113643 - RNA, 16 nt, Staphylococcus aureus subsp. aureus MW2
auuaauccacaaauaa

SEQ ID NO: 2113644 - RNA, 18 nt, Staphylococcus aureus subsp. aureus MW2
auuaauccacaaauaaca

SEQ ID NO: 2113645 - RNA, 13 nt, Staphylococcus aureus subsp. aureus MW2
auuaaucaaauau

SEQ ID NO: 2113646 - RNA, 20 nt, Staphylococcus aureus subsp. aureus MW2
auuaauagagaaaaaauaaa

SEQ ID NO: 2113647 - RNA, 20 nt, Staphylococcus aureus subsp. aureus MW2
auuaauaggauuauuaucaa

SEQ ID NO: 2113648 - RNA, 20 nt, Staphylococcus aureus subsp. aureus MW2
auuaauauaaauaucaauug

SEQ ID NO: 2113649 - RNA, 17 nt, Staphylococcus aureus subsp. aureus MW2
auuaauauaaauaucaa

SEQ ID NO: 2113650 - RNA, 15 nt, Staphylococcus aureus subsp. aureus MW2
auuaauauauauacc

SEQ ID NO: 2113651 - RNA, 14 nt, Staphylococcus aureus subsp. aureus MW2
auuaauauugagac

SEQ ID NO: 2113652 - RNA, 18 nt, Staphylococcus aureus subsp. aureus MW2
auuaauauugagacuauu

SEQ ID NO: 2113653 - RNA, 16 nt, Staphylococcus aureus subsp. aureus MW2
auuaaugaaauaccua

SEQ ID NO: 2113654 - RNA, 15 nt, Staphylococcus aureus subsp. aureus MW2
auuaaucuguaaugc

SEQ ID NO: 2113655 - RNA, 20 nt, Staphylococcus aureus subsp. aureus MW2
auuaaugcucuauauaucca

SEQ ID NO: 2113656 - RNA, 15 nt, Staphylococcus aureus subsp. aureus MW2
auuaauggcaacuaa

SEQ ID NO: 2113657 - RNA, 21 nt, Staphylococcus aureus subsp. aureus MW2
auuaaugauucaccguaugau

SEQ ID NO: 2113658 - RNA, 11 nt, Staphylococcus aureus subsp. aureus MW2
auuaaauuuug

SEQ ID NO: 2113659 - RNA, 13 nt, Staphylococcus aureus subsp. aureus MW2
auuaaauuucaaa

SEQ ID NO: 2113660 - RNA, 21 nt, Staphylococcus aureus subsp. aureus MW2
auuaaauuucaaauauaaaaa

SEQ ID NO: 2113661 - RNA, 20 nt, Staphylococcus aureus subsp. aureus MW2
auuaaaucuucuaguaauuc

SEQ ID NO: 2113662 - RNA, 18 nt, Staphylococcus aureus subsp. aureus MW2
auuaaaucguauauuaaa

SEQ ID NO: 2113663 - RNA, 16 nt, Staphylococcus aureus subsp. aureus MW2
auuaaaucuuuauaaa

SEQ ID NO: 2113664 - RNA, 19 nt, Staphylococcus aureus subsp. aureus MW2
auuaaauuauauguuuuua

SEQ ID NO: 2113665 - RNA, 21 nt, Staphylococcus aureus subsp. aureus MW2
auuaaauucaucuugcaagua

SEQ ID NO: 2113666 - RNA, 17 nt, Staphylococcus aureus subsp. aureus MW2
auuaacaauauuaaauu

SEQ ID NO: 2113667 - RNA, 21 nt, Staphylococcus aureus subsp. aureus MW2
auuaacaccagauaucauaau

SEQ ID NO: 2113668 - RNA, 22 nt, Staphylococcus aureus subsp. aureus MW2
auuaacaaggccugcaucaccu

SEQ ID NO: 2113669 - RNA, 16 nt, Staphylococcus aureus subsp. aureus MW2
auuaacaacaaauaua

SEQ ID NO: 2113670 - RNA, 17 nt, Staphylococcus aureus subsp. aureus MW2
auuaacaacaaauauaa

SEQ ID NO: 2113671 - RNA, 20 nt, Staphylococcus aureus subsp. aureus MW2
auuaaccauuucuuuuuuca

SEQ ID NO: 2113672 - RNA, 13 nt, Staphylococcus aureus subsp. aureus MW2
auuaaccccuuca

SEQ ID NO: 2113673 - RNA, 14 nt, Staphylococcus aureus subsp. aureus MW2
auuaaccccuucaa

SEQ ID NO: 2113674 - RNA, 15 nt, Staphylococcus aureus subsp. aureus MW2
auuaaccccuucaaa

SEQ ID NO: 2113675 - RNA, 14 nt, Staphylococcus aureus subsp. aureus MW2
auuaacauuaucca

SEQ ID NO: 2113676 - RNA, 11 nt, Staphylococcus aureus subsp. aureus MW2
auuaacaucau

SEQ ID NO: 2113677 - RNA, 15 nt, Staphylococcus aureus subsp. aureus MW2
auuaagaaaaucauu

SEQ ID NO: 2113678 - RNA, 16 nt, Staphylococcus aureus subsp. aureus MW2
auuaacuugauaucau

SEQ ID NO: 2113679 - RNA, 22 nt, Staphylococcus aureus subsp. aureus MW2
auuaacuguuagacuugguuac

SEQ ID NO: 2113680 - RNA, 16 nt, Staphylococcus aureus subsp. aureus MW2
auuaagaugaaauacu

SEQ ID NO: 2113681 - RNA, 17 nt, Staphylococcus aureus subsp. aureus MW2
auuaagaugaaauacuu

SEQ ID NO: 2113682 - RNA, 17 nt, Staphylococcus aureus subsp. aureus MW2
auuaagauguauaugaa

SEQ ID NO: 2113683 - RNA, 15 nt, Staphylococcus aureus subsp. aureus MW2
auuaacuaauaacua

SEQ ID NO: 2113684 - RNA, 20 nt, Staphylococcus aureus subsp. aureus MW2
auuaacuuaaaauuuaaaua

SEQ ID NO: 2113685 - RNA, 18 nt, Staphylococcus aureus subsp. aureus MW2
auuaacuuaaaauuuaaa

SEQ ID NO: 2113686 - RNA, 21 nt, Staphylococcus aureus subsp. aureus MW2
auuaacuuacuuuuguaaaaa

SEQ ID NO: 2113687 - RNA, 20 nt, Staphylococcus aureus subsp. aureus MW2
auuaacuguguauggcauaa

SEQ ID NO: 2113688 - RNA, 18 nt, Staphylococcus aureus subsp. aureus MW2
auggucuuuuaauauuuu

SEQ ID NO: 2113689 - RNA, 19 nt, Staphylococcus aureus subsp. aureus MW2
auggucuuuuaauauuuuc

SEQ ID NO: 2113690 - RNA, 14 nt, Staphylococcus aureus subsp. aureus MW2
augguguugcauua

SEQ ID NO: 2113691 - RNA, 12 nt, Staphylococcus aureus subsp. aureus MW2
augguguggugu

SEQ ID NO: 2113692 - RNA, 22 nt, Staphylococcus aureus subsp. aureus MW2
augguuacccuuuuucaaagau

SEQ ID NO: 2113693 - RNA, 21 nt, Staphylococcus aureus subsp. aureus MW2
augguaucuaaaugugaaaga

SEQ ID NO: 2113694 - RNA, 19 nt, Staphylococcus aureus subsp. aureus MW2
augguaguuagguaaaaau

SEQ ID NO: 2113695 - RNA, 16 nt, Staphylococcus aureus subsp. aureus MW2
augggauggugguuau

SEQ ID NO: 2113696 - RNA, 17 nt, Staphylococcus aureus subsp. aureus MW2
augggccccaacacaga

SEQ ID NO: 2113697 - RNA, 18 nt, Staphylococcus aureus subsp. aureus MW2
augguaaguauaauuaaa

SEQ ID NO: 2113698 - RNA, 17 nt, Staphylococcus aureus subsp. aureus MW2
auggggacauguucacu

SEQ ID NO: 2113699 - RNA, 20 nt, Staphylococcus aureus subsp. aureus MW2
auggcuagucuuuaacuuua

SEQ ID NO: 2113700 - RNA, 19 nt, Staphylococcus aureus subsp. aureus MW2
auggcuauguuuacgccaa

SEQ ID NO: 2113701 - RNA, 20 nt, Staphylococcus aureus subsp. aureus MW2
auggcaucuggcaaauugcc

SEQ ID NO: 2113702 - RNA, 14 nt, Staphylococcus aureus subsp. aureus MW2
auggcauuauugcc

SEQ ID NO: 2113703 - RNA, 13 nt, Staphylococcus aureus subsp. aureus MW2
augcgcaaaagcg

SEQ ID NO: 2113704 - RNA, 16 nt, Staphylococcus aureus subsp. aureus MW2
augcgauucucauuua

SEQ ID NO: 2113705 - RNA, 22 nt, Staphylococcus aureus subsp. aureus MW2
auguauaugaauuuuauaaauu

SEQ ID NO: 2113706 - RNA, 18 nt, Staphylococcus aureus subsp. aureus MW2
auguauauggcaucauca

SEQ ID NO: 2113707 - RNA, 13 nt, Staphylococcus aureus subsp. aureus MW2
auguauaguaacg

SEQ ID NO: 2113708 - RNA, 13 nt, Staphylococcus aureus subsp. aureus MW2
auguauaauacau

SEQ ID NO: 2113709 - RNA, 15 nt, Staphylococcus aureus subsp. aureus MW2
auguaugacauaaac

SEQ ID NO: 2113710 - RNA, 15 nt, Staphylococcus aureus subsp. aureus MW2
auguauuaaauuuca

SEQ ID NO: 2113711 - RNA, 23 nt, Staphylococcus aureus subsp. aureus MW2
auguauuaauugaauugauuaua

SEQ ID NO: 2113712 - RNA, 21 nt, Staphylococcus aureus subsp. aureus MW2
auguaugcuuguacaaaaaau

SEQ ID NO: 2113713 - RNA, 16 nt, Staphylococcus aureus subsp. aureus MW2
augucaugaauuuuca

SEQ ID NO: 2113714 - RNA, 17 nt, Staphylococcus aureus subsp. aureus MW2
augucauguauugucca

SEQ ID NO: 2113715 - RNA, 15 nt, Staphylococcus aureus subsp. aureus MW2
auguaaucagguuua

SEQ ID NO: 2113716 - RNA, 17 nt, Staphylococcus aureus subsp. aureus MW2
auguaagcuaucguaaa

SEQ ID NO: 2113717 - RNA, 17 nt, Staphylococcus aureus subsp. aureus MW2
auguaaugaaucaaauc

SEQ ID NO: 2113718 - RNA, 21 nt, Staphylococcus aureus subsp. aureus MW2
auguaaugauacaaacccaua

SEQ ID NO: 2113719 - RNA, 20 nt, Staphylococcus aureus subsp. aureus MW2
auguaaaaaauaucuuguca

SEQ ID NO: 2113720 - RNA, 13 nt, Staphylococcus aureus subsp. aureus MW2
auguaaaaaauau

SEQ ID NO: 2113721 - RNA, 21 nt, Staphylococcus aureus subsp. aureus MW2
augguuuucuuuuuaucauga

SEQ ID NO: 2113722 - RNA, 22 nt, Staphylococcus aureus subsp. aureus MW2
augguuuuguuuugcucuuuaa

SEQ ID NO: 2113723 - RNA, 13 nt, Staphylococcus aureus subsp. aureus MW2
augguuucaaaau

SEQ ID NO: 2113724 - RNA, 15 nt, Staphylococcus aureus subsp. aureus MW2
augucuuugaaaaau

SEQ ID NO: 2113725 - RNA, 17 nt, Staphylococcus aureus subsp. aureus MW2
augucgaucuaacaauu

SEQ ID NO: 2113726 - RNA, 16 nt, Staphylococcus aureus subsp. aureus MW2
augucgauauuucuag

SEQ ID NO: 2113727 - RNA, 19 nt, Staphylococcus aureus subsp. aureus MW2
augugaacaucuaguuauu

SEQ ID NO: 2113728 - RNA, 17 nt, Staphylococcus aureus subsp. aureus MW2
augugaauguuuugugu

SEQ ID NO: 2113729 - RNA, 20 nt, Staphylococcus aureus subsp. aureus MW2
augugauuuucuuucauaaa

SEQ ID NO: 2113730 - RNA, 20 nt, Staphylococcus aureus subsp. aureus MW2
augugcaagugguaaaaaug

SEQ ID NO: 2113731 - RNA, 16 nt, Staphylococcus aureus subsp. aureus MW2
auguguugugauauau

SEQ ID NO: 2113732 - RNA, 14 nt, Staphylococcus aureus subsp. aureus MW2
auguguugugauau

SEQ ID NO: 2113733 - RNA, 17 nt, Staphylococcus aureus subsp. aureus MW2
auguuaaagauuauuau

SEQ ID NO: 2113734 - RNA, 21 nt, Staphylococcus aureus subsp. aureus MW2
auguguuuucaacaguuuuaa

SEQ ID NO: 2113735 - RNA, 17 nt, Staphylococcus aureus subsp. aureus MW2
auguuaacugcaaacuu

SEQ ID NO: 2113736 - RNA, 20 nt, Staphylococcus aureus subsp. aureus MW2
augugcaacgguuugaaaaa

SEQ ID NO: 2113737 - RNA, 22 nt, Staphylococcus aureus subsp. aureus MW2
augugcaaguuggcggggcccc

SEQ ID NO: 2113738 - RNA, 23 nt, Staphylococcus aureus subsp. aureus MW2
augugcaaguuggcggggcccca

SEQ ID NO: 2113739 - RNA, 14 nt, Staphylococcus aureus subsp. aureus MW2
augugcaaguuggg

SEQ ID NO: 2113740 - RNA, 17 nt, Staphylococcus aureus subsp. aureus MW2
auguggaacaugauuca

SEQ ID NO: 2113741 - RNA, 17 nt, Staphylococcus aureus subsp. aureus MW2
augugcuuuaaaggcau

SEQ ID NO: 2113742 - RNA, 14 nt, Staphylococcus aureus subsp. aureus MW2
augugcuuuaucaa

SEQ ID NO: 2113743 - RNA, 17 nt, Staphylococcus aureus subsp. aureus MW2
auguggguguaccaauu

SEQ ID NO: 2113744 - RNA, 21 nt, Staphylococcus aureus subsp. aureus MW2
aucucaauccaauuaaauauu

SEQ ID NO: 2113745 - RNA, 20 nt, Staphylococcus aureus subsp. aureus MW2
aucucaauccaauuaaauau

SEQ ID NO: 2113746 - RNA, 20 nt, Staphylococcus aureus subsp. aureus MW2
aucucauucuuuaauauaaa

SEQ ID NO: 2113747 - RNA, 22 nt, Staphylococcus aureus subsp. aureus MW2
aucucauuuuuucgagaugaua

SEQ ID NO: 2113748 - RNA, 13 nt, Staphylococcus aureus subsp. aureus MW2
aucucauucuuua

SEQ ID NO: 2113749 - RNA, 17 nt, Staphylococcus aureus subsp. aureus MW2
aucucaugccaaaaaca

SEQ ID NO: 2113750 - RNA, 19 nt, Staphylococcus aureus subsp. aureus MW2
aucucaugccaaaaacauu

SEQ ID NO: 2113751 - RNA, 16 nt, Staphylococcus aureus subsp. aureus MW2
aucucauacuauacaa

SEQ ID NO: 2113752 - RNA, 15 nt, Staphylococcus aureus subsp. aureus MW2
aucuauuuuuaacua

SEQ ID NO: 2113753 - RNA, 17 nt, Staphylococcus aureus subsp. aureus MW2
aucuauuuuacucuuuu

SEQ ID NO: 2113754 - RNA, 15 nt, Staphylococcus aureus subsp. aureus MW2
aucuauucaaauaua

SEQ ID NO: 2113755 - RNA, 23 nt, Staphylococcus aureus subsp. aureus MW2
aucuaugauaugugaaaaagcua

SEQ ID NO: 2113756 - RNA, 21 nt, Staphylococcus aureus subsp. aureus MW2
aucuauuauuauguuauaaau

SEQ ID NO: 2113757 - RNA, 22 nt, Staphylococcus aureus subsp. aureus MW2
aucuaugguuaugguguguugg

SEQ ID NO: 2113758 - RNA, 20 nt, Staphylococcus aureus subsp. aureus MW2
aucuaugcccgugaugggua

SEQ ID NO: 2113759 - RNA, 16 nt, Staphylococcus aureus subsp. aureus MW2
aucuauauaaauguuu

SEQ ID NO: 2113760 - RNA, 14 nt, Staphylococcus aureus subsp. aureus MW2
aucuauauaaaaac

SEQ ID NO: 2113761 - RNA, 19 nt, Staphylococcus aureus subsp. aureus MW2
aucuauaggucuacaaaug

SEQ ID NO: 2113762 - RNA, 19 nt, Staphylococcus aureus subsp. aureus MW2
aucuauacaauuauggaua

SEQ ID NO: 2113763 - RNA, 18 nt, Staphylococcus aureus subsp. aureus MW2
aucuaucgguaauuuuug

SEQ ID NO: 2113764 - RNA, 15 nt, Staphylococcus aureus subsp. aureus MW2
aucuaguuguuuuau

SEQ ID NO: 2113765 - RNA, 23 nt, Staphylococcus aureus subsp. aureus MW2
aucuauaaaaagaauaugauauu

SEQ ID NO: 2113766 - RNA, 13 nt, Staphylococcus aureus subsp. aureus MW2
aucuauaagauuu

SEQ ID NO: 2113767 - RNA, 14 nt, Staphylococcus aureus subsp. aureus MW2
aucuauaauauuca

SEQ ID NO: 2113768 - RNA, 13 nt, Staphylococcus aureus subsp. aureus MW2
aucuacuuaaaau

SEQ ID NO: 2113769 - RNA, 21 nt, Staphylococcus aureus subsp. aureus MW2
aucuacuuuguucugcuuuuu

SEQ ID NO: 2113770 - RNA, 12 nt, Staphylococcus aureus subsp. aureus MW2
aucuacuaaauc

SEQ ID NO: 2113771 - RNA, 15 nt, Staphylococcus aureus subsp. aureus MW2
aucuacuaaaucaaa

SEQ ID NO: 2113772 - RNA, 17 nt, Staphylococcus aureus subsp. aureus MW2
aucuacuaaaucaaauu

SEQ ID NO: 2113773 - RNA, 14 nt, Staphylococcus aureus subsp. aureus MW2
aucucuauuuuuua

SEQ ID NO: 2113774 - RNA, 14 nt, Staphylococcus aureus subsp. aureus MW2
aucucuaaauccuu

SEQ ID NO: 2113775 - RNA, 16 nt, Staphylococcus aureus subsp. aureus MW2
aucucggcauuuuuau

SEQ ID NO: 2113776 - RNA, 13 nt, Staphylococcus aureus subsp. aureus MW2
aucucuuauaagu

SEQ ID NO: 2113777 - RNA, 14 nt, Staphylococcus aureus subsp. aureus MW2
aucugacauuuaaa

SEQ ID NO: 2113778 - RNA, 18 nt, Staphylococcus aureus subsp. aureus MW2
aucugaagguaauuuaac

SEQ ID NO: 2113779 - RNA, 18 nt, Staphylococcus aureus subsp. aureus MW2
aucugauuguucauguuu

SEQ ID NO: 2113780 - RNA, 13 nt, Staphylococcus aureus subsp. aureus MW2
aucugauuucacu

SEQ ID NO: 2113781 - RNA, 16 nt, Staphylococcus aureus subsp. aureus MW2
aucugcgaaaugcauu

SEQ ID NO: 2113782 - RNA, 22 nt, Staphylococcus aureus subsp. aureus MW2
aucguuaauaaaccuacaauau

SEQ ID NO: 2113783 - RNA, 14 nt, Staphylococcus aureus subsp. aureus MW2
aucguucccauucu

SEQ ID NO: 2113784 - RNA, 22 nt, Staphylococcus aureus subsp. aureus MW2
aucuaaaaugaguuguucagau

SEQ ID NO: 2113785 - RNA, 17 nt, Staphylococcus aureus subsp. aureus MW2
aucuaaacuauaauaau

SEQ ID NO: 2113786 - RNA, 14 nt, Staphylococcus aureus subsp. aureus MW2
aucuaaaugugaaa

SEQ ID NO: 2113787 - RNA, 14 nt, Staphylococcus aureus subsp. aureus MW2
aucuacaauauuaa

SEQ ID NO: 2113788 - RNA, 19 nt, Staphylococcus aureus subsp. aureus MW2
aucuacaauauuaaaauua

SEQ ID NO: 2113789 - RNA, 13 nt, Staphylococcus aureus subsp. aureus MW2
aucuaaaugauca

SEQ ID NO: 2113790 - RNA, 17 nt, Staphylococcus aureus subsp. aureus MW2
aucuaaauaguuuuuca

SEQ ID NO: 2113791 - RNA, 17 nt, Staphylococcus aureus subsp. aureus MW2
aucuaaagcuauaaaaa

SEQ ID NO: 2113792 - RNA, 13 nt, Staphylococcus aureus subsp. aureus MW2
aucuaaaguacuc

SEQ ID NO: 2113793 - RNA, 20 nt, Staphylococcus aureus subsp. aureus MW2
aucuacauaauuugaauuag

SEQ ID NO: 2113794 - RNA, 19 nt, Staphylococcus aureus subsp. aureus MW2
aucuacauaugaaaaaugu

SEQ ID NO: 2113795 - RNA, 22 nt, Staphylococcus aureus subsp. aureus MW2
aucuacagagaaucaauuauug

SEQ ID NO: 2113796 - RNA, 17 nt, Staphylococcus aureus subsp. aureus MW2
aucguuaaggaaagcuu

SEQ ID NO: 2113797 - RNA, 23 nt, Staphylococcus aureus subsp. aureus MW2
aucgucgcuaaagaccuuucuug

SEQ ID NO: 2113798 - RNA, 13 nt, Staphylococcus aureus subsp. aureus MW2
aucgcuaauacuu

SEQ ID NO: 2113799 - RNA, 17 nt, Staphylococcus aureus subsp. aureus MW2
aucgguaucgaauguuu

SEQ ID NO: 2113800 - RNA, 19 nt, Staphylococcus aureus subsp. aureus MW2
auccuuuuugacucaaaau

SEQ ID NO: 2113801 - RNA, 14 nt, Staphylococcus aureus subsp. aureus MW2
auccuuuuugacuc

SEQ ID NO: 2113802 - RNA, 18 nt, Staphylococcus aureus subsp. aureus MW2
aucgaacaaaugaaaaag

SEQ ID NO: 2113803 - RNA, 20 nt, Staphylococcus aureus subsp. aureus MW2
aucgaaagguaacugcuuug

SEQ ID NO: 2113804 - RNA, 21 nt, Staphylococcus aureus subsp. aureus MW2
aucgagaggguacacuucaac

SEQ ID NO: 2113805 - RNA, 17 nt, Staphylococcus aureus subsp. aureus MW2
aucagcuauaaaaguac

SEQ ID NO: 2113806 - RNA, 13 nt, Staphylococcus aureus subsp. aureus MW2
auccuuuggacuc

SEQ ID NO: 2113807 - RNA, 17 nt, Staphylococcus aureus subsp. aureus MW2
aucgcaccgucaaacuu

SEQ ID NO: 2113808 - RNA, 16 nt, Staphylococcus aureus subsp. aureus MW2
aucgcacgauauggug

SEQ ID NO: 2113809 - RNA, 22 nt, Staphylococcus aureus subsp. aureus MW2
aucgauuuuaucgaaauauuua

SEQ ID NO: 2113810 - RNA, 19 nt, Staphylococcus aureus subsp. aureus MW2
aucgauauugagaauauua

SEQ ID NO: 2113811 - RNA, 13 nt, Staphylococcus aureus subsp. aureus MW2
aucgauaaaaugu

SEQ ID NO: 2113812 - RNA, 14 nt, Staphylococcus aureus subsp. aureus MW2
aucgccuaaaaaua

SEQ ID NO: 2113813 - RNA, 16 nt, Staphylococcus aureus subsp. aureus MW2
aucgcgcaucaaaaau

SEQ ID NO: 2113814 - RNA, 16 nt, Staphylococcus aureus subsp. aureus MW2
aucgcauuuaaauaua

SEQ ID NO: 2113815 - RNA, 15 nt, Staphylococcus aureus subsp. aureus MW2
aucgcauuuaaauau

SEQ ID NO: 2113816 - RNA, 17 nt, Staphylococcus aureus subsp. aureus MW2
aucgcauguuuguaaau

SEQ ID NO: 2113817 - RNA, 13 nt, Staphylococcus aureus subsp. aureus MW2
aucgcccauacca

SEQ ID NO: 2113818 - RNA, 21 nt, Staphylococcus aureus subsp. aureus MW2
aucuucuuuuaauauuugaua

SEQ ID NO: 2113819 - RNA, 15 nt, Staphylococcus aureus subsp. aureus MW2
aucuuuaauuucauu

SEQ ID NO: 2113820 - RNA, 13 nt, Staphylococcus aureus subsp. aureus MW2
aucuuuaagcucu

SEQ ID NO: 2113821 - RNA, 18 nt, Staphylococcus aureus subsp. aureus MW2
aucuuuaaauauacuucu

SEQ ID NO: 2113822 - RNA, 21 nt, Staphylococcus aureus subsp. aureus MW2
aucuuuaaauauacuucuauu

SEQ ID NO: 2113823 - RNA, 11 nt, Staphylococcus aureus subsp. aureus MW2
aucuuucaaag

SEQ ID NO: 2113824 - RNA, 18 nt, Staphylococcus aureus subsp. aureus MW2
aucuuuccacggcauuua

SEQ ID NO: 2113825 - RNA, 15 nt, Staphylococcus aureus subsp. aureus MW2
aucuuucaaaugcuu

SEQ ID NO: 2113826 - RNA, 17 nt, Staphylococcus aureus subsp. aureus MW2
aucuuucacaauuguau

SEQ ID NO: 2113827 - RNA, 22 nt, Staphylococcus aureus subsp. aureus MW2
aucuuucacaauuguauaaugu

SEQ ID NO: 2113828 - RNA, 16 nt, Staphylococcus aureus subsp. aureus MW2
aucuuuacaacaguaa

SEQ ID NO: 2113829 - RNA, 16 nt, Staphylococcus aureus subsp. aureus MW2
aucuggcaaauugccu

SEQ ID NO: 2113830 - RNA, 18 nt, Staphylococcus aureus subsp. aureus MW2
aucuggcguuaaccauuu

SEQ ID NO: 2113831 - RNA, 21 nt, Staphylococcus aureus subsp. aureus MW2
aucuucuggauagguaucacu

SEQ ID NO: 2113832 - RNA, 16 nt, Staphylococcus aureus subsp. aureus MW2
aucuucuguuuauaua

SEQ ID NO: 2113833 - RNA, 15 nt, Staphylococcus aureus subsp. aureus MW2
aucuucuuuuucuac

SEQ ID NO: 2113834 - RNA, 15 nt, Staphylococcus aureus subsp. aureus MW2
augaaaccguauuau

SEQ ID NO: 2113835 - RNA, 23 nt, Staphylococcus aureus subsp. aureus MW2
augaaacuggauaaauaaagauu

SEQ ID NO: 2113836 - RNA, 11 nt, Staphylococcus aureus subsp. aureus MW2
aucuuuuaugg

SEQ ID NO: 2113837 - RNA, 19 nt, Staphylococcus aureus subsp. aureus MW2
aucuuuugguuuaucuguu

SEQ ID NO: 2113838 - RNA, 19 nt, Staphylococcus aureus subsp. aureus MW2
aucuuuugcuguaucuuca

SEQ ID NO: 2113839 - RNA, 14 nt, Staphylococcus aureus subsp. aureus MW2
aucuuuuaauucuu

SEQ ID NO: 2113840 - RNA, 17 nt, Staphylococcus aureus subsp. aureus MW2
aucuuuuaauucuuaau

SEQ ID NO: 2113841 - RNA, 11 nt, Staphylococcus aureus subsp. aureus MW2
aucuuuuacua

SEQ ID NO: 2113842 - RNA, 19 nt, Staphylococcus aureus subsp. aureus MW2
augaagaggucuccaauac

SEQ ID NO: 2113843 - RNA, 21 nt, Staphylococcus aureus subsp. aureus MW2
augaagcaguuguugguuuug

SEQ ID NO: 2113844 - RNA, 15 nt, Staphylococcus aureus subsp. aureus MW2
augaacuuaaugcuu

SEQ ID NO: 2113845 - RNA, 22 nt, Staphylococcus aureus subsp. aureus MW2
augaacuucuacaguuggaggu

SEQ ID NO: 2113846 - RNA, 14 nt, Staphylococcus aureus subsp. aureus MW2
augaagaauacaaa

SEQ ID NO: 2113847 - RNA, 22 nt, Staphylococcus aureus subsp. aureus MW2
augaaauaacaauagugacuuu

SEQ ID NO: 2113848 - RNA, 12 nt, Staphylococcus aureus subsp. aureus MW2
augagaaauguu

SEQ ID NO: 2113849 - RNA, 16 nt, Staphylococcus aureus subsp. aureus MW2
augacuuuuuauuagu

SEQ ID NO: 2113850 - RNA, 22 nt, Staphylococcus aureus subsp. aureus MW2
augagaagcugucuuacugcug

SEQ ID NO: 2113851 - RNA, 23 nt, Staphylococcus aureus subsp. aureus MW2
augacuuuuuauuaguauucaaa

SEQ ID NO: 2113852 - RNA, 20 nt, Staphylococcus aureus subsp. aureus MW2
augacuucgauucuccuuuu

SEQ ID NO: 2113853 - RNA, 13 nt, Staphylococcus aureus subsp. aureus MW2
augacuguagaaa

SEQ ID NO: 2113854 - RNA, 20 nt, Staphylococcus aureus subsp. aureus MW2
augacuuaacaucuuuuuca

SEQ ID NO: 2113855 - RNA, 19 nt, Staphylococcus aureus subsp. aureus MW2
augaccaugauauauaaca

SEQ ID NO: 2113856 - RNA, 14 nt, Staphylococcus aureus subsp. aureus MW2
augacugcaaauac

SEQ ID NO: 2113857 - RNA, 22 nt, Staphylococcus aureus subsp. aureus MW2
augacugagaaaaauauuucua

SEQ ID NO: 2113858 - RNA, 20 nt, Staphylococcus aureus subsp. aureus MW2
augagauuauuuuuuuaaau

SEQ ID NO: 2113859 - RNA, 17 nt, Staphylococcus aureus subsp. aureus MW2
augagcaaagcaaauua

SEQ ID NO: 2113860 - RNA, 14 nt, Staphylococcus aureus subsp. aureus MW2
augagucuuuuuga

SEQ ID NO: 2113861 - RNA, 21 nt, Staphylococcus aureus subsp. aureus MW2
augagaguaauguuccauaua

SEQ ID NO: 2113862 - RNA, 22 nt, Staphylococcus aureus subsp. aureus MW2
augaaguaauauauaaaagucg

SEQ ID NO: 2113863 - RNA, 16 nt, Staphylococcus aureus subsp. aureus MW2
augaagggaaaaaaug

SEQ ID NO: 2113864 - RNA, 21 nt, Staphylococcus aureus subsp. aureus MW2
augaaggcuuuuuguuuugaa

SEQ ID NO: 2113865 - RNA, 12 nt, Staphylococcus aureus subsp. aureus MW2
augaauauauug

SEQ ID NO: 2113866 - RNA, 20 nt, Staphylococcus aureus subsp. aureus MW2
augaauaucacucggcagau

SEQ ID NO: 2113867 - RNA, 21 nt, Staphylococcus aureus subsp. aureus MW2
augaauaauuacuaaaauauc

SEQ ID NO: 2113868 - RNA, 17 nt, Staphylococcus aureus subsp. aureus MW2
augaaucgcauuuaaau

SEQ ID NO: 2113869 - RNA, 20 nt, Staphylococcus aureus subsp. aureus MW2
augaauccaaauauuaaaaa

SEQ ID NO: 2113870 - RNA, 22 nt, Staphylococcus aureus subsp. aureus MW2
augaaucagaugauuuaauucu

SEQ ID NO: 2113871 - RNA, 20 nt, Staphylococcus aureus subsp. aureus MW2
augaaucaaaucaauaucau

SEQ ID NO: 2113872 - RNA, 17 nt, Staphylococcus aureus subsp. aureus MW2
augaaucaacaauauaa

SEQ ID NO: 2113873 - RNA, 14 nt, Staphylococcus aureus subsp. aureus MW2
augaaucagaugau

SEQ ID NO: 2113874 - RNA, 16 nt, Staphylococcus aureus subsp. aureus MW2
augacaucaauaucuu

SEQ ID NO: 2113875 - RNA, 22 nt, Staphylococcus aureus subsp. aureus MW2
augaauuuagaugcauaaaaaa

SEQ ID NO: 2113876 - RNA, 20 nt, Staphylococcus aureus subsp. aureus MW2
augaauuuacuccuuacaau

SEQ ID NO: 2113877 - RNA, 18 nt, Staphylococcus aureus subsp. aureus MW2
augaauuguuguacaugu

SEQ ID NO: 2113878 - RNA, 19 nt, Staphylococcus aureus subsp. aureus MW2
augaauuucuaauuuagua

SEQ ID NO: 2113879 - RNA, 22 nt, Staphylococcus aureus subsp. aureus MW2
augaauuucuaauuuaguaucu

SEQ ID NO: 2113880 - RNA, 23 nt, Staphylococcus aureus subsp. aureus MW2
augaauuucuaauuuaguaucua

SEQ ID NO: 2113881 - RNA, 18 nt, Staphylococcus aureus subsp. aureus MW2
augaauuauuuaaaaugc

SEQ ID NO: 2113882 - RNA, 22 nt, Staphylococcus aureus subsp. aureus MW2
augaauguuaagacauaugcag

SEQ ID NO: 2113883 - RNA, 21 nt, Staphylococcus aureus subsp. aureus MW2
augaaucgcauuuaaauauaa

SEQ ID NO: 2113884 - RNA, 14 nt, Staphylococcus aureus subsp. aureus MW2
augaaugaaaucag

SEQ ID NO: 2113885 - RNA, 15 nt, Staphylococcus aureus subsp. aureus MW2
augaaugccuaauuu

SEQ ID NO: 2113886 - RNA, 20 nt, Staphylococcus aureus subsp. aureus MW2
augaauggcauuuaauacua

SEQ ID NO: 2113887 - RNA, 12 nt, Staphylococcus aureus subsp. aureus MW2
augauuugauuu

SEQ ID NO: 2113888 - RNA, 23 nt, Staphylococcus aureus subsp. aureus MW2
augauuugauuuggguaauguuu

SEQ ID NO: 2113889 - RNA, 16 nt, Staphylococcus aureus subsp. aureus MW2
augauuugauauuuca

SEQ ID NO: 2113890 - RNA, 12 nt, Staphylococcus aureus subsp. aureus MW2
augauuucacuu

SEQ ID NO: 2113891 - RNA, 18 nt, Staphylococcus aureus subsp. aureus MW2
augauuucacuucauaaa

SEQ ID NO: 2113892 - RNA, 18 nt, Staphylococcus aureus subsp. aureus MW2
augauuuaaguuuauaau

SEQ ID NO: 2113893 - RNA, 14 nt, Staphylococcus aureus subsp. aureus MW2
augauuuaaagcaa

SEQ ID NO: 2113894 - RNA, 21 nt, Staphylococcus aureus subsp. aureus MW2
augaugugcaaacgauauguu

SEQ ID NO: 2113895 - RNA, 15 nt, Staphylococcus aureus subsp. aureus MW2
augauguuaaaaaau

SEQ ID NO: 2113896 - RNA, 20 nt, Staphylococcus aureus subsp. aureus MW2
augauuggcuugaaguuguu

SEQ ID NO: 2113897 - RNA, 17 nt, Staphylococcus aureus subsp. aureus MW2
augcaacuaaaacuauc

SEQ ID NO: 2113898 - RNA, 16 nt, Staphylococcus aureus subsp. aureus MW2
augaugagauaaaauc

SEQ ID NO: 2113899 - RNA, 15 nt, Staphylococcus aureus subsp. aureus MW2
augaugagauaaaau

SEQ ID NO: 2113900 - RNA, 19 nt, Staphylococcus aureus subsp. aureus MW2
augaugagauaaaaucaua

SEQ ID NO: 2113901 - RNA, 20 nt, Staphylococcus aureus subsp. aureus MW2
augaugggaaaucaguaaua

SEQ ID NO: 2113902 - RNA, 22 nt, Staphylococcus aureus subsp. aureus MW2
augaugacaaaaauaaaaccga

SEQ ID NO: 2113903 - RNA, 15 nt, Staphylococcus aureus subsp. aureus MW2
augaguuuaaaaaua

SEQ ID NO: 2113904 - RNA, 14 nt, Staphylococcus aureus subsp. aureus MW2
augaguuuaaaaau

SEQ ID NO: 2113905 - RNA, 14 nt, Staphylococcus aureus subsp. aureus MW2
augauaagaaucau

SEQ ID NO: 2113906 - RNA, 16 nt, Staphylococcus aureus subsp. aureus MW2
augauaaccaaucauc

SEQ ID NO: 2113907 - RNA, 12 nt, Staphylococcus aureus subsp. aureus MW2
augcaauacauu

SEQ ID NO: 2113908 - RNA, 23 nt, Staphylococcus aureus subsp. aureus MW2
augcaaguuggcggggccccaac

SEQ ID NO: 2113909 - RNA, 14 nt, Staphylococcus aureus subsp. aureus MW2
augcaauacauuaa

SEQ ID NO: 2113910 - RNA, 20 nt, Staphylococcus aureus subsp. aureus MW2
augcaguaaaaccaaaucgu

SEQ ID NO: 2113911 - RNA, 13 nt, Staphylococcus aureus subsp. aureus MW2
augcagcuguauu

SEQ ID NO: 2113912 - RNA, 22 nt, Staphylococcus aureus subsp. aureus MW2
augccaacacguuuuaagccag

SEQ ID NO: 2113913 - RNA, 20 nt, Staphylococcus aureus subsp. aureus MW2
augcauaaaaccuucaauca

SEQ ID NO: 2113914 - RNA, 20 nt, Staphylococcus aureus subsp. aureus MW2
augcaguuuuaauuaaacug

SEQ ID NO: 2113915 - RNA, 14 nt, Staphylococcus aureus subsp. aureus MW2
augccgagauuauu

SEQ ID NO: 2113916 - RNA, 17 nt, Staphylococcus aureus subsp. aureus MW2
augccauaccugcaccu

SEQ ID NO: 2113917 - RNA, 12 nt, Staphylococcus aureus subsp. aureus MW2
augccuuuaaag

SEQ ID NO: 2113918 - RNA, 21 nt, Staphylococcus aureus subsp. aureus MW2
augccuuuaaagcacauguau

SEQ ID NO: 2113919 - RNA, 23 nt, Staphylococcus aureus subsp. aureus MW2
augccugccccuuagucauguuu

SEQ ID NO: 2113920 - RNA, 17 nt, Staphylococcus aureus subsp. aureus MW2
augccgccuaauaauaa

SEQ ID NO: 2113921 - RNA, 19 nt, Staphylococcus aureus subsp. aureus MW2
auucuauccuaagcauaaa

SEQ ID NO: 2113922 - RNA, 11 nt, Staphylococcus aureus subsp. aureus MW2
auucuauuuuu

SEQ ID NO: 2113923 - RNA, 13 nt, Staphylococcus aureus subsp. aureus MW2
auucuauuuuuca

SEQ ID NO: 2113924 - RNA, 22 nt, Staphylococcus aureus subsp. aureus MW2
auucucaaagguuuacuauuaa

SEQ ID NO: 2113925 - RNA, 22 nt, Staphylococcus aureus subsp. aureus MW2
auucuaucguuguuuuaacgaa

SEQ ID NO: 2113926 - RNA, 14 nt, Staphylococcus aureus subsp. aureus MW2
auucuauacuuuua

SEQ ID NO: 2113927 - RNA, 18 nt, Staphylococcus aureus subsp. aureus MW2
auucuaugagaauagaca

SEQ ID NO: 2113928 - RNA, 23 nt, Staphylococcus aureus subsp. aureus MW2
auucuauguagcaggcaacuuuu

SEQ ID NO: 2113929 - RNA, 22 nt, Staphylococcus aureus subsp. aureus MW2
auucucuaacuuuaccaauauc

SEQ ID NO: 2113930 - RNA, 17 nt, Staphylococcus aureus subsp. aureus MW2
auucucuaacuuuacca

SEQ ID NO: 2113931 - RNA, 17 nt, Staphylococcus aureus subsp. aureus MW2
auucucgauuuuuuuau

SEQ ID NO: 2113932 - RNA, 23 nt, Staphylococcus aureus subsp. aureus MW2
auucuccuuuuguuucaaauuuu

SEQ ID NO: 2113933 - RNA, 14 nt, Staphylococcus aureus subsp. aureus MW2
auucucgauuuuuu

SEQ ID NO: 2113934 - RNA, 14 nt, Staphylococcus aureus subsp. aureus MW2
auucuggaugguua

SEQ ID NO: 2113935 - RNA, 15 nt, Staphylococcus aureus subsp. aureus MW2
auucuuaauuuaaaa

SEQ ID NO: 2113936 - RNA, 19 nt, Staphylococcus aureus subsp. aureus MW2
auugacucgaccuuuauau

SEQ ID NO: 2113937 - RNA, 12 nt, Staphylococcus aureus subsp. aureus MW2
auugaaugaagu

SEQ ID NO: 2113938 - RNA, 14 nt, Staphylococcus aureus subsp. aureus MW2
auugaaugaaguag

SEQ ID NO: 2113939 - RNA, 13 nt, Staphylococcus aureus subsp. aureus MW2
auugacuuuaauu

SEQ ID NO: 2113940 - RNA, 17 nt, Staphylococcus aureus subsp. aureus MW2
auugagaaauagcaaca

SEQ ID NO: 2113941 - RNA, 23 nt, Staphylococcus aureus subsp. aureus MW2
auugacuuacauuuuaauaaaau

SEQ ID NO: 2113942 - RNA, 16 nt, Staphylococcus aureus subsp. aureus MW2
auugaaauaauauaaa

SEQ ID NO: 2113943 - RNA, 18 nt, Staphylococcus aureus subsp. aureus MW2
auugaaagaagucugcag

SEQ ID NO: 2113944 - RNA, 21 nt, Staphylococcus aureus subsp. aureus MW2
auugaaaaauuaaaaaacaaa

SEQ ID NO: 2113945 - RNA, 21 nt, Staphylococcus aureus subsp. aureus MW2
auugaaaaagacaauuucuau

SEQ ID NO: 2113946 - RNA, 17 nt, Staphylococcus aureus subsp. aureus MW2
auugaaaauauuuuauu

SEQ ID NO: 2113947 - RNA, 22 nt, Staphylococcus aureus subsp. aureus MW2
auucuuaucauuucaaauaaga

SEQ ID NO: 2113948 - RNA, 23 nt, Staphylococcus aureus subsp. aureus MW2
auucuuauaaaauaaaaaagcca

SEQ ID NO: 2113949 - RNA, 14 nt, Staphylococcus aureus subsp. aureus MW2
auucuuagauauua

SEQ ID NO: 2113950 - RNA, 15 nt, Staphylococcus aureus subsp. aureus MW2
auucuuagauauuau

SEQ ID NO: 2113951 - RNA, 14 nt, Staphylococcus aureus subsp. aureus MW2
auucuuauaaaaua

SEQ ID NO: 2113952 - RNA, 15 nt, Staphylococcus aureus subsp. aureus MW2
auucuuuuucaaaau

SEQ ID NO: 2113953 - RNA, 16 nt, Staphylococcus aureus subsp. aureus MW2
auucuuuuucaaaaua

SEQ ID NO: 2113954 - RNA, 22 nt, Staphylococcus aureus subsp. aureus MW2
auucuucaccaacuuuuuuaac

SEQ ID NO: 2113955 - RNA, 18 nt, Staphylococcus aureus subsp. aureus MW2
auucuucaaaaaauaaua

SEQ ID NO: 2113956 - RNA, 21 nt, Staphylococcus aureus subsp. aureus MW2
auugcacuaugcauaauacca

SEQ ID NO: 2113957 - RNA, 21 nt, Staphylococcus aureus subsp. aureus MW2
auugcacguuugaaugaaccu

SEQ ID NO: 2113958 - RNA, 14 nt, Staphylococcus aureus subsp. aureus MW2
auugcacuuacugc

SEQ ID NO: 2113959 - RNA, 20 nt, Staphylococcus aureus subsp. aureus MW2
auugccuaaagacuuuaugc

SEQ ID NO: 2113960 - RNA, 17 nt, Staphylococcus aureus subsp. aureus MW2
auugccuaacguguuug

SEQ ID NO: 2113961 - RNA, 23 nt, Staphylococcus aureus subsp. aureus MW2
auugaggaucaaaaguuguugca

SEQ ID NO: 2113962 - RNA, 16 nt, Staphylococcus aureus subsp. aureus MW2
auugaguugaaaauaa

SEQ ID NO: 2113963 - RNA, 21 nt, Staphylococcus aureus subsp. aureus MW2
auugcaaaaauaauaugaauu

SEQ ID NO: 2113964 - RNA, 22 nt, Staphylococcus aureus subsp. aureus MW2
auugcaaaacuugcgcaugcuu

SEQ ID NO: 2113965 - RNA, 14 nt, Staphylococcus aureus subsp. aureus MW2
auugcaaaugcaau

SEQ ID NO: 2113966 - RNA, 21 nt, Staphylococcus aureus subsp. aureus MW2
auugcaacgcaucacaaaauu

SEQ ID NO: 2113967 - RNA, 13 nt, Staphylococcus aureus subsp. aureus MW2
auugggacuuauu

SEQ ID NO: 2113968 - RNA, 17 nt, Staphylococcus aureus subsp. aureus MW2
auuggguaauauuaguc

SEQ ID NO: 2113969 - RNA, 18 nt, Staphylococcus aureus subsp. aureus MW2
auuggauaauuucuucuu

SEQ ID NO: 2113970 - RNA, 21 nt, Staphylococcus aureus subsp. aureus MW2
auugcuuguccucuaaaacau

SEQ ID NO: 2113971 - RNA, 18 nt, Staphylococcus aureus subsp. aureus MW2
auugcuuguccucuaaaa

SEQ ID NO: 2113972 - RNA, 21 nt, Staphylococcus aureus subsp. aureus MW2
auugcuugaaauuauuauuua

SEQ ID NO: 2113973 - RNA, 15 nt, Staphylococcus aureus subsp. aureus MW2
auugcuuauuuuugu

SEQ ID NO: 2113974 - RNA, 16 nt, Staphylococcus aureus subsp. aureus MW2
auugcgaaaaauaauu

SEQ ID NO: 2113975 - RNA, 16 nt, Staphylococcus aureus subsp. aureus MW2
auugccuguagaauuu

SEQ ID NO: 2113976 - RNA, 20 nt, Staphylococcus aureus subsp. aureus MW2
auugcuaguuuuuuauuuuu

SEQ ID NO: 2113977 - RNA, 14 nt, Staphylococcus aureus subsp. aureus MW2
auugcuaaaucauc

SEQ ID NO: 2113978 - RNA, 21 nt, Staphylococcus aureus subsp. aureus MW2
auugcuacccaccuuucuuua

SEQ ID NO: 2113979 - RNA, 24 nt, Staphylococcus aureus subsp. aureus MW2
auugcuacccaccuuucuuuauca

SEQ ID NO: 2113980 - RNA, 18 nt, Staphylococcus aureus subsp. aureus MW2
auugcuguaaccccuugu

SEQ ID NO: 2113981 - RNA, 15 nt, Staphylococcus aureus subsp. aureus MW2
auuucaucaauaauu

SEQ ID NO: 2113982 - RNA, 14 nt, Staphylococcus aureus subsp. aureus MW2
auuucaaauauaaa

SEQ ID NO: 2113983 - RNA, 17 nt, Staphylococcus aureus subsp. aureus MW2
auuucaaacgauuuuca

SEQ ID NO: 2113984 - RNA, 20 nt, Staphylococcus aureus subsp. aureus MW2
auuucaacuuuuuaauaaua

SEQ ID NO: 2113985 - RNA, 19 nt, Staphylococcus aureus subsp. aureus MW2
auuuauuggguaauauuag

SEQ ID NO: 2113986 - RNA, 23 nt, Staphylococcus aureus subsp. aureus MW2
auuuauuaguugugguuguuaau

SEQ ID NO: 2113987 - RNA, 18 nt, Staphylococcus aureus subsp. aureus MW2
auuuauuauaauuguuca

SEQ ID NO: 2113988 - RNA, 15 nt, Staphylococcus aureus subsp. aureus MW2
auuucaaaaauagcg

SEQ ID NO: 2113989 - RNA, 12 nt, Staphylococcus aureus subsp. aureus MW2
auuuauuuuuga

SEQ ID NO: 2113990 - RNA, 14 nt, Staphylococcus aureus subsp. aureus MW2
auuuauuuugauua

SEQ ID NO: 2113991 - RNA, 19 nt, Staphylococcus aureus subsp. aureus MW2
auuuauuuucaauaaauaa

SEQ ID NO: 2113992 - RNA, 21 nt, Staphylococcus aureus subsp. aureus MW2
auuuauuuauaaaauaaaaug

SEQ ID NO: 2113993 - RNA, 17 nt, Staphylococcus aureus subsp. aureus MW2
auuuauuuauaaaauaa

SEQ ID NO: 2113994 - RNA, 20 nt, Staphylococcus aureus subsp. aureus MW2
auuuauuuauaaaauaaaau

SEQ ID NO: 2113995 - RNA, 13 nt, Staphylococcus aureus subsp. aureus MW2
auuuauuuuaaau

SEQ ID NO: 2113996 - RNA, 18 nt, Staphylococcus aureus subsp. aureus MW2
auuuauacugaucaaaug

SEQ ID NO: 2113997 - RNA, 22 nt, Staphylococcus aureus subsp. aureus MW2
auuuaucgcgauuauuaccaua

SEQ ID NO: 2113998 - RNA, 16 nt, Staphylococcus aureus subsp. aureus MW2
auuuauacuauaaaua

SEQ ID NO: 2113999 - RNA, 15 nt, Staphylococcus aureus subsp. aureus MW2
auuuauacagugaau

SEQ ID NO: 2114000 - RNA, 18 nt, Staphylococcus aureus subsp. aureus MW2
auuuauaacauuuaagaa

SEQ ID NO: 2114001 - RNA, 17 nt, Staphylococcus aureus subsp. aureus MW2
auuuaguuagcccuauu

SEQ ID NO: 2114002 - RNA, 14 nt, Staphylococcus aureus subsp. aureus MW2
auuuaguuuuaaua

SEQ ID NO: 2114003 - RNA, 15 nt, Staphylococcus aureus subsp. aureus MW2
auuuaguuaaauaca

SEQ ID NO: 2114004 - RNA, 16 nt, Staphylococcus aureus subsp. aureus MW2
auuuaguaucuauaca

SEQ ID NO: 2114005 - RNA, 18 nt, Staphylococcus aureus subsp. aureus MW2
auuuagaugauucuuauc

SEQ ID NO: 2114006 - RNA, 22 nt, Staphylococcus aureus subsp. aureus MW2
auuuaguauaaauaaaaauaca

SEQ ID NO: 2114007 - RNA, 15 nt, Staphylococcus aureus subsp. aureus MW2
auuuaguauaaauaa

SEQ ID NO: 2114008 - RNA, 18 nt, Staphylococcus aureus subsp. aureus MW2
auuuaguacucaauguua

SEQ ID NO: 2114009 - RNA, 14 nt, Staphylococcus aureus subsp. aureus MW2
auuuaguauaaaua

SEQ ID NO: 2114010 - RNA, 19 nt, Staphylococcus aureus subsp. aureus MW2
auuuagaauucuaaaagaa

SEQ ID NO: 2114011 - RNA, 20 nt, Staphylococcus aureus subsp. aureus MW2
auuuagaauucuaaaagaau

SEQ ID NO: 2114012 - RNA, 20 nt, Staphylococcus aureus subsp. aureus MW2
auuuagauagcggauuuauu

SEQ ID NO: 2114013 - RNA, 17 nt, Staphylococcus aureus subsp. aureus MW2
auuuagauauaauaaaa

SEQ ID NO: 2114014 - RNA, 15 nt, Staphylococcus aureus subsp. aureus MW2
auuuagauaaaaaau

SEQ ID NO: 2114015 - RNA, 19 nt, Staphylococcus aureus subsp. aureus MW2
auuuagauaaaaaauacua

SEQ ID NO: 2114016 - RNA, 22 nt, Staphylococcus aureus subsp. aureus MW2
auuuagauaaaaaauacuaacg

SEQ ID NO: 2114017 - RNA, 20 nt, Staphylococcus aureus subsp. aureus MW2
auuuaaucuuaauauuuauu

SEQ ID NO: 2114018 - RNA, 11 nt, Staphylococcus aureus subsp. aureus MW2
auuuagaaaua

SEQ ID NO: 2114019 - RNA, 18 nt, Staphylococcus aureus subsp. aureus MW2
auuuagaauaaacuuuau

SEQ ID NO: 2114020 - RNA, 20 nt, Staphylococcus aureus subsp. aureus MW2
auuuagaauaaacuuuaugg

SEQ ID NO: 2114021 - RNA, 19 nt, Staphylococcus aureus subsp. aureus MW2
auuuagaagauuagaugau

SEQ ID NO: 2114022 - RNA, 19 nt, Staphylococcus aureus subsp. aureus MW2
auuuaauaucacgaucuuu

SEQ ID NO: 2114023 - RNA, 23 nt, Staphylococcus aureus subsp. aureus MW2
auuuaauacuaauaacucuucua

SEQ ID NO: 2114024 - RNA, 17 nt, Staphylococcus aureus subsp. aureus MW2
auuuaacuaugaaauug

SEQ ID NO: 2114025 - RNA, 20 nt, Staphylococcus aureus subsp. aureus MW2
auuuaauaaguuaauguaau

SEQ ID NO: 2114026 - RNA, 13 nt, Staphylococcus aureus subsp. aureus MW2
auuuaauaaugcu

SEQ ID NO: 2114027 - RNA, 14 nt, Staphylococcus aureus subsp. aureus MW2
auugugcuuuuuca

SEQ ID NO: 2114028 - RNA, 16 nt, Staphylococcus aureus subsp. aureus MW2
auugugccauuuguaa

SEQ ID NO: 2114029 - RNA, 19 nt, Staphylococcus aureus subsp. aureus MW2
auugucuuuucauuuuuua

SEQ ID NO: 2114030 - RNA, 15 nt, Staphylococcus aureus subsp. aureus MW2
auugugaaaucuauu

SEQ ID NO: 2114031 - RNA, 18 nt, Staphylococcus aureus subsp. aureus MW2
auugugacaauuuaaauu

SEQ ID NO: 2114032 - RNA, 14 nt, Staphylococcus aureus subsp. aureus MW2
auugucuucauuaa

SEQ ID NO: 2114033 - RNA, 16 nt, Staphylococcus aureus subsp. aureus MW2
auugucaugccuucau

SEQ ID NO: 2114034 - RNA, 21 nt, Staphylococcus aureus subsp. aureus MW2
auugucguuguacaucauuaa

SEQ ID NO: 2114035 - RNA, 12 nt, Staphylococcus aureus subsp. aureus MW2
auuguaauaaua

SEQ ID NO: 2114036 - RNA, 22 nt, Staphylococcus aureus subsp. aureus MW2
auuguaauaauaaucuuuaaca

SEQ ID NO: 2114037 - RNA, 13 nt, Staphylococcus aureus subsp. aureus MW2
auuguaaucuauu

SEQ ID NO: 2114038 - RNA, 13 nt, Staphylococcus aureus subsp. aureus MW2
auuguaaauaaaa

SEQ ID NO: 2114039 - RNA, 13 nt, Staphylococcus aureus subsp. aureus MW2
auuguaaaacaaa

SEQ ID NO: 2114040 - RNA, 18 nt, Staphylococcus aureus subsp. aureus MW2
auuguaaaaauacauaau

SEQ ID NO: 2114041 - RNA, 13 nt, Staphylococcus aureus subsp. aureus MW2
auuguaaaaugcu

SEQ ID NO: 2114042 - RNA, 14 nt, Staphylococcus aureus subsp. aureus MW2
auugguuuaaaaag

SEQ ID NO: 2114043 - RNA, 15 nt, Staphylococcus aureus subsp. aureus MW2
auugggucuuuauca

SEQ ID NO: 2114044 - RNA, 19 nt, Staphylococcus aureus subsp. aureus MW2
auuguauuuuucaagcauu

SEQ ID NO: 2114045 - RNA, 18 nt, Staphylococcus aureus subsp. aureus MW2
auuguauguugaaaguga

SEQ ID NO: 2114046 - RNA, 18 nt, Staphylococcus aureus subsp. aureus MW2
auuguauucgcuuacauu

SEQ ID NO: 2114047 - RNA, 19 nt, Staphylococcus aureus subsp. aureus MW2
auuguauuaaucaaauauu

SEQ ID NO: 2114048 - RNA, 16 nt, Staphylococcus aureus subsp. aureus MW2
auuguaaucuauuuuc

SEQ ID NO: 2114049 - RNA, 21 nt, Staphylococcus aureus subsp. aureus MW2
auuguacgcuucaauuauuuc

SEQ ID NO: 2114050 - RNA, 13 nt, Staphylococcus aureus subsp. aureus MW2
auuguaaccugac

SEQ ID NO: 2114051 - RNA, 18 nt, Staphylococcus aureus subsp. aureus MW2
auuguauagaauguguau

SEQ ID NO: 2114052 - RNA, 12 nt, Staphylococcus aureus subsp. aureus MW2
auuguugugcuu

SEQ ID NO: 2114053 - RNA, 17 nt, Staphylococcus aureus subsp. aureus MW2
auuguuuaauaacaaaa

SEQ ID NO: 2114054 - RNA, 18 nt, Staphylococcus aureus subsp. aureus MW2
auuguuuaauaacaaaau

SEQ ID NO: 2114055 - RNA, 12 nt, Staphylococcus aureus subsp. aureus MW2
auuguuuaaaca

SEQ ID NO: 2114056 - RNA, 19 nt, Staphylococcus aureus subsp. aureus MW2
auuguugcaaaauacgauu

SEQ ID NO: 2114057 - RNA, 13 nt, Staphylococcus aureus subsp. aureus MW2
auuguugcaaaau

SEQ ID NO: 2114058 - RNA, 19 nt, Staphylococcus aureus subsp. aureus MW2
auuguugagaaacuuuuuc

SEQ ID NO: 2114059 - RNA, 14 nt, Staphylococcus aureus subsp. aureus MW2
auuguuaauacaug

SEQ ID NO: 2114060 - RNA, 16 nt, Staphylococcus aureus subsp. aureus MW2
auuguuacuuuaacuu

SEQ ID NO: 2114061 - RNA, 13 nt, Staphylococcus aureus subsp. aureus MW2
auuguuaaacauu

SEQ ID NO: 2114062 - RNA, 17 nt, Staphylococcus aureus subsp. aureus MW2
auuguguaugagucuuu

SEQ ID NO: 2114063 - RNA, 21 nt, Staphylococcus aureus subsp. aureus MW2
auuguuagauaaucucauucu

SEQ ID NO: 2114064 - RNA, 16 nt, Staphylococcus aureus subsp. aureus MW2
auuguucauguuuaaa

SEQ ID NO: 2114065 - RNA, 15 nt, Staphylococcus aureus subsp. aureus MW2
auuguuuguuuuuau

SEQ ID NO: 2114066 - RNA, 17 nt, Staphylococcus aureus subsp. aureus MW2
auuuaaacgguaacaaa

SEQ ID NO: 2114067 - RNA, 19 nt, Staphylococcus aureus subsp. aureus MW2
auuguuugaaaauuaacua

SEQ ID NO: 2114068 - RNA, 21 nt, Staphylococcus aureus subsp. aureus MW2
auuguuuauuccuucucuauu

SEQ ID NO: 2114069 - RNA, 18 nt, Staphylococcus aureus subsp. aureus MW2
auuguuucaccagcuugu

SEQ ID NO: 2114070 - RNA, 20 nt, Staphylococcus aureus subsp. aureus MW2
auuguuuuagcaauuugcug

SEQ ID NO: 2114071 - RNA, 16 nt, Staphylococcus aureus subsp. aureus MW2
auuuaaacucauaauu

SEQ ID NO: 2114072 - RNA, 23 nt, Staphylococcus aureus subsp. aureus MW2
auuuaaacucauaauuuucuauu

SEQ ID NO: 2114073 - RNA, 20 nt, Staphylococcus aureus subsp. aureus MW2
auuuaaaggcauaauaacca

SEQ ID NO: 2114074 - RNA, 17 nt, Staphylococcus aureus subsp. aureus MW2
auuuaaagucuucaucu

SEQ ID NO: 2114075 - RNA, 15 nt, Staphylococcus aureus subsp. aureus MW2
auuuaaauuaaaaua

SEQ ID NO: 2114076 - RNA, 19 nt, Staphylococcus aureus subsp. aureus MW2
auuuaaaugcuucucuaua

SEQ ID NO: 2114077 - RNA, 23 nt, Staphylococcus aureus subsp. aureus MW2
auuuaaauuacaguuucuauauu

SEQ ID NO: 2114078 - RNA, 17 nt, Staphylococcus aureus subsp. aureus MW2
auuuaacauguauuuag

SEQ ID NO: 2114079 - RNA, 17 nt, Staphylococcus aureus subsp. aureus MW2
auuuaacauuuuuuuca

SEQ ID NO: 2114080 - RNA, 18 nt, Staphylococcus aureus subsp. aureus MW2
auuuuaugauuugauuug

SEQ ID NO: 2114081 - RNA, 16 nt, Staphylococcus aureus subsp. aureus MW2
auuuuaucugaaaaua

SEQ ID NO: 2114082 - RNA, 19 nt, Staphylococcus aureus subsp. aureus MW2
auuuuauuagaucacuauu

SEQ ID NO: 2114083 - RNA, 14 nt, Staphylococcus aureus subsp. aureus MW2
auuuuauuauaaua

SEQ ID NO: 2114084 - RNA, 23 nt, Staphylococcus aureus subsp. aureus MW2
auuuuauuaaaucguauauuaaa

SEQ ID NO: 2114085 - RNA, 18 nt, Staphylococcus aureus subsp. aureus MW2
auuuuauguccagccauu

SEQ ID NO: 2114086 - RNA, 16 nt, Staphylococcus aureus subsp. aureus MW2
auuuuauggugcuaaa

SEQ ID NO: 2114087 - RNA, 22 nt, Staphylococcus aureus subsp. aureus MW2
auuuucaauacuugaaagauuu

SEQ ID NO: 2114088 - RNA, 16 nt, Staphylococcus aureus subsp. aureus MW2
auuuucaauaaaaaug

SEQ ID NO: 2114089 - RNA, 22 nt, Staphylococcus aureus subsp. aureus MW2
auuuucaaugauuaaaucuucu

SEQ ID NO: 2114090 - RNA, 19 nt, Staphylococcus aureus subsp. aureus MW2
auuuucaauaaauuuuaua

SEQ ID NO: 2114091 - RNA, 13 nt, Staphylococcus aureus subsp. aureus MW2
auuuuauucuuca

SEQ ID NO: 2114092 - RNA, 23 nt, Staphylococcus aureus subsp. aureus MW2
auuuuauugaguaucaugcuuuu

SEQ ID NO: 2114093 - RNA, 22 nt, Staphylococcus aureus subsp. aureus MW2
auuuucaauuagaaaauuucuc

SEQ ID NO: 2114094 - RNA, 16 nt, Staphylococcus aureus subsp. aureus MW2
auuuucaauuagaaaa

SEQ ID NO: 2114095 - RNA, 15 nt, Staphylococcus aureus subsp. aureus MW2
auuuucauauaaaua

SEQ ID NO: 2114096 - RNA, 15 nt, Staphylococcus aureus subsp. aureus MW2
auuuucauaaacucu

SEQ ID NO: 2114097 - RNA, 15 nt, Staphylococcus aureus subsp. aureus MW2
auuuuaauauuuucu

SEQ ID NO: 2114098 - RNA, 15 nt, Staphylococcus aureus subsp. aureus MW2
auuuuaauauuaugu

SEQ ID NO: 2114099 - RNA, 20 nt, Staphylococcus aureus subsp. aureus MW2
auuuuaauagguuaguaaua

SEQ ID NO: 2114100 - RNA, 17 nt, Staphylococcus aureus subsp. aureus MW2
auuuuaauaguuuuaau

SEQ ID NO: 2114101 - RNA, 18 nt, Staphylococcus aureus subsp. aureus MW2
auuuuaauaguuuuaaua

SEQ ID NO: 2114102 - RNA, 21 nt, Staphylococcus aureus subsp. aureus MW2
auuuuacuugaauauagcugu

SEQ ID NO: 2114103 - RNA, 20 nt, Staphylococcus aureus subsp. aureus MW2
auuuuagacuacauucuuca

SEQ ID NO: 2114104 - RNA, 15 nt, Staphylococcus aureus subsp. aureus MW2
auuuuaaauuuaauu

SEQ ID NO: 2114105 - RNA, 20 nt, Staphylococcus aureus subsp. aureus MW2
auuuuaaaucuaauuauuca

SEQ ID NO: 2114106 - RNA, 13 nt, Staphylococcus aureus subsp. aureus MW2
auuuuaacuuaua

SEQ ID NO: 2114107 - RNA, 21 nt, Staphylococcus aureus subsp. aureus MW2
auuuuaaauauugauauaaaa

SEQ ID NO: 2114108 - RNA, 13 nt, Staphylococcus aureus subsp. aureus MW2
auuuuaaauuuuu

SEQ ID NO: 2114109 - RNA, 15 nt, Staphylococcus aureus subsp. aureus MW2
auuuuaacuuauaua

SEQ ID NO: 2114110 - RNA, 15 nt, Staphylococcus aureus subsp. aureus MW2
auuuuaauaacaagu

SEQ ID NO: 2114111 - RNA, 19 nt, Staphylococcus aureus subsp. aureus MW2
auuuuaauaaaaucaucuu

SEQ ID NO: 2114112 - RNA, 14 nt, Staphylococcus aureus subsp. aureus MW2
auuuuguuuuaaaa

SEQ ID NO: 2114113 - RNA, 12 nt, Staphylococcus aureus subsp. aureus MW2
auuuuguuuuaa

SEQ ID NO: 2114114 - RNA, 18 nt, Staphylococcus aureus subsp. aureus MW2
auuuuguuucaacauuuc

SEQ ID NO: 2114115 - RNA, 14 nt, Staphylococcus aureus subsp. aureus MW2
auuuuguauuuuuc

SEQ ID NO: 2114116 - RNA, 16 nt, Staphylococcus aureus subsp. aureus MW2
auuuuguaugaauggu

SEQ ID NO: 2114117 - RNA, 16 nt, Staphylococcus aureus subsp. aureus MW2
auuuuguauuagcauc

SEQ ID NO: 2114118 - RNA, 14 nt, Staphylococcus aureus subsp. aureus MW2
auuuugugcuuuuu

SEQ ID NO: 2114119 - RNA, 19 nt, Staphylococcus aureus subsp. aureus MW2
auuuugagucguagauacu

SEQ ID NO: 2114120 - RNA, 21 nt, Staphylococcus aureus subsp. aureus MW2
auuuugagcuaaccacaucau

SEQ ID NO: 2114121 - RNA, 21 nt, Staphylococcus aureus subsp. aureus MW2
auuuugagaaaauaucauuuc

SEQ ID NO: 2114122 - RNA, 11 nt, Staphylococcus aureus subsp. aureus MW2
auuuugauuua

SEQ ID NO: 2114123 - RNA, 15 nt, Staphylococcus aureus subsp. aureus MW2
auuuugauuuaccuu

SEQ ID NO: 2114124 - RNA, 15 nt, Staphylococcus aureus subsp. aureus MW2
auuuuguacauaaaa

SEQ ID NO: 2114125 - RNA, 16 nt, Staphylococcus aureus subsp. aureus MW2
auuuuguacauaaaaa

SEQ ID NO: 2114126 - RNA, 17 nt, Staphylococcus aureus subsp. aureus MW2
auuuucuguccaaaaag

SEQ ID NO: 2114127 - RNA, 21 nt, Staphylococcus aureus subsp. aureus MW2
auuuucuuagaaaaucaaguu

SEQ ID NO: 2114128 - RNA, 20 nt, Staphylococcus aureus subsp. aureus MW2
auuuucuuagaaaaucaagu

SEQ ID NO: 2114129 - RNA, 20 nt, Staphylococcus aureus subsp. aureus MW2
auuuucuucaccaguuucug

SEQ ID NO: 2114130 - RNA, 18 nt, Staphylococcus aureus subsp. aureus MW2
auuuucgcaaaauuauuu

SEQ ID NO: 2114131 - RNA, 18 nt, Staphylococcus aureus subsp. aureus MW2
auuuucaucauaaucuac

SEQ ID NO: 2114132 - RNA, 21 nt, Staphylococcus aureus subsp. aureus MW2
auuucaugugcaagcuuuuua

SEQ ID NO: 2114133 - RNA, 18 nt, Staphylococcus aureus subsp. aureus MW2
auuucaugugcaagcuuu

SEQ ID NO: 2114134 - RNA, 19 nt, Staphylococcus aureus subsp. aureus MW2
auuucucccauccccuuug

SEQ ID NO: 2114135 - RNA, 20 nt, Staphylococcus aureus subsp. aureus MW2
auuucuaaauuauuuauuca

SEQ ID NO: 2114136 - RNA, 20 nt, Staphylococcus aureus subsp. aureus MW2
auuucuauuuaaacaagaaa

SEQ ID NO: 2114137 - RNA, 19 nt, Staphylococcus aureus subsp. aureus MW2
auuucuugauggauauuca

SEQ ID NO: 2114138 - RNA, 13 nt, Staphylococcus aureus subsp. aureus MW2
auuucuucugcua

SEQ ID NO: 2114139 - RNA, 18 nt, Staphylococcus aureus subsp. aureus MW2
auuucuucauuaucaaua

SEQ ID NO: 2114140 - RNA, 20 nt, Staphylococcus aureus subsp. aureus MW2
auuucuuuuuucaauguuug

SEQ ID NO: 2114141 - RNA, 14 nt, Staphylococcus aureus subsp. aureus MW2
auuugaagcauuaa

SEQ ID NO: 2114142 - RNA, 17 nt, Staphylococcus aureus subsp. aureus MW2
auuuguaguaaguagaa

SEQ ID NO: 2114143 - RNA, 15 nt, Staphylococcus aureus subsp. aureus MW2
auuuguauuauaugg

SEQ ID NO: 2114144 - RNA, 19 nt, Staphylococcus aureus subsp. aureus MW2
auuugugguaaucauguaa

SEQ ID NO: 2114145 - RNA, 15 nt, Staphylococcus aureus subsp. aureus MW2
auuuguguauaaaug

SEQ ID NO: 2114146 - RNA, 20 nt, Staphylococcus aureus subsp. aureus MW2
auuuuaaaccguuauauauu

SEQ ID NO: 2114147 - RNA, 21 nt, Staphylococcus aureus subsp. aureus MW2
auuugugugcgauaagcaaaa

SEQ ID NO: 2114148 - RNA, 18 nt, Staphylococcus aureus subsp. aureus MW2
auuuguuaauuuaauaau

SEQ ID NO: 2114149 - RNA, 23 nt, Staphylococcus aureus subsp. aureus MW2
auuuguguuuuuaauguuugcuu

SEQ ID NO: 2114150 - RNA, 14 nt, Staphylococcus aureus subsp. aureus MW2
auuuguuacuucua

SEQ ID NO: 2114151 - RNA, 21 nt, Staphylococcus aureus subsp. aureus MW2
auuuggguaauguuuuuacaa

SEQ ID NO: 2114152 - RNA, 18 nt, Staphylococcus aureus subsp. aureus MW2
auuugguaggcauuuuau

SEQ ID NO: 2114153 - RNA, 15 nt, Staphylococcus aureus subsp. aureus MW2
auuuggcguaaugau

SEQ ID NO: 2114154 - RNA, 13 nt, Staphylococcus aureus subsp. aureus MW2
auuugauacaacu

SEQ ID NO: 2114155 - RNA, 22 nt, Staphylococcus aureus subsp. aureus MW2
auuugauacaacuauauguguc

SEQ ID NO: 2114156 - RNA, 15 nt, Staphylococcus aureus subsp. aureus MW2
auuugauaauauuau

SEQ ID NO: 2114157 - RNA, 19 nt, Staphylococcus aureus subsp. aureus MW2
auuugauucauuacauguu

SEQ ID NO: 2114158 - RNA, 15 nt, Staphylococcus aureus subsp. aureus MW2
auuugaugguuuaau

SEQ ID NO: 2114159 - RNA, 16 nt, Staphylococcus aureus subsp. aureus MW2
auuugauguucuugaa

SEQ ID NO: 2114160 - RNA, 16 nt, Staphylococcus aureus subsp. aureus MW2
auuugauuauguaaau

SEQ ID NO: 2114161 - RNA, 21 nt, Staphylococcus aureus subsp. aureus MW2
auuugauuauucguauucaaa

SEQ ID NO: 2114162 - RNA, 16 nt, Staphylococcus aureus subsp. aureus MW2
auuugauuauucuuca

SEQ ID NO: 2114163 - RNA, 20 nt, Staphylococcus aureus subsp. aureus MW2
auuugauuuaaaaaguuaau

SEQ ID NO: 2114164 - RNA, 16 nt, Staphylococcus aureus subsp. aureus MW2
auuugauuuauauuuu

SEQ ID NO: 2114165 - RNA, 23 nt, Staphylococcus aureus subsp. aureus MW2
auuugccccgccauucauaaaug

SEQ ID NO: 2114166 - RNA, 22 nt, Staphylococcus aureus subsp. aureus MW2
auuugccuaaaguauuaucuaa

SEQ ID NO: 2114167 - RNA, 16 nt, Staphylococcus aureus subsp. aureus MW2
auuugcgauuucuucu

SEQ ID NO: 2114168 - RNA, 18 nt, Staphylococcus aureus subsp. aureus MW2
caaaacauuuugugacuu

SEQ ID NO: 2114169 - RNA, 19 nt, Staphylococcus aureus subsp. aureus MW2
caaaacauauucaguauau

SEQ ID NO: 2114170 - RNA, 13 nt, Staphylococcus aureus subsp. aureus MW2
caaaacauuuugu

SEQ ID NO: 2114171 - RNA, 15 nt, Staphylococcus aureus subsp. aureus MW2
caaaaccaaaugaac

SEQ ID NO: 2114172 - RNA, 22 nt, Staphylococcus aureus subsp. aureus MW2
caaaacaaaaaauaucuuuuug

SEQ ID NO: 2114173 - RNA, 23 nt, Staphylococcus aureus subsp. aureus MW2
caaaacaaaaaauaucuuuuugu

SEQ ID NO: 2114174 - RNA, 13 nt, Staphylococcus aureus subsp. aureus MW2
caaaacaaaaaau

SEQ ID NO: 2114175 - RNA, 19 nt, Staphylococcus aureus subsp. aureus MW2
caaaacaaaaaauaucuuu

SEQ ID NO: 2114176 - RNA, 15 nt, Staphylococcus aureus subsp. aureus MW2
caaaacaaaaaauau

SEQ ID NO: 2114177 - RNA, 17 nt, Staphylococcus aureus subsp. aureus MW2
caaaaccgcuauaaaau

SEQ ID NO: 2114178 - RNA, 18 nt, Staphylococcus aureus subsp. aureus MW2
caaaacgcauuucaugug

SEQ ID NO: 2114179 - RNA, 20 nt, Staphylococcus aureus subsp. aureus MW2
caaaagaaaguuaauuaugu

SEQ ID NO: 2114180 - RNA, 22 nt, Staphylococcus aureus subsp. aureus MW2
caaaacuagcaguaauauguug

SEQ ID NO: 2114181 - RNA, 21 nt, Staphylococcus aureus subsp. aureus MW2
caaaagauguuucaaaauaau

SEQ ID NO: 2114182 - RNA, 15 nt, Staphylococcus aureus subsp. aureus MW2
caaaagaugaaaauc

SEQ ID NO: 2114183 - RNA, 20 nt, Staphylococcus aureus subsp. aureus MW2
caaaagauguuucaaaauaa

SEQ ID NO: 2114184 - RNA, 11 nt, Staphylococcus aureus subsp. aureus MW2
caaaaaaugaa

SEQ ID NO: 2114185 - RNA, 12 nt, Staphylococcus aureus subsp. aureus MW2
caaaaaauaaua

SEQ ID NO: 2114186 - RNA, 21 nt, Staphylococcus aureus subsp. aureus MW2
caaaaaauaauagcaaaauua

SEQ ID NO: 2114187 - RNA, 15 nt, Staphylococcus aureus subsp. aureus MW2
caaaaaauaauuuaa

SEQ ID NO: 2114188 - RNA, 17 nt, Staphylococcus aureus subsp. aureus MW2
caaaaacuauuuuuuag

SEQ ID NO: 2114189 - RNA, 18 nt, Staphylococcus aureus subsp. aureus MW2
caaaaagcccuauuauuu

SEQ ID NO: 2114190 - RNA, 16 nt, Staphylococcus aureus subsp. aureus MW2
caaaaacauaaucauu

SEQ ID NO: 2114191 - RNA, 21 nt, Staphylococcus aureus subsp. aureus MW2
caaaaaugaagaauacaaaua

SEQ ID NO: 2114192 - RNA, 14 nt, Staphylococcus aureus subsp. aureus MW2
caaaaaugaagaau

SEQ ID NO: 2114193 - RNA, 20 nt, Staphylococcus aureus subsp. aureus MW2
caaaaauugcuauauuagua

SEQ ID NO: 2114194 - RNA, 17 nt, Staphylococcus aureus subsp. aureus MW2
caaaaauuguaaaaccu

SEQ ID NO: 2114195 - RNA, 18 nt, Staphylococcus aureus subsp. aureus MW2
caaaaauuguuaauacau

SEQ ID NO: 2114196 - RNA, 17 nt, Staphylococcus aureus subsp. aureus MW2
caaaaauagauugaaaa

SEQ ID NO: 2114197 - RNA, 22 nt, Staphylococcus aureus subsp. aureus MW2
caaaaauaauuaugaaaaguga

SEQ ID NO: 2114198 - RNA, 16 nt, Staphylococcus aureus subsp. aureus MW2
caaaaauacuuuuuga

SEQ ID NO: 2114199 - RNA, 21 nt, Staphylococcus aureus subsp. aureus MW2
caaaaauacuuuuugaugauu

SEQ ID NO: 2114200 - RNA, 15 nt, Staphylococcus aureus subsp. aureus MW2
caaaaauaaguguug

SEQ ID NO: 2114201 - RNA, 21 nt, Staphylococcus aureus subsp. aureus MW2
caaaaagucucauuaucacca

SEQ ID NO: 2114202 - RNA, 23 nt, Staphylococcus aureus subsp. aureus MW2
caaaaaaggaugaugugaauguu

SEQ ID NO: 2114203 - RNA, 15 nt, Staphylococcus aureus subsp. aureus MW2
auuuuuuucuuucuu

SEQ ID NO: 2114204 - RNA, 19 nt, Staphylococcus aureus subsp. aureus MW2
auuuuuuuguacuuucuga

SEQ ID NO: 2114205 - RNA, 22 nt, Staphylococcus aureus subsp. aureus MW2
auuuuuuucguaacauuuaaaa

SEQ ID NO: 2114206 - RNA, 18 nt, Staphylococcus aureus subsp. aureus MW2
auuuuuuuccaagcauca

SEQ ID NO: 2114207 - RNA, 17 nt, Staphylococcus aureus subsp. aureus MW2
caaaaaaacaaaaaaua

SEQ ID NO: 2114208 - RNA, 18 nt, Staphylococcus aureus subsp. aureus MW2
caaaaaaacaaaaaauaa

SEQ ID NO: 2114209 - RNA, 13 nt, Staphylococcus aureus subsp. aureus MW2
auuuuuucucuau

SEQ ID NO: 2114210 - RNA, 17 nt, Staphylococcus aureus subsp. aureus MW2
auuuuuucguuuuaaua

SEQ ID NO: 2114211 - RNA, 20 nt, Staphylococcus aureus subsp. aureus MW2
auuuuuuauuccgaacaugu

SEQ ID NO: 2114212 - RNA, 17 nt, Staphylococcus aureus subsp. aureus MW2
auuuuuucaaugucuac

SEQ ID NO: 2114213 - RNA, 18 nt, Staphylococcus aureus subsp. aureus MW2
auuuuuucaugauuuacu

SEQ ID NO: 2114214 - RNA, 12 nt, Staphylococcus aureus subsp. aureus MW2
auuuuuuuaaau

SEQ ID NO: 2114215 - RNA, 12 nt, Staphylococcus aureus subsp. aureus MW2
auuuuuugauau

SEQ ID NO: 2114216 - RNA, 21 nt, Staphylococcus aureus subsp. aureus MW2
auuuuuuuaaaucuauauaaa

SEQ ID NO: 2114217 - RNA, 17 nt, Staphylococcus aureus subsp. aureus MW2
auuuuuuuaauguuaua

SEQ ID NO: 2114218 - RNA, 14 nt, Staphylococcus aureus subsp. aureus MW2
auuuuuuuauguua

SEQ ID NO: 2114219 - RNA, 14 nt, Staphylococcus aureus subsp. aureus MW2
auuuuguuuucuuu

SEQ ID NO: 2114220 - RNA, 15 nt, Staphylococcus aureus subsp. aureus MW2
auuuuuaaaauuaug

SEQ ID NO: 2114221 - RNA, 21 nt, Staphylococcus aureus subsp. aureus MW2
auuuuuaaauaugauagccaa

SEQ ID NO: 2114222 - RNA, 17 nt, Staphylococcus aureus subsp. aureus MW2
auuuuuccaguccauuu

SEQ ID NO: 2114223 - RNA, 18 nt, Staphylococcus aureus subsp. aureus MW2
auuuuuccaguccauuuu

SEQ ID NO: 2114224 - RNA, 19 nt, Staphylococcus aureus subsp. aureus MW2
auuuuugacuguuaaacaa

SEQ ID NO: 2114225 - RNA, 16 nt, Staphylococcus aureus subsp. aureus MW2
auuuuugacuguuaaa

SEQ ID NO: 2114226 - RNA, 21 nt, Staphylococcus aureus subsp. aureus MW2
auuuuucuuuguguuugcuuu

SEQ ID NO: 2114227 - RNA, 21 nt, Staphylococcus aureus subsp. aureus MW2
auuuuucuucaguuaaaucuu

SEQ ID NO: 2114228 - RNA, 21 nt, Staphylococcus aureus subsp. aureus MW2
auuuuucuuuaagcuuucuau

SEQ ID NO: 2114229 - RNA, 12 nt, Staphylococcus aureus subsp. aureus MW2
auuuuucuucuu

SEQ ID NO: 2114230 - RNA, 20 nt, Staphylococcus aureus subsp. aureus MW2
auuuuucuuccuaaauaauu

SEQ ID NO: 2114231 - RNA, 17 nt, Staphylococcus aureus subsp. aureus MW2
auuuuuuaaugucuaaa

SEQ ID NO: 2114232 - RNA, 16 nt, Staphylococcus aureus subsp. aureus MW2
auuuuuuagacuuuau

SEQ ID NO: 2114233 - RNA, 23 nt, Staphylococcus aureus subsp. aureus MW2
auuuuuuagacuuuauuuuucca

SEQ ID NO: 2114234 - RNA, 14 nt, Staphylococcus aureus subsp. aureus MW2
auuuuuuacaacgu

SEQ ID NO: 2114235 - RNA, 23 nt, Staphylococcus aureus subsp. aureus MW2
auuuuuuagguucuucaucuuuu

SEQ ID NO: 2114236 - RNA, 13 nt, Staphylococcus aureus subsp. aureus MW2
auuuuuuaauaua

SEQ ID NO: 2114237 - RNA, 12 nt, Staphylococcus aureus subsp. aureus MW2
auuuuugucauc

SEQ ID NO: 2114238 - RNA, 20 nt, Staphylococcus aureus subsp. aureus MW2
auuuuuggauucaccaauua

SEQ ID NO: 2114239 - RNA, 16 nt, Staphylococcus aureus subsp. aureus MW2
auuuuuguauuuaugu

SEQ ID NO: 2114240 - RNA, 14 nt, Staphylococcus aureus subsp. aureus MW2
caaucuauauaaau

SEQ ID NO: 2114241 - RNA, 13 nt, Staphylococcus aureus subsp. aureus MW2
caaucguuaauuu

SEQ ID NO: 2114242 - RNA, 15 nt, Staphylococcus aureus subsp. aureus MW2
caaucuaaauguaaa

SEQ ID NO: 2114243 - RNA, 17 nt, Staphylococcus aureus subsp. aureus MW2
caaucuaaauguaaaau

SEQ ID NO: 2114244 - RNA, 19 nt, Staphylococcus aureus subsp. aureus MW2
caaucgcauuuuguuucaa

SEQ ID NO: 2114245 - RNA, 19 nt, Staphylococcus aureus subsp. aureus MW2
caaucgcuuuagcaauuga

SEQ ID NO: 2114246 - RNA, 12 nt, Staphylococcus aureus subsp. aureus MW2
caaucauaauac

SEQ ID NO: 2114247 - RNA, 18 nt, Staphylococcus aureus subsp. aureus MW2
caaucaucacacauaaau

SEQ ID NO: 2114248 - RNA, 12 nt, Staphylococcus aureus subsp. aureus MW2
caaucaaaggcu

SEQ ID NO: 2114249 - RNA, 22 nt, Staphylococcus aureus subsp. aureus MW2
caauauuugauaaguagaaaau

SEQ ID NO: 2114250 - RNA, 18 nt, Staphylococcus aureus subsp. aureus MW2
caauauucucuuuaccag

SEQ ID NO: 2114251 - RNA, 14 nt, Staphylococcus aureus subsp. aureus MW2
caauauuaggccaa

SEQ ID NO: 2114252 - RNA, 18 nt, Staphylococcus aureus subsp. aureus MW2
caauauuaggccaacguu

SEQ ID NO: 2114253 - RNA, 15 nt, Staphylococcus aureus subsp. aureus MW2
caaucauucacuuca

SEQ ID NO: 2114254 - RNA, 14 nt, Staphylococcus aureus subsp. aureus MW2
caaucaucuuaaug

SEQ ID NO: 2114255 - RNA, 20 nt, Staphylococcus aureus subsp. aureus MW2
caaucaugcuuuuuuguccc

SEQ ID NO: 2114256 - RNA, 14 nt, Staphylococcus aureus subsp. aureus MW2
caaugauucaucag

SEQ ID NO: 2114257 - RNA, 11 nt, Staphylococcus aureus subsp. aureus MW2
caaugauuaau

SEQ ID NO: 2114258 - RNA, 18 nt, Staphylococcus aureus subsp. aureus MW2
caaugauuaaaucuucua

SEQ ID NO: 2114259 - RNA, 20 nt, Staphylococcus aureus subsp. aureus MW2
caaugaugaauuguaaaagu

SEQ ID NO: 2114260 - RNA, 20 nt, Staphylococcus aureus subsp. aureus MW2
caaugagcaagucuucuaaa

SEQ ID NO: 2114261 - RNA, 15 nt, Staphylococcus aureus subsp. aureus MW2
caaugcaaguuggcg

SEQ ID NO: 2114262 - RNA, 17 nt, Staphylococcus aureus subsp. aureus MW2
caaugcaaguuggcggg

SEQ ID NO: 2114263 - RNA, 14 nt, Staphylococcus aureus subsp. aureus MW2
caaugcaaguuggc

SEQ ID NO: 2114264 - RNA, 18 nt, Staphylococcus aureus subsp. aureus MW2
caaugauuuuuaaaaaua

SEQ ID NO: 2114265 - RNA, 19 nt, Staphylococcus aureus subsp. aureus MW2
caaugccacaucauagcac

SEQ ID NO: 2114266 - RNA, 19 nt, Staphylococcus aureus subsp. aureus MW2
caaugacugagaaaaauau

SEQ ID NO: 2114267 - RNA, 16 nt, Staphylococcus aureus subsp. aureus MW2
caaugaauaaauugau

SEQ ID NO: 2114268 - RNA, 17 nt, Staphylococcus aureus subsp. aureus MW2
caaugaauucauuuuau

SEQ ID NO: 2114269 - RNA, 16 nt, Staphylococcus aureus subsp. aureus MW2
caaugaauccaaauau

SEQ ID NO: 2114270 - RNA, 21 nt, Staphylococcus aureus subsp. aureus MW2
caaugaauccaaauauuaaaa

SEQ ID NO: 2114271 - RNA, 20 nt, Staphylococcus aureus subsp. aureus MW2
caaugaaaacagguggaagu

SEQ ID NO: 2114272 - RNA, 16 nt, Staphylococcus aureus subsp. aureus MW2
caaugcgcaaugaaaa

SEQ ID NO: 2114273 - RNA, 15 nt, Staphylococcus aureus subsp. aureus MW2
caaugccuuuaaagc

SEQ ID NO: 2114274 - RNA, 16 nt, Staphylococcus aureus subsp. aureus MW2
caauggaucuguuaca

SEQ ID NO: 2114275 - RNA, 14 nt, Staphylococcus aureus subsp. aureus MW2
caauggccauuuga

SEQ ID NO: 2114276 - RNA, 13 nt, Staphylococcus aureus subsp. aureus MW2
caauggcuuuacc

SEQ ID NO: 2114277 - RNA, 13 nt, Staphylococcus aureus subsp. aureus MW2
caauguaaaaaag

SEQ ID NO: 2114278 - RNA, 12 nt, Staphylococcus aureus subsp. aureus MW2
caauguauuuug

SEQ ID NO: 2114279 - RNA, 13 nt, Staphylococcus aureus subsp. aureus MW2
caaugucaucuug

SEQ ID NO: 2114280 - RNA, 11 nt, Staphylococcus aureus subsp. aureus MW2
caauaaaaaug

SEQ ID NO: 2114281 - RNA, 19 nt, Staphylococcus aureus subsp. aureus MW2
caaguuuucggcuagauuu

SEQ ID NO: 2114282 - RNA, 19 nt, Staphylococcus aureus subsp. aureus MW2
caauaaaaaaccaagugca

SEQ ID NO: 2114283 - RNA, 12 nt, Staphylococcus aureus subsp. aureus MW2
caaguauagacc

SEQ ID NO: 2114284 - RNA, 15 nt, Staphylococcus aureus subsp. aureus MW2
caaguauagaccauc

SEQ ID NO: 2114285 - RNA, 13 nt, Staphylococcus aureus subsp. aureus MW2
caaguccaaauaa

SEQ ID NO: 2114286 - RNA, 16 nt, Staphylococcus aureus subsp. aureus MW2
caauaaauaaacaacu

SEQ ID NO: 2114287 - RNA, 22 nt, Staphylococcus aureus subsp. aureus MW2
caauaaauuguuuacuauacuu

SEQ ID NO: 2114288 - RNA, 18 nt, Staphylococcus aureus subsp. aureus MW2
caauaaauauugauucua

SEQ ID NO: 2114289 - RNA, 12 nt, Staphylococcus aureus subsp. aureus MW2
caauaaaucuuu

SEQ ID NO: 2114290 - RNA, 17 nt, Staphylococcus aureus subsp. aureus MW2
caauaacaccaauugaa

SEQ ID NO: 2114291 - RNA, 16 nt, Staphylococcus aureus subsp. aureus MW2
caauaacaccaauuga

SEQ ID NO: 2114292 - RNA, 17 nt, Staphylococcus aureus subsp. aureus MW2
caauaacaaugcagcug

SEQ ID NO: 2114293 - RNA, 19 nt, Staphylococcus aureus subsp. aureus MW2
caauaucaucauuuaaaua

SEQ ID NO: 2114294 - RNA, 14 nt, Staphylococcus aureus subsp. aureus MW2
caauauaacaucaa

SEQ ID NO: 2114295 - RNA, 15 nt, Staphylococcus aureus subsp. aureus MW2
caauauaacaucaaa

SEQ ID NO: 2114296 - RNA, 21 nt, Staphylococcus aureus subsp. aureus MW2
caauaucuucuaauuccauca

SEQ ID NO: 2114297 - RNA, 18 nt, Staphylococcus aureus subsp. aureus MW2
caauagguacaacuaaau

SEQ ID NO: 2114298 - RNA, 15 nt, Staphylococcus aureus subsp. aureus MW2
caauaggaugaaacu

SEQ ID NO: 2114299 - RNA, 12 nt, Staphylococcus aureus subsp. aureus MW2
caauaguaccau

SEQ ID NO: 2114300 - RNA, 21 nt, Staphylococcus aureus subsp. aureus MW2
caauaguaguauuaucuuuca

SEQ ID NO: 2114301 - RNA, 16 nt, Staphylococcus aureus subsp. aureus MW2
caauaguuuauaauuu

SEQ ID NO: 2114302 - RNA, 15 nt, Staphylococcus aureus subsp. aureus MW2
caauauaaacaucuu

SEQ ID NO: 2114303 - RNA, 24 nt, Staphylococcus aureus subsp. aureus MW2
caauaauugaugaaagacugacua

SEQ ID NO: 2114304 - RNA, 22 nt, Staphylococcus aureus subsp. aureus MW2
caauaauucguugauuuagcau

SEQ ID NO: 2114305 - RNA, 17 nt, Staphylococcus aureus subsp. aureus MW2
caauaauugcugucacu

SEQ ID NO: 2114306 - RNA, 14 nt, Staphylococcus aureus subsp. aureus MW2
caauaauuuuaucu

SEQ ID NO: 2114307 - RNA, 15 nt, Staphylococcus aureus subsp. aureus MW2
caauacguuuccaau

SEQ ID NO: 2114308 - RNA, 15 nt, Staphylococcus aureus subsp. aureus MW2
caauacuuuuuauau

SEQ ID NO: 2114309 - RNA, 15 nt, Staphylococcus aureus subsp. aureus MW2
caacuuauaauauua

SEQ ID NO: 2114310 - RNA, 15 nt, Staphylococcus aureus subsp. aureus MW2
caacuucaucuaaau

SEQ ID NO: 2114311 - RNA, 19 nt, Staphylococcus aureus subsp. aureus MW2
caacuucaucuaaaugaug

SEQ ID NO: 2114312 - RNA, 14 nt, Staphylococcus aureus subsp. aureus MW2
caagcauaucuuua

SEQ ID NO: 2114313 - RNA, 15 nt, Staphylococcus aureus subsp. aureus MW2
caagccaagauaaau

SEQ ID NO: 2114314 - RNA, 19 nt, Staphylococcus aureus subsp. aureus MW2
caagguaguuggcugauag

SEQ ID NO: 2114315 - RNA, 21 nt, Staphylococcus aureus subsp. aureus MW2
caagguguucgggaauuuuuu

SEQ ID NO: 2114316 - RNA, 15 nt, Staphylococcus aureus subsp. aureus MW2
caaggagaugauaac

SEQ ID NO: 2114317 - RNA, 16 nt, Staphylococcus aureus subsp. aureus MW2
caaauaaaagcaacaa

SEQ ID NO: 2114318 - RNA, 12 nt, Staphylococcus aureus subsp. aureus MW2
caaaguuuucau

SEQ ID NO: 2114319 - RNA, 13 nt, Staphylococcus aureus subsp. aureus MW2
caaauaaugaaua

SEQ ID NO: 2114320 - RNA, 19 nt, Staphylococcus aureus subsp. aureus MW2
caaauaaugugaaaaaucu

SEQ ID NO: 2114321 - RNA, 20 nt, Staphylococcus aureus subsp. aureus MW2
caaauaaacacccaauaauu

SEQ ID NO: 2114322 - RNA, 21 nt, Staphylococcus aureus subsp. aureus MW2
caaauaaacacccaauaauug

SEQ ID NO: 2114323 - RNA, 17 nt, Staphylococcus aureus subsp. aureus MW2
caaauacaguuaucacc

SEQ ID NO: 2114324 - RNA, 16 nt, Staphylococcus aureus subsp. aureus MW2
caaauacauuucaaaa

SEQ ID NO: 2114325 - RNA, 14 nt, Staphylococcus aureus subsp. aureus MW2
caaauacaguugua

SEQ ID NO: 2114326 - RNA, 19 nt, Staphylococcus aureus subsp. aureus MW2
caaauacaguuguaccaau

SEQ ID NO: 2114327 - RNA, 14 nt, Staphylococcus aureus subsp. aureus MW2
caaauaguucaaau

SEQ ID NO: 2114328 - RNA, 21 nt, Staphylococcus aureus subsp. aureus MW2
caaauaguuaagauuuuaacu

SEQ ID NO: 2114329 - RNA, 19 nt, Staphylococcus aureus subsp. aureus MW2
caaagaaacggaaaugacu

SEQ ID NO: 2114330 - RNA, 23 nt, Staphylococcus aureus subsp. aureus MW2
caaagaaaaacaucgauugauaa

SEQ ID NO: 2114331 - RNA, 17 nt, Staphylococcus aureus subsp. aureus MW2
caaacuuuucaauauua

SEQ ID NO: 2114332 - RNA, 19 nt, Staphylococcus aureus subsp. aureus MW2
caaagacauacagucaaua

SEQ ID NO: 2114333 - RNA, 14 nt, Staphylococcus aureus subsp. aureus MW2
caaaugacauuuua

SEQ ID NO: 2114334 - RNA, 17 nt, Staphylococcus aureus subsp. aureus MW2
caaaugacauuuuaaau

SEQ ID NO: 2114335 - RNA, 19 nt, Staphylococcus aureus subsp. aureus MW2
caaaucggaauaaaauaaa

SEQ ID NO: 2114336 - RNA, 14 nt, Staphylococcus aureus subsp. aureus MW2
caaaucaauaccaa

SEQ ID NO: 2114337 - RNA, 19 nt, Staphylococcus aureus subsp. aureus MW2
caaauucuuuuacagcaag

SEQ ID NO: 2114338 - RNA, 23 nt, Staphylococcus aureus subsp. aureus MW2
caaauucuaugagaauagacauu

SEQ ID NO: 2114339 - RNA, 11 nt, Staphylococcus aureus subsp. aureus MW2
caaauuacuua

SEQ ID NO: 2114340 - RNA, 22 nt, Staphylococcus aureus subsp. aureus MW2
caaauuacuuauucaaauguuu

SEQ ID NO: 2114341 - RNA, 21 nt, Staphylococcus aureus subsp. aureus MW2
caaauuagucauccaaagaaa

SEQ ID NO: 2114342 - RNA, 13 nt, Staphylococcus aureus subsp. aureus MW2
caaauuagauaaa

SEQ ID NO: 2114343 - RNA, 17 nt, Staphylococcus aureus subsp. aureus MW2
caaauuagauaaaacaa

SEQ ID NO: 2114344 - RNA, 19 nt, Staphylococcus aureus subsp. aureus MW2
caaauuagauaaaacaaaa

SEQ ID NO: 2114345 - RNA, 20 nt, Staphylococcus aureus subsp. aureus MW2
caaauuagauaaaacaaaac

SEQ ID NO: 2114346 - RNA, 22 nt, Staphylococcus aureus subsp. aureus MW2
caaauuauaauuguaaugcuuc

SEQ ID NO: 2114347 - RNA, 15 nt, Staphylococcus aureus subsp. aureus MW2
caaauuaucauuaaa

SEQ ID NO: 2114348 - RNA, 18 nt, Staphylococcus aureus subsp. aureus MW2
caaauuaauuaaaccaau

SEQ ID NO: 2114349 - RNA, 23 nt, Staphylococcus aureus subsp. aureus MW2
caaauuaaauauacuuuuauaga

SEQ ID NO: 2114350 - RNA, 17 nt, Staphylococcus aureus subsp. aureus MW2
caaaugagcguuccauu

SEQ ID NO: 2114351 - RNA, 16 nt, Staphylococcus aureus subsp. aureus MW2
caacacagagaauuuc

SEQ ID NO: 2114352 - RNA, 15 nt, Staphylococcus aureus subsp. aureus MW2
caacacagaagcugg

SEQ ID NO: 2114353 - RNA, 13 nt, Staphylococcus aureus subsp. aureus MW2
caaauuuccacag

SEQ ID NO: 2114354 - RNA, 13 nt, Staphylococcus aureus subsp. aureus MW2
caaauuuauauua

SEQ ID NO: 2114355 - RNA, 16 nt, Staphylococcus aureus subsp. aureus MW2
caaauuuauauuaaau

SEQ ID NO: 2114356 - RNA, 18 nt, Staphylococcus aureus subsp. aureus MW2
caaauuuauauuaaauaa

SEQ ID NO: 2114357 - RNA, 20 nt, Staphylococcus aureus subsp. aureus MW2
caaauugcguuguuucauua

SEQ ID NO: 2114358 - RNA, 21 nt, Staphylococcus aureus subsp. aureus MW2
caaauuggauaauuucuucuu

SEQ ID NO: 2114359 - RNA, 12 nt, Staphylococcus aureus subsp. aureus MW2
caacacagagaa

SEQ ID NO: 2114360 - RNA, 22 nt, Staphylococcus aureus subsp. aureus MW2
caacuaauuuaaagcaucauau

SEQ ID NO: 2114361 - RNA, 22 nt, Staphylococcus aureus subsp. aureus MW2
caacuaaguugacuauauaaug

SEQ ID NO: 2114362 - RNA, 18 nt, Staphylococcus aureus subsp. aureus MW2
caacuacugcuaaaauaa

SEQ ID NO: 2114363 - RNA, 21 nt, Staphylococcus aureus subsp. aureus MW2
caacuacugucaauauaacau

SEQ ID NO: 2114364 - RNA, 17 nt, Staphylococcus aureus subsp. aureus MW2
caacuaauuuaaagcau

SEQ ID NO: 2114365 - RNA, 18 nt, Staphylococcus aureus subsp. aureus MW2
caacuaauguuaaaauaa

SEQ ID NO: 2114366 - RNA, 16 nt, Staphylococcus aureus subsp. aureus MW2
caacuaagaugacuga

SEQ ID NO: 2114367 - RNA, 16 nt, Staphylococcus aureus subsp. aureus MW2
caacuaauaacaaaua

SEQ ID NO: 2114368 - RNA, 14 nt, Staphylococcus aureus subsp. aureus MW2
caacuaauaugauu

SEQ ID NO: 2114369 - RNA, 18 nt, Staphylococcus aureus subsp. aureus MW2
caacuaauaugauugguu

SEQ ID NO: 2114370 - RNA, 15 nt, Staphylococcus aureus subsp. aureus MW2
caacuaaaucaccau

SEQ ID NO: 2114371 - RNA, 12 nt, Staphylococcus aureus subsp. aureus MW2
caacuaagauau

SEQ ID NO: 2114372 - RNA, 16 nt, Staphylococcus aureus subsp. aureus MW2
caacugcgacaugucc

SEQ ID NO: 2114373 - RNA, 11 nt, Staphylococcus aureus subsp. aureus MW2
caacuuaauac

SEQ ID NO: 2114374 - RNA, 13 nt, Staphylococcus aureus subsp. aureus MW2
caacuuaauaacc

SEQ ID NO: 2114375 - RNA, 22 nt, Staphylococcus aureus subsp. aureus MW2
caacuuaauacgauaauaacua

SEQ ID NO: 2114376 - RNA, 13 nt, Staphylococcus aureus subsp. aureus MW2
caacuuagaauuu

SEQ ID NO: 2114377 - RNA, 16 nt, Staphylococcus aureus subsp. aureus MW2
caacuguucuaaaauu

SEQ ID NO: 2114378 - RNA, 18 nt, Staphylococcus aureus subsp. aureus MW2
caacugucgguucaucua

SEQ ID NO: 2114379 - RNA, 20 nt, Staphylococcus aureus subsp. aureus MW2
caacuguaguggaagacaau

SEQ ID NO: 2114380 - RNA, 15 nt, Staphylococcus aureus subsp. aureus MW2
caaccuaaaauauug

SEQ ID NO: 2114381 - RNA, 21 nt, Staphylococcus aureus subsp. aureus MW2
caaccuaugguuacccuuuuu

SEQ ID NO: 2114382 - RNA, 22 nt, Staphylococcus aureus subsp. aureus MW2
caaccuauuaauugaaaugaua

SEQ ID NO: 2114383 - RNA, 15 nt, Staphylococcus aureus subsp. aureus MW2
caacauuaauaaaua

SEQ ID NO: 2114384 - RNA, 17 nt, Staphylococcus aureus subsp. aureus MW2
caacauuaauaaauaau

SEQ ID NO: 2114385 - RNA, 15 nt, Staphylococcus aureus subsp. aureus MW2
caacauuacaugcac

SEQ ID NO: 2114386 - RNA, 21 nt, Staphylococcus aureus subsp. aureus MW2
caacauguuuggaugaacaaa

SEQ ID NO: 2114387 - RNA, 15 nt, Staphylococcus aureus subsp. aureus MW2
caacauuauuuauau

SEQ ID NO: 2114388 - RNA, 19 nt, Staphylococcus aureus subsp. aureus MW2
caacauuaauaaauaauaa

SEQ ID NO: 2114389 - RNA, 13 nt, Staphylococcus aureus subsp. aureus MW2
caacauuuuuuau

SEQ ID NO: 2114390 - RNA, 15 nt, Staphylococcus aureus subsp. aureus MW2
caacauuuuuuauag

SEQ ID NO: 2114391 - RNA, 18 nt, Staphylococcus aureus subsp. aureus MW2
caaccaaaaccaaaugaa

SEQ ID NO: 2114392 - RNA, 12 nt, Staphylococcus aureus subsp. aureus MW2
caacaugacagc

SEQ ID NO: 2114393 - RNA, 12 nt, Staphylococcus aureus subsp. aureus MW2
caacauguuugg

SEQ ID NO: 2114394 - RNA, 22 nt, Staphylococcus aureus subsp. aureus MW2
caacaugguacguacguugaug

SEQ ID NO: 2114395 - RNA, 18 nt, Staphylococcus aureus subsp. aureus MW2
caacagggguuuuuauau

SEQ ID NO: 2114396 - RNA, 16 nt, Staphylococcus aureus subsp. aureus MW2
caacagggguuuuuau

SEQ ID NO: 2114397 - RNA, 16 nt, Staphylococcus aureus subsp. aureus MW2
caacagggguaaaacu

SEQ ID NO: 2114398 - RNA, 13 nt, Staphylococcus aureus subsp. aureus MW2
caaccaauuauua

SEQ ID NO: 2114399 - RNA, 15 nt, Staphylococcus aureus subsp. aureus MW2
cagcgauuguuaaac

SEQ ID NO: 2114400 - RNA, 15 nt, Staphylococcus aureus subsp. aureus MW2
cagcgaaauuuguaa

SEQ ID NO: 2114401 - RNA, 14 nt, Staphylococcus aureus subsp. aureus MW2
cagcaccgccugaa

SEQ ID NO: 2114402 - RNA, 17 nt, Staphylococcus aureus subsp. aureus MW2
cagcaguaagauuauuu

SEQ ID NO: 2114403 - RNA, 18 nt, Staphylococcus aureus subsp. aureus MW2
cagcaguaagauuauuuu

SEQ ID NO: 2114404 - RNA, 19 nt, Staphylococcus aureus subsp. aureus MW2
cagcauuaaucguauuuuu

SEQ ID NO: 2114405 - RNA, 23 nt, Staphylococcus aureus subsp. aureus MW2
cagcaugaaucgcauuuaaauau

SEQ ID NO: 2114406 - RNA, 22 nt, Staphylococcus aureus subsp. aureus MW2
cagccauuuguuguaaaccagc

SEQ ID NO: 2114407 - RNA, 16 nt, Staphylococcus aureus subsp. aureus MW2
cagccauaauaucuuu

SEQ ID NO: 2114408 - RNA, 13 nt, Staphylococcus aureus subsp. aureus MW2
cagaugaauaaug

SEQ ID NO: 2114409 - RNA, 14 nt, Staphylococcus aureus subsp. aureus MW2
cagaugaauaaugu

SEQ ID NO: 2114410 - RNA, 22 nt, Staphylococcus aureus subsp. aureus MW2
cagaugaauaauguuuccauuu

SEQ ID NO: 2114411 - RNA, 17 nt, Staphylococcus aureus subsp. aureus MW2
cagauucauaucuuuca

SEQ ID NO: 2114412 - RNA, 17 nt, Staphylococcus aureus subsp. aureus MW2
cagauguugguucauca

SEQ ID NO: 2114413 - RNA, 18 nt, Staphylococcus aureus subsp. aureus MW2
cagauguugguucaucaa

SEQ ID NO: 2114414 - RNA, 14 nt, Staphylococcus aureus subsp. aureus MW2
cagauguugguuca

SEQ ID NO: 2114415 - RNA, 23 nt, Staphylococcus aureus subsp. aureus MW2
cagauuuauauuccauuucaaau

SEQ ID NO: 2114416 - RNA, 17 nt, Staphylococcus aureus subsp. aureus MW2
cagcacagcgauuaaau

SEQ ID NO: 2114417 - RNA, 11 nt, Staphylococcus aureus subsp. aureus MW2
cagcaaauaaa

SEQ ID NO: 2114418 - RNA, 12 nt, Staphylococcus aureus subsp. aureus MW2
cagcaaauaaaa

SEQ ID NO: 2114419 - RNA, 17 nt, Staphylococcus aureus subsp. aureus MW2
cagauaggaaacuuaaa

SEQ ID NO: 2114420 - RNA, 22 nt, Staphylococcus aureus subsp. aureus MW2
cagauagaaugucgauauuucu

SEQ ID NO: 2114421 - RNA, 13 nt, Staphylococcus aureus subsp. aureus MW2
cagauaauuauuu

SEQ ID NO: 2114422 - RNA, 14 nt, Staphylococcus aureus subsp. aureus MW2
cagauaauuauuuc

SEQ ID NO: 2114423 - RNA, 21 nt, Staphylococcus aureus subsp. aureus MW2
cagauaaguaauaauauaaau

SEQ ID NO: 2114424 - RNA, 15 nt, Staphylococcus aureus subsp. aureus MW2
cagauccauaaggau

SEQ ID NO: 2114425 - RNA, 12 nt, Staphylococcus aureus subsp. aureus MW2
cagacuccuaaa

SEQ ID NO: 2114426 - RNA, 17 nt, Staphylococcus aureus subsp. aureus MW2
cagagccguaaugagag

SEQ ID NO: 2114427 - RNA, 21 nt, Staphylococcus aureus subsp. aureus MW2
cagacuuuguuaaaaaauuaa

SEQ ID NO: 2114428 - RNA, 17 nt, Staphylococcus aureus subsp. aureus MW2
cagaagcuggcggaaag

SEQ ID NO: 2114429 - RNA, 12 nt, Staphylococcus aureus subsp. aureus MW2
cagaaaguugca

SEQ ID NO: 2114430 - RNA, 16 nt, Staphylococcus aureus subsp. aureus MW2
cagaaaugauauuuuc

SEQ ID NO: 2114431 - RNA, 13 nt, Staphylococcus aureus subsp. aureus MW2
cagacaaugcaag

SEQ ID NO: 2114432 - RNA, 19 nt, Staphylococcus aureus subsp. aureus MW2
cagacaaugcaaguuggcg

SEQ ID NO: 2114433 - RNA, 13 nt, Staphylococcus aureus subsp. aureus MW2
caauguugcuugu

SEQ ID NO: 2114434 - RNA, 14 nt, Staphylococcus aureus subsp. aureus MW2
caauguuuuacuug

SEQ ID NO: 2114435 - RNA, 20 nt, Staphylococcus aureus subsp. aureus MW2
cacugcacaucauaauaaau

SEQ ID NO: 2114436 - RNA, 15 nt, Staphylococcus aureus subsp. aureus MW2
cacugcaacacaggc

SEQ ID NO: 2114437 - RNA, 17 nt, Staphylococcus aureus subsp. aureus MW2
caaugugagauauaaag

SEQ ID NO: 2114438 - RNA, 24 nt, Staphylococcus aureus subsp. aureus MW2
caaugucuugauugaauaugugua

SEQ ID NO: 2114439 - RNA, 16 nt, Staphylococcus aureus subsp. aureus MW2
caauguuaucuugcuu

SEQ ID NO: 2114440 - RNA, 21 nt, Staphylococcus aureus subsp. aureus MW2
cacuuaaucguucccauucuu

SEQ ID NO: 2114441 - RNA, 17 nt, Staphylococcus aureus subsp. aureus MW2
cacuuaauaaauaauuu

SEQ ID NO: 2114442 - RNA, 22 nt, Staphylococcus aureus subsp. aureus MW2
cacuuaaucguucccauucuuu

SEQ ID NO: 2114443 - RNA, 16 nt, Staphylococcus aureus subsp. aureus MW2
cacuuacugugaaaau

SEQ ID NO: 2114444 - RNA, 22 nt, Staphylococcus aureus subsp. aureus MW2
cacuguaacgaguccauuuucu

SEQ ID NO: 2114445 - RNA, 19 nt, Staphylococcus aureus subsp. aureus MW2
cacugucauguguucaaau

SEQ ID NO: 2114446 - RNA, 23 nt, Staphylococcus aureus subsp. aureus MW2
cacugcuuuuaaaucauuaagaa

SEQ ID NO: 2114447 - RNA, 19 nt, Staphylococcus aureus subsp. aureus MW2
cacuuacugugaaaauacc

SEQ ID NO: 2114448 - RNA, 23 nt, Staphylococcus aureus subsp. aureus MW2
cacuuagauuccccuuuuugucu

SEQ ID NO: 2114449 - RNA, 20 nt, Staphylococcus aureus subsp. aureus MW2
cacuucaacauauaaaucau

SEQ ID NO: 2114450 - RNA, 23 nt, Staphylococcus aureus subsp. aureus MW2
cacuucuguaccgaauuggauga

SEQ ID NO: 2114451 - RNA, 12 nt, Staphylococcus aureus subsp. aureus MW2
cacuucuucacc

SEQ ID NO: 2114452 - RNA, 20 nt, Staphylococcus aureus subsp. aureus MW2
cacuucgccaagccaucuuu

SEQ ID NO: 2114453 - RNA, 14 nt, Staphylococcus aureus subsp. aureus MW2
cacuuugaucuuua

SEQ ID NO: 2114454 - RNA, 13 nt, Staphylococcus aureus subsp. aureus MW2
cacuuuuuaaacg

SEQ ID NO: 2114455 - RNA, 23 nt, Staphylococcus aureus subsp. aureus MW2
cacuuuuuaaaguaaccacaaca

SEQ ID NO: 2114456 - RNA, 14 nt, Staphylococcus aureus subsp. aureus MW2
cacuuuucaugaug

SEQ ID NO: 2114457 - RNA, 15 nt, Staphylococcus aureus subsp. aureus MW2
cacuuuuuauacauu

SEQ ID NO: 2114458 - RNA, 13 nt, Staphylococcus aureus subsp. aureus MW2
cacuugguacacc

SEQ ID NO: 2114459 - RNA, 22 nt, Staphylococcus aureus subsp. aureus MW2
cacuugguacaccuacaaauau

SEQ ID NO: 2114460 - RNA, 16 nt, Staphylococcus aureus subsp. aureus MW2
cacuugcuaaaacuaa

SEQ ID NO: 2114461 - RNA, 19 nt, Staphylococcus aureus subsp. aureus MW2
cacuuuaaacaagcaucau

SEQ ID NO: 2114462 - RNA, 12 nt, Staphylococcus aureus subsp. aureus MW2
cacuuucuacuc

SEQ ID NO: 2114463 - RNA, 17 nt, Staphylococcus aureus subsp. aureus MW2
cagcuucuuuaacaauu

SEQ ID NO: 2114464 - RNA, 14 nt, Staphylococcus aureus subsp. aureus MW2
cagcuucuuuaaca

SEQ ID NO: 2114465 - RNA, 15 nt, Staphylococcus aureus subsp. aureus MW2
cagcuucaaaaucaa

SEQ ID NO: 2114466 - RNA, 18 nt, Staphylococcus aureus subsp. aureus MW2
cagcugcuucucuuugaa

SEQ ID NO: 2114467 - RNA, 20 nt, Staphylococcus aureus subsp. aureus MW2
caggaccacucaauucucua

SEQ ID NO: 2114468 - RNA, 20 nt, Staphylococcus aureus subsp. aureus MW2
cagcuugaccgccuaugaua

SEQ ID NO: 2114469 - RNA, 22 nt, Staphylococcus aureus subsp. aureus MW2
caggagcgagccauuauuauuu

SEQ ID NO: 2114470 - RNA, 14 nt, Staphylococcus aureus subsp. aureus MW2
cagggaaaucaucu

SEQ ID NO: 2114471 - RNA, 17 nt, Staphylococcus aureus subsp. aureus MW2
caggcgcuccuacuuuu

SEQ ID NO: 2114472 - RNA, 17 nt, Staphylococcus aureus subsp. aureus MW2
cagucucuuugaagggu

SEQ ID NO: 2114473 - RNA, 20 nt, Staphylococcus aureus subsp. aureus MW2
cagucucuaaaacuuuuuca

SEQ ID NO: 2114474 - RNA, 13 nt, Staphylococcus aureus subsp. aureus MW2
cagucugcucuuu

SEQ ID NO: 2114475 - RNA, 14 nt, Staphylococcus aureus subsp. aureus MW2
cagucguuaaaaua

SEQ ID NO: 2114476 - RNA, 19 nt, Staphylococcus aureus subsp. aureus MW2
cagugaacaccccuucucu

SEQ ID NO: 2114477 - RNA, 11 nt, Staphylococcus aureus subsp. aureus MW2
cagugcaauga

SEQ ID NO: 2114478 - RNA, 15 nt, Staphylococcus aureus subsp. aureus MW2
caguggcauuuaaaa

SEQ ID NO: 2114479 - RNA, 16 nt, Staphylococcus aureus subsp. aureus MW2
cagucaauuuuuucau

SEQ ID NO: 2114480 - RNA, 20 nt, Staphylococcus aureus subsp. aureus MW2
cagucaauuuuuucaucuuu

SEQ ID NO: 2114481 - RNA, 14 nt, Staphylococcus aureus subsp. aureus MW2
caguauuuguauug

SEQ ID NO: 2114482 - RNA, 18 nt, Staphylococcus aureus subsp. aureus MW2
caguauauuuuaacaaug

SEQ ID NO: 2114483 - RNA, 15 nt, Staphylococcus aureus subsp. aureus MW2
caguaguugacugaa

SEQ ID NO: 2114484 - RNA, 14 nt, Staphylococcus aureus subsp. aureus MW2
cauaacaaagaacc

SEQ ID NO: 2114485 - RNA, 20 nt, Staphylococcus aureus subsp. aureus MW2
cauaaaugcuaaaaguauaa

SEQ ID NO: 2114486 - RNA, 14 nt, Staphylococcus aureus subsp. aureus MW2
cauaaaugacugaa

SEQ ID NO: 2114487 - RNA, 21 nt, Staphylococcus aureus subsp. aureus MW2
cauaaauguuagauuucaaac

SEQ ID NO: 2114488 - RNA, 23 nt, Staphylococcus aureus subsp. aureus MW2
cauaaaugcuucugguucuucaa

SEQ ID NO: 2114489 - RNA, 14 nt, Staphylococcus aureus subsp. aureus MW2
cauaaauauaaaau

SEQ ID NO: 2114490 - RNA, 15 nt, Staphylococcus aureus subsp. aureus MW2
cauaaauagugaaau

SEQ ID NO: 2114491 - RNA, 23 nt, Staphylococcus aureus subsp. aureus MW2
cauaaauagugaaauuauagccu

SEQ ID NO: 2114492 - RNA, 19 nt, Staphylococcus aureus subsp. aureus MW2
cauaaauauuggaauacuc

SEQ ID NO: 2114493 - RNA, 16 nt, Staphylococcus aureus subsp. aureus MW2
cauaaauauaaaauau

SEQ ID NO: 2114494 - RNA, 14 nt, Staphylococcus aureus subsp. aureus MW2
caguuguuuuuuug

SEQ ID NO: 2114495 - RNA, 13 nt, Staphylococcus aureus subsp. aureus MW2
cauaaaaaaagag

SEQ ID NO: 2114496 - RNA, 20 nt, Staphylococcus aureus subsp. aureus MW2
cauaaaaaucauaaauaaca

SEQ ID NO: 2114497 - RNA, 12 nt, Staphylococcus aureus subsp. aureus MW2
cauaaaaauaag

SEQ ID NO: 2114498 - RNA, 14 nt, Staphylococcus aureus subsp. aureus MW2
cauaaaccaugauu

SEQ ID NO: 2114499 - RNA, 15 nt, Staphylococcus aureus subsp. aureus MW2
cauaaacgaaaauac

SEQ ID NO: 2114500 - RNA, 13 nt, Staphylococcus aureus subsp. aureus MW2
cagugugaaauaa

SEQ ID NO: 2114501 - RNA, 16 nt, Staphylococcus aureus subsp. aureus MW2
caguguugaauuuaaa

SEQ ID NO: 2114502 - RNA, 15 nt, Staphylococcus aureus subsp. aureus MW2
caguugagucaauuu

SEQ ID NO: 2114503 - RNA, 16 nt, Staphylococcus aureus subsp. aureus MW2
caguugaaguugaagc

SEQ ID NO: 2114504 - RNA, 20 nt, Staphylococcus aureus subsp. aureus MW2
cauaaucucuuuacaccauu

SEQ ID NO: 2114505 - RNA, 20 nt, Staphylococcus aureus subsp. aureus MW2
cauaaucgggaugauaacca

SEQ ID NO: 2114506 - RNA, 18 nt, Staphylococcus aureus subsp. aureus MW2
cauaaucuucauuaauua

SEQ ID NO: 2114507 - RNA, 15 nt, Staphylococcus aureus subsp. aureus MW2
cauaaugaucaagua

SEQ ID NO: 2114508 - RNA, 14 nt, Staphylococcus aureus subsp. aureus MW2
cauaacugaauaaa

SEQ ID NO: 2114509 - RNA, 14 nt, Staphylococcus aureus subsp. aureus MW2
cauaacucaaauau

SEQ ID NO: 2114510 - RNA, 15 nt, Staphylococcus aureus subsp. aureus MW2
cauacauaugcuaua

SEQ ID NO: 2114511 - RNA, 15 nt, Staphylococcus aureus subsp. aureus MW2
cauacauaacacaag

SEQ ID NO: 2114512 - RNA, 15 nt, Staphylococcus aureus subsp. aureus MW2
cauacauaucuuuug

SEQ ID NO: 2114513 - RNA, 16 nt, Staphylococcus aureus subsp. aureus MW2
cauacaggaaauugaa

SEQ ID NO: 2114514 - RNA, 23 nt, Staphylococcus aureus subsp. aureus MW2
cauacacuaucauuaucaaauaa

SEQ ID NO: 2114515 - RNA, 14 nt, Staphylococcus aureus subsp. aureus MW2
cauacagaucucaa

SEQ ID NO: 2114516 - RNA, 17 nt, Staphylococcus aureus subsp. aureus MW2
cauacauauuuauauuu

SEQ ID NO: 2114517 - RNA, 23 nt, Staphylococcus aureus subsp. aureus MW2
cauaccacuugaauacuuuuuaa

SEQ ID NO: 2114518 - RNA, 17 nt, Staphylococcus aureus subsp. aureus MW2
cauaccuuuauuauuua

SEQ ID NO: 2114519 - RNA, 18 nt, Staphylococcus aureus subsp. aureus MW2
cauacgaauuaaaauaac

SEQ ID NO: 2114520 - RNA, 23 nt, Staphylococcus aureus subsp. aureus MW2
cauacgaucuuuuucaaugugau

SEQ ID NO: 2114521 - RNA, 13 nt, Staphylococcus aureus subsp. aureus MW2
cauaccuacaaau

SEQ ID NO: 2114522 - RNA, 17 nt, Staphylococcus aureus subsp. aureus MW2
cauaccuacaaauaugu

SEQ ID NO: 2114523 - RNA, 17 nt, Staphylococcus aureus subsp. aureus MW2
cauaccggcaaauaaca

SEQ ID NO: 2114524 - RNA, 17 nt, Staphylococcus aureus subsp. aureus MW2
cauaccguacaaaggua

SEQ ID NO: 2114525 - RNA, 14 nt, Staphylococcus aureus subsp. aureus MW2
cauacguucaaucg

SEQ ID NO: 2114526 - RNA, 13 nt, Staphylococcus aureus subsp. aureus MW2
cauacuucaauaa

SEQ ID NO: 2114527 - RNA, 17 nt, Staphylococcus aureus subsp. aureus MW2
cauacuucuauuuuaua

SEQ ID NO: 2114528 - RNA, 18 nt, Staphylococcus aureus subsp. aureus MW2
cauacuucuauuuuauaa

SEQ ID NO: 2114529 - RNA, 22 nt, Staphylococcus aureus subsp. aureus MW2
caugcuuuuuagcauauucugc

SEQ ID NO: 2114530 - RNA, 17 nt, Staphylococcus aureus subsp. aureus MW2
cauggaauaaauuuaua

SEQ ID NO: 2114531 - RNA, 15 nt, Staphylococcus aureus subsp. aureus MW2
caugguaucuuuaau

SEQ ID NO: 2114532 - RNA, 16 nt, Staphylococcus aureus subsp. aureus MW2
cauggcuuaaaucaaa

SEQ ID NO: 2114533 - RNA, 17 nt, Staphylococcus aureus subsp. aureus MW2
cauggcuuaaaucaaau

SEQ ID NO: 2114534 - RNA, 21 nt, Staphylococcus aureus subsp. aureus MW2
cauggcuuaaaucaaauggua

SEQ ID NO: 2114535 - RNA, 15 nt, Staphylococcus aureus subsp. aureus MW2
caugcgauucaaucu

SEQ ID NO: 2114536 - RNA, 18 nt, Staphylococcus aureus subsp. aureus MW2
caugcgauugaugcguuu

SEQ ID NO: 2114537 - RNA, 14 nt, Staphylococcus aureus subsp. aureus MW2
caugccuucaugaa

SEQ ID NO: 2114538 - RNA, 19 nt, Staphylococcus aureus subsp. aureus MW2
caucuuuuugauaauguuc

SEQ ID NO: 2114539 - RNA, 17 nt, Staphylococcus aureus subsp. aureus MW2
caucuuuugguuuaucu

SEQ ID NO: 2114540 - RNA, 18 nt, Staphylococcus aureus subsp. aureus MW2
caucuuuugguuuaucug

SEQ ID NO: 2114541 - RNA, 16 nt, Staphylococcus aureus subsp. aureus MW2
caucuuuuuuaucaug

SEQ ID NO: 2114542 - RNA, 19 nt, Staphylococcus aureus subsp. aureus MW2
caugcaccuuuacaacaua

SEQ ID NO: 2114543 - RNA, 23 nt, Staphylococcus aureus subsp. aureus MW2
caugcacgaaugguucuucccca

SEQ ID NO: 2114544 - RNA, 14 nt, Staphylococcus aureus subsp. aureus MW2
caugauuucuucuc

SEQ ID NO: 2114545 - RNA, 21 nt, Staphylococcus aureus subsp. aureus MW2
cauguuuggaugaacaaaaua

SEQ ID NO: 2114546 - RNA, 16 nt, Staphylococcus aureus subsp. aureus MW2
cauguuggcaauuguu

SEQ ID NO: 2114547 - RNA, 18 nt, Staphylococcus aureus subsp. aureus MW2
cauuaaacauauuuuuug

SEQ ID NO: 2114548 - RNA, 23 nt, Staphylococcus aureus subsp. aureus MW2
cauuaaaaaaucgaacuagacaa

SEQ ID NO: 2114549 - RNA, 14 nt, Staphylococcus aureus subsp. aureus MW2
cauuaaaaauaaaa

SEQ ID NO: 2114550 - RNA, 12 nt, Staphylococcus aureus subsp. aureus MW2
cauuaaaaaauc

SEQ ID NO: 2114551 - RNA, 15 nt, Staphylococcus aureus subsp. aureus MW2
cauguuuuuuaagua

SEQ ID NO: 2114552 - RNA, 13 nt, Staphylococcus aureus subsp. aureus MW2
cauuaaaaugaua

SEQ ID NO: 2114553 - RNA, 14 nt, Staphylococcus aureus subsp. aureus MW2
cauuaaaauaauua

SEQ ID NO: 2114554 - RNA, 21 nt, Staphylococcus aureus subsp. aureus MW2
cauuaaaaaaucgaacuagac

SEQ ID NO: 2114555 - RNA, 22 nt, Staphylococcus aureus subsp. aureus MW2
cauuaaaaggaugugacaaaua

SEQ ID NO: 2114556 - RNA, 14 nt, Staphylococcus aureus subsp. aureus MW2
cauguucuuauaaa

SEQ ID NO: 2114557 - RNA, 23 nt, Staphylococcus aureus subsp. aureus MW2
caugugcaagugguaaaaaugaa

SEQ ID NO: 2114558 - RNA, 15 nt, Staphylococcus aureus subsp. aureus MW2
caugucuuaaauucu

SEQ ID NO: 2114559 - RNA, 18 nt, Staphylococcus aureus subsp. aureus MW2
caugucuagauuucaaau

SEQ ID NO: 2114560 - RNA, 22 nt, Staphylococcus aureus subsp. aureus MW2
caugucuagauuucaaaucaau

SEQ ID NO: 2114561 - RNA, 23 nt, Staphylococcus aureus subsp. aureus MW2
caugguuaaagacagguuacuuu

SEQ ID NO: 2114562 - RNA, 14 nt, Staphylococcus aureus subsp. aureus MW2
cauuaccagcaauu

SEQ ID NO: 2114563 - RNA, 16 nt, Staphylococcus aureus subsp. aureus MW2
cauuacaguauuugac

SEQ ID NO: 2114564 - RNA, 14 nt, Staphylococcus aureus subsp. aureus MW2
cauuacaucuuuaa

SEQ ID NO: 2114565 - RNA, 17 nt, Staphylococcus aureus subsp. aureus MW2
cauuagcaugauaaagu

SEQ ID NO: 2114566 - RNA, 15 nt, Staphylococcus aureus subsp. aureus MW2
cauuagcauuaaauu

SEQ ID NO: 2114567 - RNA, 21 nt, Staphylococcus aureus subsp. aureus MW2
cauuagcuucuacuuuuguac

SEQ ID NO: 2114568 - RNA, 19 nt, Staphylococcus aureus subsp. aureus MW2
cauuagcuaauucacuuuu

SEQ ID NO: 2114569 - RNA, 15 nt, Staphylococcus aureus subsp. aureus MW2
cauuagcaugauaaa

SEQ ID NO: 2114570 - RNA, 20 nt, Staphylococcus aureus subsp. aureus MW2
cauuaauuuuuucguuaacu

SEQ ID NO: 2114571 - RNA, 19 nt, Staphylococcus aureus subsp. aureus MW2
cauuaauuuuucgucuuca

SEQ ID NO: 2114572 - RNA, 22 nt, Staphylococcus aureus subsp. aureus MW2
cauuacauuuggcguaaugaua

SEQ ID NO: 2114573 - RNA, 14 nt, Staphylococcus aureus subsp. aureus MW2
cauuacagauaauu

SEQ ID NO: 2114574 - RNA, 15 nt, Staphylococcus aureus subsp. aureus MW2
cauuaaggcuuuagu

SEQ ID NO: 2114575 - RNA, 19 nt, Staphylococcus aureus subsp. aureus MW2
cauuaagcuaugcuuuuuu

SEQ ID NO: 2114576 - RNA, 13 nt, Staphylococcus aureus subsp. aureus MW2
cauuaaauugcuu

SEQ ID NO: 2114577 - RNA, 14 nt, Staphylococcus aureus subsp. aureus MW2
cauuaaauguacau

SEQ ID NO: 2114578 - RNA, 21 nt, Staphylococcus aureus subsp. aureus MW2
cauuaaucuauauaaaaacug

SEQ ID NO: 2114579 - RNA, 13 nt, Staphylococcus aureus subsp. aureus MW2
cauuaauaauuaa

SEQ ID NO: 2114580 - RNA, 18 nt, Staphylococcus aureus subsp. aureus MW2
cauuaauaauuaaacaag

SEQ ID NO: 2114581 - RNA, 17 nt, Staphylococcus aureus subsp. aureus MW2
cauuaauaaauaauaac

SEQ ID NO: 2114582 - RNA, 22 nt, Staphylococcus aureus subsp. aureus MW2
cauuaauaaaacugcaauaauu

SEQ ID NO: 2114583 - RNA, 14 nt, Staphylococcus aureus subsp. aureus MW2
cauuaaguucauca

SEQ ID NO: 2114584 - RNA, 19 nt, Staphylococcus aureus subsp. aureus MW2
cauuaaguucaucaugcac

SEQ ID NO: 2114585 - RNA, 19 nt, Staphylococcus aureus subsp. aureus MW2
cauuaaguaaucugcaaau

SEQ ID NO: 2114586 - RNA, 14 nt, Staphylococcus aureus subsp. aureus MW2
cauuaaguacuuuu

SEQ ID NO: 2114587 - RNA, 17 nt, Staphylococcus aureus subsp. aureus MW2
cauuuugguacaaaaaa

SEQ ID NO: 2114588 - RNA, 20 nt, Staphylococcus aureus subsp. aureus MW2
cauuuugagucguagauacu

SEQ ID NO: 2114589 - RNA, 16 nt, Staphylococcus aureus subsp. aureus MW2
cauuuuuaauuuugac

SEQ ID NO: 2114590 - RNA, 21 nt, Staphylococcus aureus subsp. aureus MW2
cauuuuuaauuuugacauaaa

SEQ ID NO: 2114591 - RNA, 11 nt, Staphylococcus aureus subsp. aureus MW2
cauuuuuaaaa

SEQ ID NO: 2114592 - RNA, 14 nt, Staphylococcus aureus subsp. aureus MW2
cauuuucaagagga

SEQ ID NO: 2114593 - RNA, 19 nt, Staphylococcus aureus subsp. aureus MW2
cauuuucaaguuuaaaaua

SEQ ID NO: 2114594 - RNA, 23 nt, Staphylococcus aureus subsp. aureus MW2
cauuuucaauacuugaaagauuu

SEQ ID NO: 2114595 - RNA, 22 nt, Staphylococcus aureus subsp. aureus MW2
cauuuucauuguauguugaaag

SEQ ID NO: 2114596 - RNA, 15 nt, Staphylococcus aureus subsp. aureus MW2
cauuuuaucugaaaa

SEQ ID NO: 2114597 - RNA, 16 nt, Staphylococcus aureus subsp. aureus MW2
cauuuuaguuauacua

SEQ ID NO: 2114598 - RNA, 17 nt, Staphylococcus aureus subsp. aureus MW2
cauuuucaaaacuagca

SEQ ID NO: 2114599 - RNA, 21 nt, Staphylococcus aureus subsp. aureus MW2
cauuuuauggugcuaaaaaau

SEQ ID NO: 2114600 - RNA, 22 nt, Staphylococcus aureus subsp. aureus MW2
cauuuuauggugcuaaaaaauu

SEQ ID NO: 2114601 - RNA, 12 nt, Staphylococcus aureus subsp. aureus MW2
cauuuuaaauaa

SEQ ID NO: 2114602 - RNA, 14 nt, Staphylococcus aureus subsp. aureus MW2
cauuuuaaauaaaa

SEQ ID NO: 2114603 - RNA, 16 nt, Staphylococcus aureus subsp. aureus MW2
cauuuuaauaaaauca

SEQ ID NO: 2114604 - RNA, 15 nt, Staphylococcus aureus subsp. aureus MW2
cauuugguucuucua

SEQ ID NO: 2114605 - RNA, 18 nt, Staphylococcus aureus subsp. aureus MW2
cauuugguuuaacuuuau

SEQ ID NO: 2114606 - RNA, 22 nt, Staphylococcus aureus subsp. aureus MW2
cauuugcgauuucuucugcuaa

SEQ ID NO: 2114607 - RNA, 13 nt, Staphylococcus aureus subsp. aureus MW2
cauuuguguuuuu

SEQ ID NO: 2114608 - RNA, 23 nt, Staphylococcus aureus subsp. aureus MW2
cauuuguuaaauucaucuuauca

SEQ ID NO: 2114609 - RNA, 17 nt, Staphylococcus aureus subsp. aureus MW2
cauuuguucugcagagu

SEQ ID NO: 2114610 - RNA, 21 nt, Staphylococcus aureus subsp. aureus MW2
cauuugucacucuuuaaauca

SEQ ID NO: 2114611 - RNA, 14 nt, Staphylococcus aureus subsp. aureus MW2
cauuuguuguaaac

SEQ ID NO: 2114612 - RNA, 19 nt, Staphylococcus aureus subsp. aureus MW2
cauuuguaacaauauaaua

SEQ ID NO: 2114613 - RNA, 14 nt, Staphylococcus aureus subsp. aureus MW2
cauuuguauagauu

SEQ ID NO: 2114614 - RNA, 23 nt, Staphylococcus aureus subsp. aureus MW2
cauuugucauaauagauaaugca

SEQ ID NO: 2114615 - RNA, 18 nt, Staphylococcus aureus subsp. aureus MW2
cauuuguguuccugcuac

SEQ ID NO: 2114616 - RNA, 22 nt, Staphylococcus aureus subsp. aureus MW2
cauuuaaggauuuccucgguuu

SEQ ID NO: 2114617 - RNA, 14 nt, Staphylococcus aureus subsp. aureus MW2
cauuuaaacaacug

SEQ ID NO: 2114618 - RNA, 14 nt, Staphylococcus aureus subsp. aureus MW2
cauuuaaguuaucu

SEQ ID NO: 2114619 - RNA, 13 nt, Staphylococcus aureus subsp. aureus MW2
cauuugacugauu

SEQ ID NO: 2114620 - RNA, 15 nt, Staphylococcus aureus subsp. aureus MW2
cauuugauuuaaaaa

SEQ ID NO: 2114621 - RNA, 20 nt, Staphylococcus aureus subsp. aureus MW2
cauuucuuuuuucaauguuu

SEQ ID NO: 2114622 - RNA, 21 nt, Staphylococcus aureus subsp. aureus MW2
cauugauaaauuuuuaguuaa

SEQ ID NO: 2114623 - RNA, 15 nt, Staphylococcus aureus subsp. aureus MW2
cauugauaaaauaau

SEQ ID NO: 2114624 - RNA, 13 nt, Staphylococcus aureus subsp. aureus MW2
cauugagcaucuu

SEQ ID NO: 2114625 - RNA, 18 nt, Staphylococcus aureus subsp. aureus MW2
cauugaccaccuuuaucu

SEQ ID NO: 2114626 - RNA, 21 nt, Staphylococcus aureus subsp. aureus MW2
cauuaucaagaacuuuaaaaa

SEQ ID NO: 2114627 - RNA, 22 nt, Staphylococcus aureus subsp. aureus MW2
cauuaucuuaucugcucuuuau

SEQ ID NO: 2114628 - RNA, 14 nt, Staphylococcus aureus subsp. aureus MW2
cauucuauacuuuu

SEQ ID NO: 2114629 - RNA, 17 nt, Staphylococcus aureus subsp. aureus MW2
cauucuauacuuuuaau

SEQ ID NO: 2114630 - RNA, 22 nt, Staphylococcus aureus subsp. aureus MW2
cauuguguccauaaauauuaaa

SEQ ID NO: 2114631 - RNA, 18 nt, Staphylococcus aureus subsp. aureus MW2
cauuuaaaauauuuuuuc

SEQ ID NO: 2114632 - RNA, 14 nt, Staphylococcus aureus subsp. aureus MW2
cauuuaaaauauuu

SEQ ID NO: 2114633 - RNA, 19 nt, Staphylococcus aureus subsp. aureus MW2
cauuguuucuagcuuuaau

SEQ ID NO: 2114634 - RNA, 12 nt, Staphylococcus aureus subsp. aureus MW2
cauuuaaaaauc

SEQ ID NO: 2114635 - RNA, 20 nt, Staphylococcus aureus subsp. aureus MW2
cauuggauagguaacuaaaa

SEQ ID NO: 2114636 - RNA, 16 nt, Staphylococcus aureus subsp. aureus MW2
cauugaucuuuuauaa

SEQ ID NO: 2114637 - RNA, 13 nt, Staphylococcus aureus subsp. aureus MW2
cauugaucuuuua

SEQ ID NO: 2114638 - RNA, 14 nt, Staphylococcus aureus subsp. aureus MW2
cauugcuguaaccc

SEQ ID NO: 2114639 - RNA, 20 nt, Staphylococcus aureus subsp. aureus MW2
cauauuacuuuggaaauuua

SEQ ID NO: 2114640 - RNA, 18 nt, Staphylococcus aureus subsp. aureus MW2
cauaugucuguuccucaa

SEQ ID NO: 2114641 - RNA, 23 nt, Staphylococcus aureus subsp. aureus MW2
cauauggugaacuguuaaacuca

SEQ ID NO: 2114642 - RNA, 15 nt, Staphylococcus aureus subsp. aureus MW2
cauauguacuauuau

SEQ ID NO: 2114643 - RNA, 18 nt, Staphylococcus aureus subsp. aureus MW2
cauaugaaaaaugucuaa

SEQ ID NO: 2114644 - RNA, 23 nt, Staphylococcus aureus subsp. aureus MW2
cauaucuauaucgucgauuucau

SEQ ID NO: 2114645 - RNA, 12 nt, Staphylococcus aureus subsp. aureus MW2
cauacuuuuuca

SEQ ID NO: 2114646 - RNA, 17 nt, Staphylococcus aureus subsp. aureus MW2
cauauacaaauuuauau

SEQ ID NO: 2114647 - RNA, 14 nt, Staphylococcus aureus subsp. aureus MW2
cauauaagauaauu

SEQ ID NO: 2114648 - RNA, 23 nt, Staphylococcus aureus subsp. aureus MW2
cauauauucuaauugcacauuua

SEQ ID NO: 2114649 - RNA, 17 nt, Staphylococcus aureus subsp. aureus MW2
cauauaguuguaucaaa

SEQ ID NO: 2114650 - RNA, 14 nt, Staphylococcus aureus subsp. aureus MW2
cauauaucaacaug

SEQ ID NO: 2114651 - RNA, 20 nt, Staphylococcus aureus subsp. aureus MW2
cauauauuuuguuaauaagc

SEQ ID NO: 2114652 - RNA, 15 nt, Staphylococcus aureus subsp. aureus MW2
cauauucaaaauaac

SEQ ID NO: 2114653 - RNA, 13 nt, Staphylococcus aureus subsp. aureus MW2
cauauuuuuuaaa

SEQ ID NO: 2114654 - RNA, 16 nt, Staphylococcus aureus subsp. aureus MW2
cauauuuuuugauaua

SEQ ID NO: 2114655 - RNA, 15 nt, Staphylococcus aureus subsp. aureus MW2
cauauuuugauuuac

SEQ ID NO: 2114656 - RNA, 13 nt, Staphylococcus aureus subsp. aureus MW2
caucaaacaacau

SEQ ID NO: 2114657 - RNA, 13 nt, Staphylococcus aureus subsp. aureus MW2
caucaaaaauaaa

SEQ ID NO: 2114658 - RNA, 17 nt, Staphylococcus aureus subsp. aureus MW2
caucaauaccauaauua

SEQ ID NO: 2114659 - RNA, 20 nt, Staphylococcus aureus subsp. aureus MW2
caucaaguauaaauguuauu

SEQ ID NO: 2114660 - RNA, 22 nt, Staphylococcus aureus subsp. aureus MW2
caucaaguauaaauguuauugc

SEQ ID NO: 2114661 - RNA, 18 nt, Staphylococcus aureus subsp. aureus MW2
caucaagguguccuuuuu

SEQ ID NO: 2114662 - RNA, 14 nt, Staphylococcus aureus subsp. aureus MW2
caucaucaaguuca

SEQ ID NO: 2114663 - RNA, 23 nt, Staphylococcus aureus subsp. aureus MW2
caucauaaucuuuuccuaaaccu

SEQ ID NO: 2114664 - RNA, 13 nt, Staphylococcus aureus subsp. aureus MW2
caucaucaccaua

SEQ ID NO: 2114665 - RNA, 19 nt, Staphylococcus aureus subsp. aureus MW2
caucauagcacuacaucaa

SEQ ID NO: 2114666 - RNA, 12 nt, Staphylococcus aureus subsp. aureus MW2
caucauauacau

SEQ ID NO: 2114667 - RNA, 14 nt, Staphylococcus aureus subsp. aureus MW2
caucauauauaccu

SEQ ID NO: 2114668 - RNA, 22 nt, Staphylococcus aureus subsp. aureus MW2
caucauauauucauugauuguu

SEQ ID NO: 2114669 - RNA, 23 nt, Staphylococcus aureus subsp. aureus MW2
caucauaucauaccaaaaaguau

SEQ ID NO: 2114670 - RNA, 15 nt, Staphylococcus aureus subsp. aureus MW2
caucauaauaaaucu

SEQ ID NO: 2114671 - RNA, 16 nt, Staphylococcus aureus subsp. aureus MW2
caucauaaucuacugc

SEQ ID NO: 2114672 - RNA, 17 nt, Staphylococcus aureus subsp. aureus MW2
caucaugacuauuuucc

SEQ ID NO: 2114673 - RNA, 13 nt, Staphylococcus aureus subsp. aureus MW2
caucauucucaaa

SEQ ID NO: 2114674 - RNA, 10 nt, Staphylococcus aureus subsp. aureus MW2
caucaugauu

SEQ ID NO: 2114675 - RNA, 21 nt, Staphylococcus aureus subsp. aureus MW2
caucauuuaauugaugucaca

SEQ ID NO: 2114676 - RNA, 17 nt, Staphylococcus aureus subsp. aureus MW2
caucauuuguguuuuua

SEQ ID NO: 2114677 - RNA, 17 nt, Staphylococcus aureus subsp. aureus MW2
caucauuuucaauacuu

SEQ ID NO: 2114678 - RNA, 21 nt, Staphylococcus aureus subsp. aureus MW2
caucauuuguguaaaugaauu

SEQ ID NO: 2114679 - RNA, 15 nt, Staphylococcus aureus subsp. aureus MW2
caucaguauuuguau

SEQ ID NO: 2114680 - RNA, 21 nt, Staphylococcus aureus subsp. aureus MW2
caucauaaacgaaaauacuca

SEQ ID NO: 2114681 - RNA, 14 nt, Staphylococcus aureus subsp. aureus MW2
caucaguguguguu

SEQ ID NO: 2114682 - RNA, 22 nt, Staphylococcus aureus subsp. aureus MW2
caucuauaauauucaauaauuc

SEQ ID NO: 2114683 - RNA, 17 nt, Staphylococcus aureus subsp. aureus MW2
caucuacuauuuaaucu

SEQ ID NO: 2114684 - RNA, 17 nt, Staphylococcus aureus subsp. aureus MW2
caucuacuuaaaauaag

SEQ ID NO: 2114685 - RNA, 21 nt, Staphylococcus aureus subsp. aureus MW2
caucugaugaggcaauauuaa

SEQ ID NO: 2114686 - RNA, 13 nt, Staphylococcus aureus subsp. aureus MW2
caucugcaacuaa

SEQ ID NO: 2114687 - RNA, 15 nt, Staphylococcus aureus subsp. aureus MW2
caucugcaagggauc

SEQ ID NO: 2114688 - RNA, 16 nt, Staphylococcus aureus subsp. aureus MW2
caucugaaaaaauuaa

SEQ ID NO: 2114689 - RNA, 12 nt, Staphylococcus aureus subsp. aureus MW2
caucuucaacau

SEQ ID NO: 2114690 - RNA, 20 nt, Staphylococcus aureus subsp. aureus MW2
caucuggagacgaaccauuu

SEQ ID NO: 2114691 - RNA, 16 nt, Staphylococcus aureus subsp. aureus MW2
caucuguagguuuaau

SEQ ID NO: 2114692 - RNA, 13 nt, Staphylococcus aureus subsp. aureus MW2
caucuguuaauuc

SEQ ID NO: 2114693 - RNA, 17 nt, Staphylococcus aureus subsp. aureus MW2
caucuuucaaaugcuua

SEQ ID NO: 2114694 - RNA, 21 nt, Staphylococcus aureus subsp. aureus MW2
caucuuuauacacaaaguauu

SEQ ID NO: 2114695 - RNA, 17 nt, Staphylococcus aureus subsp. aureus MW2
caucuuuauuuacaaug

SEQ ID NO: 2114696 - RNA, 19 nt, Staphylococcus aureus subsp. aureus MW2
caucuuuagcuauuuaaaa

SEQ ID NO: 2114697 - RNA, 21 nt, Staphylococcus aureus subsp. aureus MW2
caucuuuguaaccuaaaaaca

SEQ ID NO: 2114698 - RNA, 14 nt, Staphylococcus aureus subsp. aureus MW2
caucuuuaaagaaa

SEQ ID NO: 2114699 - RNA, 19 nt, Staphylococcus aureus subsp. aureus MW2
caucuuuaagcucuuaauc

SEQ ID NO: 2114700 - RNA, 20 nt, Staphylococcus aureus subsp. aureus MW2
caucuucuugauuguaaaua

SEQ ID NO: 2114701 - RNA, 23 nt, Staphylococcus aureus subsp. aureus MW2
caucuucuugauuguaaauaaaa

SEQ ID NO: 2114702 - RNA, 16 nt, Staphylococcus aureus subsp. aureus MW2
caucgauaucuaaguc

SEQ ID NO: 2114703 - RNA, 18 nt, Staphylococcus aureus subsp. aureus MW2
cauccuaauguaauuauu

SEQ ID NO: 2114704 - RNA, 22 nt, Staphylococcus aureus subsp. aureus MW2
cauccuacgacacguguaaaaa

SEQ ID NO: 2114705 - RNA, 16 nt, Staphylococcus aureus subsp. aureus MW2
caucgaacaugaauga

SEQ ID NO: 2114706 - RNA, 15 nt, Staphylococcus aureus subsp. aureus MW2
caucgaagauguuaa

SEQ ID NO: 2114707 - RNA, 14 nt, Staphylococcus aureus subsp. aureus MW2
ccguuuuuuauaaa

SEQ ID NO: 2114708 - RNA, 16 nt, Staphylococcus aureus subsp. aureus MW2
ccuaaaauagaaaaau

SEQ ID NO: 2114709 - RNA, 14 nt, Staphylococcus aureus subsp. aureus MW2
ccuaaagcugacaa

SEQ ID NO: 2114710 - RNA, 19 nt, Staphylococcus aureus subsp. aureus MW2
ccuaaagcugacaaaccaa

SEQ ID NO: 2114711 - RNA, 19 nt, Staphylococcus aureus subsp. aureus MW2
ccuaaaccucuaaauaaaa

SEQ ID NO: 2114712 - RNA, 21 nt, Staphylococcus aureus subsp. aureus MW2
ccuaaaccucuaaauaaaauu

SEQ ID NO: 2114713 - RNA, 19 nt, Staphylococcus aureus subsp. aureus MW2
ccuaagacauaaauuuuua

SEQ ID NO: 2114714 - RNA, 14 nt, Staphylococcus aureus subsp. aureus MW2
ccuaaaugauuaau

SEQ ID NO: 2114715 - RNA, 18 nt, Staphylococcus aureus subsp. aureus MW2
ccuacaaauauuucuaaa

SEQ ID NO: 2114716 - RNA, 18 nt, Staphylococcus aureus subsp. aureus MW2
ccuacaaauauguaauca

SEQ ID NO: 2114717 - RNA, 13 nt, Staphylococcus aureus subsp. aureus MW2
ccuaauaauaaaa

SEQ ID NO: 2114718 - RNA, 20 nt, Staphylococcus aureus subsp. aureus MW2
ccuagguuuauauaucacau

SEQ ID NO: 2114719 - RNA, 16 nt, Staphylococcus aureus subsp. aureus MW2
ccuagguuuauauauc

SEQ ID NO: 2114720 - RNA, 15 nt, Staphylococcus aureus subsp. aureus MW2
ccuaucgucgcuaau

SEQ ID NO: 2114721 - RNA, 19 nt, Staphylococcus aureus subsp. aureus MW2
ccuaggaaauaaaaaauaa

SEQ ID NO: 2114722 - RNA, 21 nt, Staphylococcus aureus subsp. aureus MW2
ccuaggaaauaaaaaauaacc

SEQ ID NO: 2114723 - RNA, 17 nt, Staphylococcus aureus subsp. aureus MW2
ccuagauaccaaacugc

SEQ ID NO: 2114724 - RNA, 20 nt, Staphylococcus aureus subsp. aureus MW2
ccuagcaaaaauacuuuuug

SEQ ID NO: 2114725 - RNA, 18 nt, Staphylococcus aureus subsp. aureus MW2
ccuacuuuucaacuuuag

SEQ ID NO: 2114726 - RNA, 14 nt, Staphylococcus aureus subsp. aureus MW2
ccuacuuuuucaau

SEQ ID NO: 2114727 - RNA, 12 nt, Staphylococcus aureus subsp. aureus MW2
ccuacugcuguc

SEQ ID NO: 2114728 - RNA, 16 nt, Staphylococcus aureus subsp. aureus MW2
ccuacguguguaguag

SEQ ID NO: 2114729 - RNA, 20 nt, Staphylococcus aureus subsp. aureus MW2
ccuacaauuuuccuuucaau

SEQ ID NO: 2114730 - RNA, 21 nt, Staphylococcus aureus subsp. aureus MW2
ccuaugguuacccuuuuucaa

SEQ ID NO: 2114731 - RNA, 20 nt, Staphylococcus aureus subsp. aureus MW2
ccuauggcgcaauuuuuaac

SEQ ID NO: 2114732 - RNA, 12 nt, Staphylococcus aureus subsp. aureus MW2
ccuauuaggauc

SEQ ID NO: 2114733 - RNA, 19 nt, Staphylococcus aureus subsp. aureus MW2
ccuauuaaaucugcuugug

SEQ ID NO: 2114734 - RNA, 18 nt, Staphylococcus aureus subsp. aureus MW2
ccuauuacacuaaaaccu

SEQ ID NO: 2114735 - RNA, 13 nt, Staphylococcus aureus subsp. aureus MW2
ccuauuugauuaa

SEQ ID NO: 2114736 - RNA, 19 nt, Staphylococcus aureus subsp. aureus MW2
ccuauuugauuaaauuaaa

SEQ ID NO: 2114737 - RNA, 18 nt, Staphylococcus aureus subsp. aureus MW2
ccucaacauuaaaaugug

SEQ ID NO: 2114738 - RNA, 22 nt, Staphylococcus aureus subsp. aureus MW2
ccucacuagauaguuuauacuu

SEQ ID NO: 2114739 - RNA, 16 nt, Staphylococcus aureus subsp. aureus MW2
ccguauuuuaauauug

SEQ ID NO: 2114740 - RNA, 15 nt, Staphylococcus aureus subsp. aureus MW2
ccugauaaugcaugu

SEQ ID NO: 2114741 - RNA, 22 nt, Staphylococcus aureus subsp. aureus MW2
ccugauacacguacaaaauaau

SEQ ID NO: 2114742 - RNA, 18 nt, Staphylococcus aureus subsp. aureus MW2
ccugacauucaucacaaa

SEQ ID NO: 2114743 - RNA, 22 nt, Staphylococcus aureus subsp. aureus MW2
ccugauuccacuacaaucauac

SEQ ID NO: 2114744 - RNA, 21 nt, Staphylococcus aureus subsp. aureus MW2
ccugauauuucaacuuuuuaa

SEQ ID NO: 2114745 - RNA, 17 nt, Staphylococcus aureus subsp. aureus MW2
ccucggauaccaaaacu

SEQ ID NO: 2114746 - RNA, 22 nt, Staphylococcus aureus subsp. aureus MW2
ccucuuaaaauaccugcaacuu

SEQ ID NO: 2114747 - RNA, 12 nt, Staphylococcus aureus subsp. aureus MW2
ccugugauaaaa

SEQ ID NO: 2114748 - RNA, 13 nt, Staphylococcus aureus subsp. aureus MW2
ccugugauaaaaa

SEQ ID NO: 2114749 - RNA, 15 nt, Staphylococcus aureus subsp. aureus MW2
ccuguugaauauacu

SEQ ID NO: 2114750 - RNA, 18 nt, Staphylococcus aureus subsp. aureus MW2
ccuuaacuucauaauaua

SEQ ID NO: 2114751 - RNA, 16 nt, Staphylococcus aureus subsp. aureus MW2
ccuuaauaauaaguau

SEQ ID NO: 2114752 - RNA, 18 nt, Staphylococcus aureus subsp. aureus MW2
ccuucaauguucaauuca

SEQ ID NO: 2114753 - RNA, 20 nt, Staphylococcus aureus subsp. aureus MW2
ccuucaauguucaauucacg

SEQ ID NO: 2114754 - RNA, 12 nt, Staphylococcus aureus subsp. aureus MW2
ccuucaaaaugc

SEQ ID NO: 2114755 - RNA, 13 nt, Staphylococcus aureus subsp. aureus MW2
ccuuauauuuuau

SEQ ID NO: 2114756 - RNA, 21 nt, Staphylococcus aureus subsp. aureus MW2
ccuuauggaaaauuuuaucaa

SEQ ID NO: 2114757 - RNA, 23 nt, Staphylococcus aureus subsp. aureus MW2
ccuggaaucgaaaauaucaauuu

SEQ ID NO: 2114758 - RNA, 14 nt, Staphylococcus aureus subsp. aureus MW2
ccuggugauucacc

SEQ ID NO: 2114759 - RNA, 13 nt, Staphylococcus aureus subsp. aureus MW2
ccgcugcucuucu

SEQ ID NO: 2114760 - RNA, 15 nt, Staphylococcus aureus subsp. aureus MW2
ccgacugcaccucca

SEQ ID NO: 2114761 - RNA, 20 nt, Staphylococcus aureus subsp. aureus MW2
ccgccaacuaauguuaaaau

SEQ ID NO: 2114762 - RNA, 16 nt, Staphylococcus aureus subsp. aureus MW2
ccacuccuuaaacaaa

SEQ ID NO: 2114763 - RNA, 19 nt, Staphylococcus aureus subsp. aureus MW2
ccacucauaaucaagucug

SEQ ID NO: 2114764 - RNA, 19 nt, Staphylococcus aureus subsp. aureus MW2
ccacucaauucucuaacuu

SEQ ID NO: 2114765 - RNA, 12 nt, Staphylococcus aureus subsp. aureus MW2
ccacucaauucu

SEQ ID NO: 2114766 - RNA, 23 nt, Staphylococcus aureus subsp. aureus MW2
ccacuccuuaaacaaauaaaugu

SEQ ID NO: 2114767 - RNA, 14 nt, Staphylococcus aureus subsp. aureus MW2
ccacgguuuaccac

SEQ ID NO: 2114768 - RNA, 13 nt, Staphylococcus aureus subsp. aureus MW2
ccacgguuuacca

SEQ ID NO: 2114769 - RNA, 19 nt, Staphylococcus aureus subsp. aureus MW2
ccacuucuucaccugcguc

SEQ ID NO: 2114770 - RNA, 14 nt, Staphylococcus aureus subsp. aureus MW2
ccacuuaaucguuc

SEQ ID NO: 2114771 - RNA, 22 nt, Staphylococcus aureus subsp. aureus MW2
ccagccccaauuagccccagua

SEQ ID NO: 2114772 - RNA, 14 nt, Staphylococcus aureus subsp. aureus MW2
ccagauaucauaau

SEQ ID NO: 2114773 - RNA, 15 nt, Staphylococcus aureus subsp. aureus MW2
ccauaugcuugcugu

SEQ ID NO: 2114774 - RNA, 19 nt, Staphylococcus aureus subsp. aureus MW2
ccauaugcuugcugugaau

SEQ ID NO: 2114775 - RNA, 23 nt, Staphylococcus aureus subsp. aureus MW2
ccauaucgugcguuaaauauaua

SEQ ID NO: 2114776 - RNA, 13 nt, Staphylococcus aureus subsp. aureus MW2
ccauaauuuaaau

SEQ ID NO: 2114777 - RNA, 20 nt, Staphylococcus aureus subsp. aureus MW2
ccaucaauauuuauauuaaa

SEQ ID NO: 2114778 - RNA, 16 nt, Staphylococcus aureus subsp. aureus MW2
ccaucauuuauaugga

SEQ ID NO: 2114779 - RNA, 16 nt, Staphylococcus aureus subsp. aureus MW2
ccaucaguauuuguau

SEQ ID NO: 2114780 - RNA, 21 nt, Staphylococcus aureus subsp. aureus MW2
ccauaaauaaaaugcuacaau

SEQ ID NO: 2114781 - RNA, 14 nt, Staphylococcus aureus subsp. aureus MW2
ccauaaauauuaaa

SEQ ID NO: 2114782 - RNA, 18 nt, Staphylococcus aureus subsp. aureus MW2
ccaguugauuuaagauuu

SEQ ID NO: 2114783 - RNA, 13 nt, Staphylococcus aureus subsp. aureus MW2
ccaguaucucuuu

SEQ ID NO: 2114784 - RNA, 18 nt, Staphylococcus aureus subsp. aureus MW2
ccagucguaaugaugaca

SEQ ID NO: 2114785 - RNA, 14 nt, Staphylococcus aureus subsp. aureus MW2
ccaguccauuuuuu

SEQ ID NO: 2114786 - RNA, 13 nt, Staphylococcus aureus subsp. aureus MW2
ccagguccacaau

SEQ ID NO: 2114787 - RNA, 17 nt, Staphylococcus aureus subsp. aureus MW2
ccagguccacaauaaga

SEQ ID NO: 2114788 - RNA, 19 nt, Staphylococcus aureus subsp. aureus MW2
ccccaacacagaagcugac

SEQ ID NO: 2114789 - RNA, 19 nt, Staphylococcus aureus subsp. aureus MW2
ccccaacacagaagcuggc

SEQ ID NO: 2114790 - RNA, 21 nt, Staphylococcus aureus subsp. aureus MW2
ccccaacacagaagcuggcgg

SEQ ID NO: 2114791 - RNA, 19 nt, Staphylococcus aureus subsp. aureus MW2
ccccaacauagaagcuggc

SEQ ID NO: 2114792 - RNA, 21 nt, Staphylococcus aureus subsp. aureus MW2
ccccaacauagaagcuggcgg

SEQ ID NO: 2114793 - RNA, 17 nt, Staphylococcus aureus subsp. aureus MW2
ccccaacacagagaaau

SEQ ID NO: 2114794 - RNA, 16 nt, Staphylococcus aureus subsp. aureus MW2
ccccaacacagagaau

SEQ ID NO: 2114795 - RNA, 20 nt, Staphylococcus aureus subsp. aureus MW2
ccccaacuugcauugucugu

SEQ ID NO: 2114796 - RNA, 15 nt, Staphylococcus aureus subsp. aureus MW2
ccccaacuugcauug

SEQ ID NO: 2114797 - RNA, 14 nt, Staphylococcus aureus subsp. aureus MW2
ccccaacuugcauu

SEQ ID NO: 2114798 - RNA, 19 nt, Staphylococcus aureus subsp. aureus MW2
cccauuuuuaaaauuauga

SEQ ID NO: 2114799 - RNA, 16 nt, Staphylococcus aureus subsp. aureus MW2
cccauguauaaggaua

SEQ ID NO: 2114800 - RNA, 13 nt, Staphylococcus aureus subsp. aureus MW2
cccaugcuucuau

SEQ ID NO: 2114801 - RNA, 12 nt, Staphylococcus aureus subsp. aureus MW2
cccaacacagaa

SEQ ID NO: 2114802 - RNA, 12 nt, Staphylococcus aureus subsp. aureus MW2
cccaacacagag

SEQ ID NO: 2114803 - RNA, 18 nt, Staphylococcus aureus subsp. aureus MW2
cccaacaaagaagcuggc

SEQ ID NO: 2114804 - RNA, 11 nt, Staphylococcus aureus subsp. aureus MW2
cccaaacauag

SEQ ID NO: 2114805 - RNA, 12 nt, Staphylococcus aureus subsp. aureus MW2
ccauuuuucuuu

SEQ ID NO: 2114806 - RNA, 22 nt, Staphylococcus aureus subsp. aureus MW2
ccauuucgauaccuaaaauacc

SEQ ID NO: 2114807 - RNA, 15 nt, Staphylococcus aureus subsp. aureus MW2
ccauuuguaaauccu

SEQ ID NO: 2114808 - RNA, 23 nt, Staphylococcus aureus subsp. aureus MW2
ccaucuuuguaaccuaaaaacaa

SEQ ID NO: 2114809 - RNA, 22 nt, Staphylococcus aureus subsp. aureus MW2
ccaucuuuguaaccuaaaaaca

SEQ ID NO: 2114810 - RNA, 21 nt, Staphylococcus aureus subsp. aureus MW2
ccauuguuauccaaaacauuu

SEQ ID NO: 2114811 - RNA, 18 nt, Staphylococcus aureus subsp. aureus MW2
ccauuuaacucaccuuua

SEQ ID NO: 2114812 - RNA, 19 nt, Staphylococcus aureus subsp. aureus MW2
ccauuuaacucaccuuuau

SEQ ID NO: 2114813 - RNA, 17 nt, Staphylococcus aureus subsp. aureus MW2
ccauuuaaggauuuccu

SEQ ID NO: 2114814 - RNA, 15 nt, Staphylococcus aureus subsp. aureus MW2
cccuaauucuuuaau

SEQ ID NO: 2114815 - RNA, 15 nt, Staphylococcus aureus subsp. aureus MW2
cccuauaauguuuug

SEQ ID NO: 2114816 - RNA, 23 nt, Staphylococcus aureus subsp. aureus MW2
cccuagcaaaaauacuuuuugau

SEQ ID NO: 2114817 - RNA, 19 nt, Staphylococcus aureus subsp. aureus MW2
cccuagguuuauauaucac

SEQ ID NO: 2114818 - RNA, 18 nt, Staphylococcus aureus subsp. aureus MW2
cccuccuauuaauauaua

SEQ ID NO: 2114819 - RNA, 15 nt, Staphylococcus aureus subsp. aureus MW2
cccguuauaucuuuu

SEQ ID NO: 2114820 - RNA, 14 nt, Staphylococcus aureus subsp. aureus MW2
cccggaauauuaac

SEQ ID NO: 2114821 - RNA, 20 nt, Staphylococcus aureus subsp. aureus MW2
cgguuauuuaauaaugcuuu

SEQ ID NO: 2114822 - RNA, 12 nt, Staphylococcus aureus subsp. aureus MW2
cguaaaaucaug

SEQ ID NO: 2114823 - RNA, 20 nt, Staphylococcus aureus subsp. aureus MW2
cgguuaauaagcuaauauuu

SEQ ID NO: 2114824 - RNA, 17 nt, Staphylococcus aureus subsp. aureus MW2
cggugugaauugauuuu

SEQ ID NO: 2114825 - RNA, 16 nt, Staphylococcus aureus subsp. aureus MW2
cggucucaacuugccu

SEQ ID NO: 2114826 - RNA, 17 nt, Staphylococcus aureus subsp. aureus MW2
cggugaccuuauauuuu

SEQ ID NO: 2114827 - RNA, 14 nt, Staphylococcus aureus subsp. aureus MW2
cguaacuauaugaa

SEQ ID NO: 2114828 - RNA, 14 nt, Staphylococcus aureus subsp. aureus MW2
cguagcauuauuua

SEQ ID NO: 2114829 - RNA, 21 nt, Staphylococcus aureus subsp. aureus MW2
cguagcugaggauuuuuuagg

SEQ ID NO: 2114830 - RNA, 20 nt, Staphylococcus aureus subsp. aureus MW2
cguagccguuuuugaaaugu

SEQ ID NO: 2114831 - RNA, 16 nt, Staphylococcus aureus subsp. aureus MW2
cguaucauuuaaaaua

SEQ ID NO: 2114832 - RNA, 19 nt, Staphylococcus aureus subsp. aureus MW2
cguaugcccucauaaauca

SEQ ID NO: 2114833 - RNA, 14 nt, Staphylococcus aureus subsp. aureus MW2
cguaucuguuuaug

SEQ ID NO: 2114834 - RNA, 14 nt, Staphylococcus aureus subsp. aureus MW2
cguauuuuaauauu

SEQ ID NO: 2114835 - RNA, 15 nt, Staphylococcus aureus subsp. aureus MW2
cguauuuuaaugauu

SEQ ID NO: 2114836 - RNA, 22 nt, Staphylococcus aureus subsp. aureus MW2
cguauuuuaguacuuaauacua

SEQ ID NO: 2114837 - RNA, 17 nt, Staphylococcus aureus subsp. aureus MW2
cguauuucaaauguaau

SEQ ID NO: 2114838 - RNA, 17 nt, Staphylococcus aureus subsp. aureus MW2
cguauuuuuuuauaauu

SEQ ID NO: 2114839 - RNA, 15 nt, Staphylococcus aureus subsp. aureus MW2
cguauugaaaaugag

SEQ ID NO: 2114840 - RNA, 24 nt, Staphylococcus aureus subsp. aureus MW2
cgucagauucaaacguuuucacuu

SEQ ID NO: 2114841 - RNA, 23 nt, Staphylococcus aureus subsp. aureus MW2
cgucacaugccaucuuuguaacc

SEQ ID NO: 2114842 - RNA, 14 nt, Staphylococcus aureus subsp. aureus MW2
cgucacucacuuca

SEQ ID NO: 2114843 - RNA, 13 nt, Staphylococcus aureus subsp. aureus MW2
cggcuuuggauuu

SEQ ID NO: 2114844 - RNA, 13 nt, Staphylococcus aureus subsp. aureus MW2
cggcuuuguaaaa

SEQ ID NO: 2114845 - RNA, 16 nt, Staphylococcus aureus subsp. aureus MW2
cggccuucuuucgcuu

SEQ ID NO: 2114846 - RNA, 11 nt, Staphylococcus aureus subsp. aureus MW2
cgcuuuuuaau

SEQ ID NO: 2114847 - RNA, 22 nt, Staphylococcus aureus subsp. aureus MW2
cgcuuuugaaguugguccaaau

SEQ ID NO: 2114848 - RNA, 13 nt, Staphylococcus aureus subsp. aureus MW2
cgcuuuugaaguu

SEQ ID NO: 2114849 - RNA, 15 nt, Staphylococcus aureus subsp. aureus MW2
cgcuuuucuaauuuu

SEQ ID NO: 2114850 - RNA, 22 nt, Staphylococcus aureus subsp. aureus MW2
cgcuuuucuaauuuuucuuuaa

SEQ ID NO: 2114851 - RNA, 20 nt, Staphylococcus aureus subsp. aureus MW2
cggaaaauaucacuaauaua

SEQ ID NO: 2114852 - RNA, 13 nt, Staphylococcus aureus subsp. aureus MW2
cgcuuacuuauau

SEQ ID NO: 2114853 - RNA, 21 nt, Staphylococcus aureus subsp. aureus MW2
cgcuuagauaaauuaauauga

SEQ ID NO: 2114854 - RNA, 17 nt, Staphylococcus aureus subsp. aureus MW2
cgcuguuucaagcguuu

SEQ ID NO: 2114855 - RNA, 19 nt, Staphylococcus aureus subsp. aureus MW2
cgcuguuuuuaaaugcuuu

SEQ ID NO: 2114856 - RNA, 23 nt, Staphylococcus aureus subsp. aureus MW2
cgcuuaacccuaaagcuaaugca

SEQ ID NO: 2114857 - RNA, 11 nt, Staphylococcus aureus subsp. aureus MW2
cgcuuaauucu

SEQ ID NO: 2114858 - RNA, 14 nt, Staphylococcus aureus subsp. aureus MW2
cgcuuaauucuuca

SEQ ID NO: 2114859 - RNA, 19 nt, Staphylococcus aureus subsp. aureus MW2
cgcgugccaacaucuucaa

SEQ ID NO: 2114860 - RNA, 18 nt, Staphylococcus aureus subsp. aureus MW2
cgcggguaauauuuuugu

SEQ ID NO: 2114861 - RNA, 16 nt, Staphylococcus aureus subsp. aureus MW2
cggcacauucauaccg

SEQ ID NO: 2114862 - RNA, 22 nt, Staphylococcus aureus subsp. aureus MW2
cggcacauucauaccgaagaaa

SEQ ID NO: 2114863 - RNA, 13 nt, Staphylococcus aureus subsp. aureus MW2
cggaugagaaaug

SEQ ID NO: 2114864 - RNA, 21 nt, Staphylococcus aureus subsp. aureus MW2
cggauguuucuucaauuuaau

SEQ ID NO: 2114865 - RNA, 14 nt, Staphylococcus aureus subsp. aureus MW2
cggauuuuucucau

SEQ ID NO: 2114866 - RNA, 21 nt, Staphylococcus aureus subsp. aureus MW2
cggaaagucagcuuacaauaa

SEQ ID NO: 2114867 - RNA, 21 nt, Staphylococcus aureus subsp. aureus MW2
cggaaagucagguuacaauaa

SEQ ID NO: 2114868 - RNA, 13 nt, Staphylococcus aureus subsp. aureus MW2
cgcaaauuaaaua

SEQ ID NO: 2114869 - RNA, 17 nt, Staphylococcus aureus subsp. aureus MW2
cgauuaauaaaauucua

SEQ ID NO: 2114870 - RNA, 21 nt, Staphylococcus aureus subsp. aureus MW2
cgauuauuuagauaaaaaaua

SEQ ID NO: 2114871 - RNA, 13 nt, Staphylococcus aureus subsp. aureus MW2
cgcaaagaaaaac

SEQ ID NO: 2114872 - RNA, 22 nt, Staphylococcus aureus subsp. aureus MW2
cgaucuucaugaacagcaucuu

SEQ ID NO: 2114873 - RNA, 15 nt, Staphylococcus aureus subsp. aureus MW2
cgaucaugccuucau

SEQ ID NO: 2114874 - RNA, 24 nt, Staphylococcus aureus subsp. aureus MW2
ccuucauugaagaauauaaacuau

SEQ ID NO: 2114875 - RNA, 21 nt, Staphylococcus aureus subsp. aureus MW2
ccuucauuagccaaaucuuua

SEQ ID NO: 2114876 - RNA, 15 nt, Staphylococcus aureus subsp. aureus MW2
ccuucagucuucaug

SEQ ID NO: 2114877 - RNA, 13 nt, Staphylococcus aureus subsp. aureus MW2
ccuucaucacuau

SEQ ID NO: 2114878 - RNA, 11 nt, Staphylococcus aureus subsp. aureus MW2
cgauaaaugua

SEQ ID NO: 2114879 - RNA, 17 nt, Staphylococcus aureus subsp. aureus MW2
cgauaaauguauuaaac

SEQ ID NO: 2114880 - RNA, 17 nt, Staphylococcus aureus subsp. aureus MW2
cgauaaaaguuguauuc

SEQ ID NO: 2114881 - RNA, 16 nt, Staphylococcus aureus subsp. aureus MW2
cgauacuuuuaaaauc

SEQ ID NO: 2114882 - RNA, 19 nt, Staphylococcus aureus subsp. aureus MW2
cgauauaacauuaaaauga

SEQ ID NO: 2114883 - RNA, 15 nt, Staphylococcus aureus subsp. aureus MW2
cgccacaacauguuu

SEQ ID NO: 2114884 - RNA, 12 nt, Staphylococcus aureus subsp. aureus MW2
cgccauaaucau

SEQ ID NO: 2114885 - RNA, 16 nt, Staphylococcus aureus subsp. aureus MW2
cgccuuguuuauuuuu

SEQ ID NO: 2114886 - RNA, 15 nt, Staphylococcus aureus subsp. aureus MW2
cuugaccuucaguuu

SEQ ID NO: 2114887 - RNA, 22 nt, Staphylococcus aureus subsp. aureus MW2
cuugaaguuguuucuccaguuu

SEQ ID NO: 2114888 - RNA, 15 nt, Staphylococcus aureus subsp. aureus MW2
cuugaauaauauauu

SEQ ID NO: 2114889 - RNA, 22 nt, Staphylococcus aureus subsp. aureus MW2
cuugaauaccuuuuauuauuuu

SEQ ID NO: 2114890 - RNA, 15 nt, Staphylococcus aureus subsp. aureus MW2
cuugaauguaagaag

SEQ ID NO: 2114891 - RNA, 13 nt, Staphylococcus aureus subsp. aureus MW2
cuucuuuucuuug

SEQ ID NO: 2114892 - RNA, 23 nt, Staphylococcus aureus subsp. aureus MW2
cuucuuuuguaacguucuuauau

SEQ ID NO: 2114893 - RNA, 22 nt, Staphylococcus aureus subsp. aureus MW2
cuucuuuguuggggccccgcca

SEQ ID NO: 2114894 - RNA, 13 nt, Staphylococcus aureus subsp. aureus MW2
cuucuuuuaaguu

SEQ ID NO: 2114895 - RNA, 18 nt, Staphylococcus aureus subsp. aureus MW2
cuucuauuuuauaauaaa

SEQ ID NO: 2114896 - RNA, 22 nt, Staphylococcus aureus subsp. aureus MW2
cuucucaacaaaucuauaaaua

SEQ ID NO: 2114897 - RNA, 13 nt, Staphylococcus aureus subsp. aureus MW2
cuucucaucauuu

SEQ ID NO: 2114898 - RNA, 18 nt, Staphylococcus aureus subsp. aureus MW2
cuucucaucauuuucaau

SEQ ID NO: 2114899 - RNA, 17 nt, Staphylococcus aureus subsp. aureus MW2
cuugauuuaauuuuuaa

SEQ ID NO: 2114900 - RNA, 16 nt, Staphylococcus aureus subsp. aureus MW2
cuugcaaauauaucau

SEQ ID NO: 2114901 - RNA, 18 nt, Staphylococcus aureus subsp. aureus MW2
cuugcaaauauaucaucu

SEQ ID NO: 2114902 - RNA, 21 nt, Staphylococcus aureus subsp. aureus MW2
cuugcaaauauaucaucucua

SEQ ID NO: 2114903 - RNA, 17 nt, Staphylococcus aureus subsp. aureus MW2
cuugcaauaccucccca

SEQ ID NO: 2114904 - RNA, 19 nt, Staphylococcus aureus subsp. aureus MW2
cuugggcugacauuuuugg

SEQ ID NO: 2114905 - RNA, 14 nt, Staphylococcus aureus subsp. aureus MW2
cuugguauuuaucc

SEQ ID NO: 2114906 - RNA, 16 nt, Staphylococcus aureus subsp. aureus MW2
cuuggcguauuuuuug

SEQ ID NO: 2114907 - RNA, 13 nt, Staphylococcus aureus subsp. aureus MW2
cuuggcguauuuu

SEQ ID NO: 2114908 - RNA, 17 nt, Staphylococcus aureus subsp. aureus MW2
cuugguauuuuuuaaau

SEQ ID NO: 2114909 - RNA, 20 nt, Staphylococcus aureus subsp. aureus MW2
cuugguuaucauuauucaua

SEQ ID NO: 2114910 - RNA, 17 nt, Staphylococcus aureus subsp. aureus MW2
cuuggauuuuuugguuu

SEQ ID NO: 2114911 - RNA, 22 nt, Staphylococcus aureus subsp. aureus MW2
cuugcuucauuauauaauucuu

SEQ ID NO: 2114912 - RNA, 19 nt, Staphylococcus aureus subsp. aureus MW2
cuugcuucuuuccucuccu

SEQ ID NO: 2114913 - RNA, 20 nt, Staphylococcus aureus subsp. aureus MW2
cuuggccuacuuuuucaaua

SEQ ID NO: 2114914 - RNA, 17 nt, Staphylococcus aureus subsp. aureus MW2
cuuggcgacauuuguaa

SEQ ID NO: 2114915 - RNA, 20 nt, Staphylococcus aureus subsp. aureus MW2
cuugcuggauuacaccuuug

SEQ ID NO: 2114916 - RNA, 23 nt, Staphylococcus aureus subsp. aureus MW2
cuugcuggacggcuacaauuuuc

SEQ ID NO: 2114917 - RNA, 20 nt, Staphylococcus aureus subsp. aureus MW2
cuugccuucaaauucucaau

SEQ ID NO: 2114918 - RNA, 14 nt, Staphylococcus aureus subsp. aureus MW2
cuugccuuuuuagg

SEQ ID NO: 2114919 - RNA, 22 nt, Staphylococcus aureus subsp. aureus MW2
cuuucagcaccagaacaauuca

SEQ ID NO: 2114920 - RNA, 15 nt, Staphylococcus aureus subsp. aureus MW2
cuuucauuguaaauu

SEQ ID NO: 2114921 - RNA, 15 nt, Staphylococcus aureus subsp. aureus MW2
cuuuauuugauucuu

SEQ ID NO: 2114922 - RNA, 14 nt, Staphylococcus aureus subsp. aureus MW2
cuuuauuuuaaaca

SEQ ID NO: 2114923 - RNA, 16 nt, Staphylococcus aureus subsp. aureus MW2
cuuuauuuuaaacaug

SEQ ID NO: 2114924 - RNA, 12 nt, Staphylococcus aureus subsp. aureus MW2
cuuuauuuuuug

SEQ ID NO: 2114925 - RNA, 20 nt, Staphylococcus aureus subsp. aureus MW2
cuuuaucgaauucuucuuua

SEQ ID NO: 2114926 - RNA, 17 nt, Staphylococcus aureus subsp. aureus MW2
cuuuauacguuacggcu

SEQ ID NO: 2114927 - RNA, 18 nt, Staphylococcus aureus subsp. aureus MW2
cuuuauaaauaaacauaa

SEQ ID NO: 2114928 - RNA, 15 nt, Staphylococcus aureus subsp. aureus MW2
cuuuauacaauuuuu

SEQ ID NO: 2114929 - RNA, 18 nt, Staphylococcus aureus subsp. aureus MW2
cuuuaggaaucgucauau

SEQ ID NO: 2114930 - RNA, 18 nt, Staphylococcus aureus subsp. aureus MW2
cuuuaguuguuaggggcu

SEQ ID NO: 2114931 - RNA, 12 nt, Staphylococcus aureus subsp. aureus MW2
cuuuaguuacua

SEQ ID NO: 2114932 - RNA, 20 nt, Staphylococcus aureus subsp. aureus MW2
cuuuauuucuuucgaaaaca

SEQ ID NO: 2114933 - RNA, 16 nt, Staphylococcus aureus subsp. aureus MW2
cuuuauuguugugcuu

SEQ ID NO: 2114934 - RNA, 14 nt, Staphylococcus aureus subsp. aureus MW2
cuuuaugauaauaa

SEQ ID NO: 2114935 - RNA, 13 nt, Staphylococcus aureus subsp. aureus MW2
cuuuaucuauaug

SEQ ID NO: 2114936 - RNA, 23 nt, Staphylococcus aureus subsp. aureus MW2
cuuuacuugcuuuuucaaauaau

SEQ ID NO: 2114937 - RNA, 14 nt, Staphylococcus aureus subsp. aureus MW2
cuuuagcaauugaa

SEQ ID NO: 2114938 - RNA, 22 nt, Staphylococcus aureus subsp. aureus MW2
cuuuagaugagauuucguuaga

SEQ ID NO: 2114939 - RNA, 15 nt, Staphylococcus aureus subsp. aureus MW2
cuuuagcuauugcuu

SEQ ID NO: 2114940 - RNA, 17 nt, Staphylococcus aureus subsp. aureus MW2
cuuuagcuauuuaaaau

SEQ ID NO: 2114941 - RNA, 18 nt, Staphylococcus aureus subsp. aureus MW2
cuuuagcuauuuaaaauu

SEQ ID NO: 2114942 - RNA, 15 nt, Staphylococcus aureus subsp. aureus MW2
cuuuagcucuuuuuu

SEQ ID NO: 2114943 - RNA, 21 nt, Staphylococcus aureus subsp. aureus MW2
cuuuagcucuuuuuugauuua

SEQ ID NO: 2114944 - RNA, 20 nt, Staphylococcus aureus subsp. aureus MW2
cuuuacauucuuuguauuua

SEQ ID NO: 2114945 - RNA, 19 nt, Staphylococcus aureus subsp. aureus MW2
cuuuaacuucuuuuguuuu

SEQ ID NO: 2114946 - RNA, 17 nt, Staphylococcus aureus subsp. aureus MW2
cuuuaacuuuaauuaaa

SEQ ID NO: 2114947 - RNA, 18 nt, Staphylococcus aureus subsp. aureus MW2
cuuuaaguaauucauuug

SEQ ID NO: 2114948 - RNA, 14 nt, Staphylococcus aureus subsp. aureus MW2
cuuuaagcuuaaau

SEQ ID NO: 2114949 - RNA, 16 nt, Staphylococcus aureus subsp. aureus MW2
cuuuaagcccuucccc

SEQ ID NO: 2114950 - RNA, 20 nt, Staphylococcus aureus subsp. aureus MW2
cuuuaaguaauucauuugcu

SEQ ID NO: 2114951 - RNA, 17 nt, Staphylococcus aureus subsp. aureus MW2
cuuuaauguaauuauuu

SEQ ID NO: 2114952 - RNA, 15 nt, Staphylococcus aureus subsp. aureus MW2
cuuuaauuaaaguua

SEQ ID NO: 2114953 - RNA, 23 nt, Staphylococcus aureus subsp. aureus MW2
cuuuaacuguacgauucaauuua

SEQ ID NO: 2114954 - RNA, 20 nt, Staphylococcus aureus subsp. aureus MW2
cuuugcauacauaucuuuug

SEQ ID NO: 2114955 - RNA, 20 nt, Staphylococcus aureus subsp. aureus MW2
cuuugauauguuuccucuuu

SEQ ID NO: 2114956 - RNA, 17 nt, Staphylococcus aureus subsp. aureus MW2
cuuugauauguuuccuc

SEQ ID NO: 2114957 - RNA, 19 nt, Staphylococcus aureus subsp. aureus MW2
cuuugauaacaauuuuaaa

SEQ ID NO: 2114958 - RNA, 19 nt, Staphylococcus aureus subsp. aureus MW2
cuuugaucuuuaaauauac

SEQ ID NO: 2114959 - RNA, 19 nt, Staphylococcus aureus subsp. aureus MW2
cuuugauguucacuaaaug

SEQ ID NO: 2114960 - RNA, 19 nt, Staphylococcus aureus subsp. aureus MW2
cuuugauuuaauaauauuu

SEQ ID NO: 2114961 - RNA, 15 nt, Staphylococcus aureus subsp. aureus MW2
cuuugauuucauuug

SEQ ID NO: 2114962 - RNA, 15 nt, Staphylococcus aureus subsp. aureus MW2
cuuugccaacaccau

SEQ ID NO: 2114963 - RNA, 21 nt, Staphylococcus aureus subsp. aureus MW2
cuuugcuuaaaccuuaauaau

SEQ ID NO: 2114964 - RNA, 23 nt, Staphylococcus aureus subsp. aureus MW2
cuuuggaaauuuauuauaaaaua

SEQ ID NO: 2114965 - RNA, 20 nt, Staphylococcus aureus subsp. aureus MW2
cuuuggauuucuuuuuaaaa

SEQ ID NO: 2114966 - RNA, 15 nt, Staphylococcus aureus subsp. aureus MW2
cuuuggauuucuuuu

SEQ ID NO: 2114967 - RNA, 18 nt, Staphylococcus aureus subsp. aureus MW2
cuuuggauuucuuuuuaa

SEQ ID NO: 2114968 - RNA, 14 nt, Staphylococcus aureus subsp. aureus MW2
cuuuggcaccagua

SEQ ID NO: 2114969 - RNA, 20 nt, Staphylococcus aureus subsp. aureus MW2
cuuuggcaucauaauuaaau

SEQ ID NO: 2114970 - RNA, 20 nt, Staphylococcus aureus subsp. aureus MW2
cuuugaauggcucguuuuuu

SEQ ID NO: 2114971 - RNA, 20 nt, Staphylococcus aureus subsp. aureus MW2
cuuugaacgaaagagaaaag

SEQ ID NO: 2114972 - RNA, 21 nt, Staphylococcus aureus subsp. aureus MW2
cuuugaacgaaagagaaaagc

SEQ ID NO: 2114973 - RNA, 21 nt, Staphylococcus aureus subsp. aureus MW2
cuuugaacgagagagaaaagc

SEQ ID NO: 2114974 - RNA, 22 nt, Staphylococcus aureus subsp. aureus MW2
cuuugaaaggaauguuuaaaaa

SEQ ID NO: 2114975 - RNA, 18 nt, Staphylococcus aureus subsp. aureus MW2
cuuugaaagaaggaauaa

SEQ ID NO: 2114976 - RNA, 16 nt, Staphylococcus aureus subsp. aureus MW2
cuuugacauguguuaa

SEQ ID NO: 2114977 - RNA, 17 nt, Staphylococcus aureus subsp. aureus MW2
cuuuccacagcuuguuc

SEQ ID NO: 2114978 - RNA, 22 nt, Staphylococcus aureus subsp. aureus MW2
cuuuccacagcuuguucaauac

SEQ ID NO: 2114979 - RNA, 23 nt, Staphylococcus aureus subsp. aureus MW2
cuuuccacagcuuguucaauacu

SEQ ID NO: 2114980 - RNA, 14 nt, Staphylococcus aureus subsp. aureus MW2
cuuucguaccugcu

SEQ ID NO: 2114981 - RNA, 21 nt, Staphylococcus aureus subsp. aureus MW2
cuuucuaagauguguugaaac

SEQ ID NO: 2114982 - RNA, 23 nt, Staphylococcus aureus subsp. aureus MW2
cuuucugaucgacuaauuuuucu

SEQ ID NO: 2114983 - RNA, 23 nt, Staphylococcus aureus subsp. aureus MW2
cuuagaccccuaauuaaaaugcu

SEQ ID NO: 2114984 - RNA, 19 nt, Staphylococcus aureus subsp. aureus MW2
cuuagacgcuguuuuaaau

SEQ ID NO: 2114985 - RNA, 20 nt, Staphylococcus aureus subsp. aureus MW2
cuuaguaaguuguacuucuu

SEQ ID NO: 2114986 - RNA, 22 nt, Staphylococcus aureus subsp. aureus MW2
cuuaggugucaucgcuuuaauu

SEQ ID NO: 2114987 - RNA, 18 nt, Staphylococcus aureus subsp. aureus MW2
cuuaguaaggaauauuuc

SEQ ID NO: 2114988 - RNA, 20 nt, Staphylococcus aureus subsp. aureus MW2
cuuaggguuugguauuauuc

SEQ ID NO: 2114989 - RNA, 15 nt, Staphylococcus aureus subsp. aureus MW2
cuuacccaaaaaauu

SEQ ID NO: 2114990 - RNA, 17 nt, Staphylococcus aureus subsp. aureus MW2
cuuacccaaaaaauugu

SEQ ID NO: 2114991 - RNA, 16 nt, Staphylococcus aureus subsp. aureus MW2
cuuacauuuuaauaaa

SEQ ID NO: 2114992 - RNA, 15 nt, Staphylococcus aureus subsp. aureus MW2
cuuacugcugcuucg

SEQ ID NO: 2114993 - RNA, 17 nt, Staphylococcus aureus subsp. aureus MW2
cuuacugucaccuucua

SEQ ID NO: 2114994 - RNA, 17 nt, Staphylococcus aureus subsp. aureus MW2
cuuacugugaaaauacc

SEQ ID NO: 2114995 - RNA, 17 nt, Staphylococcus aureus subsp. aureus MW2
cuuacuuauauuuuaau

SEQ ID NO: 2114996 - RNA, 15 nt, Staphylococcus aureus subsp. aureus MW2
cuuaaugcuucaaau

SEQ ID NO: 2114997 - RNA, 14 nt, Staphylococcus aureus subsp. aureus MW2
cuuaaugcuucaaa

SEQ ID NO: 2114998 - RNA, 18 nt, Staphylococcus aureus subsp. aureus MW2
cuuaaugcuaugauuaaa

SEQ ID NO: 2114999 - RNA, 14 nt, Staphylococcus aureus subsp. aureus MW2
cuuacauuaugaac

SEQ ID NO: 2115000 - RNA, 17 nt, Staphylococcus aureus subsp. aureus MW2
cuuacauaggauaucua

SEQ ID NO: 2115001 - RNA, 16 nt, Staphylococcus aureus subsp. aureus MW2
cuuacauuacauauau

SEQ ID NO: 2115002 - RNA, 16 nt, Staphylococcus aureus subsp. aureus MW2
cuuaauggcgugcuuu

SEQ ID NO: 2115003 - RNA, 13 nt, Staphylococcus aureus subsp. aureus MW2
cuuaacuugaaau

SEQ ID NO: 2115004 - RNA, 18 nt, Staphylococcus aureus subsp. aureus MW2
cuuaagaaauuuuuucua

SEQ ID NO: 2115005 - RNA, 23 nt, Staphylococcus aureus subsp. aureus MW2
cuuaagcucauuucaauauuaaa

SEQ ID NO: 2115006 - RNA, 16 nt, Staphylococcus aureus subsp. aureus MW2
cuuaacguugcagaga

SEQ ID NO: 2115007 - RNA, 20 nt, Staphylococcus aureus subsp. aureus MW2
cuuaauacgauaauaacuag

SEQ ID NO: 2115008 - RNA, 13 nt, Staphylococcus aureus subsp. aureus MW2
cuuaauacuaauu

SEQ ID NO: 2115009 - RNA, 15 nt, Staphylococcus aureus subsp. aureus MW2
cuuaaauggaugaua

SEQ ID NO: 2115010 - RNA, 23 nt, Staphylococcus aureus subsp. aureus MW2
cuuaaauggagauucucgguuuu

SEQ ID NO: 2115011 - RNA, 22 nt, Staphylococcus aureus subsp. aureus MW2
cuuaaccauuuaaaaauugaag

SEQ ID NO: 2115012 - RNA, 17 nt, Staphylococcus aureus subsp. aureus MW2
cuuaacaucuuuuucac

SEQ ID NO: 2115013 - RNA, 17 nt, Staphylococcus aureus subsp. aureus MW2
cuuauaacauucuucaa

SEQ ID NO: 2115014 - RNA, 21 nt, Staphylococcus aureus subsp. aureus MW2
cuuauaacauucuucaaaaaa

SEQ ID NO: 2115015 - RNA, 17 nt, Staphylococcus aureus subsp. aureus MW2
cuuauaagauauagaag

SEQ ID NO: 2115016 - RNA, 17 nt, Staphylococcus aureus subsp. aureus MW2
cuuauaacaaaaauugc

SEQ ID NO: 2115017 - RNA, 21 nt, Staphylococcus aureus subsp. aureus MW2
cuuauaaagacaccuucaaua

SEQ ID NO: 2115018 - RNA, 16 nt, Staphylococcus aureus subsp. aureus MW2
cuuaguuugacaucua

SEQ ID NO: 2115019 - RNA, 18 nt, Staphylococcus aureus subsp. aureus MW2
cuuauaaagacaccuuca

SEQ ID NO: 2115020 - RNA, 19 nt, Staphylococcus aureus subsp. aureus MW2
cuuaugcaguuuuaauuaa

SEQ ID NO: 2115021 - RNA, 15 nt, Staphylococcus aureus subsp. aureus MW2
cuuaugacugcuuuu

SEQ ID NO: 2115022 - RNA, 18 nt, Staphylococcus aureus subsp. aureus MW2
cuuauuccgcaacuugua

SEQ ID NO: 2115023 - RNA, 21 nt, Staphylococcus aureus subsp. aureus MW2
cuuauucgcaccacuggccuu

SEQ ID NO: 2115024 - RNA, 17 nt, Staphylococcus aureus subsp. aureus MW2
cuuauucugaaaaauau

SEQ ID NO: 2115025 - RNA, 19 nt, Staphylococcus aureus subsp. aureus MW2
cuuauucugaaaaauauuu

SEQ ID NO: 2115026 - RNA, 21 nt, Staphylococcus aureus subsp. aureus MW2
cuuauugauauaagauucaua

SEQ ID NO: 2115027 - RNA, 16 nt, Staphylococcus aureus subsp. aureus MW2
cuuauucaaauguuua

SEQ ID NO: 2115028 - RNA, 23 nt, Staphylococcus aureus subsp. aureus MW2
cuuaugcucaucuacuuaaaaua

SEQ ID NO: 2115029 - RNA, 14 nt, Staphylococcus aureus subsp. aureus MW2
cuucaaaguuuuca

SEQ ID NO: 2115030 - RNA, 13 nt, Staphylococcus aureus subsp. aureus MW2
cuucaaaaugccg

SEQ ID NO: 2115031 - RNA, 17 nt, Staphylococcus aureus subsp. aureus MW2
cuucaaauguaacauua

SEQ ID NO: 2115032 - RNA, 18 nt, Staphylococcus aureus subsp. aureus MW2
cuucaaaguuuucauuuu

SEQ ID NO: 2115033 - RNA, 20 nt, Staphylococcus aureus subsp. aureus MW2
cuucaaaguuuucauuuuuu

SEQ ID NO: 2115034 - RNA, 23 nt, Staphylococcus aureus subsp. aureus MW2
cuucaaaguuuucauuuuuucaa

SEQ ID NO: 2115035 - RNA, 22 nt, Staphylococcus aureus subsp. aureus MW2
cuuauuuguuuaauuaucuuua

SEQ ID NO: 2115036 - RNA, 14 nt, Staphylococcus aureus subsp. aureus MW2
cuuauuuguuuaau

SEQ ID NO: 2115037 - RNA, 17 nt, Staphylococcus aureus subsp. aureus MW2
cuuauuuuaaaauauua

SEQ ID NO: 2115038 - RNA, 18 nt, Staphylococcus aureus subsp. aureus MW2
cuuauuuuaaaauauuaa

SEQ ID NO: 2115039 - RNA, 19 nt, Staphylococcus aureus subsp. aureus MW2
cuuauuuuguuuuaaaaaa

SEQ ID NO: 2115040 - RNA, 14 nt, Staphylococcus aureus subsp. aureus MW2
cuuauuucuuuuca

SEQ ID NO: 2115041 - RNA, 16 nt, Staphylococcus aureus subsp. aureus MW2
cuucaauccaagcaau

SEQ ID NO: 2115042 - RNA, 19 nt, Staphylococcus aureus subsp. aureus MW2
cuucaaucgucacaucacg

SEQ ID NO: 2115043 - RNA, 18 nt, Staphylococcus aureus subsp. aureus MW2
cuucaauucuuacaccug

SEQ ID NO: 2115044 - RNA, 15 nt, Staphylococcus aureus subsp. aureus MW2
cuucaauuuaaugua

SEQ ID NO: 2115045 - RNA, 12 nt, Staphylococcus aureus subsp. aureus MW2
cuucaauuauuu

SEQ ID NO: 2115046 - RNA, 19 nt, Staphylococcus aureus subsp. aureus MW2
cuucaagugccauuuuuaa

SEQ ID NO: 2115047 - RNA, 16 nt, Staphylococcus aureus subsp. aureus MW2
cuucaacuucaucuaa

SEQ ID NO: 2115048 - RNA, 15 nt, Staphylococcus aureus subsp. aureus MW2
cuucaacuuucucua

SEQ ID NO: 2115049 - RNA, 17 nt, Staphylococcus aureus subsp. aureus MW2
cuucaaccauuuguucu

SEQ ID NO: 2115050 - RNA, 13 nt, Staphylococcus aureus subsp. aureus MW2
cuucaacauaacu

SEQ ID NO: 2115051 - RNA, 22 nt, Staphylococcus aureus subsp. aureus MW2
cuucaacauagacacuuaacuu

SEQ ID NO: 2115052 - RNA, 21 nt, Staphylococcus aureus subsp. aureus MW2
cuucaacacgacguucuucaa

SEQ ID NO: 2115053 - RNA, 16 nt, Staphylococcus aureus subsp. aureus MW2
cuucaacgucaucugc

SEQ ID NO: 2115054 - RNA, 22 nt, Staphylococcus aureus subsp. aureus MW2
cuucggcucucgcuuacucauu

SEQ ID NO: 2115055 - RNA, 13 nt, Staphylococcus aureus subsp. aureus MW2
cuucuaucucuuu

SEQ ID NO: 2115056 - RNA, 14 nt, Staphylococcus aureus subsp. aureus MW2
cuucuaucucuuua

SEQ ID NO: 2115057 - RNA, 22 nt, Staphylococcus aureus subsp. aureus MW2
cuucuauguuggggccccgcca

SEQ ID NO: 2115058 - RNA, 23 nt, Staphylococcus aureus subsp. aureus MW2
cuucuacuuuuguaccaucaaua

SEQ ID NO: 2115059 - RNA, 17 nt, Staphylococcus aureus subsp. aureus MW2
cuucuaaccacuucuuc

SEQ ID NO: 2115060 - RNA, 21 nt, Staphylococcus aureus subsp. aureus MW2
cuucuacccauaauuuaaaug

SEQ ID NO: 2115061 - RNA, 16 nt, Staphylococcus aureus subsp. aureus MW2
cuucuacauauacaaa

SEQ ID NO: 2115062 - RNA, 15 nt, Staphylococcus aureus subsp. aureus MW2
cuucuaaguaauaua

SEQ ID NO: 2115063 - RNA, 18 nt, Staphylococcus aureus subsp. aureus MW2
cuucuaauuuaguuuuaa

SEQ ID NO: 2115064 - RNA, 12 nt, Staphylococcus aureus subsp. aureus MW2
cuucguuuuaau

SEQ ID NO: 2115065 - RNA, 14 nt, Staphylococcus aureus subsp. aureus MW2
cuucccaucuuuua

SEQ ID NO: 2115066 - RNA, 22 nt, Staphylococcus aureus subsp. aureus MW2
cuucccaucuuuuagguaauaa

SEQ ID NO: 2115067 - RNA, 16 nt, Staphylococcus aureus subsp. aureus MW2
cuuccccaccuaauca

SEQ ID NO: 2115068 - RNA, 16 nt, Staphylococcus aureus subsp. aureus MW2
cuuccccuacaaaguu

SEQ ID NO: 2115069 - RNA, 18 nt, Staphylococcus aureus subsp. aureus MW2
cuuccaaucaacuucaua

SEQ ID NO: 2115070 - RNA, 17 nt, Staphylococcus aureus subsp. aureus MW2
cuuccaacacccauaua

SEQ ID NO: 2115071 - RNA, 15 nt, Staphylococcus aureus subsp. aureus MW2
cuucaucuuuaaaga

SEQ ID NO: 2115072 - RNA, 17 nt, Staphylococcus aureus subsp. aureus MW2
cuucaucuuuuuuauca

SEQ ID NO: 2115073 - RNA, 21 nt, Staphylococcus aureus subsp. aureus MW2
cugcaucaauaugaccuuuau

SEQ ID NO: 2115074 - RNA, 19 nt, Staphylococcus aureus subsp. aureus MW2
cugcauagcgcucuggauu

SEQ ID NO: 2115075 - RNA, 13 nt, Staphylococcus aureus subsp. aureus MW2
cugcauauaaagu

SEQ ID NO: 2115076 - RNA, 23 nt, Staphylococcus aureus subsp. aureus MW2
cugcauauucacgauauaacauu

SEQ ID NO: 2115077 - RNA, 18 nt, Staphylococcus aureus subsp. aureus MW2
cugcauuacgcugucuca

SEQ ID NO: 2115078 - RNA, 14 nt, Staphylococcus aureus subsp. aureus MW2
cugccaauauauuc

SEQ ID NO: 2115079 - RNA, 16 nt, Staphylococcus aureus subsp. aureus MW2
cugccaaaaugguuaa

SEQ ID NO: 2115080 - RNA, 17 nt, Staphylococcus aureus subsp. aureus MW2
cugcacaucauaauaaa

SEQ ID NO: 2115081 - RNA, 16 nt, Staphylococcus aureus subsp. aureus MW2
cugcaaaugccucuuu

SEQ ID NO: 2115082 - RNA, 18 nt, Staphylococcus aureus subsp. aureus MW2
cugcaccgauaucauaua

SEQ ID NO: 2115083 - RNA, 13 nt, Staphylococcus aureus subsp. aureus MW2
cugcaccuccaac

SEQ ID NO: 2115084 - RNA, 13 nt, Staphylococcus aureus subsp. aureus MW2
cugcagcaaucac

SEQ ID NO: 2115085 - RNA, 18 nt, Staphylococcus aureus subsp. aureus MW2
cugauuauguucagaacu

SEQ ID NO: 2115086 - RNA, 20 nt, Staphylococcus aureus subsp. aureus MW2
cugauucaaaaauuguuaau

SEQ ID NO: 2115087 - RNA, 13 nt, Staphylococcus aureus subsp. aureus MW2
cugauucauuaaa

SEQ ID NO: 2115088 - RNA, 22 nt, Staphylococcus aureus subsp. aureus MW2
cugaugcuagcuuucuuuuuca

SEQ ID NO: 2115089 - RNA, 20 nt, Staphylococcus aureus subsp. aureus MW2
cugcugguaacucuucagua

SEQ ID NO: 2115090 - RNA, 23 nt, Staphylococcus aureus subsp. aureus MW2
cugcuggaacaccaauauaaaca

SEQ ID NO: 2115091 - RNA, 15 nt, Staphylococcus aureus subsp. aureus MW2
cugcgugaauguuac

SEQ ID NO: 2115092 - RNA, 21 nt, Staphylococcus aureus subsp. aureus MW2
cugcucuuuauauauaaaauc

SEQ ID NO: 2115093 - RNA, 13 nt, Staphylococcus aureus subsp. aureus MW2
cugcucuuuauca

SEQ ID NO: 2115094 - RNA, 22 nt, Staphylococcus aureus subsp. aureus MW2
cugcucuuuaucaccauaaaaa

SEQ ID NO: 2115095 - RNA, 18 nt, Staphylococcus aureus subsp. aureus MW2
cugcgaacagcugcuucu

SEQ ID NO: 2115096 - RNA, 16 nt, Staphylococcus aureus subsp. aureus MW2
cuggauccuuuauacg

SEQ ID NO: 2115097 - RNA, 16 nt, Staphylococcus aureus subsp. aureus MW2
cugcuuaucauuacuu

SEQ ID NO: 2115098 - RNA, 18 nt, Staphylococcus aureus subsp. aureus MW2
cugcuucagccauaauau

SEQ ID NO: 2115099 - RNA, 17 nt, Staphylococcus aureus subsp. aureus MW2
cugcuucuacccuugca

SEQ ID NO: 2115100 - RNA, 16 nt, Staphylococcus aureus subsp. aureus MW2
cugcuucggcaccuuu

SEQ ID NO: 2115101 - RNA, 12 nt, Staphylococcus aureus subsp. aureus MW2
cuggcuuuuuaa

SEQ ID NO: 2115102 - RNA, 19 nt, Staphylococcus aureus subsp. aureus MW2
cugggaacgcuguuuuuaa

SEQ ID NO: 2115103 - RNA, 12 nt, Staphylococcus aureus subsp. aureus MW2
cugguaaaaaaa

SEQ ID NO: 2115104 - RNA, 14 nt, Staphylococcus aureus subsp. aureus MW2
cugguaaaaaaaua

SEQ ID NO: 2115105 - RNA, 21 nt, Staphylococcus aureus subsp. aureus MW2
cuggugguaacguaaacaugg

SEQ ID NO: 2115106 - RNA, 12 nt, Staphylococcus aureus subsp. aureus MW2
cugguucuucac

SEQ ID NO: 2115107 - RNA, 11 nt, Staphylococcus aureus subsp. aureus MW2
cuguauauaua

SEQ ID NO: 2115108 - RNA, 22 nt, Staphylococcus aureus subsp. aureus MW2
cuguauacgacgucgcaacagg

SEQ ID NO: 2115109 - RNA, 16 nt, Staphylococcus aureus subsp. aureus MW2
cugucaucuuuauaca

SEQ ID NO: 2115110 - RNA, 18 nt, Staphylococcus aureus subsp. aureus MW2
cuguaauccauucccuuu

SEQ ID NO: 2115111 - RNA, 17 nt, Staphylococcus aureus subsp. aureus MW2
cuguaacgaguccauuu

SEQ ID NO: 2115112 - RNA, 23 nt, Staphylococcus aureus subsp. aureus MW2
cuguaacgaguccauuuucuuuu

SEQ ID NO: 2115113 - RNA, 17 nt, Staphylococcus aureus subsp. aureus MW2
cuguagcgauaccuuua

SEQ ID NO: 2115114 - RNA, 15 nt, Staphylococcus aureus subsp. aureus MW2
cuguagaaauuggcu

SEQ ID NO: 2115115 - RNA, 13 nt, Staphylococcus aureus subsp. aureus MW2
cuguagaauuucu

SEQ ID NO: 2115116 - RNA, 16 nt, Staphylococcus aureus subsp. aureus MW2
cugugauauuaauuga

SEQ ID NO: 2115117 - RNA, 20 nt, Staphylococcus aureus subsp. aureus MW2
cugugauauuaauugaaaaa

SEQ ID NO: 2115118 - RNA, 15 nt, Staphylococcus aureus subsp. aureus MW2
cugugauaaaaaucu

SEQ ID NO: 2115119 - RNA, 15 nt, Staphylococcus aureus subsp. aureus MW2
cugugcucauuuuuu

SEQ ID NO: 2115120 - RNA, 22 nt, Staphylococcus aureus subsp. aureus MW2
cugugcaugacgauaaugaaau

SEQ ID NO: 2115121 - RNA, 22 nt, Staphylococcus aureus subsp. aureus MW2
cuguuaaacucauacaaauuuu

SEQ ID NO: 2115122 - RNA, 15 nt, Staphylococcus aureus subsp. aureus MW2
cuguguuggggccca

SEQ ID NO: 2115123 - RNA, 14 nt, Staphylococcus aureus subsp. aureus MW2
cuguuaaacucaua

SEQ ID NO: 2115124 - RNA, 15 nt, Staphylococcus aureus subsp. aureus MW2
cuguuacugcacaca

SEQ ID NO: 2115125 - RNA, 15 nt, Staphylococcus aureus subsp. aureus MW2
cugugucagcauuca

SEQ ID NO: 2115126 - RNA, 13 nt, Staphylococcus aureus subsp. aureus MW2
cugugugcuguuc

SEQ ID NO: 2115127 - RNA, 18 nt, Staphylococcus aureus subsp. aureus MW2
cuguguaaaauaaaucau

SEQ ID NO: 2115128 - RNA, 17 nt, Staphylococcus aureus subsp. aureus MW2
cuguggacaaacugauu

SEQ ID NO: 2115129 - RNA, 14 nt, Staphylococcus aureus subsp. aureus MW2
cuccgaucaugccu

SEQ ID NO: 2115130 - RNA, 15 nt, Staphylococcus aureus subsp. aureus MW2
cuccgguuuaauaua

SEQ ID NO: 2115131 - RNA, 15 nt, Staphylococcus aureus subsp. aureus MW2
cuccuggauuuuuug

SEQ ID NO: 2115132 - RNA, 17 nt, Staphylococcus aureus subsp. aureus MW2
cuccuggauuuuuugga

SEQ ID NO: 2115133 - RNA, 20 nt, Staphylococcus aureus subsp. aureus MW2
cuccucuuuuauuuaugagu

SEQ ID NO: 2115134 - RNA, 15 nt, Staphylococcus aureus subsp. aureus MW2
cuccucuauuuuaug

SEQ ID NO: 2115135 - RNA, 15 nt, Staphylococcus aureus subsp. aureus MW2
cucgaagucagcgau

SEQ ID NO: 2115136 - RNA, 14 nt, Staphylococcus aureus subsp. aureus MW2
cucgaccuuuauau

SEQ ID NO: 2115137 - RNA, 12 nt, Staphylococcus aureus subsp. aureus MW2
cuccuuacaaua

SEQ ID NO: 2115138 - RNA, 20 nt, Staphylococcus aureus subsp. aureus MW2
cuccuucaauguucaauuca

SEQ ID NO: 2115139 - RNA, 18 nt, Staphylococcus aureus subsp. aureus MW2
cuccuuuuguuucaaauu

SEQ ID NO: 2115140 - RNA, 19 nt, Staphylococcus aureus subsp. aureus MW2
cuccuuuuguuucaaauuu

SEQ ID NO: 2115141 - RNA, 15 nt, Staphylococcus aureus subsp. aureus MW2
cucuggauuuuucuu

SEQ ID NO: 2115142 - RNA, 22 nt, Staphylococcus aureus subsp. aureus MW2
cucuggauuuuucuuauaaaaa

SEQ ID NO: 2115143 - RNA, 15 nt, Staphylococcus aureus subsp. aureus MW2
cucuggaacuuuaau

SEQ ID NO: 2115144 - RNA, 22 nt, Staphylococcus aureus subsp. aureus MW2
cucugcgauuucuaaagcgauu

SEQ ID NO: 2115145 - RNA, 19 nt, Staphylococcus aureus subsp. aureus MW2
cucugauacuucaccaucu

SEQ ID NO: 2115146 - RNA, 17 nt, Staphylococcus aureus subsp. aureus MW2
cucugaaaaacuucuua

SEQ ID NO: 2115147 - RNA, 12 nt, Staphylococcus aureus subsp. aureus MW2
cucugaucuaaa

SEQ ID NO: 2115148 - RNA, 20 nt, Staphylococcus aureus subsp. aureus MW2
cucuauuuuaugauuugauu

SEQ ID NO: 2115149 - RNA, 18 nt, Staphylococcus aureus subsp. aureus MW2
cugacauuucaucaauaa

SEQ ID NO: 2115150 - RNA, 21 nt, Staphylococcus aureus subsp. aureus MW2
cugacauuguugcuaaucuca

SEQ ID NO: 2115151 - RNA, 16 nt, Staphylococcus aureus subsp. aureus MW2
cugaauuuaggaauga

SEQ ID NO: 2115152 - RNA, 14 nt, Staphylococcus aureus subsp. aureus MW2
cugaaugcucaucu

SEQ ID NO: 2115153 - RNA, 20 nt, Staphylococcus aureus subsp. aureus MW2
cugaaugaagcauuuuauuu

SEQ ID NO: 2115154 - RNA, 21 nt, Staphylococcus aureus subsp. aureus MW2
cugaaucugaagguaauuuaa

SEQ ID NO: 2115155 - RNA, 18 nt, Staphylococcus aureus subsp. aureus MW2
cugaaucaggaauguuug

SEQ ID NO: 2115156 - RNA, 14 nt, Staphylococcus aureus subsp. aureus MW2
cugaauaaaauaua

SEQ ID NO: 2115157 - RNA, 21 nt, Staphylococcus aureus subsp. aureus MW2
cugaauaaauaacuucguuuu

SEQ ID NO: 2115158 - RNA, 18 nt, Staphylococcus aureus subsp. aureus MW2
cugaagguaauuuaacau

SEQ ID NO: 2115159 - RNA, 12 nt, Staphylococcus aureus subsp. aureus MW2
cugacuaauaaa

SEQ ID NO: 2115160 - RNA, 18 nt, Staphylococcus aureus subsp. aureus MW2
cugaccuaacaauuugag

SEQ ID NO: 2115161 - RNA, 16 nt, Staphylococcus aureus subsp. aureus MW2
cugacgaaaagucagc

SEQ ID NO: 2115162 - RNA, 21 nt, Staphylococcus aureus subsp. aureus MW2
cugacuuuccgccagcuucua

SEQ ID NO: 2115163 - RNA, 23 nt, Staphylococcus aureus subsp. aureus MW2
cugagcaacaaaagauguugcua

SEQ ID NO: 2115164 - RNA, 21 nt, Staphylococcus aureus subsp. aureus MW2
cucuuaaucuauaaauuauuu

SEQ ID NO: 2115165 - RNA, 19 nt, Staphylococcus aureus subsp. aureus MW2
cucuuauuuuaaaauauua

SEQ ID NO: 2115166 - RNA, 20 nt, Staphylococcus aureus subsp. aureus MW2
cucuuauuuuaaaauauuaa

SEQ ID NO: 2115167 - RNA, 19 nt, Staphylococcus aureus subsp. aureus MW2
cucuuccuccgccaucaau

SEQ ID NO: 2115168 - RNA, 19 nt, Staphylococcus aureus subsp. aureus MW2
cucuuuacggauugcugcc

SEQ ID NO: 2115169 - RNA, 21 nt, Staphylococcus aureus subsp. aureus MW2
cucuuuacggucgaauuuuuu

SEQ ID NO: 2115170 - RNA, 14 nt, Staphylococcus aureus subsp. aureus MW2
cucuuuccacagcu

SEQ ID NO: 2115171 - RNA, 20 nt, Staphylococcus aureus subsp. aureus MW2
cucuuuaaagcuaaauguua

SEQ ID NO: 2115172 - RNA, 13 nt, Staphylococcus aureus subsp. aureus MW2
cucuuuaaaucaa

SEQ ID NO: 2115173 - RNA, 21 nt, Staphylococcus aureus subsp. aureus MW2
cucuuuaaaucaaagaguaaa

SEQ ID NO: 2115174 - RNA, 14 nt, Staphylococcus aureus subsp. aureus MW2
cucuuguucaagua

SEQ ID NO: 2115175 - RNA, 20 nt, Staphylococcus aureus subsp. aureus MW2
cucuuguucaaguaaucauu

SEQ ID NO: 2115176 - RNA, 18 nt, Staphylococcus aureus subsp. aureus MW2
cucuugggaauugaccac

SEQ ID NO: 2115177 - RNA, 15 nt, Staphylococcus aureus subsp. aureus MW2
cucuugauaaaauaa

SEQ ID NO: 2115178 - RNA, 16 nt, Staphylococcus aureus subsp. aureus MW2
cucuugauaaaauaaa

SEQ ID NO: 2115179 - RNA, 15 nt, Staphylococcus aureus subsp. aureus MW2
cucuugaaaaaguua

SEQ ID NO: 2115180 - RNA, 17 nt, Staphylococcus aureus subsp. aureus MW2
cucuucuggagccucuu

SEQ ID NO: 2115181 - RNA, 18 nt, Staphylococcus aureus subsp. aureus MW2
cugaaaucaguuuuugaa

SEQ ID NO: 2115182 - RNA, 17 nt, Staphylococcus aureus subsp. aureus MW2
cugaagcgcuuggauuu

SEQ ID NO: 2115183 - RNA, 18 nt, Staphylococcus aureus subsp. aureus MW2
cugaacuuucuuuauuau

SEQ ID NO: 2115184 - RNA, 20 nt, Staphylococcus aureus subsp. aureus MW2
cugaaacuaaguuuaaugau

SEQ ID NO: 2115185 - RNA, 20 nt, Staphylococcus aureus subsp. aureus MW2
cugaaacgccucaacacuuu

SEQ ID NO: 2115186 - RNA, 18 nt, Staphylococcus aureus subsp. aureus MW2
cugaaacauuuauaaauc

SEQ ID NO: 2115187 - RNA, 15 nt, Staphylococcus aureus subsp. aureus MW2
cugaaaauaaccauu

SEQ ID NO: 2115188 - RNA, 21 nt, Staphylococcus aureus subsp. aureus MW2
cucuuugaaggguuuuuuuau

SEQ ID NO: 2115189 - RNA, 21 nt, Staphylococcus aureus subsp. aureus MW2
cucuuugaacgaaagagaaaa

SEQ ID NO: 2115190 - RNA, 20 nt, Staphylococcus aureus subsp. aureus MW2
cucuuugaacgagagagaaa

SEQ ID NO: 2115191 - RNA, 21 nt, Staphylococcus aureus subsp. aureus MW2
cugaaaaauauuuaaauagaa

SEQ ID NO: 2115192 - RNA, 18 nt, Staphylococcus aureus subsp. aureus MW2
cugaaaagaauaaguugu

SEQ ID NO: 2115193 - RNA, 16 nt, Staphylococcus aureus subsp. aureus MW2
cugaaaagccuacuuu

SEQ ID NO: 2115194 - RNA, 13 nt, Staphylococcus aureus subsp. aureus MW2
cuacccuauuuua

SEQ ID NO: 2115195 - RNA, 22 nt, Staphylococcus aureus subsp. aureus MW2
cuaccgauugucaauuuaaagu

SEQ ID NO: 2115196 - RNA, 23 nt, Staphylococcus aureus subsp. aureus MW2
cuacugcaccgauaucauauaau

SEQ ID NO: 2115197 - RNA, 16 nt, Staphylococcus aureus subsp. aureus MW2
cuacugcuaaaauaaa

SEQ ID NO: 2115198 - RNA, 16 nt, Staphylococcus aureus subsp. aureus MW2
cuacucgacacauaua

SEQ ID NO: 2115199 - RNA, 21 nt, Staphylococcus aureus subsp. aureus MW2
cuacuuugauauguuuccucu

SEQ ID NO: 2115200 - RNA, 15 nt, Staphylococcus aureus subsp. aureus MW2
cuacuuugucugcaa

SEQ ID NO: 2115201 - RNA, 18 nt, Staphylococcus aureus subsp. aureus MW2
cuacuuugucugcaauuu

SEQ ID NO: 2115202 - RNA, 20 nt, Staphylococcus aureus subsp. aureus MW2
cuacuuuauaaauaucuuuu

SEQ ID NO: 2115203 - RNA, 18 nt, Staphylococcus aureus subsp. aureus MW2
cuacuuguucaauacuuc

SEQ ID NO: 2115204 - RNA, 23 nt, Staphylococcus aureus subsp. aureus MW2
cuacuuaaaauaaguauuuuuuu

SEQ ID NO: 2115205 - RNA, 19 nt, Staphylococcus aureus subsp. aureus MW2
cuacuuccuuacagacaaa

SEQ ID NO: 2115206 - RNA, 22 nt, Staphylococcus aureus subsp. aureus MW2
cuagaaaacauaaauacaaaaa

SEQ ID NO: 2115207 - RNA, 18 nt, Staphylococcus aureus subsp. aureus MW2
cuagaaguucuuaugcag

SEQ ID NO: 2115208 - RNA, 14 nt, Staphylococcus aureus subsp. aureus MW2
cuagaaaacauaaa

SEQ ID NO: 2115209 - RNA, 15 nt, Staphylococcus aureus subsp. aureus MW2
cuaguaacuuaucug

SEQ ID NO: 2115210 - RNA, 14 nt, Staphylococcus aureus subsp. aureus MW2
cuaguaauaauagg

SEQ ID NO: 2115211 - RNA, 19 nt, Staphylococcus aureus subsp. aureus MW2
cuagguacauaaauaccug

SEQ ID NO: 2115212 - RNA, 22 nt, Staphylococcus aureus subsp. aureus MW2
cuagucuuuaacuuuaauuaaa

SEQ ID NO: 2115213 - RNA, 23 nt, Staphylococcus aureus subsp. aureus MW2
cuagucaggggccccaacacaga

SEQ ID NO: 2115214 - RNA, 15 nt, Staphylococcus aureus subsp. aureus MW2
cuagucaggggcccc

SEQ ID NO: 2115215 - RNA, 17 nt, Staphylococcus aureus subsp. aureus MW2
cuagucaggggccccaa

SEQ ID NO: 2115216 - RNA, 18 nt, Staphylococcus aureus subsp. aureus MW2
cuaguagcuagaacagau

SEQ ID NO: 2115217 - RNA, 14 nt, Staphylococcus aureus subsp. aureus MW2
cuaguagcuugaau

SEQ ID NO: 2115218 - RNA, 20 nt, Staphylococcus aureus subsp. aureus MW2
cuaguauccuuuauaaauaa

SEQ ID NO: 2115219 - RNA, 23 nt, Staphylococcus aureus subsp. aureus MW2
cuagauuucaaaucaauaccaac

SEQ ID NO: 2115220 - RNA, 11 nt, Staphylococcus aureus subsp. aureus MW2
cuagcaaaaau

SEQ ID NO: 2115221 - RNA, 12 nt, Staphylococcus aureus subsp. aureus MW2
cuagcaaaugca

SEQ ID NO: 2115222 - RNA, 21 nt, Staphylococcus aureus subsp. aureus MW2
cuagcaaaaauacuuuuugau

SEQ ID NO: 2115223 - RNA, 23 nt, Staphylococcus aureus subsp. aureus MW2
cuaugaugcuucuaacugaauua

SEQ ID NO: 2115224 - RNA, 20 nt, Staphylococcus aureus subsp. aureus MW2
cuaugauuaaagcuuaagug

SEQ ID NO: 2115225 - RNA, 14 nt, Staphylococcus aureus subsp. aureus MW2
cuaucuauaaacgu

SEQ ID NO: 2115226 - RNA, 17 nt, Staphylococcus aureus subsp. aureus MW2
cuaucgucgcuaauaaa

SEQ ID NO: 2115227 - RNA, 16 nt, Staphylococcus aureus subsp. aureus MW2
cuaugcauaauaccaa

SEQ ID NO: 2115228 - RNA, 20 nt, Staphylococcus aureus subsp. aureus MW2
cuaugauuugauauuucaaa

SEQ ID NO: 2115229 - RNA, 21 nt, Staphylococcus aureus subsp. aureus MW2
cuaugauuugauauuucaaau

SEQ ID NO: 2115230 - RNA, 14 nt, Staphylococcus aureus subsp. aureus MW2
cuaugguuauggug

SEQ ID NO: 2115231 - RNA, 13 nt, Staphylococcus aureus subsp. aureus MW2
cuauguauaauac

SEQ ID NO: 2115232 - RNA, 17 nt, Staphylococcus aureus subsp. aureus MW2
cuauguauaauacauga

SEQ ID NO: 2115233 - RNA, 19 nt, Staphylococcus aureus subsp. aureus MW2
cuauucauagaccuaugaa

SEQ ID NO: 2115234 - RNA, 20 nt, Staphylococcus aureus subsp. aureus MW2
cuauuccuauuacuacauaa

SEQ ID NO: 2115235 - RNA, 15 nt, Staphylococcus aureus subsp. aureus MW2
cuauucucagucucu

SEQ ID NO: 2115236 - RNA, 12 nt, Staphylococcus aureus subsp. aureus MW2
cuauguggcuac

SEQ ID NO: 2115237 - RNA, 18 nt, Staphylococcus aureus subsp. aureus MW2
cuauuaaacauuuuugau

SEQ ID NO: 2115238 - RNA, 22 nt, Staphylococcus aureus subsp. aureus MW2
cuauuaaacuuccuuuuuuuau

SEQ ID NO: 2115239 - RNA, 22 nt, Staphylococcus aureus subsp. aureus MW2
cuauuauuauguuauaaauucu

SEQ ID NO: 2115240 - RNA, 13 nt, Staphylococcus aureus subsp. aureus MW2
cuauuauuuuuuu

SEQ ID NO: 2115241 - RNA, 19 nt, Staphylococcus aureus subsp. aureus MW2
cuauucaaauauaaauaaa

SEQ ID NO: 2115242 - RNA, 20 nt, Staphylococcus aureus subsp. aureus MW2
cuauucaaauauaaauaaaa

SEQ ID NO: 2115243 - RNA, 23 nt, Staphylococcus aureus subsp. aureus MW2
cuauuauguaccaaauuuauaau

SEQ ID NO: 2115244 - RNA, 18 nt, Staphylococcus aureus subsp. aureus MW2
cuauuaggauccaauuua

SEQ ID NO: 2115245 - RNA, 17 nt, Staphylococcus aureus subsp. aureus MW2
cuaucccuguaaaacca

SEQ ID NO: 2115246 - RNA, 13 nt, Staphylococcus aureus subsp. aureus MW2
cuaucaauauaau

SEQ ID NO: 2115247 - RNA, 18 nt, Staphylococcus aureus subsp. aureus MW2
cuaucaauauaauuuggu

SEQ ID NO: 2115248 - RNA, 17 nt, Staphylococcus aureus subsp. aureus MW2
cuauauuuuuuuacuuu

SEQ ID NO: 2115249 - RNA, 19 nt, Staphylococcus aureus subsp. aureus MW2
cuaucaaaaaaacaaaaaa

SEQ ID NO: 2115250 - RNA, 22 nt, Staphylococcus aureus subsp. aureus MW2
cuaucaaaaaaacaaaaaauaa

SEQ ID NO: 2115251 - RNA, 12 nt, Staphylococcus aureus subsp. aureus MW2
cuaucaaauaau

SEQ ID NO: 2115252 - RNA, 18 nt, Staphylococcus aureus subsp. aureus MW2
cuaguucagcuucuaagu

SEQ ID NO: 2115253 - RNA, 16 nt, Staphylococcus aureus subsp. aureus MW2
cuaguucgauuuuuua

SEQ ID NO: 2115254 - RNA, 16 nt, Staphylococcus aureus subsp. aureus MW2
cuaguuuguaauaauu

SEQ ID NO: 2115255 - RNA, 15 nt, Staphylococcus aureus subsp. aureus MW2
cuaguuguuuuauag

SEQ ID NO: 2115256 - RNA, 22 nt, Staphylococcus aureus subsp. aureus MW2
cuaguuguuuuauagcauuucu

SEQ ID NO: 2115257 - RNA, 21 nt, Staphylococcus aureus subsp. aureus MW2
cuauauuaguagaaaccuuaa

SEQ ID NO: 2115258 - RNA, 23 nt, Staphylococcus aureus subsp. aureus MW2
cuauagcacugaaaucuagaccu

SEQ ID NO: 2115259 - RNA, 21 nt, Staphylococcus aureus subsp. aureus MW2
cuauagccaaaggcaaaaugu

SEQ ID NO: 2115260 - RNA, 15 nt, Staphylococcus aureus subsp. aureus MW2
cucaaaacaauuuaa

SEQ ID NO: 2115261 - RNA, 20 nt, Staphylococcus aureus subsp. aureus MW2
cucaaaagcuguaguuucaa

SEQ ID NO: 2115262 - RNA, 11 nt, Staphylococcus aureus subsp. aureus MW2
cucaaauauua

SEQ ID NO: 2115263 - RNA, 17 nt, Staphylococcus aureus subsp. aureus MW2
cucaaauauuaauuuau

SEQ ID NO: 2115264 - RNA, 15 nt, Staphylococcus aureus subsp. aureus MW2
cucaaauuagauaaa

SEQ ID NO: 2115265 - RNA, 16 nt, Staphylococcus aureus subsp. aureus MW2
cucaaauuagauaaaa

SEQ ID NO: 2115266 - RNA, 22 nt, Staphylococcus aureus subsp. aureus MW2
cucaaauuagauaaaacaaaac

SEQ ID NO: 2115267 - RNA, 19 nt, Staphylococcus aureus subsp. aureus MW2
cuauugugauauaugaaau

SEQ ID NO: 2115268 - RNA, 16 nt, Staphylococcus aureus subsp. aureus MW2
cucaaaaagccaacac

SEQ ID NO: 2115269 - RNA, 17 nt, Staphylococcus aureus subsp. aureus MW2
cuauugcuauauuagua

SEQ ID NO: 2115270 - RNA, 23 nt, Staphylococcus aureus subsp. aureus MW2
cuauugauauucuaaaaaauuaa

SEQ ID NO: 2115271 - RNA, 19 nt, Staphylococcus aureus subsp. aureus MW2
cucaacugaugaaaagguu

SEQ ID NO: 2115272 - RNA, 18 nt, Staphylococcus aureus subsp. aureus MW2
cucaacgggaacaucaua

SEQ ID NO: 2115273 - RNA, 20 nt, Staphylococcus aureus subsp. aureus MW2
cucaacgggaacaucauaau

SEQ ID NO: 2115274 - RNA, 17 nt, Staphylococcus aureus subsp. aureus MW2
cucacgauuaauaaaau

SEQ ID NO: 2115275 - RNA, 14 nt, Staphylococcus aureus subsp. aureus MW2
cuccaauacuuuuu

SEQ ID NO: 2115276 - RNA, 13 nt, Staphylococcus aureus subsp. aureus MW2
cuccaacuuuaaa

SEQ ID NO: 2115277 - RNA, 12 nt, Staphylococcus aureus subsp. aureus MW2
cuccaaauauug

SEQ ID NO: 2115278 - RNA, 15 nt, Staphylococcus aureus subsp. aureus MW2
cuccaaacauagaga

SEQ ID NO: 2115279 - RNA, 16 nt, Staphylococcus aureus subsp. aureus MW2
cucauauugaauacuu

SEQ ID NO: 2115280 - RNA, 17 nt, Staphylococcus aureus subsp. aureus MW2
cucaucuucuaaaucaa

SEQ ID NO: 2115281 - RNA, 18 nt, Staphylococcus aureus subsp. aureus MW2
cucaucccucuaucaaau

SEQ ID NO: 2115282 - RNA, 19 nt, Staphylococcus aureus subsp. aureus MW2
cucaugcacuuuauuaaaa

SEQ ID NO: 2115283 - RNA, 20 nt, Staphylococcus aureus subsp. aureus MW2
cucauuauaaugauuuuuau

SEQ ID NO: 2115284 - RNA, 18 nt, Staphylococcus aureus subsp. aureus MW2
cucaugccaaaaacauua

SEQ ID NO: 2115285 - RNA, 13 nt, Staphylococcus aureus subsp. aureus MW2
cucauaaaucaug

SEQ ID NO: 2115286 - RNA, 15 nt, Staphylococcus aureus subsp. aureus MW2
cucagugcauuuuuu

SEQ ID NO: 2115287 - RNA, 13 nt, Staphylococcus aureus subsp. aureus MW2
cucagugcauuuu

SEQ ID NO: 2115288 - RNA, 21 nt, Staphylococcus aureus subsp. aureus MW2
cucagucucuuugaaggguuu

SEQ ID NO: 2115289 - RNA, 10 nt, Staphylococcus aureus subsp. aureus MW2
cucauaauaa

SEQ ID NO: 2115290 - RNA, 22 nt, Staphylococcus aureus subsp. aureus MW2
cucauaauuuucuauuauuuua

SEQ ID NO: 2115291 - RNA, 14 nt, Staphylococcus aureus subsp. aureus MW2
cucauacuauacaa

SEQ ID NO: 2115292 - RNA, 15 nt, Staphylococcus aureus subsp. aureus MW2
cucauagucaucuua

SEQ ID NO: 2115293 - RNA, 14 nt, Staphylococcus aureus subsp. aureus MW2
cucagcguauuuua

SEQ ID NO: 2115294 - RNA, 20 nt, Staphylococcus aureus subsp. aureus MW2
cucacugcuguucuuuuuau

SEQ ID NO: 2115295 - RNA, 12 nt, Staphylococcus aureus subsp. aureus MW2
cuacaucaauau

SEQ ID NO: 2115296 - RNA, 17 nt, Staphylococcus aureus subsp. aureus MW2
cuacaucaauauugucu

SEQ ID NO: 2115297 - RNA, 16 nt, Staphylococcus aureus subsp. aureus MW2
cuacaugaaucaacaa

SEQ ID NO: 2115298 - RNA, 20 nt, Staphylococcus aureus subsp. aureus MW2
cuacauauacaaauuuauau

SEQ ID NO: 2115299 - RNA, 23 nt, Staphylococcus aureus subsp. aureus MW2
cuacauaauuuaucaauuucuau

SEQ ID NO: 2115300 - RNA, 17 nt, Staphylococcus aureus subsp. aureus MW2
cuacaggcaaugcaagu

SEQ ID NO: 2115301 - RNA, 20 nt, Staphylococcus aureus subsp. aureus MW2
cuacagagaaucaauuauug

SEQ ID NO: 2115302 - RNA, 17 nt, Staphylococcus aureus subsp. aureus MW2
cuacagauaaagcuucg

SEQ ID NO: 2115303 - RNA, 21 nt, Staphylococcus aureus subsp. aureus MW2
cuacagaauggauaccuaaag

SEQ ID NO: 2115304 - RNA, 19 nt, Staphylococcus aureus subsp. aureus MW2
cuacagaaguggugcuuua

SEQ ID NO: 2115305 - RNA, 13 nt, Staphylococcus aureus subsp. aureus MW2
cuaccaauaauuc

SEQ ID NO: 2115306 - RNA, 20 nt, Staphylococcus aureus subsp. aureus MW2
cuacauuaaagaaaauaucu

SEQ ID NO: 2115307 - RNA, 16 nt, Staphylococcus aureus subsp. aureus MW2
cuacauuaauuuaucg

SEQ ID NO: 2115308 - RNA, 19 nt, Staphylococcus aureus subsp. aureus MW2
cuacauucuucauuacagu

SEQ ID NO: 2115309 - RNA, 22 nt, Staphylococcus aureus subsp. aureus MW2
cuaauugaucagcauuuaaguu

SEQ ID NO: 2115310 - RNA, 24 nt, Staphylococcus aureus subsp. aureus MW2
cuaauugcacauuuaaacuucgua

SEQ ID NO: 2115311 - RNA, 22 nt, Staphylococcus aureus subsp. aureus MW2
cuaauuguuguaauucuuuuuc

SEQ ID NO: 2115312 - RNA, 15 nt, Staphylococcus aureus subsp. aureus MW2
cuaauuuuaaucauu

SEQ ID NO: 2115313 - RNA, 22 nt, Staphylococcus aureus subsp. aureus MW2
cuaauuucuaauacauacugau

SEQ ID NO: 2115314 - RNA, 17 nt, Staphylococcus aureus subsp. aureus MW2
cuaauuugcaaaaucaa

SEQ ID NO: 2115315 - RNA, 16 nt, Staphylococcus aureus subsp. aureus MW2
cuaauuuaguuuuaau

SEQ ID NO: 2115316 - RNA, 13 nt, Staphylococcus aureus subsp. aureus MW2
cuaauuuuuucau

SEQ ID NO: 2115317 - RNA, 23 nt, Staphylococcus aureus subsp. aureus MW2
cuacaaaguuuauacuuaauaua

SEQ ID NO: 2115318 - RNA, 21 nt, Staphylococcus aureus subsp. aureus MW2
cuacaaagcacaccuaauuca

SEQ ID NO: 2115319 - RNA, 23 nt, Staphylococcus aureus subsp. aureus MW2
cuaauuuugugaauuuauuuugu

SEQ ID NO: 2115320 - RNA, 16 nt, Staphylococcus aureus subsp. aureus MW2
cuaauuuugagacaaa

SEQ ID NO: 2115321 - RNA, 22 nt, Staphylococcus aureus subsp. aureus MW2
cuaauuuuguacauaaaaauaa

SEQ ID NO: 2115322 - RNA, 20 nt, Staphylococcus aureus subsp. aureus MW2
cuaauuuugugaauuuauuu

SEQ ID NO: 2115323 - RNA, 13 nt, Staphylococcus aureus subsp. aureus MW2
cuaauuuuucuuu

SEQ ID NO: 2115324 - RNA, 19 nt, Staphylococcus aureus subsp. aureus MW2
cuacaauauuaaaauuaaa

SEQ ID NO: 2115325 - RNA, 18 nt, Staphylococcus aureus subsp. aureus MW2
cuacaauucauaagaaaa

SEQ ID NO: 2115326 - RNA, 23 nt, Staphylococcus aureus subsp. aureus MW2
cuacaacgaagaauccuaugcca

SEQ ID NO: 2115327 - RNA, 14 nt, Staphylococcus aureus subsp. aureus MW2
cuacaacuucuucu

SEQ ID NO: 2115328 - RNA, 17 nt, Staphylococcus aureus subsp. aureus MW2
cuacaaauuuuaaaaua

SEQ ID NO: 2115329 - RNA, 12 nt, Staphylococcus aureus subsp. aureus MW2
cuacacccauuu

SEQ ID NO: 2115330 - RNA, 19 nt, Staphylococcus aureus subsp. aureus MW2
cuacacgaguguuaucaca

SEQ ID NO: 2115331 - RNA, 16 nt, Staphylococcus aureus subsp. aureus MW2
cuacaauuuucucauu

SEQ ID NO: 2115332 - RNA, 18 nt, Staphylococcus aureus subsp. aureus MW2
cuaaugucgcacuauaaa

SEQ ID NO: 2115333 - RNA, 19 nt, Staphylococcus aureus subsp. aureus MW2
cuaauguguggauuuaauu

SEQ ID NO: 2115334 - RNA, 20 nt, Staphylococcus aureus subsp. aureus MW2
cuaauguuaaaauaacugcu

SEQ ID NO: 2115335 - RNA, 17 nt, Staphylococcus aureus subsp. aureus MW2
cuaaugcuaauuuaacu

SEQ ID NO: 2115336 - RNA, 22 nt, Staphylococcus aureus subsp. aureus MW2
cuaauggauaugauaaccaaac

SEQ ID NO: 2115337 - RNA, 14 nt, Staphylococcus aureus subsp. aureus MW2
cuaauucugaaauc

SEQ ID NO: 2115338 - RNA, 20 nt, Staphylococcus aureus subsp. aureus MW2
cuaauucuguuucaaagcug

SEQ ID NO: 2115339 - RNA, 22 nt, Staphylococcus aureus subsp. aureus MW2
cuaauuagguauaguguuugac

SEQ ID NO: 2115340 - RNA, 14 nt, Staphylococcus aureus subsp. aureus MW2
cuaauucgccaucu

SEQ ID NO: 2115341 - RNA, 21 nt, Staphylococcus aureus subsp. aureus MW2
cuaaucguuaauaaaccuaca

SEQ ID NO: 2115342 - RNA, 16 nt, Staphylococcus aureus subsp. aureus MW2
cuaaucgacuuuuaca

SEQ ID NO: 2115343 - RNA, 21 nt, Staphylococcus aureus subsp. aureus MW2
cuaaugagcccguuaaaaaga

SEQ ID NO: 2115344 - RNA, 20 nt, Staphylococcus aureus subsp. aureus MW2
cuaaucuugguucagcuuua

SEQ ID NO: 2115345 - RNA, 18 nt, Staphylococcus aureus subsp. aureus MW2
cuaaucuugguucagcuu

SEQ ID NO: 2115346 - RNA, 16 nt, Staphylococcus aureus subsp. aureus MW2
cuaaucuuaauugucu

SEQ ID NO: 2115347 - RNA, 24 nt, Staphylococcus aureus subsp. aureus MW2
cuaauauuagauaucuuaaucuaa

SEQ ID NO: 2115348 - RNA, 14 nt, Staphylococcus aureus subsp. aureus MW2
cuaauaucaauaau

SEQ ID NO: 2115349 - RNA, 16 nt, Staphylococcus aureus subsp. aureus MW2
cuaauauaucuauagg

SEQ ID NO: 2115350 - RNA, 15 nt, Staphylococcus aureus subsp. aureus MW2
cuaauauauuaauuu

SEQ ID NO: 2115351 - RNA, 14 nt, Staphylococcus aureus subsp. aureus MW2
cuaaucaauacuaa

SEQ ID NO: 2115352 - RNA, 11 nt, Staphylococcus aureus subsp. aureus MW2
cuaaucagaua

SEQ ID NO: 2115353 - RNA, 19 nt, Staphylococcus aureus subsp. aureus MW2
cuaaucaugaaguugguuu

SEQ ID NO: 2115354 - RNA, 13 nt, Staphylococcus aureus subsp. aureus MW2
cuaaucauuuuuu

SEQ ID NO: 2115355 - RNA, 20 nt, Staphylococcus aureus subsp. aureus MW2
cuaaucauuuuuucaauagu

SEQ ID NO: 2115356 - RNA, 22 nt, Staphylococcus aureus subsp. aureus MW2
cuaacuaaguauguauaguguu

SEQ ID NO: 2115357 - RNA, 22 nt, Staphylococcus aureus subsp. aureus MW2
cuaacucugaucuaaaaccaua

SEQ ID NO: 2115358 - RNA, 20 nt, Staphylococcus aureus subsp. aureus MW2
cuaaauauuauaaaaagaua

SEQ ID NO: 2115359 - RNA, 21 nt, Staphylococcus aureus subsp. aureus MW2
cuaaauauuauaaaaagauau

SEQ ID NO: 2115360 - RNA, 22 nt, Staphylococcus aureus subsp. aureus MW2
cuaacguguuugagauauauua

SEQ ID NO: 2115361 - RNA, 22 nt, Staphylococcus aureus subsp. aureus MW2
cuaauaacucaguaaauuuauu

SEQ ID NO: 2115362 - RNA, 22 nt, Staphylococcus aureus subsp. aureus MW2
cuaauaaugauugucaaauugg

SEQ ID NO: 2115363 - RNA, 17 nt, Staphylococcus aureus subsp. aureus MW2
cuaaguaaccaagucua

SEQ ID NO: 2115364 - RNA, 14 nt, Staphylococcus aureus subsp. aureus MW2
cuaagguuguucua

SEQ ID NO: 2115365 - RNA, 18 nt, Staphylococcus aureus subsp. aureus MW2
cuaagguuguucuauaca

SEQ ID NO: 2115366 - RNA, 14 nt, Staphylococcus aureus subsp. aureus MW2
cuaauaacaaauag

SEQ ID NO: 2115367 - RNA, 22 nt, Staphylococcus aureus subsp. aureus MW2
cuaagguaagacgccgaaaaga

SEQ ID NO: 2115368 - RNA, 20 nt, Staphylococcus aureus subsp. aureus MW2
cguugugcagcaacugcauu

SEQ ID NO: 2115369 - RNA, 19 nt, Staphylococcus aureus subsp. aureus MW2
cguuugaaugaaccuuuac

SEQ ID NO: 2115370 - RNA, 21 nt, Staphylococcus aureus subsp. aureus MW2
cuaaacucguugcgcucuuuu

SEQ ID NO: 2115371 - RNA, 17 nt, Staphylococcus aureus subsp. aureus MW2
cuaaagcuauaaaaaau

SEQ ID NO: 2115372 - RNA, 17 nt, Staphylococcus aureus subsp. aureus MW2
cuaaagcgauuuccauc

SEQ ID NO: 2115373 - RNA, 16 nt, Staphylococcus aureus subsp. aureus MW2
cuaaaguauuaucuaa

SEQ ID NO: 2115374 - RNA, 15 nt, Staphylococcus aureus subsp. aureus MW2
cuaaaguaaauaaca

SEQ ID NO: 2115375 - RNA, 19 nt, Staphylococcus aureus subsp. aureus MW2
cuaaaguguagccaaauaa

SEQ ID NO: 2115376 - RNA, 18 nt, Staphylococcus aureus subsp. aureus MW2
cuaaacaaugaugggaaa

SEQ ID NO: 2115377 - RNA, 21 nt, Staphylococcus aureus subsp. aureus MW2
cuaaaauuugcucgugaaaag

SEQ ID NO: 2115378 - RNA, 18 nt, Staphylococcus aureus subsp. aureus MW2
cuaaaauuuguaauuuaa

SEQ ID NO: 2115379 - RNA, 20 nt, Staphylococcus aureus subsp. aureus MW2
cuaaacacugccguuugaag

SEQ ID NO: 2115380 - RNA, 19 nt, Staphylococcus aureus subsp. aureus MW2
cuaaaauagaaaaauuuca

SEQ ID NO: 2115381 - RNA, 21 nt, Staphylococcus aureus subsp. aureus MW2
cuaaaauagaaaaauuucaaa

SEQ ID NO: 2115382 - RNA, 18 nt, Staphylococcus aureus subsp. aureus MW2
cuaaaauaucaaaauaua

SEQ ID NO: 2115383 - RNA, 13 nt, Staphylococcus aureus subsp. aureus MW2
cuaaaauaacaac

SEQ ID NO: 2115384 - RNA, 21 nt, Staphylococcus aureus subsp. aureus MW2
cguugaauuaacaauauuaaa

SEQ ID NO: 2115385 - RNA, 15 nt, Staphylococcus aureus subsp. aureus MW2
cguucuaauaauuua

SEQ ID NO: 2115386 - RNA, 17 nt, Staphylococcus aureus subsp. aureus MW2
cguucuaauaauuuaau

SEQ ID NO: 2115387 - RNA, 16 nt, Staphylococcus aureus subsp. aureus MW2
cguugcgcucuuuucu

SEQ ID NO: 2115388 - RNA, 14 nt, Staphylococcus aureus subsp. aureus MW2
cguucauauauuuu

SEQ ID NO: 2115389 - RNA, 15 nt, Staphylococcus aureus subsp. aureus MW2
cguuauagauaagua

SEQ ID NO: 2115390 - RNA, 12 nt, Staphylococcus aureus subsp. aureus MW2
cgucauuuuuaa

SEQ ID NO: 2115391 - RNA, 15 nt, Staphylococcus aureus subsp. aureus MW2
aaaaaaauauuuaca

SEQ ID NO: 2115392 - RNA, 13 nt, Staphylococcus aureus subsp. aureus MW2
aaaaaaauagcuc

SEQ ID NO: 2115393 - RNA, 19 nt, Staphylococcus aureus subsp. aureus MW2
aaaaaacaaauguuuuaag

SEQ ID NO: 2115394 - RNA, 13 nt, Staphylococcus aureus subsp. aureus MW2
aaaaaaauuuuca

SEQ ID NO: 2115395 - RNA, 13 nt, Staphylococcus aureus subsp. aureus MW2
aaaaaaauauuua

SEQ ID NO: 2115396 - RNA, 10 nt, Staphylococcus aureus subsp. aureus MW2
aaaaaagcca

SEQ ID NO: 2115397 - RNA, 18 nt, Staphylococcus aureus subsp. aureus MW2
aaaaaacaaaaaauaauu

SEQ ID NO: 2115398 - RNA, 16 nt, Staphylococcus aureus subsp. aureus MW2
aaaaaaauuaauguuu

SEQ ID NO: 2115399 - RNA, 10 nt, Staphylococcus aureus subsp. aureus MW2
aaaaaaggaa

SEQ ID NO: 2115400 - RNA, 22 nt, Staphylococcus aureus subsp. aureus MW2
aaaaaaggaugaugugaauguu

SEQ ID NO: 2115401 - RNA, 12 nt, Staphylococcus aureus subsp. aureus MW2
aaaaaauaauag

SEQ ID NO: 2115402 - RNA, 12 nt, Staphylococcus aureus subsp. aureus MW2
aaaaaauaaugc

SEQ ID NO: 2115403 - RNA, 13 nt, Staphylococcus aureus subsp. aureus MW2
aaaaaauaaaugu

SEQ ID NO: 2115404 - RNA, 21 nt, Staphylococcus aureus subsp. aureus MW2
aaaaaauaaauguuaaagauu

SEQ ID NO: 2115405 - RNA, 15 nt, Staphylococcus aureus subsp. aureus MW2
aaaaaagugguuuaa

SEQ ID NO: 2115406 - RNA, 9 nt, Staphylococcus aureus subsp. aureus MW2
aaaaaagga

SEQ ID NO: 2115407 - RNA, 11 nt, Staphylococcus aureus subsp. aureus MW2
aaaaaaggaaa

SEQ ID NO: 2115408 - RNA, 14 nt, Staphylococcus aureus subsp. aureus MW2
aaaaacauaaaaau

SEQ ID NO: 2115409 - RNA, 18 nt, Staphylococcus aureus subsp. aureus MW2
aaaaacaguguagcacaa

SEQ ID NO: 2115410 - RNA, 17 nt, Staphylococcus aureus subsp. aureus MW2
aaaaacaucgauugaua

SEQ ID NO: 2115411 - RNA, 20 nt, Staphylococcus aureus subsp. aureus MW2
aaaaacaucuacaucaaauu

SEQ ID NO: 2115412 - RNA, 12 nt, Staphylococcus aureus subsp. aureus MW2
aaaaacagcagu

SEQ ID NO: 2115413 - RNA, 14 nt, Staphylococcus aureus subsp. aureus MW2
aaaaaaugaauguu

SEQ ID NO: 2115414 - RNA, 16 nt, Staphylococcus aureus subsp. aureus MW2
aaaaaaucgaacaaau

SEQ ID NO: 2115415 - RNA, 17 nt, Staphylococcus aureus subsp. aureus MW2
aaaaaaguugauuaaaa

SEQ ID NO: 2115416 - RNA, 18 nt, Staphylococcus aureus subsp. aureus MW2
aaaaaauaaauguuaaag

SEQ ID NO: 2115417 - RNA, 13 nt, Staphylococcus aureus subsp. aureus MW2
aaaaaaucgaauu

SEQ ID NO: 2115418 - RNA, 18 nt, Staphylococcus aureus subsp. aureus MW2
aaaaaaucgaacaaauga

SEQ ID NO: 2115419 - RNA, 20 nt, Staphylococcus aureus subsp. aureus MW2
aaaaaaugaagucuuucaac

SEQ ID NO: 2115420 - RNA, 15 nt, Staphylococcus aureus subsp. aureus MW2
aaaaaauuaauaauu

SEQ ID NO: 2115421 - RNA, 18 nt, Staphylococcus aureus subsp. aureus MW2
aaaaaauggggacauguu

SEQ ID NO: 2115422 - RNA, 16 nt, Staphylococcus aureus subsp. aureus MW2
aaaaaauuaaaaauuu

SEQ ID NO: 2115423 - RNA, 13 nt, Staphylococcus aureus subsp. aureus MW2
aaaaaauuguaua

SEQ ID NO: 2115424 - RNA, 16 nt, Staphylococcus aureus subsp. aureus MW2
aaaaaauuuaaauaau

SEQ ID NO: 2115425 - RNA, 12 nt, Staphylococcus aureus subsp. aureus MW2
aaaaaauuuaaa

SEQ ID NO: 2115426 - RNA, 13 nt, Staphylococcus aureus subsp. aureus MW2
aaaaaauuuaaau

SEQ ID NO: 2115427 - RNA, 14 nt, Staphylococcus aureus subsp. aureus MW2
aaaaacaauaaaau

SEQ ID NO: 2115428 - RNA, 18 nt, Staphylococcus aureus subsp. aureus MW2
aaaaacaaaaaaccgaac

SEQ ID NO: 2115429 - RNA, 16 nt, Staphylococcus aureus subsp. aureus MW2
aaaaacagcaguaaga

SEQ ID NO: 2115430 - RNA, 21 nt, Staphylococcus aureus subsp. aureus MW2
aaaaugcgcuuccaauuuaaa

SEQ ID NO: 2115431 - RNA, 18 nt, Staphylococcus aureus subsp. aureus MW2
aaaauuauauaaauuacc

SEQ ID NO: 2115432 - RNA, 17 nt, Staphylococcus aureus subsp. aureus MW2
aaaaugcuuuuuugaaa

SEQ ID NO: 2115433 - RNA, 16 nt, Staphylococcus aureus subsp. aureus MW2
aaaauuauguaaaaaa

SEQ ID NO: 2115434 - RNA, 19 nt, Staphylococcus aureus subsp. aureus MW2
aaaauuaucuuucaucaaa

SEQ ID NO: 2115435 - RNA, 18 nt, Staphylococcus aureus subsp. aureus MW2
aaaaucggcuuucuaagu

SEQ ID NO: 2115436 - RNA, 21 nt, Staphylococcus aureus subsp. aureus MW2
aaaauccuaagcaucguaaaa

SEQ ID NO: 2115437 - RNA, 22 nt, Staphylococcus aureus subsp. aureus MW2
aaaaugauuguuuuaaguggga

SEQ ID NO: 2115438 - RNA, 21 nt, Staphylococcus aureus subsp. aureus MW2
aaaaugauucuuaucuuuaau

SEQ ID NO: 2115439 - RNA, 23 nt, Staphylococcus aureus subsp. aureus MW2
aaaaugcaauuuuucacuuauaa

SEQ ID NO: 2115440 - RNA, 22 nt, Staphylococcus aureus subsp. aureus MW2
aaaaucuauauaacgcuuuaaa

SEQ ID NO: 2115441 - RNA, 18 nt, Staphylococcus aureus subsp. aureus MW2
aaaaucguuccaauacuc

SEQ ID NO: 2115442 - RNA, 23 nt, Staphylococcus aureus subsp. aureus MW2
aaaauuuaaauaauaauucauaa

SEQ ID NO: 2115443 - RNA, 23 nt, Staphylococcus aureus subsp. aureus MW2
aaaauuuaauugcuguaaauauu

SEQ ID NO: 2115444 - RNA, 12 nt, Staphylococcus aureus subsp. aureus MW2
aaaauuucugcu

SEQ ID NO: 2115445 - RNA, 13 nt, Staphylococcus aureus subsp. aureus MW2
aaaauuuucauuu

SEQ ID NO: 2115446 - RNA, 23 nt, Staphylococcus aureus subsp. aureus MW2
aaaauuuucuugguuugagaauc

SEQ ID NO: 2115447 - RNA, 13 nt, Staphylococcus aureus subsp. aureus MW2
aaaauuuguaaca

SEQ ID NO: 2115448 - RNA, 22 nt, Staphylococcus aureus subsp. aureus MW2
aaaauuugcucgugaaaagcag

SEQ ID NO: 2115449 - RNA, 15 nt, Staphylococcus aureus subsp. aureus MW2
aaaauuguuaauaca

SEQ ID NO: 2115450 - RNA, 16 nt, Staphylococcus aureus subsp. aureus MW2
aaaauuguuaauacau

SEQ ID NO: 2115451 - RNA, 14 nt, Staphylococcus aureus subsp. aureus MW2
aaacaaaacaaaaa

SEQ ID NO: 2115452 - RNA, 13 nt, Staphylococcus aureus subsp. aureus MW2
aaacaaaaauaag

SEQ ID NO: 2115453 - RNA, 14 nt, Staphylococcus aureus subsp. aureus MW2
aaacaaaaauaagu

SEQ ID NO: 2115454 - RNA, 16 nt, Staphylococcus aureus subsp. aureus MW2
aaacaaaaccaaaaua

SEQ ID NO: 2115455 - RNA, 15 nt, Staphylococcus aureus subsp. aureus MW2
aaacaaaacuuaaaa

SEQ ID NO: 2115456 - RNA, 18 nt, Staphylococcus aureus subsp. aureus MW2
aaacaaaacuuaaaauau

SEQ ID NO: 2115457 - RNA, 14 nt, Staphylococcus aureus subsp. aureus MW2
aaacaaaagaaagu

SEQ ID NO: 2115458 - RNA, 17 nt, Staphylococcus aureus subsp. aureus MW2
aaaauuuugcaaaaaaa

SEQ ID NO: 2115459 - RNA, 18 nt, Staphylococcus aureus subsp. aureus MW2
aaaauuuugcaaaaaaau

SEQ ID NO: 2115460 - RNA, 22 nt, Staphylococcus aureus subsp. aureus MW2
aaacaaaaaaccgaacaucuga

SEQ ID NO: 2115461 - RNA, 15 nt, Staphylococcus aureus subsp. aureus MW2
aaacaaaaaauaauu

SEQ ID NO: 2115462 - RNA, 13 nt, Staphylococcus aureus subsp. aureus MW2
aaacaaauuacac

SEQ ID NO: 2115463 - RNA, 21 nt, Staphylococcus aureus subsp. aureus MW2
aaacaaauguuuuaaguuguu

SEQ ID NO: 2115464 - RNA, 12 nt, Staphylococcus aureus subsp. aureus MW2
aaacaacaucac

SEQ ID NO: 2115465 - RNA, 20 nt, Staphylococcus aureus subsp. aureus MW2
aaacaaccugugauaaaaau

SEQ ID NO: 2115466 - RNA, 20 nt, Staphylococcus aureus subsp. aureus MW2
aaacaacaucgauuuaucau

SEQ ID NO: 2115467 - RNA, 14 nt, Staphylococcus aureus subsp. aureus MW2
aaacaaauaaaugu

SEQ ID NO: 2115468 - RNA, 21 nt, Staphylococcus aureus subsp. aureus MW2
aaacaaagcucaauaaauuau

SEQ ID NO: 2115469 - RNA, 16 nt, Staphylococcus aureus subsp. aureus MW2
aaacaaaucuuuuaaa

SEQ ID NO: 2115470 - RNA, 15 nt, Staphylococcus aureus subsp. aureus MW2
aaaauauaugaauaa

SEQ ID NO: 2115471 - RNA, 19 nt, Staphylococcus aureus subsp. aureus MW2
aaaauauaucuagccugaa

SEQ ID NO: 2115472 - RNA, 14 nt, Staphylococcus aureus subsp. aureus MW2
aaaauauaugaaua

SEQ ID NO: 2115473 - RNA, 15 nt, Staphylococcus aureus subsp. aureus MW2
aaaauauauuauaaa

SEQ ID NO: 2115474 - RNA, 20 nt, Staphylococcus aureus subsp. aureus MW2
aaaauauauuauaaaaauag

SEQ ID NO: 2115475 - RNA, 24 nt, Staphylococcus aureus subsp. aureus MW2
aaaauaguucuuuaaauuauauac

SEQ ID NO: 2115476 - RNA, 16 nt, Staphylococcus aureus subsp. aureus MW2
aaaaucaacuuuucua

SEQ ID NO: 2115477 - RNA, 19 nt, Staphylococcus aureus subsp. aureus MW2
aaaauccgcuuuauuuuau

SEQ ID NO: 2115478 - RNA, 13 nt, Staphylococcus aureus subsp. aureus MW2
aaaaucaccuuuu

SEQ ID NO: 2115479 - RNA, 21 nt, Staphylococcus aureus subsp. aureus MW2
aaaaucaccuuuuuuaacuuu

SEQ ID NO: 2115480 - RNA, 17 nt, Staphylococcus aureus subsp. aureus MW2
aaaaucacgcuaacauu

SEQ ID NO: 2115481 - RNA, 14 nt, Staphylococcus aureus subsp. aureus MW2
aaaauagaaaaauu

SEQ ID NO: 2115482 - RNA, 13 nt, Staphylococcus aureus subsp. aureus MW2
aaaauagaaaaau

SEQ ID NO: 2115483 - RNA, 17 nt, Staphylococcus aureus subsp. aureus MW2
aaaauagaaaaaacaag

SEQ ID NO: 2115484 - RNA, 18 nt, Staphylococcus aureus subsp. aureus MW2
aaaauagaaaaaacaaga

SEQ ID NO: 2115485 - RNA, 15 nt, Staphylococcus aureus subsp. aureus MW2
aaaauaauuuaauuu

SEQ ID NO: 2115486 - RNA, 13 nt, Staphylococcus aureus subsp. aureus MW2
aaaauaauuuuau

SEQ ID NO: 2115487 - RNA, 13 nt, Staphylococcus aureus subsp. aureus MW2
aaaauaccugcaa

SEQ ID NO: 2115488 - RNA, 16 nt, Staphylococcus aureus subsp. aureus MW2
aaaauacgauuuguuc

SEQ ID NO: 2115489 - RNA, 16 nt, Staphylococcus aureus subsp. aureus MW2
aaaauacgcaaaccaa

SEQ ID NO: 2115490 - RNA, 21 nt, Staphylococcus aureus subsp. aureus MW2
aaaauacguuuauccuuuaaa

SEQ ID NO: 2115491 - RNA, 16 nt, Staphylococcus aureus subsp. aureus MW2
aaaauaguucuuuaaa

SEQ ID NO: 2115492 - RNA, 21 nt, Staphylococcus aureus subsp. aureus MW2
aaaauaguucuuuaaauuaua

SEQ ID NO: 2115493 - RNA, 20 nt, Staphylococcus aureus subsp. aureus MW2
aaaauagcuauuaaaauaga

SEQ ID NO: 2115494 - RNA, 15 nt, Staphylococcus aureus subsp. aureus MW2
aaaauagauugaaaa

SEQ ID NO: 2115495 - RNA, 20 nt, Staphylococcus aureus subsp. aureus MW2
aaaauagaaaaauuucaaaa

SEQ ID NO: 2115496 - RNA, 17 nt, Staphylococcus aureus subsp. aureus MW2
aaaauaaaaugcaaaga

SEQ ID NO: 2115497 - RNA, 16 nt, Staphylococcus aureus subsp. aureus MW2
aaaauaauagauaaua

SEQ ID NO: 2115498 - RNA, 22 nt, Staphylococcus aureus subsp. aureus MW2
aaaauaaaaccgaggaaauccu

SEQ ID NO: 2115499 - RNA, 13 nt, Staphylococcus aureus subsp. aureus MW2
aaaauaaaaacuu

SEQ ID NO: 2115500 - RNA, 15 nt, Staphylococcus aureus subsp. aureus MW2
aaaauaaaaaugccg

SEQ ID NO: 2115501 - RNA, 12 nt, Staphylococcus aureus subsp. aureus MW2
aaaauaaaaacc

SEQ ID NO: 2115502 - RNA, 15 nt, Staphylococcus aureus subsp. aureus MW2
aaaauaaaaaaccaa

SEQ ID NO: 2115503 - RNA, 22 nt, Staphylococcus aureus subsp. aureus MW2
aaaaguguugacuuuaucaauu

SEQ ID NO: 2115504 - RNA, 20 nt, Staphylococcus aureus subsp. aureus MW2
aaaaguguuaaugucuucau

SEQ ID NO: 2115505 - RNA, 14 nt, Staphylococcus aureus subsp. aureus MW2
aaaagugguuuaau

SEQ ID NO: 2115506 - RNA, 17 nt, Staphylococcus aureus subsp. aureus MW2
aaaaguggccuuuuaaa

SEQ ID NO: 2115507 - RNA, 17 nt, Staphylococcus aureus subsp. aureus MW2
aaaagugcgauuaucag

SEQ ID NO: 2115508 - RNA, 21 nt, Staphylococcus aureus subsp. aureus MW2
aaaaguauugccguuauuuuc

SEQ ID NO: 2115509 - RNA, 13 nt, Staphylococcus aureus subsp. aureus MW2
aaaagucaaagag

SEQ ID NO: 2115510 - RNA, 14 nt, Staphylococcus aureus subsp. aureus MW2
aaaagucaaagagg

SEQ ID NO: 2115511 - RNA, 14 nt, Staphylococcus aureus subsp. aureus MW2
aaaaguaaguaaaa

SEQ ID NO: 2115512 - RNA, 17 nt, Staphylococcus aureus subsp. aureus MW2
aaaaguaauuaaauacu

SEQ ID NO: 2115513 - RNA, 22 nt, Staphylococcus aureus subsp. aureus MW2
aaaaguacuuuaaaauuguaua

SEQ ID NO: 2115514 - RNA, 14 nt, Staphylococcus aureus subsp. aureus MW2
aaaaguaguugaaa

SEQ ID NO: 2115515 - RNA, 19 nt, Staphylococcus aureus subsp. aureus MW2
aaaagcagucgaacaauga

SEQ ID NO: 2115516 - RNA, 13 nt, Staphylococcus aureus subsp. aureus MW2
aaaagcaucuuua

SEQ ID NO: 2115517 - RNA, 14 nt, Staphylococcus aureus subsp. aureus MW2
aaaacuauuuuuua

SEQ ID NO: 2115518 - RNA, 22 nt, Staphylococcus aureus subsp. aureus MW2
aaaacucaaaccuguuuggaaa

SEQ ID NO: 2115519 - RNA, 17 nt, Staphylococcus aureus subsp. aureus MW2
aaaacuguaaaucauca

SEQ ID NO: 2115520 - RNA, 21 nt, Staphylococcus aureus subsp. aureus MW2
aaaacuuagaacaguuagaaa

SEQ ID NO: 2115521 - RNA, 23 nt, Staphylococcus aureus subsp. aureus MW2
aaaacuuccugcuuuuuuuauaa

SEQ ID NO: 2115522 - RNA, 13 nt, Staphylococcus aureus subsp. aureus MW2
aaaacuaaugaua

SEQ ID NO: 2115523 - RNA, 14 nt, Staphylococcus aureus subsp. aureus MW2
aaaacuaaucaaau

SEQ ID NO: 2115524 - RNA, 16 nt, Staphylococcus aureus subsp. aureus MW2
aaaacuacauuugguu

SEQ ID NO: 2115525 - RNA, 17 nt, Staphylococcus aureus subsp. aureus MW2
aaaagauucggaaaaua

SEQ ID NO: 2115526 - RNA, 16 nt, Staphylococcus aureus subsp. aureus MW2
aaaagauaaauaaaag

SEQ ID NO: 2115527 - RNA, 17 nt, Staphylococcus aureus subsp. aureus MW2
aaaagagaauauaaaau

SEQ ID NO: 2115528 - RNA, 22 nt, Staphylococcus aureus subsp. aureus MW2
aaaagauccugccauuaaacga

SEQ ID NO: 2115529 - RNA, 18 nt, Staphylococcus aureus subsp. aureus MW2
aaaagaugaaaaucuuua

SEQ ID NO: 2115530 - RNA, 21 nt, Staphylococcus aureus subsp. aureus MW2
aaaagaugguuuuguuuugcu

SEQ ID NO: 2115531 - RNA, 18 nt, Staphylococcus aureus subsp. aureus MW2
aaaagaauuauucaagua

SEQ ID NO: 2115532 - RNA, 20 nt, Staphylococcus aureus subsp. aureus MW2
aaaagaauuauucaaguaaa

SEQ ID NO: 2115533 - RNA, 14 nt, Staphylococcus aureus subsp. aureus MW2
aaaagacagaaauu

SEQ ID NO: 2115534 - RNA, 22 nt, Staphylococcus aureus subsp. aureus MW2
aaaagacggugaccuuauauuu

SEQ ID NO: 2115535 - RNA, 12 nt, Staphylococcus aureus subsp. aureus MW2
aaaagagaccuu

SEQ ID NO: 2115536 - RNA, 22 nt, Staphylococcus aureus subsp. aureus MW2
aaaagagauuuuuuugaaaagu

SEQ ID NO: 2115537 - RNA, 15 nt, Staphylococcus aureus subsp. aureus MW2
aaaacaucuacauca

SEQ ID NO: 2115538 - RNA, 21 nt, Staphylococcus aureus subsp. aureus MW2
aaaacagcaguaagauauuuc

SEQ ID NO: 2115539 - RNA, 15 nt, Staphylococcus aureus subsp. aureus MW2
aaaacagcaaauaaa

SEQ ID NO: 2115540 - RNA, 22 nt, Staphylococcus aureus subsp. aureus MW2
aaaacagaggucuucgcaauca

SEQ ID NO: 2115541 - RNA, 16 nt, Staphylococcus aureus subsp. aureus MW2
aaaacauuauuaagug

SEQ ID NO: 2115542 - RNA, 19 nt, Staphylococcus aureus subsp. aureus MW2
aaaacauguugauaaaaag

SEQ ID NO: 2115543 - RNA, 13 nt, Staphylococcus aureus subsp. aureus MW2
aaaacaauauuga

SEQ ID NO: 2115544 - RNA, 17 nt, Staphylococcus aureus subsp. aureus MW2
aaaacaauuuaaaaagc

SEQ ID NO: 2115545 - RNA, 22 nt, Staphylococcus aureus subsp. aureus MW2
aaaacacccugcuuaucauuac

SEQ ID NO: 2115546 - RNA, 22 nt, Staphylococcus aureus subsp. aureus MW2
aaaaauuucgccucaucuaauu

SEQ ID NO: 2115547 - RNA, 22 nt, Staphylococcus aureus subsp. aureus MW2
aaaaauuucucccauccccuuu

SEQ ID NO: 2115548 - RNA, 16 nt, Staphylococcus aureus subsp. aureus MW2
aaaaauuucaaaaaua

SEQ ID NO: 2115549 - RNA, 18 nt, Staphylococcus aureus subsp. aureus MW2
aaaaauuucaaaaauagc

SEQ ID NO: 2115550 - RNA, 13 nt, Staphylococcus aureus subsp. aureus MW2
aaaaauuaucuca

SEQ ID NO: 2115551 - RNA, 22 nt, Staphylococcus aureus subsp. aureus MW2
aaaaauccggaacauuaaaagg

SEQ ID NO: 2115552 - RNA, 16 nt, Staphylococcus aureus subsp. aureus MW2
aaaaauuaaaaaacaa

SEQ ID NO: 2115553 - RNA, 12 nt, Staphylococcus aureus subsp. aureus MW2
aaaaauacuuuu

SEQ ID NO: 2115554 - RNA, 20 nt, Staphylococcus aureus subsp. aureus MW2
aaaaauagaaaaaacaagau

SEQ ID NO: 2115555 - RNA, 23 nt, Staphylococcus aureus subsp. aureus MW2
aaaaauagcguaauuauuauaau

SEQ ID NO: 2115556 - RNA, 16 nt, Staphylococcus aureus subsp. aureus MW2
aaaaauagcuccucca

SEQ ID NO: 2115557 - RNA, 11 nt, Staphylococcus aureus subsp. aureus MW2
aaaaauaauug

SEQ ID NO: 2115558 - RNA, 19 nt, Staphylococcus aureus subsp. aureus MW2
aaaaauaauuaugaaaagu

SEQ ID NO: 2115559 - RNA, 15 nt, Staphylococcus aureus subsp. aureus MW2
aaaaauaauuaugaa

SEQ ID NO: 2115560 - RNA, 13 nt, Staphylococcus aureus subsp. aureus MW2
aaaaauacauaau

SEQ ID NO: 2115561 - RNA, 18 nt, Staphylococcus aureus subsp. aureus MW2
aaaaacaucgauugauaa

SEQ ID NO: 2115562 - RNA, 13 nt, Staphylococcus aureus subsp. aureus MW2
aaaaacauaauca

SEQ ID NO: 2115563 - RNA, 20 nt, Staphylococcus aureus subsp. aureus MW2
aaaaaccaguuugauuaaaa

SEQ ID NO: 2115564 - RNA, 16 nt, Staphylococcus aureus subsp. aureus MW2
aaaaauaaaaccgagg

SEQ ID NO: 2115565 - RNA, 21 nt, Staphylococcus aureus subsp. aureus MW2
aaaaaccgaacaucugaaaaa

SEQ ID NO: 2115566 - RNA, 12 nt, Staphylococcus aureus subsp. aureus MW2
aaaaauaaacca

SEQ ID NO: 2115567 - RNA, 15 nt, Staphylococcus aureus subsp. aureus MW2
aaaaauaauagcaaa

SEQ ID NO: 2115568 - RNA, 14 nt, Staphylococcus aureus subsp. aureus MW2
aaaaauaauagcaa

SEQ ID NO: 2115569 - RNA, 21 nt, Staphylococcus aureus subsp. aureus MW2
aaacgcaauacgaauaucugu

SEQ ID NO: 2115570 - RNA, 20 nt, Staphylococcus aureus subsp. aureus MW2
aaacgagcuggugagaaauu

SEQ ID NO: 2115571 - RNA, 19 nt, Staphylococcus aureus subsp. aureus MW2
aaacgagcuggugagaaau

SEQ ID NO: 2115572 - RNA, 16 nt, Staphylococcus aureus subsp. aureus MW2
aaacgagacaucaucu

SEQ ID NO: 2115573 - RNA, 13 nt, Staphylococcus aureus subsp. aureus MW2
aaacgaaauuaua

SEQ ID NO: 2115574 - RNA, 17 nt, Staphylococcus aureus subsp. aureus MW2
aaaccuuacccaaaaaa

SEQ ID NO: 2115575 - RNA, 15 nt, Staphylococcus aureus subsp. aureus MW2
aaacgaaaauacuca

SEQ ID NO: 2115576 - RNA, 21 nt, Staphylococcus aureus subsp. aureus MW2
aaacaagauuccuaaagaaua

SEQ ID NO: 2115577 - RNA, 14 nt, Staphylococcus aureus subsp. aureus MW2
aaacaagaauaaau

SEQ ID NO: 2115578 - RNA, 18 nt, Staphylococcus aureus subsp. aureus MW2
aaacaagaauaaauccca

SEQ ID NO: 2115579 - RNA, 12 nt, Staphylococcus aureus subsp. aureus MW2
aaacaagaaaac

SEQ ID NO: 2115580 - RNA, 22 nt, Staphylococcus aureus subsp. aureus MW2
aaacuaaaccgaaguaauaacu

SEQ ID NO: 2115581 - RNA, 21 nt, Staphylococcus aureus subsp. aureus MW2
aaacguguacuucaauugucg

SEQ ID NO: 2115582 - RNA, 18 nt, Staphylococcus aureus subsp. aureus MW2
aaacguugaguauuacuu

SEQ ID NO: 2115583 - RNA, 22 nt, Staphylococcus aureus subsp. aureus MW2
aaacguugaguauuacuugaaa

SEQ ID NO: 2115584 - RNA, 14 nt, Staphylococcus aureus subsp. aureus MW2
aaacguuauguaca

SEQ ID NO: 2115585 - RNA, 22 nt, Staphylococcus aureus subsp. aureus MW2
aaacguaucauuuaaaauauuu

SEQ ID NO: 2115586 - RNA, 22 nt, Staphylococcus aureus subsp. aureus MW2
aaacgucacuuuauuaaauaac

SEQ ID NO: 2115587 - RNA, 23 nt, Staphylococcus aureus subsp. aureus MW2
aaacgucacuuuauuaaauaacu

SEQ ID NO: 2115588 - RNA, 20 nt, Staphylococcus aureus subsp. aureus MW2
aaacgguacagauaagaaua

SEQ ID NO: 2115589 - RNA, 14 nt, Staphylococcus aureus subsp. aureus MW2
aaacgccuuuccau

SEQ ID NO: 2115590 - RNA, 13 nt, Staphylococcus aureus subsp. aureus MW2
aaacgcucuucuu

SEQ ID NO: 2115591 - RNA, 15 nt, Staphylococcus aureus subsp. aureus MW2
aaacgcucuucuucu

SEQ ID NO: 2115592 - RNA, 23 nt, Staphylococcus aureus subsp. aureus MW2
aaacgguaacaaagauuauugaa

SEQ ID NO: 2115593 - RNA, 21 nt, Staphylococcus aureus subsp. aureus MW2
aaacuauaauaauuggaauca

SEQ ID NO: 2115594 - RNA, 18 nt, Staphylococcus aureus subsp. aureus MW2
aaacuauaauaaagauua

SEQ ID NO: 2115595 - RNA, 18 nt, Staphylococcus aureus subsp. aureus MW2
aaacuauaauaauuggaa

SEQ ID NO: 2115596 - RNA, 14 nt, Staphylococcus aureus subsp. aureus MW2
aaacuaucuacacc

SEQ ID NO: 2115597 - RNA, 14 nt, Staphylococcus aureus subsp. aureus MW2
aaacuaucuuauau

SEQ ID NO: 2115598 - RNA, 13 nt, Staphylococcus aureus subsp. aureus MW2
aaacuagcaguaa

SEQ ID NO: 2115599 - RNA, 12 nt, Staphylococcus aureus subsp. aureus MW2
aaacuagacaaa

SEQ ID NO: 2115600 - RNA, 15 nt, Staphylococcus aureus subsp. aureus MW2
aaacuacgaauucuc

SEQ ID NO: 2115601 - RNA, 15 nt, Staphylococcus aureus subsp. aureus MW2
aaacuagaaaacaua

SEQ ID NO: 2115602 - RNA, 12 nt, Staphylococcus aureus subsp. aureus MW2
aaacuaauagca

SEQ ID NO: 2115603 - RNA, 22 nt, Staphylococcus aureus subsp. aureus MW2
aaacuaauaauuuguaauuccu

SEQ ID NO: 2115604 - RNA, 15 nt, Staphylococcus aureus subsp. aureus MW2
aaacuacauuugguu

SEQ ID NO: 2115605 - RNA, 18 nt, Staphylococcus aureus subsp. aureus MW2
aaacucguaaauuuuauc

SEQ ID NO: 2115606 - RNA, 22 nt, Staphylococcus aureus subsp. aureus MW2
aaacucgcccccguaauaauuu

SEQ ID NO: 2115607 - RNA, 13 nt, Staphylococcus aureus subsp. aureus MW2
aaacuuaaaacua

SEQ ID NO: 2115608 - RNA, 13 nt, Staphylococcus aureus subsp. aureus MW2
aaacuuaaaagag

SEQ ID NO: 2115609 - RNA, 21 nt, Staphylococcus aureus subsp. aureus MW2
aaacuguaucaacauauuuau

SEQ ID NO: 2115610 - RNA, 14 nt, Staphylococcus aureus subsp. aureus MW2
aaacuuaagaauac

SEQ ID NO: 2115611 - RNA, 21 nt, Staphylococcus aureus subsp. aureus MW2
aaacuuauuaauuaauagaga

SEQ ID NO: 2115612 - RNA, 22 nt, Staphylococcus aureus subsp. aureus MW2
aaacuuccugcuuuuuuuauaa

SEQ ID NO: 2115613 - RNA, 12 nt, Staphylococcus aureus subsp. aureus MW2
aaacuucuuuuc

SEQ ID NO: 2115614 - RNA, 17 nt, Staphylococcus aureus subsp. aureus MW2
aaacuucuuuucuuuga

SEQ ID NO: 2115615 - RNA, 14 nt, Staphylococcus aureus subsp. aureus MW2
aaacuucuuuucuu

SEQ ID NO: 2115616 - RNA, 19 nt, Staphylococcus aureus subsp. aureus MW2
aaacuucuuuucuuugaua

SEQ ID NO: 2115617 - RNA, 22 nt, Staphylococcus aureus subsp. aureus MW2
aaacuuguaaauuuauuuuuaa

SEQ ID NO: 2115618 - RNA, 22 nt, Staphylococcus aureus subsp. aureus MW2
aaacuugugaauuuucagcauc

SEQ ID NO: 2115619 - RNA, 20 nt, Staphylococcus aureus subsp. aureus MW2
aaacuuuauggguauccuuc

SEQ ID NO: 2115620 - RNA, 17 nt, Staphylococcus aureus subsp. aureus MW2
aaacuuucagagauauu

SEQ ID NO: 2115621 - RNA, 22 nt, Staphylococcus aureus subsp. aureus MW2
aaagagaugggcuaagguuguu

SEQ ID NO: 2115622 - RNA, 16 nt, Staphylococcus aureus subsp. aureus MW2
aaagaguuaauaaaau

SEQ ID NO: 2115623 - RNA, 22 nt, Staphylococcus aureus subsp. aureus MW2
aaagagaauuucgaaaagaaau

SEQ ID NO: 2115624 - RNA, 13 nt, Staphylococcus aureus subsp. aureus MW2
aaagagauuuuuu

SEQ ID NO: 2115625 - RNA, 20 nt, Staphylococcus aureus subsp. aureus MW2
aaagagauuuuuuugaaaag

SEQ ID NO: 2115626 - RNA, 22 nt, Staphylococcus aureus subsp. aureus MW2
aaagacucaauuucauuugaaa

SEQ ID NO: 2115627 - RNA, 21 nt, Staphylococcus aureus subsp. aureus MW2
aaagacucuccaccauaugug

SEQ ID NO: 2115628 - RNA, 13 nt, Staphylococcus aureus subsp. aureus MW2
aaagagaaaagcu

SEQ ID NO: 2115629 - RNA, 22 nt, Staphylococcus aureus subsp. aureus MW2
aaagagaaacaaaacaaaaaau

SEQ ID NO: 2115630 - RNA, 12 nt, Staphylococcus aureus subsp. aureus MW2
aaagaauaugau

SEQ ID NO: 2115631 - RNA, 16 nt, Staphylococcus aureus subsp. aureus MW2
aaagaccguauuuuuu

SEQ ID NO: 2115632 - RNA, 23 nt, Staphylococcus aureus subsp. aureus MW2
aaagaccguauuuuuuuauaauu

SEQ ID NO: 2115633 - RNA, 21 nt, Staphylococcus aureus subsp. aureus MW2
aaagacuauauaacacaauac

SEQ ID NO: 2115634 - RNA, 20 nt, Staphylococcus aureus subsp. aureus MW2
aaagacucaauuucauuuga

SEQ ID NO: 2115635 - RNA, 18 nt, Staphylococcus aureus subsp. aureus MW2
aaagacggauaauuaauc

SEQ ID NO: 2115636 - RNA, 22 nt, Staphylococcus aureus subsp. aureus MW2
aaagaagggaagaguuaauccu

SEQ ID NO: 2115637 - RNA, 18 nt, Staphylococcus aureus subsp. aureus MW2
aaagccaucuaggucacu

SEQ ID NO: 2115638 - RNA, 15 nt, Staphylococcus aureus subsp. aureus MW2
aaagccaauuaauaa

SEQ ID NO: 2115639 - RNA, 16 nt, Staphylococcus aureus subsp. aureus MW2
aaagcaccuaaaauag

SEQ ID NO: 2115640 - RNA, 21 nt, Staphylococcus aureus subsp. aureus MW2
aaagcaccuaaaauagaaaaa

SEQ ID NO: 2115641 - RNA, 22 nt, Staphylococcus aureus subsp. aureus MW2
aaagcacuagccguuauuuuuu

SEQ ID NO: 2115642 - RNA, 16 nt, Staphylococcus aureus subsp. aureus MW2
aaagcacuauuuuuau

SEQ ID NO: 2115643 - RNA, 18 nt, Staphylococcus aureus subsp. aureus MW2
aaagcacuauuuuuauaa

SEQ ID NO: 2115644 - RNA, 22 nt, Staphylococcus aureus subsp. aureus MW2
aaagcaugauacucaauaaaau

SEQ ID NO: 2115645 - RNA, 14 nt, Staphylococcus aureus subsp. aureus MW2
aaagcauuuaaaua

SEQ ID NO: 2115646 - RNA, 11 nt, Staphylococcus aureus subsp. aureus MW2
aaagauuucag

SEQ ID NO: 2115647 - RNA, 21 nt, Staphylococcus aureus subsp. aureus MW2
aaagauauguuuauauugcaa

SEQ ID NO: 2115648 - RNA, 14 nt, Staphylococcus aureus subsp. aureus MW2
aaagauauuucugu

SEQ ID NO: 2115649 - RNA, 22 nt, Staphylococcus aureus subsp. aureus MW2
aaagauauaaggcgcucucuuu

SEQ ID NO: 2115650 - RNA, 13 nt, Staphylococcus aureus subsp. aureus MW2
aaagauauacuua

SEQ ID NO: 2115651 - RNA, 14 nt, Staphylococcus aureus subsp. aureus MW2
aaagauauaaacau

SEQ ID NO: 2115652 - RNA, 16 nt, Staphylococcus aureus subsp. aureus MW2
aaagauauaaacauuu

SEQ ID NO: 2115653 - RNA, 14 nt, Staphylococcus aureus subsp. aureus MW2
aaagauauguuuau

SEQ ID NO: 2115654 - RNA, 12 nt, Staphylococcus aureus subsp. aureus MW2
aaagauauaaac

SEQ ID NO: 2115655 - RNA, 12 nt, Staphylococcus aureus subsp. aureus MW2
aaagauacugcu

SEQ ID NO: 2115656 - RNA, 19 nt, Staphylococcus aureus subsp. aureus MW2
aaagauacaccaauauuuu

SEQ ID NO: 2115657 - RNA, 16 nt, Staphylococcus aureus subsp. aureus MW2
aaaggaccacuuagau

SEQ ID NO: 2115658 - RNA, 15 nt, Staphylococcus aureus subsp. aureus MW2
aaaggaauguuuaaa

SEQ ID NO: 2115659 - RNA, 15 nt, Staphylococcus aureus subsp. aureus MW2
aaagcgucuuuuuau

SEQ ID NO: 2115660 - RNA, 16 nt, Staphylococcus aureus subsp. aureus MW2
aaagcgugguucccaa

SEQ ID NO: 2115661 - RNA, 20 nt, Staphylococcus aureus subsp. aureus MW2
aaagcuauaaaaaaucuuuu

SEQ ID NO: 2115662 - RNA, 13 nt, Staphylococcus aureus subsp. aureus MW2
aaagcuagaaguu

SEQ ID NO: 2115663 - RNA, 13 nt, Staphylococcus aureus subsp. aureus MW2
aaagcuauaaaaa

SEQ ID NO: 2115664 - RNA, 18 nt, Staphylococcus aureus subsp. aureus MW2
aaagcccuauuauuuuuu

SEQ ID NO: 2115665 - RNA, 17 nt, Staphylococcus aureus subsp. aureus MW2
aaagguuuacuauuaaa

SEQ ID NO: 2115666 - RNA, 20 nt, Staphylococcus aureus subsp. aureus MW2
aaagguuguuuuucaucauu

SEQ ID NO: 2115667 - RNA, 20 nt, Staphylococcus aureus subsp. aureus MW2
aaagguuaauauuaaauuuu

SEQ ID NO: 2115668 - RNA, 17 nt, Staphylococcus aureus subsp. aureus MW2
aaagggcuauuugauac

SEQ ID NO: 2115669 - RNA, 15 nt, Staphylococcus aureus subsp. aureus MW2
aaagucaaagaggaa

SEQ ID NO: 2115670 - RNA, 13 nt, Staphylococcus aureus subsp. aureus MW2
aaagucaaaaaau

SEQ ID NO: 2115671 - RNA, 21 nt, Staphylococcus aureus subsp. aureus MW2
aaagucagguuacaauaaugu

SEQ ID NO: 2115672 - RNA, 14 nt, Staphylococcus aureus subsp. aureus MW2
aaagucagcuuaca

SEQ ID NO: 2115673 - RNA, 15 nt, Staphylococcus aureus subsp. aureus MW2
aaagucagcuuacaa

SEQ ID NO: 2115674 - RNA, 18 nt, Staphylococcus aureus subsp. aureus MW2
aaagucagcuuacaauaa

SEQ ID NO: 2115675 - RNA, 14 nt, Staphylococcus aureus subsp. aureus MW2
aaagucaauuuaaa

SEQ ID NO: 2115676 - RNA, 14 nt, Staphylococcus aureus subsp. aureus MW2
aaaguaauuaaaua

SEQ ID NO: 2115677 - RNA, 14 nt, Staphylococcus aureus subsp. aureus MW2
aaaguaaugcuuua

SEQ ID NO: 2115678 - RNA, 19 nt, Staphylococcus aureus subsp. aureus MW2
aaaguacaaguugaucaaa

SEQ ID NO: 2115679 - RNA, 13 nt, Staphylococcus aureus subsp. aureus MW2
aaaguacuuacaa

SEQ ID NO: 2115680 - RNA, 15 nt, Staphylococcus aureus subsp. aureus MW2
aaaguauauugcuua

SEQ ID NO: 2115681 - RNA, 15 nt, Staphylococcus aureus subsp. aureus MW2
aaaguaucagucauu

SEQ ID NO: 2115682 - RNA, 13 nt, Staphylococcus aureus subsp. aureus MW2
aaaguauauugcu

SEQ ID NO: 2115683 - RNA, 14 nt, Staphylococcus aureus subsp. aureus MW2
aaaguauaugaauc

SEQ ID NO: 2115684 - RNA, 22 nt, Staphylococcus aureus subsp. aureus MW2
aaaucagcaccgccugaaauag

SEQ ID NO: 2115685 - RNA, 17 nt, Staphylococcus aureus subsp. aureus MW2
aaaucaccuuuuuuaac

SEQ ID NO: 2115686 - RNA, 23 nt, Staphylococcus aureus subsp. aureus MW2
aaaucacgauuuucaaguaauga

SEQ ID NO: 2115687 - RNA, 21 nt, Staphylococcus aureus subsp. aureus MW2
aaaucacucaacugaugaaaa

SEQ ID NO: 2115688 - RNA, 17 nt, Staphylococcus aureus subsp. aureus MW2
aaaucauacgagaaauu

SEQ ID NO: 2115689 - RNA, 21 nt, Staphylococcus aureus subsp. aureus MW2
aaaucauacgagaaauuagaa

SEQ ID NO: 2115690 - RNA, 18 nt, Staphylococcus aureus subsp. aureus MW2
aaaucagucauucacaua

SEQ ID NO: 2115691 - RNA, 13 nt, Staphylococcus aureus subsp. aureus MW2
aaaucauaaauaa

SEQ ID NO: 2115692 - RNA, 15 nt, Staphylococcus aureus subsp. aureus MW2
aaaucaguaauauca

SEQ ID NO: 2115693 - RNA, 16 nt, Staphylococcus aureus subsp. aureus MW2
aaaucaguaauaucaa

SEQ ID NO: 2115694 - RNA, 13 nt, Staphylococcus aureus subsp. aureus MW2
aaaucaauccauc

SEQ ID NO: 2115695 - RNA, 14 nt, Staphylococcus aureus subsp. aureus MW2
aaaucaaguguugu

SEQ ID NO: 2115696 - RNA, 23 nt, Staphylococcus aureus subsp. aureus MW2
aaaucaagacucccuuuuuaaaa

SEQ ID NO: 2115697 - RNA, 12 nt, Staphylococcus aureus subsp. aureus MW2
aaaucaagaaau

SEQ ID NO: 2115698 - RNA, 22 nt, Staphylococcus aureus subsp. aureus MW2
aaaucaagacucccuuuuuaaa

SEQ ID NO: 2115699 - RNA, 14 nt, Staphylococcus aureus subsp. aureus MW2
aaaucaacuuuaau

SEQ ID NO: 2115700 - RNA, 15 nt, Staphylococcus aureus subsp. aureus MW2
aaaucaacuuuucua

SEQ ID NO: 2115701 - RNA, 16 nt, Staphylococcus aureus subsp. aureus MW2
aaaucaauccaucaau

SEQ ID NO: 2115702 - RNA, 13 nt, Staphylococcus aureus subsp. aureus MW2
aaaucaauguacu

SEQ ID NO: 2115703 - RNA, 14 nt, Staphylococcus aureus subsp. aureus MW2
aaaucaauugaaaa

SEQ ID NO: 2115704 - RNA, 20 nt, Staphylococcus aureus subsp. aureus MW2
aaaucacauaugauaauuaa

SEQ ID NO: 2115705 - RNA, 17 nt, Staphylococcus aureus subsp. aureus MW2
aaaucacauaugauaau

SEQ ID NO: 2115706 - RNA, 15 nt, Staphylococcus aureus subsp. aureus MW2
aaauaugacacauac

SEQ ID NO: 2115707 - RNA, 12 nt, Staphylococcus aureus subsp. aureus MW2
aaauaugaaaag

SEQ ID NO: 2115708 - RNA, 18 nt, Staphylococcus aureus subsp. aureus MW2
aaauaugaaaagagauuu

SEQ ID NO: 2115709 - RNA, 18 nt, Staphylococcus aureus subsp. aureus MW2
aaauaugaauaaugcaau

SEQ ID NO: 2115710 - RNA, 16 nt, Staphylococcus aureus subsp. aureus MW2
aaauaugauguuaaaa

SEQ ID NO: 2115711 - RNA, 18 nt, Staphylococcus aureus subsp. aureus MW2
aaauaugauguuaaaaaa

SEQ ID NO: 2115712 - RNA, 22 nt, Staphylococcus aureus subsp. aureus MW2
aaauaugacgcgugaauuaaaa

SEQ ID NO: 2115713 - RNA, 15 nt, Staphylococcus aureus subsp. aureus MW2
aaauauggauuuuga

SEQ ID NO: 2115714 - RNA, 13 nt, Staphylococcus aureus subsp. aureus MW2
aaauaugauugaa

SEQ ID NO: 2115715 - RNA, 19 nt, Staphylococcus aureus subsp. aureus MW2
aaauaugcacuuuuuauac

SEQ ID NO: 2115716 - RNA, 23 nt, Staphylococcus aureus subsp. aureus MW2
aaauaugcacuuuuuauacauua

SEQ ID NO: 2115717 - RNA, 15 nt, Staphylococcus aureus subsp. aureus MW2
aaauauuauuaaauc

SEQ ID NO: 2115718 - RNA, 14 nt, Staphylococcus aureus subsp. aureus MW2
aaauaggucacuuu

SEQ ID NO: 2115719 - RNA, 17 nt, Staphylococcus aureus subsp. aureus MW2
aaauaggucacuuuuaa

SEQ ID NO: 2115720 - RNA, 18 nt, Staphylococcus aureus subsp. aureus MW2
aaauaguuaagauuuuaa

SEQ ID NO: 2115721 - RNA, 18 nt, Staphylococcus aureus subsp. aureus MW2
aaauaucuuuuuguuuau

SEQ ID NO: 2115722 - RNA, 18 nt, Staphylococcus aureus subsp. aureus MW2
aaauagucggggccccaa

SEQ ID NO: 2115723 - RNA, 18 nt, Staphylococcus aureus subsp. aureus MW2
aaauaggugcuuguaaaa

SEQ ID NO: 2115724 - RNA, 22 nt, Staphylococcus aureus subsp. aureus MW2
aaauaggugcuuguaaaauuuu

SEQ ID NO: 2115725 - RNA, 16 nt, Staphylococcus aureus subsp. aureus MW2
aaaucaaagaguaaag

SEQ ID NO: 2115726 - RNA, 14 nt, Staphylococcus aureus subsp. aureus MW2
aaauauuuuuucug

SEQ ID NO: 2115727 - RNA, 11 nt, Staphylococcus aureus subsp. aureus MW2
aaaucaaagag

SEQ ID NO: 2115728 - RNA, 18 nt, Staphylococcus aureus subsp. aureus MW2
aaauauuuuaucuguaaa

SEQ ID NO: 2115729 - RNA, 16 nt, Staphylococcus aureus subsp. aureus MW2
aaauauuuuauuauaa

SEQ ID NO: 2115730 - RNA, 18 nt, Staphylococcus aureus subsp. aureus MW2
aaauauuuuuuaaaauga

SEQ ID NO: 2115731 - RNA, 21 nt, Staphylococcus aureus subsp. aureus MW2
aaauauuuacauugccacuuu

SEQ ID NO: 2115732 - RNA, 13 nt, Staphylococcus aureus subsp. aureus MW2
aaauauuuaaaua

SEQ ID NO: 2115733 - RNA, 13 nt, Staphylococcus aureus subsp. aureus MW2
aaauauuuaaccu

SEQ ID NO: 2115734 - RNA, 17 nt, Staphylococcus aureus subsp. aureus MW2
aaauauuuaaccuuuaa

SEQ ID NO: 2115735 - RNA, 15 nt, Staphylococcus aureus subsp. aureus MW2
aaauauuuaaaauau

SEQ ID NO: 2115736 - RNA, 17 nt, Staphylococcus aureus subsp. aureus MW2
aaauauuguaaucacua

SEQ ID NO: 2115737 - RNA, 16 nt, Staphylococcus aureus subsp. aureus MW2
aaauauugguaucucc

SEQ ID NO: 2115738 - RNA, 18 nt, Staphylococcus aureus subsp. aureus MW2
aaauauuauuaaaucaaa

SEQ ID NO: 2115739 - RNA, 12 nt, Staphylococcus aureus subsp. aureus MW2
aaauauucuuau

SEQ ID NO: 2115740 - RNA, 20 nt, Staphylococcus aureus subsp. aureus MW2
aaauauuggaauacucuuua

SEQ ID NO: 2115741 - RNA, 22 nt, Staphylococcus aureus subsp. aureus MW2
aaauauuggaauacucuuuaau

SEQ ID NO: 2115742 - RNA, 17 nt, Staphylococcus aureus subsp. aureus MW2
aaauauugauauaaaaa

SEQ ID NO: 2115743 - RNA, 16 nt, Staphylococcus aureus subsp. aureus MW2
aaauaauauaaaacga

SEQ ID NO: 2115744 - RNA, 14 nt, Staphylococcus aureus subsp. aureus MW2
aaauaauauaaaaa

SEQ ID NO: 2115745 - RNA, 14 nt, Staphylococcus aureus subsp. aureus MW2
aaauaauauaaaac

SEQ ID NO: 2115746 - RNA, 13 nt, Staphylococcus aureus subsp. aureus MW2
aaauaauauaaaa

SEQ ID NO: 2115747 - RNA, 17 nt, Staphylococcus aureus subsp. aureus MW2
aaauaaucccaaccauu

SEQ ID NO: 2115748 - RNA, 13 nt, Staphylococcus aureus subsp. aureus MW2
aaauaaucgaaga

SEQ ID NO: 2115749 - RNA, 19 nt, Staphylococcus aureus subsp. aureus MW2
aaauaaucgaacagaaaau

SEQ ID NO: 2115750 - RNA, 11 nt, Staphylococcus aureus subsp. aureus MW2
aaauaaugaau

SEQ ID NO: 2115751 - RNA, 15 nt, Staphylococcus aureus subsp. aureus MW2
aaauaaucucuucaa

SEQ ID NO: 2115752 - RNA, 15 nt, Staphylococcus aureus subsp. aureus MW2
aaauacuaagauuag

SEQ ID NO: 2115753 - RNA, 19 nt, Staphylococcus aureus subsp. aureus MW2
aaauacguggcucuaaaaa

SEQ ID NO: 2115754 - RNA, 20 nt, Staphylococcus aureus subsp. aureus MW2
aaauacuauacugaugaaaa

SEQ ID NO: 2115755 - RNA, 23 nt, Staphylococcus aureus subsp. aureus MW2
aaauaaugauauauuacaucauu

SEQ ID NO: 2115756 - RNA, 16 nt, Staphylococcus aureus subsp. aureus MW2
aaauacgccaaauacu

SEQ ID NO: 2115757 - RNA, 17 nt, Staphylococcus aureus subsp. aureus MW2
aaauagcguaauuauua

SEQ ID NO: 2115758 - RNA, 20 nt, Staphylococcus aureus subsp. aureus MW2
aaauagcguaauuauuauaa

SEQ ID NO: 2115759 - RNA, 16 nt, Staphylococcus aureus subsp. aureus MW2
aaauagcguaauuauu

SEQ ID NO: 2115760 - RNA, 15 nt, Staphylococcus aureus subsp. aureus MW2
aaauagcgauuuuaa

SEQ ID NO: 2115761 - RNA, 18 nt, Staphylococcus aureus subsp. aureus MW2
aaauagcgauuuuaaaga

SEQ ID NO: 2115762 - RNA, 22 nt, Staphylococcus aureus subsp. aureus MW2
aaauagcugcaaucguugaaaa

SEQ ID NO: 2115763 - RNA, 16 nt, Staphylococcus aureus subsp. aureus MW2
aaauagcuguuugaua

SEQ ID NO: 2115764 - RNA, 17 nt, Staphylococcus aureus subsp. aureus MW2
aaauacuugaauguaag

SEQ ID NO: 2115765 - RNA, 14 nt, Staphylococcus aureus subsp. aureus MW2
aaauaaaauuaaaa

SEQ ID NO: 2115766 - RNA, 15 nt, Staphylococcus aureus subsp. aureus MW2
aaauaaaauuaaaac

SEQ ID NO: 2115767 - RNA, 19 nt, Staphylococcus aureus subsp. aureus MW2
aaauaaaacgcuucauaua

SEQ ID NO: 2115768 - RNA, 17 nt, Staphylococcus aureus subsp. aureus MW2
aaagucauuaaauguac

SEQ ID NO: 2115769 - RNA, 15 nt, Staphylococcus aureus subsp. aureus MW2
aaagucauuuagaua

SEQ ID NO: 2115770 - RNA, 16 nt, Staphylococcus aureus subsp. aureus MW2
aaaguccaauacaauu

SEQ ID NO: 2115771 - RNA, 15 nt, Staphylococcus aureus subsp. aureus MW2
aaagucauuaaaugu

SEQ ID NO: 2115772 - RNA, 13 nt, Staphylococcus aureus subsp. aureus MW2
aaauaaauuuuga

SEQ ID NO: 2115773 - RNA, 19 nt, Staphylococcus aureus subsp. aureus MW2
aaauaaauuuugagaaaau

SEQ ID NO: 2115774 - RNA, 19 nt, Staphylococcus aureus subsp. aureus MW2
aaauaaccauucacuuaua

SEQ ID NO: 2115775 - RNA, 16 nt, Staphylococcus aureus subsp. aureus MW2
aaauaaaccacgcaca

SEQ ID NO: 2115776 - RNA, 15 nt, Staphylococcus aureus subsp. aureus MW2
aaauaaacauaaaaa

SEQ ID NO: 2115777 - RNA, 19 nt, Staphylococcus aureus subsp. aureus MW2
aaauaaacacaucuaugug

SEQ ID NO: 2115778 - RNA, 21 nt, Staphylococcus aureus subsp. aureus MW2
aaauaacuagauguucacauu

SEQ ID NO: 2115779 - RNA, 19 nt, Staphylococcus aureus subsp. aureus MW2
aaauaacguuaauauaauu

SEQ ID NO: 2115780 - RNA, 18 nt, Staphylococcus aureus subsp. aureus MW2
aaauaacuguaaaacauu

SEQ ID NO: 2115781 - RNA, 19 nt, Staphylococcus aureus subsp. aureus MW2
aaauaacugcuaauuuuuu

SEQ ID NO: 2115782 - RNA, 14 nt, Staphylococcus aureus subsp. aureus MW2
aaauaacuucguuu

SEQ ID NO: 2115783 - RNA, 20 nt, Staphylococcus aureus subsp. aureus MW2
aaauaacuuuuuaaaggacc

SEQ ID NO: 2115784 - RNA, 19 nt, Staphylococcus aureus subsp. aureus MW2
aaauaacgauaccuuuaau

SEQ ID NO: 2115785 - RNA, 18 nt, Staphylococcus aureus subsp. aureus MW2
aaauaagcaaucauaaua

SEQ ID NO: 2115786 - RNA, 14 nt, Staphylococcus aureus subsp. aureus MW2
aaauaauagcaaaa

SEQ ID NO: 2115787 - RNA, 17 nt, Staphylococcus aureus subsp. aureus MW2
aaauucuauaaccuuaa

SEQ ID NO: 2115788 - RNA, 22 nt, Staphylococcus aureus subsp. aureus MW2
aaauucuacaggcaaugcaagu

SEQ ID NO: 2115789 - RNA, 22 nt, Staphylococcus aureus subsp. aureus MW2
aaauucuacaggcaaugcgagu

SEQ ID NO: 2115790 - RNA, 16 nt, Staphylococcus aureus subsp. aureus MW2
aaauucuacaaacaau

SEQ ID NO: 2115791 - RNA, 18 nt, Staphylococcus aureus subsp. aureus MW2
aaauucuacaaacaaugc

SEQ ID NO: 2115792 - RNA, 20 nt, Staphylococcus aureus subsp. aureus MW2
aaauuaugcuugcuuaguau

SEQ ID NO: 2115793 - RNA, 19 nt, Staphylococcus aureus subsp. aureus MW2
aaauuauugacauugcaaa

SEQ ID NO: 2115794 - RNA, 14 nt, Staphylococcus aureus subsp. aureus MW2
aaauuaucagaauc

SEQ ID NO: 2115795 - RNA, 18 nt, Staphylococcus aureus subsp. aureus MW2
aaauuacgcaaagaaaaa

SEQ ID NO: 2115796 - RNA, 23 nt, Staphylococcus aureus subsp. aureus MW2
aaauguuauuaaccaacaugaca

SEQ ID NO: 2115797 - RNA, 15 nt, Staphylococcus aureus subsp. aureus MW2
aaauguuaaagauua

SEQ ID NO: 2115798 - RNA, 19 nt, Staphylococcus aureus subsp. aureus MW2
aaauguuaaugcuucguaa

SEQ ID NO: 2115799 - RNA, 19 nt, Staphylococcus aureus subsp. aureus MW2
aaaugcuuuaaauauuguc

SEQ ID NO: 2115800 - RNA, 10 nt, Staphylococcus aureus subsp. aureus MW2
aaaugcuuuc

SEQ ID NO: 2115801 - RNA, 16 nt, Staphylococcus aureus subsp. aureus MW2
aaaugcuuuuuugaaa

SEQ ID NO: 2115802 - RNA, 14 nt, Staphylococcus aureus subsp. aureus MW2
aaauuaaaugcaua

SEQ ID NO: 2115803 - RNA, 17 nt, Staphylococcus aureus subsp. aureus MW2
aaauguugaauguggaa

SEQ ID NO: 2115804 - RNA, 12 nt, Staphylococcus aureus subsp. aureus MW2
aaauuaaaaucu

SEQ ID NO: 2115805 - RNA, 20 nt, Staphylococcus aureus subsp. aureus MW2
aaaaagcaguaaguugauuu

SEQ ID NO: 2115806 - RNA, 17 nt, Staphylococcus aureus subsp. aureus MW2
aaauuaacuuaaaauuu

SEQ ID NO: 2115807 - RNA, 11 nt, Staphylococcus aureus subsp. aureus MW2
aaauuaacuag

SEQ ID NO: 2115808 - RNA, 19 nt, Staphylococcus aureus subsp. aureus MW2
aaaaaggaagaacagcaca

SEQ ID NO: 2115809 - RNA, 20 nt, Staphylococcus aureus subsp. aureus MW2
aaaaaggaagaacagcacau

SEQ ID NO: 2115810 - RNA, 17 nt, Staphylococcus aureus subsp. aureus MW2
aaauuacaaauuaucua

SEQ ID NO: 2115811 - RNA, 23 nt, Staphylococcus aureus subsp. aureus MW2
aaauuacacccuuuaaauuuaac

SEQ ID NO: 2115812 - RNA, 19 nt, Staphylococcus aureus subsp. aureus MW2
aaauuacacccuuuaaauu

SEQ ID NO: 2115813 - RNA, 16 nt, Staphylococcus aureus subsp. aureus MW2
aaauuacacccuuuaa

SEQ ID NO: 2115814 - RNA, 12 nt, Staphylococcus aureus subsp. aureus MW2
aaauuacaauua

SEQ ID NO: 2115815 - RNA, 15 nt, Staphylococcus aureus subsp. aureus MW2
aaaaagcucaauccu

SEQ ID NO: 2115816 - RNA, 16 nt, Staphylococcus aureus subsp. aureus MW2
aaaaagcuaauucuua

SEQ ID NO: 2115817 - RNA, 19 nt, Staphylococcus aureus subsp. aureus MW2
aaaaagcugauuucuauca

SEQ ID NO: 2115818 - RNA, 23 nt, Staphylococcus aureus subsp. aureus MW2
aaaaagcugauuucuauuaauua

SEQ ID NO: 2115819 - RNA, 18 nt, Staphylococcus aureus subsp. aureus MW2
aaaaagcgccaauacaga

SEQ ID NO: 2115820 - RNA, 23 nt, Staphylococcus aureus subsp. aureus MW2
aaaaagcggacugaaagaaaagu

SEQ ID NO: 2115821 - RNA, 17 nt, Staphylococcus aureus subsp. aureus MW2
aaaucaugaaauuaaaa

SEQ ID NO: 2115822 - RNA, 19 nt, Staphylococcus aureus subsp. aureus MW2
aaaucauuaagaaaaggcu

SEQ ID NO: 2115823 - RNA, 23 nt, Staphylococcus aureus subsp. aureus MW2
aaaucauagucgguuauuacaaa

SEQ ID NO: 2115824 - RNA, 14 nt, Staphylococcus aureus subsp. aureus MW2
aaaucauuaauaau

SEQ ID NO: 2115825 - RNA, 22 nt, Staphylococcus aureus subsp. aureus MW2
aaaucaucuuaacaauuuuaau

SEQ ID NO: 2115826 - RNA, 23 nt, Staphylococcus aureus subsp. aureus MW2
aaaucauugcgugcuucacuaaa

SEQ ID NO: 2115827 - RNA, 14 nt, Staphylococcus aureus subsp. aureus MW2
aaaucgauuaagaa

SEQ ID NO: 2115828 - RNA, 15 nt, Staphylococcus aureus subsp. aureus MW2
aaaucgauuaauuau

SEQ ID NO: 2115829 - RNA, 16 nt, Staphylococcus aureus subsp. aureus MW2
aaaucgccuuguuuau

SEQ ID NO: 2115830 - RNA, 13 nt, Staphylococcus aureus subsp. aureus MW2
aaaucuauauaaa

SEQ ID NO: 2115831 - RNA, 21 nt, Staphylococcus aureus subsp. aureus MW2
aaaucuauaccauuccaaaaa

SEQ ID NO: 2115832 - RNA, 12 nt, Staphylococcus aureus subsp. aureus MW2
aaaucuauaaau

SEQ ID NO: 2115833 - RNA, 13 nt, Staphylococcus aureus subsp. aureus MW2
aaaucuacaauau

SEQ ID NO: 2115834 - RNA, 15 nt, Staphylococcus aureus subsp. aureus MW2
aaaucuacaauauua

SEQ ID NO: 2115835 - RNA, 17 nt, Staphylococcus aureus subsp. aureus MW2
aaaucuacauaugaaaa

SEQ ID NO: 2115836 - RNA, 23 nt, Staphylococcus aureus subsp. aureus MW2
aaaucuaauccugguauaaugga

SEQ ID NO: 2115837 - RNA, 12 nt, Staphylococcus aureus subsp. aureus MW2
aaaucguuucau

SEQ ID NO: 2115838 - RNA, 13 nt, Staphylococcus aureus subsp. aureus MW2
aaaucguuucaua

SEQ ID NO: 2115839 - RNA, 19 nt, Staphylococcus aureus subsp. aureus MW2
aaaucguuaaggaaagcuu

SEQ ID NO: 2115840 - RNA, 14 nt, Staphylococcus aureus subsp. aureus MW2
aaaucucauaauaa

SEQ ID NO: 2115841 - RNA, 23 nt, Staphylococcus aureus subsp. aureus MW2
aaaucuguuuaaauuuaaaagaa

SEQ ID NO: 2115842 - RNA, 22 nt, Staphylococcus aureus subsp. aureus MW2
aaaucuguacuucuaauuugca

SEQ ID NO: 2115843 - RNA, 19 nt, Staphylococcus aureus subsp. aureus MW2
aaaucugggacgucaauca

SEQ ID NO: 2115844 - RNA, 10 nt, Staphylococcus aureus subsp. aureus MW2
aaaugaacca

SEQ ID NO: 2115845 - RNA, 14 nt, Staphylococcus aureus subsp. aureus MW2
aaaugaugauuuaa

SEQ ID NO: 2115846 - RNA, 14 nt, Staphylococcus aureus subsp. aureus MW2
aaaugauggguagu

SEQ ID NO: 2115847 - RNA, 18 nt, Staphylococcus aureus subsp. aureus MW2
aaaugcaaagacuaaaaa

SEQ ID NO: 2115848 - RNA, 14 nt, Staphylococcus aureus subsp. aureus MW2
aaaugauuucacuu

SEQ ID NO: 2115849 - RNA, 15 nt, Staphylococcus aureus subsp. aureus MW2
aaaugauuucacuuc

SEQ ID NO: 2115850 - RNA, 13 nt, Staphylococcus aureus subsp. aureus MW2
aaaugauuaauaa

SEQ ID NO: 2115851 - RNA, 22 nt, Staphylococcus aureus subsp. aureus MW2
aaaucuuuuaaauuuaguaucu

SEQ ID NO: 2115852 - RNA, 14 nt, Staphylococcus aureus subsp. aureus MW2
aaaucuuuuaaauu

SEQ ID NO: 2115853 - RNA, 15 nt, Staphylococcus aureus subsp. aureus MW2
aaaucuuuuacuaaa

SEQ ID NO: 2115854 - RNA, 22 nt, Staphylococcus aureus subsp. aureus MW2
aaaucuuuuagcuuuuguaaag

SEQ ID NO: 2115855 - RNA, 21 nt, Staphylococcus aureus subsp. aureus MW2
aaaugcgcuuccaauuuaaaa

SEQ ID NO: 2115856 - RNA, 18 nt, Staphylococcus aureus subsp. aureus MW2
aaaugcgcuuguaacaag

SEQ ID NO: 2115857 - RNA, 20 nt, Staphylococcus aureus subsp. aureus MW2
aaaugccgagauuauuaugu

SEQ ID NO: 2115858 - RNA, 17 nt, Staphylococcus aureus subsp. aureus MW2
aaaugcuacaauuuccu

SEQ ID NO: 2115859 - RNA, 15 nt, Staphylococcus aureus subsp. aureus MW2
aaaugcuacaucaau

SEQ ID NO: 2115860 - RNA, 10 nt, Staphylococcus aureus subsp. aureus MW2
aaaugcuucu

SEQ ID NO: 2115861 - RNA, 21 nt, Staphylococcus aureus subsp. aureus MW2
aaaugcuucugguucuucaau

SEQ ID NO: 2115862 - RNA, 20 nt, Staphylococcus aureus subsp. aureus MW2
aaaugcuuaagaaauuuuuu

SEQ ID NO: 2115863 - RNA, 19 nt, Staphylococcus aureus subsp. aureus MW2
aauaaaaauuauauaaauu

SEQ ID NO: 2115864 - RNA, 12 nt, Staphylococcus aureus subsp. aureus MW2
aauaaaaaugcc

SEQ ID NO: 2115865 - RNA, 17 nt, Staphylococcus aureus subsp. aureus MW2
aauaaaaauuauauaaa

SEQ ID NO: 2115866 - RNA, 21 nt, Staphylococcus aureus subsp. aureus MW2
aauaaaaaauugauaguagcu

SEQ ID NO: 2115867 - RNA, 16 nt, Staphylococcus aureus subsp. aureus MW2
aauaaaaaggagcgac

SEQ ID NO: 2115868 - RNA, 13 nt, Staphylococcus aureus subsp. aureus MW2
aauaaaaaagcca

SEQ ID NO: 2115869 - RNA, 18 nt, Staphylococcus aureus subsp. aureus MW2
aauaaaaaccagcuaaca

SEQ ID NO: 2115870 - RNA, 13 nt, Staphylococcus aureus subsp. aureus MW2
aaguuuuucaggg

SEQ ID NO: 2115871 - RNA, 19 nt, Staphylococcus aureus subsp. aureus MW2
aaguuugucuuugaacaua

SEQ ID NO: 2115872 - RNA, 21 nt, Staphylococcus aureus subsp. aureus MW2
aaguuuguuuguaaaacugaa

SEQ ID NO: 2115873 - RNA, 22 nt, Staphylococcus aureus subsp. aureus MW2
aauaaacaacugcaauagcuau

SEQ ID NO: 2115874 - RNA, 18 nt, Staphylococcus aureus subsp. aureus MW2
aauaaacacccaauaauu

SEQ ID NO: 2115875 - RNA, 14 nt, Staphylococcus aureus subsp. aureus MW2
aauaaacauaucau

SEQ ID NO: 2115876 - RNA, 16 nt, Staphylococcus aureus subsp. aureus MW2
aauaaaauauaucuua

SEQ ID NO: 2115877 - RNA, 14 nt, Staphylococcus aureus subsp. aureus MW2
aauaaaacuuauaa

SEQ ID NO: 2115878 - RNA, 20 nt, Staphylococcus aureus subsp. aureus MW2
aauaaaacgcuucauauaaa

SEQ ID NO: 2115879 - RNA, 18 nt, Staphylococcus aureus subsp. aureus MW2
aauaaacuuaaaagagaa

SEQ ID NO: 2115880 - RNA, 15 nt, Staphylococcus aureus subsp. aureus MW2
aauaaagauucaauu

SEQ ID NO: 2115881 - RNA, 12 nt, Staphylococcus aureus subsp. aureus MW2
aauaaaccagug

SEQ ID NO: 2115882 - RNA, 20 nt, Staphylococcus aureus subsp. aureus MW2
aauaaauaagcaaucauaau

SEQ ID NO: 2115883 - RNA, 12 nt, Staphylococcus aureus subsp. aureus MW2
aauaaauaacuu

SEQ ID NO: 2115884 - RNA, 22 nt, Staphylococcus aureus subsp. aureus MW2
aauaaauagacugccaauaaaa

SEQ ID NO: 2115885 - RNA, 21 nt, Staphylococcus aureus subsp. aureus MW2
aauaaauaggaugaaaaagau

SEQ ID NO: 2115886 - RNA, 14 nt, Staphylococcus aureus subsp. aureus MW2
aauaaauacaaugu

SEQ ID NO: 2115887 - RNA, 22 nt, Staphylococcus aureus subsp. aureus MW2
aauaaagcugauuuuucauuga

SEQ ID NO: 2115888 - RNA, 11 nt, Staphylococcus aureus subsp. aureus MW2
aauaaaggucu

SEQ ID NO: 2115889 - RNA, 20 nt, Staphylococcus aureus subsp. aureus MW2
aauaaaguccaauacaauuu

SEQ ID NO: 2115890 - RNA, 16 nt, Staphylococcus aureus subsp. aureus MW2
aauaacagcuacaaau

SEQ ID NO: 2115891 - RNA, 19 nt, Staphylococcus aureus subsp. aureus MW2
aauaacagcuacaaauaau

SEQ ID NO: 2115892 - RNA, 17 nt, Staphylococcus aureus subsp. aureus MW2
aauaaccgcuuaauucu

SEQ ID NO: 2115893 - RNA, 18 nt, Staphylococcus aureus subsp. aureus MW2
aauaaccgcuuaauucuu

SEQ ID NO: 2115894 - RNA, 16 nt, Staphylococcus aureus subsp. aureus MW2
aauaaccuacauuaau

SEQ ID NO: 2115895 - RNA, 19 nt, Staphylococcus aureus subsp. aureus MW2
aauaaccuacauuaauuua

SEQ ID NO: 2115896 - RNA, 17 nt, Staphylococcus aureus subsp. aureus MW2
aauaaauagauaauaua

SEQ ID NO: 2115897 - RNA, 19 nt, Staphylococcus aureus subsp. aureus MW2
aauaaauuagccauuucaa

SEQ ID NO: 2115898 - RNA, 23 nt, Staphylococcus aureus subsp. aureus MW2
aauaaauugcacgucuuguauca

SEQ ID NO: 2115899 - RNA, 22 nt, Staphylococcus aureus subsp. aureus MW2
aauaaauuuagauauaauaaaa

SEQ ID NO: 2115900 - RNA, 13 nt, Staphylococcus aureus subsp. aureus MW2
aauaaauuuauaa

SEQ ID NO: 2115901 - RNA, 13 nt, Staphylococcus aureus subsp. aureus MW2
aauaaauuuuaua

SEQ ID NO: 2115902 - RNA, 18 nt, Staphylococcus aureus subsp. aureus MW2
aauaacaaaauuaaauau

SEQ ID NO: 2115903 - RNA, 17 nt, Staphylococcus aureus subsp. aureus MW2
aauaacaaaauuaaaua

SEQ ID NO: 2115904 - RNA, 17 nt, Staphylococcus aureus subsp. aureus MW2
aagugguaaaaaugaac

SEQ ID NO: 2115905 - RNA, 23 nt, Staphylococcus aureus subsp. aureus MW2
aagugcuaagagguauacaguua

SEQ ID NO: 2115906 - RNA, 20 nt, Staphylococcus aureus subsp. aureus MW2
aagugcuugauuaacauuuu

SEQ ID NO: 2115907 - RNA, 16 nt, Staphylococcus aureus subsp. aureus MW2
aagugcuguuacuucu

SEQ ID NO: 2115908 - RNA, 21 nt, Staphylococcus aureus subsp. aureus MW2
aagugcuuaugaaugaaauca

SEQ ID NO: 2115909 - RNA, 17 nt, Staphylococcus aureus subsp. aureus MW2
aagugcuucaacuucau

SEQ ID NO: 2115910 - RNA, 17 nt, Staphylococcus aureus subsp. aureus MW2
aagucuuucaacaaaau

SEQ ID NO: 2115911 - RNA, 23 nt, Staphylococcus aureus subsp. aureus MW2
aagucuuuaauagcgucaaguuu

SEQ ID NO: 2115912 - RNA, 19 nt, Staphylococcus aureus subsp. aureus MW2
aagucuugugauaauucuu

SEQ ID NO: 2115913 - RNA, 13 nt, Staphylococcus aureus subsp. aureus MW2
aagugaugaaaaa

SEQ ID NO: 2115914 - RNA, 19 nt, Staphylococcus aureus subsp. aureus MW2
aagugcagauguugguuca

SEQ ID NO: 2115915 - RNA, 22 nt, Staphylococcus aureus subsp. aureus MW2
aagugcagauguugguucauca

SEQ ID NO: 2115916 - RNA, 17 nt, Staphylococcus aureus subsp. aureus MW2
aagugauuuaaaaaaau

SEQ ID NO: 2115917 - RNA, 13 nt, Staphylococcus aureus subsp. aureus MW2
aaguaaguaaaau

SEQ ID NO: 2115918 - RNA, 14 nt, Staphylococcus aureus subsp. aureus MW2
aaguaaguaaaaua

SEQ ID NO: 2115919 - RNA, 14 nt, Staphylococcus aureus subsp. aureus MW2
aaguaaccacaaca

SEQ ID NO: 2115920 - RNA, 19 nt, Staphylococcus aureus subsp. aureus MW2
aaguaagcguaauauuuaa

SEQ ID NO: 2115921 - RNA, 20 nt, Staphylococcus aureus subsp. aureus MW2
aaguaagcguaauauuuaag

SEQ ID NO: 2115922 - RNA, 16 nt, Staphylococcus aureus subsp. aureus MW2
aagucuguugguuuau

SEQ ID NO: 2115923 - RNA, 22 nt, Staphylococcus aureus subsp. aureus MW2
aaguaauccccgaagcacagaa

SEQ ID NO: 2115924 - RNA, 18 nt, Staphylococcus aureus subsp. aureus MW2
aaguaauaaguaauaauu

SEQ ID NO: 2115925 - RNA, 21 nt, Staphylococcus aureus subsp. aureus MW2
aaguaauaugagugaaaguuu

SEQ ID NO: 2115926 - RNA, 20 nt, Staphylococcus aureus subsp. aureus MW2
aaguaauaauuuauugauaa

SEQ ID NO: 2115927 - RNA, 22 nt, Staphylococcus aureus subsp. aureus MW2
aaguucuucugcuucagccaua

SEQ ID NO: 2115928 - RNA, 15 nt, Staphylococcus aureus subsp. aureus MW2
aaguucuuaggcaau

SEQ ID NO: 2115929 - RNA, 17 nt, Staphylococcus aureus subsp. aureus MW2
aaguucuuaugcaguuu

SEQ ID NO: 2115930 - RNA, 15 nt, Staphylococcus aureus subsp. aureus MW2
aaguugcauauaaaa

SEQ ID NO: 2115931 - RNA, 23 nt, Staphylococcus aureus subsp. aureus MW2
aaguuggcggggccccaacacag

SEQ ID NO: 2115932 - RNA, 21 nt, Staphylococcus aureus subsp. aureus MW2
aaguuggcggggcccaaacau

SEQ ID NO: 2115933 - RNA, 22 nt, Staphylococcus aureus subsp. aureus MW2
aaguuucgcugcuacaccaccu

SEQ ID NO: 2115934 - RNA, 13 nt, Staphylococcus aureus subsp. aureus MW2
aaguuugaaucau

SEQ ID NO: 2115935 - RNA, 13 nt, Staphylococcus aureus subsp. aureus MW2
aaguuuccuaucu

SEQ ID NO: 2115936 - RNA, 18 nt, Staphylococcus aureus subsp. aureus MW2
aaguuaucaaauugaccg

SEQ ID NO: 2115937 - RNA, 12 nt, Staphylococcus aureus subsp. aureus MW2
aaguuauaucau

SEQ ID NO: 2115938 - RNA, 15 nt, Staphylococcus aureus subsp. aureus MW2
aaguuacuuacgcca

SEQ ID NO: 2115939 - RNA, 19 nt, Staphylococcus aureus subsp. aureus MW2
aaguuagacuaaaaaacua

SEQ ID NO: 2115940 - RNA, 14 nt, Staphylococcus aureus subsp. aureus MW2
aaguguaaaugaaa

SEQ ID NO: 2115941 - RNA, 21 nt, Staphylococcus aureus subsp. aureus MW2
aaguguagccaaauaaauuuu

SEQ ID NO: 2115942 - RNA, 12 nt, Staphylococcus aureus subsp. aureus MW2
aaguguauauag

SEQ ID NO: 2115943 - RNA, 14 nt, Staphylococcus aureus subsp. aureus MW2
aaguguauauagua

SEQ ID NO: 2115944 - RNA, 23 nt, Staphylococcus aureus subsp. aureus MW2
aaguguauauaguaggagugaac

SEQ ID NO: 2115945 - RNA, 20 nt, Staphylococcus aureus subsp. aureus MW2
aagugguuuuacugcuucaa

SEQ ID NO: 2115946 - RNA, 23 nt, Staphylococcus aureus subsp. aureus MW2
aaguggugcuuuaucaugucuga

SEQ ID NO: 2115947 - RNA, 17 nt, Staphylococcus aureus subsp. aureus MW2
aauaauuaaauaaaaau

SEQ ID NO: 2115948 - RNA, 14 nt, Staphylococcus aureus subsp. aureus MW2
aauaauuaaacaaa

SEQ ID NO: 2115949 - RNA, 18 nt, Staphylococcus aureus subsp. aureus MW2
aauaaugugaaaaaucuu

SEQ ID NO: 2115950 - RNA, 16 nt, Staphylococcus aureus subsp. aureus MW2
aauaaugugucaaaca

SEQ ID NO: 2115951 - RNA, 18 nt, Staphylococcus aureus subsp. aureus MW2
aauaauuacuaaccuaaa

SEQ ID NO: 2115952 - RNA, 16 nt, Staphylococcus aureus subsp. aureus MW2
aauaauuacuaaaaua

SEQ ID NO: 2115953 - RNA, 22 nt, Staphylococcus aureus subsp. aureus MW2
aauaauuagucauugaaaauau

SEQ ID NO: 2115954 - RNA, 18 nt, Staphylococcus aureus subsp. aureus MW2
aauaauucccuaggaaau

SEQ ID NO: 2115955 - RNA, 16 nt, Staphylococcus aureus subsp. aureus MW2
aauaauuaugaaaagu

SEQ ID NO: 2115956 - RNA, 15 nt, Staphylococcus aureus subsp. aureus MW2
aauaauccaccuaaa

SEQ ID NO: 2115957 - RNA, 22 nt, Staphylococcus aureus subsp. aureus MW2
aauaauccaccuaaaaaguacu

SEQ ID NO: 2115958 - RNA, 20 nt, Staphylococcus aureus subsp. aureus MW2
aauaauccagucacaaacaa

SEQ ID NO: 2115959 - RNA, 15 nt, Staphylococcus aureus subsp. aureus MW2
aauaauccaagauau

SEQ ID NO: 2115960 - RNA, 11 nt, Staphylococcus aureus subsp. aureus MW2
aauaaucacuu

SEQ ID NO: 2115961 - RNA, 15 nt, Staphylococcus aureus subsp. aureus MW2
aauaaucgaacagaa

SEQ ID NO: 2115962 - RNA, 18 nt, Staphylococcus aureus subsp. aureus MW2
aauaaucgaacagaaaau

SEQ ID NO: 2115963 - RNA, 21 nt, Staphylococcus aureus subsp. aureus MW2
aauaaucgguaauuacuugug

SEQ ID NO: 2115964 - RNA, 19 nt, Staphylococcus aureus subsp. aureus MW2
aauaaucggacugauggaa

SEQ ID NO: 2115965 - RNA, 16 nt, Staphylococcus aureus subsp. aureus MW2
aauaaucggacugaug

SEQ ID NO: 2115966 - RNA, 13 nt, Staphylococcus aureus subsp. aureus MW2
aauacaaccauca

SEQ ID NO: 2115967 - RNA, 20 nt, Staphylococcus aureus subsp. aureus MW2
aauacaauuucuucauuuuc

SEQ ID NO: 2115968 - RNA, 16 nt, Staphylococcus aureus subsp. aureus MW2
aauaauuggaaucauc

SEQ ID NO: 2115969 - RNA, 22 nt, Staphylococcus aureus subsp. aureus MW2
aauaauuuaauguugcaaaauu

SEQ ID NO: 2115970 - RNA, 22 nt, Staphylococcus aureus subsp. aureus MW2
aauacaaagccuuaauaucaug

SEQ ID NO: 2115971 - RNA, 15 nt, Staphylococcus aureus subsp. aureus MW2
aauacaaacacccac

SEQ ID NO: 2115972 - RNA, 14 nt, Staphylococcus aureus subsp. aureus MW2
aauacaaaacauua

SEQ ID NO: 2115973 - RNA, 22 nt, Staphylococcus aureus subsp. aureus MW2
aauaacuagauguucacauucu

SEQ ID NO: 2115974 - RNA, 18 nt, Staphylococcus aureus subsp. aureus MW2
aauaacgucacaacggca

SEQ ID NO: 2115975 - RNA, 14 nt, Staphylococcus aureus subsp. aureus MW2
aauaacgcauauaa

SEQ ID NO: 2115976 - RNA, 14 nt, Staphylococcus aureus subsp. aureus MW2
aaaaauaauuaaau

SEQ ID NO: 2115977 - RNA, 17 nt, Staphylococcus aureus subsp. aureus MW2
aaaaauaauagcaaaau

SEQ ID NO: 2115978 - RNA, 17 nt, Staphylococcus aureus subsp. aureus MW2
aauaauaccuucaauug

SEQ ID NO: 2115979 - RNA, 14 nt, Staphylococcus aureus subsp. aureus MW2
aaaaauauuuaaau

SEQ ID NO: 2115980 - RNA, 17 nt, Staphylococcus aureus subsp. aureus MW2
aaaaauauuuaaauaga

SEQ ID NO: 2115981 - RNA, 14 nt, Staphylococcus aureus subsp. aureus MW2
aaaaauauuuacau

SEQ ID NO: 2115982 - RNA, 15 nt, Staphylococcus aureus subsp. aureus MW2
aaaaaucaaagaggc

SEQ ID NO: 2115983 - RNA, 14 nt, Staphylococcus aureus subsp. aureus MW2
aaaaaucaaagagg

SEQ ID NO: 2115984 - RNA, 14 nt, Staphylococcus aureus subsp. aureus MW2
aaaaaucauaaaua

SEQ ID NO: 2115985 - RNA, 18 nt, Staphylococcus aureus subsp. aureus MW2
aaaaaucauaaauaacac

SEQ ID NO: 2115986 - RNA, 11 nt, Staphylococcus aureus subsp. aureus MW2
aauaauauuug

SEQ ID NO: 2115987 - RNA, 12 nt, Staphylococcus aureus subsp. aureus MW2
aauaauauauuu

SEQ ID NO: 2115988 - RNA, 13 nt, Staphylococcus aureus subsp. aureus MW2
aauaauauaaaaa

SEQ ID NO: 2115989 - RNA, 14 nt, Staphylococcus aureus subsp. aureus MW2
aauaauauauuuag

SEQ ID NO: 2115990 - RNA, 20 nt, Staphylococcus aureus subsp. aureus MW2
aauacguuuaauaaugguuc

SEQ ID NO: 2115991 - RNA, 19 nt, Staphylococcus aureus subsp. aureus MW2
aauacguuuaauaaugguu

SEQ ID NO: 2115992 - RNA, 23 nt, Staphylococcus aureus subsp. aureus MW2
aauacguuuauccuuuaaaucau

SEQ ID NO: 2115993 - RNA, 14 nt, Staphylococcus aureus subsp. aureus MW2
aauacuaaaaugga

SEQ ID NO: 2115994 - RNA, 13 nt, Staphylococcus aureus subsp. aureus MW2
aauacuaacguaa

SEQ ID NO: 2115995 - RNA, 19 nt, Staphylococcus aureus subsp. aureus MW2
aauacaucuaauaaauaua

SEQ ID NO: 2115996 - RNA, 17 nt, Staphylococcus aureus subsp. aureus MW2
aauacaucuaauaaaua

SEQ ID NO: 2115997 - RNA, 11 nt, Staphylococcus aureus subsp. aureus MW2
aauacaucuaa

SEQ ID NO: 2115998 - RNA, 15 nt, Staphylococcus aureus subsp. aureus MW2
aauacauaaugguuc

SEQ ID NO: 2115999 - RNA, 13 nt, Staphylococcus aureus subsp. aureus MW2
aauacauacugau

SEQ ID NO: 2116000 - RNA, 17 nt, Staphylococcus aureus subsp. aureus MW2
aauacauacugauuaaa

SEQ ID NO: 2116001 - RNA, 16 nt, Staphylococcus aureus subsp. aureus MW2
aauacgaauuucauag

SEQ ID NO: 2116002 - RNA, 13 nt, Staphylococcus aureus subsp. aureus MW2
aauacgaaguuuc

SEQ ID NO: 2116003 - RNA, 20 nt, Staphylococcus aureus subsp. aureus MW2
aauaccuuuuucuaaaccaa

SEQ ID NO: 2116004 - RNA, 15 nt, Staphylococcus aureus subsp. aureus MW2
aauaccuuuuucuaa

SEQ ID NO: 2116005 - RNA, 13 nt, Staphylococcus aureus subsp. aureus MW2
aauacuuuuuaac

SEQ ID NO: 2116006 - RNA, 14 nt, Staphylococcus aureus subsp. aureus MW2
aauacuuuuuaacu

SEQ ID NO: 2116007 - RNA, 14 nt, Staphylococcus aureus subsp. aureus MW2
aauagaaaaaacaa

SEQ ID NO: 2116008 - RNA, 19 nt, Staphylococcus aureus subsp. aureus MW2
aauagaaaaauuucaaaaa

SEQ ID NO: 2116009 - RNA, 21 nt, Staphylococcus aureus subsp. aureus MW2
aauagaaaaauuucaaaaaua

SEQ ID NO: 2116010 - RNA, 13 nt, Staphylococcus aureus subsp. aureus MW2
aauacuugaaaga

SEQ ID NO: 2116011 - RNA, 20 nt, Staphylococcus aureus subsp. aureus MW2
aauacuugaaagauuuguag

SEQ ID NO: 2116012 - RNA, 20 nt, Staphylococcus aureus subsp. aureus MW2
aauacuuucaaacaaaucuu

SEQ ID NO: 2116013 - RNA, 22 nt, Staphylococcus aureus subsp. aureus MW2
aauacuuucaaacaaaucuuuu

SEQ ID NO: 2116014 - RNA, 18 nt, Staphylococcus aureus subsp. aureus MW2
aauacuuucacuuuuuau

SEQ ID NO: 2116015 - RNA, 22 nt, Staphylococcus aureus subsp. aureus MW2
aauacuuucacuuuuuauauca

SEQ ID NO: 2116016 - RNA, 21 nt, Staphylococcus aureus subsp. aureus MW2
aauagaacgaaauaguucaaa

SEQ ID NO: 2116017 - RNA, 12 nt, Staphylococcus aureus subsp. aureus MW2
aauagaaauaau

SEQ ID NO: 2116018 - RNA, 19 nt, Staphylococcus aureus subsp. aureus MW2
aauagagguauaauuaaau

SEQ ID NO: 2116019 - RNA, 22 nt, Staphylococcus aureus subsp. aureus MW2
aauacuacacuccccuuaucaa

SEQ ID NO: 2116020 - RNA, 21 nt, Staphylococcus aureus subsp. aureus MW2
aauacuacacuccccuuauca

SEQ ID NO: 2116021 - RNA, 15 nt, Staphylococcus aureus subsp. aureus MW2
aauacuaauuuugua

SEQ ID NO: 2116022 - RNA, 19 nt, Staphylococcus aureus subsp. aureus MW2
aauacuaauuuuguacaua

SEQ ID NO: 2116023 - RNA, 14 nt, Staphylococcus aureus subsp. aureus MW2
aauacuaaucaaag

SEQ ID NO: 2116024 - RNA, 14 nt, Staphylococcus aureus subsp. aureus MW2
aauacuauacugau

SEQ ID NO: 2116025 - RNA, 20 nt, Staphylococcus aureus subsp. aureus MW2
aauacuaccguuuuuauaua

SEQ ID NO: 2116026 - RNA, 21 nt, Staphylococcus aureus subsp. aureus MW2
aauacucaacacgauagucau

SEQ ID NO: 2116027 - RNA, 19 nt, Staphylococcus aureus subsp. aureus MW2
aauacuauaugaaaagaga

SEQ ID NO: 2116028 - RNA, 20 nt, Staphylococcus aureus subsp. aureus MW2
aauacuaucugacauuuaaa

SEQ ID NO: 2116029 - RNA, 14 nt, Staphylococcus aureus subsp. aureus MW2
aauacuauaugaaa

SEQ ID NO: 2116030 - RNA, 12 nt, Staphylococcus aureus subsp. aureus MW2
aauacuaguaau

SEQ ID NO: 2116031 - RNA, 19 nt, Staphylococcus aureus subsp. aureus MW2
aauacuguuuaaauaaaau

SEQ ID NO: 2116032 - RNA, 21 nt, Staphylococcus aureus subsp. aureus MW2
aagaugauuauucucuuuauu

SEQ ID NO: 2116033 - RNA, 23 nt, Staphylococcus aureus subsp. aureus MW2
aagaauuaauucgccuaaauggu

SEQ ID NO: 2116034 - RNA, 22 nt, Staphylococcus aureus subsp. aureus MW2
aagaauuaacaacaaauauaau

SEQ ID NO: 2116035 - RNA, 21 nt, Staphylococcus aureus subsp. aureus MW2
aagaauccuaugccaaauaac

SEQ ID NO: 2116036 - RNA, 18 nt, Staphylococcus aureus subsp. aureus MW2
aagaauguuucauaugca

SEQ ID NO: 2116037 - RNA, 22 nt, Staphylococcus aureus subsp. aureus MW2
aagaaucagcuaaauauuuuac

SEQ ID NO: 2116038 - RNA, 22 nt, Staphylococcus aureus subsp. aureus MW2
aagaugugcaucccgaaaguua

SEQ ID NO: 2116039 - RNA, 15 nt, Staphylococcus aureus subsp. aureus MW2
aagaugcuuuaauua

SEQ ID NO: 2116040 - RNA, 18 nt, Staphylococcus aureus subsp. aureus MW2
aagaugccucaguuagaa

SEQ ID NO: 2116041 - RNA, 16 nt, Staphylococcus aureus subsp. aureus MW2
aagauuaugaaaacau

SEQ ID NO: 2116042 - RNA, 21 nt, Staphylococcus aureus subsp. aureus MW2
aagauuaugaaaacauuauua

SEQ ID NO: 2116043 - RNA, 21 nt, Staphylococcus aureus subsp. aureus MW2
aagauguuugcaacauauuuu

SEQ ID NO: 2116044 - RNA, 15 nt, Staphylococcus aureus subsp. aureus MW2
aagauuauuuucaau

SEQ ID NO: 2116045 - RNA, 18 nt, Staphylococcus aureus subsp. aureus MW2
aagcaaucuuaguacaaa

SEQ ID NO: 2116046 - RNA, 19 nt, Staphylococcus aureus subsp. aureus MW2
aagcacagaaaauuauacu

SEQ ID NO: 2116047 - RNA, 17 nt, Staphylococcus aureus subsp. aureus MW2
aagcacagaaaauuaua

SEQ ID NO: 2116048 - RNA, 20 nt, Staphylococcus aureus subsp. aureus MW2
aagauuuguagcuugaauaa

SEQ ID NO: 2116049 - RNA, 14 nt, Staphylococcus aureus subsp. aureus MW2
aagcaaagaugaua

SEQ ID NO: 2116050 - RNA, 16 nt, Staphylococcus aureus subsp. aureus MW2
aagcaguuguugguuu

SEQ ID NO: 2116051 - RNA, 19 nt, Staphylococcus aureus subsp. aureus MW2
aagcagugcuaauuuugag

SEQ ID NO: 2116052 - RNA, 17 nt, Staphylococcus aureus subsp. aureus MW2
aagcaucauauacauac

SEQ ID NO: 2116053 - RNA, 18 nt, Staphylococcus aureus subsp. aureus MW2
aagcauaccuacagaaug

SEQ ID NO: 2116054 - RNA, 20 nt, Staphylococcus aureus subsp. aureus MW2
aagcaugauacucaauaaaa

SEQ ID NO: 2116055 - RNA, 21 nt, Staphylococcus aureus subsp. aureus MW2
aagcaucguaaaaaacaaaaa

SEQ ID NO: 2116056 - RNA, 13 nt, Staphylococcus aureus subsp. aureus MW2
aagcaugauacuc

SEQ ID NO: 2116057 - RNA, 20 nt, Staphylococcus aureus subsp. aureus MW2
aagcaugacacucauucaau

SEQ ID NO: 2116058 - RNA, 18 nt, Staphylococcus aureus subsp. aureus MW2
aagcaucuucaauauuua

SEQ ID NO: 2116059 - RNA, 19 nt, Staphylococcus aureus subsp. aureus MW2
aagcaucguaaaaaacaaa

SEQ ID NO: 2116060 - RNA, 17 nt, Staphylococcus aureus subsp. aureus MW2
aagcaucguaaaaaaca

SEQ ID NO: 2116061 - RNA, 18 nt, Staphylococcus aureus subsp. aureus MW2
aagcaucguaaaaaacaa

SEQ ID NO: 2116062 - RNA, 15 nt, Staphylococcus aureus subsp. aureus MW2
aagcaucguaaaaaa

SEQ ID NO: 2116063 - RNA, 14 nt, Staphylococcus aureus subsp. aureus MW2
aagcaucgaacaau

SEQ ID NO: 2116064 - RNA, 14 nt, Staphylococcus aureus subsp. aureus MW2
aagcaccuaaaaua

SEQ ID NO: 2116065 - RNA, 21 nt, Staphylococcus aureus subsp. aureus MW2
aagcaccuaaaauagaaaaau

SEQ ID NO: 2116066 - RNA, 15 nt, Staphylococcus aureus subsp. aureus MW2
aagcagacuaaaagu

SEQ ID NO: 2116067 - RNA, 16 nt, Staphylococcus aureus subsp. aureus MW2
aagccaguugaaguug

SEQ ID NO: 2116068 - RNA, 22 nt, Staphylococcus aureus subsp. aureus MW2
aagccaguugaaguugaagcgg

SEQ ID NO: 2116069 - RNA, 14 nt, Staphylococcus aureus subsp. aureus MW2
aagccauuuuucuu

SEQ ID NO: 2116070 - RNA, 23 nt, Staphylococcus aureus subsp. aureus MW2
aagcccaugcccgauaaaaccac

SEQ ID NO: 2116071 - RNA, 14 nt, Staphylococcus aureus subsp. aureus MW2
aagccccuuuuaaa

SEQ ID NO: 2116072 - RNA, 23 nt, Staphylococcus aureus subsp. aureus MW2
aagcauuuaaauauaaccuaaaa

SEQ ID NO: 2116073 - RNA, 14 nt, Staphylococcus aureus subsp. aureus MW2
aagcauuaaguuca

SEQ ID NO: 2116074 - RNA, 19 nt, Staphylococcus aureus subsp. aureus MW2
aagcauuaaguucaucaug

SEQ ID NO: 2116075 - RNA, 16 nt, Staphylococcus aureus subsp. aureus MW2
aagccaacacauaaau

SEQ ID NO: 2116076 - RNA, 17 nt, Staphylococcus aureus subsp. aureus MW2
aagcauuuuauuuuuaa

SEQ ID NO: 2116077 - RNA, 11 nt, Staphylococcus aureus subsp. aureus MW2
aagcauuuguc

SEQ ID NO: 2116078 - RNA, 22 nt, Staphylococcus aureus subsp. aureus MW2
aagguuguuuuucaucauuaaa

SEQ ID NO: 2116079 - RNA, 17 nt, Staphylococcus aureus subsp. aureus MW2
aagguuguucuauacau

SEQ ID NO: 2116080 - RNA, 15 nt, Staphylococcus aureus subsp. aureus MW2
aaggugauugaacaa

SEQ ID NO: 2116081 - RNA, 16 nt, Staphylococcus aureus subsp. aureus MW2
aaggugauugaacaau

SEQ ID NO: 2116082 - RNA, 19 nt, Staphylococcus aureus subsp. aureus MW2
aagguguucgggaauuuuu

SEQ ID NO: 2116083 - RNA, 15 nt, Staphylococcus aureus subsp. aureus MW2
aagguuaauauuaaa

SEQ ID NO: 2116084 - RNA, 15 nt, Staphylococcus aureus subsp. aureus MW2
aagguauucuauuuu

SEQ ID NO: 2116085 - RNA, 16 nt, Staphylococcus aureus subsp. aureus MW2
aaggucaaaaaauuaa

SEQ ID NO: 2116086 - RNA, 16 nt, Staphylococcus aureus subsp. aureus MW2
aagguaauuuaacauu

SEQ ID NO: 2116087 - RNA, 13 nt, Staphylococcus aureus subsp. aureus MW2
aagguacauaaau

SEQ ID NO: 2116088 - RNA, 23 nt, Staphylococcus aureus subsp. aureus MW2
aagguagcguagcauuauuuaaa

SEQ ID NO: 2116089 - RNA, 19 nt, Staphylococcus aureus subsp. aureus MW2
aaggucuauauauauuuaa

SEQ ID NO: 2116090 - RNA, 16 nt, Staphylococcus aureus subsp. aureus MW2
aaggcgaaacauuaaa

SEQ ID NO: 2116091 - RNA, 21 nt, Staphylococcus aureus subsp. aureus MW2
aagggaucggucuugaaaacc

SEQ ID NO: 2116092 - RNA, 20 nt, Staphylococcus aureus subsp. aureus MW2
aagggaucggucuugaaaac

SEQ ID NO: 2116093 - RNA, 12 nt, Staphylococcus aureus subsp. aureus MW2
aagggcaaaaaa

SEQ ID NO: 2116094 - RNA, 17 nt, Staphylococcus aureus subsp. aureus MW2
aagcgcuuggauuuuuu

SEQ ID NO: 2116095 - RNA, 15 nt, Staphylococcus aureus subsp. aureus MW2
aagcguaugauguug

SEQ ID NO: 2116096 - RNA, 14 nt, Staphylococcus aureus subsp. aureus MW2
aagcuaaguuugaa

SEQ ID NO: 2116097 - RNA, 15 nt, Staphylococcus aureus subsp. aureus MW2
aagcuaaagaguuau

SEQ ID NO: 2116098 - RNA, 13 nt, Staphylococcus aureus subsp. aureus MW2
aagcucccauuaa

SEQ ID NO: 2116099 - RNA, 21 nt, Staphylococcus aureus subsp. aureus MW2
aagcucuuuuuuguuauaucu

SEQ ID NO: 2116100 - RNA, 20 nt, Staphylococcus aureus subsp. aureus MW2
aagcugcgauauaacuaaaa

SEQ ID NO: 2116101 - RNA, 22 nt, Staphylococcus aureus subsp. aureus MW2
aagcuuaagugccagauuugaa

SEQ ID NO: 2116102 - RNA, 14 nt, Staphylococcus aureus subsp. aureus MW2
aagcugucauaccu

SEQ ID NO: 2116103 - RNA, 20 nt, Staphylococcus aureus subsp. aureus MW2
aagcugacaaaccaauuuua

SEQ ID NO: 2116104 - RNA, 22 nt, Staphylococcus aureus subsp. aureus MW2
aagcugacaaaccaauuuuaau

SEQ ID NO: 2116105 - RNA, 14 nt, Staphylococcus aureus subsp. aureus MW2
aagcugauuaaaau

SEQ ID NO: 2116106 - RNA, 17 nt, Staphylococcus aureus subsp. aureus MW2
aagcugaugugacaaag

SEQ ID NO: 2116107 - RNA, 14 nt, Staphylococcus aureus subsp. aureus MW2
aagcugauuucuau

SEQ ID NO: 2116108 - RNA, 21 nt, Staphylococcus aureus subsp. aureus MW2
aagcugauuucuaucaaauaa

SEQ ID NO: 2116109 - RNA, 22 nt, Staphylococcus aureus subsp. aureus MW2
aagcugauuucuaucaaauaau

SEQ ID NO: 2116110 - RNA, 22 nt, Staphylococcus aureus subsp. aureus MW2
aagcugauuucuauuaauuauu

SEQ ID NO: 2116111 - RNA, 18 nt, Staphylococcus aureus subsp. aureus MW2
aagcugauuuuucauuga

SEQ ID NO: 2116112 - RNA, 13 nt, Staphylococcus aureus subsp. aureus MW2
aaggaaagcuuca

SEQ ID NO: 2116113 - RNA, 15 nt, Staphylococcus aureus subsp. aureus MW2
aagcuuuuuugcuuu

SEQ ID NO: 2116114 - RNA, 23 nt, Staphylococcus aureus subsp. aureus MW2
aagcuuuuuugcuuuuauaauaa

SEQ ID NO: 2116115 - RNA, 22 nt, Staphylococcus aureus subsp. aureus MW2
aagcuuucuaucuuguucuucu

SEQ ID NO: 2116116 - RNA, 14 nt, Staphylococcus aureus subsp. aureus MW2
aagcuuugacauau

SEQ ID NO: 2116117 - RNA, 21 nt, Staphylococcus aureus subsp. aureus MW2
aagcuuugcugcuuuuccauu

SEQ ID NO: 2116118 - RNA, 19 nt, Staphylococcus aureus subsp. aureus MW2
aagcuuuuacgccuucuuu

SEQ ID NO: 2116119 - RNA, 23 nt, Staphylococcus aureus subsp. aureus MW2
aagcuuuuacgccuucuuuauaa

SEQ ID NO: 2116120 - RNA, 14 nt, Staphylococcus aureus subsp. aureus MW2
aaccgcuguuuuuc

SEQ ID NO: 2116121 - RNA, 16 nt, Staphylococcus aureus subsp. aureus MW2
aacgauuguugcaaug

SEQ ID NO: 2116122 - RNA, 13 nt, Staphylococcus aureus subsp. aureus MW2
aacgcaaauuaaa

SEQ ID NO: 2116123 - RNA, 22 nt, Staphylococcus aureus subsp. aureus MW2
aacgcaagcauaucuuuaucau

SEQ ID NO: 2116124 - RNA, 21 nt, Staphylococcus aureus subsp. aureus MW2
aacgcaccuggcacaaaugcu

SEQ ID NO: 2116125 - RNA, 14 nt, Staphylococcus aureus subsp. aureus MW2
aacggaaauaacca

SEQ ID NO: 2116126 - RNA, 20 nt, Staphylococcus aureus subsp. aureus MW2
aacgcuuuguuuuuaguaau

SEQ ID NO: 2116127 - RNA, 13 nt, Staphylococcus aureus subsp. aureus MW2
aacgcuuuaaauc

SEQ ID NO: 2116128 - RNA, 22 nt, Staphylococcus aureus subsp. aureus MW2
aacgcuguuuuuaaaugcuuua

SEQ ID NO: 2116129 - RNA, 21 nt, Staphylococcus aureus subsp. aureus MW2
aacgcuuauacuauauaauaa

SEQ ID NO: 2116130 - RNA, 16 nt, Staphylococcus aureus subsp. aureus MW2
aacgguagaauaaaag

SEQ ID NO: 2116131 - RNA, 16 nt, Staphylococcus aureus subsp. aureus MW2
aacuaauuuaaagcau

SEQ ID NO: 2116132 - RNA, 16 nt, Staphylococcus aureus subsp. aureus MW2
aacuacugcaacacca

SEQ ID NO: 2116133 - RNA, 23 nt, Staphylococcus aureus subsp. aureus MW2
aacuacgcauuuuaaauaaaaug

SEQ ID NO: 2116134 - RNA, 22 nt, Staphylococcus aureus subsp. aureus MW2
aacuacggaagugguauuaacu

SEQ ID NO: 2116135 - RNA, 14 nt, Staphylococcus aureus subsp. aureus MW2
aacuauaacaauag

SEQ ID NO: 2116136 - RNA, 18 nt, Staphylococcus aureus subsp. aureus MW2
aacuauaauaaagauuau

SEQ ID NO: 2116137 - RNA, 18 nt, Staphylococcus aureus subsp. aureus MW2
aacuaguacgaaaugcau

SEQ ID NO: 2116138 - RNA, 14 nt, Staphylococcus aureus subsp. aureus MW2
aacuauaaucauua

SEQ ID NO: 2116139 - RNA, 17 nt, Staphylococcus aureus subsp. aureus MW2
aacuauaauaauuggaa

SEQ ID NO: 2116140 - RNA, 13 nt, Staphylococcus aureus subsp. aureus MW2
aacuauaacaaua

SEQ ID NO: 2116141 - RNA, 18 nt, Staphylococcus aureus subsp. aureus MW2
aacuagaaaacauaaaua

SEQ ID NO: 2116142 - RNA, 22 nt, Staphylococcus aureus subsp. aureus MW2
aacuacugcuaaaauaaaauua

SEQ ID NO: 2116143 - RNA, 15 nt, Staphylococcus aureus subsp. aureus MW2
aacuaauaauuugua

SEQ ID NO: 2116144 - RNA, 20 nt, Staphylococcus aureus subsp. aureus MW2
aacuaauaauuuguaauucc

SEQ ID NO: 2116145 - RNA, 17 nt, Staphylococcus aureus subsp. aureus MW2
aacuaauagcauuugua

SEQ ID NO: 2116146 - RNA, 14 nt, Staphylococcus aureus subsp. aureus MW2
aacuaauaauuugu

SEQ ID NO: 2116147 - RNA, 16 nt, Staphylococcus aureus subsp. aureus MW2
aacuaauaacaaauag

SEQ ID NO: 2116148 - RNA, 14 nt, Staphylococcus aureus subsp. aureus MW2
aacuaaugucgcac

SEQ ID NO: 2116149 - RNA, 13 nt, Staphylococcus aureus subsp. aureus MW2
aacuaauuuaaag

SEQ ID NO: 2116150 - RNA, 12 nt, Staphylococcus aureus subsp. aureus MW2
aacuaagauaua

SEQ ID NO: 2116151 - RNA, 19 nt, Staphylococcus aureus subsp. aureus MW2
aacuaaguugacuauauaa

SEQ ID NO: 2116152 - RNA, 18 nt, Staphylococcus aureus subsp. aureus MW2
aacuaagugaauuaucua

SEQ ID NO: 2116153 - RNA, 18 nt, Staphylococcus aureus subsp. aureus MW2
aacuaacacgucacaugg

SEQ ID NO: 2116154 - RNA, 14 nt, Staphylococcus aureus subsp. aureus MW2
aacuaaaucaccau

SEQ ID NO: 2116155 - RNA, 23 nt, Staphylococcus aureus subsp. aureus MW2
aacuaaaucaccauuuuuuacaa

SEQ ID NO: 2116156 - RNA, 17 nt, Staphylococcus aureus subsp. aureus MW2
aacuaaaaugucuuuga

SEQ ID NO: 2116157 - RNA, 16 nt, Staphylococcus aureus subsp. aureus MW2
aacuaaaacaauaaua

SEQ ID NO: 2116158 - RNA, 13 nt, Staphylococcus aureus subsp. aureus MW2
aacguuuucacuu

SEQ ID NO: 2116159 - RNA, 23 nt, Staphylococcus aureus subsp. aureus MW2
aacuaaaaagcgugguucccaau

SEQ ID NO: 2116160 - RNA, 12 nt, Staphylococcus aureus subsp. aureus MW2
aacguuuucacu

SEQ ID NO: 2116161 - RNA, 15 nt, Staphylococcus aureus subsp. aureus MW2
aacguuuauuuuuau

SEQ ID NO: 2116162 - RNA, 19 nt, Staphylococcus aureus subsp. aureus MW2
aacguucaaucguuucuuc

SEQ ID NO: 2116163 - RNA, 20 nt, Staphylococcus aureus subsp. aureus MW2
aacguuauucguuaacaauc

SEQ ID NO: 2116164 - RNA, 18 nt, Staphylococcus aureus subsp. aureus MW2
aacguuauucguuaacaa

SEQ ID NO: 2116165 - RNA, 12 nt, Staphylococcus aureus subsp. aureus MW2
aacgucacuuua

SEQ ID NO: 2116166 - RNA, 22 nt, Staphylococcus aureus subsp. aureus MW2
aacgucauauguuuuauaauaa

SEQ ID NO: 2116167 - RNA, 17 nt, Staphylococcus aureus subsp. aureus MW2
aacguacauuuuuauga

SEQ ID NO: 2116168 - RNA, 15 nt, Staphylococcus aureus subsp. aureus MW2
aacguacauuuuuau

SEQ ID NO: 2116169 - RNA, 15 nt, Staphylococcus aureus subsp. aureus MW2
aacgucaacagcaua

SEQ ID NO: 2116170 - RNA, 22 nt, Staphylococcus aureus subsp. aureus MW2
aacgucacaugccaucuuugua

SEQ ID NO: 2116171 - RNA, 18 nt, Staphylococcus aureus subsp. aureus MW2
aacuggaacuuacaaguc

SEQ ID NO: 2116172 - RNA, 18 nt, Staphylococcus aureus subsp. aureus MW2
aacugcaaacuugauuca

SEQ ID NO: 2116173 - RNA, 16 nt, Staphylococcus aureus subsp. aureus MW2
aacugaauuaaagcau

SEQ ID NO: 2116174 - RNA, 17 nt, Staphylococcus aureus subsp. aureus MW2
aacugaugaaaagguua

SEQ ID NO: 2116175 - RNA, 12 nt, Staphylococcus aureus subsp. aureus MW2
aacuuaaauauc

SEQ ID NO: 2116176 - RNA, 20 nt, Staphylococcus aureus subsp. aureus MW2
aacuuaaugcuucaaaugua

SEQ ID NO: 2116177 - RNA, 13 nt, Staphylococcus aureus subsp. aureus MW2
aacuuacauuaca

SEQ ID NO: 2116178 - RNA, 15 nt, Staphylococcus aureus subsp. aureus MW2
aacuuaaaauuuaaa

SEQ ID NO: 2116179 - RNA, 23 nt, Staphylococcus aureus subsp. aureus MW2
aacuuaaaaaugaaaugaaguau

SEQ ID NO: 2116180 - RNA, 23 nt, Staphylococcus aureus subsp. aureus MW2
aacuuaacucuaucaaauuacuu

SEQ ID NO: 2116181 - RNA, 17 nt, Staphylococcus aureus subsp. aureus MW2
aacuuaaucaagcuagc

SEQ ID NO: 2116182 - RNA, 18 nt, Staphylococcus aureus subsp. aureus MW2
aacuuaccgcugcuuuua

SEQ ID NO: 2116183 - RNA, 13 nt, Staphylococcus aureus subsp. aureus MW2
aacuuaaaacuau

SEQ ID NO: 2116184 - RNA, 15 nt, Staphylococcus aureus subsp. aureus MW2
aacuuaaaauauuua

SEQ ID NO: 2116185 - RNA, 11 nt, Staphylococcus aureus subsp. aureus MW2
aacuucuuuuu

SEQ ID NO: 2116186 - RNA, 13 nt, Staphylococcus aureus subsp. aureus MW2
aacuucuuuucuu

SEQ ID NO: 2116187 - RNA, 13 nt, Staphylococcus aureus subsp. aureus MW2
aacuugaacagau

SEQ ID NO: 2116188 - RNA, 16 nt, Staphylococcus aureus subsp. aureus MW2
aacuugaacuaaaaca

SEQ ID NO: 2116189 - RNA, 18 nt, Staphylococcus aureus subsp. aureus MW2
aacuugaacuaaaacaau

SEQ ID NO: 2116190 - RNA, 21 nt, Staphylococcus aureus subsp. aureus MW2
aacuugauauuauauaaaagu

SEQ ID NO: 2116191 - RNA, 20 nt, Staphylococcus aureus subsp. aureus MW2
aacuugaucauuauaaaaug

SEQ ID NO: 2116192 - RNA, 18 nt, Staphylococcus aureus subsp. aureus MW2
aacuucugguucuucacu

SEQ ID NO: 2116193 - RNA, 16 nt, Staphylococcus aureus subsp. aureus MW2
aacuuaucugauuguu

SEQ ID NO: 2116194 - RNA, 15 nt, Staphylococcus aureus subsp. aureus MW2
aacuuauuauuuauc

SEQ ID NO: 2116195 - RNA, 15 nt, Staphylococcus aureus subsp. aureus MW2
aagaaauguuaaauu

SEQ ID NO: 2116196 - RNA, 18 nt, Staphylococcus aureus subsp. aureus MW2
aagaaauguuaaauuaaa

SEQ ID NO: 2116197 - RNA, 12 nt, Staphylococcus aureus subsp. aureus MW2
aagaaauuuuuu

SEQ ID NO: 2116198 - RNA, 13 nt, Staphylococcus aureus subsp. aureus MW2
aagaaauguuaaa

SEQ ID NO: 2116199 - RNA, 15 nt, Staphylococcus aureus subsp. aureus MW2
aagaacauucuaacu

SEQ ID NO: 2116200 - RNA, 14 nt, Staphylococcus aureus subsp. aureus MW2
aagaacauaaccua

SEQ ID NO: 2116201 - RNA, 14 nt, Staphylococcus aureus subsp. aureus MW2
aacuugauuaugua

SEQ ID NO: 2116202 - RNA, 13 nt, Staphylococcus aureus subsp. aureus MW2
aacuugcuuuguu

SEQ ID NO: 2116203 - RNA, 19 nt, Staphylococcus aureus subsp. aureus MW2
aacuugcuuuguucuucgu

SEQ ID NO: 2116204 - RNA, 18 nt, Staphylococcus aureus subsp. aureus MW2
aagaaaaaacuuuucaug

SEQ ID NO: 2116205 - RNA, 21 nt, Staphylococcus aureus subsp. aureus MW2
aagaaaaauguguuaaaauau

SEQ ID NO: 2116206 - RNA, 22 nt, Staphylococcus aureus subsp. aureus MW2
aagaaaaagugauaauuaaaau

SEQ ID NO: 2116207 - RNA, 21 nt, Staphylococcus aureus subsp. aureus MW2
aagaaaaagugauaauuaaaa

SEQ ID NO: 2116208 - RNA, 22 nt, Staphylococcus aureus subsp. aureus MW2
aagaagauuaugaaaacauuau

SEQ ID NO: 2116209 - RNA, 22 nt, Staphylococcus aureus subsp. aureus MW2
aagaagacauuggauuacuucc

SEQ ID NO: 2116210 - RNA, 16 nt, Staphylococcus aureus subsp. aureus MW2
aagaauaaaaaaguug

SEQ ID NO: 2116211 - RNA, 19 nt, Staphylococcus aureus subsp. aureus MW2
aagaauaaaaaaguugauu

SEQ ID NO: 2116212 - RNA, 22 nt, Staphylococcus aureus subsp. aureus MW2
aagaagugcuuaugaaugaaau

SEQ ID NO: 2116213 - RNA, 17 nt, Staphylococcus aureus subsp. aureus MW2
aagaauacaugacucca

SEQ ID NO: 2116214 - RNA, 15 nt, Staphylococcus aureus subsp. aureus MW2
aagaauaaacaacau

SEQ ID NO: 2116215 - RNA, 22 nt, Staphylococcus aureus subsp. aureus MW2
aacauugauaguuuuauaauuc

SEQ ID NO: 2116216 - RNA, 19 nt, Staphylococcus aureus subsp. aureus MW2
aacauugauuauuguucca

SEQ ID NO: 2116217 - RNA, 15 nt, Staphylococcus aureus subsp. aureus MW2
aaccaacaauugguu

SEQ ID NO: 2116218 - RNA, 23 nt, Staphylococcus aureus subsp. aureus MW2
aaccaaaucggaauaaaauaaau

SEQ ID NO: 2116219 - RNA, 19 nt, Staphylococcus aureus subsp. aureus MW2
aacauuauuuauauuuaga

SEQ ID NO: 2116220 - RNA, 19 nt, Staphylococcus aureus subsp. aureus MW2
aacauucuucaaaaaauaa

SEQ ID NO: 2116221 - RNA, 20 nt, Staphylococcus aureus subsp. aureus MW2
aacauucuucaaaaaauaau

SEQ ID NO: 2116222 - RNA, 22 nt, Staphylococcus aureus subsp. aureus MW2
aacauguuccgcuacaaaacau

SEQ ID NO: 2116223 - RNA, 21 nt, Staphylococcus aureus subsp. aureus MW2
aacauguugauaaaaaggauc

SEQ ID NO: 2116224 - RNA, 15 nt, Staphylococcus aureus subsp. aureus MW2
aacauguuucuagau

SEQ ID NO: 2116225 - RNA, 15 nt, Staphylococcus aureus subsp. aureus MW2
aacauguauuuagua

SEQ ID NO: 2116226 - RNA, 13 nt, Staphylococcus aureus subsp. aureus MW2
aacauguacaauu

SEQ ID NO: 2116227 - RNA, 15 nt, Staphylococcus aureus subsp. aureus MW2
aacauuaaaaugaua

SEQ ID NO: 2116228 - RNA, 13 nt, Staphylococcus aureus subsp. aureus MW2
aacauuaaaaugu

SEQ ID NO: 2116229 - RNA, 13 nt, Staphylococcus aureus subsp. aureus MW2
aacauuaaaauaa

SEQ ID NO: 2116230 - RNA, 14 nt, Staphylococcus aureus subsp. aureus MW2
aacauuaauaaaua

SEQ ID NO: 2116231 - RNA, 22 nt, Staphylococcus aureus subsp. aureus MW2
aacauuacccuuuaaucucaug

SEQ ID NO: 2116232 - RNA, 13 nt, Staphylococcus aureus subsp. aureus MW2
aacauaugcaagu

SEQ ID NO: 2116233 - RNA, 22 nt, Staphylococcus aureus subsp. aureus MW2
aacauagaagcuggcggaaagu

SEQ ID NO: 2116234 - RNA, 20 nt, Staphylococcus aureus subsp. aureus MW2
aacauaccuaauaacgcaua

SEQ ID NO: 2116235 - RNA, 15 nt, Staphylococcus aureus subsp. aureus MW2
aacagcgcaucauaa

SEQ ID NO: 2116236 - RNA, 14 nt, Staphylococcus aureus subsp. aureus MW2
aacauaaucauaau

SEQ ID NO: 2116237 - RNA, 17 nt, Staphylococcus aureus subsp. aureus MW2
aacaucugaaaaaauua

SEQ ID NO: 2116238 - RNA, 11 nt, Staphylococcus aureus subsp. aureus MW2
aacaucugaau

SEQ ID NO: 2116239 - RNA, 16 nt, Staphylococcus aureus subsp. aureus MW2
aacaucugaaucugaa

SEQ ID NO: 2116240 - RNA, 22 nt, Staphylococcus aureus subsp. aureus MW2
aacaucgaauuaaccccuucaa

SEQ ID NO: 2116241 - RNA, 16 nt, Staphylococcus aureus subsp. aureus MW2
aacauccccaaaaaua

SEQ ID NO: 2116242 - RNA, 21 nt, Staphylococcus aureus subsp. aureus MW2
aacaucuuuuguuguuuuuga

SEQ ID NO: 2116243 - RNA, 16 nt, Staphylococcus aureus subsp. aureus MW2
aacaugacagcaucac

SEQ ID NO: 2116244 - RNA, 22 nt, Staphylococcus aureus subsp. aureus MW2
aacaucaugucgaaucaaagua

SEQ ID NO: 2116245 - RNA, 21 nt, Staphylococcus aureus subsp. aureus MW2
aacaucauuaacuuucucaaa

SEQ ID NO: 2116246 - RNA, 13 nt, Staphylococcus aureus subsp. aureus MW2
aacaucaucuuua

SEQ ID NO: 2116247 - RNA, 15 nt, Staphylococcus aureus subsp. aureus MW2
aacaucaucauguuu

SEQ ID NO: 2116248 - RNA, 18 nt, Staphylococcus aureus subsp. aureus MW2
aacaucaucauguuuauu

SEQ ID NO: 2116249 - RNA, 16 nt, Staphylococcus aureus subsp. aureus MW2
aacaucauaaucgcca

SEQ ID NO: 2116250 - RNA, 14 nt, Staphylococcus aureus subsp. aureus MW2
aacauauucauaau

SEQ ID NO: 2116251 - RNA, 21 nt, Staphylococcus aureus subsp. aureus MW2
aacauauuuaucucuuucuuc

SEQ ID NO: 2116252 - RNA, 13 nt, Staphylococcus aureus subsp. aureus MW2
aacauauuauaua

SEQ ID NO: 2116253 - RNA, 23 nt, Staphylococcus aureus subsp. aureus MW2
aacauauucaguauauguauaga

SEQ ID NO: 2116254 - RNA, 12 nt, Staphylococcus aureus subsp. aureus MW2
aacauauuuuaa

SEQ ID NO: 2116255 - RNA, 18 nt, Staphylococcus aureus subsp. aureus MW2
aaccgaggugucaauaaa

SEQ ID NO: 2116256 - RNA, 19 nt, Staphylococcus aureus subsp. aureus MW2
aaccgagaaucuccauuua

SEQ ID NO: 2116257 - RNA, 16 nt, Staphylococcus aureus subsp. aureus MW2
aaccgaaauaucaaca

SEQ ID NO: 2116258 - RNA, 18 nt, Staphylococcus aureus subsp. aureus MW2
aaccgauuaauauaauac

SEQ ID NO: 2116259 - RNA, 18 nt, Staphylococcus aureus subsp. aureus MW2
aaccgcauacagaucuca

SEQ ID NO: 2116260 - RNA, 22 nt, Staphylococcus aureus subsp. aureus MW2
aaccgcuacaauuauaaaugau

SEQ ID NO: 2116261 - RNA, 14 nt, Staphylococcus aureus subsp. aureus MW2
aaccauuuaaaaau

SEQ ID NO: 2116262 - RNA, 14 nt, Staphylococcus aureus subsp. aureus MW2
aaccauuucuuuuu

SEQ ID NO: 2116263 - RNA, 14 nt, Staphylococcus aureus subsp. aureus MW2
aaccauuucauuuc

SEQ ID NO: 2116264 - RNA, 18 nt, Staphylococcus aureus subsp. aureus MW2
aacccaggugcaucuuuu

SEQ ID NO: 2116265 - RNA, 19 nt, Staphylococcus aureus subsp. aureus MW2
aaccauugaaugaauccca

SEQ ID NO: 2116266 - RNA, 17 nt, Staphylococcus aureus subsp. aureus MW2
aaccaugauuagcgcac

SEQ ID NO: 2116267 - RNA, 12 nt, Staphylococcus aureus subsp. aureus MW2
aaccaucugugu

SEQ ID NO: 2116268 - RNA, 15 nt, Staphylococcus aureus subsp. aureus MW2
aaccaucauaaaugu

SEQ ID NO: 2116269 - RNA, 15 nt, Staphylococcus aureus subsp. aureus MW2
aaccaucauuuauau

SEQ ID NO: 2116270 - RNA, 16 nt, Staphylococcus aureus subsp. aureus MW2
aacaauaaaaaaccaa

SEQ ID NO: 2116271 - RNA, 15 nt, Staphylococcus aureus subsp. aureus MW2
aacaauaaaaaacca

SEQ ID NO: 2116272 - RNA, 19 nt, Staphylococcus aureus subsp. aureus MW2
aacaagugaugaaaaagag

SEQ ID NO: 2116273 - RNA, 17 nt, Staphylococcus aureus subsp. aureus MW2
aacaaguucauuucaau

SEQ ID NO: 2116274 - RNA, 20 nt, Staphylococcus aureus subsp. aureus MW2
aacaaguucauuucaauacc

SEQ ID NO: 2116275 - RNA, 20 nt, Staphylococcus aureus subsp. aureus MW2
aacaauauuaaauuucugaa

SEQ ID NO: 2116276 - RNA, 16 nt, Staphylococcus aureus subsp. aureus MW2
aacaauaucaucuaaa

SEQ ID NO: 2116277 - RNA, 15 nt, Staphylococcus aureus subsp. aureus MW2
aacaauauaaaagca

SEQ ID NO: 2116278 - RNA, 13 nt, Staphylococcus aureus subsp. aureus MW2
aacaauauaauau

SEQ ID NO: 2116279 - RNA, 17 nt, Staphylococcus aureus subsp. aureus MW2
aacaauacauaaugguu

SEQ ID NO: 2116280 - RNA, 18 nt, Staphylococcus aureus subsp. aureus MW2
aaauucuuuucaagaaau

SEQ ID NO: 2116281 - RNA, 20 nt, Staphylococcus aureus subsp. aureus MW2
aacaaguauaaaugcagcug

SEQ ID NO: 2116282 - RNA, 20 nt, Staphylococcus aureus subsp. aureus MW2
aaauucuuauaaaauaaaaa

SEQ ID NO: 2116283 - RNA, 20 nt, Staphylococcus aureus subsp. aureus MW2
aacaauuuuaaaucuuuuag

SEQ ID NO: 2116284 - RNA, 23 nt, Staphylococcus aureus subsp. aureus MW2
aacaauuuuaauuuuucauuaau

SEQ ID NO: 2116285 - RNA, 16 nt, Staphylococcus aureus subsp. aureus MW2
aacaauuuuagacuac

SEQ ID NO: 2116286 - RNA, 16 nt, Staphylococcus aureus subsp. aureus MW2
aacaaugcaaguuggc

SEQ ID NO: 2116287 - RNA, 24 nt, Staphylococcus aureus subsp. aureus MW2
aacaaucggaagcauauuucuaaa

SEQ ID NO: 2116288 - RNA, 21 nt, Staphylococcus aureus subsp. aureus MW2
aaaaagggcaacacucggaaa

SEQ ID NO: 2116289 - RNA, 17 nt, Staphylococcus aureus subsp. aureus MW2
aacacaguacaaauaac

SEQ ID NO: 2116290 - RNA, 19 nt, Staphylococcus aureus subsp. aureus MW2
aacacaguacaaauaacaa

SEQ ID NO: 2116291 - RNA, 14 nt, Staphylococcus aureus subsp. aureus MW2
aacacauaaauuaa

SEQ ID NO: 2116292 - RNA, 23 nt, Staphylococcus aureus subsp. aureus MW2
aacacauauuccgagaauuauua

SEQ ID NO: 2116293 - RNA, 22 nt, Staphylococcus aureus subsp. aureus MW2
aacacacuuauaaucuauaaau

SEQ ID NO: 2116294 - RNA, 22 nt, Staphylococcus aureus subsp. aureus MW2
aacacagaagcuggcggaaagu

SEQ ID NO: 2116295 - RNA, 17 nt, Staphylococcus aureus subsp. aureus MW2
aacacagacguuuuuga

SEQ ID NO: 2116296 - RNA, 18 nt, Staphylococcus aureus subsp. aureus MW2
aacacacuguugaaaaug

SEQ ID NO: 2116297 - RNA, 20 nt, Staphylococcus aureus subsp. aureus MW2
aaaaagugaaaguauuagau

SEQ ID NO: 2116298 - RNA, 20 nt, Staphylococcus aureus subsp. aureus MW2
aaaaagucucauuaucacca

SEQ ID NO: 2116299 - RNA, 18 nt, Staphylococcus aureus subsp. aureus MW2
aaaaagugauaauuaaaa

SEQ ID NO: 2116300 - RNA, 19 nt, Staphylococcus aureus subsp. aureus MW2
aacacauucuuauuugaaa

SEQ ID NO: 2116301 - RNA, 18 nt, Staphylococcus aureus subsp. aureus MW2
aacacauucuuauuugaa

SEQ ID NO: 2116302 - RNA, 20 nt, Staphylococcus aureus subsp. aureus MW2
aaaaaguaaaaucuuuaaca

SEQ ID NO: 2116303 - RNA, 18 nt, Staphylococcus aureus subsp. aureus MW2
aaaaagguuaauauuaaa

SEQ ID NO: 2116304 - RNA, 14 nt, Staphylococcus aureus subsp. aureus MW2
aacaccaauuaaau

SEQ ID NO: 2116305 - RNA, 12 nt, Staphylococcus aureus subsp. aureus MW2
aacaccaauuga

SEQ ID NO: 2116306 - RNA, 14 nt, Staphylococcus aureus subsp. aureus MW2
aacacgaacugcau

SEQ ID NO: 2116307 - RNA, 21 nt, Staphylococcus aureus subsp. aureus MW2
aacaccuuucgcgacuucauu

SEQ ID NO: 2116308 - RNA, 22 nt, Staphylococcus aureus subsp. aureus MW2
aacacgacaaucgaauguauug

SEQ ID NO: 2116309 - RNA, 16 nt, Staphylococcus aureus subsp. aureus MW2
aacaccuaauauuuua

SEQ ID NO: 2116310 - RNA, 14 nt, Staphylococcus aureus subsp. aureus MW2
aacaccuaauauuu

SEQ ID NO: 2116311 - RNA, 21 nt, Staphylococcus aureus subsp. aureus MW2
aacaccuucguuuaaauucau

SEQ ID NO: 2116312 - RNA, 13 nt, Staphylococcus aureus subsp. aureus MW2
aacacccaauaau

SEQ ID NO: 2116313 - RNA, 22 nt, Staphylococcus aureus subsp. aureus MW2
aacaccauuauagacauaagca

SEQ ID NO: 2116314 - RNA, 22 nt, Staphylococcus aureus subsp. aureus MW2
aacaccgcaaugccacaucaua

SEQ ID NO: 2116315 - RNA, 20 nt, Staphylococcus aureus subsp. aureus MW2
aacacgauuugguugaacug

SEQ ID NO: 2116316 - RNA, 22 nt, Staphylococcus aureus subsp. aureus MW2
aacacggucgccaacaguaauu

SEQ ID NO: 2116317 - RNA, 19 nt, Staphylococcus aureus subsp. aureus MW2
aacacuggcguuaaagcuu

SEQ ID NO: 2116318 - RNA, 21 nt, Staphylococcus aureus subsp. aureus MW2
aacacucaaaauguuuaacaa

SEQ ID NO: 2116319 - RNA, 21 nt, Staphylococcus aureus subsp. aureus MW2
aacacuagguacauaaauacc

SEQ ID NO: 2116320 - RNA, 22 nt, Staphylococcus aureus subsp. aureus MW2
aacacuagguacauaaauaccu

SEQ ID NO: 2116321 - RNA, 19 nt, Staphylococcus aureus subsp. aureus MW2
aacacguuuuaagccagca

SEQ ID NO: 2116322 - RNA, 14 nt, Staphylococcus aureus subsp. aureus MW2
aacagaguugucau

SEQ ID NO: 2116323 - RNA, 22 nt, Staphylococcus aureus subsp. aureus MW2
aacagacuuuguuaaaaaauua

SEQ ID NO: 2116324 - RNA, 18 nt, Staphylococcus aureus subsp. aureus MW2
aacagcaguaagauauuu

SEQ ID NO: 2116325 - RNA, 13 nt, Staphylococcus aureus subsp. aureus MW2
aacagcauaaaua

SEQ ID NO: 2116326 - RNA, 21 nt, Staphylococcus aureus subsp. aureus MW2
aauguaacauuaaaaauaaaa

SEQ ID NO: 2116327 - RNA, 21 nt, Staphylococcus aureus subsp. aureus MW2
aauguacauuguaaauauagu

SEQ ID NO: 2116328 - RNA, 18 nt, Staphylococcus aureus subsp. aureus MW2
aauguacauuguaaauau

SEQ ID NO: 2116329 - RNA, 22 nt, Staphylococcus aureus subsp. aureus MW2
aauguaaucacuucugaaaaua

SEQ ID NO: 2116330 - RNA, 19 nt, Staphylococcus aureus subsp. aureus MW2
aauguaauuauugcaucau

SEQ ID NO: 2116331 - RNA, 19 nt, Staphylococcus aureus subsp. aureus MW2
aaugguuucauaaacugaa

SEQ ID NO: 2116332 - RNA, 19 nt, Staphylococcus aureus subsp. aureus MW2
aauggaacgccgaauaauc

SEQ ID NO: 2116333 - RNA, 16 nt, Staphylococcus aureus subsp. aureus MW2
aaugcuucaaauguaa

SEQ ID NO: 2116334 - RNA, 15 nt, Staphylococcus aureus subsp. aureus MW2
aaugcuuuaaauauu

SEQ ID NO: 2116335 - RNA, 13 nt, Staphylococcus aureus subsp. aureus MW2
aaugcuuucaaau

SEQ ID NO: 2116336 - RNA, 23 nt, Staphylococcus aureus subsp. aureus MW2
aaugccauuguuauccaaaacau

SEQ ID NO: 2116337 - RNA, 20 nt, Staphylococcus aureus subsp. aureus MW2
aaugccauuguuauccaaaa

SEQ ID NO: 2116338 - RNA, 13 nt, Staphylococcus aureus subsp. aureus MW2
aaugccauaccug

SEQ ID NO: 2116339 - RNA, 23 nt, Staphylococcus aureus subsp. aureus MW2
aaugcagauucuucaccaacuuu

SEQ ID NO: 2116340 - RNA, 18 nt, Staphylococcus aureus subsp. aureus MW2
aaugcgaagauuuuuaac

SEQ ID NO: 2116341 - RNA, 16 nt, Staphylococcus aureus subsp. aureus MW2
aaugcgacaucgccaa

SEQ ID NO: 2116342 - RNA, 13 nt, Staphylococcus aureus subsp. aureus MW2
aaugcgcaaugaa

SEQ ID NO: 2116343 - RNA, 16 nt, Staphylococcus aureus subsp. aureus MW2
aaugcaacuugaucau

SEQ ID NO: 2116344 - RNA, 21 nt, Staphylococcus aureus subsp. aureus MW2
aaugcaauacauuaauauaaa

SEQ ID NO: 2116345 - RNA, 23 nt, Staphylococcus aureus subsp. aureus MW2
aaugcaaguuggcggggcccaaa

SEQ ID NO: 2116346 - RNA, 19 nt, Staphylococcus aureus subsp. aureus MW2
aaugcagauucuucaccaa

SEQ ID NO: 2116347 - RNA, 20 nt, Staphylococcus aureus subsp. aureus MW2
aaucuucuccaaucaucauu

SEQ ID NO: 2116348 - RNA, 23 nt, Staphylococcus aureus subsp. aureus MW2
aaucuucuccaaucaucauuaaa

SEQ ID NO: 2116349 - RNA, 16 nt, Staphylococcus aureus subsp. aureus MW2
aaucuucuuuagcuau

SEQ ID NO: 2116350 - RNA, 14 nt, Staphylococcus aureus subsp. aureus MW2
aaugauuuugcuuu

SEQ ID NO: 2116351 - RNA, 19 nt, Staphylococcus aureus subsp. aureus MW2
aaugauuugugguaaucau

SEQ ID NO: 2116352 - RNA, 11 nt, Staphylococcus aureus subsp. aureus MW2
aaugauuggua

SEQ ID NO: 2116353 - RNA, 22 nt, Staphylococcus aureus subsp. aureus MW2
aaugauugucuuauaagauaua

SEQ ID NO: 2116354 - RNA, 16 nt, Staphylococcus aureus subsp. aureus MW2
aaucuugcauaaccaa

SEQ ID NO: 2116355 - RNA, 20 nt, Staphylococcus aureus subsp. aureus MW2
aaucuugcauaaccaaguaa

SEQ ID NO: 2116356 - RNA, 22 nt, Staphylococcus aureus subsp. aureus MW2
aauguucuaggcuccuaaaugu

SEQ ID NO: 2116357 - RNA, 17 nt, Staphylococcus aureus subsp. aureus MW2
aauguuaucuugcuuau

SEQ ID NO: 2116358 - RNA, 22 nt, Staphylococcus aureus subsp. aureus MW2
aauguuauugcuuauuuuugua

SEQ ID NO: 2116359 - RNA, 19 nt, Staphylococcus aureus subsp. aureus MW2
aauguuaaacacucaaaau

SEQ ID NO: 2116360 - RNA, 19 nt, Staphylococcus aureus subsp. aureus MW2
aauguuaagacauaugcag

SEQ ID NO: 2116361 - RNA, 17 nt, Staphylococcus aureus subsp. aureus MW2
aauguuaaagauuauua

SEQ ID NO: 2116362 - RNA, 14 nt, Staphylococcus aureus subsp. aureus MW2
aauguuaauaauga

SEQ ID NO: 2116363 - RNA, 16 nt, Staphylococcus aureus subsp. aureus MW2
aauguuaaauucuaaa

SEQ ID NO: 2116364 - RNA, 15 nt, Staphylococcus aureus subsp. aureus MW2
aauguuacauuugaa

SEQ ID NO: 2116365 - RNA, 15 nt, Staphylococcus aureus subsp. aureus MW2
aauguuagauuucaa

SEQ ID NO: 2116366 - RNA, 19 nt, Staphylococcus aureus subsp. aureus MW2
aauguuacacaaauuaaaa

SEQ ID NO: 2116367 - RNA, 15 nt, Staphylococcus aureus subsp. aureus MW2
aaugugaugauuaau

SEQ ID NO: 2116368 - RNA, 18 nt, Staphylococcus aureus subsp. aureus MW2
aaugugaugguucaaaua

SEQ ID NO: 2116369 - RNA, 16 nt, Staphylococcus aureus subsp. aureus MW2
aaugugauuuucuuuc

SEQ ID NO: 2116370 - RNA, 23 nt, Staphylococcus aureus subsp. aureus MW2
aaugugauuuucuuucauaaauu

SEQ ID NO: 2116371 - RNA, 16 nt, Staphylococcus aureus subsp. aureus MW2
aaugucucuuuucacg

SEQ ID NO: 2116372 - RNA, 21 nt, Staphylococcus aureus subsp. aureus MW2
aaugugcauugcuuuuguuaa

SEQ ID NO: 2116373 - RNA, 21 nt, Staphylococcus aureus subsp. aureus MW2
aauguggaacaugauucauga

SEQ ID NO: 2116374 - RNA, 18 nt, Staphylococcus aureus subsp. aureus MW2
aaugugcgaacuugcuuu

SEQ ID NO: 2116375 - RNA, 23 nt, Staphylococcus aureus subsp. aureus MW2
aauguguaugguuuuguacauau

SEQ ID NO: 2116376 - RNA, 23 nt, Staphylococcus aureus subsp. aureus MW2
aauguguuaauacuucauauccu

SEQ ID NO: 2116377 - RNA, 22 nt, Staphylococcus aureus subsp. aureus MW2
aauguguaugguuuuguacaua

SEQ ID NO: 2116378 - RNA, 15 nt, Staphylococcus aureus subsp. aureus MW2
aauguguuaaaauau

SEQ ID NO: 2116379 - RNA, 14 nt, Staphylococcus aureus subsp. aureus MW2
aauguguaugguuu

SEQ ID NO: 2116380 - RNA, 22 nt, Staphylococcus aureus subsp. aureus MW2
aauguauuuugaucugugcuug

SEQ ID NO: 2116381 - RNA, 21 nt, Staphylococcus aureus subsp. aureus MW2
aauguauugcuauaagaacua

SEQ ID NO: 2116382 - RNA, 23 nt, Staphylococcus aureus subsp. aureus MW2
aaugucauagccuauuuaaaaga

SEQ ID NO: 2116383 - RNA, 18 nt, Staphylococcus aureus subsp. aureus MW2
aaugucgaucuaacaauu

SEQ ID NO: 2116384 - RNA, 20 nt, Staphylococcus aureus subsp. aureus MW2
aauguccgauuugauaaaaa

SEQ ID NO: 2116385 - RNA, 22 nt, Staphylococcus aureus subsp. aureus MW2
aauguccgauuugauaaaaaau

SEQ ID NO: 2116386 - RNA, 22 nt, Staphylococcus aureus subsp. aureus MW2
aaugugagauacguuauuucaa

SEQ ID NO: 2116387 - RNA, 14 nt, Staphylococcus aureus subsp. aureus MW2
aaugugaugauuaa

SEQ ID NO: 2116388 - RNA, 14 nt, Staphylococcus aureus subsp. aureus MW2
aaugucuucauaau

SEQ ID NO: 2116389 - RNA, 22 nt, Staphylococcus aureus subsp. aureus MW2
aaugucgcacuauaaaauucac

SEQ ID NO: 2116390 - RNA, 18 nt, Staphylococcus aureus subsp. aureus MW2
aauuaaagauuaaaauau

SEQ ID NO: 2116391 - RNA, 17 nt, Staphylococcus aureus subsp. aureus MW2
aauuaaacuuaagaaua

SEQ ID NO: 2116392 - RNA, 16 nt, Staphylococcus aureus subsp. aureus MW2
aauuaaauaaaaauau

SEQ ID NO: 2116393 - RNA, 13 nt, Staphylococcus aureus subsp. aureus MW2
aauuaaauaauga

SEQ ID NO: 2116394 - RNA, 18 nt, Staphylococcus aureus subsp. aureus MW2
aauuaaaacuauaauaaa

SEQ ID NO: 2116395 - RNA, 15 nt, Staphylococcus aureus subsp. aureus MW2
aauuaaaauguuaau

SEQ ID NO: 2116396 - RNA, 21 nt, Staphylococcus aureus subsp. aureus MW2
aauuaaacaaaacuuaaaaua

SEQ ID NO: 2116397 - RNA, 23 nt, Staphylococcus aureus subsp. aureus MW2
aauuaaacaaaacuuaaaauauu

SEQ ID NO: 2116398 - RNA, 13 nt, Staphylococcus aureus subsp. aureus MW2
aauuaaacauuua

SEQ ID NO: 2116399 - RNA, 12 nt, Staphylococcus aureus subsp. aureus MW2
aauuaacaauau

SEQ ID NO: 2116400 - RNA, 19 nt, Staphylococcus aureus subsp. aureus MW2
aauuaacaauauuaaauuu

SEQ ID NO: 2116401 - RNA, 19 nt, Staphylococcus aureus subsp. aureus MW2
aauuaacacucagauuuua

SEQ ID NO: 2116402 - RNA, 17 nt, Staphylococcus aureus subsp. aureus MW2
aauuaacaacaaauaua

SEQ ID NO: 2116403 - RNA, 18 nt, Staphylococcus aureus subsp. aureus MW2
aauuaaccuugauuuaau

SEQ ID NO: 2116404 - RNA, 15 nt, Staphylococcus aureus subsp. aureus MW2
aauuaaauauuuaac

SEQ ID NO: 2116405 - RNA, 16 nt, Staphylococcus aureus subsp. aureus MW2
aauuaaaucuucaagu

SEQ ID NO: 2116406 - RNA, 23 nt, Staphylococcus aureus subsp. aureus MW2
aauuaaaugcauaauauauuaaa

SEQ ID NO: 2116407 - RNA, 18 nt, Staphylococcus aureus subsp. aureus MW2
aauuaaauuauauguuuu

SEQ ID NO: 2116408 - RNA, 14 nt, Staphylococcus aureus subsp. aureus MW2
aauuaaauucaaau

SEQ ID NO: 2116409 - RNA, 11 nt, Staphylococcus aureus subsp. aureus MW2
aauuaaaacag

SEQ ID NO: 2116410 - RNA, 18 nt, Staphylococcus aureus subsp. aureus MW2
aauuaaaaaacaauaaaa

SEQ ID NO: 2116411 - RNA, 14 nt, Staphylococcus aureus subsp. aureus MW2
aauuaaaaaacaau

SEQ ID NO: 2116412 - RNA, 20 nt, Staphylococcus aureus subsp. aureus MW2
aauuaaaaaacaauaaaauu

SEQ ID NO: 2116413 - RNA, 13 nt, Staphylococcus aureus subsp. aureus MW2
aauuaaaaacacc

SEQ ID NO: 2116414 - RNA, 14 nt, Staphylococcus aureus subsp. aureus MW2
aauuaaaaaacaaa

SEQ ID NO: 2116415 - RNA, 18 nt, Staphylococcus aureus subsp. aureus MW2
aauguuuuguguauuuau

SEQ ID NO: 2116416 - RNA, 16 nt, Staphylococcus aureus subsp. aureus MW2
aauguuuuggaaaaau

SEQ ID NO: 2116417 - RNA, 19 nt, Staphylococcus aureus subsp. aureus MW2
aauguuuugacuauguugu

SEQ ID NO: 2116418 - RNA, 12 nt, Staphylococcus aureus subsp. aureus MW2
aauguuugcuuu

SEQ ID NO: 2116419 - RNA, 13 nt, Staphylococcus aureus subsp. aureus MW2
aauguuucuccua

SEQ ID NO: 2116420 - RNA, 14 nt, Staphylococcus aureus subsp. aureus MW2
aauguuucaaauuu

SEQ ID NO: 2116421 - RNA, 14 nt, Staphylococcus aureus subsp. aureus MW2
aauguuuaaaaaac

SEQ ID NO: 2116422 - RNA, 15 nt, Staphylococcus aureus subsp. aureus MW2
aauguuuauaucuuu

SEQ ID NO: 2116423 - RNA, 23 nt, Staphylococcus aureus subsp. aureus MW2
aauguuggaaaaggucaaaaaau

SEQ ID NO: 2116424 - RNA, 21 nt, Staphylococcus aureus subsp. aureus MW2
aauucuagucaggggccccaa

SEQ ID NO: 2116425 - RNA, 21 nt, Staphylococcus aureus subsp. aureus MW2
aauuccuggugcaauaauaaa

SEQ ID NO: 2116426 - RNA, 17 nt, Staphylococcus aureus subsp. aureus MW2
aauucauuccaaacaca

SEQ ID NO: 2116427 - RNA, 21 nt, Staphylococcus aureus subsp. aureus MW2
aauucauuccaaacacacugu

SEQ ID NO: 2116428 - RNA, 17 nt, Staphylococcus aureus subsp. aureus MW2
aauuccaaagaaagcua

SEQ ID NO: 2116429 - RNA, 21 nt, Staphylococcus aureus subsp. aureus MW2
aauuccccaaagccuucuauc

SEQ ID NO: 2116430 - RNA, 21 nt, Staphylococcus aureus subsp. aureus MW2
aauuccucuggaacuuuaaua

SEQ ID NO: 2116431 - RNA, 20 nt, Staphylococcus aureus subsp. aureus MW2
aauuaucauaugugauuuaa

SEQ ID NO: 2116432 - RNA, 20 nt, Staphylococcus aureus subsp. aureus MW2
aauuaucagaaucaaguaau

SEQ ID NO: 2116433 - RNA, 20 nt, Staphylococcus aureus subsp. aureus MW2
aauuaucuuaagucaucaau

SEQ ID NO: 2116434 - RNA, 13 nt, Staphylococcus aureus subsp. aureus MW2
aauuaucuauaua

SEQ ID NO: 2116435 - RNA, 17 nt, Staphylococcus aureus subsp. aureus MW2
aauuaucuauauaugaa

SEQ ID NO: 2116436 - RNA, 17 nt, Staphylococcus aureus subsp. aureus MW2
aauuauaaaugauuaaa

SEQ ID NO: 2116437 - RNA, 21 nt, Staphylococcus aureus subsp. aureus MW2
aauuaguuuuuguuuacagau

SEQ ID NO: 2116438 - RNA, 17 nt, Staphylococcus aureus subsp. aureus MW2
aauuauaauuguaaugc

SEQ ID NO: 2116439 - RNA, 12 nt, Staphylococcus aureus subsp. aureus MW2
aauuaagaaaag

SEQ ID NO: 2116440 - RNA, 22 nt, Staphylococcus aureus subsp. aureus MW2
aauuaagaaaaucauucauuug

SEQ ID NO: 2116441 - RNA, 12 nt, Staphylococcus aureus subsp. aureus MW2
aauuaacuugau

SEQ ID NO: 2116442 - RNA, 17 nt, Staphylococcus aureus subsp. aureus MW2
aauuaagaugaaauacu

SEQ ID NO: 2116443 - RNA, 19 nt, Staphylococcus aureus subsp. aureus MW2
aauucaggauggaaugaua

SEQ ID NO: 2116444 - RNA, 16 nt, Staphylococcus aureus subsp. aureus MW2
aauucacuuuuaacug

SEQ ID NO: 2116445 - RNA, 23 nt, Staphylococcus aureus subsp. aureus MW2
aauucaguaaucuuguuuucauu

SEQ ID NO: 2116446 - RNA, 19 nt, Staphylococcus aureus subsp. aureus MW2
aauucacuuauacauguaa

SEQ ID NO: 2116447 - RNA, 15 nt, Staphylococcus aureus subsp. aureus MW2
aauuauuauaauaaa

SEQ ID NO: 2116448 - RNA, 13 nt, Staphylococcus aureus subsp. aureus MW2
aauuauuauaaua

SEQ ID NO: 2116449 - RNA, 23 nt, Staphylococcus aureus subsp. aureus MW2
aauuauuccuucauugaagaaua

SEQ ID NO: 2116450 - RNA, 20 nt, Staphylococcus aureus subsp. aureus MW2
aauuauuauugcugugauug

SEQ ID NO: 2116451 - RNA, 20 nt, Staphylococcus aureus subsp. aureus MW2
aauuauuauuuaaauuuuca

SEQ ID NO: 2116452 - RNA, 17 nt, Staphylococcus aureus subsp. aureus MW2
aauuauugcaucauaau

SEQ ID NO: 2116453 - RNA, 18 nt, Staphylococcus aureus subsp. aureus MW2
aauuauugagaauauuua

SEQ ID NO: 2116454 - RNA, 11 nt, Staphylococcus aureus subsp. aureus MW2
aauuauuuaau

SEQ ID NO: 2116455 - RNA, 19 nt, Staphylococcus aureus subsp. aureus MW2
aauuauucaaguaaaacau

SEQ ID NO: 2116456 - RNA, 12 nt, Staphylococcus aureus subsp. aureus MW2
aauuguauuuuc

SEQ ID NO: 2116457 - RNA, 16 nt, Staphylococcus aureus subsp. aureus MW2
aauuguauuuucugcu

SEQ ID NO: 2116458 - RNA, 22 nt, Staphylococcus aureus subsp. aureus MW2
aauuguauuaaucaaauauuuu

SEQ ID NO: 2116459 - RNA, 15 nt, Staphylococcus aureus subsp. aureus MW2
aauuguauuauuauu

SEQ ID NO: 2116460 - RNA, 16 nt, Staphylococcus aureus subsp. aureus MW2
aauuguaguaaugaag

SEQ ID NO: 2116461 - RNA, 13 nt, Staphylococcus aureus subsp. aureus MW2
aauuguauagaau

SEQ ID NO: 2116462 - RNA, 18 nt, Staphylococcus aureus subsp. aureus MW2
aauuguagauccaauucc

SEQ ID NO: 2116463 - RNA, 20 nt, Staphylococcus aureus subsp. aureus MW2
aauugguuuggauaaaauga

SEQ ID NO: 2116464 - RNA, 22 nt, Staphylococcus aureus subsp. aureus MW2
aauugguuuggauaaaaugaua

SEQ ID NO: 2116465 - RNA, 20 nt, Staphylococcus aureus subsp. aureus MW2
aauuguaaucuauuuucugc

SEQ ID NO: 2116466 - RNA, 12 nt, Staphylococcus aureus subsp. aureus MW2
aauuguaauacu

SEQ ID NO: 2116467 - RNA, 19 nt, Staphylococcus aureus subsp. aureus MW2
aauuguucuaauacaccaa

SEQ ID NO: 2116468 - RNA, 16 nt, Staphylococcus aureus subsp. aureus MW2
aauuguuacuaguucu

SEQ ID NO: 2116469 - RNA, 21 nt, Staphylococcus aureus subsp. aureus MW2
aauuguguugaaucaacaguu

SEQ ID NO: 2116470 - RNA, 14 nt, Staphylococcus aureus subsp. aureus MW2
aauuguuaauuuca

SEQ ID NO: 2116471 - RNA, 17 nt, Staphylococcus aureus subsp. aureus MW2
aauugugcuuuuucaua

SEQ ID NO: 2116472 - RNA, 20 nt, Staphylococcus aureus subsp. aureus MW2
aauuuaaaacaaugauuaaa

SEQ ID NO: 2116473 - RNA, 21 nt, Staphylococcus aureus subsp. aureus MW2
aauuuaaaacaaugauuaaaa

SEQ ID NO: 2116474 - RNA, 15 nt, Staphylococcus aureus subsp. aureus MW2
aauuuaaaaauagua

SEQ ID NO: 2116475 - RNA, 20 nt, Staphylococcus aureus subsp. aureus MW2
aauuuaaaaauaguucuuua

SEQ ID NO: 2116476 - RNA, 14 nt, Staphylococcus aureus subsp. aureus MW2
aauuuaaaagaaaa

SEQ ID NO: 2116477 - RNA, 15 nt, Staphylococcus aureus subsp. aureus MW2
aauuuaaaagaaaaa

SEQ ID NO: 2116478 - RNA, 18 nt, Staphylococcus aureus subsp. aureus MW2
aauuguuguacauguauu

SEQ ID NO: 2116479 - RNA, 19 nt, Staphylococcus aureus subsp. aureus MW2
aauuguuuaauaacaaaau

SEQ ID NO: 2116480 - RNA, 15 nt, Staphylococcus aureus subsp. aureus MW2
aauuguugcauuacu

SEQ ID NO: 2116481 - RNA, 16 nt, Staphylococcus aureus subsp. aureus MW2
aauuuaauauuguuaa

SEQ ID NO: 2116482 - RNA, 20 nt, Staphylococcus aureus subsp. aureus MW2
aauuuaauaugcuauguaaa

SEQ ID NO: 2116483 - RNA, 15 nt, Staphylococcus aureus subsp. aureus MW2
aauuuaauauuauaa

SEQ ID NO: 2116484 - RNA, 16 nt, Staphylococcus aureus subsp. aureus MW2
aauuuaauauuauaag

SEQ ID NO: 2116485 - RNA, 17 nt, Staphylococcus aureus subsp. aureus MW2
aauuuaauuucaacaac

SEQ ID NO: 2116486 - RNA, 15 nt, Staphylococcus aureus subsp. aureus MW2
aauuuaauuuuauuu

SEQ ID NO: 2116487 - RNA, 18 nt, Staphylococcus aureus subsp. aureus MW2
aauuuagucauuacaaau

SEQ ID NO: 2116488 - RNA, 21 nt, Staphylococcus aureus subsp. aureus MW2
aauuuaguauaaauaaaaaua

SEQ ID NO: 2116489 - RNA, 21 nt, Staphylococcus aureus subsp. aureus MW2
aauuuagguggagauuuaaca

SEQ ID NO: 2116490 - RNA, 13 nt, Staphylococcus aureus subsp. aureus MW2
aauuuagguuaau

SEQ ID NO: 2116491 - RNA, 17 nt, Staphylococcus aureus subsp. aureus MW2
aauuuagguuaauuaaa

SEQ ID NO: 2116492 - RNA, 18 nt, Staphylococcus aureus subsp. aureus MW2
aauugcucuuuaacaaug

SEQ ID NO: 2116493 - RNA, 15 nt, Staphylococcus aureus subsp. aureus MW2
aauugcugucacuaa

SEQ ID NO: 2116494 - RNA, 13 nt, Staphylococcus aureus subsp. aureus MW2
aauugcuuguucu

SEQ ID NO: 2116495 - RNA, 16 nt, Staphylococcus aureus subsp. aureus MW2
aauuggauuaaauacg

SEQ ID NO: 2116496 - RNA, 17 nt, Staphylococcus aureus subsp. aureus MW2
aauugcuuguucuuucu

SEQ ID NO: 2116497 - RNA, 17 nt, Staphylococcus aureus subsp. aureus MW2
aauugcuuuagaaaguc

SEQ ID NO: 2116498 - RNA, 16 nt, Staphylococcus aureus subsp. aureus MW2
aauuggcagauagaau

SEQ ID NO: 2116499 - RNA, 15 nt, Staphylococcus aureus subsp. aureus MW2
aauuggaaguauuua

SEQ ID NO: 2116500 - RNA, 22 nt, Staphylococcus aureus subsp. aureus MW2
aauugguauaacaauuuuagac

SEQ ID NO: 2116501 - RNA, 23 nt, Staphylococcus aureus subsp. aureus MW2
aauuggucgucauaccuauaaau

SEQ ID NO: 2116502 - RNA, 17 nt, Staphylococcus aureus subsp. aureus MW2
aaaacaauaaaauuacu

SEQ ID NO: 2116503 - RNA, 18 nt, Staphylococcus aureus subsp. aureus MW2
aauugcauuacuacaaac

SEQ ID NO: 2116504 - RNA, 19 nt, Staphylococcus aureus subsp. aureus MW2
aaaacaaauuacacccuuu

SEQ ID NO: 2116505 - RNA, 15 nt, Staphylococcus aureus subsp. aureus MW2
aaaacaaauguuuua

SEQ ID NO: 2116506 - RNA, 17 nt, Staphylococcus aureus subsp. aureus MW2
aaaacaaagguuuguaa

SEQ ID NO: 2116507 - RNA, 12 nt, Staphylococcus aureus subsp. aureus MW2
aauugaaaugau

SEQ ID NO: 2116508 - RNA, 21 nt, Staphylococcus aureus subsp. aureus MW2
aauucuuuuucagcuaauugu

SEQ ID NO: 2116509 - RNA, 11 nt, Staphylococcus aureus subsp. aureus MW2
aauugaaaauc

SEQ ID NO: 2116510 - RNA, 13 nt, Staphylococcus aureus subsp. aureus MW2
aauugaaaugaua

SEQ ID NO: 2116511 - RNA, 17 nt, Staphylococcus aureus subsp. aureus MW2
aauugaaaugauaaaaa

SEQ ID NO: 2116512 - RNA, 15 nt, Staphylococcus aureus subsp. aureus MW2
aauugaaauuaacug

SEQ ID NO: 2116513 - RNA, 23 nt, Staphylococcus aureus subsp. aureus MW2
aauucuuuuucagcuaauugucg

SEQ ID NO: 2116514 - RNA, 12 nt, Staphylococcus aureus subsp. aureus MW2
aauugaaauuau

SEQ ID NO: 2116515 - RNA, 17 nt, Staphylococcus aureus subsp. aureus MW2
aauucuggauuaaaccc

SEQ ID NO: 2116516 - RNA, 18 nt, Staphylococcus aureus subsp. aureus MW2
aauucuuuucaagaaauu

SEQ ID NO: 2116517 - RNA, 13 nt, Staphylococcus aureus subsp. aureus MW2
aauucuuuuguaa

SEQ ID NO: 2116518 - RNA, 13 nt, Staphylococcus aureus subsp. aureus MW2
aaucaaaucaaua

SEQ ID NO: 2116519 - RNA, 23 nt, Staphylococcus aureus subsp. aureus MW2
aaucaaagggcuucgauucauaa

SEQ ID NO: 2116520 - RNA, 18 nt, Staphylococcus aureus subsp. aureus MW2
aaucaaaugguacaguua

SEQ ID NO: 2116521 - RNA, 15 nt, Staphylococcus aureus subsp. aureus MW2
aaucaaauugaccau

SEQ ID NO: 2116522 - RNA, 21 nt, Staphylococcus aureus subsp. aureus MW2
aaucaacaucaucuuuaauuu

SEQ ID NO: 2116523 - RNA, 14 nt, Staphylococcus aureus subsp. aureus MW2
aaucaacaauauaa

SEQ ID NO: 2116524 - RNA, 19 nt, Staphylococcus aureus subsp. aureus MW2
aaucaagcaaugcaugcuu

SEQ ID NO: 2116525 - RNA, 13 nt, Staphylococcus aureus subsp. aureus MW2
aaucaagcaaugc

SEQ ID NO: 2116526 - RNA, 12 nt, Staphylococcus aureus subsp. aureus MW2
aaucaagaauau

SEQ ID NO: 2116527 - RNA, 22 nt, Staphylococcus aureus subsp. aureus MW2
aaucaacguauauaaguuaaaa

SEQ ID NO: 2116528 - RNA, 23 nt, Staphylococcus aureus subsp. aureus MW2
aaucaacuuuuuguuaauuuuuu

SEQ ID NO: 2116529 - RNA, 15 nt, Staphylococcus aureus subsp. aureus MW2
aaucaacuucauaua

SEQ ID NO: 2116530 - RNA, 12 nt, Staphylococcus aureus subsp. aureus MW2
aaucaauacuaa

SEQ ID NO: 2116531 - RNA, 14 nt, Staphylococcus aureus subsp. aureus MW2
aaucacauaugaua

SEQ ID NO: 2116532 - RNA, 14 nt, Staphylococcus aureus subsp. aureus MW2
aaucacaauacgaa

SEQ ID NO: 2116533 - RNA, 13 nt, Staphylococcus aureus subsp. aureus MW2
aaucacaauauaa

SEQ ID NO: 2116534 - RNA, 14 nt, Staphylococcus aureus subsp. aureus MW2
aaucacaguuauau

SEQ ID NO: 2116535 - RNA, 18 nt, Staphylococcus aureus subsp. aureus MW2
aaucacaguuauauauua

SEQ ID NO: 2116536 - RNA, 20 nt, Staphylococcus aureus subsp. aureus MW2
aaucacauaacaaacauacc

SEQ ID NO: 2116537 - RNA, 20 nt, Staphylococcus aureus subsp. aureus MW2
aaucacgauuaaugucacau

SEQ ID NO: 2116538 - RNA, 23 nt, Staphylococcus aureus subsp. aureus MW2
aaucacuuggcgacauuuguaaa

SEQ ID NO: 2116539 - RNA, 16 nt, Staphylococcus aureus subsp. aureus MW2
aaucacuucugaaaau

SEQ ID NO: 2116540 - RNA, 22 nt, Staphylococcus aureus subsp. aureus MW2
aaucacuccucuauuuuaugau

SEQ ID NO: 2116541 - RNA, 23 nt, Staphylococcus aureus subsp. aureus MW2
aaucacuauuuguuguuauauaa

SEQ ID NO: 2116542 - RNA, 17 nt, Staphylococcus aureus subsp. aureus MW2
aaucacgauuuucaagu

SEQ ID NO: 2116543 - RNA, 15 nt, Staphylococcus aureus subsp. aureus MW2
aaucacgcuaacauu

SEQ ID NO: 2116544 - RNA, 13 nt, Staphylococcus aureus subsp. aureus MW2
aauagcauuugua

SEQ ID NO: 2116545 - RNA, 15 nt, Staphylococcus aureus subsp. aureus MW2
aauagccauaucaua

SEQ ID NO: 2116546 - RNA, 18 nt, Staphylococcus aureus subsp. aureus MW2
aauagccauaucauauua

SEQ ID NO: 2116547 - RNA, 19 nt, Staphylococcus aureus subsp. aureus MW2
aauaugauugaaugaagcu

SEQ ID NO: 2116548 - RNA, 17 nt, Staphylococcus aureus subsp. aureus MW2
aauaugauuaauaaagu

SEQ ID NO: 2116549 - RNA, 14 nt, Staphylococcus aureus subsp. aureus MW2
aauaugauguuaaa

SEQ ID NO: 2116550 - RNA, 15 nt, Staphylococcus aureus subsp. aureus MW2
aauaugaucuaacau

SEQ ID NO: 2116551 - RNA, 22 nt, Staphylococcus aureus subsp. aureus MW2
aauagcccuuuauacaauuuuu

SEQ ID NO: 2116552 - RNA, 17 nt, Staphylococcus aureus subsp. aureus MW2
aauaugcuuuuaauagu

SEQ ID NO: 2116553 - RNA, 16 nt, Staphylococcus aureus subsp. aureus MW2
aauauuaaauucaucu

SEQ ID NO: 2116554 - RNA, 14 nt, Staphylococcus aureus subsp. aureus MW2
aauauuaacaccag

SEQ ID NO: 2116555 - RNA, 14 nt, Staphylococcus aureus subsp. aureus MW2
aauauuaaauucau

SEQ ID NO: 2116556 - RNA, 18 nt, Staphylococcus aureus subsp. aureus MW2
aauauuaaaauuaaaacu

SEQ ID NO: 2116557 - RNA, 21 nt, Staphylococcus aureus subsp. aureus MW2
aauauuaaauuucugaacaua

SEQ ID NO: 2116558 - RNA, 17 nt, Staphylococcus aureus subsp. aureus MW2
aauauuaaucaauuuau

SEQ ID NO: 2116559 - RNA, 14 nt, Staphylococcus aureus subsp. aureus MW2
aauauuaauaaagu

SEQ ID NO: 2116560 - RNA, 19 nt, Staphylococcus aureus subsp. aureus MW2
aauauuacuuuaucucauu

SEQ ID NO: 2116561 - RNA, 19 nt, Staphylococcus aureus subsp. aureus MW2
aauauuauaaaaagauaua

SEQ ID NO: 2116562 - RNA, 18 nt, Staphylococcus aureus subsp. aureus MW2
aauauuauuaaaucaaag

SEQ ID NO: 2116563 - RNA, 18 nt, Staphylococcus aureus subsp. aureus MW2
aauauggaauuucauaua

SEQ ID NO: 2116564 - RNA, 13 nt, Staphylococcus aureus subsp. aureus MW2
aauauguuaauuu

SEQ ID NO: 2116565 - RNA, 11 nt, Staphylococcus aureus subsp. aureus MW2
aauauuaaaau

SEQ ID NO: 2116566 - RNA, 21 nt, Staphylococcus aureus subsp. aureus MW2
aauauguggcgcucuuauaaa

SEQ ID NO: 2116567 - RNA, 20 nt, Staphylococcus aureus subsp. aureus MW2
aauauucgauacauaaaaca

SEQ ID NO: 2116568 - RNA, 21 nt, Staphylococcus aureus subsp. aureus MW2
aauauuauuuuuaagugauga

SEQ ID NO: 2116569 - RNA, 13 nt, Staphylococcus aureus subsp. aureus MW2
aauauuauuuuua

SEQ ID NO: 2116570 - RNA, 17 nt, Staphylococcus aureus subsp. aureus MW2
aauauucaacuuguuaa

SEQ ID NO: 2116571 - RNA, 20 nt, Staphylococcus aureus subsp. aureus MW2
aauauuauucauaauauauu

SEQ ID NO: 2116572 - RNA, 16 nt, Staphylococcus aureus subsp. aureus MW2
aauauucaauaauuca

SEQ ID NO: 2116573 - RNA, 16 nt, Staphylococcus aureus subsp. aureus MW2
aauauugcguuuaauu

SEQ ID NO: 2116574 - RNA, 15 nt, Staphylococcus aureus subsp. aureus MW2
aauauugucuucauu

SEQ ID NO: 2116575 - RNA, 20 nt, Staphylococcus aureus subsp. aureus MW2
aauauugauucuagugaaau

SEQ ID NO: 2116576 - RNA, 18 nt, Staphylococcus aureus subsp. aureus MW2
aauauugaauaaaaaaac

SEQ ID NO: 2116577 - RNA, 19 nt, Staphylococcus aureus subsp. aureus MW2
aauauugaauaaaaaaaca

SEQ ID NO: 2116578 - RNA, 22 nt, Staphylococcus aureus subsp. aureus MW2
aauauuuauauuaaauacuaua

SEQ ID NO: 2116579 - RNA, 21 nt, Staphylococcus aureus subsp. aureus MW2
aauauuuacauugccacuuuu

SEQ ID NO: 2116580 - RNA, 17 nt, Staphylococcus aureus subsp. aureus MW2
aauauuuaaacuaguaa

SEQ ID NO: 2116581 - RNA, 13 nt, Staphylococcus aureus subsp. aureus MW2
aauauuuaaauag

SEQ ID NO: 2116582 - RNA, 18 nt, Staphylococcus aureus subsp. aureus MW2
aauauuuaaaaaacaaau

SEQ ID NO: 2116583 - RNA, 14 nt, Staphylococcus aureus subsp. aureus MW2
aauauuuaaguuuc

SEQ ID NO: 2116584 - RNA, 20 nt, Staphylococcus aureus subsp. aureus MW2
aauauuucccuaugaaauaa

SEQ ID NO: 2116585 - RNA, 17 nt, Staphylococcus aureus subsp. aureus MW2
aauauuucuaaaccauu

SEQ ID NO: 2116586 - RNA, 23 nt, Staphylococcus aureus subsp. aureus MW2
aauauuuuuguugcaauugccuu

SEQ ID NO: 2116587 - RNA, 13 nt, Staphylococcus aureus subsp. aureus MW2
aauauuuuuuaaa

SEQ ID NO: 2116588 - RNA, 21 nt, Staphylococcus aureus subsp. aureus MW2
aauauuuuuugauauuugauc

SEQ ID NO: 2116589 - RNA, 23 nt, Staphylococcus aureus subsp. aureus MW2
aauauuuuucaauuaaauguuua

SEQ ID NO: 2116590 - RNA, 12 nt, Staphylococcus aureus subsp. aureus MW2
aauauuugauaa

SEQ ID NO: 2116591 - RNA, 21 nt, Staphylococcus aureus subsp. aureus MW2
aauauuugauaaguagaaaau

SEQ ID NO: 2116592 - RNA, 22 nt, Staphylococcus aureus subsp. aureus MW2
aauauuugauaaguagaaaaua

SEQ ID NO: 2116593 - RNA, 11 nt, Staphylococcus aureus subsp. aureus MW2
aauauuugauu

SEQ ID NO: 2116594 - RNA, 22 nt, Staphylococcus aureus subsp. aureus MW2
aauauuuucuuagaaaaucaag

SEQ ID NO: 2116595 - RNA, 20 nt, Staphylococcus aureus subsp. aureus MW2
aauauuuuuacauauuuaua

SEQ ID NO: 2116596 - RNA, 20 nt, Staphylococcus aureus subsp. aureus MW2
aaucuguacuucuaauuugc

SEQ ID NO: 2116597 - RNA, 18 nt, Staphylococcus aureus subsp. aureus MW2
aaucuucuaauuaagaau

SEQ ID NO: 2116598 - RNA, 23 nt, Staphylococcus aureus subsp. aureus MW2
aaucuuauuuuguuuuaaaaaac

SEQ ID NO: 2116599 - RNA, 21 nt, Staphylococcus aureus subsp. aureus MW2
aaucuuaugaugucauguauu

SEQ ID NO: 2116600 - RNA, 18 nt, Staphylococcus aureus subsp. aureus MW2
aaucuuaguacaaaauug

SEQ ID NO: 2116601 - RNA, 17 nt, Staphylococcus aureus subsp. aureus MW2
aaucuuaguacaaaauu

SEQ ID NO: 2116602 - RNA, 19 nt, Staphylococcus aureus subsp. aureus MW2
aaucucuuuagaugagauu

SEQ ID NO: 2116603 - RNA, 21 nt, Staphylococcus aureus subsp. aureus MW2
aaucucaugccaaaaacauua

SEQ ID NO: 2116604 - RNA, 20 nt, Staphylococcus aureus subsp. aureus MW2
aaucugaagguaauuuaaca

SEQ ID NO: 2116605 - RNA, 16 nt, Staphylococcus aureus subsp. aureus MW2
aaucucuuuacaccau

SEQ ID NO: 2116606 - RNA, 15 nt, Staphylococcus aureus subsp. aureus MW2
aaucugauucauuaa

SEQ ID NO: 2116607 - RNA, 15 nt, Staphylococcus aureus subsp. aureus MW2
aaucugcaaaugccu

SEQ ID NO: 2116608 - RNA, 19 nt, Staphylococcus aureus subsp. aureus MW2
aaucugcaacgauuuuaaa

SEQ ID NO: 2116609 - RNA, 12 nt, Staphylococcus aureus subsp. aureus MW2
aaaaauuguaaa

SEQ ID NO: 2116610 - RNA, 16 nt, Staphylococcus aureus subsp. aureus MW2
aaaaauuuaaauaaua

SEQ ID NO: 2116611 - RNA, 22 nt, Staphylococcus aureus subsp. aureus MW2
aaaaauugcuauauuaguauaa

SEQ ID NO: 2116612 - RNA, 21 nt, Staphylococcus aureus subsp. aureus MW2
aaaaauugcaaugcuaucaug

SEQ ID NO: 2116613 - RNA, 20 nt, Staphylococcus aureus subsp. aureus MW2
aaucgucauauuaauauuuu

SEQ ID NO: 2116614 - RNA, 21 nt, Staphylococcus aureus subsp. aureus MW2
aaucguauuagccaauaaaau

SEQ ID NO: 2116615 - RNA, 16 nt, Staphylococcus aureus subsp. aureus MW2
aaucuauuuuaaacuc

SEQ ID NO: 2116616 - RNA, 16 nt, Staphylococcus aureus subsp. aureus MW2
aaucuauugugauaua

SEQ ID NO: 2116617 - RNA, 13 nt, Staphylococcus aureus subsp. aureus MW2
aaucuauuuuaaa

SEQ ID NO: 2116618 - RNA, 20 nt, Staphylococcus aureus subsp. aureus MW2
aaucguuccaacaacuaaga

SEQ ID NO: 2116619 - RNA, 22 nt, Staphylococcus aureus subsp. aureus MW2
aaucguuccaccgaacccuguu

SEQ ID NO: 2116620 - RNA, 14 nt, Staphylococcus aureus subsp. aureus MW2
aaucguuaaaacac

SEQ ID NO: 2116621 - RNA, 14 nt, Staphylococcus aureus subsp. aureus MW2
aaucguuaaggaaa

SEQ ID NO: 2116622 - RNA, 19 nt, Staphylococcus aureus subsp. aureus MW2
aaucuaaggccauuuguag

SEQ ID NO: 2116623 - RNA, 18 nt, Staphylococcus aureus subsp. aureus MW2
aaucuacgauuuucaaga

SEQ ID NO: 2116624 - RNA, 12 nt, Staphylococcus aureus subsp. aureus MW2
aaucuacaauau

SEQ ID NO: 2116625 - RNA, 14 nt, Staphylococcus aureus subsp. aureus MW2
aaucuacaauauua

SEQ ID NO: 2116626 - RNA, 21 nt, Staphylococcus aureus subsp. aureus MW2
aauccgauucacucuguaaua

SEQ ID NO: 2116627 - RNA, 20 nt, Staphylococcus aureus subsp. aureus MW2
aauccgauuuugauauaaaa

SEQ ID NO: 2116628 - RNA, 23 nt, Staphylococcus aureus subsp. aureus MW2
aauccgucuuuuuuuaugaaaag

SEQ ID NO: 2116629 - RNA, 23 nt, Staphylococcus aureus subsp. aureus MW2
aauccguaacgaugguugcuuca

SEQ ID NO: 2116630 - RNA, 22 nt, Staphylococcus aureus subsp. aureus MW2
aauccucacaaauuugaauaua

SEQ ID NO: 2116631 - RNA, 23 nt, Staphylococcus aureus subsp. aureus MW2
aauccucaguuauaccauauuua

SEQ ID NO: 2116632 - RNA, 14 nt, Staphylococcus aureus subsp. aureus MW2
aaucgauaacaguu

SEQ ID NO: 2116633 - RNA, 14 nt, Staphylococcus aureus subsp. aureus MW2
aaucgauaaaaugu

SEQ ID NO: 2116634 - RNA, 21 nt, Staphylococcus aureus subsp. aureus MW2
aaucgauuaagaaugcaccaa

SEQ ID NO: 2116635 - RNA, 21 nt, Staphylococcus aureus subsp. aureus MW2
aaucgacuuuuacaaucauca

SEQ ID NO: 2116636 - RNA, 15 nt, Staphylococcus aureus subsp. aureus MW2
aauccuuuauauuua

SEQ ID NO: 2116637 - RNA, 17 nt, Staphylococcus aureus subsp. aureus MW2
aaucgagugauucagga

SEQ ID NO: 2116638 - RNA, 20 nt, Staphylococcus aureus subsp. aureus MW2
aaucaucuuaaugcuaugau

SEQ ID NO: 2116639 - RNA, 18 nt, Staphylococcus aureus subsp. aureus MW2
aaucagaugauuuaauuc

SEQ ID NO: 2116640 - RNA, 18 nt, Staphylococcus aureus subsp. aureus MW2
aaucauguaaugcuuaaa

SEQ ID NO: 2116641 - RNA, 19 nt, Staphylococcus aureus subsp. aureus MW2
aaucauuguaaaugaucau

SEQ ID NO: 2116642 - RNA, 15 nt, Staphylococcus aureus subsp. aureus MW2
aaucauuguggcuuu

SEQ ID NO: 2116643 - RNA, 14 nt, Staphylococcus aureus subsp. aureus MW2
aaucauuuguguau

SEQ ID NO: 2116644 - RNA, 17 nt, Staphylococcus aureus subsp. aureus MW2
aaucaucuuuuugaaau

SEQ ID NO: 2116645 - RNA, 13 nt, Staphylococcus aureus subsp. aureus MW2
aaucaugacauaa

SEQ ID NO: 2116646 - RNA, 13 nt, Staphylococcus aureus subsp. aureus MW2
aaucaugacauag

SEQ ID NO: 2116647 - RNA, 15 nt, Staphylococcus aureus subsp. aureus MW2
aaucaugacauaaaa

SEQ ID NO: 2116648 - RNA, 21 nt, Staphylococcus aureus subsp. aureus MW2
aaucaugcucguuuuuauuca

SEQ ID NO: 2116649 - RNA, 21 nt, Staphylococcus aureus subsp. aureus MW2
aauccaaaaucuuuacuugua

SEQ ID NO: 2116650 - RNA, 19 nt, Staphylococcus aureus subsp. aureus MW2
aaucccauaaugacuauaa

SEQ ID NO: 2116651 - RNA, 14 nt, Staphylococcus aureus subsp. aureus MW2
acaauccugaagag

SEQ ID NO: 2116652 - RNA, 19 nt, Staphylococcus aureus subsp. aureus MW2
acaauccugaagagaaaau

SEQ ID NO: 2116653 - RNA, 21 nt, Staphylococcus aureus subsp. aureus MW2
acaauccugaagagaaaauuu

SEQ ID NO: 2116654 - RNA, 22 nt, Staphylococcus aureus subsp. aureus MW2
acaauccugaagagaaaauuug

SEQ ID NO: 2116655 - RNA, 23 nt, Staphylococcus aureus subsp. aureus MW2
acaauccugaagagaaaauuugu

SEQ ID NO: 2116656 - RNA, 23 nt, Staphylococcus aureus subsp. aureus MW2
acaauauuuuuacauauuuauac

SEQ ID NO: 2116657 - RNA, 21 nt, Staphylococcus aureus subsp. aureus MW2
acaauauuuuuacauauuuau

SEQ ID NO: 2116658 - RNA, 24 nt, Staphylococcus aureus subsp. aureus MW2
acaaucaaauuacaaauuaucuag

SEQ ID NO: 2116659 - RNA, 14 nt, Staphylococcus aureus subsp. aureus MW2
acaaucacgauuaa

SEQ ID NO: 2116660 - RNA, 14 nt, Staphylococcus aureus subsp. aureus MW2
acaaucacagcaau

SEQ ID NO: 2116661 - RNA, 12 nt, Staphylococcus aureus subsp. aureus MW2
acaaucaucuua

SEQ ID NO: 2116662 - RNA, 24 nt, Staphylococcus aureus subsp. aureus MW2
acaaucagauaaguuacuagcauu

SEQ ID NO: 2116663 - RNA, 19 nt, Staphylococcus aureus subsp. aureus MW2
acaaucagauaaguuacua

SEQ ID NO: 2116664 - RNA, 19 nt, Staphylococcus aureus subsp. aureus MW2
acaaucguuuuaaugccug

SEQ ID NO: 2116665 - RNA, 22 nt, Staphylococcus aureus subsp. aureus MW2
acaaucuaaauguaaaaucauu

SEQ ID NO: 2116666 - RNA, 14 nt, Staphylococcus aureus subsp. aureus MW2
acaaugauuaaaau

SEQ ID NO: 2116667 - RNA, 15 nt, Staphylococcus aureus subsp. aureus MW2
acaaugcaaguuggc

SEQ ID NO: 2116668 - RNA, 17 nt, Staphylococcus aureus subsp. aureus MW2
acaauucauaagaaaaa

SEQ ID NO: 2116669 - RNA, 13 nt, Staphylococcus aureus subsp. aureus MW2
acaaugcgcaaug

SEQ ID NO: 2116670 - RNA, 13 nt, Staphylococcus aureus subsp. aureus MW2
acaaugcagcugu

SEQ ID NO: 2116671 - RNA, 15 nt, Staphylococcus aureus subsp. aureus MW2
acaaugcagcuguau

SEQ ID NO: 2116672 - RNA, 15 nt, Staphylococcus aureus subsp. aureus MW2
acaauuuuaucugaa

SEQ ID NO: 2116673 - RNA, 16 nt, Staphylococcus aureus subsp. aureus MW2
acaauuuuaucugaau

SEQ ID NO: 2116674 - RNA, 20 nt, Staphylococcus aureus subsp. aureus MW2
acaauuuuaucugaaucugc

SEQ ID NO: 2116675 - RNA, 22 nt, Staphylococcus aureus subsp. aureus MW2
acaauuuuccuuucaauaauaa

SEQ ID NO: 2116676 - RNA, 22 nt, Staphylococcus aureus subsp. aureus MW2
acaauuuucgaugcauauucau

SEQ ID NO: 2116677 - RNA, 20 nt, Staphylococcus aureus subsp. aureus MW2
acaauucauaagaaaaaugu

SEQ ID NO: 2116678 - RNA, 15 nt, Staphylococcus aureus subsp. aureus MW2
acaauacauaauggu

SEQ ID NO: 2116679 - RNA, 16 nt, Staphylococcus aureus subsp. aureus MW2
acaauacauaaugguu

SEQ ID NO: 2116680 - RNA, 10 nt, Staphylococcus aureus subsp. aureus MW2
acaauaaugu

SEQ ID NO: 2116681 - RNA, 20 nt, Staphylococcus aureus subsp. aureus MW2
acaauaaugugcaaguuggg

SEQ ID NO: 2116682 - RNA, 20 nt, Staphylococcus aureus subsp. aureus MW2
acaaguugcugaauaaaaua

SEQ ID NO: 2116683 - RNA, 19 nt, Staphylococcus aureus subsp. aureus MW2
acaaguugcugaauaaaau

SEQ ID NO: 2116684 - RNA, 17 nt, Staphylococcus aureus subsp. aureus MW2
acaaguugcugaauaaa

SEQ ID NO: 2116685 - RNA, 16 nt, Staphylococcus aureus subsp. aureus MW2
acaaguugcugaauaa

SEQ ID NO: 2116686 - RNA, 16 nt, Staphylococcus aureus subsp. aureus MW2
acaauaaugugcaagu

SEQ ID NO: 2116687 - RNA, 16 nt, Staphylococcus aureus subsp. aureus MW2
acaaguuauuauccaa

SEQ ID NO: 2116688 - RNA, 17 nt, Staphylococcus aureus subsp. aureus MW2
acaaguuacauuaggaa

SEQ ID NO: 2116689 - RNA, 11 nt, Staphylococcus aureus subsp. aureus MW2
acaaguucauu

SEQ ID NO: 2116690 - RNA, 15 nt, Staphylococcus aureus subsp. aureus MW2
acaaguacaauaaua

SEQ ID NO: 2116691 - RNA, 15 nt, Staphylococcus aureus subsp. aureus MW2
acaagguuucaagag

SEQ ID NO: 2116692 - RNA, 15 nt, Staphylococcus aureus subsp. aureus MW2
acaacgacuuucacu

SEQ ID NO: 2116693 - RNA, 18 nt, Staphylococcus aureus subsp. aureus MW2
acaaccugugauaaaaau

SEQ ID NO: 2116694 - RNA, 21 nt, Staphylococcus aureus subsp. aureus MW2
acaaccugugauaaaaaucuu

SEQ ID NO: 2116695 - RNA, 24 nt, Staphylococcus aureus subsp. aureus MW2
acaagcuauaaauccaaugaugaa

SEQ ID NO: 2116696 - RNA, 13 nt, Staphylococcus aureus subsp. aureus MW2
acaccuacaaaua

SEQ ID NO: 2116697 - RNA, 13 nt, Staphylococcus aureus subsp. aureus MW2
acaccugcaaugu

SEQ ID NO: 2116698 - RNA, 16 nt, Staphylococcus aureus subsp. aureus MW2
acaauuuuuaaaaacc

SEQ ID NO: 2116699 - RNA, 13 nt, Staphylococcus aureus subsp. aureus MW2
acaauuuuuaaaa

SEQ ID NO: 2116700 - RNA, 14 nt, Staphylococcus aureus subsp. aureus MW2
acacaacgauagau

SEQ ID NO: 2116701 - RNA, 17 nt, Staphylococcus aureus subsp. aureus MW2
acacaaauuaaaacucg

SEQ ID NO: 2116702 - RNA, 15 nt, Staphylococcus aureus subsp. aureus MW2
acacaugcaucaacu

SEQ ID NO: 2116703 - RNA, 20 nt, Staphylococcus aureus subsp. aureus MW2
acacauguauucaacugcgu

SEQ ID NO: 2116704 - RNA, 15 nt, Staphylococcus aureus subsp. aureus MW2
acacauuauugaagu

SEQ ID NO: 2116705 - RNA, 18 nt, Staphylococcus aureus subsp. aureus MW2
acacauuauugaaguuuu

SEQ ID NO: 2116706 - RNA, 23 nt, Staphylococcus aureus subsp. aureus MW2
acacauuauugaaguuuuccuaa

SEQ ID NO: 2116707 - RNA, 22 nt, Staphylococcus aureus subsp. aureus MW2
acaccgcaaugccacaucauag

SEQ ID NO: 2116708 - RNA, 18 nt, Staphylococcus aureus subsp. aureus MW2
acacccauuugucuuaau

SEQ ID NO: 2116709 - RNA, 22 nt, Staphylococcus aureus subsp. aureus MW2
acaccaauugaauauuuuucaa

SEQ ID NO: 2116710 - RNA, 15 nt, Staphylococcus aureus subsp. aureus MW2
acaccaauauaaaca

SEQ ID NO: 2116711 - RNA, 16 nt, Staphylococcus aureus subsp. aureus MW2
acaaaaauauagcuau

SEQ ID NO: 2116712 - RNA, 12 nt, Staphylococcus aureus subsp. aureus MW2
acaaaacauauu

SEQ ID NO: 2116713 - RNA, 14 nt, Staphylococcus aureus subsp. aureus MW2
acaaaaaauuaucu

SEQ ID NO: 2116714 - RNA, 16 nt, Staphylococcus aureus subsp. aureus MW2
acaaaaacuauuuuuu

SEQ ID NO: 2116715 - RNA, 15 nt, Staphylococcus aureus subsp. aureus MW2
aauuuagucauuaca

SEQ ID NO: 2116716 - RNA, 16 nt, Staphylococcus aureus subsp. aureus MW2
aauuuauaaugauuaa

SEQ ID NO: 2116717 - RNA, 17 nt, Staphylococcus aureus subsp. aureus MW2
aauuuauaauuucuaaa

SEQ ID NO: 2116718 - RNA, 20 nt, Staphylococcus aureus subsp. aureus MW2
aauuuauaauuucuaaaucu

SEQ ID NO: 2116719 - RNA, 15 nt, Staphylococcus aureus subsp. aureus MW2
aauuuauaauuugua

SEQ ID NO: 2116720 - RNA, 16 nt, Staphylococcus aureus subsp. aureus MW2
aauuuauauagucuau

SEQ ID NO: 2116721 - RNA, 14 nt, Staphylococcus aureus subsp. aureus MW2
acaaaaaauuguaa

SEQ ID NO: 2116722 - RNA, 10 nt, Staphylococcus aureus subsp. aureus MW2
acaaaagaaa

SEQ ID NO: 2116723 - RNA, 17 nt, Staphylococcus aureus subsp. aureus MW2
acaaaagaaaguuaauu

SEQ ID NO: 2116724 - RNA, 13 nt, Staphylococcus aureus subsp. aureus MW2
acaaaacuuaaaa

SEQ ID NO: 2116725 - RNA, 23 nt, Staphylococcus aureus subsp. aureus MW2
acaaaagaggcgccacaacaugu

SEQ ID NO: 2116726 - RNA, 11 nt, Staphylococcus aureus subsp. aureus MW2
acaaaagcaac

SEQ ID NO: 2116727 - RNA, 14 nt, Staphylococcus aureus subsp. aureus MW2
acaaaauaacaugu

SEQ ID NO: 2116728 - RNA, 16 nt, Staphylococcus aureus subsp. aureus MW2
acaaaagugaauguuu

SEQ ID NO: 2116729 - RNA, 10 nt, Staphylococcus aureus subsp. aureus MW2
acaaaaugau

SEQ ID NO: 2116730 - RNA, 19 nt, Staphylococcus aureus subsp. aureus MW2
acaaaaugcguaucaauau

SEQ ID NO: 2116731 - RNA, 15 nt, Staphylococcus aureus subsp. aureus MW2
acaaacugauuuuuu

SEQ ID NO: 2116732 - RNA, 14 nt, Staphylococcus aureus subsp. aureus MW2
acaaacauaaucau

SEQ ID NO: 2116733 - RNA, 15 nt, Staphylococcus aureus subsp. aureus MW2
acaaaccaauuuuaa

SEQ ID NO: 2116734 - RNA, 16 nt, Staphylococcus aureus subsp. aureus MW2
acaaaccaauuuuaau

SEQ ID NO: 2116735 - RNA, 13 nt, Staphylococcus aureus subsp. aureus MW2
acaaacaagaaua

SEQ ID NO: 2116736 - RNA, 22 nt, Staphylococcus aureus subsp. aureus MW2
acaaaauugucucacuuguccu

SEQ ID NO: 2116737 - RNA, 18 nt, Staphylococcus aureus subsp. aureus MW2
acaaaauugucucacuug

SEQ ID NO: 2116738 - RNA, 13 nt, Staphylococcus aureus subsp. aureus MW2
acaaagauauguu

SEQ ID NO: 2116739 - RNA, 17 nt, Staphylococcus aureus subsp. aureus MW2
acaaagauauguuuaua

SEQ ID NO: 2116740 - RNA, 21 nt, Staphylococcus aureus subsp. aureus MW2
acaaagaaccacgcaucaugu

SEQ ID NO: 2116741 - RNA, 22 nt, Staphylococcus aureus subsp. aureus MW2
acaaagaagcccccuaauauau

SEQ ID NO: 2116742 - RNA, 14 nt, Staphylococcus aureus subsp. aureus MW2
acaaagaagcuggc

SEQ ID NO: 2116743 - RNA, 13 nt, Staphylococcus aureus subsp. aureus MW2
acaaacuucacau

SEQ ID NO: 2116744 - RNA, 19 nt, Staphylococcus aureus subsp. aureus MW2
acaaagcucaauaaauuau

SEQ ID NO: 2116745 - RNA, 16 nt, Staphylococcus aureus subsp. aureus MW2
acaaagauuauugaaa

SEQ ID NO: 2116746 - RNA, 13 nt, Staphylococcus aureus subsp. aureus MW2
acaaauguuuuaa

SEQ ID NO: 2116747 - RNA, 19 nt, Staphylococcus aureus subsp. aureus MW2
acaaauguuuuaaguuguu

SEQ ID NO: 2116748 - RNA, 12 nt, Staphylococcus aureus subsp. aureus MW2
acaaauuaaaaa

SEQ ID NO: 2116749 - RNA, 16 nt, Staphylococcus aureus subsp. aureus MW2
acaaauuaucacucau

SEQ ID NO: 2116750 - RNA, 11 nt, Staphylococcus aureus subsp. aureus MW2
acaaauuauua

SEQ ID NO: 2116751 - RNA, 12 nt, Staphylococcus aureus subsp. aureus MW2
acaaauuauuaa

SEQ ID NO: 2116752 - RNA, 16 nt, Staphylococcus aureus subsp. aureus MW2
acaaauucuaugagaa

SEQ ID NO: 2116753 - RNA, 18 nt, Staphylococcus aureus subsp. aureus MW2
acaaauucuaugagaaua

SEQ ID NO: 2116754 - RNA, 21 nt, Staphylococcus aureus subsp. aureus MW2
acaaauucuaugagaauagac

SEQ ID NO: 2116755 - RNA, 16 nt, Staphylococcus aureus subsp. aureus MW2
acaaaucuauaaauau

SEQ ID NO: 2116756 - RNA, 19 nt, Staphylococcus aureus subsp. aureus MW2
acaaaucgauuaauuauaa

SEQ ID NO: 2116757 - RNA, 19 nt, Staphylococcus aureus subsp. aureus MW2
acaaaucuuuuaaauuuag

SEQ ID NO: 2116758 - RNA, 22 nt, Staphylococcus aureus subsp. aureus MW2
acaaaugaagguguugaaaagu

SEQ ID NO: 2116759 - RNA, 11 nt, Staphylococcus aureus subsp. aureus MW2
acaaaugaaaa

SEQ ID NO: 2116760 - RNA, 16 nt, Staphylococcus aureus subsp. aureus MW2
acaaaugcuacaucaa

SEQ ID NO: 2116761 - RNA, 17 nt, Staphylococcus aureus subsp. aureus MW2
acaaaugcuacaucaau

SEQ ID NO: 2116762 - RNA, 18 nt, Staphylococcus aureus subsp. aureus MW2
acaaaugcuacaucaaua

SEQ ID NO: 2116763 - RNA, 19 nt, Staphylococcus aureus subsp. aureus MW2
acaaaugcuacaucaauau

SEQ ID NO: 2116764 - RNA, 23 nt, Staphylococcus aureus subsp. aureus MW2
acaaauauacuugccuucaaauu

SEQ ID NO: 2116765 - RNA, 14 nt, Staphylococcus aureus subsp. aureus MW2
acaaauauuucuaa

SEQ ID NO: 2116766 - RNA, 13 nt, Staphylococcus aureus subsp. aureus MW2
acaaaguuaauca

SEQ ID NO: 2116767 - RNA, 19 nt, Staphylococcus aureus subsp. aureus MW2
acaaauacaguuaucaccg

SEQ ID NO: 2116768 - RNA, 12 nt, Staphylococcus aureus subsp. aureus MW2
acaaauaaaaaa

SEQ ID NO: 2116769 - RNA, 21 nt, Staphylococcus aureus subsp. aureus MW2
acaaauaaaagcaacaaauau

SEQ ID NO: 2116770 - RNA, 14 nt, Staphylococcus aureus subsp. aureus MW2
acaaauaacaaaca

SEQ ID NO: 2116771 - RNA, 21 nt, Staphylococcus aureus subsp. aureus MW2
acaaaguauuugaaguauuuu

SEQ ID NO: 2116772 - RNA, 15 nt, Staphylococcus aureus subsp. aureus MW2
acaaagugauuuaaa

SEQ ID NO: 2116773 - RNA, 16 nt, Staphylococcus aureus subsp. aureus MW2
acaaagugauuuaaaa

SEQ ID NO: 2116774 - RNA, 20 nt, Staphylococcus aureus subsp. aureus MW2
acaaagugauuuaaaaaaau

SEQ ID NO: 2116775 - RNA, 14 nt, Staphylococcus aureus subsp. aureus MW2
acaacacauaaauu

SEQ ID NO: 2116776 - RNA, 15 nt, Staphylococcus aureus subsp. aureus MW2
acaacaaucaaauua

SEQ ID NO: 2116777 - RNA, 14 nt, Staphylococcus aureus subsp. aureus MW2
acaacaaucacgau

SEQ ID NO: 2116778 - RNA, 14 nt, Staphylococcus aureus subsp. aureus MW2
acaacauaacaaag

SEQ ID NO: 2116779 - RNA, 17 nt, Staphylococcus aureus subsp. aureus MW2
acaacacgaugacaugg

SEQ ID NO: 2116780 - RNA, 22 nt, Staphylococcus aureus subsp. aureus MW2
acaaauugcaauggcaaccuuu

SEQ ID NO: 2116781 - RNA, 23 nt, Staphylococcus aureus subsp. aureus MW2
acaaauuugaauauacuuaauuu

SEQ ID NO: 2116782 - RNA, 16 nt, Staphylococcus aureus subsp. aureus MW2
acaaauuuauauuaaa

SEQ ID NO: 2116783 - RNA, 19 nt, Staphylococcus aureus subsp. aureus MW2
acaaauuuauauuaaauaa

SEQ ID NO: 2116784 - RNA, 19 nt, Staphylococcus aureus subsp. aureus MW2
acaaauuugaauauacuua

SEQ ID NO: 2116785 - RNA, 16 nt, Staphylococcus aureus subsp. aureus MW2
acaaauuuuaaaauaa

SEQ ID NO: 2116786 - RNA, 14 nt, Staphylococcus aureus subsp. aureus MW2
acaacaaauuuuga

SEQ ID NO: 2116787 - RNA, 22 nt, Staphylococcus aureus subsp. aureus MW2
acaacagugcucuaugcuuuua

SEQ ID NO: 2116788 - RNA, 13 nt, Staphylococcus aureus subsp. aureus MW2
acaaccaucagca

SEQ ID NO: 2116789 - RNA, 21 nt, Staphylococcus aureus subsp. aureus MW2
accaaauuugugauuaugcau

SEQ ID NO: 2116790 - RNA, 13 nt, Staphylococcus aureus subsp. aureus MW2
accaaauuuauaa

SEQ ID NO: 2116791 - RNA, 22 nt, Staphylococcus aureus subsp. aureus MW2
accaacaauugcacuuggugau

SEQ ID NO: 2116792 - RNA, 22 nt, Staphylococcus aureus subsp. aureus MW2
accaaauaaauaagugauaaau

SEQ ID NO: 2116793 - RNA, 19 nt, Staphylococcus aureus subsp. aureus MW2
accaaaucggaauaaaaua

SEQ ID NO: 2116794 - RNA, 16 nt, Staphylococcus aureus subsp. aureus MW2
accaaacaauacauaa

SEQ ID NO: 2116795 - RNA, 21 nt, Staphylococcus aureus subsp. aureus MW2
acauuuuugauuuuaauacua

SEQ ID NO: 2116796 - RNA, 14 nt, Staphylococcus aureus subsp. aureus MW2
acauuuuuuucaau

SEQ ID NO: 2116797 - RNA, 15 nt, Staphylococcus aureus subsp. aureus MW2
accaaaaaauccaag

SEQ ID NO: 2116798 - RNA, 22 nt, Staphylococcus aureus subsp. aureus MW2
accaaaaauaauuaugaaaagu

SEQ ID NO: 2116799 - RNA, 14 nt, Staphylococcus aureus subsp. aureus MW2
acauucuucaaaaa

SEQ ID NO: 2116800 - RNA, 16 nt, Staphylococcus aureus subsp. aureus MW2
acauucuucaaaaaau

SEQ ID NO: 2116801 - RNA, 18 nt, Staphylococcus aureus subsp. aureus MW2
acauucuugaauaaauuu

SEQ ID NO: 2116802 - RNA, 21 nt, Staphylococcus aureus subsp. aureus MW2
acauuaguuugaucauuuacu

SEQ ID NO: 2116803 - RNA, 16 nt, Staphylococcus aureus subsp. aureus MW2
acauuagcaugauaaa

SEQ ID NO: 2116804 - RNA, 20 nt, Staphylococcus aureus subsp. aureus MW2
acauguauuggccaaacaac

SEQ ID NO: 2116805 - RNA, 19 nt, Staphylococcus aureus subsp. aureus MW2
acauuaaucaugcguuuua

SEQ ID NO: 2116806 - RNA, 22 nt, Staphylococcus aureus subsp. aureus MW2
acauuaaugauagcaaugaauu

SEQ ID NO: 2116807 - RNA, 15 nt, Staphylococcus aureus subsp. aureus MW2
acauuacauuuagua

SEQ ID NO: 2116808 - RNA, 17 nt, Staphylococcus aureus subsp. aureus MW2
acauuacguaucuuuac

SEQ ID NO: 2116809 - RNA, 14 nt, Staphylococcus aureus subsp. aureus MW2
acauuguuaaacua

SEQ ID NO: 2116810 - RNA, 19 nt, Staphylococcus aureus subsp. aureus MW2
acauugauaguuuuauaau

SEQ ID NO: 2116811 - RNA, 19 nt, Staphylococcus aureus subsp. aureus MW2
acauucuucaaaaaauaau

SEQ ID NO: 2116812 - RNA, 22 nt, Staphylococcus aureus subsp. aureus MW2
acauuuuaacaagugaugaaaa

SEQ ID NO: 2116813 - RNA, 17 nt, Staphylococcus aureus subsp. aureus MW2
acauuuuaucugaaaau

SEQ ID NO: 2116814 - RNA, 20 nt, Staphylococcus aureus subsp. aureus MW2
acauuuguaaauauuuuuua

SEQ ID NO: 2116815 - RNA, 21 nt, Staphylococcus aureus subsp. aureus MW2
acauuugucacucuuuaaauc

SEQ ID NO: 2116816 - RNA, 22 nt, Staphylococcus aureus subsp. aureus MW2
acauuuaagaaacgucuuaauu

SEQ ID NO: 2116817 - RNA, 14 nt, Staphylococcus aureus subsp. aureus MW2
acauuuaagaaacg

SEQ ID NO: 2116818 - RNA, 15 nt, Staphylococcus aureus subsp. aureus MW2
acauuuagauuucau

SEQ ID NO: 2116819 - RNA, 20 nt, Staphylococcus aureus subsp. aureus MW2
acauuugaccaaguaugaga

SEQ ID NO: 2116820 - RNA, 16 nt, Staphylococcus aureus subsp. aureus MW2
acaugacauucauuua

SEQ ID NO: 2116821 - RNA, 16 nt, Staphylococcus aureus subsp. aureus MW2
acaugaauuuuaauau

SEQ ID NO: 2116822 - RNA, 19 nt, Staphylococcus aureus subsp. aureus MW2
acaugaauuuuaauauauu

SEQ ID NO: 2116823 - RNA, 17 nt, Staphylococcus aureus subsp. aureus MW2
acaucuguagguuuaau

SEQ ID NO: 2116824 - RNA, 15 nt, Staphylococcus aureus subsp. aureus MW2
acaucugaaucugaa

SEQ ID NO: 2116825 - RNA, 14 nt, Staphylococcus aureus subsp. aureus MW2
acaucugaaaaaau

SEQ ID NO: 2116826 - RNA, 14 nt, Staphylococcus aureus subsp. aureus MW2
acaucuaauaaaua

SEQ ID NO: 2116827 - RNA, 16 nt, Staphylococcus aureus subsp. aureus MW2
acaucuaauaaauaua

SEQ ID NO: 2116828 - RNA, 18 nt, Staphylococcus aureus subsp. aureus MW2
acaucuacaucaaauuuu

SEQ ID NO: 2116829 - RNA, 12 nt, Staphylococcus aureus subsp. aureus MW2
acaugugaaaua

SEQ ID NO: 2116830 - RNA, 18 nt, Staphylococcus aureus subsp. aureus MW2
acauguauuuaguaucau

SEQ ID NO: 2116831 - RNA, 13 nt, Staphylococcus aureus subsp. aureus MW2
acauguacauuau

SEQ ID NO: 2116832 - RNA, 20 nt, Staphylococcus aureus subsp. aureus MW2
acauguacguuuuuuuaaau

SEQ ID NO: 2116833 - RNA, 13 nt, Staphylococcus aureus subsp. aureus MW2
acauguacaauuu

SEQ ID NO: 2116834 - RNA, 18 nt, Staphylococcus aureus subsp. aureus MW2
acauguacaauuuuuaaa

SEQ ID NO: 2116835 - RNA, 22 nt, Staphylococcus aureus subsp. aureus MW2
acaugguuuucuuuuuaucaug

SEQ ID NO: 2116836 - RNA, 22 nt, Staphylococcus aureus subsp. aureus MW2
acaugagauuauuuuuuuaaau

SEQ ID NO: 2116837 - RNA, 13 nt, Staphylococcus aureus subsp. aureus MW2
acauaaucauaau

SEQ ID NO: 2116838 - RNA, 19 nt, Staphylococcus aureus subsp. aureus MW2
acauaaccuaauucgccau

SEQ ID NO: 2116839 - RNA, 21 nt, Staphylococcus aureus subsp. aureus MW2
acauaaggucuuggacuaaua

SEQ ID NO: 2116840 - RNA, 22 nt, Staphylococcus aureus subsp. aureus MW2
acauaagaaaaagcaguaagag

SEQ ID NO: 2116841 - RNA, 17 nt, Staphylococcus aureus subsp. aureus MW2
acaucaauaucuucuuc

SEQ ID NO: 2116842 - RNA, 13 nt, Staphylococcus aureus subsp. aureus MW2
acaucaauaucuu

SEQ ID NO: 2116843 - RNA, 14 nt, Staphylococcus aureus subsp. aureus MW2
acaucaauaucuuc

SEQ ID NO: 2116844 - RNA, 19 nt, Staphylococcus aureus subsp. aureus MW2
acaucaagucgcaucguag

SEQ ID NO: 2116845 - RNA, 14 nt, Staphylococcus aureus subsp. aureus MW2
acaucaucauguuu

SEQ ID NO: 2116846 - RNA, 15 nt, Staphylococcus aureus subsp. aureus MW2
acaucaauaucuucu

SEQ ID NO: 2116847 - RNA, 17 nt, Staphylococcus aureus subsp. aureus MW2
acaucaucuuuaauuuu

SEQ ID NO: 2116848 - RNA, 22 nt, Staphylococcus aureus subsp. aureus MW2
acauccaauuauguuuaucuac

SEQ ID NO: 2116849 - RNA, 13 nt, Staphylococcus aureus subsp. aureus MW2
acaucauuaacuu

SEQ ID NO: 2116850 - RNA, 14 nt, Staphylococcus aureus subsp. aureus MW2
acaucggaauucaa

SEQ ID NO: 2116851 - RNA, 20 nt, Staphylococcus aureus subsp. aureus MW2
acagguaaauuuaaaauaau

SEQ ID NO: 2116852 - RNA, 14 nt, Staphylococcus aureus subsp. aureus MW2
acaguacaaauaac

SEQ ID NO: 2116853 - RNA, 16 nt, Staphylococcus aureus subsp. aureus MW2
acaguaauuuuuaaac

SEQ ID NO: 2116854 - RNA, 18 nt, Staphylococcus aureus subsp. aureus MW2
acaguaauuuuuaaacaa

SEQ ID NO: 2116855 - RNA, 21 nt, Staphylococcus aureus subsp. aureus MW2
acaguacgguuauuuggauaa

SEQ ID NO: 2116856 - RNA, 20 nt, Staphylococcus aureus subsp. aureus MW2
acagucccaaccccuuuauu

SEQ ID NO: 2116857 - RNA, 16 nt, Staphylococcus aureus subsp. aureus MW2
acauaaauacaaaaau

SEQ ID NO: 2116858 - RNA, 21 nt, Staphylococcus aureus subsp. aureus MW2
acauaaauauggauuuugaag

SEQ ID NO: 2116859 - RNA, 18 nt, Staphylococcus aureus subsp. aureus MW2
acauaaaugcuaaaagua

SEQ ID NO: 2116860 - RNA, 15 nt, Staphylococcus aureus subsp. aureus MW2
acauaacacaaguua

SEQ ID NO: 2116861 - RNA, 14 nt, Staphylococcus aureus subsp. aureus MW2
acauaacacaaguu

SEQ ID NO: 2116862 - RNA, 13 nt, Staphylococcus aureus subsp. aureus MW2
acauaaaucaaua

SEQ ID NO: 2116863 - RNA, 17 nt, Staphylococcus aureus subsp. aureus MW2
acauaacagcuaaaaau

SEQ ID NO: 2116864 - RNA, 14 nt, Staphylococcus aureus subsp. aureus MW2
acauaaaacuuaca

SEQ ID NO: 2116865 - RNA, 13 nt, Staphylococcus aureus subsp. aureus MW2
acauaaaaaaaua

SEQ ID NO: 2116866 - RNA, 19 nt, Staphylococcus aureus subsp. aureus MW2
acaguuuuuauauuaagac

SEQ ID NO: 2116867 - RNA, 19 nt, Staphylococcus aureus subsp. aureus MW2
acaguuucaucuucaacuu

SEQ ID NO: 2116868 - RNA, 20 nt, Staphylococcus aureus subsp. aureus MW2
acaguuucuuggucugcugu

SEQ ID NO: 2116869 - RNA, 14 nt, Staphylococcus aureus subsp. aureus MW2
acaguuucuauauu

SEQ ID NO: 2116870 - RNA, 20 nt, Staphylococcus aureus subsp. aureus MW2
acaguuaugccugaagcgcu

SEQ ID NO: 2116871 - RNA, 14 nt, Staphylococcus aureus subsp. aureus MW2
acaguuauauauua

SEQ ID NO: 2116872 - RNA, 17 nt, Staphylococcus aureus subsp. aureus MW2
acaguuauauauuacuu

SEQ ID NO: 2116873 - RNA, 15 nt, Staphylococcus aureus subsp. aureus MW2
acaguuacuucaguu

SEQ ID NO: 2116874 - RNA, 14 nt, Staphylococcus aureus subsp. aureus MW2
acaguguggucuug

SEQ ID NO: 2116875 - RNA, 15 nt, Staphylococcus aureus subsp. aureus MW2
acagugaaucuaaac

SEQ ID NO: 2116876 - RNA, 19 nt, Staphylococcus aureus subsp. aureus MW2
acagugcaugaugaacuua

SEQ ID NO: 2116877 - RNA, 17 nt, Staphylococcus aureus subsp. aureus MW2
acacguguaaaaaugau

SEQ ID NO: 2116878 - RNA, 22 nt, Staphylococcus aureus subsp. aureus MW2
acagcacauuuuuaguuagaaa

SEQ ID NO: 2116879 - RNA, 17 nt, Staphylococcus aureus subsp. aureus MW2
acacgucuaauuuuaau

SEQ ID NO: 2116880 - RNA, 14 nt, Staphylococcus aureus subsp. aureus MW2
acagcuuuuucuac

SEQ ID NO: 2116881 - RNA, 14 nt, Staphylococcus aureus subsp. aureus MW2
acagcgcaucauaa

SEQ ID NO: 2116882 - RNA, 19 nt, Staphylococcus aureus subsp. aureus MW2
acagcuucucauugaaauc

SEQ ID NO: 2116883 - RNA, 14 nt, Staphylococcus aureus subsp. aureus MW2
agaccuuucuugac

SEQ ID NO: 2116884 - RNA, 13 nt, Staphylococcus aureus subsp. aureus MW2
agaccuaugaauu

SEQ ID NO: 2116885 - RNA, 17 nt, Staphylococcus aureus subsp. aureus MW2
agaauuucguuauuaaa

SEQ ID NO: 2116886 - RNA, 17 nt, Staphylococcus aureus subsp. aureus MW2
agaauuucaucaaaucc

SEQ ID NO: 2116887 - RNA, 13 nt, Staphylococcus aureus subsp. aureus MW2
agaauucauuaau

SEQ ID NO: 2116888 - RNA, 16 nt, Staphylococcus aureus subsp. aureus MW2
agacgcuguuuuaaau

SEQ ID NO: 2116889 - RNA, 22 nt, Staphylococcus aureus subsp. aureus MW2
agacucaauuucauuugaaaua

SEQ ID NO: 2116890 - RNA, 16 nt, Staphylococcus aureus subsp. aureus MW2
agacuccuaaauuauu

SEQ ID NO: 2116891 - RNA, 19 nt, Staphylococcus aureus subsp. aureus MW2
agacuuauuugaaugcaaa

SEQ ID NO: 2116892 - RNA, 16 nt, Staphylococcus aureus subsp. aureus MW2
agacuucuuucaauua

SEQ ID NO: 2116893 - RNA, 20 nt, Staphylococcus aureus subsp. aureus MW2
agacugccaauaaaaugcaa

SEQ ID NO: 2116894 - RNA, 19 nt, Staphylococcus aureus subsp. aureus MW2
agagccccuuacaacuuua

SEQ ID NO: 2116895 - RNA, 12 nt, Staphylococcus aureus subsp. aureus MW2
aaaaccaaauga

SEQ ID NO: 2116896 - RNA, 20 nt, Staphylococcus aureus subsp. aureus MW2
agagcucaaccucuuaguuc

SEQ ID NO: 2116897 - RNA, 13 nt, Staphylococcus aureus subsp. aureus MW2
agagagaaaagcu

SEQ ID NO: 2116898 - RNA, 14 nt, Staphylococcus aureus subsp. aureus MW2
agagagaaaagcua

SEQ ID NO: 2116899 - RNA, 11 nt, Staphylococcus aureus subsp. aureus MW2
agacuuucuug

SEQ ID NO: 2116900 - RNA, 13 nt, Staphylococcus aureus subsp. aureus MW2
agacuuuaaaauu

SEQ ID NO: 2116901 - RNA, 13 nt, Staphylococcus aureus subsp. aureus MW2
agagaaaagcuag

SEQ ID NO: 2116902 - RNA, 14 nt, Staphylococcus aureus subsp. aureus MW2
agagaaaagcuaga

SEQ ID NO: 2116903 - RNA, 12 nt, Staphylococcus aureus subsp. aureus MW2
agagaaaauuug

SEQ ID NO: 2116904 - RNA, 13 nt, Staphylococcus aureus subsp. aureus MW2
agagaaaauuugu

SEQ ID NO: 2116905 - RNA, 20 nt, Staphylococcus aureus subsp. aureus MW2
agagaaucaauuauugaaaa

SEQ ID NO: 2116906 - RNA, 19 nt, Staphylococcus aureus subsp. aureus MW2
agagaauauagauuuugua

SEQ ID NO: 2116907 - RNA, 21 nt, Staphylococcus aureus subsp. aureus MW2
agagaauuucgaaaagaaauu

SEQ ID NO: 2116908 - RNA, 17 nt, Staphylococcus aureus subsp. aureus MW2
agagaauuucgaaaaga

SEQ ID NO: 2116909 - RNA, 12 nt, Staphylococcus aureus subsp. aureus MW2
agagacauuuua

SEQ ID NO: 2116910 - RNA, 17 nt, Staphylococcus aureus subsp. aureus MW2
agagacuuauuuuauac

SEQ ID NO: 2116911 - RNA, 20 nt, Staphylococcus aureus subsp. aureus MW2
agagacugaagagcuuuuag

SEQ ID NO: 2116912 - RNA, 20 nt, Staphylococcus aureus subsp. aureus MW2
agauggucuuuuaauuaaaa

SEQ ID NO: 2116913 - RNA, 17 nt, Staphylococcus aureus subsp. aureus MW2
agaugcuuuaauuaaag

SEQ ID NO: 2116914 - RNA, 20 nt, Staphylococcus aureus subsp. aureus MW2
agauguugcuagugcauuua

SEQ ID NO: 2116915 - RNA, 21 nt, Staphylococcus aureus subsp. aureus MW2
agauguugguucaucaaacaa

SEQ ID NO: 2116916 - RNA, 15 nt, Staphylococcus aureus subsp. aureus MW2
agauguuucaaaaua

SEQ ID NO: 2116917 - RNA, 15 nt, Staphylococcus aureus subsp. aureus MW2
agaugcuaauguaau

SEQ ID NO: 2116918 - RNA, 18 nt, Staphylococcus aureus subsp. aureus MW2
agaugcucaaugcauuuc

SEQ ID NO: 2116919 - RNA, 15 nt, Staphylococcus aureus subsp. aureus MW2
agaugaugcuucgca

SEQ ID NO: 2116920 - RNA, 16 nt, Staphylococcus aureus subsp. aureus MW2
agaugauucuuaucau

SEQ ID NO: 2116921 - RNA, 19 nt, Staphylococcus aureus subsp. aureus MW2
agaugauugucuagcagag

SEQ ID NO: 2116922 - RNA, 22 nt, Staphylococcus aureus subsp. aureus MW2
agaugaaauacuugaauguaag

SEQ ID NO: 2116923 - RNA, 21 nt, Staphylococcus aureus subsp. aureus MW2
agaucuuuguaugcaucaguu

SEQ ID NO: 2116924 - RNA, 19 nt, Staphylococcus aureus subsp. aureus MW2
agaugauaacgucauucuu

SEQ ID NO: 2116925 - RNA, 19 nt, Staphylococcus aureus subsp. aureus MW2
agaucuaugauaugugaaa

SEQ ID NO: 2116926 - RNA, 13 nt, Staphylococcus aureus subsp. aureus MW2
agaucguuuucaa

SEQ ID NO: 2116927 - RNA, 21 nt, Staphylococcus aureus subsp. aureus MW2
agaucucaauccaauuaaaua

SEQ ID NO: 2116928 - RNA, 15 nt, Staphylococcus aureus subsp. aureus MW2
agauaagaauauuua

SEQ ID NO: 2116929 - RNA, 15 nt, Staphylococcus aureus subsp. aureus MW2
agauaacuagcaaau

SEQ ID NO: 2116930 - RNA, 17 nt, Staphylococcus aureus subsp. aureus MW2
agauaaauuaauaugaa

SEQ ID NO: 2116931 - RNA, 15 nt, Staphylococcus aureus subsp. aureus MW2
agauaaaacaaaacc

SEQ ID NO: 2116932 - RNA, 23 nt, Staphylococcus aureus subsp. aureus MW2
agaguaguucggaugagaaaugu

SEQ ID NO: 2116933 - RNA, 20 nt, Staphylococcus aureus subsp. aureus MW2
agauauuucuguuuuccuuu

SEQ ID NO: 2116934 - RNA, 14 nt, Staphylococcus aureus subsp. aureus MW2
agaucaauaucacu

SEQ ID NO: 2116935 - RNA, 21 nt, Staphylococcus aureus subsp. aureus MW2
agaucaauaucacuaucagcu

SEQ ID NO: 2116936 - RNA, 21 nt, Staphylococcus aureus subsp. aureus MW2
agauagguuuauuucugaaaa

SEQ ID NO: 2116937 - RNA, 21 nt, Staphylococcus aureus subsp. aureus MW2
agauaguuugagaaaauuaau

SEQ ID NO: 2116938 - RNA, 16 nt, Staphylococcus aureus subsp. aureus MW2
agauacacguaacgca

SEQ ID NO: 2116939 - RNA, 17 nt, Staphylococcus aureus subsp. aureus MW2
agauacaccaauauuuu

SEQ ID NO: 2116940 - RNA, 16 nt, Staphylococcus aureus subsp. aureus MW2
agauaccaaacugccu

SEQ ID NO: 2116941 - RNA, 14 nt, Staphylococcus aureus subsp. aureus MW2
agauaauuauuucu

SEQ ID NO: 2116942 - RNA, 21 nt, Staphylococcus aureus subsp. aureus MW2
agauaauuuuuaacaucauuu

SEQ ID NO: 2116943 - RNA, 12 nt, Staphylococcus aureus subsp. aureus MW2
agauaaugcacc

SEQ ID NO: 2116944 - RNA, 22 nt, Staphylococcus aureus subsp. aureus MW2
agaaccacgcaucauguauaug

SEQ ID NO: 2116945 - RNA, 14 nt, Staphylococcus aureus subsp. aureus MW2
agaaccaacaauaa

SEQ ID NO: 2116946 - RNA, 21 nt, Staphylococcus aureus subsp. aureus MW2
agaacuugcuuuucauuuaau

SEQ ID NO: 2116947 - RNA, 15 nt, Staphylococcus aureus subsp. aureus MW2
agaacguucauauau

SEQ ID NO: 2116948 - RNA, 23 nt, Staphylococcus aureus subsp. aureus MW2
agaaaucagcuuuucuucaacua

SEQ ID NO: 2116949 - RNA, 21 nt, Staphylococcus aureus subsp. aureus MW2
agaaaucuuauagauuuuuca

SEQ ID NO: 2116950 - RNA, 12 nt, Staphylococcus aureus subsp. aureus MW2
agaacaaaaugu

SEQ ID NO: 2116951 - RNA, 21 nt, Staphylococcus aureus subsp. aureus MW2
agaaauuuaauauuguuaauu

SEQ ID NO: 2116952 - RNA, 22 nt, Staphylococcus aureus subsp. aureus MW2
agaaauguuaacgauagacauu

SEQ ID NO: 2116953 - RNA, 16 nt, Staphylococcus aureus subsp. aureus MW2
agaaaugucaguuuug

SEQ ID NO: 2116954 - RNA, 19 nt, Staphylococcus aureus subsp. aureus MW2
aaaacagaauuucaucaaa

SEQ ID NO: 2116955 - RNA, 20 nt, Staphylococcus aureus subsp. aureus MW2
agaaacacaaggaauauaca

SEQ ID NO: 2116956 - RNA, 16 nt, Staphylococcus aureus subsp. aureus MW2
agaaacacauaugcag

SEQ ID NO: 2116957 - RNA, 18 nt, Staphylococcus aureus subsp. aureus MW2
agaaaccuuaaaaucagu

SEQ ID NO: 2116958 - RNA, 15 nt, Staphylococcus aureus subsp. aureus MW2
agaaacgaaauuaua

SEQ ID NO: 2116959 - RNA, 17 nt, Staphylococcus aureus subsp. aureus MW2
agaauacaaauauuaag

SEQ ID NO: 2116960 - RNA, 16 nt, Staphylococcus aureus subsp. aureus MW2
agaauacaaauauuaa

SEQ ID NO: 2116961 - RNA, 13 nt, Staphylococcus aureus subsp. aureus MW2
agaauaaaaaagu

SEQ ID NO: 2116962 - RNA, 17 nt, Staphylococcus aureus subsp. aureus MW2
agaauacuaaaaguguu

SEQ ID NO: 2116963 - RNA, 17 nt, Staphylococcus aureus subsp. aureus MW2
agaauaguuaccaaaau

SEQ ID NO: 2116964 - RNA, 18 nt, Staphylococcus aureus subsp. aureus MW2
agaauaguuaccaaaauu

SEQ ID NO: 2116965 - RNA, 16 nt, Staphylococcus aureus subsp. aureus MW2
agaauaguuaccaaaa

SEQ ID NO: 2116966 - RNA, 21 nt, Staphylococcus aureus subsp. aureus MW2
agaagacauuccccauuuauc

SEQ ID NO: 2116967 - RNA, 19 nt, Staphylococcus aureus subsp. aureus MW2
agaaguuguuuagaaaagu

SEQ ID NO: 2116968 - RNA, 16 nt, Staphylococcus aureus subsp. aureus MW2
agaaguucuuaugcag

SEQ ID NO: 2116969 - RNA, 22 nt, Staphylococcus aureus subsp. aureus MW2
agaagugcgguuuaaucuauau

SEQ ID NO: 2116970 - RNA, 20 nt, Staphylococcus aureus subsp. aureus MW2
agaauuaguacuugaaacau

SEQ ID NO: 2116971 - RNA, 15 nt, Staphylococcus aureus subsp. aureus MW2
agaauuaaugaaaua

SEQ ID NO: 2116972 - RNA, 17 nt, Staphylococcus aureus subsp. aureus MW2
agaauuauguuggacug

SEQ ID NO: 2116973 - RNA, 15 nt, Staphylococcus aureus subsp. aureus MW2
agaaucuccauuuaa

SEQ ID NO: 2116974 - RNA, 14 nt, Staphylococcus aureus subsp. aureus MW2
agaaucuccauuua

SEQ ID NO: 2116975 - RNA, 17 nt, Staphylococcus aureus subsp. aureus MW2
agaaugcgauuuccuuu

SEQ ID NO: 2116976 - RNA, 11 nt, Staphylococcus aureus subsp. aureus MW2
agaauauuaag

SEQ ID NO: 2116977 - RNA, 20 nt, Staphylococcus aureus subsp. aureus MW2
agaauaugaucuaacaucau

SEQ ID NO: 2116978 - RNA, 23 nt, Staphylococcus aureus subsp. aureus MW2
agaauaugaucuaacaucauuaa

SEQ ID NO: 2116979 - RNA, 21 nt, Staphylococcus aureus subsp. aureus MW2
agaauaguuaccaaaauuuga

SEQ ID NO: 2116980 - RNA, 13 nt, Staphylococcus aureus subsp. aureus MW2
agaauauaaaaua

SEQ ID NO: 2116981 - RNA, 14 nt, Staphylococcus aureus subsp. aureus MW2
agaauauaacguuc

SEQ ID NO: 2116982 - RNA, 20 nt, Staphylococcus aureus subsp. aureus MW2
agaauauaggaaucuuguuu

SEQ ID NO: 2116983 - RNA, 21 nt, Staphylococcus aureus subsp. aureus MW2
agaauauauguauaacaauau

SEQ ID NO: 2116984 - RNA, 19 nt, Staphylococcus aureus subsp. aureus MW2
agaaucaucuaaaugcacu

SEQ ID NO: 2116985 - RNA, 18 nt, Staphylococcus aureus subsp. aureus MW2
agaaucaaccguuuuauu

SEQ ID NO: 2116986 - RNA, 19 nt, Staphylococcus aureus subsp. aureus MW2
agaaucaauuauugaaaac

SEQ ID NO: 2116987 - RNA, 17 nt, Staphylococcus aureus subsp. aureus MW2
agaaucagcuaaauauu

SEQ ID NO: 2116988 - RNA, 22 nt, Staphylococcus aureus subsp. aureus MW2
acuuuguucugcuuuuucuuua

SEQ ID NO: 2116989 - RNA, 19 nt, Staphylococcus aureus subsp. aureus MW2
acuuuguucugcuuuuucu

SEQ ID NO: 2116990 - RNA, 21 nt, Staphylococcus aureus subsp. aureus MW2
acuuuguucugcuuuuucuuu

SEQ ID NO: 2116991 - RNA, 23 nt, Staphylococcus aureus subsp. aureus MW2
acuuuuacuuucucaucuauuua

SEQ ID NO: 2116992 - RNA, 16 nt, Staphylococcus aureus subsp. aureus MW2
acuuuuacaaucauca

SEQ ID NO: 2116993 - RNA, 18 nt, Staphylococcus aureus subsp. aureus MW2
acuuuuaaucuguaugua

SEQ ID NO: 2116994 - RNA, 17 nt, Staphylococcus aureus subsp. aureus MW2
acuuuggacuuuaaagu

SEQ ID NO: 2116995 - RNA, 19 nt, Staphylococcus aureus subsp. aureus MW2
acuuuggaaauuuauuaua

SEQ ID NO: 2116996 - RNA, 17 nt, Staphylococcus aureus subsp. aureus MW2
acuuuggucaacuuuuu

SEQ ID NO: 2116997 - RNA, 16 nt, Staphylococcus aureus subsp. aureus MW2
acuuucgcuugcaaag

SEQ ID NO: 2116998 - RNA, 17 nt, Staphylococcus aureus subsp. aureus MW2
acuuuccgccuucaauc

SEQ ID NO: 2116999 - RNA, 18 nt, Staphylococcus aureus subsp. aureus MW2
acuuucuuuuguuuuuau

SEQ ID NO: 2117000 - RNA, 23 nt, Staphylococcus aureus subsp. aureus MW2
acuuugaauugguugaucaauua

SEQ ID NO: 2117001 - RNA, 21 nt, Staphylococcus aureus subsp. aureus MW2
acuuucuacucuaauuacaua

SEQ ID NO: 2117002 - RNA, 14 nt, Staphylococcus aureus subsp. aureus MW2
acuuucuaauuguu

SEQ ID NO: 2117003 - RNA, 20 nt, Staphylococcus aureus subsp. aureus MW2
acuuucuuuauuaugcugaa

SEQ ID NO: 2117004 - RNA, 18 nt, Staphylococcus aureus subsp. aureus MW2
acuuucuugaugaauuaa

SEQ ID NO: 2117005 - RNA, 16 nt, Staphylococcus aureus subsp. aureus MW2
acuuuuugaguaucca

SEQ ID NO: 2117006 - RNA, 22 nt, Staphylococcus aureus subsp. aureus MW2
acuuuuugaguauccaauacua

SEQ ID NO: 2117007 - RNA, 13 nt, Staphylococcus aureus subsp. aureus MW2
acuuuuuguuaau

SEQ ID NO: 2117008 - RNA, 16 nt, Staphylococcus aureus subsp. aureus MW2
acuuuuuuaacuuuaa

SEQ ID NO: 2117009 - RNA, 19 nt, Staphylococcus aureus subsp. aureus MW2
acuuuuuuagguguaaaau

SEQ ID NO: 2117010 - RNA, 18 nt, Staphylococcus aureus subsp. aureus MW2
acuuuuucagaaugaacu

SEQ ID NO: 2117011 - RNA, 15 nt, Staphylococcus aureus subsp. aureus MW2
acuuuuucaauaugu

SEQ ID NO: 2117012 - RNA, 23 nt, Staphylococcus aureus subsp. aureus MW2
acuuuuucgauuaauucuucuuc

SEQ ID NO: 2117013 - RNA, 14 nt, Staphylococcus aureus subsp. aureus MW2
acuuuucuaaacaa

SEQ ID NO: 2117014 - RNA, 16 nt, Staphylococcus aureus subsp. aureus MW2
acuuuucuaucaaaaa

SEQ ID NO: 2117015 - RNA, 12 nt, Staphylococcus aureus subsp. aureus MW2
acuuuucuuauc

SEQ ID NO: 2117016 - RNA, 22 nt, Staphylococcus aureus subsp. aureus MW2
acuuuuauggagugauauagau

SEQ ID NO: 2117017 - RNA, 15 nt, Staphylococcus aureus subsp. aureus MW2
acuuuuauuuuuuau

SEQ ID NO: 2117018 - RNA, 15 nt, Staphylococcus aureus subsp. aureus MW2
agaaaaugaguacaa

SEQ ID NO: 2117019 - RNA, 21 nt, Staphylococcus aureus subsp. aureus MW2
agaaaauaugacgaucuucau

SEQ ID NO: 2117020 - RNA, 21 nt, Staphylococcus aureus subsp. aureus MW2
agaaaauuaauagagaaaaaa

SEQ ID NO: 2117021 - RNA, 18 nt, Staphylococcus aureus subsp. aureus MW2
acuuuuuugugauuauua

SEQ ID NO: 2117022 - RNA, 14 nt, Staphylococcus aureus subsp. aureus MW2
acuuuuuuguucaa

SEQ ID NO: 2117023 - RNA, 14 nt, Staphylococcus aureus subsp. aureus MW2
agaaaauacagauu

SEQ ID NO: 2117024 - RNA, 14 nt, Staphylococcus aureus subsp. aureus MW2
agaaaaaacaagau

SEQ ID NO: 2117025 - RNA, 16 nt, Staphylococcus aureus subsp. aureus MW2
acuuuaaaauuguaua

SEQ ID NO: 2117026 - RNA, 22 nt, Staphylococcus aureus subsp. aureus MW2
acuuuaaaauuguauagaaugu

SEQ ID NO: 2117027 - RNA, 13 nt, Staphylococcus aureus subsp. aureus MW2
acuuguuuccuac

SEQ ID NO: 2117028 - RNA, 16 nt, Staphylococcus aureus subsp. aureus MW2
acuuuaacuucuuuug

SEQ ID NO: 2117029 - RNA, 22 nt, Staphylococcus aureus subsp. aureus MW2
acuuuaaccacuccuuaaacaa

SEQ ID NO: 2117030 - RNA, 15 nt, Staphylococcus aureus subsp. aureus MW2
acuuuaaaucuuguu

SEQ ID NO: 2117031 - RNA, 15 nt, Staphylococcus aureus subsp. aureus MW2
acuuuaaaauuguau

SEQ ID NO: 2117032 - RNA, 11 nt, Staphylococcus aureus subsp. aureus MW2
acuuuaccauc

SEQ ID NO: 2117033 - RNA, 20 nt, Staphylococcus aureus subsp. aureus MW2
acuuuaccaauaucaugcaa

SEQ ID NO: 2117034 - RNA, 20 nt, Staphylococcus aureus subsp. aureus MW2
acuuuaauugcucuuuaaca

SEQ ID NO: 2117035 - RNA, 22 nt, Staphylococcus aureus subsp. aureus MW2
acuuuaauaccagcauccauug

SEQ ID NO: 2117036 - RNA, 20 nt, Staphylococcus aureus subsp. aureus MW2
acuuuaauaccagcauccau

SEQ ID NO: 2117037 - RNA, 18 nt, Staphylococcus aureus subsp. aureus MW2
acuuuacgauaaauagug

SEQ ID NO: 2117038 - RNA, 13 nt, Staphylococcus aureus subsp. aureus MW2
acuuuaguauauu

SEQ ID NO: 2117039 - RNA, 18 nt, Staphylococcus aureus subsp. aureus MW2
acuuuauaaccuaaagcu

SEQ ID NO: 2117040 - RNA, 16 nt, Staphylococcus aureus subsp. aureus MW2
acuuucacuuuuuaua

SEQ ID NO: 2117041 - RNA, 16 nt, Staphylococcus aureus subsp. aureus MW2
acuuucacuacauuaa

SEQ ID NO: 2117042 - RNA, 22 nt, Staphylococcus aureus subsp. aureus MW2
acuuucagucguuaaaauacca

SEQ ID NO: 2117043 - RNA, 22 nt, Staphylococcus aureus subsp. aureus MW2
acuuuauuucuauaucuauuua

SEQ ID NO: 2117044 - RNA, 21 nt, Staphylococcus aureus subsp. aureus MW2
acuugcuguugcaauaaaauc

SEQ ID NO: 2117045 - RNA, 20 nt, Staphylococcus aureus subsp. aureus MW2
acuugcuguugcaauaaaau

SEQ ID NO: 2117046 - RNA, 16 nt, Staphylococcus aureus subsp. aureus MW2
acuugcuaaaacuaau

SEQ ID NO: 2117047 - RNA, 15 nt, Staphylococcus aureus subsp. aureus MW2
acuugccuauuuuuu

SEQ ID NO: 2117048 - RNA, 20 nt, Staphylococcus aureus subsp. aureus MW2
acuugccuauuuuuuuaugu

SEQ ID NO: 2117049 - RNA, 14 nt, Staphylococcus aureus subsp. aureus MW2
acuugcgcaugcuu

SEQ ID NO: 2117050 - RNA, 14 nt, Staphylococcus aureus subsp. aureus MW2
acuuauauuuuaau

SEQ ID NO: 2117051 - RNA, 23 nt, Staphylococcus aureus subsp. aureus MW2
acuuauauacguugauuaacaca

SEQ ID NO: 2117052 - RNA, 13 nt, Staphylococcus aureus subsp. aureus MW2
acuuauaauauua

SEQ ID NO: 2117053 - RNA, 18 nt, Staphylococcus aureus subsp. aureus MW2
acuuguuaagguauccuu

SEQ ID NO: 2117054 - RNA, 22 nt, Staphylococcus aureus subsp. aureus MW2
acuuguucaauacuucuuguuc

SEQ ID NO: 2117055 - RNA, 23 nt, Staphylococcus aureus subsp. aureus MW2
acuugugacaaucgcuugcuucu

SEQ ID NO: 2117056 - RNA, 18 nt, Staphylococcus aureus subsp. aureus MW2
acuugucguauucuucaa

SEQ ID NO: 2117057 - RNA, 15 nt, Staphylococcus aureus subsp. aureus MW2
acuuguaauauaaca

SEQ ID NO: 2117058 - RNA, 15 nt, Staphylococcus aureus subsp. aureus MW2
acuuguaaauuuauu

SEQ ID NO: 2117059 - RNA, 14 nt, Staphylococcus aureus subsp. aureus MW2
acuugguauuuauc

SEQ ID NO: 2117060 - RNA, 21 nt, Staphylococcus aureus subsp. aureus MW2
acuuggcgacauuuguaaaua

SEQ ID NO: 2117061 - RNA, 14 nt, Staphylococcus aureus subsp. aureus MW2
agcccuauuuuuaa

SEQ ID NO: 2117062 - RNA, 14 nt, Staphylococcus aureus subsp. aureus MW2
agcccuauuauuuu

SEQ ID NO: 2117063 - RNA, 22 nt, Staphylococcus aureus subsp. aureus MW2
agccuauuuaaaagacaaucuc

SEQ ID NO: 2117064 - RNA, 18 nt, Staphylococcus aureus subsp. aureus MW2
agccucuuaaaauaccug

SEQ ID NO: 2117065 - RNA, 19 nt, Staphylococcus aureus subsp. aureus MW2
agccugaaauagaaauguc

SEQ ID NO: 2117066 - RNA, 21 nt, Staphylococcus aureus subsp. aureus MW2
agccuagaacauugauuauug

SEQ ID NO: 2117067 - RNA, 22 nt, Staphylococcus aureus subsp. aureus MW2
agccuagaacauugauuauugu

SEQ ID NO: 2117068 - RNA, 14 nt, Staphylococcus aureus subsp. aureus MW2
agccuaauuuuucu

SEQ ID NO: 2117069 - RNA, 16 nt, Staphylococcus aureus subsp. aureus MW2
agccguuuuugaaaug

SEQ ID NO: 2117070 - RNA, 20 nt, Staphylococcus aureus subsp. aureus MW2
agcggaaauaugauugaaug

SEQ ID NO: 2117071 - RNA, 22 nt, Staphylococcus aureus subsp. aureus MW2
agcggaaauaugauugaaugaa

SEQ ID NO: 2117072 - RNA, 22 nt, Staphylococcus aureus subsp. aureus MW2
agcguagcgaaaguaucuauga

SEQ ID NO: 2117073 - RNA, 19 nt, Staphylococcus aureus subsp. aureus MW2
agcguagcauuauuuaaag

SEQ ID NO: 2117074 - RNA, 13 nt, Staphylococcus aureus subsp. aureus MW2
aaaaccucuuuuu

SEQ ID NO: 2117075 - RNA, 19 nt, Staphylococcus aureus subsp. aureus MW2
aaaaccuuacccaaaaaau

SEQ ID NO: 2117076 - RNA, 19 nt, Staphylococcus aureus subsp. aureus MW2
agcauaucuuuaucauuau

SEQ ID NO: 2117077 - RNA, 13 nt, Staphylococcus aureus subsp. aureus MW2
agcauauuucuaa

SEQ ID NO: 2117078 - RNA, 17 nt, Staphylococcus aureus subsp. aureus MW2
agcauauugauguucuc

SEQ ID NO: 2117079 - RNA, 14 nt, Staphylococcus aureus subsp. aureus MW2
agcaucauuuuucg

SEQ ID NO: 2117080 - RNA, 19 nt, Staphylococcus aureus subsp. aureus MW2
agcaucgauuuauuauuac

SEQ ID NO: 2117081 - RNA, 21 nt, Staphylococcus aureus subsp. aureus MW2
agcaguuguugguuuugcaac

SEQ ID NO: 2117082 - RNA, 23 nt, Staphylococcus aureus subsp. aureus MW2
agccaaaucuuuaauaaccuuua

SEQ ID NO: 2117083 - RNA, 14 nt, Staphylococcus aureus subsp. aureus MW2
agccacagccaccu

SEQ ID NO: 2117084 - RNA, 18 nt, Staphylococcus aureus subsp. aureus MW2
agcauuagcaaauauuau

SEQ ID NO: 2117085 - RNA, 20 nt, Staphylococcus aureus subsp. aureus MW2
agcauuaaauuccaugucaa

SEQ ID NO: 2117086 - RNA, 16 nt, Staphylococcus aureus subsp. aureus MW2
agcaucugcaugguuu

SEQ ID NO: 2117087 - RNA, 16 nt, Staphylococcus aureus subsp. aureus MW2
agcaucuauaauauuc

SEQ ID NO: 2117088 - RNA, 20 nt, Staphylococcus aureus subsp. aureus MW2
agcauugggacauaaaauua

SEQ ID NO: 2117089 - RNA, 19 nt, Staphylococcus aureus subsp. aureus MW2
agcauugggacauaaaauu

SEQ ID NO: 2117090 - RNA, 22 nt, Staphylococcus aureus subsp. aureus MW2
agcauugagauggucuuuuaau

SEQ ID NO: 2117091 - RNA, 16 nt, Staphylococcus aureus subsp. aureus MW2
agcauuucuuuauuag

SEQ ID NO: 2117092 - RNA, 15 nt, Staphylococcus aureus subsp. aureus MW2
agcauuuuauuuuua

SEQ ID NO: 2117093 - RNA, 16 nt, Staphylococcus aureus subsp. aureus MW2
agcacgagacaauaau

SEQ ID NO: 2117094 - RNA, 16 nt, Staphylococcus aureus subsp. aureus MW2
agcaccgcgaauuacg

SEQ ID NO: 2117095 - RNA, 14 nt, Staphylococcus aureus subsp. aureus MW2
agcacgcuuauuga

SEQ ID NO: 2117096 - RNA, 20 nt, Staphylococcus aureus subsp. aureus MW2
agcaauuaaagucaauuuaa

SEQ ID NO: 2117097 - RNA, 17 nt, Staphylococcus aureus subsp. aureus MW2
agcaauugaaucaaaua

SEQ ID NO: 2117098 - RNA, 18 nt, Staphylococcus aureus subsp. aureus MW2
agcaauacgauugcaaug

SEQ ID NO: 2117099 - RNA, 16 nt, Staphylococcus aureus subsp. aureus MW2
agcaaucacaccugca

SEQ ID NO: 2117100 - RNA, 15 nt, Staphylococcus aureus subsp. aureus MW2
agcaaucauaauacu

SEQ ID NO: 2117101 - RNA, 14 nt, Staphylococcus aureus subsp. aureus MW2
agcaauaucaucau

SEQ ID NO: 2117102 - RNA, 19 nt, Staphylococcus aureus subsp. aureus MW2
agcaauaucaucauuuaaa

SEQ ID NO: 2117103 - RNA, 13 nt, Staphylococcus aureus subsp. aureus MW2
agauuauuaugug

SEQ ID NO: 2117104 - RNA, 17 nt, Staphylococcus aureus subsp. aureus MW2
agauuauuuaaaacuug

SEQ ID NO: 2117105 - RNA, 15 nt, Staphylococcus aureus subsp. aureus MW2
agauuaugacaacau

SEQ ID NO: 2117106 - RNA, 21 nt, Staphylococcus aureus subsp. aureus MW2
agauuaugaaaacauuauuaa

SEQ ID NO: 2117107 - RNA, 20 nt, Staphylococcus aureus subsp. aureus MW2
agauucaaacguuuucacuu

SEQ ID NO: 2117108 - RNA, 18 nt, Staphylococcus aureus subsp. aureus MW2
agauucaaacguuuucac

SEQ ID NO: 2117109 - RNA, 16 nt, Staphylococcus aureus subsp. aureus MW2
agauuauuuucaauua

SEQ ID NO: 2117110 - RNA, 17 nt, Staphylococcus aureus subsp. aureus MW2
agcaaguccaaauaaug

SEQ ID NO: 2117111 - RNA, 20 nt, Staphylococcus aureus subsp. aureus MW2
agcaaguccaaauaaugugc

SEQ ID NO: 2117112 - RNA, 21 nt, Staphylococcus aureus subsp. aureus MW2
agcaagcagugcuaauuuuga

SEQ ID NO: 2117113 - RNA, 16 nt, Staphylococcus aureus subsp. aureus MW2
acucaauucucuaacu

SEQ ID NO: 2117114 - RNA, 12 nt, Staphylococcus aureus subsp. aureus MW2
acucaauucucu

SEQ ID NO: 2117115 - RNA, 15 nt, Staphylococcus aureus subsp. aureus MW2
acucaccugcagcau

SEQ ID NO: 2117116 - RNA, 22 nt, Staphylococcus aureus subsp. aureus MW2
acucaauaugaaaccuuugguu

SEQ ID NO: 2117117 - RNA, 14 nt, Staphylococcus aureus subsp. aureus MW2
acucaacugaugaa

SEQ ID NO: 2117118 - RNA, 14 nt, Staphylococcus aureus subsp. aureus MW2
acucaaauaucuaa

SEQ ID NO: 2117119 - RNA, 19 nt, Staphylococcus aureus subsp. aureus MW2
acucaaaauguuuaacaau

SEQ ID NO: 2117120 - RNA, 23 nt, Staphylococcus aureus subsp. aureus MW2
acuauguuguuuaaauuucaaaa

SEQ ID NO: 2117121 - RNA, 19 nt, Staphylococcus aureus subsp. aureus MW2
acuauuaaaggaaaucaau

SEQ ID NO: 2117122 - RNA, 19 nt, Staphylococcus aureus subsp. aureus MW2
acucaaaccuguuuggaaa

SEQ ID NO: 2117123 - RNA, 21 nt, Staphylococcus aureus subsp. aureus MW2
acucaaacaauaaagccaucu

SEQ ID NO: 2117124 - RNA, 15 nt, Staphylococcus aureus subsp. aureus MW2
acuacgcauuuuaaa

SEQ ID NO: 2117125 - RNA, 22 nt, Staphylococcus aureus subsp. aureus MW2
acguucgccaacuaaaucacca

SEQ ID NO: 2117126 - RNA, 15 nt, Staphylococcus aureus subsp. aureus MW2
acuacuauugauauu

SEQ ID NO: 2117127 - RNA, 21 nt, Staphylococcus aureus subsp. aureus MW2
acuacucccccguaguauaua

SEQ ID NO: 2117128 - RNA, 19 nt, Staphylococcus aureus subsp. aureus MW2
acuacugucucaucuucua

SEQ ID NO: 2117129 - RNA, 22 nt, Staphylococcus aureus subsp. aureus MW2
acuaguucuaaguguugaccau

SEQ ID NO: 2117130 - RNA, 20 nt, Staphylococcus aureus subsp. aureus MW2
acuagucuuuuuauuuuaau

SEQ ID NO: 2117131 - RNA, 16 nt, Staphylococcus aureus subsp. aureus MW2
acuaguguauacaagg

SEQ ID NO: 2117132 - RNA, 18 nt, Staphylococcus aureus subsp. aureus MW2
acuaguguauacaaggca

SEQ ID NO: 2117133 - RNA, 19 nt, Staphylococcus aureus subsp. aureus MW2
acuaguguauacaaggcau

SEQ ID NO: 2117134 - RNA, 14 nt, Staphylococcus aureus subsp. aureus MW2
acuaguaauagaau

SEQ ID NO: 2117135 - RNA, 22 nt, Staphylococcus aureus subsp. aureus MW2
acuaguaauagaauagucaauu

SEQ ID NO: 2117136 - RNA, 19 nt, Staphylococcus aureus subsp. aureus MW2
acuaguuuguaauaauuaa

SEQ ID NO: 2117137 - RNA, 18 nt, Staphylococcus aureus subsp. aureus MW2
acuaguuuguaauaauua

SEQ ID NO: 2117138 - RNA, 18 nt, Staphylococcus aureus subsp. aureus MW2
acuaucuuauauuuauga

SEQ ID NO: 2117139 - RNA, 14 nt, Staphylococcus aureus subsp. aureus MW2
acuaucuuuugcuu

SEQ ID NO: 2117140 - RNA, 14 nt, Staphylococcus aureus subsp. aureus MW2
acuaucguuuuuau

SEQ ID NO: 2117141 - RNA, 16 nt, Staphylococcus aureus subsp. aureus MW2
acucaggcuuaauuaa

SEQ ID NO: 2117142 - RNA, 14 nt, Staphylococcus aureus subsp. aureus MW2
acucauaaucaagu

SEQ ID NO: 2117143 - RNA, 22 nt, Staphylococcus aureus subsp. aureus MW2
acucauaauuuucuauuauuuu

SEQ ID NO: 2117144 - RNA, 15 nt, Staphylococcus aureus subsp. aureus MW2
acucaguaaauuuau

SEQ ID NO: 2117145 - RNA, 13 nt, Staphylococcus aureus subsp. aureus MW2
acucaucgaguuu

SEQ ID NO: 2117146 - RNA, 17 nt, Staphylococcus aureus subsp. aureus MW2
acuccuuaaacaaauaa

SEQ ID NO: 2117147 - RNA, 16 nt, Staphylococcus aureus subsp. aureus MW2
acucggggaauuuuua

SEQ ID NO: 2117148 - RNA, 17 nt, Staphylococcus aureus subsp. aureus MW2
acuccaguuuauaacug

SEQ ID NO: 2117149 - RNA, 14 nt, Staphylococcus aureus subsp. aureus MW2
acucccuuuuuaaa

SEQ ID NO: 2117150 - RNA, 15 nt, Staphylococcus aureus subsp. aureus MW2
acucccuuuauuuuc

SEQ ID NO: 2117151 - RNA, 19 nt, Staphylococcus aureus subsp. aureus MW2
acugcuaauuuuuucauca

SEQ ID NO: 2117152 - RNA, 18 nt, Staphylococcus aureus subsp. aureus MW2
acugcuaauauuagauau

SEQ ID NO: 2117153 - RNA, 20 nt, Staphylococcus aureus subsp. aureus MW2
acugcuaauauuagauaucu

SEQ ID NO: 2117154 - RNA, 14 nt, Staphylococcus aureus subsp. aureus MW2
acugcuaauuuuuu

SEQ ID NO: 2117155 - RNA, 16 nt, Staphylococcus aureus subsp. aureus MW2
acugcuaaaauuguau

SEQ ID NO: 2117156 - RNA, 20 nt, Staphylococcus aureus subsp. aureus MW2
acugcguuaugaauugcuuu

SEQ ID NO: 2117157 - RNA, 13 nt, Staphylococcus aureus subsp. aureus MW2
acugcuaauauua

SEQ ID NO: 2117158 - RNA, 20 nt, Staphylococcus aureus subsp. aureus MW2
acugcaccgauaucauauaa

SEQ ID NO: 2117159 - RNA, 22 nt, Staphylococcus aureus subsp. aureus MW2
acugauggaaaaguuuuuuacu

SEQ ID NO: 2117160 - RNA, 17 nt, Staphylococcus aureus subsp. aureus MW2
acugacuaauaaaacuu

SEQ ID NO: 2117161 - RNA, 15 nt, Staphylococcus aureus subsp. aureus MW2
acucguaaauuuuau

SEQ ID NO: 2117162 - RNA, 17 nt, Staphylococcus aureus subsp. aureus MW2
acucggggaauuuuuau

SEQ ID NO: 2117163 - RNA, 13 nt, Staphylococcus aureus subsp. aureus MW2
acucuacuagaau

SEQ ID NO: 2117164 - RNA, 13 nt, Staphylococcus aureus subsp. aureus MW2
acuguaaaacaau

SEQ ID NO: 2117165 - RNA, 13 nt, Staphylococcus aureus subsp. aureus MW2
acugggcaacuuu

SEQ ID NO: 2117166 - RNA, 18 nt, Staphylococcus aureus subsp. aureus MW2
acugggcaacuuuuuuag

SEQ ID NO: 2117167 - RNA, 16 nt, Staphylococcus aureus subsp. aureus MW2
acugcuuuuaaaucau

SEQ ID NO: 2117168 - RNA, 18 nt, Staphylococcus aureus subsp. aureus MW2
acuggcguuaaagcuuuu

SEQ ID NO: 2117169 - RNA, 22 nt, Staphylococcus aureus subsp. aureus MW2
acuggcguuaaagcuuuucuug

SEQ ID NO: 2117170 - RNA, 16 nt, Staphylococcus aureus subsp. aureus MW2
acuuaaucguucccau

SEQ ID NO: 2117171 - RNA, 23 nt, Staphylococcus aureus subsp. aureus MW2
acuuaaugacuucuuuauauuua

SEQ ID NO: 2117172 - RNA, 17 nt, Staphylococcus aureus subsp. aureus MW2
acuuaaugcuucaaaug

SEQ ID NO: 2117173 - RNA, 20 nt, Staphylococcus aureus subsp. aureus MW2
acuuagggugacucaaugaa

SEQ ID NO: 2117174 - RNA, 15 nt, Staphylococcus aureus subsp. aureus MW2
acuuaguaauaagac

SEQ ID NO: 2117175 - RNA, 18 nt, Staphylococcus aureus subsp. aureus MW2
acuuaauacuaauuuugu

SEQ ID NO: 2117176 - RNA, 16 nt, Staphylococcus aureus subsp. aureus MW2
acuguuugcuuuauca

SEQ ID NO: 2117177 - RNA, 22 nt, Staphylococcus aureus subsp. aureus MW2
acuguuaaagucuguugguuua

SEQ ID NO: 2117178 - RNA, 22 nt, Staphylococcus aureus subsp. aureus MW2
acuguauagcuggcuuuuuaau

SEQ ID NO: 2117179 - RNA, 20 nt, Staphylococcus aureus subsp. aureus MW2
acuguaugccgccuaauaau

SEQ ID NO: 2117180 - RNA, 22 nt, Staphylococcus aureus subsp. aureus MW2
acuguauuuuagcgucauuuuu

SEQ ID NO: 2117181 - RNA, 18 nt, Staphylococcus aureus subsp. aureus MW2
acugucaccuucuauauu

SEQ ID NO: 2117182 - RNA, 15 nt, Staphylococcus aureus subsp. aureus MW2
acuguaaaugaaaug

SEQ ID NO: 2117183 - RNA, 12 nt, Staphylococcus aureus subsp. aureus MW2
acuguaaaucau

SEQ ID NO: 2117184 - RNA, 17 nt, Staphylococcus aureus subsp. aureus MW2
acuguagaaacacaagg

SEQ ID NO: 2117185 - RNA, 21 nt, Staphylococcus aureus subsp. aureus MW2
acgccucaacacuuucuacuc

SEQ ID NO: 2117186 - RNA, 21 nt, Staphylococcus aureus subsp. aureus MW2
acgccuuggccuacuuuuuca

SEQ ID NO: 2117187 - RNA, 15 nt, Staphylococcus aureus subsp. aureus MW2
acgauauucuacaug

SEQ ID NO: 2117188 - RNA, 15 nt, Staphylococcus aureus subsp. aureus MW2
acgcuaauuuuacuc

SEQ ID NO: 2117189 - RNA, 17 nt, Staphylococcus aureus subsp. aureus MW2
acgcuaauuuuacucug

SEQ ID NO: 2117190 - RNA, 19 nt, Staphylococcus aureus subsp. aureus MW2
acgcucaugaguuucucau

SEQ ID NO: 2117191 - RNA, 17 nt, Staphylococcus aureus subsp. aureus MW2
acgcgugaauuaaaaaa

SEQ ID NO: 2117192 - RNA, 20 nt, Staphylococcus aureus subsp. aureus MW2
acgcgguaaaacgaagucag

SEQ ID NO: 2117193 - RNA, 13 nt, Staphylococcus aureus subsp. aureus MW2
acgcuguaaucca

SEQ ID NO: 2117194 - RNA, 19 nt, Staphylococcus aureus subsp. aureus MW2
acgcggguaauauuuuugu

SEQ ID NO: 2117195 - RNA, 19 nt, Staphylococcus aureus subsp. aureus MW2
acguggcucuaaaaacaaa

SEQ ID NO: 2117196 - RNA, 15 nt, Staphylococcus aureus subsp. aureus MW2
acguguuugagauau

SEQ ID NO: 2117197 - RNA, 18 nt, Staphylococcus aureus subsp. aureus MW2
acgugguugguuaccauc

SEQ ID NO: 2117198 - RNA, 16 nt, Staphylococcus aureus subsp. aureus MW2
acguguaaauguuaaa

SEQ ID NO: 2117199 - RNA, 22 nt, Staphylococcus aureus subsp. aureus MW2
acgugaggcccauaaauuacuu

SEQ ID NO: 2117200 - RNA, 22 nt, Staphylococcus aureus subsp. aureus MW2
acgucgcaacaggaccacucaa

SEQ ID NO: 2117201 - RNA, 21 nt, Staphylococcus aureus subsp. aureus MW2
acgucacuuuauuaaauaacu

SEQ ID NO: 2117202 - RNA, 23 nt, Staphylococcus aureus subsp. aureus MW2
acguccgacaucauaaaugacgu

SEQ ID NO: 2117203 - RNA, 17 nt, Staphylococcus aureus subsp. aureus MW2
acgguuauuuggauaau

SEQ ID NO: 2117204 - RNA, 20 nt, Staphylococcus aureus subsp. aureus MW2
acguauagaugcuaauguaa

SEQ ID NO: 2117205 - RNA, 16 nt, Staphylococcus aureus subsp. aureus MW2
acguauacaaauugau

SEQ ID NO: 2117206 - RNA, 17 nt, Staphylococcus aureus subsp. aureus MW2
acguaugcccucauaaa

SEQ ID NO: 2117207 - RNA, 21 nt, Staphylococcus aureus subsp. aureus MW2
acguaugcccucauaaaucau

SEQ ID NO: 2117208 - RNA, 16 nt, Staphylococcus aureus subsp. aureus MW2
acguaucaucaaaauu

SEQ ID NO: 2117209 - RNA, 19 nt, Staphylococcus aureus subsp. aureus MW2
acgucaagcuuugcugcuu

SEQ ID NO: 2117210 - RNA, 16 nt, Staphylococcus aureus subsp. aureus MW2
acggcacuaauauuua

SEQ ID NO: 2117211 - RNA, 20 nt, Staphylococcus aureus subsp. aureus MW2
acggcacuaauauuuaaaaa

SEQ ID NO: 2117212 - RNA, 18 nt, Staphylococcus aureus subsp. aureus MW2
acgguaggaccucuuauu

SEQ ID NO: 2117213 - RNA, 17 nt, Staphylococcus aureus subsp. aureus MW2
accugcgccuucuuuuu

SEQ ID NO: 2117214 - RNA, 17 nt, Staphylococcus aureus subsp. aureus MW2
accugcuuuuuauuauu

SEQ ID NO: 2117215 - RNA, 20 nt, Staphylococcus aureus subsp. aureus MW2
accugcucuuuccacagcuu

SEQ ID NO: 2117216 - RNA, 18 nt, Staphylococcus aureus subsp. aureus MW2
accugcugaaguuugaac

SEQ ID NO: 2117217 - RNA, 14 nt, Staphylococcus aureus subsp. aureus MW2
accugugauaaaaa

SEQ ID NO: 2117218 - RNA, 19 nt, Staphylococcus aureus subsp. aureus MW2
accuucaguuucuacugua

SEQ ID NO: 2117219 - RNA, 15 nt, Staphylococcus aureus subsp. aureus MW2
accuucaguuucuac

SEQ ID NO: 2117220 - RNA, 20 nt, Staphylococcus aureus subsp. aureus MW2
accuuguucuuuacuccaaa

SEQ ID NO: 2117221 - RNA, 15 nt, Staphylococcus aureus subsp. aureus MW2
accuucguuuaaauu

SEQ ID NO: 2117222 - RNA, 19 nt, Staphylococcus aureus subsp. aureus MW2
accuucuauauugggacuu

SEQ ID NO: 2117223 - RNA, 16 nt, Staphylococcus aureus subsp. aureus MW2
accuugaaugauauua

SEQ ID NO: 2117224 - RNA, 18 nt, Staphylococcus aureus subsp. aureus MW2
accuugaaugauauuaac

SEQ ID NO: 2117225 - RNA, 16 nt, Staphylococcus aureus subsp. aureus MW2
acgagcaguauauauc

SEQ ID NO: 2117226 - RNA, 19 nt, Staphylococcus aureus subsp. aureus MW2
acgacucuccaaauauugu

SEQ ID NO: 2117227 - RNA, 20 nt, Staphylococcus aureus subsp. aureus MW2
acgagucauaaauauaaaau

SEQ ID NO: 2117228 - RNA, 20 nt, Staphylococcus aureus subsp. aureus MW2
acgauaacaauuuauuaaaa

SEQ ID NO: 2117229 - RNA, 18 nt, Staphylococcus aureus subsp. aureus MW2
acgagcuggugagaaauu

SEQ ID NO: 2117230 - RNA, 13 nt, Staphylococcus aureus subsp. aureus MW2
acgacgaaauaau

SEQ ID NO: 2117231 - RNA, 13 nt, Staphylococcus aureus subsp. aureus MW2
acgacgaaauaaa

SEQ ID NO: 2117232 - RNA, 19 nt, Staphylococcus aureus subsp. aureus MW2
acgacguuuuuuuauguuc

SEQ ID NO: 2117233 - RNA, 21 nt, Staphylococcus aureus subsp. aureus MW2
accuuuuaaggcagcuaaaaa

SEQ ID NO: 2117234 - RNA, 18 nt, Staphylococcus aureus subsp. aureus MW2
accuuugcuaaauauuau

SEQ ID NO: 2117235 - RNA, 23 nt, Staphylococcus aureus subsp. aureus MW2
accuuugccaacaccauuauaga

SEQ ID NO: 2117236 - RNA, 17 nt, Staphylococcus aureus subsp. aureus MW2
acgaaaccaaaaauaau

SEQ ID NO: 2117237 - RNA, 16 nt, Staphylococcus aureus subsp. aureus MW2
acgaauagaaaauaau

SEQ ID NO: 2117238 - RNA, 14 nt, Staphylococcus aureus subsp. aureus MW2
acgaaagagaaaag

SEQ ID NO: 2117239 - RNA, 15 nt, Staphylococcus aureus subsp. aureus MW2
acgaaagagaaaagc

SEQ ID NO: 2117240 - RNA, 17 nt, Staphylococcus aureus subsp. aureus MW2
acgaaagagaaaagcua

SEQ ID NO: 2117241 - RNA, 22 nt, Staphylococcus aureus subsp. aureus MW2
acgacaaucacagcaauaauaa

SEQ ID NO: 2117242 - RNA, 22 nt, Staphylococcus aureus subsp. aureus MW2
acgacaacuugaacuaaaacaa

SEQ ID NO: 2117243 - RNA, 19 nt, Staphylococcus aureus subsp. aureus MW2
accguguuguugaauaauu

SEQ ID NO: 2117244 - RNA, 20 nt, Staphylococcus aureus subsp. aureus MW2
accgucuucucuaucaguau

SEQ ID NO: 2117245 - RNA, 16 nt, Staphylococcus aureus subsp. aureus MW2
accuaugguuacccuu

SEQ ID NO: 2117246 - RNA, 14 nt, Staphylococcus aureus subsp. aureus MW2
accuauuugcugaa

SEQ ID NO: 2117247 - RNA, 20 nt, Staphylococcus aureus subsp. aureus MW2
accucauccgccaauuaaaa

SEQ ID NO: 2117248 - RNA, 15 nt, Staphylococcus aureus subsp. aureus MW2
accucauuugacaua

SEQ ID NO: 2117249 - RNA, 17 nt, Staphylococcus aureus subsp. aureus MW2
accuauuccuaauaaau

SEQ ID NO: 2117250 - RNA, 17 nt, Staphylococcus aureus subsp. aureus MW2
accuauuccuauuacua

SEQ ID NO: 2117251 - RNA, 22 nt, Staphylococcus aureus subsp. aureus MW2
accuacuuugauauguuuccuc

SEQ ID NO: 2117252 - RNA, 17 nt, Staphylococcus aureus subsp. aureus MW2
accuacuacaaauuuua

SEQ ID NO: 2117253 - RNA, 22 nt, Staphylococcus aureus subsp. aureus MW2
accuacauuaauuuaucguuua

SEQ ID NO: 2117254 - RNA, 16 nt, Staphylococcus aureus subsp. aureus MW2
accuacacggucccaa

SEQ ID NO: 2117255 - RNA, 20 nt, Staphylococcus aureus subsp. aureus MW2
accguuuuuuauaaaucauu

SEQ ID NO: 2117256 - RNA, 13 nt, Staphylococcus aureus subsp. aureus MW2
accuaaaaacaaa

SEQ ID NO: 2117257 - RNA, 14 nt, Staphylococcus aureus subsp. aureus MW2
accuaaaaacagca

SEQ ID NO: 2117258 - RNA, 12 nt, Staphylococcus aureus subsp. aureus MW2
accuaaaauacc

SEQ ID NO: 2117259 - RNA, 18 nt, Staphylococcus aureus subsp. aureus MW2
accuaaaauacccauuuu

SEQ ID NO: 2117260 - RNA, 20 nt, Staphylococcus aureus subsp. aureus MW2
accuaauucgccaucuuuuu

SEQ ID NO: 2117261 - RNA, 12 nt, Staphylococcus aureus subsp. aureus MW2
accuacaaauau

SEQ ID NO: 2117262 - RNA, 20 nt, Staphylococcus aureus subsp. aureus MW2
accuacaacgaagaauccua

SEQ ID NO: 2117263 - RNA, 23 nt, Staphylococcus aureus subsp. aureus MW2
accuaauauauuacuaaccuauu

SEQ ID NO: 2117264 - RNA, 16 nt, Staphylococcus aureus subsp. aureus MW2
accuaacgcuaaugau

SEQ ID NO: 2117265 - RNA, 22 nt, Staphylococcus aureus subsp. aureus MW2
accguaaucuuuuaacuuuccg

SEQ ID NO: 2117266 - RNA, 13 nt, Staphylococcus aureus subsp. aureus MW2
accguaauuuuaa

SEQ ID NO: 2117267 - RNA, 18 nt, Staphylococcus aureus subsp. aureus MW2
accgcuucuuuuaaguua

SEQ ID NO: 2117268 - RNA, 16 nt, Staphylococcus aureus subsp. aureus MW2
accgcuuaauucuuca

SEQ ID NO: 2117269 - RNA, 20 nt, Staphylococcus aureus subsp. aureus MW2
accgauuaauauaauaccua

SEQ ID NO: 2117270 - RNA, 16 nt, Staphylococcus aureus subsp. aureus MW2
accauauuuuuagaaa

SEQ ID NO: 2117271 - RNA, 18 nt, Staphylococcus aureus subsp. aureus MW2
accauauuuuuagaaaag

SEQ ID NO: 2117272 - RNA, 23 nt, Staphylococcus aureus subsp. aureus MW2
accauauuuuuuaguaauaacau

SEQ ID NO: 2117273 - RNA, 23 nt, Staphylococcus aureus subsp. aureus MW2
accaguuugaucauaauucagug

SEQ ID NO: 2117274 - RNA, 17 nt, Staphylococcus aureus subsp. aureus MW2
accauagauuauauuau

SEQ ID NO: 2117275 - RNA, 23 nt, Staphylococcus aureus subsp. aureus MW2
accauagauuauauuaucauuga

SEQ ID NO: 2117276 - RNA, 16 nt, Staphylococcus aureus subsp. aureus MW2
accauaguaacaaaau

SEQ ID NO: 2117277 - RNA, 17 nt, Staphylococcus aureus subsp. aureus MW2
accauaguaacaaaaug

SEQ ID NO: 2117278 - RNA, 18 nt, Staphylococcus aureus subsp. aureus MW2
accaguggaaauuaugua

SEQ ID NO: 2117279 - RNA, 15 nt, Staphylococcus aureus subsp. aureus MW2
accagcuaacaaaag

SEQ ID NO: 2117280 - RNA, 14 nt, Staphylococcus aureus subsp. aureus MW2
accagcuaaccaaa

SEQ ID NO: 2117281 - RNA, 16 nt, Staphylococcus aureus subsp. aureus MW2
accagcucguuuuuug

SEQ ID NO: 2117282 - RNA, 21 nt, Staphylococcus aureus subsp. aureus MW2
accagcuuucguaccugcucu

SEQ ID NO: 2117283 - RNA, 13 nt, Staphylococcus aureus subsp. aureus MW2
accagcacaucaa

SEQ ID NO: 2117284 - RNA, 18 nt, Staphylococcus aureus subsp. aureus MW2
accaacuugcacauuauu

SEQ ID NO: 2117285 - RNA, 12 nt, Staphylococcus aureus subsp. aureus MW2
accaacuuuuuu

SEQ ID NO: 2117286 - RNA, 20 nt, Staphylococcus aureus subsp. aureus MW2
accaucuggcguuaaccauu

SEQ ID NO: 2117287 - RNA, 21 nt, Staphylococcus aureus subsp. aureus MW2
accaucuucuugauuguaaau

SEQ ID NO: 2117288 - RNA, 17 nt, Staphylococcus aureus subsp. aureus MW2
acccaccuuucuuuauc

SEQ ID NO: 2117289 - RNA, 16 nt, Staphylococcus aureus subsp. aureus MW2
acccauauuaaauuuu

SEQ ID NO: 2117290 - RNA, 21 nt, Staphylococcus aureus subsp. aureus MW2
acccuaaugagcccguuaaaa

SEQ ID NO: 2117291 - RNA, 20 nt, Staphylococcus aureus subsp. aureus MW2
acccuugucaguuuuuuuau

SEQ ID NO: 2117292 - RNA, 18 nt, Staphylococcus aureus subsp. aureus MW2
acccuuuaaauuuaacuc

SEQ ID NO: 2117293 - RNA, 22 nt, Staphylococcus aureus subsp. aureus MW2
acccuucccuaucauacauauu

SEQ ID NO: 2117294 - RNA, 13 nt, Staphylococcus aureus subsp. aureus MW2
accgaaaauaccu

SEQ ID NO: 2117295 - RNA, 15 nt, Staphylococcus aureus subsp. aureus MW2
agcucugaagaagac

SEQ ID NO: 2117296 - RNA, 17 nt, Staphylococcus aureus subsp. aureus MW2
agcucugaagaagacau

SEQ ID NO: 2117297 - RNA, 17 nt, Staphylococcus aureus subsp. aureus MW2
agcucguuaaaucacau

SEQ ID NO: 2117298 - RNA, 17 nt, Staphylococcus aureus subsp. aureus MW2
agcucguuuuuugauug

SEQ ID NO: 2117299 - RNA, 18 nt, Staphylococcus aureus subsp. aureus MW2
agcucuuuuuugauuuaa

SEQ ID NO: 2117300 - RNA, 20 nt, Staphylococcus aureus subsp. aureus MW2
agcucuuuuuuguuauaucu

SEQ ID NO: 2117301 - RNA, 17 nt, Staphylococcus aureus subsp. aureus MW2
agcucuugcuaaagugu

SEQ ID NO: 2117302 - RNA, 22 nt, Staphylococcus aureus subsp. aureus MW2
agcucuugcuaaaguguagcca

SEQ ID NO: 2117303 - RNA, 20 nt, Staphylococcus aureus subsp. aureus MW2
agcucuuaaucuauaaauua

SEQ ID NO: 2117304 - RNA, 19 nt, Staphylococcus aureus subsp. aureus MW2
agcucuuaaaucacuagcu

SEQ ID NO: 2117305 - RNA, 17 nt, Staphylococcus aureus subsp. aureus MW2
agcugacgaaaagucag

SEQ ID NO: 2117306 - RNA, 18 nt, Staphylococcus aureus subsp. aureus MW2
agcugacgaaaagucagc

SEQ ID NO: 2117307 - RNA, 15 nt, Staphylococcus aureus subsp. aureus MW2
agcugugugaaauau

SEQ ID NO: 2117308 - RNA, 19 nt, Staphylococcus aureus subsp. aureus MW2
agcuggcggaaagucagcu

SEQ ID NO: 2117309 - RNA, 20 nt, Staphylococcus aureus subsp. aureus MW2
agcuggcggaaagucagcuu

SEQ ID NO: 2117310 - RNA, 18 nt, Staphylococcus aureus subsp. aureus MW2
agcuggcggaaagucagg

SEQ ID NO: 2117311 - RNA, 19 nt, Staphylococcus aureus subsp. aureus MW2
agcugauuucuaucaaaua

SEQ ID NO: 2117312 - RNA, 22 nt, Staphylococcus aureus subsp. aureus MW2
agcugauuucuauuaauuauuu

SEQ ID NO: 2117313 - RNA, 18 nt, Staphylococcus aureus subsp. aureus MW2
agcugauuccauuucgau

SEQ ID NO: 2117314 - RNA, 14 nt, Staphylococcus aureus subsp. aureus MW2
agcugcgauauaac

SEQ ID NO: 2117315 - RNA, 20 nt, Staphylococcus aureus subsp. aureus MW2
agcuuuaauuuaucauuauu

SEQ ID NO: 2117316 - RNA, 12 nt, Staphylococcus aureus subsp. aureus MW2
agcuuuuguaaa

SEQ ID NO: 2117317 - RNA, 23 nt, Staphylococcus aureus subsp. aureus MW2
agcuuuuuucaauucuagucagg

SEQ ID NO: 2117318 - RNA, 21 nt, Staphylococcus aureus subsp. aureus MW2
agcuuucuaucuuguucuucu

SEQ ID NO: 2117319 - RNA, 19 nt, Staphylococcus aureus subsp. aureus MW2
agcuuuaugugguuuugau

SEQ ID NO: 2117320 - RNA, 17 nt, Staphylococcus aureus subsp. aureus MW2
agcuuuauaaaacgcuu

SEQ ID NO: 2117321 - RNA, 15 nt, Staphylococcus aureus subsp. aureus MW2
agcuucuuuaacaau

SEQ ID NO: 2117322 - RNA, 16 nt, Staphylococcus aureus subsp. aureus MW2
agcuucuuuaacaauu

SEQ ID NO: 2117323 - RNA, 19 nt, Staphylococcus aureus subsp. aureus MW2
agcuucuuuguuggggccc

SEQ ID NO: 2117324 - RNA, 21 nt, Staphylococcus aureus subsp. aureus MW2
agcuucuuuguuggggccccg

SEQ ID NO: 2117325 - RNA, 19 nt, Staphylococcus aureus subsp. aureus MW2
agcuugaauaauauauuua

SEQ ID NO: 2117326 - RNA, 16 nt, Staphylococcus aureus subsp. aureus MW2
agcuugaauaauauau

SEQ ID NO: 2117327 - RNA, 21 nt, Staphylococcus aureus subsp. aureus MW2
agcuuaaauagugcuuuuuca

SEQ ID NO: 2117328 - RNA, 14 nt, Staphylococcus aureus subsp. aureus MW2
aggaauauaaaacu

SEQ ID NO: 2117329 - RNA, 15 nt, Staphylococcus aureus subsp. aureus MW2
aggaauauaaaacug

SEQ ID NO: 2117330 - RNA, 18 nt, Staphylococcus aureus subsp. aureus MW2
aggaauaucuuucaaauu

SEQ ID NO: 2117331 - RNA, 17 nt, Staphylococcus aureus subsp. aureus MW2
aggaauaccacuuaauc

SEQ ID NO: 2117332 - RNA, 18 nt, Staphylococcus aureus subsp. aureus MW2
aggaauaauuuuaaaaau

SEQ ID NO: 2117333 - RNA, 15 nt, Staphylococcus aureus subsp. aureus MW2
aggaauccaaagcug

SEQ ID NO: 2117334 - RNA, 19 nt, Staphylococcus aureus subsp. aureus MW2
aggaccacucaauucucua

SEQ ID NO: 2117335 - RNA, 12 nt, Staphylococcus aureus subsp. aureus MW2
aggauaagaacg

SEQ ID NO: 2117336 - RNA, 18 nt, Staphylococcus aureus subsp. aureus MW2
aggauacauaaaucuaau

SEQ ID NO: 2117337 - RNA, 15 nt, Staphylococcus aureus subsp. aureus MW2
aggagucuggaacaa

SEQ ID NO: 2117338 - RNA, 21 nt, Staphylococcus aureus subsp. aureus MW2
aggauaugcuguguaucauca

SEQ ID NO: 2117339 - RNA, 15 nt, Staphylococcus aureus subsp. aureus MW2
aggaugaguuuaaaa

SEQ ID NO: 2117340 - RNA, 17 nt, Staphylococcus aureus subsp. aureus MW2
aggaugaguuuaaaaau

SEQ ID NO: 2117341 - RNA, 20 nt, Staphylococcus aureus subsp. aureus MW2
aggcauauccgaaaauugcu

SEQ ID NO: 2117342 - RNA, 13 nt, Staphylococcus aureus subsp. aureus MW2
aggcaaugcaagu

SEQ ID NO: 2117343 - RNA, 16 nt, Staphylococcus aureus subsp. aureus MW2
aggcaaucuugaacaa

SEQ ID NO: 2117344 - RNA, 17 nt, Staphylococcus aureus subsp. aureus MW2
aggcaaugcaaguuggc

SEQ ID NO: 2117345 - RNA, 13 nt, Staphylococcus aureus subsp. aureus MW2
aggcagguacuuc

SEQ ID NO: 2117346 - RNA, 14 nt, Staphylococcus aureus subsp. aureus MW2
aggcaauauuaaaa

SEQ ID NO: 2117347 - RNA, 19 nt, Staphylococcus aureus subsp. aureus MW2
aggauggaaugauacgccu

SEQ ID NO: 2117348 - RNA, 18 nt, Staphylococcus aureus subsp. aureus MW2
aggauguuauaaaaugaa

SEQ ID NO: 2117349 - RNA, 15 nt, Staphylococcus aureus subsp. aureus MW2
aggauguuauaaaau

SEQ ID NO: 2117350 - RNA, 14 nt, Staphylococcus aureus subsp. aureus MW2
aggauguucaucaa

SEQ ID NO: 2117351 - RNA, 23 nt, Staphylococcus aureus subsp. aureus MW2
aggcugggacauaaaucaauguu

SEQ ID NO: 2117352 - RNA, 17 nt, Staphylococcus aureus subsp. aureus MW2
aggcuagcuaaaauuug

SEQ ID NO: 2117353 - RNA, 18 nt, Staphylococcus aureus subsp. aureus MW2
aggcuagauaauaaucca

SEQ ID NO: 2117354 - RNA, 12 nt, Staphylococcus aureus subsp. aureus MW2
aggcuaauuuuu

SEQ ID NO: 2117355 - RNA, 23 nt, Staphylococcus aureus subsp. aureus MW2
aggggacuuaaccauuuaaaaau

SEQ ID NO: 2117356 - RNA, 13 nt, Staphylococcus aureus subsp. aureus MW2
agggguaaaacuu

SEQ ID NO: 2117357 - RNA, 17 nt, Staphylococcus aureus subsp. aureus MW2
agguaaaaauuaacaac

SEQ ID NO: 2117358 - RNA, 21 nt, Staphylococcus aureus subsp. aureus MW2
aggguauugaaauaauauaaa

SEQ ID NO: 2117359 - RNA, 17 nt, Staphylococcus aureus subsp. aureus MW2
aggcuuaaauauaauga

SEQ ID NO: 2117360 - RNA, 16 nt, Staphylococcus aureus subsp. aureus MW2
agguuauuuuuuaugg

SEQ ID NO: 2117361 - RNA, 14 nt, Staphylococcus aureus subsp. aureus MW2
agguugaagaagga

SEQ ID NO: 2117362 - RNA, 15 nt, Staphylococcus aureus subsp. aureus MW2
agguucuucaucuuu

SEQ ID NO: 2117363 - RNA, 16 nt, Staphylococcus aureus subsp. aureus MW2
agguuuucgccaauaa

SEQ ID NO: 2117364 - RNA, 17 nt, Staphylococcus aureus subsp. aureus MW2
agguuuuacaauuuuug

SEQ ID NO: 2117365 - RNA, 16 nt, Staphylococcus aureus subsp. aureus MW2
aguaaagugaaauaaa

SEQ ID NO: 2117366 - RNA, 15 nt, Staphylococcus aureus subsp. aureus MW2
aguaacucaagugau

SEQ ID NO: 2117367 - RNA, 17 nt, Staphylococcus aureus subsp. aureus MW2
aguaaauaauuuaaauu

SEQ ID NO: 2117368 - RNA, 21 nt, Staphylococcus aureus subsp. aureus MW2
aguaaauaauuuaaauuaaaa

SEQ ID NO: 2117369 - RNA, 18 nt, Staphylococcus aureus subsp. aureus MW2
aguaaugugcauugcuuu

SEQ ID NO: 2117370 - RNA, 16 nt, Staphylococcus aureus subsp. aureus MW2
aguaauuaaauacuug

SEQ ID NO: 2117371 - RNA, 22 nt, Staphylococcus aureus subsp. aureus MW2
aguacaauccugaagagaaaau

SEQ ID NO: 2117372 - RNA, 18 nt, Staphylococcus aureus subsp. aureus MW2
aguacggcugcuuuaacu

SEQ ID NO: 2117373 - RNA, 23 nt, Staphylococcus aureus subsp. aureus MW2
aguacgcaauuuaauauuauaag

SEQ ID NO: 2117374 - RNA, 17 nt, Staphylococcus aureus subsp. aureus MW2
agguuaucacaacagua

SEQ ID NO: 2117375 - RNA, 14 nt, Staphylococcus aureus subsp. aureus MW2
agguuauauuuaaa

SEQ ID NO: 2117376 - RNA, 19 nt, Staphylococcus aureus subsp. aureus MW2
agguuauuauaaaauaaau

SEQ ID NO: 2117377 - RNA, 15 nt, Staphylococcus aureus subsp. aureus MW2
agguuacaauaaugu

SEQ ID NO: 2117378 - RNA, 17 nt, Staphylococcus aureus subsp. aureus MW2
aggugucguaauuuacc

SEQ ID NO: 2117379 - RNA, 19 nt, Staphylococcus aureus subsp. aureus MW2
aggugcaucuuuugguuua

SEQ ID NO: 2117380 - RNA, 20 nt, Staphylococcus aureus subsp. aureus MW2
aggugcaucuuuugguuuag

SEQ ID NO: 2117381 - RNA, 17 nt, Staphylococcus aureus subsp. aureus MW2
aggugucaauaaauugu

SEQ ID NO: 2117382 - RNA, 19 nt, Staphylococcus aureus subsp. aureus MW2
agguauuucauugauaagu

SEQ ID NO: 2117383 - RNA, 13 nt, Staphylococcus aureus subsp. aureus MW2
aggucaaaaaauu

SEQ ID NO: 2117384 - RNA, 19 nt, Staphylococcus aureus subsp. aureus MW2
aggucaaaaaauuaaucaa

SEQ ID NO: 2117385 - RNA, 17 nt, Staphylococcus aureus subsp. aureus MW2
agguauucaaauaaaca

SEQ ID NO: 2117386 - RNA, 19 nt, Staphylococcus aureus subsp. aureus MW2
agguaaauuuaaaauaaua

SEQ ID NO: 2117387 - RNA, 12 nt, Staphylococcus aureus subsp. aureus MW2
agguaaauuuaa

SEQ ID NO: 2117388 - RNA, 20 nt, Staphylococcus aureus subsp. aureus MW2
aggucaaaaaauuaaucaau

SEQ ID NO: 2117389 - RNA, 13 nt, Staphylococcus aureus subsp. aureus MW2
agucagaaagaau

SEQ ID NO: 2117390 - RNA, 16 nt, Staphylococcus aureus subsp. aureus MW2
agucagcauacaauaa

SEQ ID NO: 2117391 - RNA, 21 nt, Staphylococcus aureus subsp. aureus MW2
agucaccugcuuuuuauuauu

SEQ ID NO: 2117392 - RNA, 17 nt, Staphylococcus aureus subsp. aureus MW2
agucaauuuaaauaagu

SEQ ID NO: 2117393 - RNA, 23 nt, Staphylococcus aureus subsp. aureus MW2
aguacuuacgaauagaaaauaau

SEQ ID NO: 2117394 - RNA, 16 nt, Staphylococcus aureus subsp. aureus MW2
aguacuuuaaaauugu

SEQ ID NO: 2117395 - RNA, 23 nt, Staphylococcus aureus subsp. aureus MW2
aguacuuggaaaauacuauacug

SEQ ID NO: 2117396 - RNA, 17 nt, Staphylococcus aureus subsp. aureus MW2
aguagaaccuauauuaa

SEQ ID NO: 2117397 - RNA, 15 nt, Staphylococcus aureus subsp. aureus MW2
aguccauuuucuuuu

SEQ ID NO: 2117398 - RNA, 16 nt, Staphylococcus aureus subsp. aureus MW2
aguccauuuucuuuuu

SEQ ID NO: 2117399 - RNA, 13 nt, Staphylococcus aureus subsp. aureus MW2
agucauuacaaau

SEQ ID NO: 2117400 - RNA, 17 nt, Staphylococcus aureus subsp. aureus MW2
agucauucaaucaucaa

SEQ ID NO: 2117401 - RNA, 21 nt, Staphylococcus aureus subsp. aureus MW2
agucauucaaucaucaagaca

SEQ ID NO: 2117402 - RNA, 15 nt, Staphylococcus aureus subsp. aureus MW2
agucaugucccauaa

SEQ ID NO: 2117403 - RNA, 18 nt, Staphylococcus aureus subsp. aureus MW2
agucauuugaugguuuaa

SEQ ID NO: 2117404 - RNA, 14 nt, Staphylococcus aureus subsp. aureus MW2
agucauuugauuua

SEQ ID NO: 2117405 - RNA, 12 nt, Staphylococcus aureus subsp. aureus MW2
agucaucaucau

SEQ ID NO: 2117406 - RNA, 15 nt, Staphylococcus aureus subsp. aureus MW2
agucauccaaagaaa

SEQ ID NO: 2117407 - RNA, 10 nt, Staphylococcus aureus subsp. aureus MW2
agucaucauc

SEQ ID NO: 2117408 - RNA, 22 nt, Staphylococcus aureus subsp. aureus MW2
agucaggggccccaacacagag

SEQ ID NO: 2117409 - RNA, 21 nt, Staphylococcus aureus subsp. aureus MW2
agucauaaauugauuucuaau

SEQ ID NO: 2117410 - RNA, 17 nt, Staphylococcus aureus subsp. aureus MW2
agucauagcuaugauuu

SEQ ID NO: 2117411 - RNA, 17 nt, Staphylococcus aureus subsp. aureus MW2
agucauaaauauaaaau

SEQ ID NO: 2117412 - RNA, 16 nt, Staphylococcus aureus subsp. aureus MW2
agucagcuuacaauaa

SEQ ID NO: 2117413 - RNA, 14 nt, Staphylococcus aureus subsp. aureus MW2
agucuugauggugg

SEQ ID NO: 2117414 - RNA, 16 nt, Staphylococcus aureus subsp. aureus MW2
agucuuaaacauaaca

SEQ ID NO: 2117415 - RNA, 19 nt, Staphylococcus aureus subsp. aureus MW2
agucuuaaacauaacauga

SEQ ID NO: 2117416 - RNA, 18 nt, Staphylococcus aureus subsp. aureus MW2
agugacauuccaaaaccg

SEQ ID NO: 2117417 - RNA, 22 nt, Staphylococcus aureus subsp. aureus MW2
agugaaagucguuguugaaauu

SEQ ID NO: 2117418 - RNA, 17 nt, Staphylococcus aureus subsp. aureus MW2
agugaaaguauuagaua

SEQ ID NO: 2117419 - RNA, 19 nt, Staphylococcus aureus subsp. aureus MW2
agugaaagucguuguugaa

SEQ ID NO: 2117420 - RNA, 17 nt, Staphylococcus aureus subsp. aureus MW2
agugaaaucauuuaaau

SEQ ID NO: 2117421 - RNA, 21 nt, Staphylococcus aureus subsp. aureus MW2
agugaacaccccuucucuaaa

SEQ ID NO: 2117422 - RNA, 23 nt, Staphylococcus aureus subsp. aureus MW2
agucuaaaugcaauauguaacaa

SEQ ID NO: 2117423 - RNA, 12 nt, Staphylococcus aureus subsp. aureus MW2
agucuaugaaua

SEQ ID NO: 2117424 - RNA, 13 nt, Staphylococcus aureus subsp. aureus MW2
agucuaugaauaa

SEQ ID NO: 2117425 - RNA, 14 nt, Staphylococcus aureus subsp. aureus MW2
agucuaugaauaau

SEQ ID NO: 2117426 - RNA, 15 nt, Staphylococcus aureus subsp. aureus MW2
agucuaugaauaaug

SEQ ID NO: 2117427 - RNA, 19 nt, Staphylococcus aureus subsp. aureus MW2
agucgcaauggcaauugau

SEQ ID NO: 2117428 - RNA, 14 nt, Staphylococcus aureus subsp. aureus MW2
agucccgcuuaaaa

SEQ ID NO: 2117429 - RNA, 20 nt, Staphylococcus aureus subsp. aureus MW2
agugaguuuuauuuauaaac

SEQ ID NO: 2117430 - RNA, 13 nt, Staphylococcus aureus subsp. aureus MW2
agugaguauaagu

SEQ ID NO: 2117431 - RNA, 16 nt, Staphylococcus aureus subsp. aureus MW2
agugauaaauaaugca

SEQ ID NO: 2117432 - RNA, 19 nt, Staphylococcus aureus subsp. aureus MW2
agugcuugauuaacauuuu

SEQ ID NO: 2117433 - RNA, 15 nt, Staphylococcus aureus subsp. aureus MW2
agugauaauuaaaau

SEQ ID NO: 2117434 - RNA, 17 nt, Staphylococcus aureus subsp. aureus MW2
aguggaagacaaugauu

SEQ ID NO: 2117435 - RNA, 14 nt, Staphylococcus aureus subsp. aureus MW2
aguggaaauuaugu

SEQ ID NO: 2117436 - RNA, 22 nt, Staphylococcus aureus subsp. aureus MW2
agugguuguucccauuuuuaaa

SEQ ID NO: 2117437 - RNA, 21 nt, Staphylococcus aureus subsp. aureus MW2
agugguuuucuuuauuuuaaa

SEQ ID NO: 2117438 - RNA, 14 nt, Staphylococcus aureus subsp. aureus MW2
aguguaaaugaaag

SEQ ID NO: 2117439 - RNA, 23 nt, Staphylococcus aureus subsp. aureus MW2
agugugcaggauaacguucacuu

SEQ ID NO: 2117440 - RNA, 19 nt, Staphylococcus aureus subsp. aureus MW2
aguguagccaaauaaauuu

SEQ ID NO: 2117441 - RNA, 22 nt, Staphylococcus aureus subsp. aureus MW2
aguguaauguuccccugaaaag

SEQ ID NO: 2117442 - RNA, 13 nt, Staphylococcus aureus subsp. aureus MW2
aguguaccuuguu

SEQ ID NO: 2117443 - RNA, 22 nt, Staphylococcus aureus subsp. aureus MW2
aguguucucauuauaaugauuu

SEQ ID NO: 2117444 - RNA, 22 nt, Staphylococcus aureus subsp. aureus MW2
aguguuauauuggcgggcccca

SEQ ID NO: 2117445 - RNA, 17 nt, Staphylococcus aureus subsp. aureus MW2
aguguguaucucuuauu

SEQ ID NO: 2117446 - RNA, 15 nt, Staphylococcus aureus subsp. aureus MW2
aguguggucuuguga

SEQ ID NO: 2117447 - RNA, 11 nt, Staphylococcus aureus subsp. aureus MW2
aguuaaaaccu

SEQ ID NO: 2117448 - RNA, 19 nt, Staphylococcus aureus subsp. aureus MW2
aguuaaaauugguuuggau

SEQ ID NO: 2117449 - RNA, 11 nt, Staphylococcus aureus subsp. aureus MW2
aguguuucaua

SEQ ID NO: 2117450 - RNA, 19 nt, Staphylococcus aureus subsp. aureus MW2
aguguuucauaaucucuuu

SEQ ID NO: 2117451 - RNA, 18 nt, Staphylococcus aureus subsp. aureus MW2
aguuaaauaucauaccgu

SEQ ID NO: 2117452 - RNA, 20 nt, Staphylococcus aureus subsp. aureus MW2
aguuaacggcguauucaauu

SEQ ID NO: 2117453 - RNA, 15 nt, Staphylococcus aureus subsp. aureus MW2
aguugacaauacaaa

SEQ ID NO: 2117454 - RNA, 17 nt, Staphylococcus aureus subsp. aureus MW2
aguugagucaauuucuu

SEQ ID NO: 2117455 - RNA, 16 nt, Staphylococcus aureus subsp. aureus MW2
aguugcugaauaaaau

SEQ ID NO: 2117456 - RNA, 23 nt, Staphylococcus aureus subsp. aureus MW2
aguugaaccguaacuauaugaaa

SEQ ID NO: 2117457 - RNA, 21 nt, Staphylococcus aureus subsp. aureus MW2
aguugaaaaccucuuuuuguu

SEQ ID NO: 2117458 - RNA, 21 nt, Staphylococcus aureus subsp. aureus MW2
aguugaaaauaaucgaacaga

SEQ ID NO: 2117459 - RNA, 16 nt, Staphylococcus aureus subsp. aureus MW2
aguucgaacacacacu

SEQ ID NO: 2117460 - RNA, 19 nt, Staphylococcus aureus subsp. aureus MW2
aguuauaccauauuuaugg

SEQ ID NO: 2117461 - RNA, 17 nt, Staphylococcus aureus subsp. aureus MW2
aguuauauauuacuuaa

SEQ ID NO: 2117462 - RNA, 18 nt, Staphylococcus aureus subsp. aureus MW2
aguuauaucauaacuuaa

SEQ ID NO: 2117463 - RNA, 15 nt, Staphylococcus aureus subsp. aureus MW2
aguuauuuaaguucu

SEQ ID NO: 2117464 - RNA, 15 nt, Staphylococcus aureus subsp. aureus MW2
aguucaaaauacuca

SEQ ID NO: 2117465 - RNA, 14 nt, Staphylococcus aureus subsp. aureus MW2
aguucaaacagaaa

SEQ ID NO: 2117466 - RNA, 19 nt, Staphylococcus aureus subsp. aureus MW2
aguucaaauugaacuucuu

SEQ ID NO: 2117467 - RNA, 23 nt, Staphylococcus aureus subsp. aureus MW2
aguucaaauggacuaacgucauu

SEQ ID NO: 2117468 - RNA, 21 nt, Staphylococcus aureus subsp. aureus MW2
aguuaggcgacuuaacuuaag

SEQ ID NO: 2117469 - RNA, 18 nt, Staphylococcus aureus subsp. aureus MW2
aguuagguaaaaauuaac

SEQ ID NO: 2117470 - RNA, 11 nt, Staphylococcus aureus subsp. aureus MW2
aguuaguuuuc

SEQ ID NO: 2117471 - RNA, 20 nt, Staphylococcus aureus subsp. aureus MW2
aguuaagugucuauguugaa

SEQ ID NO: 2117472 - RNA, 21 nt, Staphylococcus aureus subsp. aureus MW2
aguuaauccucauuaugagau

SEQ ID NO: 2117473 - RNA, 15 nt, Staphylococcus aureus subsp. aureus MW2
aguuaauauaauuaa

SEQ ID NO: 2117474 - RNA, 17 nt, Staphylococcus aureus subsp. aureus MW2
aguuaauauaauuaaac

SEQ ID NO: 2117475 - RNA, 16 nt, Staphylococcus aureus subsp. aureus MW2
aguuaauaaaauuacg

SEQ ID NO: 2117476 - RNA, 16 nt, Staphylococcus aureus subsp. aureus MW2
aguucaggaucaagug

SEQ ID NO: 2117477 - RNA, 19 nt, Staphylococcus aureus subsp. aureus MW2
aguucaucuggugcaauau

SEQ ID NO: 2117478 - RNA, 21 nt, Staphylococcus aureus subsp. aureus MW2
auaagacuucccuauauguag

SEQ ID NO: 2117479 - RNA, 15 nt, Staphylococcus aureus subsp. aureus MW2
auaagaaaauaccua

SEQ ID NO: 2117480 - RNA, 13 nt, Staphylococcus aureus subsp. aureus MW2
auaacuuguaaua

SEQ ID NO: 2117481 - RNA, 12 nt, Staphylococcus aureus subsp. aureus MW2
auaacuuuaaaa

SEQ ID NO: 2117482 - RNA, 15 nt, Staphylococcus aureus subsp. aureus MW2
auaacuuuaaaaauu

SEQ ID NO: 2117483 - RNA, 15 nt, Staphylococcus aureus subsp. aureus MW2
auaacuucguuuuaa

SEQ ID NO: 2117484 - RNA, 23 nt, Staphylococcus aureus subsp. aureus MW2
auaacucgacuugguauuuaucc

SEQ ID NO: 2117485 - RNA, 17 nt, Staphylococcus aureus subsp. aureus MW2
auaacuauuuaauuauu

SEQ ID NO: 2117486 - RNA, 22 nt, Staphylococcus aureus subsp. aureus MW2
auaacucaguaaauuuauuauu

SEQ ID NO: 2117487 - RNA, 21 nt, Staphylococcus aureus subsp. aureus MW2
auaaauuuauauauagaaaua

SEQ ID NO: 2117488 - RNA, 22 nt, Staphylococcus aureus subsp. aureus MW2
auaaauuuauauauagaaauaa

SEQ ID NO: 2117489 - RNA, 21 nt, Staphylococcus aureus subsp. aureus MW2
auaaauuucaagguauacaca

SEQ ID NO: 2117490 - RNA, 17 nt, Staphylococcus aureus subsp. aureus MW2
auaaauuguaugaauaa

SEQ ID NO: 2117491 - RNA, 20 nt, Staphylococcus aureus subsp. aureus MW2
auaaauuuaacguuauucau

SEQ ID NO: 2117492 - RNA, 21 nt, Staphylococcus aureus subsp. aureus MW2
auaaauugguucuauaauaaa

SEQ ID NO: 2117493 - RNA, 19 nt, Staphylococcus aureus subsp. aureus MW2
auaaauuguaauauauuaa

SEQ ID NO: 2117494 - RNA, 19 nt, Staphylococcus aureus subsp. aureus MW2
auaacgagcaguauauauc

SEQ ID NO: 2117495 - RNA, 18 nt, Staphylococcus aureus subsp. aureus MW2
auaacgauaccuuuaaua

SEQ ID NO: 2117496 - RNA, 15 nt, Staphylococcus aureus subsp. aureus MW2
auaacgcacugcauu

SEQ ID NO: 2117497 - RNA, 13 nt, Staphylococcus aureus subsp. aureus MW2
auaacuacacuua

SEQ ID NO: 2117498 - RNA, 17 nt, Staphylococcus aureus subsp. aureus MW2
auaacuaagauauuuag

SEQ ID NO: 2117499 - RNA, 16 nt, Staphylococcus aureus subsp. aureus MW2
auaagccuuuucaaac

SEQ ID NO: 2117500 - RNA, 17 nt, Staphylococcus aureus subsp. aureus MW2
auaagccuuuucaaaca

SEQ ID NO: 2117501 - RNA, 14 nt, Staphylococcus aureus subsp. aureus MW2
auaagauuucucag

SEQ ID NO: 2117502 - RNA, 19 nt, Staphylococcus aureus subsp. aureus MW2
auaagcaaagacaaaagca

SEQ ID NO: 2117503 - RNA, 21 nt, Staphylococcus aureus subsp. aureus MW2
auaagaugcaugccaauuaau

SEQ ID NO: 2117504 - RNA, 14 nt, Staphylococcus aureus subsp. aureus MW2
auaagauuuugcuu

SEQ ID NO: 2117505 - RNA, 21 nt, Staphylococcus aureus subsp. aureus MW2
auaagauaguuugagaaaauu

SEQ ID NO: 2117506 - RNA, 17 nt, Staphylococcus aureus subsp. aureus MW2
auaaggaagcguaugau

SEQ ID NO: 2117507 - RNA, 19 nt, Staphylococcus aureus subsp. aureus MW2
auaaggaauguauuuuuca

SEQ ID NO: 2117508 - RNA, 22 nt, Staphylococcus aureus subsp. aureus MW2
auaaggaugauuuauuaacuca

SEQ ID NO: 2117509 - RNA, 13 nt, Staphylococcus aureus subsp. aureus MW2
auaagcuaauauu

SEQ ID NO: 2117510 - RNA, 14 nt, Staphylococcus aureus subsp. aureus MW2
auaagcuaauauuu

SEQ ID NO: 2117511 - RNA, 16 nt, Staphylococcus aureus subsp. aureus MW2
auaagcuaauauuuau

SEQ ID NO: 2117512 - RNA, 23 nt, Staphylococcus aureus subsp. aureus MW2
auaagcuaauauuuauuuuaaau

SEQ ID NO: 2117513 - RNA, 16 nt, Staphylococcus aureus subsp. aureus MW2
auaagguacauaaaua

SEQ ID NO: 2117514 - RNA, 16 nt, Staphylococcus aureus subsp. aureus MW2
auaaugucuuacuugu

SEQ ID NO: 2117515 - RNA, 22 nt, Staphylococcus aureus subsp. aureus MW2
auaauguauaaaacagaauuuc

SEQ ID NO: 2117516 - RNA, 19 nt, Staphylococcus aureus subsp. aureus MW2
auaaugcuacuauuaaaua

SEQ ID NO: 2117517 - RNA, 14 nt, Staphylococcus aureus subsp. aureus MW2
auaaugcuacuauu

SEQ ID NO: 2117518 - RNA, 16 nt, Staphylococcus aureus subsp. aureus MW2
auaaugcuacuauuaa

SEQ ID NO: 2117519 - RNA, 20 nt, Staphylococcus aureus subsp. aureus MW2
auaaugcacgcgugccaaca

SEQ ID NO: 2117520 - RNA, 14 nt, Staphylococcus aureus subsp. aureus MW2
auaaugauuuuuau

SEQ ID NO: 2117521 - RNA, 18 nt, Staphylococcus aureus subsp. aureus MW2
auaaugcaugugaaauua

SEQ ID NO: 2117522 - RNA, 22 nt, Staphylococcus aureus subsp. aureus MW2
auaaugccaccguggaauuuac

SEQ ID NO: 2117523 - RNA, 19 nt, Staphylococcus aureus subsp. aureus MW2
auaaucguauucauaucau

SEQ ID NO: 2117524 - RNA, 13 nt, Staphylococcus aureus subsp. aureus MW2
auaaucuacugcu

SEQ ID NO: 2117525 - RNA, 12 nt, Staphylococcus aureus subsp. aureus MW2
auaaucuaucuu

SEQ ID NO: 2117526 - RNA, 19 nt, Staphylococcus aureus subsp. aureus MW2
auaaucucauucuuuaaua

SEQ ID NO: 2117527 - RNA, 21 nt, Staphylococcus aureus subsp. aureus MW2
auaaucucauucuuuaauaua

SEQ ID NO: 2117528 - RNA, 13 nt, Staphylococcus aureus subsp. aureus MW2
auaauuaaacaaa

SEQ ID NO: 2117529 - RNA, 21 nt, Staphylococcus aureus subsp. aureus MW2
auaauguuuccugauauuuca

SEQ ID NO: 2117530 - RNA, 20 nt, Staphylococcus aureus subsp. aureus MW2
auaauguuuccugauauuuc

SEQ ID NO: 2117531 - RNA, 19 nt, Staphylococcus aureus subsp. aureus MW2
auaauguuaagcaguuggu

SEQ ID NO: 2117532 - RNA, 14 nt, Staphylococcus aureus subsp. aureus MW2
auaauguuuccauu

SEQ ID NO: 2117533 - RNA, 16 nt, Staphylococcus aureus subsp. aureus MW2
auaauuaaauauaaag

SEQ ID NO: 2117534 - RNA, 15 nt, Staphylococcus aureus subsp. aureus MW2
auaauuaaauaacuu

SEQ ID NO: 2117535 - RNA, 14 nt, Staphylococcus aureus subsp. aureus MW2
auaauuaaauauaa

SEQ ID NO: 2117536 - RNA, 14 nt, Staphylococcus aureus subsp. aureus MW2
auaauuaaauaacu

SEQ ID NO: 2117537 - RNA, 11 nt, Staphylococcus aureus subsp. aureus MW2
auaauuaaaua

SEQ ID NO: 2117538 - RNA, 12 nt, Staphylococcus aureus subsp. aureus MW2
auaauuaaauaa

SEQ ID NO: 2117539 - RNA, 18 nt, Staphylococcus aureus subsp. aureus MW2
auaauuaaacuaauagca

SEQ ID NO: 2117540 - RNA, 12 nt, Staphylococcus aureus subsp. aureus MW2
auaauuaaacuu

SEQ ID NO: 2117541 - RNA, 20 nt, Staphylococcus aureus subsp. aureus MW2
auaauuaaacuuuaugaaaa

SEQ ID NO: 2117542 - RNA, 21 nt, Staphylococcus aureus subsp. aureus MW2
auaauuaaacuuuaugaaaau

SEQ ID NO: 2117543 - RNA, 19 nt, Staphylococcus aureus subsp. aureus MW2
auaauuaauuuuguaauua

SEQ ID NO: 2117544 - RNA, 15 nt, Staphylococcus aureus subsp. aureus MW2
auaauuacuaaaaua

SEQ ID NO: 2117545 - RNA, 14 nt, Staphylococcus aureus subsp. aureus MW2
auaauuaauaacau

SEQ ID NO: 2117546 - RNA, 13 nt, Staphylococcus aureus subsp. aureus MW2
auaauuaauguuu

SEQ ID NO: 2117547 - RNA, 23 nt, Staphylococcus aureus subsp. aureus MW2
auaauuaauccgucuuuuuuuau

SEQ ID NO: 2117548 - RNA, 18 nt, Staphylococcus aureus subsp. aureus MW2
auaauuaaauaaaaauau

SEQ ID NO: 2117549 - RNA, 23 nt, Staphylococcus aureus subsp. aureus MW2
auaauuaacuuacuuuuguaaaa

SEQ ID NO: 2117550 - RNA, 17 nt, Staphylococcus aureus subsp. aureus MW2
auaauuauuaaacuuug

SEQ ID NO: 2117551 - RNA, 22 nt, Staphylococcus aureus subsp. aureus MW2
auaauuagucauugaaaauauu

SEQ ID NO: 2117552 - RNA, 16 nt, Staphylococcus aureus subsp. aureus MW2
auaauuagauuuaaaa

SEQ ID NO: 2117553 - RNA, 14 nt, Staphylococcus aureus subsp. aureus MW2
auaauuaaguguau

SEQ ID NO: 2117554 - RNA, 15 nt, Staphylococcus aureus subsp. aureus MW2
auaauuagauuuaaa

SEQ ID NO: 2117555 - RNA, 20 nt, Staphylococcus aureus subsp. aureus MW2
auaaguacaaauaauacagg

SEQ ID NO: 2117556 - RNA, 15 nt, Staphylococcus aureus subsp. aureus MW2
auaaguacaaauaau

SEQ ID NO: 2117557 - RNA, 13 nt, Staphylococcus aureus subsp. aureus MW2
auaaguauuuuuu

SEQ ID NO: 2117558 - RNA, 21 nt, Staphylococcus aureus subsp. aureus MW2
auaaguaguucaauaaauuuu

SEQ ID NO: 2117559 - RNA, 16 nt, Staphylococcus aureus subsp. aureus MW2
auaaguaauaauauaa

SEQ ID NO: 2117560 - RNA, 16 nt, Staphylococcus aureus subsp. aureus MW2
auaauauauuaacaac

SEQ ID NO: 2117561 - RNA, 20 nt, Staphylococcus aureus subsp. aureus MW2
auaauagccgcuucauugau

SEQ ID NO: 2117562 - RNA, 16 nt, Staphylococcus aureus subsp. aureus MW2
auaauagcaaaauuau

SEQ ID NO: 2117563 - RNA, 13 nt, Staphylococcus aureus subsp. aureus MW2
auaauauauuuag

SEQ ID NO: 2117564 - RNA, 23 nt, Staphylococcus aureus subsp. aureus MW2
auaauagaaauaaucacauuaau

SEQ ID NO: 2117565 - RNA, 15 nt, Staphylococcus aureus subsp. aureus MW2
auaauagauaauagu

SEQ ID NO: 2117566 - RNA, 17 nt, Staphylococcus aureus subsp. aureus MW2
auaauauugaaagauau

SEQ ID NO: 2117567 - RNA, 22 nt, Staphylococcus aureus subsp. aureus MW2
auaaucaagucugcauuaauuu

SEQ ID NO: 2117568 - RNA, 14 nt, Staphylococcus aureus subsp. aureus MW2
auaaucaagaauau

SEQ ID NO: 2117569 - RNA, 18 nt, Staphylococcus aureus subsp. aureus MW2
auaaucaagaauauaaau

SEQ ID NO: 2117570 - RNA, 22 nt, Staphylococcus aureus subsp. aureus MW2
auaaucacaauacgaaaccaaa

SEQ ID NO: 2117571 - RNA, 19 nt, Staphylococcus aureus subsp. aureus MW2
auaauccauucuucuuguu

SEQ ID NO: 2117572 - RNA, 20 nt, Staphylococcus aureus subsp. aureus MW2
auaaucccaaccauucuacc

SEQ ID NO: 2117573 - RNA, 15 nt, Staphylococcus aureus subsp. aureus MW2
auaauccaagauaua

SEQ ID NO: 2117574 - RNA, 21 nt, Staphylococcus aureus subsp. aureus MW2
auaauccaccuaaaaaguacu

SEQ ID NO: 2117575 - RNA, 20 nt, Staphylococcus aureus subsp. aureus MW2
auaaaagccaugauacgaug

SEQ ID NO: 2117576 - RNA, 21 nt, Staphylococcus aureus subsp. aureus MW2
auaaaagcacuauuuuuauaa

SEQ ID NO: 2117577 - RNA, 14 nt, Staphylococcus aureus subsp. aureus MW2
auaaaagcaacaaa

SEQ ID NO: 2117578 - RNA, 17 nt, Staphylococcus aureus subsp. aureus MW2
auaaaacuaauuaggua

SEQ ID NO: 2117579 - RNA, 16 nt, Staphylococcus aureus subsp. aureus MW2
auaaaagucgauaaau

SEQ ID NO: 2117580 - RNA, 22 nt, Staphylococcus aureus subsp. aureus MW2
auaaaaggcuuuguuaaacaca

SEQ ID NO: 2117581 - RNA, 20 nt, Staphylococcus aureus subsp. aureus MW2
auaaaacuuacauuacauau

SEQ ID NO: 2117582 - RNA, 13 nt, Staphylococcus aureus subsp. aureus MW2
auaaaacuuacau

SEQ ID NO: 2117583 - RNA, 14 nt, Staphylococcus aureus subsp. aureus MW2
auaaaagagaagcu

SEQ ID NO: 2117584 - RNA, 17 nt, Staphylococcus aureus subsp. aureus MW2
auaaaaauuauauaaau

SEQ ID NO: 2117585 - RNA, 13 nt, Staphylococcus aureus subsp. aureus MW2
auaaaaauugaau

SEQ ID NO: 2117586 - RNA, 17 nt, Staphylococcus aureus subsp. aureus MW2
auaaaaaucuuggugau

SEQ ID NO: 2117587 - RNA, 16 nt, Staphylococcus aureus subsp. aureus MW2
auaaaaauguauuaaa

SEQ ID NO: 2117588 - RNA, 20 nt, Staphylococcus aureus subsp. aureus MW2
auaaaaauguauuaaauaug

SEQ ID NO: 2117589 - RNA, 16 nt, Staphylococcus aureus subsp. aureus MW2
auaaaaccgguacuuu

SEQ ID NO: 2117590 - RNA, 19 nt, Staphylococcus aureus subsp. aureus MW2
auaaaaccgguacuuucau

SEQ ID NO: 2117591 - RNA, 14 nt, Staphylococcus aureus subsp. aureus MW2
auaaaacaaauuau

SEQ ID NO: 2117592 - RNA, 19 nt, Staphylococcus aureus subsp. aureus MW2
auaaaaagaauaugauauu

SEQ ID NO: 2117593 - RNA, 18 nt, Staphylococcus aureus subsp. aureus MW2
auaaaaaggagcgacaau

SEQ ID NO: 2117594 - RNA, 21 nt, Staphylococcus aureus subsp. aureus MW2
auaaaaaggagcgacaaugga

SEQ ID NO: 2117595 - RNA, 16 nt, Staphylococcus aureus subsp. aureus MW2
auaaaaauacauaauu

SEQ ID NO: 2117596 - RNA, 15 nt, Staphylococcus aureus subsp. aureus MW2
auaaaaauauucaaa

SEQ ID NO: 2117597 - RNA, 22 nt, Staphylococcus aureus subsp. aureus MW2
aguuuuuuaaaauaaugauaua

SEQ ID NO: 2117598 - RNA, 12 nt, Staphylococcus aureus subsp. aureus MW2
auaaaaaauaac

SEQ ID NO: 2117599 - RNA, 14 nt, Staphylococcus aureus subsp. aureus MW2
auaaaaaauacuaa

SEQ ID NO: 2117600 - RNA, 17 nt, Staphylococcus aureus subsp. aureus MW2
auaaaaaaccaagugca

SEQ ID NO: 2117601 - RNA, 12 nt, Staphylococcus aureus subsp. aureus MW2
auaaaaaaagaa

SEQ ID NO: 2117602 - RNA, 22 nt, Staphylococcus aureus subsp. aureus MW2
auaaaaaaauagcuccuccaaa

SEQ ID NO: 2117603 - RNA, 14 nt, Staphylococcus aureus subsp. aureus MW2
auaaaaaaagagac

SEQ ID NO: 2117604 - RNA, 15 nt, Staphylococcus aureus subsp. aureus MW2
aguuuuuuuauaagc

SEQ ID NO: 2117605 - RNA, 16 nt, Staphylococcus aureus subsp. aureus MW2
aguuggcggggcccca

SEQ ID NO: 2117606 - RNA, 22 nt, Staphylococcus aureus subsp. aureus MW2
aguuggcggggcccaaacauag

SEQ ID NO: 2117607 - RNA, 15 nt, Staphylococcus aureus subsp. aureus MW2
aguuggcggggcccc

SEQ ID NO: 2117608 - RNA, 18 nt, Staphylococcus aureus subsp. aureus MW2
aguuggggaugggcccca

SEQ ID NO: 2117609 - RNA, 22 nt, Staphylococcus aureus subsp. aureus MW2
aguuggggaugggccccaacac

SEQ ID NO: 2117610 - RNA, 18 nt, Staphylococcus aureus subsp. aureus MW2
aguugguggaugucaugu

SEQ ID NO: 2117611 - RNA, 19 nt, Staphylococcus aureus subsp. aureus MW2
aguuuuggucaaguaaaug

SEQ ID NO: 2117612 - RNA, 15 nt, Staphylococcus aureus subsp. aureus MW2
aguuuuguauucagg

SEQ ID NO: 2117613 - RNA, 14 nt, Staphylococcus aureus subsp. aureus MW2
aguugguuuagaca

SEQ ID NO: 2117614 - RNA, 17 nt, Staphylococcus aureus subsp. aureus MW2
aguuguaacuguuugau

SEQ ID NO: 2117615 - RNA, 16 nt, Staphylococcus aureus subsp. aureus MW2
aguuuucuucacugcu

SEQ ID NO: 2117616 - RNA, 18 nt, Staphylococcus aureus subsp. aureus MW2
auaaacguccaaacacaa

SEQ ID NO: 2117617 - RNA, 14 nt, Staphylococcus aureus subsp. aureus MW2
auaaacuacacacg

SEQ ID NO: 2117618 - RNA, 18 nt, Staphylococcus aureus subsp. aureus MW2
auaaacuacuaaaaggac

SEQ ID NO: 2117619 - RNA, 23 nt, Staphylococcus aureus subsp. aureus MW2
auaaacuacuaaaaggacucaua

SEQ ID NO: 2117620 - RNA, 14 nt, Staphylococcus aureus subsp. aureus MW2
auaaacuauuaaau

SEQ ID NO: 2117621 - RNA, 16 nt, Staphylococcus aureus subsp. aureus MW2
auaaacuauuaaauca

SEQ ID NO: 2117622 - RNA, 23 nt, Staphylococcus aureus subsp. aureus MW2
auaaaaguuaccuacuacauucu

SEQ ID NO: 2117623 - RNA, 17 nt, Staphylococcus aureus subsp. aureus MW2
auaaaaguguaauguuc

SEQ ID NO: 2117624 - RNA, 16 nt, Staphylococcus aureus subsp. aureus MW2
auaaaaguuaggcgac

SEQ ID NO: 2117625 - RNA, 18 nt, Staphylococcus aureus subsp. aureus MW2
auaaaauaaaaaagccac

SEQ ID NO: 2117626 - RNA, 13 nt, Staphylococcus aureus subsp. aureus MW2
auaaacauaucau

SEQ ID NO: 2117627 - RNA, 17 nt, Staphylococcus aureus subsp. aureus MW2
auaaacaucuucuucau

SEQ ID NO: 2117628 - RNA, 12 nt, Staphylococcus aureus subsp. aureus MW2
auaaacauauca

SEQ ID NO: 2117629 - RNA, 13 nt, Staphylococcus aureus subsp. aureus MW2
auaaagaaugauu

SEQ ID NO: 2117630 - RNA, 22 nt, Staphylococcus aureus subsp. aureus MW2
auaaagaaugauuuauaaaaaa

SEQ ID NO: 2117631 - RNA, 20 nt, Staphylococcus aureus subsp. aureus MW2
auaaagaauuucgaaaagaa

SEQ ID NO: 2117632 - RNA, 23 nt, Staphylococcus aureus subsp. aureus MW2
auaaacuuuugcaauuuuugaaa

SEQ ID NO: 2117633 - RNA, 14 nt, Staphylococcus aureus subsp. aureus MW2
auaaacucuuauaa

SEQ ID NO: 2117634 - RNA, 12 nt, Staphylococcus aureus subsp. aureus MW2
auaaacuuaaaa

SEQ ID NO: 2117635 - RNA, 14 nt, Staphylococcus aureus subsp. aureus MW2
auaaacuuaaaaga

SEQ ID NO: 2117636 - RNA, 17 nt, Staphylococcus aureus subsp. aureus MW2
auaaacuuaaaagagaa

SEQ ID NO: 2117637 - RNA, 15 nt, Staphylococcus aureus subsp. aureus MW2
auaaaggaauagcua

SEQ ID NO: 2117638 - RNA, 13 nt, Staphylococcus aureus subsp. aureus MW2
auaaagauuauau

SEQ ID NO: 2117639 - RNA, 15 nt, Staphylococcus aureus subsp. aureus MW2
auaaagauuauaucu

SEQ ID NO: 2117640 - RNA, 18 nt, Staphylococcus aureus subsp. aureus MW2
auaaaugacuucacauuu

SEQ ID NO: 2117641 - RNA, 13 nt, Staphylococcus aureus subsp. aureus MW2
auaaaugauuaaa

SEQ ID NO: 2117642 - RNA, 23 nt, Staphylococcus aureus subsp. aureus MW2
auaaaugauuucuucauuaucaa

SEQ ID NO: 2117643 - RNA, 19 nt, Staphylococcus aureus subsp. aureus MW2
auaaauguuauugcuuauu

SEQ ID NO: 2117644 - RNA, 18 nt, Staphylococcus aureus subsp. aureus MW2
auaaauguuauugcuuau

SEQ ID NO: 2117645 - RNA, 22 nt, Staphylococcus aureus subsp. aureus MW2
auaaauguccgauuugauaaaa

SEQ ID NO: 2117646 - RNA, 15 nt, Staphylococcus aureus subsp. aureus MW2
auaaauguuagauuu

SEQ ID NO: 2117647 - RNA, 18 nt, Staphylococcus aureus subsp. aureus MW2
auaaauguuagauuucaa

SEQ ID NO: 2117648 - RNA, 19 nt, Staphylococcus aureus subsp. aureus MW2
auaaauguuagauuucaaa

SEQ ID NO: 2117649 - RNA, 18 nt, Staphylococcus aureus subsp. aureus MW2
auaaauguuauuaaccaa

SEQ ID NO: 2117650 - RNA, 21 nt, Staphylococcus aureus subsp. aureus MW2
auaaaugucacugcaaacaca

SEQ ID NO: 2117651 - RNA, 13 nt, Staphylococcus aureus subsp. aureus MW2
auaaauugauauu

SEQ ID NO: 2117652 - RNA, 18 nt, Staphylococcus aureus subsp. aureus MW2
auaaauucucuaauuucu

SEQ ID NO: 2117653 - RNA, 17 nt, Staphylococcus aureus subsp. aureus MW2
auaaauuagaugaaaug

SEQ ID NO: 2117654 - RNA, 14 nt, Staphylococcus aureus subsp. aureus MW2
auaaauuauuuuug

SEQ ID NO: 2117655 - RNA, 13 nt, Staphylococcus aureus subsp. aureus MW2
auaaaucaacuua

SEQ ID NO: 2117656 - RNA, 15 nt, Staphylococcus aureus subsp. aureus MW2
auaaaucaacuuaaa

SEQ ID NO: 2117657 - RNA, 16 nt, Staphylococcus aureus subsp. aureus MW2
auaaaucaacuuaaau

SEQ ID NO: 2117658 - RNA, 21 nt, Staphylococcus aureus subsp. aureus MW2
auaaauauuggaauacucuuu

SEQ ID NO: 2117659 - RNA, 14 nt, Staphylococcus aureus subsp. aureus MW2
auaaauauuguguu

SEQ ID NO: 2117660 - RNA, 19 nt, Staphylococcus aureus subsp. aureus MW2
auaaaugaauuauuuaaaa

SEQ ID NO: 2117661 - RNA, 13 nt, Staphylococcus aureus subsp. aureus MW2
auaaaucaucauu

SEQ ID NO: 2117662 - RNA, 15 nt, Staphylococcus aureus subsp. aureus MW2
auaaauaaaaauaca

SEQ ID NO: 2117663 - RNA, 22 nt, Staphylococcus aureus subsp. aureus MW2
auaaauaaaaauacauaauuaa

SEQ ID NO: 2117664 - RNA, 18 nt, Staphylococcus aureus subsp. aureus MW2
auaaauaaaaauauaucu

SEQ ID NO: 2117665 - RNA, 13 nt, Staphylococcus aureus subsp. aureus MW2
auaaauaaaaaua

SEQ ID NO: 2117666 - RNA, 17 nt, Staphylococcus aureus subsp. aureus MW2
auaaaguguaaauuuga

SEQ ID NO: 2117667 - RNA, 13 nt, Staphylococcus aureus subsp. aureus MW2
auaaauaaaauuu

SEQ ID NO: 2117668 - RNA, 12 nt, Staphylococcus aureus subsp. aureus MW2
auaaauaaaaug

SEQ ID NO: 2117669 - RNA, 13 nt, Staphylococcus aureus subsp. aureus MW2
auaaauaaaaugc

SEQ ID NO: 2117670 - RNA, 16 nt, Staphylococcus aureus subsp. aureus MW2
aaaacuauaauaaaga

SEQ ID NO: 2117671 - RNA, 23 nt, Staphylococcus aureus subsp. aureus MW2
aucauaauagccgcuucauugau

SEQ ID NO: 2117672 - RNA, 16 nt, Staphylococcus aureus subsp. aureus MW2
aaaacgugacauuuuc

SEQ ID NO: 2117673 - RNA, 15 nt, Staphylococcus aureus subsp. aureus MW2
aucauacgagaaauu

SEQ ID NO: 2117674 - RNA, 13 nt, Staphylococcus aureus subsp. aureus MW2
aucauacgagaaa

SEQ ID NO: 2117675 - RNA, 15 nt, Staphylococcus aureus subsp. aureus MW2
aucauacauauuuau

SEQ ID NO: 2117676 - RNA, 14 nt, Staphylococcus aureus subsp. aureus MW2
aucauacauuagaa

SEQ ID NO: 2117677 - RNA, 13 nt, Staphylococcus aureus subsp. aureus MW2
aucauaauuaaau

SEQ ID NO: 2117678 - RNA, 19 nt, Staphylococcus aureus subsp. aureus MW2
aucauaccagcaaguguau

SEQ ID NO: 2117679 - RNA, 19 nt, Staphylococcus aureus subsp. aureus MW2
aucauaauucccuguuaug

SEQ ID NO: 2117680 - RNA, 18 nt, Staphylococcus aureus subsp. aureus MW2
aucaucucugcuuuaaua

SEQ ID NO: 2117681 - RNA, 21 nt, Staphylococcus aureus subsp. aureus MW2
aucaucucugcuuuaauauaa

SEQ ID NO: 2117682 - RNA, 17 nt, Staphylococcus aureus subsp. aureus MW2
aucaugacacaaaggau

SEQ ID NO: 2117683 - RNA, 16 nt, Staphylococcus aureus subsp. aureus MW2
aucaugacauaaaacu

SEQ ID NO: 2117684 - RNA, 24 nt, Staphylococcus aureus subsp. aureus MW2
aucaugacuauuuuccaucacaua

SEQ ID NO: 2117685 - RNA, 14 nt, Staphylococcus aureus subsp. aureus MW2
aucaugacacaaag

SEQ ID NO: 2117686 - RNA, 19 nt, Staphylococcus aureus subsp. aureus MW2
aucauguacaguuacuuuc

SEQ ID NO: 2117687 - RNA, 23 nt, Staphylococcus aureus subsp. aureus MW2
aucauguaaugcuuaaaaacaau

SEQ ID NO: 2117688 - RNA, 16 nt, Staphylococcus aureus subsp. aureus MW2
aaaacugaaguaaaaa

SEQ ID NO: 2117689 - RNA, 18 nt, Staphylococcus aureus subsp. aureus MW2
aaaacugaaguaaaaagc

SEQ ID NO: 2117690 - RNA, 15 nt, Staphylococcus aureus subsp. aureus MW2
aucaugcuuuuuaau

SEQ ID NO: 2117691 - RNA, 14 nt, Staphylococcus aureus subsp. aureus MW2
aucaugcuuuuuug

SEQ ID NO: 2117692 - RNA, 17 nt, Staphylococcus aureus subsp. aureus MW2
aucaugcucguuuuuau

SEQ ID NO: 2117693 - RNA, 13 nt, Staphylococcus aureus subsp. aureus MW2
aucaugccuucau

SEQ ID NO: 2117694 - RNA, 18 nt, Staphylococcus aureus subsp. aureus MW2
aaaagaacauucuaacua

SEQ ID NO: 2117695 - RNA, 23 nt, Staphylococcus aureus subsp. aureus MW2
aucauguuccccauuaauuaaca

SEQ ID NO: 2117696 - RNA, 20 nt, Staphylococcus aureus subsp. aureus MW2
aucauguucuaaugcugcuu

SEQ ID NO: 2117697 - RNA, 18 nt, Staphylococcus aureus subsp. aureus MW2
aucaugucgaaucaaagu

SEQ ID NO: 2117698 - RNA, 22 nt, Staphylococcus aureus subsp. aureus MW2
aucauugauauagucaaugaau

SEQ ID NO: 2117699 - RNA, 16 nt, Staphylococcus aureus subsp. aureus MW2
auccaaagacauacag

SEQ ID NO: 2117700 - RNA, 11 nt, Staphylococcus aureus subsp. aureus MW2
auccaaaccaa

SEQ ID NO: 2117701 - RNA, 16 nt, Staphylococcus aureus subsp. aureus MW2
aucauuguaaaacaaa

SEQ ID NO: 2117702 - RNA, 13 nt, Staphylococcus aureus subsp. aureus MW2
aucauuguaaaug

SEQ ID NO: 2117703 - RNA, 17 nt, Staphylococcus aureus subsp. aureus MW2
auccaauuuauaaugau

SEQ ID NO: 2117704 - RNA, 15 nt, Staphylococcus aureus subsp. aureus MW2
auccacgguuuacca

SEQ ID NO: 2117705 - RNA, 20 nt, Staphylococcus aureus subsp. aureus MW2
auccaucaauaccauaauua

SEQ ID NO: 2117706 - RNA, 15 nt, Staphylococcus aureus subsp. aureus MW2
auccauauauguaac

SEQ ID NO: 2117707 - RNA, 15 nt, Staphylococcus aureus subsp. aureus MW2
auccaguuaauuauu

SEQ ID NO: 2117708 - RNA, 17 nt, Staphylococcus aureus subsp. aureus MW2
auccaguaaucaaagau

SEQ ID NO: 2117709 - RNA, 22 nt, Staphylococcus aureus subsp. aureus MW2
auccaguccuuuuuuuauguuu

SEQ ID NO: 2117710 - RNA, 19 nt, Staphylococcus aureus subsp. aureus MW2
aucccauuggcaucacaua

SEQ ID NO: 2117711 - RNA, 22 nt, Staphylococcus aureus subsp. aureus MW2
auccuacgacacguguaaaaau

SEQ ID NO: 2117712 - RNA, 17 nt, Staphylococcus aureus subsp. aureus MW2
auccuaugccaaauaac

SEQ ID NO: 2117713 - RNA, 20 nt, Staphylococcus aureus subsp. aureus MW2
auccuauggcgcaauuuuua

SEQ ID NO: 2117714 - RNA, 22 nt, Staphylococcus aureus subsp. aureus MW2
auccuuuuugacucaaaaucuu

SEQ ID NO: 2117715 - RNA, 16 nt, Staphylococcus aureus subsp. aureus MW2
auccuuugcucaccuu

SEQ ID NO: 2117716 - RNA, 11 nt, Staphylococcus aureus subsp. aureus MW2
auccuuaaaug

SEQ ID NO: 2117717 - RNA, 15 nt, Staphylococcus aureus subsp. aureus MW2
auccuuaacuuuauc

SEQ ID NO: 2117718 - RNA, 24 nt, Staphylococcus aureus subsp. aureus MW2
auccucacaaauuugaauauacuu

SEQ ID NO: 2117719 - RNA, 23 nt, Staphylococcus aureus subsp. aureus MW2
auccucaguauuuaauguuuuag

SEQ ID NO: 2117720 - RNA, 16 nt, Staphylococcus aureus subsp. aureus MW2
auccucaguuauacca

SEQ ID NO: 2117721 - RNA, 17 nt, Staphylococcus aureus subsp. aureus MW2
auccucauuaauaaauu

SEQ ID NO: 2117722 - RNA, 18 nt, Staphylococcus aureus subsp. aureus MW2
auccucauuaugagaucc

SEQ ID NO: 2117723 - RNA, 18 nt, Staphylococcus aureus subsp. aureus MW2
aucgccuaaaaauaaaau

SEQ ID NO: 2117724 - RNA, 15 nt, Staphylococcus aureus subsp. aureus MW2
aucgccuaaaaauaa

SEQ ID NO: 2117725 - RNA, 13 nt, Staphylococcus aureus subsp. aureus MW2
aucgccuaaaaau

SEQ ID NO: 2117726 - RNA, 16 nt, Staphylococcus aureus subsp. aureus MW2
aucgccuaaaaauaaa

SEQ ID NO: 2117727 - RNA, 14 nt, Staphylococcus aureus subsp. aureus MW2
aucgcgauuauuac

SEQ ID NO: 2117728 - RNA, 18 nt, Staphylococcus aureus subsp. aureus MW2
aucgauuaguuuuugguu

SEQ ID NO: 2117729 - RNA, 23 nt, Staphylococcus aureus subsp. aureus MW2
aucgaucgguauuuucauuuuag

SEQ ID NO: 2117730 - RNA, 19 nt, Staphylococcus aureus subsp. aureus MW2
aucgaugacuuugucuuua

SEQ ID NO: 2117731 - RNA, 15 nt, Staphylococcus aureus subsp. aureus MW2
aucgaaaauuucagg

SEQ ID NO: 2117732 - RNA, 22 nt, Staphylococcus aureus subsp. aureus MW2
aucgcaucuguuaacugaauuu

SEQ ID NO: 2117733 - RNA, 21 nt, Staphylococcus aureus subsp. aureus MW2
aucuaaaugaucuuuguagcc

SEQ ID NO: 2117734 - RNA, 21 nt, Staphylococcus aureus subsp. aureus MW2
aucuaaaugcacuagcaacau

SEQ ID NO: 2117735 - RNA, 14 nt, Staphylococcus aureus subsp. aureus MW2
aucuaaauguaaaa

SEQ ID NO: 2117736 - RNA, 19 nt, Staphylococcus aureus subsp. aureus MW2
aucguugcuuuuauuuuua

SEQ ID NO: 2117737 - RNA, 14 nt, Staphylococcus aureus subsp. aureus MW2
aucguugaaaaaua

SEQ ID NO: 2117738 - RNA, 15 nt, Staphylococcus aureus subsp. aureus MW2
aucuaaaaauccauu

SEQ ID NO: 2117739 - RNA, 18 nt, Staphylococcus aureus subsp. aureus MW2
aucguuuucaacauaaua

SEQ ID NO: 2117740 - RNA, 17 nt, Staphylococcus aureus subsp. aureus MW2
aucuaaucuuaauuguc

SEQ ID NO: 2117741 - RNA, 22 nt, Staphylococcus aureus subsp. aureus MW2
aucuaauucuguuucaaagcug

SEQ ID NO: 2117742 - RNA, 14 nt, Staphylococcus aureus subsp. aureus MW2
aucuaauucaaugu

SEQ ID NO: 2117743 - RNA, 14 nt, Staphylococcus aureus subsp. aureus MW2
aucuaauucguaau

SEQ ID NO: 2117744 - RNA, 19 nt, Staphylococcus aureus subsp. aureus MW2
aucuacaucaaauuuuucg

SEQ ID NO: 2117745 - RNA, 13 nt, Staphylococcus aureus subsp. aureus MW2
aucuacuuuuucg

SEQ ID NO: 2117746 - RNA, 23 nt, Staphylococcus aureus subsp. aureus MW2
aucuacuuccuuacagacaaaca

SEQ ID NO: 2117747 - RNA, 14 nt, Staphylococcus aureus subsp. aureus MW2
aucuacuuaaaaua

SEQ ID NO: 2117748 - RNA, 21 nt, Staphylococcus aureus subsp. aureus MW2
aucuacuuaaaauaaguauuu

SEQ ID NO: 2117749 - RNA, 22 nt, Staphylococcus aureus subsp. aureus MW2
aucuacuuaaaauaaguauuuu

SEQ ID NO: 2117750 - RNA, 20 nt, Staphylococcus aureus subsp. aureus MW2
aucuauguauaguaacgcau

SEQ ID NO: 2117751 - RNA, 18 nt, Staphylococcus aureus subsp. aureus MW2
aucuauuauuauguuaua

SEQ ID NO: 2117752 - RNA, 16 nt, Staphylococcus aureus subsp. aureus MW2
aucuauucaaauauaa

SEQ ID NO: 2117753 - RNA, 15 nt, Staphylococcus aureus subsp. aureus MW2
aucuauucaaaugau

SEQ ID NO: 2117754 - RNA, 20 nt, Staphylococcus aureus subsp. aureus MW2
aucguguauuauugaaacua

SEQ ID NO: 2117755 - RNA, 21 nt, Staphylococcus aureus subsp. aureus MW2
aucguuaauaaaccuacaaua

SEQ ID NO: 2117756 - RNA, 14 nt, Staphylococcus aureus subsp. aureus MW2
aucguuaaggaaag

SEQ ID NO: 2117757 - RNA, 20 nt, Staphylococcus aureus subsp. aureus MW2
aucguuaauuggauuuuuac

SEQ ID NO: 2117758 - RNA, 19 nt, Staphylococcus aureus subsp. aureus MW2
aucguuauaaguacaaaua

SEQ ID NO: 2117759 - RNA, 17 nt, Staphylococcus aureus subsp. aureus MW2
aucgugcccauaugauu

SEQ ID NO: 2117760 - RNA, 16 nt, Staphylococcus aureus subsp. aureus MW2
aucgugcccauaugau

SEQ ID NO: 2117761 - RNA, 16 nt, Staphylococcus aureus subsp. aureus MW2
aucgucuccaacuuua

SEQ ID NO: 2117762 - RNA, 18 nt, Staphylococcus aureus subsp. aureus MW2
aucucuauuuuuuauguu

SEQ ID NO: 2117763 - RNA, 18 nt, Staphylococcus aureus subsp. aureus MW2
aucucuucaauuuauuuu

SEQ ID NO: 2117764 - RNA, 20 nt, Staphylococcus aureus subsp. aureus MW2
aucucuucaauuuauuuuua

SEQ ID NO: 2117765 - RNA, 16 nt, Staphylococcus aureus subsp. aureus MW2
aucucuucaauuuauu

SEQ ID NO: 2117766 - RNA, 15 nt, Staphylococcus aureus subsp. aureus MW2
aucucuuauuuuaaa

SEQ ID NO: 2117767 - RNA, 16 nt, Staphylococcus aureus subsp. aureus MW2
aucucuuauuuuaaaa

SEQ ID NO: 2117768 - RNA, 18 nt, Staphylococcus aureus subsp. aureus MW2
aucucuuauuuuaaaaua

SEQ ID NO: 2117769 - RNA, 19 nt, Staphylococcus aureus subsp. aureus MW2
aucucuaaauccuuuggac

SEQ ID NO: 2117770 - RNA, 19 nt, Staphylococcus aureus subsp. aureus MW2
aucuauuuuaaacucaucc

SEQ ID NO: 2117771 - RNA, 18 nt, Staphylococcus aureus subsp. aureus MW2
aucuauuuaauaauguau

SEQ ID NO: 2117772 - RNA, 15 nt, Staphylococcus aureus subsp. aureus MW2
aucuauuucuauaua

SEQ ID NO: 2117773 - RNA, 14 nt, Staphylococcus aureus subsp. aureus MW2
aucuauuuaucaua

SEQ ID NO: 2117774 - RNA, 20 nt, Staphylococcus aureus subsp. aureus MW2
aucuauuuaucauacuucaa

SEQ ID NO: 2117775 - RNA, 18 nt, Staphylococcus aureus subsp. aureus MW2
aucuauugugauauauga

SEQ ID NO: 2117776 - RNA, 14 nt, Staphylococcus aureus subsp. aureus MW2
aucucaaaauuucg

SEQ ID NO: 2117777 - RNA, 12 nt, Staphylococcus aureus subsp. aureus MW2
aucucaaaauuu

SEQ ID NO: 2117778 - RNA, 15 nt, Staphylococcus aureus subsp. aureus MW2
aucucaaauauuaau

SEQ ID NO: 2117779 - RNA, 14 nt, Staphylococcus aureus subsp. aureus MW2
aucucaauccaauu

SEQ ID NO: 2117780 - RNA, 19 nt, Staphylococcus aureus subsp. aureus MW2
aucuccgcuacaauuauau

SEQ ID NO: 2117781 - RNA, 16 nt, Staphylococcus aureus subsp. aureus MW2
aucuccauuagaacua

SEQ ID NO: 2117782 - RNA, 13 nt, Staphylococcus aureus subsp. aureus MW2
aucugcauuuaau

SEQ ID NO: 2117783 - RNA, 17 nt, Staphylococcus aureus subsp. aureus MW2
aucugcaugguuugcug

SEQ ID NO: 2117784 - RNA, 17 nt, Staphylococcus aureus subsp. aureus MW2
aucugcaacgauuuuaa

SEQ ID NO: 2117785 - RNA, 23 nt, Staphylococcus aureus subsp. aureus MW2
aucugcaagugcuucaacuucau

SEQ ID NO: 2117786 - RNA, 21 nt, Staphylococcus aureus subsp. aureus MW2
aucugauuguucauguuuaaa

SEQ ID NO: 2117787 - RNA, 19 nt, Staphylococcus aureus subsp. aureus MW2
aucugcaaaugccucuuuu

SEQ ID NO: 2117788 - RNA, 17 nt, Staphylococcus aureus subsp. aureus MW2
aucugauaccguuagua

SEQ ID NO: 2117789 - RNA, 20 nt, Staphylococcus aureus subsp. aureus MW2
aucucuucugucuaaaaaca

SEQ ID NO: 2117790 - RNA, 14 nt, Staphylococcus aureus subsp. aureus MW2
aucuuguucuucuu

SEQ ID NO: 2117791 - RNA, 21 nt, Staphylococcus aureus subsp. aureus MW2
aucuuuaauuuucuugccauc

SEQ ID NO: 2117792 - RNA, 23 nt, Staphylococcus aureus subsp. aureus MW2
aucuuuacaacaguaaucaugca

SEQ ID NO: 2117793 - RNA, 22 nt, Staphylococcus aureus subsp. aureus MW2
aucuuuagagacuuauuuuaua

SEQ ID NO: 2117794 - RNA, 20 nt, Staphylococcus aureus subsp. aureus MW2
aucuuuagcuauuuaaaauu

SEQ ID NO: 2117795 - RNA, 18 nt, Staphylococcus aureus subsp. aureus MW2
aucuuuauaaaauuguaa

SEQ ID NO: 2117796 - RNA, 22 nt, Staphylococcus aureus subsp. aureus MW2
aucuuuacgauaaacuaaaaag

SEQ ID NO: 2117797 - RNA, 14 nt, Staphylococcus aureus subsp. aureus MW2
aucuuuaaucaaag

SEQ ID NO: 2117798 - RNA, 12 nt, Staphylococcus aureus subsp. aureus MW2
aucuuuaacucu

SEQ ID NO: 2117799 - RNA, 19 nt, Staphylococcus aureus subsp. aureus MW2
aucuuguuuucauuuaaaa

SEQ ID NO: 2117800 - RNA, 16 nt, Staphylococcus aureus subsp. aureus MW2
aucuuuaaagucaaca

SEQ ID NO: 2117801 - RNA, 23 nt, Staphylococcus aureus subsp. aureus MW2
aucuuguucuucgucaaauucaa

SEQ ID NO: 2117802 - RNA, 11 nt, Staphylococcus aureus subsp. aureus MW2
aucuuugauaa

SEQ ID NO: 2117803 - RNA, 19 nt, Staphylococcus aureus subsp. aureus MW2
aucuuuaguauuucaucau

SEQ ID NO: 2117804 - RNA, 19 nt, Staphylococcus aureus subsp. aureus MW2
aucuuuguaaauuuuuaag

SEQ ID NO: 2117805 - RNA, 17 nt, Staphylococcus aureus subsp. aureus MW2
aucuuuguaaauuuuua

SEQ ID NO: 2117806 - RNA, 16 nt, Staphylococcus aureus subsp. aureus MW2
aucuuugauuaugaac

SEQ ID NO: 2117807 - RNA, 13 nt, Staphylococcus aureus subsp. aureus MW2
aucuuuugcuucg

SEQ ID NO: 2117808 - RNA, 17 nt, Staphylococcus aureus subsp. aureus MW2
aucuuuugcaccuucaa

SEQ ID NO: 2117809 - RNA, 21 nt, Staphylococcus aureus subsp. aureus MW2
aucuuuugguuuaucuguugu

SEQ ID NO: 2117810 - RNA, 13 nt, Staphylococcus aureus subsp. aureus MW2
aucuuuuguuguu

SEQ ID NO: 2117811 - RNA, 20 nt, Staphylococcus aureus subsp. aureus MW2
aucuuuuucaaaaauuguua

SEQ ID NO: 2117812 - RNA, 13 nt, Staphylococcus aureus subsp. aureus MW2
aucuuuuuuaugu

SEQ ID NO: 2117813 - RNA, 16 nt, Staphylococcus aureus subsp. aureus MW2
aucuuuuuuacuaaaa

SEQ ID NO: 2117814 - RNA, 14 nt, Staphylococcus aureus subsp. aureus MW2
aucuuuuugaaauu

SEQ ID NO: 2117815 - RNA, 17 nt, Staphylococcus aureus subsp. aureus MW2
aucuuuuucacuaauca

SEQ ID NO: 2117816 - RNA, 14 nt, Staphylococcus aureus subsp. aureus MW2
aucuucuuuuuuau

SEQ ID NO: 2117817 - RNA, 18 nt, Staphylococcus aureus subsp. aureus MW2
aucuugaacaauucuuca

SEQ ID NO: 2117818 - RNA, 13 nt, Staphylococcus aureus subsp. aureus MW2
aucuucuguuuau

SEQ ID NO: 2117819 - RNA, 16 nt, Staphylococcus aureus subsp. aureus MW2
aucuugauuauauuuu

SEQ ID NO: 2117820 - RNA, 16 nt, Staphylococcus aureus subsp. aureus MW2
aucuguccgauuuaau

SEQ ID NO: 2117821 - RNA, 20 nt, Staphylococcus aureus subsp. aureus MW2
aucuguccgauuuaauauug

SEQ ID NO: 2117822 - RNA, 15 nt, Staphylococcus aureus subsp. aureus MW2
aucuguccgauuuuu

SEQ ID NO: 2117823 - RNA, 19 nt, Staphylococcus aureus subsp. aureus MW2
aucuucuaguaauucuuca

SEQ ID NO: 2117824 - RNA, 17 nt, Staphylococcus aureus subsp. aureus MW2
aucuucuaguaauucuu

SEQ ID NO: 2117825 - RNA, 23 nt, Staphylococcus aureus subsp. aureus MW2
aucuucuaauucguuuugcuaac

SEQ ID NO: 2117826 - RNA, 14 nt, Staphylococcus aureus subsp. aureus MW2
aucuucuaauuguu

SEQ ID NO: 2117827 - RNA, 14 nt, Staphylococcus aureus subsp. aureus MW2
aucuucuaauucca

SEQ ID NO: 2117828 - RNA, 20 nt, Staphylococcus aureus subsp. aureus MW2
aucuucuaguaauucuucau

SEQ ID NO: 2117829 - RNA, 14 nt, Staphylococcus aureus subsp. aureus MW2
aucuucucauaaaa

SEQ ID NO: 2117830 - RNA, 16 nt, Staphylococcus aureus subsp. aureus MW2
augaccuggaauauug

SEQ ID NO: 2117831 - RNA, 16 nt, Staphylococcus aureus subsp. aureus MW2
augaccuaauauauua

SEQ ID NO: 2117832 - RNA, 22 nt, Staphylococcus aureus subsp. aureus MW2
augaccauugucaugccuucau

SEQ ID NO: 2117833 - RNA, 15 nt, Staphylococcus aureus subsp. aureus MW2
augaccauugucaug

SEQ ID NO: 2117834 - RNA, 14 nt, Staphylococcus aureus subsp. aureus MW2
augacacauacacc

SEQ ID NO: 2117835 - RNA, 13 nt, Staphylococcus aureus subsp. aureus MW2
augaccaauauuc

SEQ ID NO: 2117836 - RNA, 23 nt, Staphylococcus aureus subsp. aureus MW2
augacauuuuaaaucuaauuauu

SEQ ID NO: 2117837 - RNA, 14 nt, Staphylococcus aureus subsp. aureus MW2
augagagauagaaa

SEQ ID NO: 2117838 - RNA, 21 nt, Staphylococcus aureus subsp. aureus MW2
augagacgcauugcaagacuu

SEQ ID NO: 2117839 - RNA, 16 nt, Staphylococcus aureus subsp. aureus MW2
augacgaacgauagau

SEQ ID NO: 2117840 - RNA, 22 nt, Staphylococcus aureus subsp. aureus MW2
augacaagagacugaagagcuu

SEQ ID NO: 2117841 - RNA, 14 nt, Staphylococcus aureus subsp. aureus MW2
augaauuaauagcu

SEQ ID NO: 2117842 - RNA, 16 nt, Staphylococcus aureus subsp. aureus MW2
augaauguuaagacau

SEQ ID NO: 2117843 - RNA, 19 nt, Staphylococcus aureus subsp. aureus MW2
augaauggcauuuaauacu

SEQ ID NO: 2117844 - RNA, 19 nt, Staphylococcus aureus subsp. aureus MW2
augaauggagcaugauuac

SEQ ID NO: 2117845 - RNA, 19 nt, Staphylococcus aureus subsp. aureus MW2
augaauucauuuuaucuau

SEQ ID NO: 2117846 - RNA, 19 nt, Staphylococcus aureus subsp. aureus MW2
augaauuauuuaaaaugcu

SEQ ID NO: 2117847 - RNA, 15 nt, Staphylococcus aureus subsp. aureus MW2
augaauuauuuaaaa

SEQ ID NO: 2117848 - RNA, 21 nt, Staphylococcus aureus subsp. aureus MW2
augaauaaauuguaauauauu

SEQ ID NO: 2117849 - RNA, 21 nt, Staphylococcus aureus subsp. aureus MW2
augaaugccuaauuuugugaa

SEQ ID NO: 2117850 - RNA, 19 nt, Staphylococcus aureus subsp. aureus MW2
augaaugccuaauuuugug

SEQ ID NO: 2117851 - RNA, 14 nt, Staphylococcus aureus subsp. aureus MW2
augaaaauuaaaaa

SEQ ID NO: 2117852 - RNA, 20 nt, Staphylococcus aureus subsp. aureus MW2
augaacuuaaugcuucaaau

SEQ ID NO: 2117853 - RNA, 16 nt, Staphylococcus aureus subsp. aureus MW2
augaaagcaccuaaaa

SEQ ID NO: 2117854 - RNA, 17 nt, Staphylococcus aureus subsp. aureus MW2
augaaagcaccuaaaau

SEQ ID NO: 2117855 - RNA, 20 nt, Staphylococcus aureus subsp. aureus MW2
augaaagcaccuaaaauaga

SEQ ID NO: 2117856 - RNA, 22 nt, Staphylococcus aureus subsp. aureus MW2
augaaagcaccuaaaauagaaa

SEQ ID NO: 2117857 - RNA, 21 nt, Staphylococcus aureus subsp. aureus MW2
augaagaggucuccaauacuu

SEQ ID NO: 2117858 - RNA, 22 nt, Staphylococcus aureus subsp. aureus MW2
auaccuaucccuguaaaaccau

SEQ ID NO: 2117859 - RNA, 22 nt, Staphylococcus aureus subsp. aureus MW2
auaccguacaaagguaauagaa

SEQ ID NO: 2117860 - RNA, 18 nt, Staphylococcus aureus subsp. aureus MW2
auaccgaauaauuuugau

SEQ ID NO: 2117861 - RNA, 13 nt, Staphylococcus aureus subsp. aureus MW2
auacguaaauggu

SEQ ID NO: 2117862 - RNA, 18 nt, Staphylococcus aureus subsp. aureus MW2
auacuaauaucuucuuua

SEQ ID NO: 2117863 - RNA, 15 nt, Staphylococcus aureus subsp. aureus MW2
auacuaaucaaagaa

SEQ ID NO: 2117864 - RNA, 19 nt, Staphylococcus aureus subsp. aureus MW2
auacuaaucaaagaaaaag

SEQ ID NO: 2117865 - RNA, 16 nt, Staphylococcus aureus subsp. aureus MW2
auacuaaauugagaag

SEQ ID NO: 2117866 - RNA, 15 nt, Staphylococcus aureus subsp. aureus MW2
auacuaaauuugaaa

SEQ ID NO: 2117867 - RNA, 13 nt, Staphylococcus aureus subsp. aureus MW2
auacuaaauugag

SEQ ID NO: 2117868 - RNA, 21 nt, Staphylococcus aureus subsp. aureus MW2
auacuaaaaguguuaugaauu

SEQ ID NO: 2117869 - RNA, 16 nt, Staphylococcus aureus subsp. aureus MW2
auacguuuauaucuua

SEQ ID NO: 2117870 - RNA, 23 nt, Staphylococcus aureus subsp. aureus MW2
auacguuuauccuuuaaaucauu

SEQ ID NO: 2117871 - RNA, 22 nt, Staphylococcus aureus subsp. aureus MW2
auacugaugaaaacuuaaaaau

SEQ ID NO: 2117872 - RNA, 18 nt, Staphylococcus aureus subsp. aureus MW2
auacuaauuuuguacaua

SEQ ID NO: 2117873 - RNA, 18 nt, Staphylococcus aureus subsp. aureus MW2
auagaaguuuuuugauua

SEQ ID NO: 2117874 - RNA, 14 nt, Staphylococcus aureus subsp. aureus MW2
auagaaguuuuuug

SEQ ID NO: 2117875 - RNA, 15 nt, Staphylococcus aureus subsp. aureus MW2
auagaaguauggaug

SEQ ID NO: 2117876 - RNA, 19 nt, Staphylococcus aureus subsp. aureus MW2
auagaaugauuaaaauuaa

SEQ ID NO: 2117877 - RNA, 15 nt, Staphylococcus aureus subsp. aureus MW2
auagaaugaauaauu

SEQ ID NO: 2117878 - RNA, 15 nt, Staphylococcus aureus subsp. aureus MW2
auagaaugucgauau

SEQ ID NO: 2117879 - RNA, 15 nt, Staphylococcus aureus subsp. aureus MW2
auagacaccaaaaac

SEQ ID NO: 2117880 - RNA, 17 nt, Staphylococcus aureus subsp. aureus MW2
auagacauaagcaaaga

SEQ ID NO: 2117881 - RNA, 12 nt, Staphylococcus aureus subsp. aureus MW2
auagaaaugaua

SEQ ID NO: 2117882 - RNA, 15 nt, Staphylococcus aureus subsp. aureus MW2
auagaaauaaucaca

SEQ ID NO: 2117883 - RNA, 16 nt, Staphylococcus aureus subsp. aureus MW2
auagaaauaauuuaaa

SEQ ID NO: 2117884 - RNA, 19 nt, Staphylococcus aureus subsp. aureus MW2
auacuguuuaaauaaaauu

SEQ ID NO: 2117885 - RNA, 14 nt, Staphylococcus aureus subsp. aureus MW2
auacuguuuaaaua

SEQ ID NO: 2117886 - RNA, 23 nt, Staphylococcus aureus subsp. aureus MW2
auacugaugguguugcauuagau

SEQ ID NO: 2117887 - RNA, 14 nt, Staphylococcus aureus subsp. aureus MW2
auacuguauuuaua

SEQ ID NO: 2117888 - RNA, 16 nt, Staphylococcus aureus subsp. aureus MW2
auacuuaauauaguua

SEQ ID NO: 2117889 - RNA, 22 nt, Staphylococcus aureus subsp. aureus MW2
auaccacuuaaucguucccauu

SEQ ID NO: 2117890 - RNA, 22 nt, Staphylococcus aureus subsp. aureus MW2
auaccacuugaauacuuuuuaa

SEQ ID NO: 2117891 - RNA, 19 nt, Staphylococcus aureus subsp. aureus MW2
auaccacuugaauacuuuu

SEQ ID NO: 2117892 - RNA, 14 nt, Staphylococcus aureus subsp. aureus MW2
auaccacuuaaucg

SEQ ID NO: 2117893 - RNA, 23 nt, Staphylococcus aureus subsp. aureus MW2
auaccacaucgcauaauaucuua

SEQ ID NO: 2117894 - RNA, 19 nt, Staphylococcus aureus subsp. aureus MW2
auaccacacuuuaaacaag

SEQ ID NO: 2117895 - RNA, 18 nt, Staphylococcus aureus subsp. aureus MW2
auaccacacuuuaaacaa

SEQ ID NO: 2117896 - RNA, 22 nt, Staphylococcus aureus subsp. aureus MW2
auaccaaccaaaaccaaaugaa

SEQ ID NO: 2117897 - RNA, 18 nt, Staphylococcus aureus subsp. aureus MW2
auaccaacugcaaauaca

SEQ ID NO: 2117898 - RNA, 13 nt, Staphylococcus aureus subsp. aureus MW2
auaccaacugucg

SEQ ID NO: 2117899 - RNA, 21 nt, Staphylococcus aureus subsp. aureus MW2
auaccaacugucgguucaucu

SEQ ID NO: 2117900 - RNA, 20 nt, Staphylococcus aureus subsp. aureus MW2
auaccauugugaugauaauu

SEQ ID NO: 2117901 - RNA, 18 nt, Staphylococcus aureus subsp. aureus MW2
auaccauuccaaaaauug

SEQ ID NO: 2117902 - RNA, 15 nt, Staphylococcus aureus subsp. aureus MW2
auaccauaauuaaau

SEQ ID NO: 2117903 - RNA, 19 nt, Staphylococcus aureus subsp. aureus MW2
auaccaguggaaauuaugu

SEQ ID NO: 2117904 - RNA, 22 nt, Staphylococcus aureus subsp. aureus MW2
auaccagugggcuccaaacaua

SEQ ID NO: 2117905 - RNA, 17 nt, Staphylococcus aureus subsp. aureus MW2
auacccuacuauauauc

SEQ ID NO: 2117906 - RNA, 18 nt, Staphylococcus aureus subsp. aureus MW2
auacccaauauuaaucca

SEQ ID NO: 2117907 - RNA, 18 nt, Staphylococcus aureus subsp. aureus MW2
auacauuucuguauaaac

SEQ ID NO: 2117908 - RNA, 13 nt, Staphylococcus aureus subsp. aureus MW2
auacauuuugaaa

SEQ ID NO: 2117909 - RNA, 14 nt, Staphylococcus aureus subsp. aureus MW2
auacauuuacauau

SEQ ID NO: 2117910 - RNA, 12 nt, Staphylococcus aureus subsp. aureus MW2
auacauuauuaa

SEQ ID NO: 2117911 - RNA, 21 nt, Staphylococcus aureus subsp. aureus MW2
auacauuccaaaguaccaucu

SEQ ID NO: 2117912 - RNA, 19 nt, Staphylococcus aureus subsp. aureus MW2
auacaugugggauaucuuc

SEQ ID NO: 2117913 - RNA, 15 nt, Staphylococcus aureus subsp. aureus MW2
auacauuaauauaaa

SEQ ID NO: 2117914 - RNA, 17 nt, Staphylococcus aureus subsp. aureus MW2
auacauguaacagugug

SEQ ID NO: 2117915 - RNA, 23 nt, Staphylococcus aureus subsp. aureus MW2
auacauguaacagugugaaauaa

SEQ ID NO: 2117916 - RNA, 16 nt, Staphylococcus aureus subsp. aureus MW2
auacauguacauuauc

SEQ ID NO: 2117917 - RNA, 20 nt, Staphylococcus aureus subsp. aureus MW2
auacauccauacuucuauuu

SEQ ID NO: 2117918 - RNA, 16 nt, Staphylococcus aureus subsp. aureus MW2
auacaucaucgccagc

SEQ ID NO: 2117919 - RNA, 14 nt, Staphylococcus aureus subsp. aureus MW2
auacauauuuauau

SEQ ID NO: 2117920 - RNA, 18 nt, Staphylococcus aureus subsp. aureus MW2
auacauauuuauauuuug

SEQ ID NO: 2117921 - RNA, 15 nt, Staphylococcus aureus subsp. aureus MW2
auacaugauauaaau

SEQ ID NO: 2117922 - RNA, 14 nt, Staphylococcus aureus subsp. aureus MW2
auaauucauaaaug

SEQ ID NO: 2117923 - RNA, 21 nt, Staphylococcus aureus subsp. aureus MW2
auaauucaguguuacuauaca

SEQ ID NO: 2117924 - RNA, 14 nt, Staphylococcus aureus subsp. aureus MW2
auacauaucuuuug

SEQ ID NO: 2117925 - RNA, 14 nt, Staphylococcus aureus subsp. aureus MW2
auacauauaagaau

SEQ ID NO: 2117926 - RNA, 12 nt, Staphylococcus aureus subsp. aureus MW2
auacauacugau

SEQ ID NO: 2117927 - RNA, 20 nt, Staphylococcus aureus subsp. aureus MW2
auacauaacgucccauaaua

SEQ ID NO: 2117928 - RNA, 14 nt, Staphylococcus aureus subsp. aureus MW2
auagagacauuuua

SEQ ID NO: 2117929 - RNA, 21 nt, Staphylococcus aureus subsp. aureus MW2
auagcgcucuggauuuuucuu

SEQ ID NO: 2117930 - RNA, 20 nt, Staphylococcus aureus subsp. aureus MW2
auagcgcucuggauuuuucu

SEQ ID NO: 2117931 - RNA, 22 nt, Staphylococcus aureus subsp. aureus MW2
auagcccuuuauacaauuuuuu

SEQ ID NO: 2117932 - RNA, 16 nt, Staphylococcus aureus subsp. aureus MW2
auaggaaacuuaaaua

SEQ ID NO: 2117933 - RNA, 17 nt, Staphylococcus aureus subsp. aureus MW2
auaggauuauuaucaaa

SEQ ID NO: 2117934 - RNA, 16 nt, Staphylococcus aureus subsp. aureus MW2
auaggauuuccuauua

SEQ ID NO: 2117935 - RNA, 20 nt, Staphylococcus aureus subsp. aureus MW2
auaggauuuccuauuaggau

SEQ ID NO: 2117936 - RNA, 21 nt, Staphylococcus aureus subsp. aureus MW2
auaggauuuccuauuaggauc

SEQ ID NO: 2117937 - RNA, 14 nt, Staphylococcus aureus subsp. aureus MW2
auaggaaacuuaaa

SEQ ID NO: 2117938 - RNA, 15 nt, Staphylococcus aureus subsp. aureus MW2
auagcuuuacuucuc

SEQ ID NO: 2117939 - RNA, 20 nt, Staphylococcus aureus subsp. aureus MW2
auagcugugauuugaucaac

SEQ ID NO: 2117940 - RNA, 22 nt, Staphylococcus aureus subsp. aureus MW2
auaggugauuauauauauuaaa

SEQ ID NO: 2117941 - RNA, 14 nt, Staphylococcus aureus subsp. aureus MW2
auagguauaagaau

SEQ ID NO: 2117942 - RNA, 16 nt, Staphylococcus aureus subsp. aureus MW2
auagggcgcacauuau

SEQ ID NO: 2117943 - RNA, 20 nt, Staphylococcus aureus subsp. aureus MW2
auaguaacgucugguuuaau

SEQ ID NO: 2117944 - RNA, 15 nt, Staphylococcus aureus subsp. aureus MW2
auaguaccaugcucu

SEQ ID NO: 2117945 - RNA, 21 nt, Staphylococcus aureus subsp. aureus MW2
auaguaccaugcucuuuuucc

SEQ ID NO: 2117946 - RNA, 21 nt, Staphylococcus aureus subsp. aureus MW2
auaguaacagacuuuguuaaa

SEQ ID NO: 2117947 - RNA, 18 nt, Staphylococcus aureus subsp. aureus MW2
auaguaagguuugaacuc

SEQ ID NO: 2117948 - RNA, 16 nt, Staphylococcus aureus subsp. aureus MW2
auaguaauaaaagucg

SEQ ID NO: 2117949 - RNA, 17 nt, Staphylococcus aureus subsp. aureus MW2
auaguaaagugaaauaa

SEQ ID NO: 2117950 - RNA, 19 nt, Staphylococcus aureus subsp. aureus MW2
auaguaaaauaaauacaau

SEQ ID NO: 2117951 - RNA, 23 nt, Staphylococcus aureus subsp. aureus MW2
auaguauuaacuauaaauagaag

SEQ ID NO: 2117952 - RNA, 15 nt, Staphylococcus aureus subsp. aureus MW2
auaguauguaucuuu

SEQ ID NO: 2117953 - RNA, 19 nt, Staphylococcus aureus subsp. aureus MW2
auaguauuaacuauaaaua

SEQ ID NO: 2117954 - RNA, 12 nt, Staphylococcus aureus subsp. aureus MW2
auaguaggagug

SEQ ID NO: 2117955 - RNA, 19 nt, Staphylococcus aureus subsp. aureus MW2
auaguaggguauugaaaua

SEQ ID NO: 2117956 - RNA, 21 nt, Staphylococcus aureus subsp. aureus MW2
auauccacgguuuaccacuua

SEQ ID NO: 2117957 - RNA, 22 nt, Staphylococcus aureus subsp. aureus MW2
auaucaugcgcaauauucguag

SEQ ID NO: 2117958 - RNA, 20 nt, Staphylococcus aureus subsp. aureus MW2
auaucagcuaaguuaaauau

SEQ ID NO: 2117959 - RNA, 21 nt, Staphylococcus aureus subsp. aureus MW2
auaucacaacacauaaauuaa

SEQ ID NO: 2117960 - RNA, 15 nt, Staphylococcus aureus subsp. aureus MW2
auauauaaugaaggu

SEQ ID NO: 2117961 - RNA, 22 nt, Staphylococcus aureus subsp. aureus MW2
auauauaaccauaguaacaaaa

SEQ ID NO: 2117962 - RNA, 13 nt, Staphylococcus aureus subsp. aureus MW2
auauauacaaaua

SEQ ID NO: 2117963 - RNA, 18 nt, Staphylococcus aureus subsp. aureus MW2
auauauacaaauaaacac

SEQ ID NO: 2117964 - RNA, 11 nt, Staphylococcus aureus subsp. aureus MW2
auauauaaaag

SEQ ID NO: 2117965 - RNA, 14 nt, Staphylococcus aureus subsp. aureus MW2
auauauuauaaaaa

SEQ ID NO: 2117966 - RNA, 15 nt, Staphylococcus aureus subsp. aureus MW2
auauauuauaaaaau

SEQ ID NO: 2117967 - RNA, 18 nt, Staphylococcus aureus subsp. aureus MW2
auauauuaacaacuuuau

SEQ ID NO: 2117968 - RNA, 12 nt, Staphylococcus aureus subsp. aureus MW2
auauauuaaaaa

SEQ ID NO: 2117969 - RNA, 13 nt, Staphylococcus aureus subsp. aureus MW2
auauauuaaaaau

SEQ ID NO: 2117970 - RNA, 15 nt, Staphylococcus aureus subsp. aureus MW2
auauauguaacauaa

SEQ ID NO: 2117971 - RNA, 16 nt, Staphylococcus aureus subsp. aureus MW2
auauauguaacauaaa

SEQ ID NO: 2117972 - RNA, 14 nt, Staphylococcus aureus subsp. aureus MW2
auauaugauaaaua

SEQ ID NO: 2117973 - RNA, 15 nt, Staphylococcus aureus subsp. aureus MW2
auauauucaucucuu

SEQ ID NO: 2117974 - RNA, 18 nt, Staphylococcus aureus subsp. aureus MW2
auauauucguuacaaaug

SEQ ID NO: 2117975 - RNA, 13 nt, Staphylococcus aureus subsp. aureus MW2
auaucaaauacau

SEQ ID NO: 2117976 - RNA, 21 nt, Staphylococcus aureus subsp. aureus MW2
auaucaaauacauuucaaaaa

SEQ ID NO: 2117977 - RNA, 18 nt, Staphylococcus aureus subsp. aureus MW2
auaucaauaauucguuga

SEQ ID NO: 2117978 - RNA, 21 nt, Staphylococcus aureus subsp. aureus MW2
auaucaauuuauuauuaacug

SEQ ID NO: 2117979 - RNA, 12 nt, Staphylococcus aureus subsp. aureus MW2
auaucaaguaug

SEQ ID NO: 2117980 - RNA, 19 nt, Staphylococcus aureus subsp. aureus MW2
auauagucaaugaauaaug

SEQ ID NO: 2117981 - RNA, 19 nt, Staphylococcus aureus subsp. aureus MW2
auauaguaaaauaaauaca

SEQ ID NO: 2117982 - RNA, 22 nt, Staphylococcus aureus subsp. aureus MW2
auauaguacuuacgaauagaaa

SEQ ID NO: 2117983 - RNA, 15 nt, Staphylococcus aureus subsp. aureus MW2
auauagcauaaaauu

SEQ ID NO: 2117984 - RNA, 20 nt, Staphylococcus aureus subsp. aureus MW2
auauaacuauggucaucaau

SEQ ID NO: 2117985 - RNA, 21 nt, Staphylococcus aureus subsp. aureus MW2
auauaacuauggucaucaauu

SEQ ID NO: 2117986 - RNA, 13 nt, Staphylococcus aureus subsp. aureus MW2
auauaauuuauuu

SEQ ID NO: 2117987 - RNA, 18 nt, Staphylococcus aureus subsp. aureus MW2
auauaauuuuaauauuau

SEQ ID NO: 2117988 - RNA, 13 nt, Staphylococcus aureus subsp. aureus MW2
auauacaaauaaa

SEQ ID NO: 2117989 - RNA, 14 nt, Staphylococcus aureus subsp. aureus MW2
auauaccaaccaaa

SEQ ID NO: 2117990 - RNA, 15 nt, Staphylococcus aureus subsp. aureus MW2
auauacauuuacaua

SEQ ID NO: 2117991 - RNA, 23 nt, Staphylococcus aureus subsp. aureus MW2
auagugguaaaaaguuuaaagua

SEQ ID NO: 2117992 - RNA, 18 nt, Staphylococcus aureus subsp. aureus MW2
auagugugucauaaugaa

SEQ ID NO: 2117993 - RNA, 16 nt, Staphylococcus aureus subsp. aureus MW2
auagucuuaaacauaa

SEQ ID NO: 2117994 - RNA, 16 nt, Staphylococcus aureus subsp. aureus MW2
auagucgguuauuaca

SEQ ID NO: 2117995 - RNA, 23 nt, Staphylococcus aureus subsp. aureus MW2
auagucggggccccaacacagag

SEQ ID NO: 2117996 - RNA, 22 nt, Staphylococcus aureus subsp. aureus MW2
auaguccgcguguacuuuacca

SEQ ID NO: 2117997 - RNA, 14 nt, Staphylococcus aureus subsp. aureus MW2
auauaaauagguca

SEQ ID NO: 2117998 - RNA, 20 nt, Staphylococcus aureus subsp. aureus MW2
auaguuaagauuuuaacuuc

SEQ ID NO: 2117999 - RNA, 17 nt, Staphylococcus aureus subsp. aureus MW2
auauaaauuaucagaau

SEQ ID NO: 2118000 - RNA, 16 nt, Staphylococcus aureus subsp. aureus MW2
auauaacgcuuuaaau

SEQ ID NO: 2118001 - RNA, 17 nt, Staphylococcus aureus subsp. aureus MW2
auauaaccgugaugaug

SEQ ID NO: 2118002 - RNA, 20 nt, Staphylococcus aureus subsp. aureus MW2
auauaaccauaguaacaaaa

SEQ ID NO: 2118003 - RNA, 13 nt, Staphylococcus aureus subsp. aureus MW2
aucaaaaauaaaa

SEQ ID NO: 2118004 - RNA, 19 nt, Staphylococcus aureus subsp. aureus MW2
auauuuuuuacaagcuuua

SEQ ID NO: 2118005 - RNA, 23 nt, Staphylococcus aureus subsp. aureus MW2
auauuuuuuacaagcuuuauaaa

SEQ ID NO: 2118006 - RNA, 22 nt, Staphylococcus aureus subsp. aureus MW2
aucaaaaaaacaaaaaauaauu

SEQ ID NO: 2118007 - RNA, 16 nt, Staphylococcus aureus subsp. aureus MW2
auauuuuuugauauaa

SEQ ID NO: 2118008 - RNA, 17 nt, Staphylococcus aureus subsp. aureus MW2
auauuuuuugauauaaa

SEQ ID NO: 2118009 - RNA, 16 nt, Staphylococcus aureus subsp. aureus MW2
auauuuuuuguacauu

SEQ ID NO: 2118010 - RNA, 22 nt, Staphylococcus aureus subsp. aureus MW2
auauuuuuuguacauuauuaau

SEQ ID NO: 2118011 - RNA, 17 nt, Staphylococcus aureus subsp. aureus MW2
auauuuuuaucaucuuc

SEQ ID NO: 2118012 - RNA, 19 nt, Staphylococcus aureus subsp. aureus MW2
auauuuuucuucaguuaaa

SEQ ID NO: 2118013 - RNA, 12 nt, Staphylococcus aureus subsp. aureus MW2
auauuuuucuuc

SEQ ID NO: 2118014 - RNA, 13 nt, Staphylococcus aureus subsp. aureus MW2
auauuucuuacca

SEQ ID NO: 2118015 - RNA, 23 nt, Staphylococcus aureus subsp. aureus MW2
auauuucuguuuuccuuuugaau

SEQ ID NO: 2118016 - RNA, 16 nt, Staphylococcus aureus subsp. aureus MW2
auauuuuuacauauuu

SEQ ID NO: 2118017 - RNA, 12 nt, Staphylococcus aureus subsp. aureus MW2
auauucuuaucu

SEQ ID NO: 2118018 - RNA, 20 nt, Staphylococcus aureus subsp. aureus MW2
auauucguagcaugacauua

SEQ ID NO: 2118019 - RNA, 22 nt, Staphylococcus aureus subsp. aureus MW2
auauucuaauugcacauuuaaa

SEQ ID NO: 2118020 - RNA, 18 nt, Staphylococcus aureus subsp. aureus MW2
auauucuacaugaaucaa

SEQ ID NO: 2118021 - RNA, 21 nt, Staphylococcus aureus subsp. aureus MW2
auauucugcaccuguuuuaau

SEQ ID NO: 2118022 - RNA, 21 nt, Staphylococcus aureus subsp. aureus MW2
auauuuacacagaaugauaua

SEQ ID NO: 2118023 - RNA, 22 nt, Staphylococcus aureus subsp. aureus MW2
auauuuaucgcgauuauuacca

SEQ ID NO: 2118024 - RNA, 22 nt, Staphylococcus aureus subsp. aureus MW2
auauuucgguuagucuuaaucc

SEQ ID NO: 2118025 - RNA, 16 nt, Staphylococcus aureus subsp. aureus MW2
auauuucuaaaccauu

SEQ ID NO: 2118026 - RNA, 14 nt, Staphylococcus aureus subsp. aureus MW2
auauuucuaaauua

SEQ ID NO: 2118027 - RNA, 21 nt, Staphylococcus aureus subsp. aureus MW2
auauuucugggcuuucuuuuu

SEQ ID NO: 2118028 - RNA, 12 nt, Staphylococcus aureus subsp. aureus MW2
auauuuauucua

SEQ ID NO: 2118029 - RNA, 13 nt, Staphylococcus aureus subsp. aureus MW2
aucaaauuuuucg

SEQ ID NO: 2118030 - RNA, 23 nt, Staphylococcus aureus subsp. aureus MW2
aucaacauauuuaucucuuucuu

SEQ ID NO: 2118031 - RNA, 21 nt, Staphylococcus aureus subsp. aureus MW2
aucaacaguuuuauuaucuuu

SEQ ID NO: 2118032 - RNA, 17 nt, Staphylococcus aureus subsp. aureus MW2
aucaacauuaauaaaua

SEQ ID NO: 2118033 - RNA, 17 nt, Staphylococcus aureus subsp. aureus MW2
aucaacugcuucacgau

SEQ ID NO: 2118034 - RNA, 13 nt, Staphylococcus aureus subsp. aureus MW2
aucaaauuaccau

SEQ ID NO: 2118035 - RNA, 22 nt, Staphylococcus aureus subsp. aureus MW2
aucaaauuacuuauucaaaugu

SEQ ID NO: 2118036 - RNA, 13 nt, Staphylococcus aureus subsp. aureus MW2
aucaaaucaauau

SEQ ID NO: 2118037 - RNA, 16 nt, Staphylococcus aureus subsp. aureus MW2
aucaaaucaauaucau

SEQ ID NO: 2118038 - RNA, 18 nt, Staphylococcus aureus subsp. aureus MW2
aucaaauagacaccaaaa

SEQ ID NO: 2118039 - RNA, 19 nt, Staphylococcus aureus subsp. aureus MW2
aucaaauagacaccaaaaa

SEQ ID NO: 2118040 - RNA, 24 nt, Staphylococcus aureus subsp. aureus MW2
aucaaaguuuucaggaauuguuaa

SEQ ID NO: 2118041 - RNA, 21 nt, Staphylococcus aureus subsp. aureus MW2
aucaaagucuucuucaacaau

SEQ ID NO: 2118042 - RNA, 16 nt, Staphylococcus aureus subsp. aureus MW2
aucaaaguaucuuuug

SEQ ID NO: 2118043 - RNA, 23 nt, Staphylococcus aureus subsp. aureus MW2
aucaaagaaaaagugauaauuaa

SEQ ID NO: 2118044 - RNA, 19 nt, Staphylococcus aureus subsp. aureus MW2
aucaaagaggcuuuaaaau

SEQ ID NO: 2118045 - RNA, 21 nt, Staphylococcus aureus subsp. aureus MW2
aucaaaguaucagucauugca

SEQ ID NO: 2118046 - RNA, 19 nt, Staphylococcus aureus subsp. aureus MW2
aucaaagucucuaguaucu

SEQ ID NO: 2118047 - RNA, 11 nt, Staphylococcus aureus subsp. aureus MW2
aucaaaggcuu

SEQ ID NO: 2118048 - RNA, 16 nt, Staphylococcus aureus subsp. aureus MW2
aucaaagaguaaaguu

SEQ ID NO: 2118049 - RNA, 23 nt, Staphylococcus aureus subsp. aureus MW2
auaugcuugcugugaauaaaauu

SEQ ID NO: 2118050 - RNA, 15 nt, Staphylococcus aureus subsp. aureus MW2
auauccuguuucaua

SEQ ID NO: 2118051 - RNA, 12 nt, Staphylococcus aureus subsp. aureus MW2
auaugcauauau

SEQ ID NO: 2118052 - RNA, 17 nt, Staphylococcus aureus subsp. aureus MW2
auauccugccaauauau

SEQ ID NO: 2118053 - RNA, 13 nt, Staphylococcus aureus subsp. aureus MW2
auaugcaucaaca

SEQ ID NO: 2118054 - RNA, 16 nt, Staphylococcus aureus subsp. aureus MW2
auaugcaucaacagau

SEQ ID NO: 2118055 - RNA, 20 nt, Staphylococcus aureus subsp. aureus MW2
auaugccaaaguaauaaugg

SEQ ID NO: 2118056 - RNA, 15 nt, Staphylococcus aureus subsp. aureus MW2
auauguaaaugaaau

SEQ ID NO: 2118057 - RNA, 15 nt, Staphylococcus aureus subsp. aureus MW2
auauguacuauuauc

SEQ ID NO: 2118058 - RNA, 23 nt, Staphylococcus aureus subsp. aureus MW2
auaugguuguuuuccaauaauaa

SEQ ID NO: 2118059 - RNA, 12 nt, Staphylococcus aureus subsp. aureus MW2
auauguaaauga

SEQ ID NO: 2118060 - RNA, 15 nt, Staphylococcus aureus subsp. aureus MW2
auaugguuagaaaaa

SEQ ID NO: 2118061 - RNA, 16 nt, Staphylococcus aureus subsp. aureus MW2
auaugguuagaaaaaa

SEQ ID NO: 2118062 - RNA, 15 nt, Staphylococcus aureus subsp. aureus MW2
auauguuuuauaaua

SEQ ID NO: 2118063 - RNA, 15 nt, Staphylococcus aureus subsp. aureus MW2
auauguuuaauguau

SEQ ID NO: 2118064 - RNA, 22 nt, Staphylococcus aureus subsp. aureus MW2
auauguuuauauugcaaaaaua

SEQ ID NO: 2118065 - RNA, 21 nt, Staphylococcus aureus subsp. aureus MW2
auaugucucucuuucuuauuc

SEQ ID NO: 2118066 - RNA, 22 nt, Staphylococcus aureus subsp. aureus MW2
auaugucucucuuucuuauuca

SEQ ID NO: 2118067 - RNA, 14 nt, Staphylococcus aureus subsp. aureus MW2
auaugugaaaaagc

SEQ ID NO: 2118068 - RNA, 15 nt, Staphylococcus aureus subsp. aureus MW2
auauguguguugcuu

SEQ ID NO: 2118069 - RNA, 21 nt, Staphylococcus aureus subsp. aureus MW2
auauguguguugcuuugauuu

SEQ ID NO: 2118070 - RNA, 22 nt, Staphylococcus aureus subsp. aureus MW2
auaugugcuuuuguaaauuaca

SEQ ID NO: 2118071 - RNA, 20 nt, Staphylococcus aureus subsp. aureus MW2
auauguggcacucauaaccg

SEQ ID NO: 2118072 - RNA, 20 nt, Staphylococcus aureus subsp. aureus MW2
auauguggcgcucuuauaaa

SEQ ID NO: 2118073 - RNA, 14 nt, Staphylococcus aureus subsp. aureus MW2
auauuaauugaaaa

SEQ ID NO: 2118074 - RNA, 15 nt, Staphylococcus aureus subsp. aureus MW2
auauuaauuuauaau

SEQ ID NO: 2118075 - RNA, 13 nt, Staphylococcus aureus subsp. aureus MW2
auauuacauauaa

SEQ ID NO: 2118076 - RNA, 19 nt, Staphylococcus aureus subsp. aureus MW2
auauuagauaucuuaaucu

SEQ ID NO: 2118077 - RNA, 19 nt, Staphylococcus aureus subsp. aureus MW2
auauuacuucucaucgaau

SEQ ID NO: 2118078 - RNA, 22 nt, Staphylococcus aureus subsp. aureus MW2
auauuacuaaccuauuaaaaua

SEQ ID NO: 2118079 - RNA, 23 nt, Staphylococcus aureus subsp. aureus MW2
auauuacuaaccuauuaaaauaa

SEQ ID NO: 2118080 - RNA, 19 nt, Staphylococcus aureus subsp. aureus MW2
auauuacuaaccuauuaaa

SEQ ID NO: 2118081 - RNA, 18 nt, Staphylococcus aureus subsp. aureus MW2
auauuaacuguuagacuu

SEQ ID NO: 2118082 - RNA, 15 nt, Staphylococcus aureus subsp. aureus MW2
auauuaagauguaua

SEQ ID NO: 2118083 - RNA, 15 nt, Staphylococcus aureus subsp. aureus MW2
auauuaauagaaagu

SEQ ID NO: 2118084 - RNA, 17 nt, Staphylococcus aureus subsp. aureus MW2
auauuaauauaaaauaa

SEQ ID NO: 2118085 - RNA, 14 nt, Staphylococcus aureus subsp. aureus MW2
auauuaauauauuu

SEQ ID NO: 2118086 - RNA, 15 nt, Staphylococcus aureus subsp. aureus MW2
auauuaauauauuua

SEQ ID NO: 2118087 - RNA, 16 nt, Staphylococcus aureus subsp. aureus MW2
auauuaauauauuuaa

SEQ ID NO: 2118088 - RNA, 17 nt, Staphylococcus aureus subsp. aureus MW2
auauuaauauauuuaaa

SEQ ID NO: 2118089 - RNA, 19 nt, Staphylococcus aureus subsp. aureus MW2
auauuaauauguuaauuua

SEQ ID NO: 2118090 - RNA, 12 nt, Staphylococcus aureus subsp. aureus MW2
auauuaauauuu

SEQ ID NO: 2118091 - RNA, 17 nt, Staphylococcus aureus subsp. aureus MW2
auauuaauauuugauua

SEQ ID NO: 2118092 - RNA, 18 nt, Staphylococcus aureus subsp. aureus MW2
auauuaauauuuuuugau

SEQ ID NO: 2118093 - RNA, 15 nt, Staphylococcus aureus subsp. aureus MW2
auauuaaucaauuua

SEQ ID NO: 2118094 - RNA, 13 nt, Staphylococcus aureus subsp. aureus MW2
auauuaaaguaaa

SEQ ID NO: 2118095 - RNA, 13 nt, Staphylococcus aureus subsp. aureus MW2
auauuaaauaaag

SEQ ID NO: 2118096 - RNA, 15 nt, Staphylococcus aureus subsp. aureus MW2
auauuaacaccagau

SEQ ID NO: 2118097 - RNA, 17 nt, Staphylococcus aureus subsp. aureus MW2
auauuaaauuuacaaaa

SEQ ID NO: 2118098 - RNA, 22 nt, Staphylococcus aureus subsp. aureus MW2
auauuaaauuuacaaaaacuau

SEQ ID NO: 2118099 - RNA, 14 nt, Staphylococcus aureus subsp. aureus MW2
auauucaaaauaac

SEQ ID NO: 2118100 - RNA, 14 nt, Staphylococcus aureus subsp. aureus MW2
auauucaaacgaag

SEQ ID NO: 2118101 - RNA, 13 nt, Staphylococcus aureus subsp. aureus MW2
auauucaaauuua

SEQ ID NO: 2118102 - RNA, 14 nt, Staphylococcus aureus subsp. aureus MW2
auauucaaauuuac

SEQ ID NO: 2118103 - RNA, 16 nt, Staphylococcus aureus subsp. aureus MW2
auauucgcuuaaaaac

SEQ ID NO: 2118104 - RNA, 23 nt, Staphylococcus aureus subsp. aureus MW2
auauucgcgaacguuauuuucaa

SEQ ID NO: 2118105 - RNA, 18 nt, Staphylococcus aureus subsp. aureus MW2
auauuaggccaacguuuu

SEQ ID NO: 2118106 - RNA, 12 nt, Staphylococcus aureus subsp. aureus MW2
auauuauauaua

SEQ ID NO: 2118107 - RNA, 15 nt, Staphylococcus aureus subsp. aureus MW2
auauuauaaaaagau

SEQ ID NO: 2118108 - RNA, 18 nt, Staphylococcus aureus subsp. aureus MW2
auauuaugccauucauua

SEQ ID NO: 2118109 - RNA, 16 nt, Staphylococcus aureus subsp. aureus MW2
auauuaugaacaugaa

SEQ ID NO: 2118110 - RNA, 21 nt, Staphylococcus aureus subsp. aureus MW2
auauuaugaacaugaaauuaa

SEQ ID NO: 2118111 - RNA, 17 nt, Staphylococcus aureus subsp. aureus MW2
auauuauucauaauaua

SEQ ID NO: 2118112 - RNA, 20 nt, Staphylococcus aureus subsp. aureus MW2
auauuauugugaaaucuauu

SEQ ID NO: 2118113 - RNA, 20 nt, Staphylococcus aureus subsp. aureus MW2
aucacacgcauacaggaaau

SEQ ID NO: 2118114 - RNA, 15 nt, Staphylococcus aureus subsp. aureus MW2
aucacagaaaauaca

SEQ ID NO: 2118115 - RNA, 22 nt, Staphylococcus aureus subsp. aureus MW2
aucacagaaaauacauuucugu

SEQ ID NO: 2118116 - RNA, 16 nt, Staphylococcus aureus subsp. aureus MW2
aucacaguuauauauu

SEQ ID NO: 2118117 - RNA, 18 nt, Staphylococcus aureus subsp. aureus MW2
aucacaguuauauauuac

SEQ ID NO: 2118118 - RNA, 13 nt, Staphylococcus aureus subsp. aureus MW2
aucacaucauacc

SEQ ID NO: 2118119 - RNA, 16 nt, Staphylococcus aureus subsp. aureus MW2
aucacagcaauaauaa

SEQ ID NO: 2118120 - RNA, 13 nt, Staphylococcus aureus subsp. aureus MW2
aucacauuaacaa

SEQ ID NO: 2118121 - RNA, 18 nt, Staphylococcus aureus subsp. aureus MW2
aucacaauauaacaucaa

SEQ ID NO: 2118122 - RNA, 23 nt, Staphylococcus aureus subsp. aureus MW2
aucacaauacgaaaccaaaaaua

SEQ ID NO: 2118123 - RNA, 15 nt, Staphylococcus aureus subsp. aureus MW2
aucacaacacauaaa

SEQ ID NO: 2118124 - RNA, 17 nt, Staphylococcus aureus subsp. aureus MW2
aucaauuucuguaauaa

SEQ ID NO: 2118125 - RNA, 16 nt, Staphylococcus aureus subsp. aureus MW2
aucaauuuauuauuaa

SEQ ID NO: 2118126 - RNA, 15 nt, Staphylococcus aureus subsp. aureus MW2
aucaauuuaauuaag

SEQ ID NO: 2118127 - RNA, 17 nt, Staphylococcus aureus subsp. aureus MW2
aucaacuugaauguaug

SEQ ID NO: 2118128 - RNA, 15 nt, Staphylococcus aureus subsp. aureus MW2
aucaccauaaaaaua

SEQ ID NO: 2118129 - RNA, 19 nt, Staphylococcus aureus subsp. aureus MW2
aucacgugguuucuuuaau

SEQ ID NO: 2118130 - RNA, 19 nt, Staphylococcus aureus subsp. aureus MW2
aucacguuuuucuuuaaac

SEQ ID NO: 2118131 - RNA, 20 nt, Staphylococcus aureus subsp. aureus MW2
aucacucggcagauguucag

SEQ ID NO: 2118132 - RNA, 21 nt, Staphylococcus aureus subsp. aureus MW2
aucacugaaugcuaauacuaa

SEQ ID NO: 2118133 - RNA, 13 nt, Staphylococcus aureus subsp. aureus MW2
aucacuauuuuag

SEQ ID NO: 2118134 - RNA, 16 nt, Staphylococcus aureus subsp. aureus MW2
aucacucaacauauua

SEQ ID NO: 2118135 - RNA, 14 nt, Staphylococcus aureus subsp. aureus MW2
aucacuaaaguaaa

SEQ ID NO: 2118136 - RNA, 16 nt, Staphylococcus aureus subsp. aureus MW2
aucacuauauuucaca

SEQ ID NO: 2118137 - RNA, 16 nt, Staphylococcus aureus subsp. aureus MW2
aucagcuauaaaagua

SEQ ID NO: 2118138 - RNA, 15 nt, Staphylococcus aureus subsp. aureus MW2
aucagcuaaauauuu

SEQ ID NO: 2118139 - RNA, 14 nt, Staphylococcus aureus subsp. aureus MW2
aucagaaucaagua

SEQ ID NO: 2118140 - RNA, 21 nt, Staphylococcus aureus subsp. aureus MW2
aucaguuucaucaaguauaaa

SEQ ID NO: 2118141 - RNA, 13 nt, Staphylococcus aureus subsp. aureus MW2
aucagucauucac

SEQ ID NO: 2118142 - RNA, 18 nt, Staphylococcus aureus subsp. aureus MW2
aucagucauucacauaca

SEQ ID NO: 2118143 - RNA, 23 nt, Staphylococcus aureus subsp. aureus MW2
aucagucucuaaaacuuuuucaa

SEQ ID NO: 2118144 - RNA, 16 nt, Staphylococcus aureus subsp. aureus MW2
aucaguuguguaauaa

SEQ ID NO: 2118145 - RNA, 16 nt, Staphylococcus aureus subsp. aureus MW2
aucaguuauuuuaaua

SEQ ID NO: 2118146 - RNA, 14 nt, Staphylococcus aureus subsp. aureus MW2
aucaguaauaucaa

SEQ ID NO: 2118147 - RNA, 17 nt, Staphylococcus aureus subsp. aureus MW2
aucaggcuuuauuguug

SEQ ID NO: 2118148 - RNA, 20 nt, Staphylococcus aureus subsp. aureus MW2
caaguaugagacgcauugca

SEQ ID NO: 2118149 - RNA, 18 nt, Staphylococcus aureus subsp. aureus MW2
caaggauguuauaaaaug

SEQ ID NO: 2118150 - RNA, 20 nt, Staphylococcus aureus subsp. aureus MW2
caaggauguuauaaaaugaa

SEQ ID NO: 2118151 - RNA, 14 nt, Staphylococcus aureus subsp. aureus MW2
caagcuuuauaaaa

SEQ ID NO: 2118152 - RNA, 14 nt, Staphylococcus aureus subsp. aureus MW2
caagugcagauguu

SEQ ID NO: 2118153 - RNA, 20 nt, Staphylococcus aureus subsp. aureus MW2
caagucguucucuuaaauau

SEQ ID NO: 2118154 - RNA, 18 nt, Staphylococcus aureus subsp. aureus MW2
caagucuucuaaaaaauc

SEQ ID NO: 2118155 - RNA, 10 nt, Staphylococcus aureus subsp. aureus MW2
caauaaaauu

SEQ ID NO: 2118156 - RNA, 13 nt, Staphylococcus aureus subsp. aureus MW2
caauaaaaugcaa

SEQ ID NO: 2118157 - RNA, 20 nt, Staphylococcus aureus subsp. aureus MW2
caauaaaaugcaauuuuuca

SEQ ID NO: 2118158 - RNA, 13 nt, Staphylococcus aureus subsp. aureus MW2
caauaaaaauuga

SEQ ID NO: 2118159 - RNA, 21 nt, Staphylococcus aureus subsp. aureus MW2
caauaaaauuggaacacgaaa

SEQ ID NO: 2118160 - RNA, 16 nt, Staphylococcus aureus subsp. aureus MW2
caaguuacgauaucau

SEQ ID NO: 2118161 - RNA, 24 nt, Staphylococcus aureus subsp. aureus MW2
caaguuuaguaucuccaucaaagu

SEQ ID NO: 2118162 - RNA, 19 nt, Staphylococcus aureus subsp. aureus MW2
caaguuuauaaucuuuuuu

SEQ ID NO: 2118163 - RNA, 22 nt, Staphylococcus aureus subsp. aureus MW2
caaguuucauggggcuuaugca

SEQ ID NO: 2118164 - RNA, 14 nt, Staphylococcus aureus subsp. aureus MW2
caauaauaaaucac

SEQ ID NO: 2118165 - RNA, 15 nt, Staphylococcus aureus subsp. aureus MW2
caauaauaugccaaa

SEQ ID NO: 2118166 - RNA, 17 nt, Staphylococcus aureus subsp. aureus MW2
caauacagaacuuuaau

SEQ ID NO: 2118167 - RNA, 19 nt, Staphylococcus aureus subsp. aureus MW2
caauacagaacuuuaauaa

SEQ ID NO: 2118168 - RNA, 22 nt, Staphylococcus aureus subsp. aureus MW2
caauacagaacuuuaauaauga

SEQ ID NO: 2118169 - RNA, 16 nt, Staphylococcus aureus subsp. aureus MW2
caauacaaacacccac

SEQ ID NO: 2118170 - RNA, 19 nt, Staphylococcus aureus subsp. aureus MW2
caauacgaaaccaaaaaua

SEQ ID NO: 2118171 - RNA, 21 nt, Staphylococcus aureus subsp. aureus MW2
caauacgaaaccaaaaauaau

SEQ ID NO: 2118172 - RNA, 16 nt, Staphylococcus aureus subsp. aureus MW2
caauauacaaugcuga

SEQ ID NO: 2118173 - RNA, 20 nt, Staphylococcus aureus subsp. aureus MW2
caauauacauuuacauauug

SEQ ID NO: 2118174 - RNA, 21 nt, Staphylococcus aureus subsp. aureus MW2
caauauagaaaaugaguacaa

SEQ ID NO: 2118175 - RNA, 14 nt, Staphylococcus aureus subsp. aureus MW2
caauauacuuuuua

SEQ ID NO: 2118176 - RNA, 17 nt, Staphylococcus aureus subsp. aureus MW2
caauauacuuuuuaaau

SEQ ID NO: 2118177 - RNA, 13 nt, Staphylococcus aureus subsp. aureus MW2
caauacgcaaugu

SEQ ID NO: 2118178 - RNA, 15 nt, Staphylococcus aureus subsp. aureus MW2
caauauauucaccua

SEQ ID NO: 2118179 - RNA, 20 nt, Staphylococcus aureus subsp. aureus MW2
caauauauucaccuacaaca

SEQ ID NO: 2118180 - RNA, 14 nt, Staphylococcus aureus subsp. aureus MW2
caauaucauauuug

SEQ ID NO: 2118181 - RNA, 13 nt, Staphylococcus aureus subsp. aureus MW2
caaucacaauaua

SEQ ID NO: 2118182 - RNA, 20 nt, Staphylococcus aureus subsp. aureus MW2
caauauuuuuacauauuuau

SEQ ID NO: 2118183 - RNA, 22 nt, Staphylococcus aureus subsp. aureus MW2
caauaucuucuuuuaauauuug

SEQ ID NO: 2118184 - RNA, 15 nt, Staphylococcus aureus subsp. aureus MW2
caaucaacuucauau

SEQ ID NO: 2118185 - RNA, 23 nt, Staphylococcus aureus subsp. aureus MW2
caaucaacgagucauaaauauaa

SEQ ID NO: 2118186 - RNA, 17 nt, Staphylococcus aureus subsp. aureus MW2
caaucaguaauaaugua

SEQ ID NO: 2118187 - RNA, 20 nt, Staphylococcus aureus subsp. aureus MW2
caaucacuccucuauuuuau

SEQ ID NO: 2118188 - RNA, 23 nt, Staphylococcus aureus subsp. aureus MW2
caaucauaccggcaaauaacaau

SEQ ID NO: 2118189 - RNA, 15 nt, Staphylococcus aureus subsp. aureus MW2
caaucgcaucuguua

SEQ ID NO: 2118190 - RNA, 23 nt, Staphylococcus aureus subsp. aureus MW2
caaucguuucuuccgcacugccu

SEQ ID NO: 2118191 - RNA, 18 nt, Staphylococcus aureus subsp. aureus MW2
caaucguugaaaaauauc

SEQ ID NO: 2118192 - RNA, 13 nt, Staphylococcus aureus subsp. aureus MW2
caaucuauauaaa

SEQ ID NO: 2118193 - RNA, 15 nt, Staphylococcus aureus subsp. aureus MW2
caaucuacuuuuucg

SEQ ID NO: 2118194 - RNA, 22 nt, Staphylococcus aureus subsp. aureus MW2
caaucuaaauguaaaaucauua

SEQ ID NO: 2118195 - RNA, 15 nt, Staphylococcus aureus subsp. aureus MW2
caaucuauuuuaaac

SEQ ID NO: 2118196 - RNA, 19 nt, Staphylococcus aureus subsp. aureus MW2
caagacucccuuuuuaaaa

SEQ ID NO: 2118197 - RNA, 22 nt, Staphylococcus aureus subsp. aureus MW2
caagacucccuuuuuaaaauac

SEQ ID NO: 2118198 - RNA, 16 nt, Staphylococcus aureus subsp. aureus MW2
caagagauaagaaaau

SEQ ID NO: 2118199 - RNA, 14 nt, Staphylococcus aureus subsp. aureus MW2
caagagauaagaaa

SEQ ID NO: 2118200 - RNA, 13 nt, Staphylococcus aureus subsp. aureus MW2
caagauaaaucau

SEQ ID NO: 2118201 - RNA, 22 nt, Staphylococcus aureus subsp. aureus MW2
caagacauuacaucuuuaagcu

SEQ ID NO: 2118202 - RNA, 22 nt, Staphylococcus aureus subsp. aureus MW2
caagaauuauggcagauccaua

SEQ ID NO: 2118203 - RNA, 16 nt, Staphylococcus aureus subsp. aureus MW2
caagaauuaaugaaau

SEQ ID NO: 2118204 - RNA, 18 nt, Staphylococcus aureus subsp. aureus MW2
caagcguuucuugaucua

SEQ ID NO: 2118205 - RNA, 15 nt, Staphylococcus aureus subsp. aureus MW2
caagccguugguugu

SEQ ID NO: 2118206 - RNA, 21 nt, Staphylococcus aureus subsp. aureus MW2
caagauuaugacaacauaaca

SEQ ID NO: 2118207 - RNA, 18 nt, Staphylococcus aureus subsp. aureus MW2
caagauuaugacaacaua

SEQ ID NO: 2118208 - RNA, 23 nt, Staphylococcus aureus subsp. aureus MW2
caagauuaugacaacauaacaaa

SEQ ID NO: 2118209 - RNA, 14 nt, Staphylococcus aureus subsp. aureus MW2
caagcaucaugaaa

SEQ ID NO: 2118210 - RNA, 15 nt, Staphylococcus aureus subsp. aureus MW2
caacuauaugugucg

SEQ ID NO: 2118211 - RNA, 21 nt, Staphylococcus aureus subsp. aureus MW2
caacguauauaaguuaaaauu

SEQ ID NO: 2118212 - RNA, 17 nt, Staphylococcus aureus subsp. aureus MW2
caacgucccaacaacau

SEQ ID NO: 2118213 - RNA, 21 nt, Staphylococcus aureus subsp. aureus MW2
caacgucccaacaacauauca

SEQ ID NO: 2118214 - RNA, 13 nt, Staphylococcus aureus subsp. aureus MW2
caacuuauuauuu

SEQ ID NO: 2118215 - RNA, 15 nt, Staphylococcus aureus subsp. aureus MW2
caacuuauucuucac

SEQ ID NO: 2118216 - RNA, 14 nt, Staphylococcus aureus subsp. aureus MW2
caacugcuuuuuau

SEQ ID NO: 2118217 - RNA, 16 nt, Staphylococcus aureus subsp. aureus MW2
caacugcuuuuuauua

SEQ ID NO: 2118218 - RNA, 18 nt, Staphylococcus aureus subsp. aureus MW2
caaccuaccuauuugauu

SEQ ID NO: 2118219 - RNA, 14 nt, Staphylococcus aureus subsp. aureus MW2
caaaucuuuuaaau

SEQ ID NO: 2118220 - RNA, 15 nt, Staphylococcus aureus subsp. aureus MW2
caaaucuuuuaaauu

SEQ ID NO: 2118221 - RNA, 18 nt, Staphylococcus aureus subsp. aureus MW2
caaaugaaaaaguaaaau

SEQ ID NO: 2118222 - RNA, 20 nt, Staphylococcus aureus subsp. aureus MW2
caaaugaauggagcaugauu

SEQ ID NO: 2118223 - RNA, 15 nt, Staphylococcus aureus subsp. aureus MW2
caaaugaaccagcua

SEQ ID NO: 2118224 - RNA, 20 nt, Staphylococcus aureus subsp. aureus MW2
caaaugaaaaaguaaaaucu

SEQ ID NO: 2118225 - RNA, 17 nt, Staphylococcus aureus subsp. aureus MW2
caaaugugaaagucauc

SEQ ID NO: 2118226 - RNA, 18 nt, Staphylococcus aureus subsp. aureus MW2
caaaugugaaagucaucc

SEQ ID NO: 2118227 - RNA, 19 nt, Staphylococcus aureus subsp. aureus MW2
caaauguguaaacuagaca

SEQ ID NO: 2118228 - RNA, 15 nt, Staphylococcus aureus subsp. aureus MW2
caaaugcaauaggau

SEQ ID NO: 2118229 - RNA, 19 nt, Staphylococcus aureus subsp. aureus MW2
caaauuuaggcaugucaaa

SEQ ID NO: 2118230 - RNA, 20 nt, Staphylococcus aureus subsp. aureus MW2
caaauuuauaauuuguauaa

SEQ ID NO: 2118231 - RNA, 23 nt, Staphylococcus aureus subsp. aureus MW2
caaauuggauaauuucuucuucu

SEQ ID NO: 2118232 - RNA, 21 nt, Staphylococcus aureus subsp. aureus MW2
caaauuggucgucauaccuau

SEQ ID NO: 2118233 - RNA, 16 nt, Staphylococcus aureus subsp. aureus MW2
caaauucuaugagaau

SEQ ID NO: 2118234 - RNA, 19 nt, Staphylococcus aureus subsp. aureus MW2
caaauuggaaaaauaaaua

SEQ ID NO: 2118235 - RNA, 19 nt, Staphylococcus aureus subsp. aureus MW2
caaauucgacucaaacaau

SEQ ID NO: 2118236 - RNA, 15 nt, Staphylococcus aureus subsp. aureus MW2
caaauucauuuguau

SEQ ID NO: 2118237 - RNA, 16 nt, Staphylococcus aureus subsp. aureus MW2
caaauuaaaaaacaau

SEQ ID NO: 2118238 - RNA, 16 nt, Staphylococcus aureus subsp. aureus MW2
caaauucauauuaacu

SEQ ID NO: 2118239 - RNA, 22 nt, Staphylococcus aureus subsp. aureus MW2
caaauuaaauauacuuuuauag

SEQ ID NO: 2118240 - RNA, 13 nt, Staphylococcus aureus subsp. aureus MW2
caaauuaaaucac

SEQ ID NO: 2118241 - RNA, 17 nt, Staphylococcus aureus subsp. aureus MW2
caaagucucuaguaucu

SEQ ID NO: 2118242 - RNA, 17 nt, Staphylococcus aureus subsp. aureus MW2
caaagucauuaaaugua

SEQ ID NO: 2118243 - RNA, 19 nt, Staphylococcus aureus subsp. aureus MW2
caaaguaccaucucuauuu

SEQ ID NO: 2118244 - RNA, 20 nt, Staphylococcus aureus subsp. aureus MW2
caaaguaccaucucuauuuu

SEQ ID NO: 2118245 - RNA, 15 nt, Staphylococcus aureus subsp. aureus MW2
caaauauuucuaaac

SEQ ID NO: 2118246 - RNA, 15 nt, Staphylococcus aureus subsp. aureus MW2
caaauauuuuauuac

SEQ ID NO: 2118247 - RNA, 17 nt, Staphylococcus aureus subsp. aureus MW2
caaauauuuuauuacau

SEQ ID NO: 2118248 - RNA, 21 nt, Staphylococcus aureus subsp. aureus MW2
caaauauacuugccuucaaau

SEQ ID NO: 2118249 - RNA, 17 nt, Staphylococcus aureus subsp. aureus MW2
caaauauaauguauaaa

SEQ ID NO: 2118250 - RNA, 21 nt, Staphylococcus aureus subsp. aureus MW2
caaauauaauguauaaaacag

SEQ ID NO: 2118251 - RNA, 23 nt, Staphylococcus aureus subsp. aureus MW2
caaaucgauuaauuauaaguagu

SEQ ID NO: 2118252 - RNA, 16 nt, Staphylococcus aureus subsp. aureus MW2
caaaucggaauaaaau

SEQ ID NO: 2118253 - RNA, 20 nt, Staphylococcus aureus subsp. aureus MW2
caaaucggaauaaaauaaau

SEQ ID NO: 2118254 - RNA, 23 nt, Staphylococcus aureus subsp. aureus MW2
caaaucggcuauacauugauaaa

SEQ ID NO: 2118255 - RNA, 20 nt, Staphylococcus aureus subsp. aureus MW2
caacauugagauuaucuuua

SEQ ID NO: 2118256 - RNA, 20 nt, Staphylococcus aureus subsp. aureus MW2
caacauugauaguuuuauaa

SEQ ID NO: 2118257 - RNA, 23 nt, Staphylococcus aureus subsp. aureus MW2
caacauuuugauacguaaacacu

SEQ ID NO: 2118258 - RNA, 18 nt, Staphylococcus aureus subsp. aureus MW2
caaccagucagaaagaau

SEQ ID NO: 2118259 - RNA, 16 nt, Staphylococcus aureus subsp. aureus MW2
caacauuaauaaauaa

SEQ ID NO: 2118260 - RNA, 18 nt, Staphylococcus aureus subsp. aureus MW2
caacauuacuaauugauc

SEQ ID NO: 2118261 - RNA, 22 nt, Staphylococcus aureus subsp. aureus MW2
caacauguuccgcuacaaaaca

SEQ ID NO: 2118262 - RNA, 22 nt, Staphylococcus aureus subsp. aureus MW2
caacauguuuggaugaacaaaa

SEQ ID NO: 2118263 - RNA, 14 nt, Staphylococcus aureus subsp. aureus MW2
caacauguuuggau

SEQ ID NO: 2118264 - RNA, 18 nt, Staphylococcus aureus subsp. aureus MW2
caacaucuuuuguuguuu

SEQ ID NO: 2118265 - RNA, 22 nt, Staphylococcus aureus subsp. aureus MW2
caaccaugcuuuuuagcauauu

SEQ ID NO: 2118266 - RNA, 15 nt, Staphylococcus aureus subsp. aureus MW2
caacaguuuuaaaga

SEQ ID NO: 2118267 - RNA, 23 nt, Staphylococcus aureus subsp. aureus MW2
caacaguuucuuggucugcugua

SEQ ID NO: 2118268 - RNA, 21 nt, Staphylococcus aureus subsp. aureus MW2
caacaguuucuuggucugcug

SEQ ID NO: 2118269 - RNA, 22 nt, Staphylococcus aureus subsp. aureus MW2
caacaucuuuuguugcucagug

SEQ ID NO: 2118270 - RNA, 15 nt, Staphylococcus aureus subsp. aureus MW2
caacaacaaguucuu

SEQ ID NO: 2118271 - RNA, 19 nt, Staphylococcus aureus subsp. aureus MW2
caacacccauauaauuugg

SEQ ID NO: 2118272 - RNA, 16 nt, Staphylococcus aureus subsp. aureus MW2
caaaauauaaaauccu

SEQ ID NO: 2118273 - RNA, 12 nt, Staphylococcus aureus subsp. aureus MW2
caaaauauaaaa

SEQ ID NO: 2118274 - RNA, 24 nt, Staphylococcus aureus subsp. aureus MW2
caaaauacucaacacgauagucau

SEQ ID NO: 2118275 - RNA, 18 nt, Staphylococcus aureus subsp. aureus MW2
caaaauuauguaaaaaau

SEQ ID NO: 2118276 - RNA, 17 nt, Staphylococcus aureus subsp. aureus MW2
caaaauuauguaaaaaa

SEQ ID NO: 2118277 - RNA, 19 nt, Staphylococcus aureus subsp. aureus MW2
caaaauuauguaaaaaaua

SEQ ID NO: 2118278 - RNA, 21 nt, Staphylococcus aureus subsp. aureus MW2
caaaaugguuauauaaacaaa

SEQ ID NO: 2118279 - RNA, 16 nt, Staphylococcus aureus subsp. aureus MW2
caaaaugguuaaaauc

SEQ ID NO: 2118280 - RNA, 20 nt, Staphylococcus aureus subsp. aureus MW2
caaaagugaauguuuuucgg

SEQ ID NO: 2118281 - RNA, 22 nt, Staphylococcus aureus subsp. aureus MW2
caaaagugccagguucaauagu

SEQ ID NO: 2118282 - RNA, 13 nt, Staphylococcus aureus subsp. aureus MW2
caaaaguaugauu

SEQ ID NO: 2118283 - RNA, 14 nt, Staphylococcus aureus subsp. aureus MW2
caaaaguaugauuu

SEQ ID NO: 2118284 - RNA, 18 nt, Staphylococcus aureus subsp. aureus MW2
caaaauaaugauacuaau

SEQ ID NO: 2118285 - RNA, 19 nt, Staphylococcus aureus subsp. aureus MW2
caaaauaaugauacuaaua

SEQ ID NO: 2118286 - RNA, 20 nt, Staphylococcus aureus subsp. aureus MW2
caaaaggauaagaacgagaa

SEQ ID NO: 2118287 - RNA, 20 nt, Staphylococcus aureus subsp. aureus MW2
caaaaggcugggacauaaau

SEQ ID NO: 2118288 - RNA, 20 nt, Staphylococcus aureus subsp. aureus MW2
caaaacgcauuucauguguc

SEQ ID NO: 2118289 - RNA, 22 nt, Staphylococcus aureus subsp. aureus MW2
caaaaacuauuuuuuagacuuu

SEQ ID NO: 2118290 - RNA, 19 nt, Staphylococcus aureus subsp. aureus MW2
caaaacuuuuacuuucuca

SEQ ID NO: 2118291 - RNA, 16 nt, Staphylococcus aureus subsp. aureus MW2
caaaacuugcgcaugc

SEQ ID NO: 2118292 - RNA, 14 nt, Staphylococcus aureus subsp. aureus MW2
caaaacuuaaaaua

SEQ ID NO: 2118293 - RNA, 23 nt, Staphylococcus aureus subsp. aureus MW2
caaaagauguuucaaaauaauuu

SEQ ID NO: 2118294 - RNA, 22 nt, Staphylococcus aureus subsp. aureus MW2
caaacaaccugugauaaaaauc

SEQ ID NO: 2118295 - RNA, 22 nt, Staphylococcus aureus subsp. aureus MW2
caaacaacaucacuuuaggguu

SEQ ID NO: 2118296 - RNA, 18 nt, Staphylococcus aureus subsp. aureus MW2
caaaccaauuuuaauagu

SEQ ID NO: 2118297 - RNA, 12 nt, Staphylococcus aureus subsp. aureus MW2
caaacaauacau

SEQ ID NO: 2118298 - RNA, 23 nt, Staphylococcus aureus subsp. aureus MW2
caaacgaaggucuacuaaauaac

SEQ ID NO: 2118299 - RNA, 20 nt, Staphylococcus aureus subsp. aureus MW2
caaagaaagcuaauaucaau

SEQ ID NO: 2118300 - RNA, 18 nt, Staphylococcus aureus subsp. aureus MW2
caaagaaauguaugacau

SEQ ID NO: 2118301 - RNA, 15 nt, Staphylococcus aureus subsp. aureus MW2
caaagacauacaguc

SEQ ID NO: 2118302 - RNA, 22 nt, Staphylococcus aureus subsp. aureus MW2
caaagacauacagucaauacaa

SEQ ID NO: 2118303 - RNA, 19 nt, Staphylococcus aureus subsp. aureus MW2
caaagauuauugaaauuug

SEQ ID NO: 2118304 - RNA, 17 nt, Staphylococcus aureus subsp. aureus MW2
caaagaugauacccaau

SEQ ID NO: 2118305 - RNA, 20 nt, Staphylococcus aureus subsp. aureus MW2
caaagccuucuaucucuuua

SEQ ID NO: 2118306 - RNA, 18 nt, Staphylococcus aureus subsp. aureus MW2
caaaggacgucuuuuuag

SEQ ID NO: 2118307 - RNA, 13 nt, Staphylococcus aureus subsp. aureus MW2
caaaggauauuga

SEQ ID NO: 2118308 - RNA, 15 nt, Staphylococcus aureus subsp. aureus MW2
caaaggauauugaaa

SEQ ID NO: 2118309 - RNA, 15 nt, Staphylococcus aureus subsp. aureus MW2
cacccauuugucuua

SEQ ID NO: 2118310 - RNA, 17 nt, Staphylococcus aureus subsp. aureus MW2
cacccugcuuaucauua

SEQ ID NO: 2118311 - RNA, 13 nt, Staphylococcus aureus subsp. aureus MW2
caccuacaaauau

SEQ ID NO: 2118312 - RNA, 19 nt, Staphylococcus aureus subsp. aureus MW2
caccuacaaauauuucuaa

SEQ ID NO: 2118313 - RNA, 13 nt, Staphylococcus aureus subsp. aureus MW2
caccuaauaccau

SEQ ID NO: 2118314 - RNA, 22 nt, Staphylococcus aureus subsp. aureus MW2
caccuaauaaugcgauuacagu

SEQ ID NO: 2118315 - RNA, 23 nt, Staphylococcus aureus subsp. aureus MW2
aaaauaacauguuuguggcaccu

SEQ ID NO: 2118316 - RNA, 14 nt, Staphylococcus aureus subsp. aureus MW2
aaaauaaccauuca

SEQ ID NO: 2118317 - RNA, 16 nt, Staphylococcus aureus subsp. aureus MW2
aaaauaaccauucacu

SEQ ID NO: 2118318 - RNA, 13 nt, Staphylococcus aureus subsp. aureus MW2
aaaauaaauguua

SEQ ID NO: 2118319 - RNA, 23 nt, Staphylococcus aureus subsp. aureus MW2
cacgcuaacauucagugcaauga

SEQ ID NO: 2118320 - RNA, 13 nt, Staphylococcus aureus subsp. aureus MW2
cacgcguucaaau

SEQ ID NO: 2118321 - RNA, 23 nt, Staphylococcus aureus subsp. aureus MW2
aaaauagucggggccccaacaca

SEQ ID NO: 2118322 - RNA, 20 nt, Staphylococcus aureus subsp. aureus MW2
aaaauagucggggccccaac

SEQ ID NO: 2118323 - RNA, 20 nt, Staphylococcus aureus subsp. aureus MW2
aaaauaguaaagugaaauaa

SEQ ID NO: 2118324 - RNA, 16 nt, Staphylococcus aureus subsp. aureus MW2
aaaauagcuauuaaaa

SEQ ID NO: 2118325 - RNA, 12 nt, Staphylococcus aureus subsp. aureus MW2
cacgauuuuuaa

SEQ ID NO: 2118326 - RNA, 19 nt, Staphylococcus aureus subsp. aureus MW2
cacgauuaaugucacaugu

SEQ ID NO: 2118327 - RNA, 23 nt, Staphylococcus aureus subsp. aureus MW2
cacgauuacgcucauaugucugu

SEQ ID NO: 2118328 - RNA, 13 nt, Staphylococcus aureus subsp. aureus MW2
aaaauaauuaaau

SEQ ID NO: 2118329 - RNA, 16 nt, Staphylococcus aureus subsp. aureus MW2
aaaauaauuaaauaaa

SEQ ID NO: 2118330 - RNA, 21 nt, Staphylococcus aureus subsp. aureus MW2
aaaauaauuaaacuuuaugaa

SEQ ID NO: 2118331 - RNA, 10 nt, Staphylococcus aureus subsp. aureus MW2
aaaauaaugc

SEQ ID NO: 2118332 - RNA, 15 nt, Staphylococcus aureus subsp. aureus MW2
aaaauaaugcaacua

SEQ ID NO: 2118333 - RNA, 18 nt, Staphylococcus aureus subsp. aureus MW2
aaaauaaugcuuauuaaa

SEQ ID NO: 2118334 - RNA, 16 nt, Staphylococcus aureus subsp. aureus MW2
aaaauaccugcaauga

SEQ ID NO: 2118335 - RNA, 14 nt, Staphylococcus aureus subsp. aureus MW2
aaaauacuaagauu

SEQ ID NO: 2118336 - RNA, 21 nt, Staphylococcus aureus subsp. aureus MW2
aaaauacuaagauuagcuaug

SEQ ID NO: 2118337 - RNA, 18 nt, Staphylococcus aureus subsp. aureus MW2
aaaauaccaacugcaaau

SEQ ID NO: 2118338 - RNA, 19 nt, Staphylococcus aureus subsp. aureus MW2
aaaauaccaacugcaaaua

SEQ ID NO: 2118339 - RNA, 21 nt, Staphylococcus aureus subsp. aureus MW2
aaaauaccaacugcaaauaca

SEQ ID NO: 2118340 - RNA, 15 nt, Staphylococcus aureus subsp. aureus MW2
aaaauacuauacuga

SEQ ID NO: 2118341 - RNA, 21 nt, Staphylococcus aureus subsp. aureus MW2
caccuggucguacuuucaaau

SEQ ID NO: 2118342 - RNA, 22 nt, Staphylococcus aureus subsp. aureus MW2
aaaauagauugaaaaaauaacu

SEQ ID NO: 2118343 - RNA, 22 nt, Staphylococcus aureus subsp. aureus MW2
aaaauagccauaucauauuacu

SEQ ID NO: 2118344 - RNA, 21 nt, Staphylococcus aureus subsp. aureus MW2
aaaauagcguaauuauuauaa

SEQ ID NO: 2118345 - RNA, 22 nt, Staphylococcus aureus subsp. aureus MW2
cacgaaauugugaacuaaauug

SEQ ID NO: 2118346 - RNA, 19 nt, Staphylococcus aureus subsp. aureus MW2
aaaauagaaaaauuucaaa

SEQ ID NO: 2118347 - RNA, 15 nt, Staphylococcus aureus subsp. aureus MW2
aaaauagaaaaaaca

SEQ ID NO: 2118348 - RNA, 14 nt, Staphylococcus aureus subsp. aureus MW2
cacgagcugcuuca

SEQ ID NO: 2118349 - RNA, 11 nt, Staphylococcus aureus subsp. aureus MW2
cacgagaaaug

SEQ ID NO: 2118350 - RNA, 15 nt, Staphylococcus aureus subsp. aureus MW2
cacgacuuucuaaag

SEQ ID NO: 2118351 - RNA, 14 nt, Staphylococcus aureus subsp. aureus MW2
cacgacauguaggu

SEQ ID NO: 2118352 - RNA, 13 nt, Staphylococcus aureus subsp. aureus MW2
cacauacauuuug

SEQ ID NO: 2118353 - RNA, 15 nt, Staphylococcus aureus subsp. aureus MW2
cacauaugauaauua

SEQ ID NO: 2118354 - RNA, 16 nt, Staphylococcus aureus subsp. aureus MW2
cacaucaugacauuaa

SEQ ID NO: 2118355 - RNA, 12 nt, Staphylococcus aureus subsp. aureus MW2
cacaucauagca

SEQ ID NO: 2118356 - RNA, 23 nt, Staphylococcus aureus subsp. aureus MW2
cacaucauagcacuacaucaagu

SEQ ID NO: 2118357 - RNA, 23 nt, Staphylococcus aureus subsp. aureus MW2
cacaucauaauaaaucuaucuau

SEQ ID NO: 2118358 - RNA, 23 nt, Staphylococcus aureus subsp. aureus MW2
cacauuuuuaguuagaaaguauu

SEQ ID NO: 2118359 - RNA, 18 nt, Staphylococcus aureus subsp. aureus MW2
cacauuauuguaaccuga

SEQ ID NO: 2118360 - RNA, 21 nt, Staphylococcus aureus subsp. aureus MW2
cacauuauuguaaccugacuu

SEQ ID NO: 2118361 - RNA, 17 nt, Staphylococcus aureus subsp. aureus MW2
cacauuauuuaaacggu

SEQ ID NO: 2118362 - RNA, 15 nt, Staphylococcus aureus subsp. aureus MW2
cacaucgcauaauau

SEQ ID NO: 2118363 - RNA, 23 nt, Staphylococcus aureus subsp. aureus MW2
caccaacaauagguacaacuaaa

SEQ ID NO: 2118364 - RNA, 15 nt, Staphylococcus aureus subsp. aureus MW2
aaaaguguaauguuc

SEQ ID NO: 2118365 - RNA, 21 nt, Staphylococcus aureus subsp. aureus MW2
aaaaguguuaugaauuagagg

SEQ ID NO: 2118366 - RNA, 17 nt, Staphylococcus aureus subsp. aureus MW2
aaaaguguuuaaaugcu

SEQ ID NO: 2118367 - RNA, 16 nt, Staphylococcus aureus subsp. aureus MW2
aaaagugguuguuccc

SEQ ID NO: 2118368 - RNA, 13 nt, Staphylococcus aureus subsp. aureus MW2
aaaaguguaaugu

SEQ ID NO: 2118369 - RNA, 23 nt, Staphylococcus aureus subsp. aureus MW2
aaaaguggucguuuauuuuaaau

SEQ ID NO: 2118370 - RNA, 23 nt, Staphylococcus aureus subsp. aureus MW2
aaaagugguuaauaacagaguug

SEQ ID NO: 2118371 - RNA, 18 nt, Staphylococcus aureus subsp. aureus MW2
aaaaguggccuuuuaaac

SEQ ID NO: 2118372 - RNA, 13 nt, Staphylococcus aureus subsp. aureus MW2
aaaauaaaaacca

SEQ ID NO: 2118373 - RNA, 17 nt, Staphylococcus aureus subsp. aureus MW2
aaaauaaaaaaugcacu

SEQ ID NO: 2118374 - RNA, 14 nt, Staphylococcus aureus subsp. aureus MW2
aaaauaaaacaaau

SEQ ID NO: 2118375 - RNA, 19 nt, Staphylococcus aureus subsp. aureus MW2
aaaauaaaauuaacgagcu

SEQ ID NO: 2118376 - RNA, 18 nt, Staphylococcus aureus subsp. aureus MW2
caccagauaucauaauau

SEQ ID NO: 2118377 - RNA, 13 nt, Staphylococcus aureus subsp. aureus MW2
caccagcacauca

SEQ ID NO: 2118378 - RNA, 14 nt, Staphylococcus aureus subsp. aureus MW2
caccagcacaucaa

SEQ ID NO: 2118379 - RNA, 21 nt, Staphylococcus aureus subsp. aureus MW2
cacacagguaaauuuaaaaua

SEQ ID NO: 2118380 - RNA, 22 nt, Staphylococcus aureus subsp. aureus MW2
cacacagguaaauuuaaaauaa

SEQ ID NO: 2118381 - RNA, 20 nt, Staphylococcus aureus subsp. aureus MW2
cacacagguaaauuuaaaau

SEQ ID NO: 2118382 - RNA, 14 nt, Staphylococcus aureus subsp. aureus MW2
cacacuuuaaacaa

SEQ ID NO: 2118383 - RNA, 15 nt, Staphylococcus aureus subsp. aureus MW2
cacacuuuaaacaag

SEQ ID NO: 2118384 - RNA, 13 nt, Staphylococcus aureus subsp. aureus MW2
cacagaagcuggc

SEQ ID NO: 2118385 - RNA, 14 nt, Staphylococcus aureus subsp. aureus MW2
cacagaagcuggcg

SEQ ID NO: 2118386 - RNA, 19 nt, Staphylococcus aureus subsp. aureus MW2
cacagcaauucacuuauac

SEQ ID NO: 2118387 - RNA, 14 nt, Staphylococcus aureus subsp. aureus MW2
cacaagcaucuaua

SEQ ID NO: 2118388 - RNA, 15 nt, Staphylococcus aureus subsp. aureus MW2
cacaauaagauugac

SEQ ID NO: 2118389 - RNA, 20 nt, Staphylococcus aureus subsp. aureus MW2
cacaauccuuucaucugcaa

SEQ ID NO: 2118390 - RNA, 16 nt, Staphylococcus aureus subsp. aureus MW2
cacaauaucacuuaaa

SEQ ID NO: 2118391 - RNA, 19 nt, Staphylococcus aureus subsp. aureus MW2
cacaacggcauaauacaca

SEQ ID NO: 2118392 - RNA, 15 nt, Staphylococcus aureus subsp. aureus MW2
caauggaucuguuac

SEQ ID NO: 2118393 - RNA, 16 nt, Staphylococcus aureus subsp. aureus MW2
caauguagcaauuuuc

SEQ ID NO: 2118394 - RNA, 19 nt, Staphylococcus aureus subsp. aureus MW2
caaugaauaaugacaaauu

SEQ ID NO: 2118395 - RNA, 22 nt, Staphylococcus aureus subsp. aureus MW2
caaugaauuucuaauuuaguau

SEQ ID NO: 2118396 - RNA, 17 nt, Staphylococcus aureus subsp. aureus MW2
caaugcugauaccuaag

SEQ ID NO: 2118397 - RNA, 15 nt, Staphylococcus aureus subsp. aureus MW2
caaugacugagaaaa

SEQ ID NO: 2118398 - RNA, 22 nt, Staphylococcus aureus subsp. aureus MW2
caaugacuuaacaucuuuuuca

SEQ ID NO: 2118399 - RNA, 13 nt, Staphylococcus aureus subsp. aureus MW2
caauugcauacgu

SEQ ID NO: 2118400 - RNA, 17 nt, Staphylococcus aureus subsp. aureus MW2
caauuucuucauuuuca

SEQ ID NO: 2118401 - RNA, 12 nt, Staphylococcus aureus subsp. aureus MW2
caauuucucuau

SEQ ID NO: 2118402 - RNA, 12 nt, Staphylococcus aureus subsp. aureus MW2
caauuucucugu

SEQ ID NO: 2118403 - RNA, 14 nt, Staphylococcus aureus subsp. aureus MW2
caauuucucugugu

SEQ ID NO: 2118404 - RNA, 23 nt, Staphylococcus aureus subsp. aureus MW2
caauuucguuuuauuaaugaagc

SEQ ID NO: 2118405 - RNA, 19 nt, Staphylococcus aureus subsp. aureus MW2
caauuuauuaacuguguau

SEQ ID NO: 2118406 - RNA, 16 nt, Staphylococcus aureus subsp. aureus MW2
caauuuauuuuuauau

SEQ ID NO: 2118407 - RNA, 21 nt, Staphylococcus aureus subsp. aureus MW2
caauguuaggugcuugguuaa

SEQ ID NO: 2118408 - RNA, 18 nt, Staphylococcus aureus subsp. aureus MW2
caaugucugcaucagauc

SEQ ID NO: 2118409 - RNA, 14 nt, Staphylococcus aureus subsp. aureus MW2
caauguucaauuca

SEQ ID NO: 2118410 - RNA, 17 nt, Staphylococcus aureus subsp. aureus MW2
caauucuuacaccugca

SEQ ID NO: 2118411 - RNA, 21 nt, Staphylococcus aureus subsp. aureus MW2
caauucugugagguaaaacua

SEQ ID NO: 2118412 - RNA, 12 nt, Staphylococcus aureus subsp. aureus MW2
caauucuucaau

SEQ ID NO: 2118413 - RNA, 20 nt, Staphylococcus aureus subsp. aureus MW2
augcaaguuggcggggcccc

SEQ ID NO: 2118414 - RNA, 22 nt, Staphylococcus aureus subsp. aureus MW2
augcaaguuggggaugggcccc

SEQ ID NO: 2118415 - RNA, 19 nt, Staphylococcus aureus subsp. aureus MW2
augcaauacauuaauauaa

SEQ ID NO: 2118416 - RNA, 19 nt, Staphylococcus aureus subsp. aureus MW2
augcaagcgacgauuggaa

SEQ ID NO: 2118417 - RNA, 15 nt, Staphylococcus aureus subsp. aureus MW2
augcaauugaccaac

SEQ ID NO: 2118418 - RNA, 18 nt, Staphylococcus aureus subsp. aureus MW2
augauuuuuaaaaauaca

SEQ ID NO: 2118419 - RNA, 19 nt, Staphylococcus aureus subsp. aureus MW2
augcaacuuauaauauuaa

SEQ ID NO: 2118420 - RNA, 17 nt, Staphylococcus aureus subsp. aureus MW2
augcaaccuaaaauauu

SEQ ID NO: 2118421 - RNA, 14 nt, Staphylococcus aureus subsp. aureus MW2
augauuuauaaaaa

SEQ ID NO: 2118422 - RNA, 15 nt, Staphylococcus aureus subsp. aureus MW2
augauuuauaaaaaa

SEQ ID NO: 2118423 - RNA, 21 nt, Staphylococcus aureus subsp. aureus MW2
augauuucacuucauaaagcg

SEQ ID NO: 2118424 - RNA, 15 nt, Staphylococcus aureus subsp. aureus MW2
augauuuacuaaugc

SEQ ID NO: 2118425 - RNA, 20 nt, Staphylococcus aureus subsp. aureus MW2
augauuugauauuucaaaua

SEQ ID NO: 2118426 - RNA, 16 nt, Staphylococcus aureus subsp. aureus MW2
augauugaaugaagcu

SEQ ID NO: 2118427 - RNA, 17 nt, Staphylococcus aureus subsp. aureus MW2
augauugcaaauuauca

SEQ ID NO: 2118428 - RNA, 15 nt, Staphylococcus aureus subsp. aureus MW2
augauugaaauccuu

SEQ ID NO: 2118429 - RNA, 15 nt, Staphylococcus aureus subsp. aureus MW2
augauuguaauaucu

SEQ ID NO: 2118430 - RNA, 22 nt, Staphylococcus aureus subsp. aureus MW2
augauuguaauaucuaaagauu

SEQ ID NO: 2118431 - RNA, 16 nt, Staphylococcus aureus subsp. aureus MW2
augauuguuaauacaa

SEQ ID NO: 2118432 - RNA, 17 nt, Staphylococcus aureus subsp. aureus MW2
augauuccaaguauuuu

SEQ ID NO: 2118433 - RNA, 19 nt, Staphylococcus aureus subsp. aureus MW2
augauuccaaguauuuucu

SEQ ID NO: 2118434 - RNA, 21 nt, Staphylococcus aureus subsp. aureus MW2
augauuaaaguguuucaacau

SEQ ID NO: 2118435 - RNA, 19 nt, Staphylococcus aureus subsp. aureus MW2
augauuaaagcuuaagugc

SEQ ID NO: 2118436 - RNA, 18 nt, Staphylococcus aureus subsp. aureus MW2
augauuacaacuuauucu

SEQ ID NO: 2118437 - RNA, 14 nt, Staphylococcus aureus subsp. aureus MW2
augauuaauuaaag

SEQ ID NO: 2118438 - RNA, 14 nt, Staphylococcus aureus subsp. aureus MW2
augauuaguaauga

SEQ ID NO: 2118439 - RNA, 20 nt, Staphylococcus aureus subsp. aureus MW2
augauuacuuuaagauuauu

SEQ ID NO: 2118440 - RNA, 18 nt, Staphylococcus aureus subsp. aureus MW2
augauuauucucuuuauu

SEQ ID NO: 2118441 - RNA, 21 nt, Staphylococcus aureus subsp. aureus MW2
augauguuaaaaaauauguau

SEQ ID NO: 2118442 - RNA, 16 nt, Staphylococcus aureus subsp. aureus MW2
augaugucauguauug

SEQ ID NO: 2118443 - RNA, 14 nt, Staphylococcus aureus subsp. aureus MW2
augaugucauguau

SEQ ID NO: 2118444 - RNA, 21 nt, Staphylococcus aureus subsp. aureus MW2
augaugcuucuaacugaauua

SEQ ID NO: 2118445 - RNA, 14 nt, Staphylococcus aureus subsp. aureus MW2
augaugauuuaagu

SEQ ID NO: 2118446 - RNA, 15 nt, Staphylococcus aureus subsp. aureus MW2
augaugauaaauuga

SEQ ID NO: 2118447 - RNA, 14 nt, Staphylococcus aureus subsp. aureus MW2
augaugaauuguug

SEQ ID NO: 2118448 - RNA, 21 nt, Staphylococcus aureus subsp. aureus MW2
augaugaauuguuguacaugu

SEQ ID NO: 2118449 - RNA, 23 nt, Staphylococcus aureus subsp. aureus MW2
augaugaauuguuguacauguau

SEQ ID NO: 2118450 - RNA, 20 nt, Staphylococcus aureus subsp. aureus MW2
augaugacaaaaauaaaacc

SEQ ID NO: 2118451 - RNA, 15 nt, Staphylococcus aureus subsp. aureus MW2
augaugacaucaaua

SEQ ID NO: 2118452 - RNA, 17 nt, Staphylococcus aureus subsp. aureus MW2
augaugaacuuaaugcu

SEQ ID NO: 2118453 - RNA, 16 nt, Staphylococcus aureus subsp. aureus MW2
augagcccguuaaaaa

SEQ ID NO: 2118454 - RNA, 18 nt, Staphylococcus aureus subsp. aureus MW2
augccucaguuagaagau

SEQ ID NO: 2118455 - RNA, 19 nt, Staphylococcus aureus subsp. aureus MW2
augccuugucuauuguaaa

SEQ ID NO: 2118456 - RNA, 20 nt, Staphylococcus aureus subsp. aureus MW2
augccuuaugucauauacua

SEQ ID NO: 2118457 - RNA, 22 nt, Staphylococcus aureus subsp. aureus MW2
augccuuuuauuuaucuuuuaa

SEQ ID NO: 2118458 - RNA, 16 nt, Staphylococcus aureus subsp. aureus MW2
augccauuguuaucca

SEQ ID NO: 2118459 - RNA, 21 nt, Staphylococcus aureus subsp. aureus MW2
augccaucuuuguaaccuaaa

SEQ ID NO: 2118460 - RNA, 16 nt, Staphylococcus aureus subsp. aureus MW2
augccaauuaauucuu

SEQ ID NO: 2118461 - RNA, 21 nt, Staphylococcus aureus subsp. aureus MW2
augcugcuucuucagguguuu

SEQ ID NO: 2118462 - RNA, 20 nt, Staphylococcus aureus subsp. aureus MW2
augcucuauauauccauuca

SEQ ID NO: 2118463 - RNA, 21 nt, Staphylococcus aureus subsp. aureus MW2
augcucccuucaaaguuuuca

SEQ ID NO: 2118464 - RNA, 15 nt, Staphylococcus aureus subsp. aureus MW2
augcuucaaagucaa

SEQ ID NO: 2118465 - RNA, 15 nt, Staphylococcus aureus subsp. aureus MW2
augcuuaaaaacaau

SEQ ID NO: 2118466 - RNA, 23 nt, Staphylococcus aureus subsp. aureus MW2
augcuuauucugaaaaauauuua

SEQ ID NO: 2118467 - RNA, 17 nt, Staphylococcus aureus subsp. aureus MW2
augcuuguacaaaaaau

SEQ ID NO: 2118468 - RNA, 17 nt, Staphylococcus aureus subsp. aureus MW2
augcuuuaauuaaaguu

SEQ ID NO: 2118469 - RNA, 17 nt, Staphylococcus aureus subsp. aureus MW2
augcuuggacauauacu

SEQ ID NO: 2118470 - RNA, 20 nt, Staphylococcus aureus subsp. aureus MW2
augcuuuaugugcagcuuga

SEQ ID NO: 2118471 - RNA, 22 nt, Staphylococcus aureus subsp. aureus MW2
augcuuuacuauauucaaugau

SEQ ID NO: 2118472 - RNA, 22 nt, Staphylococcus aureus subsp. aureus MW2
augcuuuaggugaguuaccaua

SEQ ID NO: 2118473 - RNA, 13 nt, Staphylococcus aureus subsp. aureus MW2
auggagcaugauu

SEQ ID NO: 2118474 - RNA, 16 nt, Staphylococcus aureus subsp. aureus MW2
augcuuuuuugaaaug

SEQ ID NO: 2118475 - RNA, 20 nt, Staphylococcus aureus subsp. aureus MW2
augcuuuuuuuacaauauga

SEQ ID NO: 2118476 - RNA, 17 nt, Staphylococcus aureus subsp. aureus MW2
auggaaaauauauuaua

SEQ ID NO: 2118477 - RNA, 15 nt, Staphylococcus aureus subsp. aureus MW2
augcuuuugaucuaa

SEQ ID NO: 2118478 - RNA, 17 nt, Staphylococcus aureus subsp. aureus MW2
auggaaaggcguuuuuu

SEQ ID NO: 2118479 - RNA, 21 nt, Staphylococcus aureus subsp. aureus MW2
auggaacgccgaauaauccag

SEQ ID NO: 2118480 - RNA, 16 nt, Staphylococcus aureus subsp. aureus MW2
auggaaucauuuucuu

SEQ ID NO: 2118481 - RNA, 18 nt, Staphylococcus aureus subsp. aureus MW2
auggaaguuguugcuuug

SEQ ID NO: 2118482 - RNA, 21 nt, Staphylococcus aureus subsp. aureus MW2
auggaaguuguugcuuuggua

SEQ ID NO: 2118483 - RNA, 16 nt, Staphylococcus aureus subsp. aureus MW2
auggacaguuuuuaua

SEQ ID NO: 2118484 - RNA, 23 nt, Staphylococcus aureus subsp. aureus MW2
auggaaguauauguuacucuuag

SEQ ID NO: 2118485 - RNA, 17 nt, Staphylococcus aureus subsp. aureus MW2
auggcuuaaaucaaaug

SEQ ID NO: 2118486 - RNA, 14 nt, Staphylococcus aureus subsp. aureus MW2
auggcugcaacaau

SEQ ID NO: 2118487 - RNA, 21 nt, Staphylococcus aureus subsp. aureus MW2
auggcugcaacaauuugcaua

SEQ ID NO: 2118488 - RNA, 17 nt, Staphylococcus aureus subsp. aureus MW2
auggcugcaucaauaug

SEQ ID NO: 2118489 - RNA, 19 nt, Staphylococcus aureus subsp. aureus MW2
auggcugcaucaauaugac

SEQ ID NO: 2118490 - RNA, 20 nt, Staphylococcus aureus subsp. aureus MW2
augguagauacauagaaagg

SEQ ID NO: 2118491 - RNA, 20 nt, Staphylococcus aureus subsp. aureus MW2
augguaguuagguaaaaauu

SEQ ID NO: 2118492 - RNA, 15 nt, Staphylococcus aureus subsp. aureus MW2
auguaaaauuagcaa

SEQ ID NO: 2118493 - RNA, 15 nt, Staphylococcus aureus subsp. aureus MW2
auguaaauaaaaauu

SEQ ID NO: 2118494 - RNA, 22 nt, Staphylococcus aureus subsp. aureus MW2
auguaaaucgugcuguuaucau

SEQ ID NO: 2118495 - RNA, 13 nt, Staphylococcus aureus subsp. aureus MW2
auguaacaaacaa

SEQ ID NO: 2118496 - RNA, 13 nt, Staphylococcus aureus subsp. aureus MW2
auguaacauaaag

SEQ ID NO: 2118497 - RNA, 21 nt, Staphylococcus aureus subsp. aureus MW2
auguacaaccuuugcuuaaac

SEQ ID NO: 2118498 - RNA, 20 nt, Staphylococcus aureus subsp. aureus MW2
augguugauuacaauuguuc

SEQ ID NO: 2118499 - RNA, 23 nt, Staphylococcus aureus subsp. aureus MW2
augguugauuuuggaugaagcgg

SEQ ID NO: 2118500 - RNA, 20 nt, Staphylococcus aureus subsp. aureus MW2
auguaaaaucauuaauaauu

SEQ ID NO: 2118501 - RNA, 15 nt, Staphylococcus aureus subsp. aureus MW2
augguugaucgaaua

SEQ ID NO: 2118502 - RNA, 21 nt, Staphylococcus aureus subsp. aureus MW2
augguuaucacuuauuauuuu

SEQ ID NO: 2118503 - RNA, 15 nt, Staphylococcus aureus subsp. aureus MW2
augguuauggugugu

SEQ ID NO: 2118504 - RNA, 17 nt, Staphylococcus aureus subsp. aureus MW2
augguucaaauaucauu

SEQ ID NO: 2118505 - RNA, 17 nt, Staphylococcus aureus subsp. aureus MW2
augguuacccuuuuuca

SEQ ID NO: 2118506 - RNA, 14 nt, Staphylococcus aureus subsp. aureus MW2
augucuagauuuca

SEQ ID NO: 2118507 - RNA, 18 nt, Staphylococcus aureus subsp. aureus MW2
augucucagauucauauc

SEQ ID NO: 2118508 - RNA, 14 nt, Staphylococcus aureus subsp. aureus MW2
augucguuuucuua

SEQ ID NO: 2118509 - RNA, 17 nt, Staphylococcus aureus subsp. aureus MW2
augucguuuucuuaaac

SEQ ID NO: 2118510 - RNA, 14 nt, Staphylococcus aureus subsp. aureus MW2
augucuaaaaaugu

SEQ ID NO: 2118511 - RNA, 18 nt, Staphylococcus aureus subsp. aureus MW2
augucgcacuauaaaauu

SEQ ID NO: 2118512 - RNA, 16 nt, Staphylococcus aureus subsp. aureus MW2
augucgaaaauagcua

SEQ ID NO: 2118513 - RNA, 22 nt, Staphylococcus aureus subsp. aureus MW2
auguaccacucauaaucaaguc

SEQ ID NO: 2118514 - RNA, 18 nt, Staphylococcus aureus subsp. aureus MW2
auguacauuguaaauaua

SEQ ID NO: 2118515 - RNA, 14 nt, Staphylococcus aureus subsp. aureus MW2
auguaccaaauuua

SEQ ID NO: 2118516 - RNA, 20 nt, Staphylococcus aureus subsp. aureus MW2
auguaccaaauuuauaauuu

SEQ ID NO: 2118517 - RNA, 23 nt, Staphylococcus aureus subsp. aureus MW2
auguaccgaauccuucaucaaua

SEQ ID NO: 2118518 - RNA, 23 nt, Staphylococcus aureus subsp. aureus MW2
auguacacuuuugauuguuuaaa

SEQ ID NO: 2118519 - RNA, 21 nt, Staphylococcus aureus subsp. aureus MW2
augugcaagugguaaaaauga

SEQ ID NO: 2118520 - RNA, 14 nt, Staphylococcus aureus subsp. aureus MW2
augugcaaguuggc

SEQ ID NO: 2118521 - RNA, 17 nt, Staphylococcus aureus subsp. aureus MW2
augugaugcuugaaugu

SEQ ID NO: 2118522 - RNA, 20 nt, Staphylococcus aureus subsp. aureus MW2
augugaugcuugaauguuug

SEQ ID NO: 2118523 - RNA, 18 nt, Staphylococcus aureus subsp. aureus MW2
augugaugguucaaauau

SEQ ID NO: 2118524 - RNA, 21 nt, Staphylococcus aureus subsp. aureus MW2
augugcaucauuuauaugaug

SEQ ID NO: 2118525 - RNA, 15 nt, Staphylococcus aureus subsp. aureus MW2
augugacauaccagu

SEQ ID NO: 2118526 - RNA, 14 nt, Staphylococcus aureus subsp. aureus MW2
augucuuugaaaaa

SEQ ID NO: 2118527 - RNA, 21 nt, Staphylococcus aureus subsp. aureus MW2
augucuuuuuuuguaaauguu

SEQ ID NO: 2118528 - RNA, 17 nt, Staphylococcus aureus subsp. aureus MW2
augugaaaaagcuaauu

SEQ ID NO: 2118529 - RNA, 16 nt, Staphylococcus aureus subsp. aureus MW2
augucuuugaaaaauu

SEQ ID NO: 2118530 - RNA, 18 nt, Staphylococcus aureus subsp. aureus MW2
augucucucuuucuuauu

SEQ ID NO: 2118531 - RNA, 15 nt, Staphylococcus aureus subsp. aureus MW2
augucuuaucaauua

SEQ ID NO: 2118532 - RNA, 20 nt, Staphylococcus aureus subsp. aureus MW2
augugucauaauccauucuu

SEQ ID NO: 2118533 - RNA, 18 nt, Staphylococcus aureus subsp. aureus MW2
augugucauaauccauuc

SEQ ID NO: 2118534 - RNA, 15 nt, Staphylococcus aureus subsp. aureus MW2
auguguuaaaccaac

SEQ ID NO: 2118535 - RNA, 22 nt, Staphylococcus aureus subsp. aureus MW2
auguguugcauuacuaucuuca

SEQ ID NO: 2118536 - RNA, 13 nt, Staphylococcus aureus subsp. aureus MW2
auguguugcauua

SEQ ID NO: 2118537 - RNA, 17 nt, Staphylococcus aureus subsp. aureus MW2
augugucacauuauaac

SEQ ID NO: 2118538 - RNA, 17 nt, Staphylococcus aureus subsp. aureus MW2
augugcgucacucacuu

SEQ ID NO: 2118539 - RNA, 21 nt, Staphylococcus aureus subsp. aureus MW2
augugcgugguuuauuuuaau

SEQ ID NO: 2118540 - RNA, 15 nt, Staphylococcus aureus subsp. aureus MW2
augugcuuuaucaac

SEQ ID NO: 2118541 - RNA, 17 nt, Staphylococcus aureus subsp. aureus MW2
auguggcgcucuuauaa

SEQ ID NO: 2118542 - RNA, 18 nt, Staphylococcus aureus subsp. aureus MW2
auguggcgcucuuauaaa

SEQ ID NO: 2118543 - RNA, 18 nt, Staphylococcus aureus subsp. aureus MW2
auguuccgcuacaaaaca

SEQ ID NO: 2118544 - RNA, 15 nt, Staphylococcus aureus subsp. aureus MW2
auguuauuagauacu

SEQ ID NO: 2118545 - RNA, 22 nt, Staphylococcus aureus subsp. aureus MW2
auguuaucgauauagcauaaaa

SEQ ID NO: 2118546 - RNA, 20 nt, Staphylococcus aureus subsp. aureus MW2
auguuaucgauauagcauaa

SEQ ID NO: 2118547 - RNA, 14 nt, Staphylococcus aureus subsp. aureus MW2
auguuauauuauga

SEQ ID NO: 2118548 - RNA, 14 nt, Staphylococcus aureus subsp. aureus MW2
auguuaaacaauac

SEQ ID NO: 2118549 - RNA, 22 nt, Staphylococcus aureus subsp. aureus MW2
auguuaaacuagaaaacauaaa

SEQ ID NO: 2118550 - RNA, 23 nt, Staphylococcus aureus subsp. aureus MW2
auguuaaacuagaaaacauaaau

SEQ ID NO: 2118551 - RNA, 15 nt, Staphylococcus aureus subsp. aureus MW2
auguuauaaaaugaa

SEQ ID NO: 2118552 - RNA, 18 nt, Staphylococcus aureus subsp. aureus MW2
auguuauaaaaugaauaa

SEQ ID NO: 2118553 - RNA, 13 nt, Staphylococcus aureus subsp. aureus MW2
auguuacugauga

SEQ ID NO: 2118554 - RNA, 21 nt, Staphylococcus aureus subsp. aureus MW2
auguuacucuuagguauacgu

SEQ ID NO: 2118555 - RNA, 15 nt, Staphylococcus aureus subsp. aureus MW2
auguuacccuaauga

SEQ ID NO: 2118556 - RNA, 16 nt, Staphylococcus aureus subsp. aureus MW2
auguucuuauaaaagu

SEQ ID NO: 2118557 - RNA, 15 nt, Staphylococcus aureus subsp. aureus MW2
auguucuuuuuuaau

SEQ ID NO: 2118558 - RNA, 20 nt, Staphylococcus aureus subsp. aureus MW2
auguuccuuguuuuaaacuu

SEQ ID NO: 2118559 - RNA, 22 nt, Staphylococcus aureus subsp. aureus MW2
auguucuaggcuccuaaauguu

SEQ ID NO: 2118560 - RNA, 17 nt, Staphylococcus aureus subsp. aureus MW2
auguuuggaugaacaaa

SEQ ID NO: 2118561 - RNA, 16 nt, Staphylococcus aureus subsp. aureus MW2
auguuugccagguaaa

SEQ ID NO: 2118562 - RNA, 21 nt, Staphylococcus aureus subsp. aureus MW2
auguuugcauaccuauaaaca

SEQ ID NO: 2118563 - RNA, 14 nt, Staphylococcus aureus subsp. aureus MW2
auguugauaaaaag

SEQ ID NO: 2118564 - RNA, 17 nt, Staphylococcus aureus subsp. aureus MW2
auguuuggcauaauaau

SEQ ID NO: 2118565 - RNA, 22 nt, Staphylococcus aureus subsp. aureus MW2
auguuugucguuacuaccuauu

SEQ ID NO: 2118566 - RNA, 22 nt, Staphylococcus aureus subsp. aureus MW2
auguuuuauaaggaugucgauu

SEQ ID NO: 2118567 - RNA, 13 nt, Staphylococcus aureus subsp. aureus MW2
auuaaaaaucaaa

SEQ ID NO: 2118568 - RNA, 18 nt, Staphylococcus aureus subsp. aureus MW2
auuaaaacagcaaauaaa

SEQ ID NO: 2118569 - RNA, 23 nt, Staphylococcus aureus subsp. aureus MW2
auuaaaacgaaguuauuuauuca

SEQ ID NO: 2118570 - RNA, 21 nt, Staphylococcus aureus subsp. aureus MW2
auuaaaagaguacauuuauuu

SEQ ID NO: 2118571 - RNA, 20 nt, Staphylococcus aureus subsp. aureus MW2
auuaaagcaucuucaauauu

SEQ ID NO: 2118572 - RNA, 18 nt, Staphylococcus aureus subsp. aureus MW2
auuaaagcaucgaacaau

SEQ ID NO: 2118573 - RNA, 16 nt, Staphylococcus aureus subsp. aureus MW2
auuaaaggaaaucaau

SEQ ID NO: 2118574 - RNA, 20 nt, Staphylococcus aureus subsp. aureus MW2
auuaaagcuagaaacaaugc

SEQ ID NO: 2118575 - RNA, 12 nt, Staphylococcus aureus subsp. aureus MW2
auuaaaugcaau

SEQ ID NO: 2118576 - RNA, 22 nt, Staphylococcus aureus subsp. aureus MW2
auuaaaugaugcaguaaaacca

SEQ ID NO: 2118577 - RNA, 19 nt, Staphylococcus aureus subsp. aureus MW2
auuaaaugaugcaguaaaa

SEQ ID NO: 2118578 - RNA, 13 nt, Staphylococcus aureus subsp. aureus MW2
auuaaaucugcuu

SEQ ID NO: 2118579 - RNA, 23 nt, Staphylococcus aureus subsp. aureus MW2
auuaaauccgcuuguucaacuaa

SEQ ID NO: 2118580 - RNA, 19 nt, Staphylococcus aureus subsp. aureus MW2
auuaagaugaaauacuuga

SEQ ID NO: 2118581 - RNA, 19 nt, Staphylococcus aureus subsp. aureus MW2
auuaagauguauaugaauu

SEQ ID NO: 2118582 - RNA, 21 nt, Staphylococcus aureus subsp. aureus MW2
auuaagccaucccaacuuaau

SEQ ID NO: 2118583 - RNA, 17 nt, Staphylococcus aureus subsp. aureus MW2
auuaagacugauuaauu

SEQ ID NO: 2118584 - RNA, 15 nt, Staphylococcus aureus subsp. aureus MW2
auuaagcuaugcuuu

SEQ ID NO: 2118585 - RNA, 14 nt, Staphylococcus aureus subsp. aureus MW2
auuaauaaaacugc

SEQ ID NO: 2118586 - RNA, 20 nt, Staphylococcus aureus subsp. aureus MW2
auuaauaagugcuguuacuu

SEQ ID NO: 2118587 - RNA, 14 nt, Staphylococcus aureus subsp. aureus MW2
auuaauaauuaaac

SEQ ID NO: 2118588 - RNA, 15 nt, Staphylococcus aureus subsp. aureus MW2
auuaauacaucaaua

SEQ ID NO: 2118589 - RNA, 19 nt, Staphylococcus aureus subsp. aureus MW2
auuaaauguacauuguaaa

SEQ ID NO: 2118590 - RNA, 22 nt, Staphylococcus aureus subsp. aureus MW2
auuaaaugcauaauauauuaaa

SEQ ID NO: 2118591 - RNA, 22 nt, Staphylococcus aureus subsp. aureus MW2
auuaaauuauauguuuuuauua

SEQ ID NO: 2118592 - RNA, 19 nt, Staphylococcus aureus subsp. aureus MW2
auuaaccuugauuuaauuu

SEQ ID NO: 2118593 - RNA, 16 nt, Staphylococcus aureus subsp. aureus MW2
auuaacgauuaauaua

SEQ ID NO: 2118594 - RNA, 19 nt, Staphylococcus aureus subsp. aureus MW2
auuaacgcuuauacuauau

SEQ ID NO: 2118595 - RNA, 22 nt, Staphylococcus aureus subsp. aureus MW2
auuaacuuaaaauuuaaauauu

SEQ ID NO: 2118596 - RNA, 18 nt, Staphylococcus aureus subsp. aureus MW2
auuaacgucaacagcaua

SEQ ID NO: 2118597 - RNA, 14 nt, Staphylococcus aureus subsp. aureus MW2
auuaacguguacac

SEQ ID NO: 2118598 - RNA, 16 nt, Staphylococcus aureus subsp. aureus MW2
auuaacgucaacagca

SEQ ID NO: 2118599 - RNA, 18 nt, Staphylococcus aureus subsp. aureus MW2
auuauagucuuaaacaua

SEQ ID NO: 2118600 - RNA, 16 nt, Staphylococcus aureus subsp. aureus MW2
auuauagguauaagaa

SEQ ID NO: 2118601 - RNA, 20 nt, Staphylococcus aureus subsp. aureus MW2
auuauaucgucguaacucuu

SEQ ID NO: 2118602 - RNA, 15 nt, Staphylococcus aureus subsp. aureus MW2
auuauauauauuaaa

SEQ ID NO: 2118603 - RNA, 20 nt, Staphylococcus aureus subsp. aureus MW2
auuaguauucaaaaaaauau

SEQ ID NO: 2118604 - RNA, 14 nt, Staphylococcus aureus subsp. aureus MW2
aaaagcuagaaguu

SEQ ID NO: 2118605 - RNA, 17 nt, Staphylococcus aureus subsp. aureus MW2
auuagucauugaaaaua

SEQ ID NO: 2118606 - RNA, 19 nt, Staphylococcus aureus subsp. aureus MW2
auuaugccuuugauuuuac

SEQ ID NO: 2118607 - RNA, 22 nt, Staphylococcus aureus subsp. aureus MW2
auuaucuauccauuugguuuaa

SEQ ID NO: 2118608 - RNA, 14 nt, Staphylococcus aureus subsp. aureus MW2
auuaucuauccauu

SEQ ID NO: 2118609 - RNA, 22 nt, Staphylococcus aureus subsp. aureus MW2
auuauguaaaaaauaucuuguc

SEQ ID NO: 2118610 - RNA, 18 nt, Staphylococcus aureus subsp. aureus MW2
auuauguaaaaaauaucu

SEQ ID NO: 2118611 - RNA, 16 nt, Staphylococcus aureus subsp. aureus MW2
auuauguaaaaaauau

SEQ ID NO: 2118612 - RNA, 14 nt, Staphylococcus aureus subsp. aureus MW2
auuauguaaaaaau

SEQ ID NO: 2118613 - RNA, 13 nt, Staphylococcus aureus subsp. aureus MW2
auuauguauuuuu

SEQ ID NO: 2118614 - RNA, 23 nt, Staphylococcus aureus subsp. aureus MW2
auuauguaaauugguauaacaau

SEQ ID NO: 2118615 - RNA, 18 nt, Staphylococcus aureus subsp. aureus MW2
auuauguaauucuagcgu

SEQ ID NO: 2118616 - RNA, 17 nt, Staphylococcus aureus subsp. aureus MW2
auuauguaccaaauuua

SEQ ID NO: 2118617 - RNA, 17 nt, Staphylococcus aureus subsp. aureus MW2
auuauguuauaaauucu

SEQ ID NO: 2118618 - RNA, 18 nt, Staphylococcus aureus subsp. aureus MW2
auuaugugucuuccaauc

SEQ ID NO: 2118619 - RNA, 14 nt, Staphylococcus aureus subsp. aureus MW2
auuauguguauauu

SEQ ID NO: 2118620 - RNA, 13 nt, Staphylococcus aureus subsp. aureus MW2
auuauuaaaucaa

SEQ ID NO: 2118621 - RNA, 14 nt, Staphylococcus aureus subsp. aureus MW2
auucaaaauaacuu

SEQ ID NO: 2118622 - RNA, 14 nt, Staphylococcus aureus subsp. aureus MW2
auuauuuuuuuaaa

SEQ ID NO: 2118623 - RNA, 14 nt, Staphylococcus aureus subsp. aureus MW2
auucaaaaauuguu

SEQ ID NO: 2118624 - RNA, 21 nt, Staphylococcus aureus subsp. aureus MW2
auucaaaaauuguuaauacau

SEQ ID NO: 2118625 - RNA, 17 nt, Staphylococcus aureus subsp. aureus MW2
auucaacuuauuauuua

SEQ ID NO: 2118626 - RNA, 15 nt, Staphylococcus aureus subsp. aureus MW2
auucaacuaauuuaa

SEQ ID NO: 2118627 - RNA, 19 nt, Staphylococcus aureus subsp. aureus MW2
auucaaaggacgucuuuuu

SEQ ID NO: 2118628 - RNA, 18 nt, Staphylococcus aureus subsp. aureus MW2
auucaacgucaucaaaac

SEQ ID NO: 2118629 - RNA, 19 nt, Staphylococcus aureus subsp. aureus MW2
auucaagcaucauuuuucg

SEQ ID NO: 2118630 - RNA, 13 nt, Staphylococcus aureus subsp. aureus MW2
auuauuugauaaa

SEQ ID NO: 2118631 - RNA, 22 nt, Staphylococcus aureus subsp. aureus MW2
auuauuuagaauucuaaaagaa

SEQ ID NO: 2118632 - RNA, 17 nt, Staphylococcus aureus subsp. aureus MW2
auuauuuccuguuacuu

SEQ ID NO: 2118633 - RNA, 16 nt, Staphylococcus aureus subsp. aureus MW2
auuauuugauaaauaa

SEQ ID NO: 2118634 - RNA, 16 nt, Staphylococcus aureus subsp. aureus MW2
auuauuuuacuuugua

SEQ ID NO: 2118635 - RNA, 18 nt, Staphylococcus aureus subsp. aureus MW2
auuauuuuguauuuuuca

SEQ ID NO: 2118636 - RNA, 21 nt, Staphylococcus aureus subsp. aureus MW2
auuauuuuguauuuuucaaau

SEQ ID NO: 2118637 - RNA, 15 nt, Staphylococcus aureus subsp. aureus MW2
auuauuuuguauuuu

SEQ ID NO: 2118638 - RNA, 19 nt, Staphylococcus aureus subsp. aureus MW2
auuauuaagugaguuuuau

SEQ ID NO: 2118639 - RNA, 18 nt, Staphylococcus aureus subsp. aureus MW2
auuauuaacuguaccugc

SEQ ID NO: 2118640 - RNA, 14 nt, Staphylococcus aureus subsp. aureus MW2
auuauuaacuguac

SEQ ID NO: 2118641 - RNA, 18 nt, Staphylococcus aureus subsp. aureus MW2
auuauugguugaaauuaa

SEQ ID NO: 2118642 - RNA, 18 nt, Staphylococcus aureus subsp. aureus MW2
auuauugucaucauguuc

SEQ ID NO: 2118643 - RNA, 23 nt, Staphylococcus aureus subsp. aureus MW2
auuauuuagaauucuaaaagaau

SEQ ID NO: 2118644 - RNA, 14 nt, Staphylococcus aureus subsp. aureus MW2
auuauuuaaaacuu

SEQ ID NO: 2118645 - RNA, 16 nt, Staphylococcus aureus subsp. aureus MW2
auuauuuaaauuuuca

SEQ ID NO: 2118646 - RNA, 19 nt, Staphylococcus aureus subsp. aureus MW2
auuacuaaccuauuaaaau

SEQ ID NO: 2118647 - RNA, 23 nt, Staphylococcus aureus subsp. aureus MW2
auuacuacuuuauaaauaucuuu

SEQ ID NO: 2118648 - RNA, 20 nt, Staphylococcus aureus subsp. aureus MW2
auuacuacuuuauaaauauc

SEQ ID NO: 2118649 - RNA, 14 nt, Staphylococcus aureus subsp. aureus MW2
auuacuauaaaaaa

SEQ ID NO: 2118650 - RNA, 23 nt, Staphylococcus aureus subsp. aureus MW2
auuacuauauuuaaauuggaauc

SEQ ID NO: 2118651 - RNA, 17 nt, Staphylococcus aureus subsp. aureus MW2
auuacuauaaaaaacag

SEQ ID NO: 2118652 - RNA, 13 nt, Staphylococcus aureus subsp. aureus MW2
auuacuauauuua

SEQ ID NO: 2118653 - RNA, 20 nt, Staphylococcus aureus subsp. aureus MW2
auuaccuggguauacagguu

SEQ ID NO: 2118654 - RNA, 19 nt, Staphylococcus aureus subsp. aureus MW2
aaaagcccccuuuucacaa

SEQ ID NO: 2118655 - RNA, 16 nt, Staphylococcus aureus subsp. aureus MW2
auuaauauaaaauaaa

SEQ ID NO: 2118656 - RNA, 21 nt, Staphylococcus aureus subsp. aureus MW2
auuaauauaagucuauuaugu

SEQ ID NO: 2118657 - RNA, 13 nt, Staphylococcus aureus subsp. aureus MW2
auuaauauauaua

SEQ ID NO: 2118658 - RNA, 15 nt, Staphylococcus aureus subsp. aureus MW2
auuaauauauuuaaa

SEQ ID NO: 2118659 - RNA, 16 nt, Staphylococcus aureus subsp. aureus MW2
auuaauagguuauuug

SEQ ID NO: 2118660 - RNA, 15 nt, Staphylococcus aureus subsp. aureus MW2
auuaauagaaagugc

SEQ ID NO: 2118661 - RNA, 14 nt, Staphylococcus aureus subsp. aureus MW2
auuaauagaaagug

SEQ ID NO: 2118662 - RNA, 16 nt, Staphylococcus aureus subsp. aureus MW2
auuacauaauuuaucu

SEQ ID NO: 2118663 - RNA, 19 nt, Staphylococcus aureus subsp. aureus MW2
auuacauauaagauagaua

SEQ ID NO: 2118664 - RNA, 17 nt, Staphylococcus aureus subsp. aureus MW2
auuacauuuuaugucca

SEQ ID NO: 2118665 - RNA, 18 nt, Staphylococcus aureus subsp. aureus MW2
auuacccuuuaaucucau

SEQ ID NO: 2118666 - RNA, 16 nt, Staphylococcus aureus subsp. aureus MW2
auuagaaaauuucuca

SEQ ID NO: 2118667 - RNA, 17 nt, Staphylococcus aureus subsp. aureus MW2
auuacuuucauuguaaa

SEQ ID NO: 2118668 - RNA, 15 nt, Staphylococcus aureus subsp. aureus MW2
auuacuuuggaaauu

SEQ ID NO: 2118669 - RNA, 14 nt, Staphylococcus aureus subsp. aureus MW2
auuagaaccaucau

SEQ ID NO: 2118670 - RNA, 15 nt, Staphylococcus aureus subsp. aureus MW2
auuagaacuucucuu

SEQ ID NO: 2118671 - RNA, 17 nt, Staphylococcus aureus subsp. aureus MW2
auuagaacuucucuuug

SEQ ID NO: 2118672 - RNA, 19 nt, Staphylococcus aureus subsp. aureus MW2
auuagaacuucucuuugaa

SEQ ID NO: 2118673 - RNA, 23 nt, Staphylococcus aureus subsp. aureus MW2
auuagaacuucucuuugaacgaa

SEQ ID NO: 2118674 - RNA, 19 nt, Staphylococcus aureus subsp. aureus MW2
auuagacguguaaauguua

SEQ ID NO: 2118675 - RNA, 15 nt, Staphylococcus aureus subsp. aureus MW2
auuacuugaauauua

SEQ ID NO: 2118676 - RNA, 13 nt, Staphylococcus aureus subsp. aureus MW2
auuacuuuagaaa

SEQ ID NO: 2118677 - RNA, 13 nt, Staphylococcus aureus subsp. aureus MW2
auuacuuauucaa

SEQ ID NO: 2118678 - RNA, 16 nt, Staphylococcus aureus subsp. aureus MW2
auuacuuccauugcuu

SEQ ID NO: 2118679 - RNA, 13 nt, Staphylococcus aureus subsp. aureus MW2
auuacuuaucugu

SEQ ID NO: 2118680 - RNA, 21 nt, Staphylococcus aureus subsp. aureus MW2
auuacuaaccuauuaaaauaa

SEQ ID NO: 2118681 - RNA, 14 nt, Staphylococcus aureus subsp. aureus MW2
auuagauuuuaugc

SEQ ID NO: 2118682 - RNA, 15 nt, Staphylococcus aureus subsp. aureus MW2
auuagcaaauauuau

SEQ ID NO: 2118683 - RNA, 17 nt, Staphylococcus aureus subsp. aureus MW2
auuagauauauuugaaa

SEQ ID NO: 2118684 - RNA, 15 nt, Staphylococcus aureus subsp. aureus MW2
auuagauaucuuaau

SEQ ID NO: 2118685 - RNA, 22 nt, Staphylococcus aureus subsp. aureus MW2
auuagauaucuuaaucuaaaaa

SEQ ID NO: 2118686 - RNA, 13 nt, Staphylococcus aureus subsp. aureus MW2
auuagauauauuu

SEQ ID NO: 2118687 - RNA, 15 nt, Staphylococcus aureus subsp. aureus MW2
auuagaucuaugguu

SEQ ID NO: 2118688 - RNA, 17 nt, Staphylococcus aureus subsp. aureus MW2
aaaagcggacugaaaga

SEQ ID NO: 2118689 - RNA, 22 nt, Staphylococcus aureus subsp. aureus MW2
aaaagccuacuuugucugcaau

SEQ ID NO: 2118690 - RNA, 15 nt, Staphylococcus aureus subsp. aureus MW2
auuccaaguauuuuc

SEQ ID NO: 2118691 - RNA, 18 nt, Staphylococcus aureus subsp. aureus MW2
auuccaaguauuuucucu

SEQ ID NO: 2118692 - RNA, 14 nt, Staphylococcus aureus subsp. aureus MW2
auuccaaucuauuu

SEQ ID NO: 2118693 - RNA, 19 nt, Staphylococcus aureus subsp. aureus MW2
auuccaaucuauuuuaaac

SEQ ID NO: 2118694 - RNA, 21 nt, Staphylococcus aureus subsp. aureus MW2
auuccaaaaauuguaaaaccu

SEQ ID NO: 2118695 - RNA, 20 nt, Staphylococcus aureus subsp. aureus MW2
auuccaaaaccgaaaauacc

SEQ ID NO: 2118696 - RNA, 20 nt, Staphylococcus aureus subsp. aureus MW2
auuccaaacacacuguugaa

SEQ ID NO: 2118697 - RNA, 14 nt, Staphylococcus aureus subsp. aureus MW2
auuccacuacaauc

SEQ ID NO: 2118698 - RNA, 19 nt, Staphylococcus aureus subsp. aureus MW2
auuccauaguauguaucuu

SEQ ID NO: 2118699 - RNA, 16 nt, Staphylococcus aureus subsp. aureus MW2
auuccauuucaaaugc

SEQ ID NO: 2118700 - RNA, 17 nt, Staphylococcus aureus subsp. aureus MW2
auucccugcagcaauca

SEQ ID NO: 2118701 - RNA, 17 nt, Staphylococcus aureus subsp. aureus MW2
auuccuagcuuuuaugu

SEQ ID NO: 2118702 - RNA, 19 nt, Staphylococcus aureus subsp. aureus MW2
auucauaucuuucaauuaa

SEQ ID NO: 2118703 - RNA, 14 nt, Staphylococcus aureus subsp. aureus MW2
auucauaucuuuca

SEQ ID NO: 2118704 - RNA, 17 nt, Staphylococcus aureus subsp. aureus MW2
auucauauauacugccc

SEQ ID NO: 2118705 - RNA, 19 nt, Staphylococcus aureus subsp. aureus MW2
auucaucgucucacuuaau

SEQ ID NO: 2118706 - RNA, 15 nt, Staphylococcus aureus subsp. aureus MW2
auucaucgucucacu

SEQ ID NO: 2118707 - RNA, 23 nt, Staphylococcus aureus subsp. aureus MW2
auucaucuugcaaguauuuucuu

SEQ ID NO: 2118708 - RNA, 12 nt, Staphylococcus aureus subsp. aureus MW2
auucaugaauaa

SEQ ID NO: 2118709 - RNA, 14 nt, Staphylococcus aureus subsp. aureus MW2
auucaugaauaauu

SEQ ID NO: 2118710 - RNA, 15 nt, Staphylococcus aureus subsp. aureus MW2
auucaugauauguuc

SEQ ID NO: 2118711 - RNA, 21 nt, Staphylococcus aureus subsp. aureus MW2
auucauguccgagacuauauu

SEQ ID NO: 2118712 - RNA, 14 nt, Staphylococcus aureus subsp. aureus MW2
auucauuacauguu

SEQ ID NO: 2118713 - RNA, 19 nt, Staphylococcus aureus subsp. aureus MW2
auucauuacauguuacuga

SEQ ID NO: 2118714 - RNA, 15 nt, Staphylococcus aureus subsp. aureus MW2
auucauuaauaggau

SEQ ID NO: 2118715 - RNA, 13 nt, Staphylococcus aureus subsp. aureus MW2
auucauucaauac

SEQ ID NO: 2118716 - RNA, 13 nt, Staphylococcus aureus subsp. aureus MW2
auucauuaagcuu

SEQ ID NO: 2118717 - RNA, 14 nt, Staphylococcus aureus subsp. aureus MW2
auucauucaauacg

SEQ ID NO: 2118718 - RNA, 16 nt, Staphylococcus aureus subsp. aureus MW2
auucauuuauuuucuu

SEQ ID NO: 2118719 - RNA, 22 nt, Staphylococcus aureus subsp. aureus MW2
auucauuuucuuuuucuugaag

SEQ ID NO: 2118720 - RNA, 13 nt, Staphylococcus aureus subsp. aureus MW2
auucauuuuaaau

SEQ ID NO: 2118721 - RNA, 22 nt, Staphylococcus aureus subsp. aureus MW2
auuccuuggugccgaaauuguu

SEQ ID NO: 2118722 - RNA, 17 nt, Staphylococcus aureus subsp. aureus MW2
auucgcuuguucaguaa

SEQ ID NO: 2118723 - RNA, 23 nt, Staphylococcus aureus subsp. aureus MW2
auucguaccaacucgcuauaugu

SEQ ID NO: 2118724 - RNA, 15 nt, Staphylococcus aureus subsp. aureus MW2
auucguaauuuauga

SEQ ID NO: 2118725 - RNA, 14 nt, Staphylococcus aureus subsp. aureus MW2
auucuccuuuuguu

SEQ ID NO: 2118726 - RNA, 21 nt, Staphylococcus aureus subsp. aureus MW2
auucuacaggcaaugcaaguu

SEQ ID NO: 2118727 - RNA, 13 nt, Staphylococcus aureus subsp. aureus MW2
auucuauacuuuu

SEQ ID NO: 2118728 - RNA, 16 nt, Staphylococcus aureus subsp. aureus MW2
auucuauacuuuuaau

SEQ ID NO: 2118729 - RNA, 18 nt, Staphylococcus aureus subsp. aureus MW2
auucuaauugcacauuua

SEQ ID NO: 2118730 - RNA, 18 nt, Staphylococcus aureus subsp. aureus MW2
auucuacaggcaaugcaa

SEQ ID NO: 2118731 - RNA, 17 nt, Staphylococcus aureus subsp. aureus MW2
auucgugauuacauucu

SEQ ID NO: 2118732 - RNA, 14 nt, Staphylococcus aureus subsp. aureus MW2
auucuaaguuaaaa

SEQ ID NO: 2118733 - RNA, 17 nt, Staphylococcus aureus subsp. aureus MW2
auucuaaguuaaaaccu

SEQ ID NO: 2118734 - RNA, 14 nt, Staphylococcus aureus subsp. aureus MW2
auucucgguuuuuu

SEQ ID NO: 2118735 - RNA, 14 nt, Staphylococcus aureus subsp. aureus MW2
auucugaaaaauau

SEQ ID NO: 2118736 - RNA, 14 nt, Staphylococcus aureus subsp. aureus MW2
auucuugaauaaau

SEQ ID NO: 2118737 - RNA, 18 nt, Staphylococcus aureus subsp. aureus MW2
auucuuguuugauuuuag

SEQ ID NO: 2118738 - RNA, 17 nt, Staphylococcus aureus subsp. aureus MW2
auucuucauuuauaaca

SEQ ID NO: 2118739 - RNA, 20 nt, Staphylococcus aureus subsp. aureus MW2
auugaugaaagacugacuaa

SEQ ID NO: 2118740 - RNA, 19 nt, Staphylococcus aureus subsp. aureus MW2
auugaucuuuuauaaugaa

SEQ ID NO: 2118741 - RNA, 14 nt, Staphylococcus aureus subsp. aureus MW2
auugaugaauaaau

SEQ ID NO: 2118742 - RNA, 18 nt, Staphylococcus aureus subsp. aureus MW2
auugaugucacauaugac

SEQ ID NO: 2118743 - RNA, 15 nt, Staphylococcus aureus subsp. aureus MW2
auugcaaaaauaaua

SEQ ID NO: 2118744 - RNA, 13 nt, Staphylococcus aureus subsp. aureus MW2
auugaugacugcu

SEQ ID NO: 2118745 - RNA, 13 nt, Staphylococcus aureus subsp. aureus MW2
auugaugauguac

SEQ ID NO: 2118746 - RNA, 15 nt, Staphylococcus aureus subsp. aureus MW2
auucuuuaauuaaau

SEQ ID NO: 2118747 - RNA, 16 nt, Staphylococcus aureus subsp. aureus MW2
auugaaaaaauaacug

SEQ ID NO: 2118748 - RNA, 14 nt, Staphylococcus aureus subsp. aureus MW2
auugaaaaauuaaa

SEQ ID NO: 2118749 - RNA, 14 nt, Staphylococcus aureus subsp. aureus MW2
auugcaaaugcucu

SEQ ID NO: 2118750 - RNA, 23 nt, Staphylococcus aureus subsp. aureus MW2
auugcaagacuuggugcccaagu

SEQ ID NO: 2118751 - RNA, 13 nt, Staphylococcus aureus subsp. aureus MW2
auugcaauggcuu

SEQ ID NO: 2118752 - RNA, 22 nt, Staphylococcus aureus subsp. aureus MW2
auugcacuaugcauaauaccaa

SEQ ID NO: 2118753 - RNA, 23 nt, Staphylococcus aureus subsp. aureus MW2
auugcacuaugcauaauaccaau

SEQ ID NO: 2118754 - RNA, 22 nt, Staphylococcus aureus subsp. aureus MW2
auugcacgucuuguaucaacau

SEQ ID NO: 2118755 - RNA, 19 nt, Staphylococcus aureus subsp. aureus MW2
auugcauacguaaauggua

SEQ ID NO: 2118756 - RNA, 18 nt, Staphylococcus aureus subsp. aureus MW2
auugccuaagaacuuaau

SEQ ID NO: 2118757 - RNA, 23 nt, Staphylococcus aureus subsp. aureus MW2
auugcugcuguacaauuucgcuu

SEQ ID NO: 2118758 - RNA, 12 nt, Staphylococcus aureus subsp. aureus MW2
auugcuaaaaaa

SEQ ID NO: 2118759 - RNA, 13 nt, Staphylococcus aureus subsp. aureus MW2
auugcuaaaaaaa

SEQ ID NO: 2118760 - RNA, 13 nt, Staphylococcus aureus subsp. aureus MW2
auugcuaaaucau

SEQ ID NO: 2118761 - RNA, 20 nt, Staphylococcus aureus subsp. aureus MW2
auugcuacccaccuuucuuu

SEQ ID NO: 2118762 - RNA, 22 nt, Staphylococcus aureus subsp. aureus MW2
auugcguaagguauuucauuga

SEQ ID NO: 2118763 - RNA, 21 nt, Staphylococcus aureus subsp. aureus MW2
auugcgugcuucacuaaaaau

SEQ ID NO: 2118764 - RNA, 21 nt, Staphylococcus aureus subsp. aureus MW2
auugccaguaucucuuuucua

SEQ ID NO: 2118765 - RNA, 19 nt, Staphylococcus aureus subsp. aureus MW2
auuguucauguuuaaaaua

SEQ ID NO: 2118766 - RNA, 14 nt, Staphylococcus aureus subsp. aureus MW2
auuguugauaaaug

SEQ ID NO: 2118767 - RNA, 15 nt, Staphylococcus aureus subsp. aureus MW2
auuguuacuuuaacu

SEQ ID NO: 2118768 - RNA, 19 nt, Staphylococcus aureus subsp. aureus MW2
auuguuaagcccucauuuu

SEQ ID NO: 2118769 - RNA, 19 nt, Staphylococcus aureus subsp. aureus MW2
auuguuagauaaucucauu

SEQ ID NO: 2118770 - RNA, 22 nt, Staphylococcus aureus subsp. aureus MW2
auuguuauagcguuuaagaaau

SEQ ID NO: 2118771 - RNA, 18 nt, Staphylococcus aureus subsp. aureus MW2
auuguuauacauauauuc

SEQ ID NO: 2118772 - RNA, 18 nt, Staphylococcus aureus subsp. aureus MW2
auuguuauccaaaacauu

SEQ ID NO: 2118773 - RNA, 19 nt, Staphylococcus aureus subsp. aureus MW2
auuguuauccaaaacauuu

SEQ ID NO: 2118774 - RNA, 20 nt, Staphylococcus aureus subsp. aureus MW2
auugucuagguuagaauuau

SEQ ID NO: 2118775 - RNA, 17 nt, Staphylococcus aureus subsp. aureus MW2
auuguguugaaucaaca

SEQ ID NO: 2118776 - RNA, 18 nt, Staphylococcus aureus subsp. aureus MW2
auuguguccauaaauauu

SEQ ID NO: 2118777 - RNA, 18 nt, Staphylococcus aureus subsp. aureus MW2
auuuaaauugacuuuaau

SEQ ID NO: 2118778 - RNA, 16 nt, Staphylococcus aureus subsp. aureus MW2
auuuaaauuaaaauaa

SEQ ID NO: 2118779 - RNA, 18 nt, Staphylococcus aureus subsp. aureus MW2
auuuaaauuaaaauaauu

SEQ ID NO: 2118780 - RNA, 14 nt, Staphylococcus aureus subsp. aureus MW2
auuuaaauuacagu

SEQ ID NO: 2118781 - RNA, 13 nt, Staphylococcus aureus subsp. aureus MW2
auuuaaauuuuca

SEQ ID NO: 2118782 - RNA, 17 nt, Staphylococcus aureus subsp. aureus MW2
auuuaaacuucguaaau

SEQ ID NO: 2118783 - RNA, 22 nt, Staphylococcus aureus subsp. aureus MW2
auuuaaauauaaccuaaaaaca

SEQ ID NO: 2118784 - RNA, 13 nt, Staphylococcus aureus subsp. aureus MW2
auuuaaauagaag

SEQ ID NO: 2118785 - RNA, 20 nt, Staphylococcus aureus subsp. aureus MW2
auuuaaaugcuuucaaauac

SEQ ID NO: 2118786 - RNA, 16 nt, Staphylococcus aureus subsp. aureus MW2
auuuaaaucaauauuc

SEQ ID NO: 2118787 - RNA, 20 nt, Staphylococcus aureus subsp. aureus MW2
auuguugcaaaauacgauuu

SEQ ID NO: 2118788 - RNA, 21 nt, Staphylococcus aureus subsp. aureus MW2
auuguugcuaaucucagauuu

SEQ ID NO: 2118789 - RNA, 18 nt, Staphylococcus aureus subsp. aureus MW2
auuguugcaaugauuaau

SEQ ID NO: 2118790 - RNA, 20 nt, Staphylococcus aureus subsp. aureus MW2
auuguuuaauaacaaaauua

SEQ ID NO: 2118791 - RNA, 13 nt, Staphylococcus aureus subsp. aureus MW2
auuuaaacuagua

SEQ ID NO: 2118792 - RNA, 14 nt, Staphylococcus aureus subsp. aureus MW2
auuuaaagcaucau

SEQ ID NO: 2118793 - RNA, 13 nt, Staphylococcus aureus subsp. aureus MW2
auuguaguauuuu

SEQ ID NO: 2118794 - RNA, 21 nt, Staphylococcus aureus subsp. aureus MW2
auuguaguauuuuuugccauc

SEQ ID NO: 2118795 - RNA, 15 nt, Staphylococcus aureus subsp. aureus MW2
auugucaucauguuc

SEQ ID NO: 2118796 - RNA, 22 nt, Staphylococcus aureus subsp. aureus MW2
auuguacgcuucaauuauuuca

SEQ ID NO: 2118797 - RNA, 16 nt, Staphylococcus aureus subsp. aureus MW2
auuguaaaacaaauua

SEQ ID NO: 2118798 - RNA, 16 nt, Staphylococcus aureus subsp. aureus MW2
auuguaauauauuaau

SEQ ID NO: 2118799 - RNA, 15 nt, Staphylococcus aureus subsp. aureus MW2
auuguaaucacuauu

SEQ ID NO: 2118800 - RNA, 15 nt, Staphylococcus aureus subsp. aureus MW2
auuguacugauauau

SEQ ID NO: 2118801 - RNA, 22 nt, Staphylococcus aureus subsp. aureus MW2
auuguagcgccuaagacauaaa

SEQ ID NO: 2118802 - RNA, 13 nt, Staphylococcus aureus subsp. aureus MW2
auuguaaaaugua

SEQ ID NO: 2118803 - RNA, 14 nt, Staphylococcus aureus subsp. aureus MW2
auuguaaauauagu

SEQ ID NO: 2118804 - RNA, 18 nt, Staphylococcus aureus subsp. aureus MW2
auuguaaauauaguaaua

SEQ ID NO: 2118805 - RNA, 18 nt, Staphylococcus aureus subsp. aureus MW2
auuguaaaucuuguugga

SEQ ID NO: 2118806 - RNA, 22 nt, Staphylococcus aureus subsp. aureus MW2
auuguaagucgaaaguacccag

SEQ ID NO: 2118807 - RNA, 14 nt, Staphylococcus aureus subsp. aureus MW2
auuguaaaaugcuc

SEQ ID NO: 2118808 - RNA, 21 nt, Staphylococcus aureus subsp. aureus MW2
auuguaaaaacguucaaucgu

SEQ ID NO: 2118809 - RNA, 18 nt, Staphylococcus aureus subsp. aureus MW2
auugguuuucauguguca

SEQ ID NO: 2118810 - RNA, 21 nt, Staphylococcus aureus subsp. aureus MW2
auugguuuuuacuauaauaau

SEQ ID NO: 2118811 - RNA, 17 nt, Staphylococcus aureus subsp. aureus MW2
auugguuuggauaaaau

SEQ ID NO: 2118812 - RNA, 15 nt, Staphylococcus aureus subsp. aureus MW2
aaaaggucaaaaaau

SEQ ID NO: 2118813 - RNA, 16 nt, Staphylococcus aureus subsp. aureus MW2
auugguugauuaguuu

SEQ ID NO: 2118814 - RNA, 23 nt, Staphylococcus aureus subsp. aureus MW2
auuggcuccccaauuucucugug

SEQ ID NO: 2118815 - RNA, 14 nt, Staphylococcus aureus subsp. aureus MW2
auuggcuugcuuca

SEQ ID NO: 2118816 - RNA, 20 nt, Staphylococcus aureus subsp. aureus MW2
auugggagcaaucaauacaa

SEQ ID NO: 2118817 - RNA, 18 nt, Staphylococcus aureus subsp. aureus MW2
auugguucuauaauaaau

SEQ ID NO: 2118818 - RNA, 20 nt, Staphylococcus aureus subsp. aureus MW2
caaaaaaagacacaucacua

SEQ ID NO: 2118819 - RNA, 15 nt, Staphylococcus aureus subsp. aureus MW2
caaaaaauuguauaa

SEQ ID NO: 2118820 - RNA, 19 nt, Staphylococcus aureus subsp. aureus MW2
caaaaaauuguaagucgaa

SEQ ID NO: 2118821 - RNA, 19 nt, Staphylococcus aureus subsp. aureus MW2
caaaaaaucgaacaaauga

SEQ ID NO: 2118822 - RNA, 11 nt, Staphylococcus aureus subsp. aureus MW2
caaaaaauauc

SEQ ID NO: 2118823 - RNA, 13 nt, Staphylococcus aureus subsp. aureus MW2
caaaaaauaauuu

SEQ ID NO: 2118824 - RNA, 23 nt, Staphylococcus aureus subsp. aureus MW2
auuuuuucguuaacucuaucuau

SEQ ID NO: 2118825 - RNA, 21 nt, Staphylococcus aureus subsp. aureus MW2
auuuuuucuauggcacaaaug

SEQ ID NO: 2118826 - RNA, 19 nt, Staphylococcus aureus subsp. aureus MW2
caaaaaaacaaaaaauaau

SEQ ID NO: 2118827 - RNA, 20 nt, Staphylococcus aureus subsp. aureus MW2
auuuuucuuauaaaaaucuu

SEQ ID NO: 2118828 - RNA, 16 nt, Staphylococcus aureus subsp. aureus MW2
auuuuucuuauaaaaa

SEQ ID NO: 2118829 - RNA, 14 nt, Staphylococcus aureus subsp. aureus MW2
auuuuucuuauaaa

SEQ ID NO: 2118830 - RNA, 17 nt, Staphylococcus aureus subsp. aureus MW2
auuuuugauaacuguaa

SEQ ID NO: 2118831 - RNA, 15 nt, Staphylococcus aureus subsp. aureus MW2
auuuuucuucuuuuu

SEQ ID NO: 2118832 - RNA, 20 nt, Staphylococcus aureus subsp. aureus MW2
auuuuucgucuucaauuaau

SEQ ID NO: 2118833 - RNA, 15 nt, Staphylococcus aureus subsp. aureus MW2
auuuuucuuuguguu

SEQ ID NO: 2118834 - RNA, 22 nt, Staphylococcus aureus subsp. aureus MW2
auuuuugaaaaaaauuuucauu

SEQ ID NO: 2118835 - RNA, 18 nt, Staphylococcus aureus subsp. aureus MW2
auuuuuuagacaaauguu

SEQ ID NO: 2118836 - RNA, 16 nt, Staphylococcus aureus subsp. aureus MW2
auuuucgggaauuuua

SEQ ID NO: 2118837 - RNA, 17 nt, Staphylococcus aureus subsp. aureus MW2
auuuucuauuauuuuac

SEQ ID NO: 2118838 - RNA, 15 nt, Staphylococcus aureus subsp. aureus MW2
auuuucgcaaaauuu

SEQ ID NO: 2118839 - RNA, 17 nt, Staphylococcus aureus subsp. aureus MW2
auuuuggcacauaaauc

SEQ ID NO: 2118840 - RNA, 15 nt, Staphylococcus aureus subsp. aureus MW2
auuuuggaacauauu

SEQ ID NO: 2118841 - RNA, 17 nt, Staphylococcus aureus subsp. aureus MW2
auuuugcuuuauuuucu

SEQ ID NO: 2118842 - RNA, 18 nt, Staphylococcus aureus subsp. aureus MW2
auuuugcuuuaaacauug

SEQ ID NO: 2118843 - RNA, 21 nt, Staphylococcus aureus subsp. aureus MW2
auuuugcuuuaaacauugacu

SEQ ID NO: 2118844 - RNA, 17 nt, Staphylococcus aureus subsp. aureus MW2
auuuugucuuuuauauu

SEQ ID NO: 2118845 - RNA, 19 nt, Staphylococcus aureus subsp. aureus MW2
auuuugucuuuuauauuuu

SEQ ID NO: 2118846 - RNA, 15 nt, Staphylococcus aureus subsp. aureus MW2
auuuugugaauuuau

SEQ ID NO: 2118847 - RNA, 14 nt, Staphylococcus aureus subsp. aureus MW2
auuuugugaauuua

SEQ ID NO: 2118848 - RNA, 16 nt, Staphylococcus aureus subsp. aureus MW2
auuuugggaauuguau

SEQ ID NO: 2118849 - RNA, 11 nt, Staphylococcus aureus subsp. aureus MW2
auuuuuaaaau

SEQ ID NO: 2118850 - RNA, 12 nt, Staphylococcus aureus subsp. aureus MW2
auuuuuaaaauu

SEQ ID NO: 2118851 - RNA, 15 nt, Staphylococcus aureus subsp. aureus MW2
auuuuguuuuaaaaa

SEQ ID NO: 2118852 - RNA, 21 nt, Staphylococcus aureus subsp. aureus MW2
auuuuuaaaaaccuagggaua

SEQ ID NO: 2118853 - RNA, 23 nt, Staphylococcus aureus subsp. aureus MW2
auuuuuaaaauuaugauuauuuu

SEQ ID NO: 2118854 - RNA, 19 nt, Staphylococcus aureus subsp. aureus MW2
auuuuuaaacaaaaauaag

SEQ ID NO: 2118855 - RNA, 15 nt, Staphylococcus aureus subsp. aureus MW2
auuuuuaaauuacua

SEQ ID NO: 2118856 - RNA, 14 nt, Staphylococcus aureus subsp. aureus MW2
auuuuguuucacua

SEQ ID NO: 2118857 - RNA, 18 nt, Staphylococcus aureus subsp. aureus MW2
auuuuguugaaacuguau

SEQ ID NO: 2118858 - RNA, 23 nt, Staphylococcus aureus subsp. aureus MW2
auuuuguugaaacuguaucaaca

SEQ ID NO: 2118859 - RNA, 24 nt, Staphylococcus aureus subsp. aureus MW2
auuuuguuaggagagauguauaaa

SEQ ID NO: 2118860 - RNA, 23 nt, Staphylococcus aureus subsp. aureus MW2
auuuuguuaauaagcgcaucccu

SEQ ID NO: 2118861 - RNA, 14 nt, Staphylococcus aureus subsp. aureus MW2
auuuuucaaauguu

SEQ ID NO: 2118862 - RNA, 17 nt, Staphylococcus aureus subsp. aureus MW2
auuuuuaaauuacuaua

SEQ ID NO: 2118863 - RNA, 23 nt, Staphylococcus aureus subsp. aureus MW2
auuuuuaagcugcucgauauaag

SEQ ID NO: 2118864 - RNA, 22 nt, Staphylococcus aureus subsp. aureus MW2
auuuuuccauaguggaauacuu

SEQ ID NO: 2118865 - RNA, 16 nt, Staphylococcus aureus subsp. aureus MW2
auuugauaaauaaaau

SEQ ID NO: 2118866 - RNA, 15 nt, Staphylococcus aureus subsp. aureus MW2
auuugauaaaaaaug

SEQ ID NO: 2118867 - RNA, 16 nt, Staphylococcus aureus subsp. aureus MW2
auuugauaaaaaauga

SEQ ID NO: 2118868 - RNA, 21 nt, Staphylococcus aureus subsp. aureus MW2
auuugaggauacauaaaucua

SEQ ID NO: 2118869 - RNA, 18 nt, Staphylococcus aureus subsp. aureus MW2
auuugaggauacauaaau

SEQ ID NO: 2118870 - RNA, 14 nt, Staphylococcus aureus subsp. aureus MW2
auuugaaguauuuu

SEQ ID NO: 2118871 - RNA, 19 nt, Staphylococcus aureus subsp. aureus MW2
auuugaaguauuuuccuuc

SEQ ID NO: 2118872 - RNA, 13 nt, Staphylococcus aureus subsp. aureus MW2
auuuguuuuaaau

SEQ ID NO: 2118873 - RNA, 18 nt, Staphylococcus aureus subsp. aureus MW2
auuuguuuauggauuuau

SEQ ID NO: 2118874 - RNA, 14 nt, Staphylococcus aureus subsp. aureus MW2
auuugauccauaua

SEQ ID NO: 2118875 - RNA, 12 nt, Staphylococcus aureus subsp. aureus MW2
auuugaucaacc

SEQ ID NO: 2118876 - RNA, 21 nt, Staphylococcus aureus subsp. aureus MW2
auuugaucaaccuguucuuua

SEQ ID NO: 2118877 - RNA, 16 nt, Staphylococcus aureus subsp. aureus MW2
auuuuaaaaauaaaaa

SEQ ID NO: 2118878 - RNA, 13 nt, Staphylococcus aureus subsp. aureus MW2
auuuuaaauuuaa

SEQ ID NO: 2118879 - RNA, 19 nt, Staphylococcus aureus subsp. aureus MW2
auuuuaaauuuaauuuuau

SEQ ID NO: 2118880 - RNA, 14 nt, Staphylococcus aureus subsp. aureus MW2
auuuuaacuuuaua

SEQ ID NO: 2118881 - RNA, 19 nt, Staphylococcus aureus subsp. aureus MW2
auuuuaacaaugaaccauc

SEQ ID NO: 2118882 - RNA, 19 nt, Staphylococcus aureus subsp. aureus MW2
auuuuaacaagugaugaaa

SEQ ID NO: 2118883 - RNA, 22 nt, Staphylococcus aureus subsp. aureus MW2
auuuuaacaagugaugaaaaag

SEQ ID NO: 2118884 - RNA, 17 nt, Staphylococcus aureus subsp. aureus MW2
auuuuaccuguuucuau

SEQ ID NO: 2118885 - RNA, 23 nt, Staphylococcus aureus subsp. aureus MW2
auuuuaccuguuucuauauuaau

SEQ ID NO: 2118886 - RNA, 18 nt, Staphylococcus aureus subsp. aureus MW2
auuuuacgcuuacuuaua

SEQ ID NO: 2118887 - RNA, 19 nt, Staphylococcus aureus subsp. aureus MW2
auuuuacgcuuacuuauau

SEQ ID NO: 2118888 - RNA, 16 nt, Staphylococcus aureus subsp. aureus MW2
auuuuacgcuuuuucu

SEQ ID NO: 2118889 - RNA, 14 nt, Staphylococcus aureus subsp. aureus MW2
auuuuaauauauuu

SEQ ID NO: 2118890 - RNA, 14 nt, Staphylococcus aureus subsp. aureus MW2
auuuuaauauuuuc

SEQ ID NO: 2118891 - RNA, 20 nt, Staphylococcus aureus subsp. aureus MW2
auuuuaaucauuguuuuaaa

SEQ ID NO: 2118892 - RNA, 22 nt, Staphylococcus aureus subsp. aureus MW2
auuuuaaucauuguuuuaaauu

SEQ ID NO: 2118893 - RNA, 17 nt, Staphylococcus aureus subsp. aureus MW2
auuuuaaugauuuuuca

SEQ ID NO: 2118894 - RNA, 20 nt, Staphylococcus aureus subsp. aureus MW2
auuuuaauaaauuagccauu

SEQ ID NO: 2118895 - RNA, 21 nt, Staphylococcus aureus subsp. aureus MW2
auuuuaauaaauuagccauuu

SEQ ID NO: 2118896 - RNA, 21 nt, Staphylococcus aureus subsp. aureus MW2
auuuuaauauugaaaugagcu

SEQ ID NO: 2118897 - RNA, 14 nt, Staphylococcus aureus subsp. aureus MW2
auuuuaauuuuuca

SEQ ID NO: 2118898 - RNA, 17 nt, Staphylococcus aureus subsp. aureus MW2
auuuuaauuuuucauua

SEQ ID NO: 2118899 - RNA, 18 nt, Staphylococcus aureus subsp. aureus MW2
auuuuacaaaaugaugaa

SEQ ID NO: 2118900 - RNA, 20 nt, Staphylococcus aureus subsp. aureus MW2
auuuuagcgucauuuuuaau

SEQ ID NO: 2118901 - RNA, 12 nt, Staphylococcus aureus subsp. aureus MW2
auuuuagauuga

SEQ ID NO: 2118902 - RNA, 21 nt, Staphylococcus aureus subsp. aureus MW2
auuuuagagccccuuacaacu

SEQ ID NO: 2118903 - RNA, 20 nt, Staphylococcus aureus subsp. aureus MW2
auuuuaguucacaugaauuu

SEQ ID NO: 2118904 - RNA, 15 nt, Staphylococcus aureus subsp. aureus MW2
auuuuaggcauuuua

SEQ ID NO: 2118905 - RNA, 19 nt, Staphylococcus aureus subsp. aureus MW2
auuuuaggcauuuuagauu

SEQ ID NO: 2118906 - RNA, 20 nt, Staphylococcus aureus subsp. aureus MW2
auuuuaucuaaagcuauaaa

SEQ ID NO: 2118907 - RNA, 22 nt, Staphylococcus aureus subsp. aureus MW2
auuuuaucuaaagcuauaaaaa

SEQ ID NO: 2118908 - RNA, 14 nt, Staphylococcus aureus subsp. aureus MW2
auuuuauauuuuag

SEQ ID NO: 2118909 - RNA, 14 nt, Staphylococcus aureus subsp. aureus MW2
auuuuaucaucuau

SEQ ID NO: 2118910 - RNA, 18 nt, Staphylococcus aureus subsp. aureus MW2
auuuuauauaaaaagaag

SEQ ID NO: 2118911 - RNA, 14 nt, Staphylococcus aureus subsp. aureus MW2
auuuuauauaaaaa

SEQ ID NO: 2118912 - RNA, 22 nt, Staphylococcus aureus subsp. aureus MW2
auuuuauaauaaccuacauuaa

SEQ ID NO: 2118913 - RNA, 14 nt, Staphylococcus aureus subsp. aureus MW2
auuuuauaagaauu

SEQ ID NO: 2118914 - RNA, 18 nt, Staphylococcus aureus subsp. aureus MW2
auuuuauaagaauuuaaa

SEQ ID NO: 2118915 - RNA, 19 nt, Staphylococcus aureus subsp. aureus MW2
auuuucaagaccaaauauu

SEQ ID NO: 2118916 - RNA, 13 nt, Staphylococcus aureus subsp. aureus MW2
auuuucaaagcug

SEQ ID NO: 2118917 - RNA, 18 nt, Staphylococcus aureus subsp. aureus MW2
auuuucaaagcugccaaa

SEQ ID NO: 2118918 - RNA, 11 nt, Staphylococcus aureus subsp. aureus MW2
auuuucaaaac

SEQ ID NO: 2118919 - RNA, 19 nt, Staphylococcus aureus subsp. aureus MW2
auuuuauuuuuuagcacau

SEQ ID NO: 2118920 - RNA, 20 nt, Staphylococcus aureus subsp. aureus MW2
auuuuauuuuuuagcacauc

SEQ ID NO: 2118921 - RNA, 14 nt, Staphylococcus aureus subsp. aureus MW2
auuuuauuuugugc

SEQ ID NO: 2118922 - RNA, 21 nt, Staphylococcus aureus subsp. aureus MW2
auuuucacaaucauagauaua

SEQ ID NO: 2118923 - RNA, 13 nt, Staphylococcus aureus subsp. aureus MW2
auuuucaauuaga

SEQ ID NO: 2118924 - RNA, 23 nt, Staphylococcus aureus subsp. aureus MW2
auuuucacaaucauagauauaag

SEQ ID NO: 2118925 - RNA, 18 nt, Staphylococcus aureus subsp. aureus MW2
auuuucaauaaauuuuau

SEQ ID NO: 2118926 - RNA, 16 nt, Staphylococcus aureus subsp. aureus MW2
auuuucaauaaauuuu

SEQ ID NO: 2118927 - RNA, 13 nt, Staphylococcus aureus subsp. aureus MW2
auuuucaauacuu

SEQ ID NO: 2118928 - RNA, 21 nt, Staphylococcus aureus subsp. aureus MW2
auuuucaauaaauuuuauaua

SEQ ID NO: 2118929 - RNA, 15 nt, Staphylococcus aureus subsp. aureus MW2
auuugaaauauacca

SEQ ID NO: 2118930 - RNA, 12 nt, Staphylococcus aureus subsp. aureus MW2
auuugaaauaau

SEQ ID NO: 2118931 - RNA, 22 nt, Staphylococcus aureus subsp. aureus MW2
auuugaaaauauuacuaacaac

SEQ ID NO: 2118932 - RNA, 16 nt, Staphylococcus aureus subsp. aureus MW2
auuugaacaucauuua

SEQ ID NO: 2118933 - RNA, 15 nt, Staphylococcus aureus subsp. aureus MW2
auuucuuuuuaaaau

SEQ ID NO: 2118934 - RNA, 13 nt, Staphylococcus aureus subsp. aureus MW2
auuucuuuuuuca

SEQ ID NO: 2118935 - RNA, 19 nt, Staphylococcus aureus subsp. aureus MW2
auuucuggcguacauauaa

SEQ ID NO: 2118936 - RNA, 20 nt, Staphylococcus aureus subsp. aureus MW2
auuucucguuucgucagauu

SEQ ID NO: 2118937 - RNA, 17 nt, Staphylococcus aureus subsp. aureus MW2
auuucugcaaaauguua

SEQ ID NO: 2118938 - RNA, 13 nt, Staphylococcus aureus subsp. aureus MW2
auuucuaaauuau

SEQ ID NO: 2118939 - RNA, 18 nt, Staphylococcus aureus subsp. aureus MW2
auuucuaaaccauuuuca

SEQ ID NO: 2118940 - RNA, 20 nt, Staphylococcus aureus subsp. aureus MW2
auuucguuuuauuaaugaag

SEQ ID NO: 2118941 - RNA, 22 nt, Staphylococcus aureus subsp. aureus MW2
auuucaguaggacacauaaaug

SEQ ID NO: 2118942 - RNA, 18 nt, Staphylococcus aureus subsp. aureus MW2
auuucaguauauuuuaac

SEQ ID NO: 2118943 - RNA, 20 nt, Staphylococcus aureus subsp. aureus MW2
auuucaggcguuaauacaua

SEQ ID NO: 2118944 - RNA, 19 nt, Staphylococcus aureus subsp. aureus MW2
auuucagcuuauuaagcuu

SEQ ID NO: 2118945 - RNA, 14 nt, Staphylococcus aureus subsp. aureus MW2
auuucaauuuggaa

SEQ ID NO: 2118946 - RNA, 15 nt, Staphylococcus aureus subsp. aureus MW2
auuucagcgauaacg

SEQ ID NO: 2118947 - RNA, 15 nt, Staphylococcus aureus subsp. aureus MW2
auuucggacaauaac

SEQ ID NO: 2118948 - RNA, 20 nt, Staphylococcus aureus subsp. aureus MW2
auuucggggacguucaugga

SEQ ID NO: 2118949 - RNA, 17 nt, Staphylococcus aureus subsp. aureus MW2
auuucccuggaaaauga

SEQ ID NO: 2118950 - RNA, 23 nt, Staphylococcus aureus subsp. aureus MW2
auuuccgaauaaaggucuauaua

SEQ ID NO: 2118951 - RNA, 23 nt, Staphylococcus aureus subsp. aureus MW2
aaaagugcaaguccaaauaauau

SEQ ID NO: 2118952 - RNA, 20 nt, Staphylococcus aureus subsp. aureus MW2
aaaagugaauaauugagaaa

SEQ ID NO: 2118953 - RNA, 19 nt, Staphylococcus aureus subsp. aureus MW2
aaaagugccagguucaaua

SEQ ID NO: 2118954 - RNA, 17 nt, Staphylococcus aureus subsp. aureus MW2
auuuauguguuggcuuu

SEQ ID NO: 2118955 - RNA, 17 nt, Staphylococcus aureus subsp. aureus MW2
auuuaucuuuuaaaauc

SEQ ID NO: 2118956 - RNA, 21 nt, Staphylococcus aureus subsp. aureus MW2
auuuaucuuuagagacuuauu

SEQ ID NO: 2118957 - RNA, 16 nt, Staphylococcus aureus subsp. aureus MW2
auuuauuguuuuuaaa

SEQ ID NO: 2118958 - RNA, 15 nt, Staphylococcus aureus subsp. aureus MW2
auuuauuaacucaug

SEQ ID NO: 2118959 - RNA, 14 nt, Staphylococcus aureus subsp. aureus MW2
auuuauuauaaaau

SEQ ID NO: 2118960 - RNA, 22 nt, Staphylococcus aureus subsp. aureus MW2
auuuauuaguugugguuguuaa

SEQ ID NO: 2118961 - RNA, 14 nt, Staphylococcus aureus subsp. aureus MW2
auuuauuaguuuuu

SEQ ID NO: 2118962 - RNA, 14 nt, Staphylococcus aureus subsp. aureus MW2
auuuauuauuacca

SEQ ID NO: 2118963 - RNA, 15 nt, Staphylococcus aureus subsp. aureus MW2
auuuauuauaaaaua

SEQ ID NO: 2118964 - RNA, 17 nt, Staphylococcus aureus subsp. aureus MW2
auuucaauuuggaaaua

SEQ ID NO: 2118965 - RNA, 18 nt, Staphylococcus aureus subsp. aureus MW2
auuucaauugcacuuacu

SEQ ID NO: 2118966 - RNA, 13 nt, Staphylococcus aureus subsp. aureus MW2
auuucaauugcau

SEQ ID NO: 2118967 - RNA, 20 nt, Staphylococcus aureus subsp. aureus MW2
auuucaaugagaagcugucu

SEQ ID NO: 2118968 - RNA, 16 nt, Staphylococcus aureus subsp. aureus MW2
auuucaauccuuuguu

SEQ ID NO: 2118969 - RNA, 16 nt, Staphylococcus aureus subsp. aureus MW2
auuucaaauauaaaaa

SEQ ID NO: 2118970 - RNA, 14 nt, Staphylococcus aureus subsp. aureus MW2
auuucaaaaaggaa

SEQ ID NO: 2118971 - RNA, 15 nt, Staphylococcus aureus subsp. aureus MW2
auuucaaaaaggaau

SEQ ID NO: 2118972 - RNA, 15 nt, Staphylococcus aureus subsp. aureus MW2
auuuauuuucuuugg

SEQ ID NO: 2118973 - RNA, 18 nt, Staphylococcus aureus subsp. aureus MW2
auuuauuuucaauaaaua

SEQ ID NO: 2118974 - RNA, 18 nt, Staphylococcus aureus subsp. aureus MW2
auuuauuucauauuuaau

SEQ ID NO: 2118975 - RNA, 17 nt, Staphylococcus aureus subsp. aureus MW2
auuuauuguuuuuaaaa

SEQ ID NO: 2118976 - RNA, 23 nt, Staphylococcus aureus subsp. aureus MW2
auuuauuucuuuuugucauuaau

SEQ ID NO: 2118977 - RNA, 17 nt, Staphylococcus aureus subsp. aureus MW2
auuuauuuuugauagug

SEQ ID NO: 2118978 - RNA, 16 nt, Staphylococcus aureus subsp. aureus MW2
auuuauuuucuuuggu

SEQ ID NO: 2118979 - RNA, 13 nt, Staphylococcus aureus subsp. aureus MW2
auuuauuuuuaau

SEQ ID NO: 2118980 - RNA, 16 nt, Staphylococcus aureus subsp. aureus MW2
auuuauccugaccaag

SEQ ID NO: 2118981 - RNA, 19 nt, Staphylococcus aureus subsp. aureus MW2
auuuaucgagaacaucauc

SEQ ID NO: 2118982 - RNA, 17 nt, Staphylococcus aureus subsp. aureus MW2
auuuaucaccuuuaggc

SEQ ID NO: 2118983 - RNA, 16 nt, Staphylococcus aureus subsp. aureus MW2
auuuaucauacuucaa

SEQ ID NO: 2118984 - RNA, 17 nt, Staphylococcus aureus subsp. aureus MW2
auuuaucaauuucuauu

SEQ ID NO: 2118985 - RNA, 15 nt, Staphylococcus aureus subsp. aureus MW2
auuuauauuccauuu

SEQ ID NO: 2118986 - RNA, 20 nt, Staphylococcus aureus subsp. aureus MW2
auuuauauuccauuucaaau

SEQ ID NO: 2118987 - RNA, 21 nt, Staphylococcus aureus subsp. aureus MW2
auuuauauuccauuucaaaug

SEQ ID NO: 2118988 - RNA, 15 nt, Staphylococcus aureus subsp. aureus MW2
aaaagucaaagagga

SEQ ID NO: 2118989 - RNA, 23 nt, Staphylococcus aureus subsp. aureus MW2
aaaaguauugccguuauuuucaa

SEQ ID NO: 2118990 - RNA, 19 nt, Staphylococcus aureus subsp. aureus MW2
aaaagucccgcuuaaaaug

SEQ ID NO: 2118991 - RNA, 17 nt, Staphylococcus aureus subsp. aureus MW2
auuuauaugauguucaa

SEQ ID NO: 2118992 - RNA, 16 nt, Staphylococcus aureus subsp. aureus MW2
auuuauauuaaauaaa

SEQ ID NO: 2118993 - RNA, 19 nt, Staphylococcus aureus subsp. aureus MW2
auuuauauagucuaugaau

SEQ ID NO: 2118994 - RNA, 17 nt, Staphylococcus aureus subsp. aureus MW2
auuuauauauagaaaua

SEQ ID NO: 2118995 - RNA, 14 nt, Staphylococcus aureus subsp. aureus MW2
auuuauagcaucaa

SEQ ID NO: 2118996 - RNA, 15 nt, Staphylococcus aureus subsp. aureus MW2
auuuauacuauaaau

SEQ ID NO: 2118997 - RNA, 14 nt, Staphylococcus aureus subsp. aureus MW2
auuuauacuauaaa

SEQ ID NO: 2118998 - RNA, 16 nt, Staphylococcus aureus subsp. aureus MW2
auuuauaaugauuaaa

SEQ ID NO: 2118999 - RNA, 23 nt, Staphylococcus aureus subsp. aureus MW2
auuuaauaucacgaucuuuaaag

SEQ ID NO: 2119000 - RNA, 19 nt, Staphylococcus aureus subsp. aureus MW2
auuuaauauugaauaaaaa

SEQ ID NO: 2119001 - RNA, 13 nt, Staphylococcus aureus subsp. aureus MW2
auuuauaacuuag

SEQ ID NO: 2119002 - RNA, 13 nt, Staphylococcus aureus subsp. aureus MW2
auuuaauagacau

SEQ ID NO: 2119003 - RNA, 16 nt, Staphylococcus aureus subsp. aureus MW2
auuuaauagacauuaa

SEQ ID NO: 2119004 - RNA, 15 nt, Staphylococcus aureus subsp. aureus MW2
auuuaauaaguuaau

SEQ ID NO: 2119005 - RNA, 12 nt, Staphylococcus aureus subsp. aureus MW2
auuuaauaaugu

SEQ ID NO: 2119006 - RNA, 13 nt, Staphylococcus aureus subsp. aureus MW2
auuuaauaacgaa

SEQ ID NO: 2119007 - RNA, 20 nt, Staphylococcus aureus subsp. aureus MW2
auuuaauaaacaccaauauu

SEQ ID NO: 2119008 - RNA, 15 nt, Staphylococcus aureus subsp. aureus MW2
auuuaaccuuuaaaa

SEQ ID NO: 2119009 - RNA, 19 nt, Staphylococcus aureus subsp. aureus MW2
cagcuaaaaguuucccaag

SEQ ID NO: 2119010 - RNA, 23 nt, Staphylococcus aureus subsp. aureus MW2
aaaauugaaggaaaauaaaaacc

SEQ ID NO: 2119011 - RNA, 17 nt, Staphylococcus aureus subsp. aureus MW2
cagcuuuaauaauauga

SEQ ID NO: 2119012 - RNA, 14 nt, Staphylococcus aureus subsp. aureus MW2
cagcuuuaauaaua

SEQ ID NO: 2119013 - RNA, 17 nt, Staphylococcus aureus subsp. aureus MW2
caggaauguuuguauuc

SEQ ID NO: 2119014 - RNA, 24 nt, Staphylococcus aureus subsp. aureus MW2
aaaauuuccacuuugaucuuuaaa

SEQ ID NO: 2119015 - RNA, 14 nt, Staphylococcus aureus subsp. aureus MW2
caggaauuguuaaa

SEQ ID NO: 2119016 - RNA, 18 nt, Staphylococcus aureus subsp. aureus MW2
caggaucacguuuuucuu

SEQ ID NO: 2119017 - RNA, 13 nt, Staphylococcus aureus subsp. aureus MW2
caggcaaugcaag

SEQ ID NO: 2119018 - RNA, 14 nt, Staphylococcus aureus subsp. aureus MW2
caggcaaugcaagu

SEQ ID NO: 2119019 - RNA, 18 nt, Staphylococcus aureus subsp. aureus MW2
caggcaaugcgaguuggg

SEQ ID NO: 2119020 - RNA, 21 nt, Staphylococcus aureus subsp. aureus MW2
aaacaaaaaauaucuuuuugu

SEQ ID NO: 2119021 - RNA, 17 nt, Staphylococcus aureus subsp. aureus MW2
aaacaaaaaauaucuuu

SEQ ID NO: 2119022 - RNA, 13 nt, Staphylococcus aureus subsp. aureus MW2
aaacaaaaaauaa

SEQ ID NO: 2119023 - RNA, 14 nt, Staphylococcus aureus subsp. aureus MW2
aaacaaaaaauaau

SEQ ID NO: 2119024 - RNA, 13 nt, Staphylococcus aureus subsp. aureus MW2
aaacaaaaaauau

SEQ ID NO: 2119025 - RNA, 19 nt, Staphylococcus aureus subsp. aureus MW2
aaacaaaacuuaaaauauu

SEQ ID NO: 2119026 - RNA, 14 nt, Staphylococcus aureus subsp. aureus MW2
cagcgacauuuuua

SEQ ID NO: 2119027 - RNA, 20 nt, Staphylococcus aureus subsp. aureus MW2
cagcgauaacguacaaugua

SEQ ID NO: 2119028 - RNA, 16 nt, Staphylococcus aureus subsp. aureus MW2
cagcgauuaaaugaug

SEQ ID NO: 2119029 - RNA, 17 nt, Staphylococcus aureus subsp. aureus MW2
aaaauuaaaaaacaaaa

SEQ ID NO: 2119030 - RNA, 17 nt, Staphylococcus aureus subsp. aureus MW2
aaaauguuuaacaauaa

SEQ ID NO: 2119031 - RNA, 13 nt, Staphylococcus aureus subsp. aureus MW2
aaaauuaaaaaau

SEQ ID NO: 2119032 - RNA, 14 nt, Staphylococcus aureus subsp. aureus MW2
aaaauuaaaacagc

SEQ ID NO: 2119033 - RNA, 14 nt, Staphylococcus aureus subsp. aureus MW2
aaaauguuuaacaa

SEQ ID NO: 2119034 - RNA, 13 nt, Staphylococcus aureus subsp. aureus MW2
aaaauuaaaaucu

SEQ ID NO: 2119035 - RNA, 22 nt, Staphylococcus aureus subsp. aureus MW2
aaaauuaaaacagcaaauaaaa

SEQ ID NO: 2119036 - RNA, 15 nt, Staphylococcus aureus subsp. aureus MW2
aaaauuaacuuaaaa

SEQ ID NO: 2119037 - RNA, 15 nt, Staphylococcus aureus subsp. aureus MW2
aaaauuaagaugaaa

SEQ ID NO: 2119038 - RNA, 17 nt, Staphylococcus aureus subsp. aureus MW2
aaaauuaauguuuucag

SEQ ID NO: 2119039 - RNA, 12 nt, Staphylococcus aureus subsp. aureus MW2
aaaauuaauaau

SEQ ID NO: 2119040 - RNA, 12 nt, Staphylococcus aureus subsp. aureus MW2
aaaauuaucaau

SEQ ID NO: 2119041 - RNA, 13 nt, Staphylococcus aureus subsp. aureus MW2
aaaauuauaugga

SEQ ID NO: 2119042 - RNA, 14 nt, Staphylococcus aureus subsp. aureus MW2
aaaauucaccaacu

SEQ ID NO: 2119043 - RNA, 15 nt, Staphylococcus aureus subsp. aureus MW2
aaaauuauguaaaaa

SEQ ID NO: 2119044 - RNA, 21 nt, Staphylococcus aureus subsp. aureus MW2
aaaauuacgcaaagaaaaaca

SEQ ID NO: 2119045 - RNA, 19 nt, Staphylococcus aureus subsp. aureus MW2
aaaauucuaacugcaaaac

SEQ ID NO: 2119046 - RNA, 21 nt, Staphylococcus aureus subsp. aureus MW2
aaaauuccuagcuuuuauguc

SEQ ID NO: 2119047 - RNA, 18 nt, Staphylococcus aureus subsp. aureus MW2
cagcguuaucuuuaagua

SEQ ID NO: 2119048 - RNA, 14 nt, Staphylococcus aureus subsp. aureus MW2
cacugccuuuuugu

SEQ ID NO: 2119049 - RNA, 23 nt, Staphylococcus aureus subsp. aureus MW2
cacugcuaaaauuguauuauuau

SEQ ID NO: 2119050 - RNA, 14 nt, Staphylococcus aureus subsp. aureus MW2
cacugcuuuuaaau

SEQ ID NO: 2119051 - RNA, 15 nt, Staphylococcus aureus subsp. aureus MW2
cacugacaugauaaa

SEQ ID NO: 2119052 - RNA, 20 nt, Staphylococcus aureus subsp. aureus MW2
cacuccuuaaacaaauaaau

SEQ ID NO: 2119053 - RNA, 22 nt, Staphylococcus aureus subsp. aureus MW2
cacuccuuaaacaaauaaaugu

SEQ ID NO: 2119054 - RNA, 18 nt, Staphylococcus aureus subsp. aureus MW2
cacuccuuaaacaaauaa

SEQ ID NO: 2119055 - RNA, 14 nt, Staphylococcus aureus subsp. aureus MW2
cacuccucuauuuu

SEQ ID NO: 2119056 - RNA, 19 nt, Staphylococcus aureus subsp. aureus MW2
cacuaaaugugacuuuaaa

SEQ ID NO: 2119057 - RNA, 22 nt, Staphylococcus aureus subsp. aureus MW2
cacuacagugcaugaugaacuu

SEQ ID NO: 2119058 - RNA, 20 nt, Staphylococcus aureus subsp. aureus MW2
cacguucuugguauuuuuua

SEQ ID NO: 2119059 - RNA, 18 nt, Staphylococcus aureus subsp. aureus MW2
cacguguauuguauuuua

SEQ ID NO: 2119060 - RNA, 15 nt, Staphylococcus aureus subsp. aureus MW2
cacuaucuuuugcuu

SEQ ID NO: 2119061 - RNA, 13 nt, Staphylococcus aureus subsp. aureus MW2
cacuauaauuucu

SEQ ID NO: 2119062 - RNA, 15 nt, Staphylococcus aureus subsp. aureus MW2
cacuauaaaauucac

SEQ ID NO: 2119063 - RNA, 13 nt, Staphylococcus aureus subsp. aureus MW2
cacuaucauuauc

SEQ ID NO: 2119064 - RNA, 16 nt, Staphylococcus aureus subsp. aureus MW2
cacuauauccuuuuug

SEQ ID NO: 2119065 - RNA, 15 nt, Staphylococcus aureus subsp. aureus MW2
cacuagcgucagcaa

SEQ ID NO: 2119066 - RNA, 16 nt, Staphylococcus aureus subsp. aureus MW2
cacuagguacauaaau

SEQ ID NO: 2119067 - RNA, 20 nt, Staphylococcus aureus subsp. aureus MW2
cacuaguguauacaaggcau

SEQ ID NO: 2119068 - RNA, 18 nt, Staphylococcus aureus subsp. aureus MW2
cacuagauaguuuauacu

SEQ ID NO: 2119069 - RNA, 14 nt, Staphylococcus aureus subsp. aureus MW2
cacuagcaacaucu

SEQ ID NO: 2119070 - RNA, 18 nt, Staphylococcus aureus subsp. aureus MW2
cacuagcaacaucuuuug

SEQ ID NO: 2119071 - RNA, 17 nt, Staphylococcus aureus subsp. aureus MW2
cacucaauucucuaacu

SEQ ID NO: 2119072 - RNA, 20 nt, Staphylococcus aureus subsp. aureus MW2
cacucacuucaacgucaucu

SEQ ID NO: 2119073 - RNA, 19 nt, Staphylococcus aureus subsp. aureus MW2
cacucauaaucaagucugc

SEQ ID NO: 2119074 - RNA, 18 nt, Staphylococcus aureus subsp. aureus MW2
cacucauaaccgcuucuu

SEQ ID NO: 2119075 - RNA, 12 nt, Staphylococcus aureus subsp. aureus MW2
cacucauaaccg

SEQ ID NO: 2119076 - RNA, 18 nt, Staphylococcus aureus subsp. aureus MW2
cacuguuuuauaaaugaa

SEQ ID NO: 2119077 - RNA, 16 nt, Staphylococcus aureus subsp. aureus MW2
cacuuaagcuuuaauc

SEQ ID NO: 2119078 - RNA, 15 nt, Staphylococcus aureus subsp. aureus MW2
cacuguuaaagaugu

SEQ ID NO: 2119079 - RNA, 22 nt, Staphylococcus aureus subsp. aureus MW2
cacuguuaaagauguugaaaag

SEQ ID NO: 2119080 - RNA, 14 nt, Staphylococcus aureus subsp. aureus MW2
cacuucaaaagaaa

SEQ ID NO: 2119081 - RNA, 12 nt, Staphylococcus aureus subsp. aureus MW2
cacuuauuauuu

SEQ ID NO: 2119082 - RNA, 22 nt, Staphylococcus aureus subsp. aureus MW2
cacuuaauaucaguagcauauu

SEQ ID NO: 2119083 - RNA, 16 nt, Staphylococcus aureus subsp. aureus MW2
cacuuaauauaaggaa

SEQ ID NO: 2119084 - RNA, 23 nt, Staphylococcus aureus subsp. aureus MW2
cacuuaaucguucccauucuuug

SEQ ID NO: 2119085 - RNA, 21 nt, Staphylococcus aureus subsp. aureus MW2
cacuuacugugaaaauaccaa

SEQ ID NO: 2119086 - RNA, 18 nt, Staphylococcus aureus subsp. aureus MW2
cacuuggauucaaaugac

SEQ ID NO: 2119087 - RNA, 17 nt, Staphylococcus aureus subsp. aureus MW2
cacuuggauucaaauga

SEQ ID NO: 2119088 - RNA, 20 nt, Staphylococcus aureus subsp. aureus MW2
cacuugaauacuuuuuaacu

SEQ ID NO: 2119089 - RNA, 19 nt, Staphylococcus aureus subsp. aureus MW2
cacuucugaaaauaaccau

SEQ ID NO: 2119090 - RNA, 11 nt, Staphylococcus aureus subsp. aureus MW2
cacuucauaaa

SEQ ID NO: 2119091 - RNA, 17 nt, Staphylococcus aureus subsp. aureus MW2
cacuucaguuaaaccuu

SEQ ID NO: 2119092 - RNA, 20 nt, Staphylococcus aureus subsp. aureus MW2
cacuucaguuaaaccuucua

SEQ ID NO: 2119093 - RNA, 16 nt, Staphylococcus aureus subsp. aureus MW2
cacuucaguuaaaccu

SEQ ID NO: 2119094 - RNA, 17 nt, Staphylococcus aureus subsp. aureus MW2
cacuuccaucaauccaa

SEQ ID NO: 2119095 - RNA, 23 nt, Staphylococcus aureus subsp. aureus MW2
cacuucgccaagccaucuuucuu

SEQ ID NO: 2119096 - RNA, 14 nt, Staphylococcus aureus subsp. aureus MW2
cacuucgccaagcc

SEQ ID NO: 2119097 - RNA, 14 nt, Staphylococcus aureus subsp. aureus MW2
aaaauauuuaaaua

SEQ ID NO: 2119098 - RNA, 22 nt, Staphylococcus aureus subsp. aureus MW2
aaaauauuuaaauagaagaaaa

SEQ ID NO: 2119099 - RNA, 18 nt, Staphylococcus aureus subsp. aureus MW2
cacuuugaucuuuaaaua

SEQ ID NO: 2119100 - RNA, 20 nt, Staphylococcus aureus subsp. aureus MW2
aaaauaugauugcaaauuau

SEQ ID NO: 2119101 - RNA, 17 nt, Staphylococcus aureus subsp. aureus MW2
aaaauaugauuuaaaau

SEQ ID NO: 2119102 - RNA, 17 nt, Staphylococcus aureus subsp. aureus MW2
aaaauaucugaaaaacc

SEQ ID NO: 2119103 - RNA, 20 nt, Staphylococcus aureus subsp. aureus MW2
aaaauauguguuaacugaua

SEQ ID NO: 2119104 - RNA, 24 nt, Staphylococcus aureus subsp. aureus MW2
aaaauauuaggugaaaccauacua

SEQ ID NO: 2119105 - RNA, 23 nt, Staphylococcus aureus subsp. aureus MW2
cacuuuaaacaagcaucaugaaa

SEQ ID NO: 2119106 - RNA, 16 nt, Staphylococcus aureus subsp. aureus MW2
cacuuuaggguucauu

SEQ ID NO: 2119107 - RNA, 23 nt, Staphylococcus aureus subsp. aureus MW2
aaaauaucacuaauauauuuaga

SEQ ID NO: 2119108 - RNA, 22 nt, Staphylococcus aureus subsp. aureus MW2
cagaaaagcagucgaacaauga

SEQ ID NO: 2119109 - RNA, 13 nt, Staphylococcus aureus subsp. aureus MW2
cagaacuaaugua

SEQ ID NO: 2119110 - RNA, 21 nt, Staphylococcus aureus subsp. aureus MW2
cagaacuacaauucauaagaa

SEQ ID NO: 2119111 - RNA, 23 nt, Staphylococcus aureus subsp. aureus MW2
cagacgaaacacacuaaaagcug

SEQ ID NO: 2119112 - RNA, 14 nt, Staphylococcus aureus subsp. aureus MW2
cagacgaaucaaag

SEQ ID NO: 2119113 - RNA, 20 nt, Staphylococcus aureus subsp. aureus MW2
cagaaugaacuucucuuagu

SEQ ID NO: 2119114 - RNA, 16 nt, Staphylococcus aureus subsp. aureus MW2
cagauaauuauuucua

SEQ ID NO: 2119115 - RNA, 23 nt, Staphylococcus aureus subsp. aureus MW2
cagauagaaugucgauauuucua

SEQ ID NO: 2119116 - RNA, 22 nt, Staphylococcus aureus subsp. aureus MW2
aaaaucgaacaaaugaaaaagu

SEQ ID NO: 2119117 - RNA, 21 nt, Staphylococcus aureus subsp. aureus MW2
aaaauccuaugaauaaauugu

SEQ ID NO: 2119118 - RNA, 21 nt, Staphylococcus aureus subsp. aureus MW2
aaaauccucacaaauuugaau

SEQ ID NO: 2119119 - RNA, 15 nt, Staphylococcus aureus subsp. aureus MW2
aaaauccugaaauua

SEQ ID NO: 2119120 - RNA, 22 nt, Staphylococcus aureus subsp. aureus MW2
aaaauguaggcgccauaaucau

SEQ ID NO: 2119121 - RNA, 13 nt, Staphylococcus aureus subsp. aureus MW2
aaaauguaaucac

SEQ ID NO: 2119122 - RNA, 20 nt, Staphylococcus aureus subsp. aureus MW2
aaaaugucauuugaauccaa

SEQ ID NO: 2119123 - RNA, 16 nt, Staphylococcus aureus subsp. aureus MW2
aaaaugucuaaaaaaa

SEQ ID NO: 2119124 - RNA, 17 nt, Staphylococcus aureus subsp. aureus MW2
aaaaugucuaaaaaaau

SEQ ID NO: 2119125 - RNA, 22 nt, Staphylococcus aureus subsp. aureus MW2
aaaauguauuaaauaugcacuu

SEQ ID NO: 2119126 - RNA, 15 nt, Staphylococcus aureus subsp. aureus MW2
aaaaugucauuugaa

SEQ ID NO: 2119127 - RNA, 18 nt, Staphylococcus aureus subsp. aureus MW2
aaaauggcgaaaaagcua

SEQ ID NO: 2119128 - RNA, 23 nt, Staphylococcus aureus subsp. aureus MW2
aaaauggugauccgccuugauuu

SEQ ID NO: 2119129 - RNA, 19 nt, Staphylococcus aureus subsp. aureus MW2
aaaauguuacacaaauuaa

SEQ ID NO: 2119130 - RNA, 17 nt, Staphylococcus aureus subsp. aureus MW2
aaaaugucuuugaaaaa

SEQ ID NO: 2119131 - RNA, 14 nt, Staphylococcus aureus subsp. aureus MW2
cagcacauuuuuag

SEQ ID NO: 2119132 - RNA, 19 nt, Staphylococcus aureus subsp. aureus MW2
aaaaucggauuaacauuau

SEQ ID NO: 2119133 - RNA, 20 nt, Staphylococcus aureus subsp. aureus MW2
aaaaucggacagcugaaaaa

SEQ ID NO: 2119134 - RNA, 23 nt, Staphylococcus aureus subsp. aureus MW2
aaaaucucauaauaauucaguaa

SEQ ID NO: 2119135 - RNA, 23 nt, Staphylococcus aureus subsp. aureus MW2
aaaaucuguuucuuguucuaaaa

SEQ ID NO: 2119136 - RNA, 22 nt, Staphylococcus aureus subsp. aureus MW2
cagauucauaucuuucaauuaa

SEQ ID NO: 2119137 - RNA, 15 nt, Staphylococcus aureus subsp. aureus MW2
cagauucuucaccaa

SEQ ID NO: 2119138 - RNA, 14 nt, Staphylococcus aureus subsp. aureus MW2
cagauugauauaaa

SEQ ID NO: 2119139 - RNA, 23 nt, Staphylococcus aureus subsp. aureus MW2
aaaaugauguaacguuucuuugu

SEQ ID NO: 2119140 - RNA, 14 nt, Staphylococcus aureus subsp. aureus MW2
aaaaugauuauucu

SEQ ID NO: 2119141 - RNA, 13 nt, Staphylococcus aureus subsp. aureus MW2
aaaaugauaucug

SEQ ID NO: 2119142 - RNA, 14 nt, Staphylococcus aureus subsp. aureus MW2
aaaaugaguacaac

SEQ ID NO: 2119143 - RNA, 20 nt, Staphylococcus aureus subsp. aureus MW2
cagcaaaugcuuaagaaauu

SEQ ID NO: 2119144 - RNA, 13 nt, Staphylococcus aureus subsp. aureus MW2
aaaaugcacugag

SEQ ID NO: 2119145 - RNA, 19 nt, Staphylococcus aureus subsp. aureus MW2
aaaaugccgagauuauuau

SEQ ID NO: 2119146 - RNA, 23 nt, Staphylococcus aureus subsp. aureus MW2
aaaaugcgcuuccaauuuaaaau

SEQ ID NO: 2119147 - RNA, 20 nt, Staphylococcus aureus subsp. aureus MW2
cagcaagagauagguuuugu

SEQ ID NO: 2119148 - RNA, 16 nt, Staphylococcus aureus subsp. aureus MW2
cagugcuauguauuuu

SEQ ID NO: 2119149 - RNA, 22 nt, Staphylococcus aureus subsp. aureus MW2
cagugcuaauuuugagacaaaa

SEQ ID NO: 2119150 - RNA, 23 nt, Staphylococcus aureus subsp. aureus MW2
cagugcuauguauuuuucuuaau

SEQ ID NO: 2119151 - RNA, 22 nt, Staphylococcus aureus subsp. aureus MW2
cagugggcgguuauuaacaaaa

SEQ ID NO: 2119152 - RNA, 16 nt, Staphylococcus aureus subsp. aureus MW2
cagguauguucaucag

SEQ ID NO: 2119153 - RNA, 15 nt, Staphylococcus aureus subsp. aureus MW2
cagugccuugcugga

SEQ ID NO: 2119154 - RNA, 14 nt, Staphylococcus aureus subsp. aureus MW2
caguuaauuauuua

SEQ ID NO: 2119155 - RNA, 21 nt, Staphylococcus aureus subsp. aureus MW2
caguuaauuauuuagauucuu

SEQ ID NO: 2119156 - RNA, 12 nt, Staphylococcus aureus subsp. aureus MW2
caguuaauaauu

SEQ ID NO: 2119157 - RNA, 14 nt, Staphylococcus aureus subsp. aureus MW2
caguuaauaauuuu

SEQ ID NO: 2119158 - RNA, 18 nt, Staphylococcus aureus subsp. aureus MW2
caguguuugacugaauga

SEQ ID NO: 2119159 - RNA, 18 nt, Staphylococcus aureus subsp. aureus MW2
caguguuauauuggcggg

SEQ ID NO: 2119160 - RNA, 19 nt, Staphylococcus aureus subsp. aureus MW2
caguguuauauuggcgggc

SEQ ID NO: 2119161 - RNA, 23 nt, Staphylococcus aureus subsp. aureus MW2
caguguguaucucuuauuuuaaa

SEQ ID NO: 2119162 - RNA, 18 nt, Staphylococcus aureus subsp. aureus MW2
caguuagaaacagaauua

SEQ ID NO: 2119163 - RNA, 21 nt, Staphylococcus aureus subsp. aureus MW2
caguugcacaaauugcaaugg

SEQ ID NO: 2119164 - RNA, 23 nt, Staphylococcus aureus subsp. aureus MW2
caguuguguaauaaagcaguguu

SEQ ID NO: 2119165 - RNA, 18 nt, Staphylococcus aureus subsp. aureus MW2
caguuguuuuuuugucag

SEQ ID NO: 2119166 - RNA, 22 nt, Staphylococcus aureus subsp. aureus MW2
caguuuaauucguuucacuacu

SEQ ID NO: 2119167 - RNA, 14 nt, Staphylococcus aureus subsp. aureus MW2
caguuucaucuuca

SEQ ID NO: 2119168 - RNA, 21 nt, Staphylococcus aureus subsp. aureus MW2
caguuucaucuucaacuuucu

SEQ ID NO: 2119169 - RNA, 17 nt, Staphylococcus aureus subsp. aureus MW2
caguuuccauaaauaaa

SEQ ID NO: 2119170 - RNA, 17 nt, Staphylococcus aureus subsp. aureus MW2
caguuuuuauauuaaga

SEQ ID NO: 2119171 - RNA, 14 nt, Staphylococcus aureus subsp. aureus MW2
cauaaaaaaagaac

SEQ ID NO: 2119172 - RNA, 18 nt, Staphylococcus aureus subsp. aureus MW2
caguuuuaauuaaacugu

SEQ ID NO: 2119173 - RNA, 20 nt, Staphylococcus aureus subsp. aureus MW2
caguuugauuaaaauccgcu

SEQ ID NO: 2119174 - RNA, 16 nt, Staphylococcus aureus subsp. aureus MW2
cauaccggcaaauaac

SEQ ID NO: 2119175 - RNA, 15 nt, Staphylococcus aureus subsp. aureus MW2
cauacccauauuaaa

SEQ ID NO: 2119176 - RNA, 17 nt, Staphylococcus aureus subsp. aureus MW2
cauacccauauuaaauu

SEQ ID NO: 2119177 - RNA, 21 nt, Staphylococcus aureus subsp. aureus MW2
cauaccaguggaaauuaugua

SEQ ID NO: 2119178 - RNA, 20 nt, Staphylococcus aureus subsp. aureus MW2
cauaccuaauaacgcauaua

SEQ ID NO: 2119179 - RNA, 19 nt, Staphylococcus aureus subsp. aureus MW2
cauacacaaugccuuuaaa

SEQ ID NO: 2119180 - RNA, 14 nt, Staphylococcus aureus subsp. aureus MW2
cauaauuuaucugc

SEQ ID NO: 2119181 - RNA, 18 nt, Staphylococcus aureus subsp. aureus MW2
cauacaaauuuuuuuuau

SEQ ID NO: 2119182 - RNA, 15 nt, Staphylococcus aureus subsp. aureus MW2
cauacauauuuauau

SEQ ID NO: 2119183 - RNA, 12 nt, Staphylococcus aureus subsp. aureus MW2
cauaaucuuuau

SEQ ID NO: 2119184 - RNA, 23 nt, Staphylococcus aureus subsp. aureus MW2
cauaaucuuuauuaauaaauucu

SEQ ID NO: 2119185 - RNA, 20 nt, Staphylococcus aureus subsp. aureus MW2
cauaaugacuauaacaccaa

SEQ ID NO: 2119186 - RNA, 14 nt, Staphylococcus aureus subsp. aureus MW2
cauaauuccauagu

SEQ ID NO: 2119187 - RNA, 14 nt, Staphylococcus aureus subsp. aureus MW2
cauaauuaauaaca

SEQ ID NO: 2119188 - RNA, 18 nt, Staphylococcus aureus subsp. aureus MW2
cauaauuaccuuuccauu

SEQ ID NO: 2119189 - RNA, 14 nt, Staphylococcus aureus subsp. aureus MW2
cauaauucuagaga

SEQ ID NO: 2119190 - RNA, 22 nt, Staphylococcus aureus subsp. aureus MW2
cauaaugugaugguucaaauau

SEQ ID NO: 2119191 - RNA, 21 nt, Staphylococcus aureus subsp. aureus MW2
cauaauuaaauagcuuuacuu

SEQ ID NO: 2119192 - RNA, 12 nt, Staphylococcus aureus subsp. aureus MW2
cauaaucauaau

SEQ ID NO: 2119193 - RNA, 16 nt, Staphylococcus aureus subsp. aureus MW2
cauaaucaagucugca

SEQ ID NO: 2119194 - RNA, 19 nt, Staphylococcus aureus subsp. aureus MW2
cauaauauuucuuaccauu

SEQ ID NO: 2119195 - RNA, 22 nt, Staphylococcus aureus subsp. aureus MW2
cauaauauauuaacaacuuuau

SEQ ID NO: 2119196 - RNA, 15 nt, Staphylococcus aureus subsp. aureus MW2
cauaauauauuaaaa

SEQ ID NO: 2119197 - RNA, 18 nt, Staphylococcus aureus subsp. aureus MW2
cauaauauauuaaaaauc

SEQ ID NO: 2119198 - RNA, 14 nt, Staphylococcus aureus subsp. aureus MW2
cauaauauauuaac

SEQ ID NO: 2119199 - RNA, 12 nt, Staphylococcus aureus subsp. aureus MW2
cauaauacacau

SEQ ID NO: 2119200 - RNA, 17 nt, Staphylococcus aureus subsp. aureus MW2
cauaauaaucguaaaca

SEQ ID NO: 2119201 - RNA, 13 nt, Staphylococcus aureus subsp. aureus MW2
cauaauaaaaagg

SEQ ID NO: 2119202 - RNA, 16 nt, Staphylococcus aureus subsp. aureus MW2
cauaaaauuucugcuu

SEQ ID NO: 2119203 - RNA, 22 nt, Staphylococcus aureus subsp. aureus MW2
cauaaaauuaacuuaaaauuua

SEQ ID NO: 2119204 - RNA, 12 nt, Staphylococcus aureus subsp. aureus MW2
cauaaaauuuaa

SEQ ID NO: 2119205 - RNA, 21 nt, Staphylococcus aureus subsp. aureus MW2
cauaaaauacgcaaaccaauc

SEQ ID NO: 2119206 - RNA, 20 nt, Staphylococcus aureus subsp. aureus MW2
cauaaacaauaacuguucuu

SEQ ID NO: 2119207 - RNA, 14 nt, Staphylococcus aureus subsp. aureus MW2
cauaaacucuuaua

SEQ ID NO: 2119208 - RNA, 22 nt, Staphylococcus aureus subsp. aureus MW2
cauaaagaauuucgaaaagaaa

SEQ ID NO: 2119209 - RNA, 13 nt, Staphylococcus aureus subsp. aureus MW2
cauaaaaauagaa

SEQ ID NO: 2119210 - RNA, 19 nt, Staphylococcus aureus subsp. aureus MW2
cauaaaaauagaaaaaaca

SEQ ID NO: 2119211 - RNA, 13 nt, Staphylococcus aureus subsp. aureus MW2
cauaaaaauauuc

SEQ ID NO: 2119212 - RNA, 15 nt, Staphylococcus aureus subsp. aureus MW2
cauaaaaaucauaaa

SEQ ID NO: 2119213 - RNA, 15 nt, Staphylococcus aureus subsp. aureus MW2
cauaaaaaaagaacu

SEQ ID NO: 2119214 - RNA, 23 nt, Staphylococcus aureus subsp. aureus MW2
cauaaaacuuacauuacauauau

SEQ ID NO: 2119215 - RNA, 19 nt, Staphylococcus aureus subsp. aureus MW2
cauaaaacuuacauuacau

SEQ ID NO: 2119216 - RNA, 20 nt, Staphylococcus aureus subsp. aureus MW2
cauaaaagacagaaauuacu

SEQ ID NO: 2119217 - RNA, 12 nt, Staphylococcus aureus subsp. aureus MW2
cauaaaucaaug

SEQ ID NO: 2119218 - RNA, 22 nt, Staphylococcus aureus subsp. aureus MW2
cauaaaucaugaaauuaaaaac

SEQ ID NO: 2119219 - RNA, 14 nt, Staphylococcus aureus subsp. aureus MW2
cauaaauauaagau

SEQ ID NO: 2119220 - RNA, 17 nt, Staphylococcus aureus subsp. aureus MW2
cauaaaugcuaaaagua

SEQ ID NO: 2119221 - RNA, 15 nt, Staphylococcus aureus subsp. aureus MW2
cauaaauuagaugaa

SEQ ID NO: 2119222 - RNA, 21 nt, Staphylococcus aureus subsp. aureus MW2
cauaaauuguuuuacaugauu

SEQ ID NO: 2119223 - RNA, 22 nt, Staphylococcus aureus subsp. aureus MW2
cauaaagugaguauaaguuugu

SEQ ID NO: 2119224 - RNA, 22 nt, Staphylococcus aureus subsp. aureus MW2
cauaaggucuuggacuaauaau

SEQ ID NO: 2119225 - RNA, 16 nt, Staphylococcus aureus subsp. aureus MW2
cauaagguacauaaau

SEQ ID NO: 2119226 - RNA, 16 nt, Staphylococcus aureus subsp. aureus MW2
cauaacugaauaaacc

SEQ ID NO: 2119227 - RNA, 18 nt, Staphylococcus aureus subsp. aureus MW2
cauaacuguagcuccuaa

SEQ ID NO: 2119228 - RNA, 16 nt, Staphylococcus aureus subsp. aureus MW2
cauaagaaaauacuaa

SEQ ID NO: 2119229 - RNA, 15 nt, Staphylococcus aureus subsp. aureus MW2
cauaagaaaauacua

SEQ ID NO: 2119230 - RNA, 19 nt, Staphylococcus aureus subsp. aureus MW2
cauaacuguagcuccuaaa

SEQ ID NO: 2119231 - RNA, 15 nt, Staphylococcus aureus subsp. aureus MW2
cauaacaacaucaaa

SEQ ID NO: 2119232 - RNA, 22 nt, Staphylococcus aureus subsp. aureus MW2
cauaaauuuauauauagaaaua

SEQ ID NO: 2119233 - RNA, 20 nt, Staphylococcus aureus subsp. aureus MW2
cauaacaaacauaccccuuu

SEQ ID NO: 2119234 - RNA, 21 nt, Staphylococcus aureus subsp. aureus MW2
cauaacaaacauaccccuuug

SEQ ID NO: 2119235 - RNA, 18 nt, Staphylococcus aureus subsp. aureus MW2
cauaacaaaaacaucuac

SEQ ID NO: 2119236 - RNA, 16 nt, Staphylococcus aureus subsp. aureus MW2
cauaacauaagaaaaa

SEQ ID NO: 2119237 - RNA, 19 nt, Staphylococcus aureus subsp. aureus MW2
cauaacauaagaaaaagca

SEQ ID NO: 2119238 - RNA, 22 nt, Staphylococcus aureus subsp. aureus MW2
cauaacgagcaguauauaucaa

SEQ ID NO: 2119239 - RNA, 23 nt, Staphylococcus aureus subsp. aureus MW2
cauaacgacaacuugaacuaaaa

SEQ ID NO: 2119240 - RNA, 17 nt, Staphylococcus aureus subsp. aureus MW2
cauaaccaaguaauucu

SEQ ID NO: 2119241 - RNA, 19 nt, Staphylococcus aureus subsp. aureus MW2
caucaauaucuucuucuaa

SEQ ID NO: 2119242 - RNA, 18 nt, Staphylococcus aureus subsp. aureus MW2
caucaacgccauauuuau

SEQ ID NO: 2119243 - RNA, 20 nt, Staphylococcus aureus subsp. aureus MW2
cauauuuaucgcgauuauua

SEQ ID NO: 2119244 - RNA, 13 nt, Staphylococcus aureus subsp. aureus MW2
caucaaaaaugag

SEQ ID NO: 2119245 - RNA, 14 nt, Staphylococcus aureus subsp. aureus MW2
caucaaacaacauc

SEQ ID NO: 2119246 - RNA, 17 nt, Staphylococcus aureus subsp. aureus MW2
caucaaacaacaucacu

SEQ ID NO: 2119247 - RNA, 20 nt, Staphylococcus aureus subsp. aureus MW2
caucaaacaacaucacuuua

SEQ ID NO: 2119248 - RNA, 12 nt, Staphylococcus aureus subsp. aureus MW2
caucaaaauuua

SEQ ID NO: 2119249 - RNA, 15 nt, Staphylococcus aureus subsp. aureus MW2
cauauucaguauaug

SEQ ID NO: 2119250 - RNA, 20 nt, Staphylococcus aureus subsp. aureus MW2
cauauucauaauaucgauga

SEQ ID NO: 2119251 - RNA, 11 nt, Staphylococcus aureus subsp. aureus MW2
cauauucacau

SEQ ID NO: 2119252 - RNA, 21 nt, Staphylococcus aureus subsp. aureus MW2
cauauucaaaauaacuuaugg

SEQ ID NO: 2119253 - RNA, 22 nt, Staphylococcus aureus subsp. aureus MW2
cauauuuagguaauacaucauc

SEQ ID NO: 2119254 - RNA, 20 nt, Staphylococcus aureus subsp. aureus MW2
cauauugugccgcuucuaca

SEQ ID NO: 2119255 - RNA, 18 nt, Staphylococcus aureus subsp. aureus MW2
cauauguaauacaaaaga

SEQ ID NO: 2119256 - RNA, 14 nt, Staphylococcus aureus subsp. aureus MW2
cauaugugguggcu

SEQ ID NO: 2119257 - RNA, 19 nt, Staphylococcus aureus subsp. aureus MW2
cauauguguaugauagaau

SEQ ID NO: 2119258 - RNA, 14 nt, Staphylococcus aureus subsp. aureus MW2
cauauuaacuguua

SEQ ID NO: 2119259 - RNA, 15 nt, Staphylococcus aureus subsp. aureus MW2
cauauuaauauguua

SEQ ID NO: 2119260 - RNA, 22 nt, Staphylococcus aureus subsp. aureus MW2
cauauguuguuucuaaugcuca

SEQ ID NO: 2119261 - RNA, 18 nt, Staphylococcus aureus subsp. aureus MW2
cauauuaauauuuuuuga

SEQ ID NO: 2119262 - RNA, 16 nt, Staphylococcus aureus subsp. aureus MW2
cauauguaauacaaaa

SEQ ID NO: 2119263 - RNA, 15 nt, Staphylococcus aureus subsp. aureus MW2
cauauguaauacaaa

SEQ ID NO: 2119264 - RNA, 23 nt, Staphylococcus aureus subsp. aureus MW2
cauauggcaaaaucaacuuuaau

SEQ ID NO: 2119265 - RNA, 15 nt, Staphylococcus aureus subsp. aureus MW2
cauaucauauuacuu

SEQ ID NO: 2119266 - RNA, 17 nt, Staphylococcus aureus subsp. aureus MW2
cauauacucuaaaaaag

SEQ ID NO: 2119267 - RNA, 17 nt, Staphylococcus aureus subsp. aureus MW2
cauaugaaaaaugucua

SEQ ID NO: 2119268 - RNA, 13 nt, Staphylococcus aureus subsp. aureus MW2
cauaucuuucaau

SEQ ID NO: 2119269 - RNA, 16 nt, Staphylococcus aureus subsp. aureus MW2
cauaucuuuaucauua

SEQ ID NO: 2119270 - RNA, 13 nt, Staphylococcus aureus subsp. aureus MW2
cauaucuauuuuu

SEQ ID NO: 2119271 - RNA, 22 nt, Staphylococcus aureus subsp. aureus MW2
cauaucgugcguuaaauauaua

SEQ ID NO: 2119272 - RNA, 20 nt, Staphylococcus aureus subsp. aureus MW2
cauauacaaauuuauauuaa

SEQ ID NO: 2119273 - RNA, 21 nt, Staphylococcus aureus subsp. aureus MW2
cauauacaaauuuauauuaaa

SEQ ID NO: 2119274 - RNA, 23 nt, Staphylococcus aureus subsp. aureus MW2
cauauaaugguugaauaacacua

SEQ ID NO: 2119275 - RNA, 20 nt, Staphylococcus aureus subsp. aureus MW2
cauauaauuugggucguuag

SEQ ID NO: 2119276 - RNA, 15 nt, Staphylococcus aureus subsp. aureus MW2
cauacuacucccccg

SEQ ID NO: 2119277 - RNA, 22 nt, Staphylococcus aureus subsp. aureus MW2
cauacuauacaauguauuuuga

SEQ ID NO: 2119278 - RNA, 22 nt, Staphylococcus aureus subsp. aureus MW2
caucaaugagcaagucuucuaa

SEQ ID NO: 2119279 - RNA, 22 nt, Staphylococcus aureus subsp. aureus MW2
caucaaucgcuuuagcaauuga

SEQ ID NO: 2119280 - RNA, 12 nt, Staphylococcus aureus subsp. aureus MW2
caucaucuauuu

SEQ ID NO: 2119281 - RNA, 16 nt, Staphylococcus aureus subsp. aureus MW2
caucaucaaguucacc

SEQ ID NO: 2119282 - RNA, 19 nt, Staphylococcus aureus subsp. aureus MW2
caucaucacuguagauuca

SEQ ID NO: 2119283 - RNA, 22 nt, Staphylococcus aureus subsp. aureus MW2
caucaucacuguagauucaaau

SEQ ID NO: 2119284 - RNA, 12 nt, Staphylococcus aureus subsp. aureus MW2
caucaucaccau

SEQ ID NO: 2119285 - RNA, 17 nt, Staphylococcus aureus subsp. aureus MW2
caucaucaccauacuaa

SEQ ID NO: 2119286 - RNA, 17 nt, Staphylococcus aureus subsp. aureus MW2
caucaguauuuguauug

SEQ ID NO: 2119287 - RNA, 14 nt, Staphylococcus aureus subsp. aureus MW2
caucaguuaauaau

SEQ ID NO: 2119288 - RNA, 23 nt, Staphylococcus aureus subsp. aureus MW2
caucaguuguguaauaaagcagu

SEQ ID NO: 2119289 - RNA, 20 nt, Staphylococcus aureus subsp. aureus MW2
caucauaaucaagaauauaa

SEQ ID NO: 2119290 - RNA, 15 nt, Staphylococcus aureus subsp. aureus MW2
caucauagcacuaca

SEQ ID NO: 2119291 - RNA, 24 nt, Staphylococcus aureus subsp. aureus MW2
caucgauugauaauguaaaaugau

SEQ ID NO: 2119292 - RNA, 13 nt, Staphylococcus aureus subsp. aureus MW2
caucauuguaaaa

SEQ ID NO: 2119293 - RNA, 16 nt, Staphylococcus aureus subsp. aureus MW2
caucauuguaaaacaa

SEQ ID NO: 2119294 - RNA, 14 nt, Staphylococcus aureus subsp. aureus MW2
caucuauauuuaau

SEQ ID NO: 2119295 - RNA, 20 nt, Staphylococcus aureus subsp. aureus MW2
caucuauauuuaauuuugau

SEQ ID NO: 2119296 - RNA, 22 nt, Staphylococcus aureus subsp. aureus MW2
caucuauucaaaugauuuuagu

SEQ ID NO: 2119297 - RNA, 13 nt, Staphylococcus aureus subsp. aureus MW2
caucuauguggcu

SEQ ID NO: 2119298 - RNA, 21 nt, Staphylococcus aureus subsp. aureus MW2
caucuaugacucguuuauaau

SEQ ID NO: 2119299 - RNA, 21 nt, Staphylococcus aureus subsp. aureus MW2
caucuauaauauucaauaauu

SEQ ID NO: 2119300 - RNA, 13 nt, Staphylococcus aureus subsp. aureus MW2
caucuacacccau

SEQ ID NO: 2119301 - RNA, 16 nt, Staphylococcus aureus subsp. aureus MW2
caucuacuuaaaauaa

SEQ ID NO: 2119302 - RNA, 21 nt, Staphylococcus aureus subsp. aureus MW2
caucgucaucacuuuuuaaac

SEQ ID NO: 2119303 - RNA, 22 nt, Staphylococcus aureus subsp. aureus MW2
caucgucaucacuuuuuaaacg

SEQ ID NO: 2119304 - RNA, 21 nt, Staphylococcus aureus subsp. aureus MW2
caucguuuacuacaucauaaa

SEQ ID NO: 2119305 - RNA, 23 nt, Staphylococcus aureus subsp. aureus MW2
caucugaugaggcaauauuaaaa

SEQ ID NO: 2119306 - RNA, 15 nt, Staphylococcus aureus subsp. aureus MW2
caucugcaagugcuu

SEQ ID NO: 2119307 - RNA, 12 nt, Staphylococcus aureus subsp. aureus MW2
caucucuucugg

SEQ ID NO: 2119308 - RNA, 22 nt, Staphylococcus aureus subsp. aureus MW2
caucugaaaaaauuaauaauuu

SEQ ID NO: 2119309 - RNA, 19 nt, Staphylococcus aureus subsp. aureus MW2
caucuuaucaagaauauaa

SEQ ID NO: 2119310 - RNA, 15 nt, Staphylococcus aureus subsp. aureus MW2
caucuuaucaagaau

SEQ ID NO: 2119311 - RNA, 22 nt, Staphylococcus aureus subsp. aureus MW2
caucuuagacgcuguuuuaaau

SEQ ID NO: 2119312 - RNA, 23 nt, Staphylococcus aureus subsp. aureus MW2
caucuucaagacgcauuguugua

SEQ ID NO: 2119313 - RNA, 22 nt, Staphylococcus aureus subsp. aureus MW2
caucuucaagacgcauuguugu

SEQ ID NO: 2119314 - RNA, 14 nt, Staphylococcus aureus subsp. aureus MW2
caucuguagguuua

SEQ ID NO: 2119315 - RNA, 22 nt, Staphylococcus aureus subsp. aureus MW2
caucuguagguuuaauguuuaa

SEQ ID NO: 2119316 - RNA, 23 nt, Staphylococcus aureus subsp. aureus MW2
caucuguagguuuaauguuuaau

SEQ ID NO: 2119317 - RNA, 16 nt, Staphylococcus aureus subsp. aureus MW2
ccaaauccaucuaauu

SEQ ID NO: 2119318 - RNA, 21 nt, Staphylococcus aureus subsp. aureus MW2
ccaaaucggaauaaaauaaau

SEQ ID NO: 2119319 - RNA, 12 nt, Staphylococcus aureus subsp. aureus MW2
ccaacaacuaag

SEQ ID NO: 2119320 - RNA, 23 nt, Staphylococcus aureus subsp. aureus MW2
ccaacauauuuuaacuaugaaug

SEQ ID NO: 2119321 - RNA, 15 nt, Staphylococcus aureus subsp. aureus MW2
ccaacauagaagcug

SEQ ID NO: 2119322 - RNA, 17 nt, Staphylococcus aureus subsp. aureus MW2
ccaacauagaagcuggc

SEQ ID NO: 2119323 - RNA, 22 nt, Staphylococcus aureus subsp. aureus MW2
ccaaaguaccaucucuauuuuu

SEQ ID NO: 2119324 - RNA, 17 nt, Staphylococcus aureus subsp. aureus MW2
ccaaagcuaaguuugaa

SEQ ID NO: 2119325 - RNA, 17 nt, Staphylococcus aureus subsp. aureus MW2
ccaaaguaauaauggca

SEQ ID NO: 2119326 - RNA, 20 nt, Staphylococcus aureus subsp. aureus MW2
cauuuuauggugcuaaaaaa

SEQ ID NO: 2119327 - RNA, 22 nt, Staphylococcus aureus subsp. aureus MW2
ccaaggauguuauaaaaugaau

SEQ ID NO: 2119328 - RNA, 17 nt, Staphylococcus aureus subsp. aureus MW2
ccaagcucguuaaauca

SEQ ID NO: 2119329 - RNA, 16 nt, Staphylococcus aureus subsp. aureus MW2
ccaagaugguauugcu

SEQ ID NO: 2119330 - RNA, 19 nt, Staphylococcus aureus subsp. aureus MW2
ccaagauaaaucaucauuc

SEQ ID NO: 2119331 - RNA, 21 nt, Staphylococcus aureus subsp. aureus MW2
ccaacugucgguucaucuaaa

SEQ ID NO: 2119332 - RNA, 17 nt, Staphylococcus aureus subsp. aureus MW2
ccaagucuaaaugcaau

SEQ ID NO: 2119333 - RNA, 19 nt, Staphylococcus aureus subsp. aureus MW2
ccaaguuacgauaucauac

SEQ ID NO: 2119334 - RNA, 14 nt, Staphylococcus aureus subsp. aureus MW2
ccaauaucauauuu

SEQ ID NO: 2119335 - RNA, 23 nt, Staphylococcus aureus subsp. aureus MW2
ccaauacaauuuagguuaauuaa

SEQ ID NO: 2119336 - RNA, 13 nt, Staphylococcus aureus subsp. aureus MW2
ccaaucaauaguu

SEQ ID NO: 2119337 - RNA, 13 nt, Staphylococcus aureus subsp. aureus MW2
ccaauuucucugu

SEQ ID NO: 2119338 - RNA, 21 nt, Staphylococcus aureus subsp. aureus MW2
ccaauuucucuguguuggggc

SEQ ID NO: 2119339 - RNA, 23 nt, Staphylococcus aureus subsp. aureus MW2
ccaauuuaguccuucuuuacuaa

SEQ ID NO: 2119340 - RNA, 17 nt, Staphylococcus aureus subsp. aureus MW2
ccaaugcuugaauuuua

SEQ ID NO: 2119341 - RNA, 23 nt, Staphylococcus aureus subsp. aureus MW2
ccacagcaauucacuuauacaug

SEQ ID NO: 2119342 - RNA, 16 nt, Staphylococcus aureus subsp. aureus MW2
ccaccagucguaauga

SEQ ID NO: 2119343 - RNA, 11 nt, Staphylococcus aureus subsp. aureus MW2
ccaccugauaa

SEQ ID NO: 2119344 - RNA, 20 nt, Staphylococcus aureus subsp. aureus MW2
cauguacguuuuuuuaaaua

SEQ ID NO: 2119345 - RNA, 23 nt, Staphylococcus aureus subsp. aureus MW2
cauguaacagugugaaauaauaa

SEQ ID NO: 2119346 - RNA, 17 nt, Staphylococcus aureus subsp. aureus MW2
cauguaaugcuuaaaaa

SEQ ID NO: 2119347 - RNA, 17 nt, Staphylococcus aureus subsp. aureus MW2
cauguaacguaaaaaug

SEQ ID NO: 2119348 - RNA, 15 nt, Staphylococcus aureus subsp. aureus MW2
cauguaaugaaucaa

SEQ ID NO: 2119349 - RNA, 15 nt, Staphylococcus aureus subsp. aureus MW2
cauguacauugguuu

SEQ ID NO: 2119350 - RNA, 19 nt, Staphylococcus aureus subsp. aureus MW2
cauguccgagacuauauuc

SEQ ID NO: 2119351 - RNA, 13 nt, Staphylococcus aureus subsp. aureus MW2
cauggcuuaaauc

SEQ ID NO: 2119352 - RNA, 22 nt, Staphylococcus aureus subsp. aureus MW2
caucuucaauauuuaaauuuua

SEQ ID NO: 2119353 - RNA, 19 nt, Staphylococcus aureus subsp. aureus MW2
caucuucaacuuucucuaa

SEQ ID NO: 2119354 - RNA, 13 nt, Staphylococcus aureus subsp. aureus MW2
caucuucuaauug

SEQ ID NO: 2119355 - RNA, 18 nt, Staphylococcus aureus subsp. aureus MW2
caucuucuaauuguugug

SEQ ID NO: 2119356 - RNA, 12 nt, Staphylococcus aureus subsp. aureus MW2
cauggaaaagug

SEQ ID NO: 2119357 - RNA, 17 nt, Staphylococcus aureus subsp. aureus MW2
cauggaaaagugcgauu

SEQ ID NO: 2119358 - RNA, 14 nt, Staphylococcus aureus subsp. aureus MW2
cauggaaaauauau

SEQ ID NO: 2119359 - RNA, 16 nt, Staphylococcus aureus subsp. aureus MW2
cauggaaaauauauua

SEQ ID NO: 2119360 - RNA, 22 nt, Staphylococcus aureus subsp. aureus MW2
cauggaaaauauauuauaaaaa

SEQ ID NO: 2119361 - RNA, 18 nt, Staphylococcus aureus subsp. aureus MW2
caugcuuuuuaauguuau

SEQ ID NO: 2119362 - RNA, 12 nt, Staphylococcus aureus subsp. aureus MW2
caugcuuuuuag

SEQ ID NO: 2119363 - RNA, 16 nt, Staphylococcus aureus subsp. aureus MW2
cauggaauaaauuuau

SEQ ID NO: 2119364 - RNA, 15 nt, Staphylococcus aureus subsp. aureus MW2
cauuacguaucuuua

SEQ ID NO: 2119365 - RNA, 19 nt, Staphylococcus aureus subsp. aureus MW2
cauuacauauaucaacaug

SEQ ID NO: 2119366 - RNA, 19 nt, Staphylococcus aureus subsp. aureus MW2
cauuacauguuacugauga

SEQ ID NO: 2119367 - RNA, 15 nt, Staphylococcus aureus subsp. aureus MW2
cauuagcaaauauua

SEQ ID NO: 2119368 - RNA, 18 nt, Staphylococcus aureus subsp. aureus MW2
cauuagacuuucuuaauu

SEQ ID NO: 2119369 - RNA, 13 nt, Staphylococcus aureus subsp. aureus MW2
cauuacuuucugc

SEQ ID NO: 2119370 - RNA, 16 nt, Staphylococcus aureus subsp. aureus MW2
cauuagcaugauaaag

SEQ ID NO: 2119371 - RNA, 23 nt, Staphylococcus aureus subsp. aureus MW2
cauuagccaaaucuuuaauaacc

SEQ ID NO: 2119372 - RNA, 17 nt, Staphylococcus aureus subsp. aureus MW2
cauuacuaucuucauca

SEQ ID NO: 2119373 - RNA, 18 nt, Staphylococcus aureus subsp. aureus MW2
cauuacuaucuucaucau

SEQ ID NO: 2119374 - RNA, 19 nt, Staphylococcus aureus subsp. aureus MW2
cauuacuaaaacaaauuca

SEQ ID NO: 2119375 - RNA, 14 nt, Staphylococcus aureus subsp. aureus MW2
cauuacuacuuaau

SEQ ID NO: 2119376 - RNA, 19 nt, Staphylococcus aureus subsp. aureus MW2
cauuaauaauuaaacaaaa

SEQ ID NO: 2119377 - RNA, 15 nt, Staphylococcus aureus subsp. aureus MW2
cauuaauaaauaaua

SEQ ID NO: 2119378 - RNA, 15 nt, Staphylococcus aureus subsp. aureus MW2
cauuaaguucaucau

SEQ ID NO: 2119379 - RNA, 14 nt, Staphylococcus aureus subsp. aureus MW2
cauuaauauaaaua

SEQ ID NO: 2119380 - RNA, 18 nt, Staphylococcus aureus subsp. aureus MW2
cauuaaguacuuuuacaa

SEQ ID NO: 2119381 - RNA, 16 nt, Staphylococcus aureus subsp. aureus MW2
caugugucauaaucca

SEQ ID NO: 2119382 - RNA, 18 nt, Staphylococcus aureus subsp. aureus MW2
cauuauauaauucuucaa

SEQ ID NO: 2119383 - RNA, 18 nt, Staphylococcus aureus subsp. aureus MW2
cauuauagacauaagcaa

SEQ ID NO: 2119384 - RNA, 11 nt, Staphylococcus aureus subsp. aureus MW2
cauuauuuaaa

SEQ ID NO: 2119385 - RNA, 17 nt, Staphylococcus aureus subsp. aureus MW2
cauuauuuauauuuaga

SEQ ID NO: 2119386 - RNA, 16 nt, Staphylococcus aureus subsp. aureus MW2
cauuauuugcugcuaa

SEQ ID NO: 2119387 - RNA, 20 nt, Staphylococcus aureus subsp. aureus MW2
cauuauuugcugcuaauuga

SEQ ID NO: 2119388 - RNA, 23 nt, Staphylococcus aureus subsp. aureus MW2
cauuauuuuacgcuuacuuauau

SEQ ID NO: 2119389 - RNA, 22 nt, Staphylococcus aureus subsp. aureus MW2
cauuauuuuucgcuucaaaagc

SEQ ID NO: 2119390 - RNA, 14 nt, Staphylococcus aureus subsp. aureus MW2
cauucaaucaucaa

SEQ ID NO: 2119391 - RNA, 17 nt, Staphylococcus aureus subsp. aureus MW2
cauuauaaugauuuuua

SEQ ID NO: 2119392 - RNA, 18 nt, Staphylococcus aureus subsp. aureus MW2
cauuaguuuuuaaaauua

SEQ ID NO: 2119393 - RNA, 20 nt, Staphylococcus aureus subsp. aureus MW2
cauuaguuguaucagugaca

SEQ ID NO: 2119394 - RNA, 15 nt, Staphylococcus aureus subsp. aureus MW2
cauuaguugcauaau

SEQ ID NO: 2119395 - RNA, 17 nt, Staphylococcus aureus subsp. aureus MW2
cauuaguuaugugcuaa

SEQ ID NO: 2119396 - RNA, 17 nt, Staphylococcus aureus subsp. aureus MW2
cauuaggauguucagcu

SEQ ID NO: 2119397 - RNA, 19 nt, Staphylococcus aureus subsp. aureus MW2
cauuaggaaaacuucaaua

SEQ ID NO: 2119398 - RNA, 15 nt, Staphylococcus aureus subsp. aureus MW2
cauucauaaaugacu

SEQ ID NO: 2119399 - RNA, 17 nt, Staphylococcus aureus subsp. aureus MW2
cauucauaaaugacuga

SEQ ID NO: 2119400 - RNA, 21 nt, Staphylococcus aureus subsp. aureus MW2
cauucauaccgaagaaacuaa

SEQ ID NO: 2119401 - RNA, 13 nt, Staphylococcus aureus subsp. aureus MW2
cauucaucacaaa

SEQ ID NO: 2119402 - RNA, 19 nt, Staphylococcus aureus subsp. aureus MW2
cauuccucuauuguaucuu

SEQ ID NO: 2119403 - RNA, 17 nt, Staphylococcus aureus subsp. aureus MW2
cauugcguaacaucaca

SEQ ID NO: 2119404 - RNA, 21 nt, Staphylococcus aureus subsp. aureus MW2
cauugcuuguccucuaaaaca

SEQ ID NO: 2119405 - RNA, 17 nt, Staphylococcus aureus subsp. aureus MW2
cauugccuaagaacuua

SEQ ID NO: 2119406 - RNA, 22 nt, Staphylococcus aureus subsp. aureus MW2
cauugauuugggcgcuuuuuaa

SEQ ID NO: 2119407 - RNA, 23 nt, Staphylococcus aureus subsp. aureus MW2
cauugcacuugucucaaauuaaa

SEQ ID NO: 2119408 - RNA, 17 nt, Staphylococcus aureus subsp. aureus MW2
cauugcacuaugcauaa

SEQ ID NO: 2119409 - RNA, 22 nt, Staphylococcus aureus subsp. aureus MW2
cauuguggcuuuuuuuauggug

SEQ ID NO: 2119410 - RNA, 16 nt, Staphylococcus aureus subsp. aureus MW2
cauuguauaugugugu

SEQ ID NO: 2119411 - RNA, 15 nt, Staphylococcus aureus subsp. aureus MW2
cauuguuauccaaaa

SEQ ID NO: 2119412 - RNA, 21 nt, Staphylococcus aureus subsp. aureus MW2
cauuguuauuaucguaaaaaa

SEQ ID NO: 2119413 - RNA, 17 nt, Staphylococcus aureus subsp. aureus MW2
cauuguuuguagaauuu

SEQ ID NO: 2119414 - RNA, 11 nt, Staphylococcus aureus subsp. aureus MW2
cauuuaagccu

SEQ ID NO: 2119415 - RNA, 20 nt, Staphylococcus aureus subsp. aureus MW2
cauuuaauuggaguucaucu

SEQ ID NO: 2119416 - RNA, 20 nt, Staphylococcus aureus subsp. aureus MW2
cauuuaaaauauuuuuucug

SEQ ID NO: 2119417 - RNA, 12 nt, Staphylococcus aureus subsp. aureus MW2
cauuuaaaaaau

SEQ ID NO: 2119418 - RNA, 17 nt, Staphylococcus aureus subsp. aureus MW2
cauuuaaaaaucuacau

SEQ ID NO: 2119419 - RNA, 13 nt, Staphylococcus aureus subsp. aureus MW2
cauuuaaauauaa

SEQ ID NO: 2119420 - RNA, 15 nt, Staphylococcus aureus subsp. aureus MW2
cauuguaaaaugcuc

SEQ ID NO: 2119421 - RNA, 13 nt, Staphylococcus aureus subsp. aureus MW2
cauuguauaaaaa

SEQ ID NO: 2119422 - RNA, 22 nt, Staphylococcus aureus subsp. aureus MW2
cauugucaugccuucauuagcc

SEQ ID NO: 2119423 - RNA, 22 nt, Staphylococcus aureus subsp. aureus MW2
cauuggcaauauacuuuuuaaa

SEQ ID NO: 2119424 - RNA, 17 nt, Staphylococcus aureus subsp. aureus MW2
cauuuuaaaucuaauua

SEQ ID NO: 2119425 - RNA, 21 nt, Staphylococcus aureus subsp. aureus MW2
cauuuuaaauuuaacuaugaa

SEQ ID NO: 2119426 - RNA, 21 nt, Staphylococcus aureus subsp. aureus MW2
cauuuuaacaagugaugaaaa

SEQ ID NO: 2119427 - RNA, 15 nt, Staphylococcus aureus subsp. aureus MW2
cauuuuauccaaacc

SEQ ID NO: 2119428 - RNA, 15 nt, Staphylococcus aureus subsp. aureus MW2
cauuuuauauuuuag

SEQ ID NO: 2119429 - RNA, 21 nt, Staphylococcus aureus subsp. aureus MW2
cauuuuagauugacuaaguuu

SEQ ID NO: 2119430 - RNA, 22 nt, Staphylococcus aureus subsp. aureus MW2
cauuuguaaauauuuuuuaaaa

SEQ ID NO: 2119431 - RNA, 13 nt, Staphylococcus aureus subsp. aureus MW2
cauuuguguaaau

SEQ ID NO: 2119432 - RNA, 15 nt, Staphylococcus aureus subsp. aureus MW2
cauuugucauaauag

SEQ ID NO: 2119433 - RNA, 17 nt, Staphylococcus aureus subsp. aureus MW2
cauuugucuuaauuuuu

SEQ ID NO: 2119434 - RNA, 13 nt, Staphylococcus aureus subsp. aureus MW2
cauuugaccaagu

SEQ ID NO: 2119435 - RNA, 19 nt, Staphylococcus aureus subsp. aureus MW2
cauuugcgauuucuucugc

SEQ ID NO: 2119436 - RNA, 21 nt, Staphylococcus aureus subsp. aureus MW2
cauuugcgauuucuucugcua

SEQ ID NO: 2119437 - RNA, 14 nt, Staphylococcus aureus subsp. aureus MW2
cauuucuucaauuu

SEQ ID NO: 2119438 - RNA, 15 nt, Staphylococcus aureus subsp. aureus MW2
cauuucuucaauuuu

SEQ ID NO: 2119439 - RNA, 15 nt, Staphylococcus aureus subsp. aureus MW2
cauuucaauauuaaa

SEQ ID NO: 2119440 - RNA, 23 nt, Staphylococcus aureus subsp. aureus MW2
cauuuauuuucuuuggugaaagu

SEQ ID NO: 2119441 - RNA, 18 nt, Staphylococcus aureus subsp. aureus MW2
cauuuauuuuuucucuau

SEQ ID NO: 2119442 - RNA, 14 nt, Staphylococcus aureus subsp. aureus MW2
cauuucaaaugccu

SEQ ID NO: 2119443 - RNA, 13 nt, Staphylococcus aureus subsp. aureus MW2
cauuucagaaaua

SEQ ID NO: 2119444 - RNA, 16 nt, Staphylococcus aureus subsp. aureus MW2
cauuucagaaauacau

SEQ ID NO: 2119445 - RNA, 23 nt, Staphylococcus aureus subsp. aureus MW2
cauuuacuugauuagauuugugu

SEQ ID NO: 2119446 - RNA, 18 nt, Staphylococcus aureus subsp. aureus MW2
cauuuacuugauuagauu

SEQ ID NO: 2119447 - RNA, 15 nt, Staphylococcus aureus subsp. aureus MW2
cauuuaguuaaauac

SEQ ID NO: 2119448 - RNA, 18 nt, Staphylococcus aureus subsp. aureus MW2
cauuuaguuggacaaauu

SEQ ID NO: 2119449 - RNA, 13 nt, Staphylococcus aureus subsp. aureus MW2
cauuuauaaaucu

SEQ ID NO: 2119450 - RNA, 15 nt, Staphylococcus aureus subsp. aureus MW2
cauuuauaaaucuuu

SEQ ID NO: 2119451 - RNA, 21 nt, Staphylococcus aureus subsp. aureus MW2
cauuuauguguuggcuuuuau

SEQ ID NO: 2119452 - RNA, 20 nt, Staphylococcus aureus subsp. aureus MW2
cauuucaugugucacaauga

SEQ ID NO: 2119453 - RNA, 14 nt, Staphylococcus aureus subsp. aureus MW2
cauuucauguguca

SEQ ID NO: 2119454 - RNA, 21 nt, Staphylococcus aureus subsp. aureus MW2
cauuucgauaccuaaaauacc

SEQ ID NO: 2119455 - RNA, 15 nt, Staphylococcus aureus subsp. aureus MW2
cauuuccuauaugcu

SEQ ID NO: 2119456 - RNA, 22 nt, Staphylococcus aureus subsp. aureus MW2
ccagcuucuuuguuggggcccc

SEQ ID NO: 2119457 - RNA, 23 nt, Staphylococcus aureus subsp. aureus MW2
ccagcuucuuuguuggggccccg

SEQ ID NO: 2119458 - RNA, 15 nt, Staphylococcus aureus subsp. aureus MW2
ccagccuauucguuu

SEQ ID NO: 2119459 - RNA, 23 nt, Staphylococcus aureus subsp. aureus MW2
ccaucaauccaacuacugcaaca

SEQ ID NO: 2119460 - RNA, 20 nt, Staphylococcus aureus subsp. aureus MW2
ccaucaauaccauaauuaaa

SEQ ID NO: 2119461 - RNA, 21 nt, Staphylococcus aureus subsp. aureus MW2
ccauaucgugcguuaaauaua

SEQ ID NO: 2119462 - RNA, 22 nt, Staphylococcus aureus subsp. aureus MW2
ccauaucgugcguuaaauauau

SEQ ID NO: 2119463 - RNA, 21 nt, Staphylococcus aureus subsp. aureus MW2
ccauaaggaaccugucuuaau

SEQ ID NO: 2119464 - RNA, 22 nt, Staphylococcus aureus subsp. aureus MW2
ccauaaggauuuuuaauuuuau

SEQ ID NO: 2119465 - RNA, 21 nt, Staphylococcus aureus subsp. aureus MW2
ccauacuaaauaaguaguuca

SEQ ID NO: 2119466 - RNA, 14 nt, Staphylococcus aureus subsp. aureus MW2
ccauacucuaacuu

SEQ ID NO: 2119467 - RNA, 14 nt, Staphylococcus aureus subsp. aureus MW2
ccauacuucuauuu

SEQ ID NO: 2119468 - RNA, 23 nt, Staphylococcus aureus subsp. aureus MW2
ccauauaaagcugcgauauaacu

SEQ ID NO: 2119469 - RNA, 11 nt, Staphylococcus aureus subsp. aureus MW2
ccauagauuau

SEQ ID NO: 2119470 - RNA, 13 nt, Staphylococcus aureus subsp. aureus MW2
ccauaacaccgca

SEQ ID NO: 2119471 - RNA, 15 nt, Staphylococcus aureus subsp. aureus MW2
ccauaaauauuaaau

SEQ ID NO: 2119472 - RNA, 17 nt, Staphylococcus aureus subsp. aureus MW2
ccaguugaaguugaagc

SEQ ID NO: 2119473 - RNA, 19 nt, Staphylococcus aureus subsp. aureus MW2
ccaucugugucagcauuca

SEQ ID NO: 2119474 - RNA, 16 nt, Staphylococcus aureus subsp. aureus MW2
ccaucgcaacugauaa

SEQ ID NO: 2119475 - RNA, 20 nt, Staphylococcus aureus subsp. aureus MW2
aaacaauaaaaaaccaagug

SEQ ID NO: 2119476 - RNA, 13 nt, Staphylococcus aureus subsp. aureus MW2
aaacaauaauuua

SEQ ID NO: 2119477 - RNA, 13 nt, Staphylococcus aureus subsp. aureus MW2
aaacaauaaaaaa

SEQ ID NO: 2119478 - RNA, 20 nt, Staphylococcus aureus subsp. aureus MW2
aaacaagcuagaaacacaua

SEQ ID NO: 2119479 - RNA, 19 nt, Staphylococcus aureus subsp. aureus MW2
aaacaagccuuaaaauauu

SEQ ID NO: 2119480 - RNA, 15 nt, Staphylococcus aureus subsp. aureus MW2
aaacaagauuccuaa

SEQ ID NO: 2119481 - RNA, 22 nt, Staphylococcus aureus subsp. aureus MW2
aaacaagauuccuaaagaauau

SEQ ID NO: 2119482 - RNA, 15 nt, Staphylococcus aureus subsp. aureus MW2
aaacaagaauaaauc

SEQ ID NO: 2119483 - RNA, 19 nt, Staphylococcus aureus subsp. aureus MW2
aaacaagaauaaaucccau

SEQ ID NO: 2119484 - RNA, 16 nt, Staphylococcus aureus subsp. aureus MW2
cccacaucuuuuuaaa

SEQ ID NO: 2119485 - RNA, 14 nt, Staphylococcus aureus subsp. aureus MW2
cccaaaaaauugua

SEQ ID NO: 2119486 - RNA, 13 nt, Staphylococcus aureus subsp. aureus MW2
ccauuucaaaugc

SEQ ID NO: 2119487 - RNA, 22 nt, Staphylococcus aureus subsp. aureus MW2
ccauuucaauugcacuuacugc

SEQ ID NO: 2119488 - RNA, 15 nt, Staphylococcus aureus subsp. aureus MW2
cccaacacagagaaa

SEQ ID NO: 2119489 - RNA, 15 nt, Staphylococcus aureus subsp. aureus MW2
cccaacaaagaagcu

SEQ ID NO: 2119490 - RNA, 15 nt, Staphylococcus aureus subsp. aureus MW2
cccaacacagaagcu

SEQ ID NO: 2119491 - RNA, 17 nt, Staphylococcus aureus subsp. aureus MW2
cccaacacagaagcugg

SEQ ID NO: 2119492 - RNA, 15 nt, Staphylococcus aureus subsp. aureus MW2
cccaacauagaagcu

SEQ ID NO: 2119493 - RNA, 17 nt, Staphylococcus aureus subsp. aureus MW2
cccaacauagaagcugg

SEQ ID NO: 2119494 - RNA, 17 nt, Staphylococcus aureus subsp. aureus MW2
cccaacaacauaucaua

SEQ ID NO: 2119495 - RNA, 14 nt, Staphylococcus aureus subsp. aureus MW2
cccaaauugccaau

SEQ ID NO: 2119496 - RNA, 13 nt, Staphylococcus aureus subsp. aureus MW2
cccaaacauagag

SEQ ID NO: 2119497 - RNA, 14 nt, Staphylococcus aureus subsp. aureus MW2
cccaaacauagaga

SEQ ID NO: 2119498 - RNA, 19 nt, Staphylococcus aureus subsp. aureus MW2
cccaaugcuugaauuuuau

SEQ ID NO: 2119499 - RNA, 15 nt, Staphylococcus aureus subsp. aureus MW2
cccaaccaugcuuuu

SEQ ID NO: 2119500 - RNA, 15 nt, Staphylococcus aureus subsp. aureus MW2
cccaauaauugcugu

SEQ ID NO: 2119501 - RNA, 17 nt, Staphylococcus aureus subsp. aureus MW2
cccaauauuaauccaca

SEQ ID NO: 2119502 - RNA, 20 nt, Staphylococcus aureus subsp. aureus MW2
cccaauauuaauccacaaau

SEQ ID NO: 2119503 - RNA, 17 nt, Staphylococcus aureus subsp. aureus MW2
ccauuguugauaaaugg

SEQ ID NO: 2119504 - RNA, 15 nt, Staphylococcus aureus subsp. aureus MW2
ccauuguuauccaaa

SEQ ID NO: 2119505 - RNA, 16 nt, Staphylococcus aureus subsp. aureus MW2
ccauugguuaugcugu

SEQ ID NO: 2119506 - RNA, 13 nt, Staphylococcus aureus subsp. aureus MW2
ccauugucaugcc

SEQ ID NO: 2119507 - RNA, 18 nt, Staphylococcus aureus subsp. aureus MW2
ccauugucaugccuucau

SEQ ID NO: 2119508 - RNA, 17 nt, Staphylococcus aureus subsp. aureus MW2
ccauugcacuaugcaua

SEQ ID NO: 2119509 - RNA, 22 nt, Staphylococcus aureus subsp. aureus MW2
ccauugcacaguuucaucuuca

SEQ ID NO: 2119510 - RNA, 18 nt, Staphylococcus aureus subsp. aureus MW2
ccauugaucuuuuauaau

SEQ ID NO: 2119511 - RNA, 19 nt, Staphylococcus aureus subsp. aureus MW2
ccauucaucgucucacuua

SEQ ID NO: 2119512 - RNA, 21 nt, Staphylococcus aureus subsp. aureus MW2
ccauucaauguuuaauuuucu

SEQ ID NO: 2119513 - RNA, 16 nt, Staphylococcus aureus subsp. aureus MW2
ccccuuacaacuuuag

SEQ ID NO: 2119514 - RNA, 16 nt, Staphylococcus aureus subsp. aureus MW2
ccccaacuugcacauu

SEQ ID NO: 2119515 - RNA, 21 nt, Staphylococcus aureus subsp. aureus MW2
ccccauuuauguguuggcuuu

SEQ ID NO: 2119516 - RNA, 18 nt, Staphylococcus aureus subsp. aureus MW2
aaacacucaaaauguuua

SEQ ID NO: 2119517 - RNA, 16 nt, Staphylococcus aureus subsp. aureus MW2
ccgagaauuauuauuc

SEQ ID NO: 2119518 - RNA, 19 nt, Staphylococcus aureus subsp. aureus MW2
ccgagauuggcaauuugga

SEQ ID NO: 2119519 - RNA, 19 nt, Staphylococcus aureus subsp. aureus MW2
aaacacuuuuaguuguaac

SEQ ID NO: 2119520 - RNA, 20 nt, Staphylococcus aureus subsp. aureus MW2
aaacacgcggugggcgaaau

SEQ ID NO: 2119521 - RNA, 21 nt, Staphylococcus aureus subsp. aureus MW2
cccuggaaaaugauucgcugu

SEQ ID NO: 2119522 - RNA, 18 nt, Staphylococcus aureus subsp. aureus MW2
ccgaacacaaaaaugaag

SEQ ID NO: 2119523 - RNA, 22 nt, Staphylococcus aureus subsp. aureus MW2
ccgaacaucugaaaaaauuaau

SEQ ID NO: 2119524 - RNA, 20 nt, Staphylococcus aureus subsp. aureus MW2
ccgaaaguuagacuaaaaaa

SEQ ID NO: 2119525 - RNA, 15 nt, Staphylococcus aureus subsp. aureus MW2
aaacaugaacaauca

SEQ ID NO: 2119526 - RNA, 19 nt, Staphylococcus aureus subsp. aureus MW2
aaacaucuucuucaucaua

SEQ ID NO: 2119527 - RNA, 13 nt, Staphylococcus aureus subsp. aureus MW2
aaacauaaaaaua

SEQ ID NO: 2119528 - RNA, 13 nt, Staphylococcus aureus subsp. aureus MW2
aaaccaauuuuaa

SEQ ID NO: 2119529 - RNA, 14 nt, Staphylococcus aureus subsp. aureus MW2
aaaccaauuuuaau

SEQ ID NO: 2119530 - RNA, 15 nt, Staphylococcus aureus subsp. aureus MW2
aaaccaauuuuaaua

SEQ ID NO: 2119531 - RNA, 20 nt, Staphylococcus aureus subsp. aureus MW2
aaaccaauuuuaauaguuuu

SEQ ID NO: 2119532 - RNA, 23 nt, Staphylococcus aureus subsp. aureus MW2
aaaccaauuuuaauaguuuuaau

SEQ ID NO: 2119533 - RNA, 17 nt, Staphylococcus aureus subsp. aureus MW2
aaaccaaugauuguuaa

SEQ ID NO: 2119534 - RNA, 15 nt, Staphylococcus aureus subsp. aureus MW2
aaaccaauuuuaacu

SEQ ID NO: 2119535 - RNA, 16 nt, Staphylococcus aureus subsp. aureus MW2
aaacauuuuuagaauc

SEQ ID NO: 2119536 - RNA, 21 nt, Staphylococcus aureus subsp. aureus MW2
aaacauuuugugacuuuguuc

SEQ ID NO: 2119537 - RNA, 18 nt, Staphylococcus aureus subsp. aureus MW2
aaacauuuuugauuuuaa

SEQ ID NO: 2119538 - RNA, 17 nt, Staphylococcus aureus subsp. aureus MW2
ccugcuacaacuucuuc

SEQ ID NO: 2119539 - RNA, 19 nt, Staphylococcus aureus subsp. aureus MW2
ccuguaaaaccauagauaa

SEQ ID NO: 2119540 - RNA, 19 nt, Staphylococcus aureus subsp. aureus MW2
ccugucuuaauucauucca

SEQ ID NO: 2119541 - RNA, 15 nt, Staphylococcus aureus subsp. aureus MW2
ccuuaaaauauuuaa

SEQ ID NO: 2119542 - RNA, 14 nt, Staphylococcus aureus subsp. aureus MW2
ccuuaaaauauuua

SEQ ID NO: 2119543 - RNA, 23 nt, Staphylococcus aureus subsp. aureus MW2
ccuguuuuaauugggucuuuauc

SEQ ID NO: 2119544 - RNA, 19 nt, Staphylococcus aureus subsp. aureus MW2
ccuguucuuuauuuaaagg

SEQ ID NO: 2119545 - RNA, 18 nt, Staphylococcus aureus subsp. aureus MW2
ccuugauuuaauuuuuaa

SEQ ID NO: 2119546 - RNA, 20 nt, Staphylococcus aureus subsp. aureus MW2
ccuucauugaagaauauaaa

SEQ ID NO: 2119547 - RNA, 17 nt, Staphylococcus aureus subsp. aureus MW2
ccuucauuagccaaauc

SEQ ID NO: 2119548 - RNA, 16 nt, Staphylococcus aureus subsp. aureus MW2
ccuucuauauaguaaa

SEQ ID NO: 2119549 - RNA, 15 nt, Staphylococcus aureus subsp. aureus MW2
ccuucucaucauuuu

SEQ ID NO: 2119550 - RNA, 18 nt, Staphylococcus aureus subsp. aureus MW2
ccuuuuaauuuaguuaua

SEQ ID NO: 2119551 - RNA, 11 nt, Staphylococcus aureus subsp. aureus MW2
ccuuuucaaac

SEQ ID NO: 2119552 - RNA, 10 nt, Staphylococcus aureus subsp. aureus MW2
ccuuuuaaau

SEQ ID NO: 2119553 - RNA, 15 nt, Staphylococcus aureus subsp. aureus MW2
ccuuuuuuauuuuuc

SEQ ID NO: 2119554 - RNA, 16 nt, Staphylococcus aureus subsp. aureus MW2
ccuuuuuuauuuuucu

SEQ ID NO: 2119555 - RNA, 17 nt, Staphylococcus aureus subsp. aureus MW2
ccuuuuuguaauuguaa

SEQ ID NO: 2119556 - RNA, 14 nt, Staphylococcus aureus subsp. aureus MW2
cgaaaagucagcuu

SEQ ID NO: 2119557 - RNA, 18 nt, Staphylococcus aureus subsp. aureus MW2
cgaaaauugcuaaaaaaa

SEQ ID NO: 2119558 - RNA, 20 nt, Staphylococcus aureus subsp. aureus MW2
cgaaaauugcuaaaaaaauu

SEQ ID NO: 2119559 - RNA, 20 nt, Staphylococcus aureus subsp. aureus MW2
cgaaaauagcuauuaaaaua

SEQ ID NO: 2119560 - RNA, 15 nt, Staphylococcus aureus subsp. aureus MW2
cgaaacauuaaaaua

SEQ ID NO: 2119561 - RNA, 19 nt, Staphylococcus aureus subsp. aureus MW2
cgaaagagaaaagcuagaa

SEQ ID NO: 2119562 - RNA, 20 nt, Staphylococcus aureus subsp. aureus MW2
cgaaaguuagacuaaaaaac

SEQ ID NO: 2119563 - RNA, 17 nt, Staphylococcus aureus subsp. aureus MW2
cgaaagaugauauauuc

SEQ ID NO: 2119564 - RNA, 22 nt, Staphylococcus aureus subsp. aureus MW2
cgaacaucugaaaaaauuaaua

SEQ ID NO: 2119565 - RNA, 16 nt, Staphylococcus aureus subsp. aureus MW2
cgaacaucugaaaaaa

SEQ ID NO: 2119566 - RNA, 18 nt, Staphylococcus aureus subsp. aureus MW2
cgaacaucugaaaaaauu

SEQ ID NO: 2119567 - RNA, 12 nt, Staphylococcus aureus subsp. aureus MW2
cgaacaucaucu

SEQ ID NO: 2119568 - RNA, 19 nt, Staphylococcus aureus subsp. aureus MW2
cgaaccauuuccgaauaaa

SEQ ID NO: 2119569 - RNA, 19 nt, Staphylococcus aureus subsp. aureus MW2
cgaacaaggcgacuucuau

SEQ ID NO: 2119570 - RNA, 13 nt, Staphylococcus aureus subsp. aureus MW2
cgaaauucucugu

SEQ ID NO: 2119571 - RNA, 17 nt, Staphylococcus aureus subsp. aureus MW2
cgaaauucucuguguug

SEQ ID NO: 2119572 - RNA, 22 nt, Staphylococcus aureus subsp. aureus MW2
cgaauaacuguuuaucaugaug

SEQ ID NO: 2119573 - RNA, 19 nt, Staphylococcus aureus subsp. aureus MW2
cgaaggucuacuaaauaac

SEQ ID NO: 2119574 - RNA, 21 nt, Staphylococcus aureus subsp. aureus MW2
ccugaaauuaacgucaacagc

SEQ ID NO: 2119575 - RNA, 21 nt, Staphylococcus aureus subsp. aureus MW2
ccugaaucaggaauguuugua

SEQ ID NO: 2119576 - RNA, 21 nt, Staphylococcus aureus subsp. aureus MW2
ccucuuuucuuuaaaaaagga

SEQ ID NO: 2119577 - RNA, 22 nt, Staphylococcus aureus subsp. aureus MW2
ccucuuuucuuuaaaaaaggaa

SEQ ID NO: 2119578 - RNA, 23 nt, Staphylococcus aureus subsp. aureus MW2
ccucuuuucuuuaaaaaaggaaa

SEQ ID NO: 2119579 - RNA, 14 nt, Staphylococcus aureus subsp. aureus MW2
ccugacuuuccgcc

SEQ ID NO: 2119580 - RNA, 21 nt, Staphylococcus aureus subsp. aureus MW2
ccugacuuuccgccagcuucu

SEQ ID NO: 2119581 - RNA, 18 nt, Staphylococcus aureus subsp. aureus MW2
ccugauacacguacaaaa

SEQ ID NO: 2119582 - RNA, 19 nt, Staphylococcus aureus subsp. aureus MW2
ccuauuaauugaaaugaua

SEQ ID NO: 2119583 - RNA, 16 nt, Staphylococcus aureus subsp. aureus MW2
ccuaugccaaauaacg

SEQ ID NO: 2119584 - RNA, 20 nt, Staphylococcus aureus subsp. aureus MW2
ccuaugccaaauaacguuaa

SEQ ID NO: 2119585 - RNA, 17 nt, Staphylococcus aureus subsp. aureus MW2
aaacgccucaacacuuu

SEQ ID NO: 2119586 - RNA, 15 nt, Staphylococcus aureus subsp. aureus MW2
aaacgccucaacacu

SEQ ID NO: 2119587 - RNA, 14 nt, Staphylococcus aureus subsp. aureus MW2
ccucauaaaucaug

SEQ ID NO: 2119588 - RNA, 21 nt, Staphylococcus aureus subsp. aureus MW2
ccucauaaaucaugaaauuaa

SEQ ID NO: 2119589 - RNA, 16 nt, Staphylococcus aureus subsp. aureus MW2
ccucugcaacgccuuu

SEQ ID NO: 2119590 - RNA, 21 nt, Staphylococcus aureus subsp. aureus MW2
ccucugcuagacaaucaucuu

SEQ ID NO: 2119591 - RNA, 14 nt, Staphylococcus aureus subsp. aureus MW2
ccucuccuucggcu

SEQ ID NO: 2119592 - RNA, 14 nt, Staphylococcus aureus subsp. aureus MW2
ccucuaaauaaaau

SEQ ID NO: 2119593 - RNA, 15 nt, Staphylococcus aureus subsp. aureus MW2
aaaccgaaaauaccu

SEQ ID NO: 2119594 - RNA, 12 nt, Staphylococcus aureus subsp. aureus MW2
aaaccgauuaau

SEQ ID NO: 2119595 - RNA, 12 nt, Staphylococcus aureus subsp. aureus MW2
ccgcuauaaaau

SEQ ID NO: 2119596 - RNA, 13 nt, Staphylococcus aureus subsp. aureus MW2
ccggaauauuaac

SEQ ID NO: 2119597 - RNA, 20 nt, Staphylococcus aureus subsp. aureus MW2
ccggaauauuaacaccagau

SEQ ID NO: 2119598 - RNA, 14 nt, Staphylococcus aureus subsp. aureus MW2
ccgcugcucuucuc

SEQ ID NO: 2119599 - RNA, 16 nt, Staphylococcus aureus subsp. aureus MW2
aaaccuagggauaauu

SEQ ID NO: 2119600 - RNA, 18 nt, Staphylococcus aureus subsp. aureus MW2
aaaccuacuaauauauua

SEQ ID NO: 2119601 - RNA, 16 nt, Staphylococcus aureus subsp. aureus MW2
aaaccucaacauuaaa

SEQ ID NO: 2119602 - RNA, 20 nt, Staphylococcus aureus subsp. aureus MW2
aaaccguauagucauuacau

SEQ ID NO: 2119603 - RNA, 22 nt, Staphylococcus aureus subsp. aureus MW2
aaacgauugauuaucauaugaa

SEQ ID NO: 2119604 - RNA, 14 nt, Staphylococcus aureus subsp. aureus MW2
aaaccuuacccaaa

SEQ ID NO: 2119605 - RNA, 13 nt, Staphylococcus aureus subsp. aureus MW2
ccguauuucaaau

SEQ ID NO: 2119606 - RNA, 17 nt, Staphylococcus aureus subsp. aureus MW2
aaacgugacauuuucaa

SEQ ID NO: 2119607 - RNA, 22 nt, Staphylococcus aureus subsp. aureus MW2
cgcggugggcgaaaucaguuug

SEQ ID NO: 2119608 - RNA, 18 nt, Staphylococcus aureus subsp. aureus MW2
cgccuuguuuauuuuuaa

SEQ ID NO: 2119609 - RNA, 18 nt, Staphylococcus aureus subsp. aureus MW2
cgccuuuuuuauuuuucu

SEQ ID NO: 2119610 - RNA, 23 nt, Staphylococcus aureus subsp. aureus MW2
cgccuuuuuuauuuuucuuuuug

SEQ ID NO: 2119611 - RNA, 21 nt, Staphylococcus aureus subsp. aureus MW2
cgauugauaauguaaaaugau

SEQ ID NO: 2119612 - RNA, 22 nt, Staphylococcus aureus subsp. aureus MW2
cgauugauaauguaaaaugaug

SEQ ID NO: 2119613 - RNA, 19 nt, Staphylococcus aureus subsp. aureus MW2
cgauuugauaaaaaaugaa

SEQ ID NO: 2119614 - RNA, 19 nt, Staphylococcus aureus subsp. aureus MW2
cgauguguaacauuacguu

SEQ ID NO: 2119615 - RNA, 20 nt, Staphylococcus aureus subsp. aureus MW2
cgauuuuaaaagauaaauaa

SEQ ID NO: 2119616 - RNA, 22 nt, Staphylococcus aureus subsp. aureus MW2
cgcaaaaacuugugaauuuuca

SEQ ID NO: 2119617 - RNA, 16 nt, Staphylococcus aureus subsp. aureus MW2
cgcaauuuuuaacaaa

SEQ ID NO: 2119618 - RNA, 12 nt, Staphylococcus aureus subsp. aureus MW2
cgcaauuuuuaa

SEQ ID NO: 2119619 - RNA, 14 nt, Staphylococcus aureus subsp. aureus MW2
cgcaauuuaauauu

SEQ ID NO: 2119620 - RNA, 20 nt, Staphylococcus aureus subsp. aureus MW2
cgcaucuuuugguuuaucug

SEQ ID NO: 2119621 - RNA, 13 nt, Staphylococcus aureus subsp. aureus MW2
cgcaucauguaua

SEQ ID NO: 2119622 - RNA, 18 nt, Staphylococcus aureus subsp. aureus MW2
cgcauacuuuuucagaau

SEQ ID NO: 2119623 - RNA, 21 nt, Staphylococcus aureus subsp. aureus MW2
aaacggcacuaauauuuaaaa

SEQ ID NO: 2119624 - RNA, 14 nt, Staphylococcus aureus subsp. aureus MW2
cgcauuuaaauaua

SEQ ID NO: 2119625 - RNA, 12 nt, Staphylococcus aureus subsp. aureus MW2
cgcauuguugua

SEQ ID NO: 2119626 - RNA, 23 nt, Staphylococcus aureus subsp. aureus MW2
cgccaauacagaacuuuaauaau

SEQ ID NO: 2119627 - RNA, 20 nt, Staphylococcus aureus subsp. aureus MW2
cgagauguguccuaauaagu

SEQ ID NO: 2119628 - RNA, 19 nt, Staphylococcus aureus subsp. aureus MW2
cgagagagaaaagcuagaa

SEQ ID NO: 2119629 - RNA, 18 nt, Staphylococcus aureus subsp. aureus MW2
cgagaaauuagaaccauc

SEQ ID NO: 2119630 - RNA, 23 nt, Staphylococcus aureus subsp. aureus MW2
cgacuuucacuacauuaaaaaua

SEQ ID NO: 2119631 - RNA, 14 nt, Staphylococcus aureus subsp. aureus MW2
cgacguuuaaaugc

SEQ ID NO: 2119632 - RNA, 15 nt, Staphylococcus aureus subsp. aureus MW2
cgaauacuaaaaugg

SEQ ID NO: 2119633 - RNA, 21 nt, Staphylococcus aureus subsp. aureus MW2
aaacgcucuucuucuucagga

SEQ ID NO: 2119634 - RNA, 13 nt, Staphylococcus aureus subsp. aureus MW2
aaacggaaauaac

SEQ ID NO: 2119635 - RNA, 16 nt, Staphylococcus aureus subsp. aureus MW2
cgagcguaauggauua

SEQ ID NO: 2119636 - RNA, 16 nt, Staphylococcus aureus subsp. aureus MW2
cgagcuggugagaaau

SEQ ID NO: 2119637 - RNA, 20 nt, Staphylococcus aureus subsp. aureus MW2
cgagcugcuucaacuacuuc

SEQ ID NO: 2119638 - RNA, 20 nt, Staphylococcus aureus subsp. aureus MW2
cgagcuaauaugucuagacu

SEQ ID NO: 2119639 - RNA, 15 nt, Staphylococcus aureus subsp. aureus MW2
cgaggaccaucucua

SEQ ID NO: 2119640 - RNA, 21 nt, Staphylococcus aureus subsp. aureus MW2
cgauagauuuaucaccuuuag

SEQ ID NO: 2119641 - RNA, 17 nt, Staphylococcus aureus subsp. aureus MW2
cgauaccaaauauauuu

SEQ ID NO: 2119642 - RNA, 17 nt, Staphylococcus aureus subsp. aureus MW2
cgauaauucuaacuuga

SEQ ID NO: 2119643 - RNA, 23 nt, Staphylococcus aureus subsp. aureus MW2
cgaguuuguuucuaaauucuuuu

SEQ ID NO: 2119644 - RNA, 19 nt, Staphylococcus aureus subsp. aureus MW2
cgaguuuguuucuaaauuc

SEQ ID NO: 2119645 - RNA, 12 nt, Staphylococcus aureus subsp. aureus MW2
cgauaaaagaac

SEQ ID NO: 2119646 - RNA, 12 nt, Staphylococcus aureus subsp. aureus MW2
cgauaaaaccac

SEQ ID NO: 2119647 - RNA, 17 nt, Staphylococcus aureus subsp. aureus MW2
cgauaacaauuuauuaa

SEQ ID NO: 2119648 - RNA, 14 nt, Staphylococcus aureus subsp. aureus MW2
cggcauuuuuauau

SEQ ID NO: 2119649 - RNA, 22 nt, Staphylococcus aureus subsp. aureus MW2
cggaaaauaucacuaauauauu

SEQ ID NO: 2119650 - RNA, 12 nt, Staphylococcus aureus subsp. aureus MW2
cgcuuuuuaaaa

SEQ ID NO: 2119651 - RNA, 14 nt, Staphylococcus aureus subsp. aureus MW2
cgcuuuaaaucauu

SEQ ID NO: 2119652 - RNA, 16 nt, Staphylococcus aureus subsp. aureus MW2
cgcuaauacuuuaacu

SEQ ID NO: 2119653 - RNA, 14 nt, Staphylococcus aureus subsp. aureus MW2
cggaauaaaauaaa

SEQ ID NO: 2119654 - RNA, 21 nt, Staphylococcus aureus subsp. aureus MW2
cggaagcauauuucuaaauua

SEQ ID NO: 2119655 - RNA, 18 nt, Staphylococcus aureus subsp. aureus MW2
cggaaauaugauugaaug

SEQ ID NO: 2119656 - RNA, 14 nt, Staphylococcus aureus subsp. aureus MW2
cggaaagucagcuu

SEQ ID NO: 2119657 - RNA, 17 nt, Staphylococcus aureus subsp. aureus MW2
cggaaagucagcuuaca

SEQ ID NO: 2119658 - RNA, 19 nt, Staphylococcus aureus subsp. aureus MW2
cggaaagucagcuuacaau

SEQ ID NO: 2119659 - RNA, 19 nt, Staphylococcus aureus subsp. aureus MW2
cggacaaguugcacauuau

SEQ ID NO: 2119660 - RNA, 14 nt, Staphylococcus aureus subsp. aureus MW2
cggcacauucauac

SEQ ID NO: 2119661 - RNA, 14 nt, Staphylococcus aureus subsp. aureus MW2
cggcaccuuuauua

SEQ ID NO: 2119662 - RNA, 21 nt, Human
ugaggagcuggaaacacaugu

SEQ ID NO: 2119663 - RNA, 18 nt, Human
ucacuggcuguuaaucuu

SEQ ID NO: 2119664 - RNA, 12 nt, Human
ucacuuguuuua

SEQ ID NO: 2119665 - RNA, 17 nt, Human
ugcuggagacauugagg

SEQ ID NO: 2119666 - RNA, 14 nt, Human
ugcggccuggucua

SEQ ID NO: 2119667 - RNA, 22 nt, Human
uaaauugacacuuaaaaauggu

SEQ ID NO: 2119668 - RNA, 15 nt, Human
cgcccacuagaccca

SEQ ID NO: 2119669 - RNA, 22 nt, Human
cuccauccugaggcuccacuug

SEQ ID NO: 2119670 - RNA, 13 nt, Human
cucauccacuuuc

SEQ ID NO: 2119671 - RNA, 14 nt, Human
uuagggguagcauu

SEQ ID NO: 2119672 - RNA, 14 nt, Human
ccuccauccugagg

SEQ ID NO: 2119673 - RNA, 23 nt, Human
ccugcuagaacagucucuugagg

SEQ ID NO: 2119674 - RNA, 19 nt, Human
cuugaugaagaaguugaua

SEQ ID NO: 2119675 - RNA, 20 nt, Human
cuugccuaggcauagcccug

SEQ ID NO: 2119676 - RNA, 13 nt, Human
cuuauauauugua

SEQ ID NO: 2119677 - RNA, 15 nt, Human
cugggagccccaauu

SEQ ID NO: 2119678 - RNA, 11 nt, Human
gauacagaaaa

SEQ ID NO: 2119679 - RNA, 22 nt, Human
gaucuggcucuggacaggcacu

SEQ ID NO: 2119680 - RNA, 16 nt, Human
gcccugcugaguccca

SEQ ID NO: 2119681 - RNA, 18 nt, Human
aaaaaugguuuaaauggu

SEQ ID NO: 2119682 - RNA, 16 nt, Human
aaaaaauaacaaugaa

SEQ ID NO: 2119683 - RNA, 16 nt, Human
aaaugucuugcuugau

SEQ ID NO: 2119684 - RNA, 14 nt, Human
aagguacuucaaau

SEQ ID NO: 2119685 - RNA, 18 nt, Human
aaguacucauacauguua

SEQ ID NO: 2119686 - RNA, 19 nt, Human
aagucacauuccugaacag

SEQ ID NO: 2119687 - RNA, 19 nt, Human
ugggagcuuuuguagaagu

SEQ ID NO: 2119688 - RNA, 12 nt, Human
uguaaaauggug

SEQ ID NO: 2119689 - RNA, 22 nt, Human
ugugauauguaccuaacgaagu

SEQ ID NO: 2119690 - RNA, 21 nt, Human
ugaaguccaagcauuuagaug

SEQ ID NO: 2119691 - RNA, 15 nt, Human
ugagagugaacaaau

SEQ ID NO: 2119692 - RNA, 23 nt, Human
ugaccaacaucgcagacacaugu

SEQ ID NO: 2119693 - RNA, 18 nt, Human
ugaacuagaguuuagcug

SEQ ID NO: 2119694 - RNA, 21 nt, Human
ugaacaguuguguuugaagca

SEQ ID NO: 2119695 - RNA, 16 nt, Human
guuuuuuccuagucug

SEQ ID NO: 2119696 - RNA, 18 nt, Human
uaaaaauccuacuuucau

SEQ ID NO: 2119697 - RNA, 18 nt, Human
uauuuuaauaauguuuca

SEQ ID NO: 2119698 - RNA, 22 nt, Human
uauuuacggaacucaaauacgu

SEQ ID NO: 2119699 - RNA, 19 nt, Human
uauuuaaccucuaaauucu

SEQ ID NO: 2119700 - RNA, 21 nt, Human
uauuugcuguuauuuuaucug

SEQ ID NO: 2119701 - RNA, 21 nt, Human
uauauuuuuuguuaaaugauu

SEQ ID NO: 2119702 - RNA, 14 nt, Human
uaagauauuaacug

SEQ ID NO: 2119703 - RNA, 18 nt, Human
gaauaauccuaaacauau

SEQ ID NO: 2119704 - RNA, 20 nt, Human
gcuuccgcauccuagucucu

SEQ ID NO: 2119705 - RNA, 15 nt, Human
gcccacuagacccac

SEQ ID NO: 2119706 - RNA, 17 nt, Human
caugaauuaguuuuaua

SEQ ID NO: 2119707 - RNA, 21 nt, Human
caauagucaaauugugugaaa

SEQ ID NO: 2119708 - RNA, 18 nt, Human
auguauguacuucaugcu

SEQ ID NO: 2119709 - RNA, 16 nt, Human
auguagaauauauuuc

SEQ ID NO: 2119710 - RNA, 18 nt, Human
ccauccugaggcuccacu

SEQ ID NO: 2119711 - RNA, 21 nt, Human
ccucagucucccucccuuggg

SEQ ID NO: 2119712 - RNA, 11 nt, Human
cgacggagccg

SEQ ID NO: 2119713 - RNA, 20 nt, Human
agauacugaaauaaacgucu

SEQ ID NO: 2119714 - RNA, 19 nt, Human
agaaccuagggugauauua

SEQ ID NO: 2119715 - RNA, 18 nt, Human
agaaagccaugugcagcc

SEQ ID NO: 2119716 - RNA, 19 nt, Human
auagugaggcaucgcaaug

SEQ ID NO: 2119717 - RNA, 20 nt, Human
auaucuccgucaacucauau

SEQ ID NO: 2119718 - RNA, 17 nt, Human
auauuauuuuauagcua

SEQ ID NO: 2119719 - RNA, 14 nt, Human
auccacuuuccaau

SEQ ID NO: 2119720 - RNA, 14 nt, Human
aagaaguugauaug

SEQ ID NO: 2119721 - RNA, 14 nt, Human
aacucaaauacgug

SEQ ID NO: 2119722 - RNA, 17 nt, Human
aacaaugcuguauuuua

SEQ ID NO: 2119723 - RNA, 23 nt, Human
aauuugguuuucacauuggaaac

SEQ ID NO: 2119724 - RNA, 17 nt, Human
aauuuuuauauuugaaa

SEQ ID NO: 2119725 - RNA, 20 nt, Human
aagccagacaucaacagaua

SEQ ID NO: 2119726 - RNA, 15 nt, Human
acuaucucauuucca

SEQ ID NO: 2119727 - RNA, 16 nt, Human
acuaugucauuugcug

SEQ ID NO: 2119728 - RNA, 19 nt, Human
uugaagagguuuuaaagcu

SEQ ID NO: 2119729 - RNA, 14 nt, Human
ugugaacccaaagu

SEQ ID NO: 2119730 - RNA, 18 nt, Human
uucccacacuguccauuc

SEQ ID NO: 2119731 - RNA, 21 nt, Human
uggggaauauguuagagaauu

SEQ ID NO: 2119732 - RNA, 19 nt, Human
ucuuucaaagugucuugaa

SEQ ID NO: 2119733 - RNA, 16 nt, Human
ugggucgccggcaucu

SEQ ID NO: 2119734 - RNA, 17 nt, Human
ucugugagaugcuagaa

SEQ ID NO: 2119735 - RNA, 13 nt, Human
ucucauccacuuu

SEQ ID NO: 2119736 - RNA, 15 nt, Human
uaugccuuuucccaa

SEQ ID NO: 2119737 - RNA, 17 nt, Human
uauuuucaugcuguuca

SEQ ID NO: 2119738 - RNA, 12 nt, Human
uauuuuguuuca

SEQ ID NO: 2119739 - RNA, 22 nt, Human
uacgugggcauucaaauguauu

SEQ ID NO: 2119740 - RNA, 20 nt, Human
uauguagaauauauuuccuu

SEQ ID NO: 2119741 - RNA, 15 nt, Human
uaugcuucuguuuua

SEQ ID NO: 2119742 - RNA, 11 nt, Human
uaauuggaaag

SEQ ID NO: 2119743 - RNA, 14 nt, Human
uaauuugguuuuca

SEQ ID NO: 2119744 - RNA, 21 nt, Human
uacaucccuuaccugggaaag

SEQ ID NO: 2119745 - RNA, 16 nt, Human
guuagagaauuuccuu

SEQ ID NO: 2119746 - RNA, 14 nt, Human
gcuguuaaucuuuc

SEQ ID NO: 2119747 - RNA, 20 nt, Human
gggaaugaagauacugaaau

SEQ ID NO: 2119748 - RNA, 19 nt, Human
aaaaucucaauauuucaga

SEQ ID NO: 2119749 - RNA, 13 nt, Human
aaacuuuuggaag

SEQ ID NO: 2119750 - RNA, 20 nt, Human
aaacauccuacaagacacag

SEQ ID NO: 2119751 - RNA, 14 nt, Human
aaaccgaacugaug

SEQ ID NO: 2119752 - RNA, 14 nt, Human
aggacugaauuaug

SEQ ID NO: 2119753 - RNA, 13 nt, Human
aguuuuauaugcu

SEQ ID NO: 2119754 - RNA, 16 nt, Human
acaugggacauuugcu

SEQ ID NO: 2119755 - RNA, 17 nt, Human
agcagggacuugaaccc

SEQ ID NO: 2119756 - RNA, 21 nt, Human
agcccuuccccucugcagcuu

SEQ ID NO: 2119757 - RNA, 17 nt, Human
agcuacuuauuguagca

SEQ ID NO: 2119758 - RNA, 17 nt, Human
auugaggcuuuaaaacu

SEQ ID NO: 2119759 - RNA, 14 nt, Human
auugucuagugaaa

SEQ ID NO: 2119760 - RNA, 21 nt, Human
auucagauaugauucaaaugu

SEQ ID NO: 2119761 - RNA, 23 nt, Human
augacuuguacucugaaaguuuu

SEQ ID NO: 2119762 - RNA, 19 nt, Human
auuaugaauuacauuugua

SEQ ID NO: 2119763 - RNA, 18 nt, Human
auccugaggcuccacuug

SEQ ID NO: 2119764 - RNA, 20 nt, Human
caaauacgugggcauucaaa

SEQ ID NO: 2119765 - RNA, 18 nt, Human
aauagguuuggacaaaau

SEQ ID NO: 2119766 - RNA, 21 nt, Human
aauacgugggcauucaaaugu

SEQ ID NO: 2119767 - RNA, 14 nt, Human
aauaagccagacau

SEQ ID NO: 2119768 - RNA, 12 nt, Human
aauggaauacuc

SEQ ID NO: 2119769 - RNA, 22 nt, Human
aaugauaacuggaaacuucagc

SEQ ID NO: 2119770 - RNA, 16 nt, Human
agaaucacuugaaccc

SEQ ID NO: 2119771 - RNA, 18 nt, Human
agaauuucuaaaaguuua

SEQ ID NO: 2119772 - RNA, 18 nt, Human
agaaacacaacuauauug

SEQ ID NO: 2119773 - RNA, 14 nt, Human
acugccaucauuua

SEQ ID NO: 2119774 - RNA, 13 nt, Human
aauguuucaaaca

SEQ ID NO: 2119775 - RNA, 15 nt, Human
aauuaacacaugauc

SEQ ID NO: 2119776 - RNA, 16 nt, Human
aauuacauuuguauaa

SEQ ID NO: 2119777 - RNA, 14 nt, Human
aauuggagcucgug

SEQ ID NO: 2119778 - RNA, 15 nt, Human
aauuuaguauuuugu

SEQ ID NO: 2119779 - RNA, 13 nt, Human
aaaagacagugaa

SEQ ID NO: 2119780 - RNA, 21 nt, Human
aaaggacaccauuuuggcaag

SEQ ID NO: 2119781 - RNA, 20 nt, Human
aaguaaacggucucucacuu

SEQ ID NO: 2119782 - RNA, 20 nt, Human
aauacucuuauaucuauauu

SEQ ID NO: 2119783 - RNA, 17 nt, Human
aauauuauguuaaaacu

SEQ ID NO: 2119784 - RNA, 19 nt, Human
aauaucuccgucaacucau

SEQ ID NO: 2119785 - RNA, 22 nt, Human
aauaucuccgucaacucauauu

SEQ ID NO: 2119786 - RNA, 17 nt, Human
aaugaagauacugaaau

SEQ ID NO: 2119787 - RNA, 18 nt, Human
aaugaaguacucauacau

SEQ ID NO: 2119788 - RNA, 21 nt, Human
agagcuacaggccccaucugg

SEQ ID NO: 2119789 - RNA, 19 nt, Human
agauaugauucaaaugucu

SEQ ID NO: 2119790 - RNA, 18 nt, Human
cugauaugggucuugaua

SEQ ID NO: 2119791 - RNA, 21 nt, Human
cuauaauuuaaauauaugcua

SEQ ID NO: 2119792 - RNA, 18 nt, Human
gaaagaaaauaacgauaa

SEQ ID NO: 2119793 - RNA, 18 nt, Human
gacauugaggcaggcacu

SEQ ID NO: 2119794 - RNA, 17 nt, Human
gaaaacaauaacgauaa

SEQ ID NO: 2119795 - RNA, 16 nt, Human
agcauuccaacuaucu

SEQ ID NO: 2119796 - RNA, 19 nt, Human
gcacagugaucaaguuauu

SEQ ID NO: 2119797 - RNA, 22 nt, Human
gauguuuagaaacacaacuaua

SEQ ID NO: 2119798 - RNA, 14 nt, Human
gcauuccaacuauc

SEQ ID NO: 2119799 - RNA, 16 nt, Human
ugagcuacaaaugcau

SEQ ID NO: 2119800 - RNA, 12 nt, Human
ugauucaaaugu

SEQ ID NO: 2119801 - RNA, 12 nt, Human
ugauacagaaaa

SEQ ID NO: 2119802 - RNA, 12 nt, Human
ucggacggcucc

SEQ ID NO: 2119803 - RNA, 13 nt, Human
ucugagccuuggg

SEQ ID NO: 2119804 - RNA, 19 nt, Human
ucucagcuucacccugagg

SEQ ID NO: 2119805 - RNA, 16 nt, Human
ucuaucauuaaaguuc

SEQ ID NO: 2119806 - RNA, 13 nt, Human
ucuauguagaaua

SEQ ID NO: 2119807 - RNA, 13 nt, Human
uaaucuuucacag

SEQ ID NO: 2119808 - RNA, 14 nt, Human
uaauaauguuucaa

SEQ ID NO: 2119809 - RNA, 17 nt, Human
uacauggaagaccucau

SEQ ID NO: 2119810 - RNA, 21 nt, Human
uaauuuguaguguuggagaag

SEQ ID NO: 2119811 - RNA, 15 nt, Human
uaauuuuaacucuau

SEQ ID NO: 2119812 - RNA, 20 nt, Human
agcuuuuuucucugauacag

SEQ ID NO: 2119813 - RNA, 18 nt, Human
aggugacuauuauauuuc

SEQ ID NO: 2119814 - RNA, 13 nt, Human
uuguuaaaugauu

SEQ ID NO: 2119815 - RNA, 13 nt, Human
uuguaaaauggug

SEQ ID NO: 2119816 - RNA, 13 nt, Human
uuuuauuuaaccu

SEQ ID NO: 2119817 - RNA, 13 nt, Human
agccuccagcugc

SEQ ID NO: 2119818 - RNA, 18 nt, Human
aucaguuauuuuuaaacu

SEQ ID NO: 2119819 - RNA, 15 nt, Human
aguuucccuugcaug

SEQ ID NO: 2119820 - RNA, 18 nt, Human
auauaaauuuaucauuua

SEQ ID NO: 2119821 - RNA, 18 nt, Human
augccccauucaacaucu

SEQ ID NO: 2119822 - RNA, 23 nt, Human
augagcacgcauggaaaaguuuc

SEQ ID NO: 2119823 - RNA, 17 nt, Human
auggcacuaguauuucu

SEQ ID NO: 2119824 - RNA, 16 nt, Human
augcuagaacucccuu

SEQ ID NO: 2119825 - RNA, 15 nt, Human
cagcccuuagcccuu

SEQ ID NO: 2119826 - RNA, 13 nt, Human
auuucuccuugga

SEQ ID NO: 2119827 - RNA, 17 nt, Human
auuucuaggacugaauu

SEQ ID NO: 2119828 - RNA, 22 nt, Human
auuuccaagaaauauuccuuaa

SEQ ID NO: 2119829 - RNA, 22 nt, Human
auuuuagggguagcauuugugu

SEQ ID NO: 2119830 - RNA, 15 nt, Human
cacuuaaaaaugguu

SEQ ID NO: 2119831 - RNA, 15 nt, Human
cagauaugauucaaa

SEQ ID NO: 2119832 - RNA, 15 nt, Human
caaugccccugaauu

SEQ ID NO: 2119833 - RNA, 16 nt, Human
cuguacgcgagcgcgc

SEQ ID NO: 2119834 - RNA, 20 nt, Human
auaaauggcuuccuggcaau

SEQ ID NO: 2119835 - RNA, 20 nt, Human
uauguccuuggugccuggag

SEQ ID NO: 2119836 - RNA, 22 nt, Human
ucuacuaaaaauacaaaaaaaa

SEQ ID NO: 2119837 - RNA, 17 nt, Human
agacacacugaagaagc

SEQ ID NO: 2119838 - RNA, 17 nt, Human
uccuacaagacacagug

SEQ ID NO: 2119839 - RNA, 18 nt, Human
aguuuauauagaaaugua

SEQ ID NO: 2119840 - RNA, 16 nt, Human
cucaauaaaguacaag

SEQ ID NO: 2119841 - RNA, 12 nt, Human
guagacacacau

SEQ ID NO: 2119842 - RNA, 21 nt, Human
gcggcgggagggcgcggggcg

SEQ ID NO: 2119843 - RNA, 19 nt, Human
agucccuccccaaaugcuu

SEQ ID NO: 2119844 - RNA, 18 nt, Human
ccggggaggggcgcucgc

SEQ ID NO: 2119845 - RNA, 18 nt, Human
auccuucagccugaaaga

SEQ ID NO: 2119846 - RNA, 17 nt, Human
cuuccuaauuccacagc

SEQ ID NO: 2119847 - RNA, 18 nt, Human
ggaaagaauaaccaacac

SEQ ID NO: 2119848 - RNA, 20 nt, Human
gcuuccaggcuggcgugcag

SEQ ID NO: 2119849 - RNA, 12 nt, Human
aucuucacuuuu

SEQ ID NO: 2119850 - RNA, 13 nt, Human
gcagaacagugau

SEQ ID NO: 2119851 - RNA, 14 nt, Human
cagauccccaagcc

SEQ ID NO: 2119852 - RNA, 18 nt, Human
uaagcuucacuguaaaau

SEQ ID NO: 2119853 - RNA, 22 nt, Human
cuugaauuguaggugacuauua

SEQ ID NO: 2119854 - RNA, 22 nt, Human
caguauggcagcuuuccucaaa

SEQ ID NO: 2119855 - RNA, 14 nt, Human
gccccaucuggucc

SEQ ID NO: 2119856 - RNA, 17 nt, Human
agggcauagaaguaaaa

SEQ ID NO: 2119857 - RNA, 19 nt, Human
ccuuagcccuuccccucug

SEQ ID NO: 2119858 - RNA, 23 nt, Human
ggcuaagcuucacuguaaaauaa

SEQ ID NO: 2119859 - RNA, 18 nt, Human
ccaagcugguggcucugu

SEQ ID NO: 2119860 - RNA, 12 nt, Human
ggggcggcggcc

SEQ ID NO: 2119861 - RNA, 16 nt, Human
agugaaagaaaauaac

SEQ ID NO: 2119862 - RNA, 20 nt, Human
ccuaagucccugcugcccuu

SEQ ID NO: 2119863 - RNA, 14 nt, Human
acgcgcgcuccgcg

SEQ ID NO: 2119864 - RNA, 13 nt, Human
uuuauuauauaua

SEQ ID NO: 2119865 - RNA, 14 nt, Human
cugccccccagccc

SEQ ID NO: 2119866 - RNA, 14 nt, Human
cacccugagguugu

SEQ ID NO: 2119867 - RNA, 15 nt, Human
ccacaagaaaugaaa

SEQ ID NO: 2119868 - RNA, 19 nt, Human
uuauggcacuaguauuucu

SEQ ID NO: 2119869 - RNA, 19 nt, Human
uggagccuacuaaaugcuc

SEQ ID NO: 2119870 - RNA, 20 nt, Human
ucaagucuuucacauuuaaa

SEQ ID NO: 2119871 - RNA, 14 nt, Human
ucuuuuuuuuaaua

SEQ ID NO: 2119872 - RNA, 13 nt, Human
ccagcacagccuc

SEQ ID NO: 2119873 - RNA, 11 nt, Human
aauuccacagc

SEQ ID NO: 2119874 - RNA, 14 nt, Human
aucuaugccacaag

SEQ ID NO: 2119875 - RNA, 15 nt, Human
aguaugugcauauuu

SEQ ID NO: 2119876 - RNA, 16 nt, Human
cuucaacucccugccc

SEQ ID NO: 2119877 - RNA, 14 nt, Human
cucccucccuuggg

SEQ ID NO: 2119878 - RNA, 19 nt, Human
caauucuugccaaauauaa

SEQ ID NO: 2119879 - RNA, 20 nt, Human
accggccuuugcaccuccau

SEQ ID NO: 2119880 - RNA, 21 nt, Human
ucauucacucaacaaacauaa

SEQ ID NO: 2119881 - RNA, 19 nt, Human
aauguuuacagauccccaa

SEQ ID NO: 2119882 - RNA, 18 nt, Human
ucaaggguacacugccuu

SEQ ID NO: 2119883 - RNA, 18 nt, Human
auuauuucacuuuagaaa

SEQ ID NO: 2119884 - RNA, 19 nt, Human
ugaaauggacuuuuguaca

SEQ ID NO: 2119885 - RNA, 23 nt, Human
gcugaguguuucacaccuuaucu

SEQ ID NO: 2119886 - RNA, 18 nt, Human
uccagcuggccgggagcc

SEQ ID NO: 2119887 - RNA, 14 nt, Human
gagcccauggcacu

SEQ ID NO: 2119888 - RNA, 19 nt, Human
cugccccccagcccuccuu

SEQ ID NO: 2119889 - RNA, 14 nt, Human
uauuugcuguuauu

SEQ ID NO: 2119890 - RNA, 23 nt, Human
cuacacgagauacagaauuuuau

SEQ ID NO: 2119891 - RNA, 21 nt, Human
uagaagucacauuccugaaca

SEQ ID NO: 2119892 - RNA, 15 nt, Human
cuggguuccuuccuc

SEQ ID NO: 2119893 - RNA, 23 nt, Human
gcccuggugccucaccccuugcc

SEQ ID NO: 2119894 - RNA, 14 nt, Human
cgucccccucuggc

SEQ ID NO: 2119895 - RNA, 18 nt, Human
cugcugguggcgcuggcu

SEQ ID NO: 2119896 - RNA, 18 nt, Human
acagaaagcagaacagug

SEQ ID NO: 2119897 - RNA, 23 nt, Human
uaaguuuuuuuuuaaaaaagaaa

SEQ ID NO: 2119898 - RNA, 21 nt, Human
uuacauuuguauaaaauaauu

SEQ ID NO: 2119899 - RNA, 19 nt, Human
cugcaaagcccagcuugaa

SEQ ID NO: 2119900 - RNA, 22 nt, Human
agaagagccggagccuccagcu

SEQ ID NO: 2119901 - RNA, 19 nt, Human
uccccuauccuacuucccc

SEQ ID NO: 2119902 - RNA, 15 nt, Human
auaaauaaaaauaau

SEQ ID NO: 2119903 - RNA, 18 nt, Human
uuuauguuuaauucugaa

SEQ ID NO: 2119904 - RNA, 20 nt, Human
agggcaguguucccuggggc

SEQ ID NO: 2119905 - RNA, 22 nt, Human
ccauucuuccucccauucagga

SEQ ID NO: 2119906 - RNA, 13 nt, Human
auccuagucucua

SEQ ID NO: 2119907 - RNA, 21 nt, Human
cucagugucaaugcagccccc

SEQ ID NO: 2119908 - RNA, 20 nt, Human
uugauaaguacaugauaagc

SEQ ID NO: 2119909 - RNA, 21 nt, Human
uauaaaauaauuuuuauauuu

SEQ ID NO: 2119910 - RNA, 14 nt, Human
ggaaucuuguaaag

SEQ ID NO: 2119911 - RNA, 19 nt, Human
gaaugggggcagcaccucc

SEQ ID NO: 2119912 - RNA, 18 nt, Human
auuuaguauuuuguuuca

SEQ ID NO: 2119913 - RNA, 17 nt, Human
gaaagccaugugcagcc

SEQ ID NO: 2119914 - RNA, 21 nt, Human
cauuucuugagguaaaagcau

SEQ ID NO: 2119915 - RNA, 13 nt, Human
ccagcccuccuua

SEQ ID NO: 2119916 - RNA, 22 nt, Human
ucaacuccaaacugacucuuaa

SEQ ID NO: 2119917 - RNA, 23 nt, Human
ccgcagggugaacugcagcgagu

SEQ ID NO: 2119918 - RNA, 23 nt, Human
acugucuuguuggacgagaaaac

SEQ ID NO: 2119919 - RNA, 13 nt, Human
uggacgagaaaac

SEQ ID NO: 2119920 - RNA, 17 nt, Human
cccggccggcgcgcuca

SEQ ID NO: 2119921 - RNA, 18 nt, Human
cucuggccuucggccucc

SEQ ID NO: 2119922 - RNA, 19 nt, Human
auuuaguuauaaaaauaua

SEQ ID NO: 2119923 - RNA, 15 nt, Human
gccuugggaccccug

SEQ ID NO: 2119924 - RNA, 22 nt, Human
ggccggcgcgcucaucccaccc

SEQ ID NO: 2119925 - RNA, 20 nt, Human
uucuaggacugaauuaugaa

SEQ ID NO: 2119926 - RNA, 16 nt, Human
uagaaagccaugugca

SEQ ID NO: 2119927 - RNA, 14 nt, Human
gcgcccucuggcug

SEQ ID NO: 2119928 - RNA, 17 nt, Human
cagggcugaagcugugu

SEQ ID NO: 2119929 - RNA, 14 nt, Human
ugcagcuuccaggc

SEQ ID NO: 2119930 - RNA, 14 nt, Human
ggagccuccagcug

SEQ ID NO: 2119931 - RNA, 16 nt, Human
cucgccacgcucuggg

SEQ ID NO: 2119932 - RNA, 17 nt, Human
ccuuggugccuggagcc

SEQ ID NO: 2119933 - RNA, 22 nt, Human
cuccagccugagcgacagugag

SEQ ID NO: 2119934 - RNA, 15 nt, Human
gaaaugaaagcaggg

SEQ ID NO: 2119935 - RNA, 19 nt, Human
cuucccgcuguuccucgcc

SEQ ID NO: 2119936 - RNA, 17 nt, Human
cugagaugggagaauca

SEQ ID NO: 2119937 - RNA, 17 nt, Human
ucuuucacauuuaaaua

SEQ ID NO: 2119938 - RNA, 19 nt, Human
cuaagcuucacuguaaaau

SEQ ID NO: 2119939 - RNA, 12 nt, Human
agggauggggcu

SEQ ID NO: 2119940 - RNA, 15 nt, Human
uucugcacacagcac

SEQ ID NO: 2119941 - RNA, 16 nt, Human
cucucucauccacuuu

SEQ ID NO: 2119942 - RNA, 21 nt, Human
cucaagcuaugugagcucacc

SEQ ID NO: 2119943 - RNA, 19 nt, Human
cccccucuggcuccagcug

SEQ ID NO: 2119944 - RNA, 23 nt, Human
cccuagaaagccaugugcagcca

SEQ ID NO: 2119945 - RNA, 21 nt, Human
uuauagcuacuaauuuuaaaa

SEQ ID NO: 2119946 - RNA, 17 nt, Human
ggaaauauuuauuuuaa

SEQ ID NO: 2119947 - RNA, 12 nt, Human
agcuuggaaugu

SEQ ID NO: 2119948 - RNA, 20 nt, Human
accugauuucugagcauuua

SEQ ID NO: 2119949 - RNA, 13 nt, Human
uaauuuuuauauu

SEQ ID NO: 2119950 - RNA, 18 nt, Human
uaaaauccauacauuugu

SEQ ID NO: 2119951 - RNA, 23 nt, Human
aucuuccuauaauuuuagacauu

SEQ ID NO: 2119952 - RNA, 15 nt, Human
caggcaaauuccuga

SEQ ID NO: 2119953 - RNA, 20 nt, Human
acaaugacuuguacucugaa

SEQ ID NO: 2119954 - RNA, 17 nt, Human
caaacauauauaacaau

SEQ ID NO: 2119955 - RNA, 15 nt, Human
guaaggggaauugag

SEQ ID NO: 2119956 - RNA, 17 nt, Human
acucaccucccccaucu

SEQ ID NO: 2119957 - RNA, 22 nt, Human
cccaggcggguccgggucgcag

SEQ ID NO: 2119958 - RNA, 14 nt, Human
auuuuaucugcuau

SEQ ID NO: 2119959 - RNA, 22 nt, Human
cggagccuccagcugccccggg

SEQ ID NO: 2119960 - RNA, 21 nt, Human
auauuuccuuauucagaauuu

SEQ ID NO: 2119961 - RNA, 16 nt, Human
uuacccccugggagcc

SEQ ID NO: 2119962 - RNA, 19 nt, Human
agauuugagcucagcccug

SEQ ID NO: 2119963 - RNA, 15 nt, Human
uccucaacucugagu

SEQ ID NO: 2119964 - RNA, 16 nt, Human
aauauuuuaauguuuc

SEQ ID NO: 2119965 - RNA, 16 nt, Human
ugcaaauugucacagg

SEQ ID NO: 2119966 - RNA, 20 nt, Human
ucacuguauguccuuggugc

SEQ ID NO: 2119967 - RNA, 18 nt, Human
acagucucuugaggcaca

SEQ ID NO: 2119968 - RNA, 21 nt, Human
gaagcuagaaaacaggcaaau

SEQ ID NO: 2119969 - RNA, 17 nt, Human
gcucaccagucccuccc

SEQ ID NO: 2119970 - RNA, 18 nt, Human
uuuuaaaaaagaaacauu

SEQ ID NO: 2119971 - RNA, 14 nt, Human
guaacugauuugua

SEQ ID NO: 2119972 - RNA, 19 nt, Human
ggagggcgcggggcgggga

SEQ ID NO: 2119973 - RNA, 20 nt, Human
uaguuauaaaaauauauagc

SEQ ID NO: 2119974 - RNA, 17 nt, Human
aguugauaaguacauga

SEQ ID NO: 2119975 - RNA, 13 nt, Human
uggcuccagcugg

SEQ ID NO: 2119976 - RNA, 17 nt, Human
auaucaauuuaaaaaaa

SEQ ID NO: 2119977 - RNA, 16 nt, Human
auaacuggaaacuuca

SEQ ID NO: 2119978 - RNA, 17 nt, Human
ccucagucucccucccu

SEQ ID NO: 2119979 - RNA, 21 nt, Human
acaguuaccucugccucagaa

SEQ ID NO: 2119980 - RNA, 23 nt, Human
caacacccugagguugugugugg

SEQ ID NO: 2119981 - RNA, 19 nt, Human
gcugcugguggcgcuggcu

SEQ ID NO: 2119982 - RNA, 20 nt, Human
gacaggcacuaucuggguuu

SEQ ID NO: 2119983 - RNA, 20 nt, Human
accucugccucagaaaacaa

SEQ ID NO: 2119984 - RNA, 18 nt, Human
cagugaaagaaaauaaca

SEQ ID NO: 2119985 - RNA, 22 nt, Human
gcagagagguagggauggggcu

SEQ ID NO: 2119986 - RNA, 19 nt, Human
cuuuuggaagguauuuaau

SEQ ID NO: 2119987 - RNA, 22 nt, Human
acauuggaaacaagucagucau

SEQ ID NO: 2119988 - RNA, 11 nt, Human
caucuagugag

SEQ ID NO: 2119989 - RNA, 20 nt, Human
aucuauguagaauauauuuc

SEQ ID NO: 2119990 - RNA, 19 nt, Human
gaaaaugucauuguucuug

SEQ ID NO: 2119991 - RNA, 10 nt, Human
aaacacaugu

SEQ ID NO: 2119992 - RNA, 14 nt, Human
cggacggcuccgga

SEQ ID NO: 2119993 - RNA, 16 nt, Human
aguugaauuuuacaug

SEQ ID NO: 2119994 - RNA, 17 nt, Human
ugaacuugguuuuaauu

SEQ ID NO: 2119995 - RNA, 22 nt, Human
gggccugagaccaaggcccccg

SEQ ID NO: 2119996 - RNA, 12 nt, Human
uaguuuuuaaag

SEQ ID NO: 2119997 - RNA, 19 nt, Human
aaaguucuagugaccgaga

SEQ ID NO: 2119998 - RNA, 17 nt, Human
caauucgauccccuguc

SEQ ID NO: 2119999 - RNA, 16 nt, Human
ugacuuaaugccacua

SEQ ID NO: 2120000 - RNA, 16 nt, Human
acugauguaaguaaac

SEQ ID NO: 2120001 - RNA, 12 nt, Human
acagagacagaa

SEQ ID NO: 2120002 - RNA, 16 nt, Human
auaaugaauacuuuau

SEQ ID NO: 2120003 - RNA, 16 nt, Human
ucuugagguaaaagca

SEQ ID NO: 2120004 - RNA, 16 nt, Human
ccucaaaacuucagac

SEQ ID NO: 2120005 - RNA, 14 nt, Human
cgcuccgcgcagcu

SEQ ID NO: 2120006 - RNA, 21 nt, Human
cuccagcuggccgggagccug

SEQ ID NO: 2120007 - RNA, 14 nt, Human
ucuaggaaauauuu

SEQ ID NO: 2120008 - RNA, 14 nt, Human
ugagguugugugug

SEQ ID NO: 2120009 - RNA, 23 nt, Human
cucagcccuggugggcagagagg

SEQ ID NO: 2120010 - RNA, 15 nt, Human
gaaagaaaauaacga

SEQ ID NO: 2120011 - RNA, 20 nt, Human
cacuagacccacuggacuca

SEQ ID NO: 2120012 - RNA, 14 nt, Human
uauauauuuuagau

SEQ ID NO: 2120013 - RNA, 20 nt, Human
cgcaggaccaucccggccgg

SEQ ID NO: 2120014 - RNA, 17 nt, Human
uugugaagcaaaauuuu

SEQ ID NO: 2120015 - RNA, 17 nt, Human
uuuuauaugcuauuuau

SEQ ID NO: 2120016 - RNA, 16 nt, Human
cgcauggaaaaguuuc

SEQ ID NO: 2120017 - RNA, 20 nt, Human
agcucaggcuggcaccgcug

SEQ ID NO: 2120018 - RNA, 17 nt, Human
guugcugggggggauug

SEQ ID NO: 2120019 - RNA, 14 nt, Human
uucuggaauaaucc

SEQ ID NO: 2120020 - RNA, 14 nt, Human
ccaugaccaacauc

SEQ ID NO: 2120021 - RNA, 22 nt, Human
uccaugaguugcaguuuuuucc

SEQ ID NO: 2120022 - RNA, 20 nt, Human
gaaacgaggauugggaaaaa

SEQ ID NO: 2120023 - RNA, 14 nt, Human
uuuuauaugcuauu

SEQ ID NO: 2120024 - RNA, 18 nt, Human
uacauuuguauaaaauaa

SEQ ID NO: 2120025 - RNA, 22 nt, Human
agcuuguauuccuuuuucucuc

SEQ ID NO: 2120026 - RNA, 19 nt, Human
ugggacaggggagaaccua

SEQ ID NO: 2120027 - RNA, 16 nt, Human
agccucagucucccuc

SEQ ID NO: 2120028 - RNA, 18 nt, Human
auguuucauaagaauucu

SEQ ID NO: 2120029 - RNA, 12 nt, Human
ggcugaugcagu

SEQ ID NO: 2120030 - RNA, 20 nt, Human
uuaaugccacuaaauugaca

SEQ ID NO: 2120031 - RNA, 17 nt, Human
cccacggcuggagcugc

SEQ ID NO: 2120032 - RNA, 21 nt, Human
cugauauuggacaguaaaauc

SEQ ID NO: 2120033 - RNA, 13 nt, Human
auuauauauauuu

SEQ ID NO: 2120034 - RNA, 12 nt, Human
cuuccucugagc

SEQ ID NO: 2120035 - RNA, 24 nt, Human
ccccugagcuugcagagaugaggc

SEQ ID NO: 2120036 - RNA, 14 nt, Human
caugaacuuguaaa

SEQ ID NO: 2120037 - RNA, 16 nt, Human
agcuacaggccccauc

SEQ ID NO: 2120038 - RNA, 15 nt, Human
uggacgagaaaacaa

SEQ ID NO: 2120039 - RNA, 20 nt, Human
ccccuauccuacuuccccuu

SEQ ID NO: 2120040 - RNA, 17 nt, Human
caagaaaugaaagcagg

SEQ ID NO: 2120041 - RNA, 17 nt, Human
ugugcauauuuuauuau

SEQ ID NO: 2120042 - RNA, 21 nt, Human
ugcuggccaccugcugagccc

SEQ ID NO: 2120043 - RNA, 20 nt, Human
cucgcuuccgcauccuaguc

SEQ ID NO: 2120044 - RNA, 18 nt, Human
aguucuccacuagcuaug

SEQ ID NO: 2120045 - RNA, 23 nt, Human
gaaaaugucauuguucuugugaa

SEQ ID NO: 2120046 - RNA, 19 nt, Human
ucuucacuuuuauaagaaa

SEQ ID NO: 2120047 - RNA, 14 nt, Human
uauauuuccuuauu

SEQ ID NO: 2120048 - RNA, 17 nt, Human
augcagagguccacaac

SEQ ID NO: 2120049 - RNA, 16 nt, Human
uccucacuuugaagag

SEQ ID NO: 2120050 - RNA, 19 nt, Human
auagugaggagcuuugaaa

SEQ ID NO: 2120051 - RNA, 20 nt, Human
ccaggcggguccgggucgca

SEQ ID NO: 2120052 - RNA, 19 nt, Human
guuauuauauuuacaaaug

SEQ ID NO: 2120053 - RNA, 16 nt, Human
gcuccaagaauuucua

SEQ ID NO: 2120054 - RNA, 19 nt, Human
ucaguccaugaagauguag

SEQ ID NO: 2120055 - RNA, 15 nt, Human
ugagguaaccucauu

SEQ ID NO: 2120056 - RNA, 20 nt, Human
aacaagccuccuuuuaaagu

SEQ ID NO: 2120057 - RNA, 21 nt, Human
ccaaggaugccccgucccccu

SEQ ID NO: 2120058 - RNA, 19 nt, Human
auuuugugaagcaaaauuu

SEQ ID NO: 2120059 - RNA, 17 nt, Human
auuucuaaaaguuuaag

SEQ ID NO: 2120060 - RNA, 19 nt, Human
uggugagugccuguaauca

SEQ ID NO: 2120061 - RNA, 14 nt, Human
ucuauaauuuaaau

SEQ ID NO: 2120062 - RNA, 23 nt, Human
auucaauaucuuuuuuuuaauaa

SEQ ID NO: 2120063 - RNA, 17 nt, Human
ucgggauuaguacacac

SEQ ID NO: 2120064 - RNA, 19 nt, Human
gcacuaguauuucuaugaa

SEQ ID NO: 2120065 - RNA, 13 nt, Human
gggaggggcgcuc

SEQ ID NO: 2120066 - RNA, 19 nt, Human
ucaauucuugccaaauaua

SEQ ID NO: 2120067 - RNA, 16 nt, Human
ucccugccccccagcc

SEQ ID NO: 2120068 - RNA, 14 nt, Human
cucgcccacuuccu

SEQ ID NO: 2120069 - RNA, 15 nt, Human
ccagauccuggaaau

SEQ ID NO: 2120070 - RNA, 16 nt, Human
aggacugaauuaugaa

SEQ ID NO: 2120071 - RNA, 23 nt, Human
uagacacacaugaaguccaagca

SEQ ID NO: 2120072 - RNA, 21 nt, Human
cugagccucagucucccuccc

SEQ ID NO: 2120073 - RNA, 16 nt, Human
agaugcuagaacuccc

SEQ ID NO: 2120074 - RNA, 21 nt, Human
cucuucuggguuccuuccucu

SEQ ID NO: 2120075 - RNA, 14 nt, Human
ccacuggacucacc

SEQ ID NO: 2120076 - RNA, 14 nt, Human
cccggccggcgcgc

SEQ ID NO: 2120077 - RNA, 17 nt, Human
agcugccccggggaggg

SEQ ID NO: 2120078 - RNA, 18 nt, Human
cauagguuuaauaauuuu

SEQ ID NO: 2120079 - RNA, 14 nt, Human
auccuugaagauuu

SEQ ID NO: 2120080 - RNA, 23 nt, Human
uguucuugugaacccaaagugug

SEQ ID NO: 2120081 - RNA, 15 nt, Human
aaaaacguauugcau

SEQ ID NO: 2120082 - RNA, 17 nt, Human
cccacuggacucaccuc

SEQ ID NO: 2120083 - RNA, 14 nt, Human
cucugccucagaaa

SEQ ID NO: 2120084 - RNA, 20 nt, Human
guaucaaaagaaagaaaauc

SEQ ID NO: 2120085 - RNA, 12 nt, Human
agugcagccccg

SEQ ID NO: 2120086 - RNA, 16 nt, Human
guuaucuucacuuuua

SEQ ID NO: 2120087 - RNA, 14 nt, Human
cacuuauaggaauu

SEQ ID NO: 2120088 - RNA, 15 nt, Human
gaucuggcucuggac

SEQ ID NO: 2120089 - RNA, 22 nt, Human
ccaaacauccuacaagacacag

SEQ ID NO: 2120090 - RNA, 22 nt, Human
uuuauaagaaauaggaaauauu

SEQ ID NO: 2120091 - RNA, 21 nt, Human
agucacuaguuguaauuuuuu

SEQ ID NO: 2120092 - RNA, 20 nt, Human
auccucgaggcccuagcauu

SEQ ID NO: 2120093 - RNA, 17 nt, Human
ucuuuaucuuuuuagua

SEQ ID NO: 2120094 - RNA, 19 nt, Human
gucaaauugugugaaaggu

SEQ ID NO: 2120095 - RNA, 22 nt, Human
ugaguguugccuaauuuguuuu

SEQ ID NO: 2120096 - RNA, 13 nt, Human
uccuacuuccccu

SEQ ID NO: 2120097 - RNA, 16 nt, Human
agugaaauauuauuuu

SEQ ID NO: 2120098 - RNA, 23 nt, Human
aggcuuuaaaacuuauccuccau

SEQ ID NO: 2120099 - RNA, 20 nt, Human
cuggccaccugcugagcccc

SEQ ID NO: 2120100 - RNA, 23 nt, Human
uaacgauaaaagacagugaaaga

SEQ ID NO: 2120101 - RNA, 18 nt, Human
ccugucacgugugggcaa

SEQ ID NO: 2120102 - RNA, 20 nt, Human
cccuuccuaauuccacagcu

SEQ ID NO: 2120103 - RNA, 21 nt, Human
cagagguccacaacacacaga

SEQ ID NO: 2120104 - RNA, 13 nt, Human
ugggcauucaaau

SEQ ID NO: 2120105 - RNA, 22 nt, Human
ugaauuguaggugacuauuaua

SEQ ID NO: 2120106 - RNA, 16 nt, Human
auuuguauaaaauaau

SEQ ID NO: 2120107 - RNA, 16 nt, Human
guccauugggcaggca

SEQ ID NO: 2120108 - RNA, 13 nt, Human
ucaucccacccgc

SEQ ID NO: 2120109 - RNA, 18 nt, Human
agcauuguuggcuguucc

SEQ ID NO: 2120110 - RNA, 18 nt, Human
ggaggacgcucucuggcc

SEQ ID NO: 2120111 - RNA, 22 nt, Human
uacugagagugaacaaauuuac

SEQ ID NO: 2120112 - RNA, 23 nt, Human
aaccugccagcuggccuugugag

SEQ ID NO: 2120113 - RNA, 15 nt, Human
gugggccugagacca

SEQ ID NO: 2120114 - RNA, 13 nt, Human
cgggaggcagagg

SEQ ID NO: 2120115 - RNA, 14 nt, Human
cggggaggggcgcu

SEQ ID NO: 2120116 - RNA, 20 nt, Human
gaaaauaacgauaaaagaca

SEQ ID NO: 2120117 - RNA, 20 nt, Human
uagcauuuguguugaagagg

SEQ ID NO: 2120118 - RNA, 16 nt, Human
acauccuacaagacac

SEQ ID NO: 2120119 - RNA, 22 nt, Human
cccaugauguuuagaaacacaa

SEQ ID NO: 2120120 - RNA, 20 nt, Human
gcccauccugccccugagcc

SEQ ID NO: 2120121 - RNA, 12 nt, Human
guccccagagcu

SEQ ID NO: 2120122 - RNA, 20 nt, Human
agccgguccuugcugcaccu

SEQ ID NO: 2120123 - RNA, 11 nt, Human
ucaccuccccc

SEQ ID NO: 2120124 - RNA, 15 nt, Human
aaaaguugaauuuua

SEQ ID NO: 2120125 - RNA, 14 nt, Human
agagacagaaagca

SEQ ID NO: 2120126 - RNA, 20 nt, Human
ucuguuuucccuccuuggag

SEQ ID NO: 2120127 - RNA, 15 nt, Human
aaaaaauaacaauga

SEQ ID NO: 2120128 - RNA, 20 nt, Human
caagcucuaucaccaaggag

SEQ ID NO: 2120129 - RNA, 17 nt, Human
aaucuuucacaggggac

SEQ ID NO: 2120130 - RNA, 19 nt, Human
guaguccuguaauggaagc

SEQ ID NO: 2120131 - RNA, 17 nt, Human
ugaucaccugcccugcu

SEQ ID NO: 2120132 - RNA, 16 nt, Human
auuuuaauaauguuuc

SEQ ID NO: 2120133 - RNA, 16 nt, Human
cagaagcaacccaaau

SEQ ID NO: 2120134 - RNA, 23 nt, Human
caucaacagauaaauaguuuaug

SEQ ID NO: 2120135 - RNA, 22 nt, Human
gcggggagcgagccccaggcgg

SEQ ID NO: 2120136 - RNA, 21 nt, Human
cccuagaaagccaugugcagc

SEQ ID NO: 2120137 - RNA, 13 nt, Human
ccaaaagguauuu

SEQ ID NO: 2120138 - RNA, 14 nt, Human
uaaaggaauuuaaa

SEQ ID NO: 2120139 - RNA, 13 nt, Human
guaacuaauuuua

SEQ ID NO: 2120140 - RNA, 21 nt, Human
uccuucagccugaaagaggaa

SEQ ID NO: 2120141 - RNA, 19 nt, Human
aagucagucauucagauau

SEQ ID NO: 2120142 - RNA, 19 nt, Human
ccuccagggagucucagcu

SEQ ID NO: 2120143 - RNA, 15 nt, Human
cagugaaagaaaaua

SEQ ID NO: 2120144 - RNA, 18 nt, Human
cuggguuaggccuugccu

SEQ ID NO: 2120145 - RNA, 22 nt, Human
ugguccuaagucccugcugccc

SEQ ID NO: 2120146 - RNA, 19 nt, Human
uuguacucugaaaguuuug

SEQ ID NO: 2120147 - RNA, 22 nt, Human
cgggucgcaggaccaucccggc

SEQ ID NO: 2120148 - RNA, 15 nt, Human
agggaagacaagaag

SEQ ID NO: 2120149 - RNA, 14 nt, Human
cuguaaucacagcu

SEQ ID NO: 2120150 - RNA, 13 nt, Human
uaggacugaauua

SEQ ID NO: 2120151 - RNA, 23 nt, Human
uugacccucacaggagcaucucc

SEQ ID NO: 2120152 - RNA, 16 nt, Human
cugcgcgccgcgcucc

SEQ ID NO: 2120153 - RNA, 13 nt, Human
agacacagugacc

SEQ ID NO: 2120154 - RNA, 16 nt, Human
ggcuaauaucuuaucu

SEQ ID NO: 2120155 - RNA, 14 nt, Human
cuccagugagacag

SEQ ID NO: 2120156 - RNA, 15 nt, Human
aucaguaugaaaaug

SEQ ID NO: 2120157 - RNA, 21 nt, Human
auacauaaaguaugugcauau

SEQ ID NO: 2120158 - RNA, 23 nt, Human
cucuugaggcacagaaacuccug

SEQ ID NO: 2120159 - RNA, 11 nt, Human
ucaccugcccu

SEQ ID NO: 2120160 - RNA, 12 nt, Human
cagaacagugau

SEQ ID NO: 2120161 - RNA, 22 nt, Human
ucauucccguugaacgucacau

SEQ ID NO: 2120162 - RNA, 14 nt, Human
gaaaaaauaacaau

SEQ ID NO: 2120163 - RNA, 19 nt, Human
auaaaagacaaggaaaaaa

SEQ ID NO: 2120164 - RNA, 19 nt, Human
gagguacugagagugaaca

SEQ ID NO: 2120165 - RNA, 21 nt, Human
cuuucaugaaggggcggcggc

SEQ ID NO: 2120166 - RNA, 15 nt, Human
cccggccggcgcgcu

SEQ ID NO: 2120167 - RNA, 20 nt, Human
ccauuguggucacaggaagu

SEQ ID NO: 2120168 - RNA, 23 nt, Human
acuuauuguagcauccuggaaua

SEQ ID NO: 2120169 - RNA, 17 nt, Human
uuucacauuuaaauaaa

SEQ ID NO: 2120170 - RNA, 15 nt, Human
augauaacuggaaac

SEQ ID NO: 2120171 - RNA, 14 nt, Human
gacaagaaggaaag

SEQ ID NO: 2120172 - RNA, 15 nt, Human
uguauuuuaaaagaa

SEQ ID NO: 2120173 - RNA, 14 nt, Human
uuucuaugaaauau

SEQ ID NO: 2120174 - RNA, 20 nt, Human
ugauuauaugucacuuugcu

SEQ ID NO: 2120175 - RNA, 20 nt, Human
gagccugaucaccugcccug

SEQ ID NO: 2120176 - RNA, 14 nt, Human
cauuaaaguucuag

SEQ ID NO: 2120177 - RNA, 19 nt, Human
ccgcagggugaacugcagc

SEQ ID NO: 2120178 - RNA, 13 nt, Human
uguuuucccuccu

SEQ ID NO: 2120179 - RNA, 17 nt, Human
uaaaagacagugaaaga

SEQ ID NO: 2120180 - RNA, 14 nt, Human
uacccccugggagc

SEQ ID NO: 2120181 - RNA, 21 nt, Human
ccccugcaaagcccagcuuga

SEQ ID NO: 2120182 - RNA, 18 nt, Human
ugaagaagcuagaaaaca

SEQ ID NO: 2120183 - RNA, 16 nt, Human
accuguucgcgcgccu

SEQ ID NO: 2120184 - RNA, 18 nt, Human
ugcuauuuauuaaguauu

SEQ ID NO: 2120185 - RNA, 16 nt, Human
cuggaugcucucguug

SEQ ID NO: 2120186 - RNA, 15 nt, Human
cuucucuucacaguc

SEQ ID NO: 2120187 - RNA, 21 nt, Human
ccuuuuuuugaaaaaaagcuu

SEQ ID NO: 2120188 - RNA, 15 nt, Human
agccgggaaagaaga

SEQ ID NO: 2120189 - RNA, 20 nt, Human
gcuugcagagaugaggccgc

SEQ ID NO: 2120190 - RNA, 19 nt, Human
uauacugugugcuaaaaca

SEQ ID NO: 2120191 - RNA, 19 nt, Human
ugaaauuguauuacaaauc

SEQ ID NO: 2120192 - RNA, 17 nt, Human
gacagucaccucaugga

SEQ ID NO: 2120193 - RNA, 23 nt, Human
cuugauaaauggcuuccuggcaa

SEQ ID NO: 2120194 - RNA, 14 nt, Human
cccugccccccagc

SEQ ID NO: 2120195 - RNA, 18 nt, Human
uucucuaggaaauauuua

SEQ ID NO: 2120196 - RNA, 16 nt, Human
ugaagauacugaaaua

SEQ ID NO: 2120197 - RNA, 14 nt, Human
cuacaagacacagu

SEQ ID NO: 2120198 - RNA, 19 nt, Human
cuguccauucuuccuccca

SEQ ID NO: 2120199 - RNA, 16 nt, Human
caggcugagccucagu

SEQ ID NO: 2120200 - RNA, 11 nt, Human
augggacaggg

SEQ ID NO: 2120201 - RNA, 12 nt, Human
ucuacacuccag

SEQ ID NO: 2120202 - RNA, 22 nt, Human
aggauggcuaguaucaaaagaa

SEQ ID NO: 2120203 - RNA, 22 nt, Human
auuacuguaagaaaauaucacu

SEQ ID NO: 2120204 - RNA, 18 nt, Human
acaaauccaaugaaauga

SEQ ID NO: 2120205 - RNA, 22 nt, Human
cuuuccacagaagcuccaggua

SEQ ID NO: 2120206 - RNA, 15 nt, Human
uuggggaauauguua

SEQ ID NO: 2120207 - RNA, 19 nt, Human
agaugagagaacagggcug

SEQ ID NO: 2120208 - RNA, 19 nt, Human
acggagccgggaaagaaga

SEQ ID NO: 2120209 - RNA, 18 nt, Human
gaauaauccuaaacauau

SEQ ID NO: 2120210 - RNA, 23 nt, Human
cucuacuaaaaauacaaaaaaaa

SEQ ID NO: 2120211 - RNA, 21 nt, Human
uggaaacguauucaaacaauu

SEQ ID NO: 2120212 - RNA, 16 nt, Human
uauuuuugugauuuug

SEQ ID NO: 2120213 - RNA, 14 nt, Human
uucagccugaaaga

SEQ ID NO: 2120214 - RNA, 17 nt, Human
cuagaaaacaggcaaau

SEQ ID NO: 2120215 - RNA, 22 nt, Human
gaagugaaaaucuacacuccag

SEQ ID NO: 2120216 - RNA, 23 nt, Human
aucgcagacacaugugcuggcca

SEQ ID NO: 2120217 - RNA, 21 nt, Human
ucuuauaucuauauuuuacau

SEQ ID NO: 2120218 - RNA, 23 nt, Human
aucuaugccacaagaacccccuu

SEQ ID NO: 2120219 - RNA, 14 nt, Human
gaucuaugccacaa

SEQ ID NO: 2120220 - RNA, 14 nt, Human
aauauuuauuuuaa

SEQ ID NO: 2120221 - RNA, 12 nt, Human
uuuugaaaccaa

SEQ ID NO: 2120222 - RNA, 20 nt, Human
aaagagugaaggauuuaugu

SEQ ID NO: 2120223 - RNA, 18 nt, Human
aaauauaaauaaaaauaa

SEQ ID NO: 2120224 - RNA, 22 nt, Human
ccgggagccugaucaccugccc

SEQ ID NO: 2120225 - RNA, 18 nt, Human
ucaccagucccuccccaa

SEQ ID NO: 2120226 - RNA, 15 nt, Human
ucucagaaggaaaga

SEQ ID NO: 2120227 - RNA, 14 nt, Human
uugacccacaagaa

SEQ ID NO: 2120228 - RNA, 16 nt, Human
uaaauaaaaauaaucc

SEQ ID NO: 2120229 - RNA, 22 nt, Human
gaaaacaauaacgauaaaagac

SEQ ID NO: 2120230 - RNA, 15 nt, Human
cagugucugcuggag

SEQ ID NO: 2120231 - RNA, 18 nt, Human
aucuacacuccagugaga

SEQ ID NO: 2120232 - RNA, 14 nt, Human
uuccccucugcagc

SEQ ID NO: 2120233 - RNA, 17 nt, Human
ucuuauaauuuaaaaua

SEQ ID NO: 2120234 - RNA, 21 nt, Human
auguuuaauucugaaagcaac

SEQ ID NO: 2120235 - RNA, 21 nt, Human
gcagcauuguuggcuguuccu

SEQ ID NO: 2120236 - RNA, 18 nt, Human
cuggaaacuucagcgguu

SEQ ID NO: 2120237 - RNA, 17 nt, Human
ugcccacggcuggagcu

SEQ ID NO: 2120238 - RNA, 12 nt, Human
cucccugccccc

SEQ ID NO: 2120239 - RNA, 19 nt, Human
ucagugucaaugcagcccc

SEQ ID NO: 2120240 - RNA, 14 nt, Human
agcaaguauuagaa

SEQ ID NO: 2120241 - RNA, 21 nt, Human
guauacugugugcuaaaacaa

SEQ ID NO: 2120242 - RNA, 21 nt, Human
uccuacaagacacagugacca

SEQ ID NO: 2120243 - RNA, 22 nt, Human
ccagcuggccuugugaggagcu

SEQ ID NO: 2120244 - RNA, 17 nt, Human
cucagucucccucccuu

SEQ ID NO: 2120245 - RNA, 23 nt, Human
uccacaaguaaaaggaaaugcuc

SEQ ID NO: 2120246 - RNA, 19 nt, Human
gcccuuccccucugcagcu

SEQ ID NO: 2120247 - RNA, 21 nt, Human
cugguagcuaaauauauauuu

SEQ ID NO: 2120248 - RNA, 16 nt, Human
gcagcucaggcuggca

SEQ ID NO: 2120249 - RNA, 18 nt, Human
acuuuaugcuaagugaaa

SEQ ID NO: 2120250 - RNA, 14 nt, Human
uaguuucccuugca

SEQ ID NO: 2120251 - RNA, 22 nt, Human
gccccggggaggggcgcucgcu

SEQ ID NO: 2120252 - RNA, 16 nt, Human
acuuuuauaagaaaua

SEQ ID NO: 2120253 - RNA, 22 nt, Human
cucagcuucacccugaggugag

SEQ ID NO: 2120254 - RNA, 12 nt, Human
acucccugcccc

SEQ ID NO: 2120255 - RNA, 15 nt, Human
gcaagcucuaucacc

SEQ ID NO: 2120256 - RNA, 14 nt, Human
gcuccgcgcagcuc

SEQ ID NO: 2120257 - RNA, 15 nt, Human
cucauccacuuucca

SEQ ID NO: 2120258 - RNA, 20 nt, Human
cuuccucccauucaggaugc

SEQ ID NO: 2120259 - RNA, 19 nt, Human
ggcgggagggcgcggggcg

SEQ ID NO: 2120260 - RNA, 18 nt, Human
aucagcaucccuagaaag

SEQ ID NO: 2120261 - RNA, 22 nt, Human
ggaaaugauguuucauaagaau

SEQ ID NO: 2120262 - RNA, 21 nt, Human
ugggaggcugagaugggagaa

SEQ ID NO: 2120263 - RNA, 18 nt, Human
cuccgucaacucauauuu

SEQ ID NO: 2120264 - RNA, 18 nt, Human
cccaggcugagccucagu

SEQ ID NO: 2120265 - RNA, 21 nt, Human
aauauauuuccuuauucagaa

SEQ ID NO: 2120266 - RNA, 17 nt, Human
uuuccugggagcuuuug

SEQ ID NO: 2120267 - RNA, 17 nt, Human
cuaccuguucgcgcgcc

SEQ ID NO: 2120268 - RNA, 20 nt, Human
aauucugguagcuaaauaua

SEQ ID NO: 2120269 - RNA, 18 nt, Human
uaaauguuguuuuaggaa

SEQ ID NO: 2120270 - RNA, 13 nt, Human
uuccuucugcucc

SEQ ID NO: 2120271 - RNA, 17 nt, Human
uuccaagccucaugucc

SEQ ID NO: 2120272 - RNA, 17 nt, Human
agggagucucagcuuca

SEQ ID NO: 2120273 - RNA, 23 nt, Human
cacuggacucaccucccccaucu

SEQ ID NO: 2120274 - RNA, 15 nt, Human
cuuuaaaacuuaucc

SEQ ID NO: 2120275 - RNA, 20 nt, Human
ccagcuggccgggagccuga

SEQ ID NO: 2120276 - RNA, 18 nt, Human
cuccagccugagcgacag

SEQ ID NO: 2120277 - RNA, 23 nt, Human
cacaagaaaugaaagcagggacu

SEQ ID NO: 2120278 - RNA, 16 nt, Human
acaugugcuggccacc

SEQ ID NO: 2120279 - RNA, 22 nt, Human
ucucagcuucacccugagguga

SEQ ID NO: 2120280 - RNA, 17 nt, Human
uuagauagaugaagaag

SEQ ID NO: 2120281 - RNA, 19 nt, Human
ucuuaucuuccuauaauuu

SEQ ID NO: 2120282 - RNA, 17 nt, Human
agucuucagcagagaag

SEQ ID NO: 2120283 - RNA, 18 nt, Human
acacuguccauucuuccu

SEQ ID NO: 2120284 - RNA, 22 nt, Human
auauauaacaaugcuguauuuu

SEQ ID NO: 2120285 - RNA, 15 nt, Human
auccugccccugagc

SEQ ID NO: 2120286 - RNA, 18 nt, Human
gacccacuggacucaccu

SEQ ID NO: 2120287 - RNA, 17 nt, Human
cacaccaaccuucugag

SEQ ID NO: 2120288 - RNA, 19 nt, Human
augaaguacucauacaugu

SEQ ID NO: 2120289 - RNA, 16 nt, Human
aauauaaauaaaaaua

SEQ ID NO: 2120290 - RNA, 13 nt, Human
ucacuguaaaaua

SEQ ID NO: 2120291 - RNA, 12 nt, Human
gcgagccccagg

SEQ ID NO: 2120292 - RNA, 19 nt, Human
ugaacaaauuuacagagac

SEQ ID NO: 2120293 - RNA, 20 nt, Human
uuagcauaguaccucugcua

SEQ ID NO: 2120294 - RNA, 16 nt, Human
gccucagucucccucc

SEQ ID NO: 2120295 - RNA, 22 nt, Human
ugucucuacuaaaaauacaaaa

SEQ ID NO: 2120296 - RNA, 18 nt, Human
uauguuagagaauuuccu

SEQ ID NO: 2120297 - RNA, 15 nt, Human
uguuaucuucacuuu

SEQ ID NO: 2120298 - RNA, 17 nt, Human
caaauauaaauaaaaau

SEQ ID NO: 2120299 - RNA, 18 nt, Human
gaugcaguucugaagaag

SEQ ID NO: 2120300 - RNA, 17 nt, Human
uauauuuccaagaaaua

SEQ ID NO: 2120301 - RNA, 19 nt, Human
cagauucuuuacccccugg

SEQ ID NO: 2120302 - RNA, 22 nt, Human
gcugccucucucauccacuuuc

SEQ ID NO: 2120303 - RNA, 20 nt, Human
acuauagugugagccaggaa

SEQ ID NO: 2120304 - RNA, 15 nt, Human
uggagcuagaauuug

SEQ ID NO: 2120305 - RNA, 14 nt, Human
uggacucaccuccc

SEQ ID NO: 2120306 - RNA, 13 nt, Human
uauuucuaugaaa

SEQ ID NO: 2120307 - RNA, 15 nt, Human
cagaauucauucacu

SEQ ID NO: 2120308 - RNA, 16 nt, Human
cuaagucccugcugcc

SEQ ID NO: 2120309 - RNA, 19 nt, Human
cagcacgggggccaaggau

SEQ ID NO: 2120310 - RNA, 22 nt, Human
cccccugcaaagcccagcuuga

SEQ ID NO: 2120311 - RNA, 16 nt, Human
uagcuacuaauuuuaa

SEQ ID NO: 2120312 - RNA, 21 nt, Human
ccuggugccucaccccuugcc

SEQ ID NO: 2120313 - RNA, 17 nt, Human
agcucugcccauccugc

SEQ ID NO: 2120314 - RNA, 15 nt, Human
ugagcgcccacuaga

SEQ ID NO: 2120315 - RNA, 19 nt, Human
cuuggggccuaugcagagg

SEQ ID NO: 2120316 - RNA, 21 nt, Human
cagcccuuagcccuuccccuc

SEQ ID NO: 2120317 - RNA, 20 nt, Human
ucucguugacccucacagga

SEQ ID NO: 2120318 - RNA, 19 nt, Human
ugagucccaggcugagccu

SEQ ID NO: 2120319 - RNA, 22 nt, Human
agucccugcugcccuuccccuu

SEQ ID NO: 2120320 - RNA, 20 nt, Human
accuacacgagauacagaau

SEQ ID NO: 2120321 - RNA, 18 nt, Human
uaaauugacacuuaaaaa

SEQ ID NO: 2120322 - RNA, 21 nt, Human
aaagcugaaauggacuuuugu

SEQ ID NO: 2120323 - RNA, 13 nt, Human
gccguccccagag

SEQ ID NO: 2120324 - RNA, 14 nt, Human
cagagguugcagug

SEQ ID NO: 2120325 - RNA, 16 nt, Human
uaggauguugaaaaag

SEQ ID NO: 2120326 - RNA, 20 nt, Human
ccucaagcuaugugagcuca

SEQ ID NO: 2120327 - RNA, 12 nt, Human
aagaaaauaacg

SEQ ID NO: 2120328 - RNA, 16 nt, Human
cugugccguccccaga

SEQ ID NO: 2120329 - RNA, 16 nt, Human
gucucucacuuguuuu

SEQ ID NO: 2120330 - RNA, 18 nt, Human
aaaucuuauaauuuaaaa

SEQ ID NO: 2120331 - RNA, 19 nt, Human
acuucagcgguuuauauaa

SEQ ID NO: 2120332 - RNA, 17 nt, Human
acuauuuaauuauuuca

SEQ ID NO: 2120333 - RNA, 16 nt, Human
aaagacaaggaaaaaa

SEQ ID NO: 2120334 - RNA, 19 nt, Human
uuuccugaaaacccuugcc

SEQ ID NO: 2120335 - RNA, 15 nt, Human
cuuccucccggccgc

SEQ ID NO: 2120336 - RNA, 16 nt, Human
cggggagcgagcccca

SEQ ID NO: 2120337 - RNA, 16 nt, Human
ggccuccauccugagg

SEQ ID NO: 2120338 - RNA, 23 nt, Human
cacagaaacuccuguucaugccc

SEQ ID NO: 2120339 - RNA, 14 nt, Human
ugaggcuuuaaaac

SEQ ID NO: 2120340 - RNA, 15 nt, Human
aauuuaucauuuagu

SEQ ID NO: 2120341 - RNA, 21 nt, Human
uauacugugugcuaaaacaag

SEQ ID NO: 2120342 - RNA, 14 nt, Human
ggccacaucugagc

SEQ ID NO: 2120343 - RNA, 17 nt, Human
accugagccccaaaagg

SEQ ID NO: 2120344 - RNA, 20 nt, Human
uuucuuccuggauuccucac

SEQ ID NO: 2120345 - RNA, 16 nt, Human
aagaagcuagaaaaca

SEQ ID NO: 2120346 - RNA, 18 nt, Human
auauuuuuuucugaaauu

SEQ ID NO: 2120347 - RNA, 21 nt, Human
agccgguccuugcugcaccug

SEQ ID NO: 2120348 - RNA, 15 nt, Human
ccccugagcuugcag

SEQ ID NO: 2120349 - RNA, 14 nt, Human
cucccugcccccca

SEQ ID NO: 2120350 - RNA, 16 nt, Human
cugcucucaguucacu

SEQ ID NO: 2120351 - RNA, 19 nt, Human
auuggagcucgugggacag

SEQ ID NO: 2120352 - RNA, 20 nt, Human
gcucgcccacuuccucccgg

SEQ ID NO: 2120353 - RNA, 17 nt, Human
gccaugggacagggagg

SEQ ID NO: 2120354 - RNA, 17 nt, Human
aggcuagaaccaccugc

SEQ ID NO: 2120355 - RNA, 16 nt, Human
guucugcacacagcac

SEQ ID NO: 2120356 - RNA, 22 nt, Human
uuuaauaauguuucaaacauau

SEQ ID NO: 2120357 - RNA, 16 nt, Human
cagucucccucccuug

SEQ ID NO: 2120358 - RNA, 14 nt, Human
caaggaaaaaauaa

SEQ ID NO: 2120359 - RNA, 16 nt, Human
accucugccucagaaa

SEQ ID NO: 2120360 - RNA, 18 nt, Human
gccugagcgacagugaga

SEQ ID NO: 2120361 - RNA, 17 nt, Human
uuauaucaauuuaaaaa

SEQ ID NO: 2120362 - RNA, 13 nt, Human
ccugccccccagc

SEQ ID NO: 2120363 - RNA, 13 nt, Human
cacacugaagaag

SEQ ID NO: 2120364 - RNA, 15 nt, Human
ccacaggaaccacaa

SEQ ID NO: 2120365 - RNA, 22 nt, Human
accaaucaugaauuaguuuuau

SEQ ID NO: 2120366 - RNA, 13 nt, Human
ucuaagaagugaa

SEQ ID NO: 2120367 - RNA, 12 nt, Human
gcugaugcaguu

SEQ ID NO: 2120368 - RNA, 18 nt, Human
uuggggccuaugcagagg

SEQ ID NO: 2120369 - RNA, 15 nt, Human
gcccacuagacccac

SEQ ID NO: 2120370 - RNA, 16 nt, Human
gcugcugguggcgcug

SEQ ID NO: 2120371 - RNA, 20 nt, Human
cuuccaggcuggcgugcagc

SEQ ID NO: 2120372 - RNA, 19 nt, Human
uggaacaguuaccucugcc

SEQ ID NO: 2120373 - RNA, 16 nt, Human
auaucuauauuuuaca

SEQ ID NO: 2120374 - RNA, 20 nt, Human
aaauaauuuuuauauuugaa

SEQ ID NO: 2120375 - RNA, 15 nt, Human
cuaucuuugagcgcc

SEQ ID NO: 2120376 - RNA, 14 nt, Human
ccagcuggccggga

SEQ ID NO: 2120377 - RNA, 22 nt, Human
gcuugcagagaugaggccgcca

SEQ ID NO: 2120378 - RNA, 23 nt, Human
gcuguggauuuaauguggaaaug

SEQ ID NO: 2120379 - RNA, 19 nt, Human
auuuucaugcuguucauga

SEQ ID NO: 2120380 - RNA, 14 nt, Human
ggagcaucuccuca

SEQ ID NO: 2120381 - RNA, 19 nt, Human
cuaccuguucgcgcgccuc

SEQ ID NO: 2120382 - RNA, 14 nt, Human
uccacaacacacag

SEQ ID NO: 2120383 - RNA, 12 nt, Human
cauguuccccuu

SEQ ID NO: 2120384 - RNA, 20 nt, Human
guauuuaauagguuuggaca

SEQ ID NO: 2120385 - RNA, 16 nt, Human
aaguaaaggcaaacuu

SEQ ID NO: 2120386 - RNA, 20 nt, Human
cucuguucugcacacagcac

SEQ ID NO: 2120387 - RNA, 18 nt, Human
ccaaccuucugaggagcu

SEQ ID NO: 2120388 - RNA, 23 nt, Human
ugaauuauguuugcauguucacu

SEQ ID NO: 2120389 - RNA, 19 nt, Human
ggaaaaaauaacaaugaaa

SEQ ID NO: 2120390 - RNA, 19 nt, Human
cauuguugucugcaacucu

SEQ ID NO: 2120391 - RNA, 15 nt, Human
aucuuuaacccacua

SEQ ID NO: 2120392 - RNA, 18 nt, Human
cagucucccucccuuggg

SEQ ID NO: 2120393 - RNA, 17 nt, Human
ccaccugcugagcccca

SEQ ID NO: 2120394 - RNA, 22 nt, Human
agcuguguccucaugagggcug

SEQ ID NO: 2120395 - RNA, 13 nt, Human
gcggccuggucua

SEQ ID NO: 2120396 - RNA, 17 nt, Human
ucucuggccuucggccu

SEQ ID NO: 2120397 - RNA, 16 nt, Human
aauuuaguauuuuguu

SEQ ID NO: 2120398 - RNA, 18 nt, Human
uguaaaggaauuuaaaaa

SEQ ID NO: 2120399 - RNA, 14 nt, Human
guaacuaauuuuaa

SEQ ID NO: 2120400 - RNA, 12 nt, Human
agaauauauuuc

SEQ ID NO: 2120401 - RNA, 16 nt, Human
uggcgcuggcugcgcu

SEQ ID NO: 2120402 - RNA, 16 nt, Human
ccagucccuccccaaa

SEQ ID NO: 2120403 - RNA, 14 nt, Human
uauuuauuuuaaua

SEQ ID NO: 2120404 - RNA, 22 nt, Human
caagcucuaucaccaaggagcc

SEQ ID NO: 2120405 - RNA, 15 nt, Human
acaaggaaaaaauaa

SEQ ID NO: 2120406 - RNA, 21 nt, Human
aauuccugacugcuaguuuau

SEQ ID NO: 2120407 - RNA, 19 nt, Human
aacaguuguguuugaagca

SEQ ID NO: 2120408 - RNA, 15 nt, Human
cgcgcugcgcgccgc

SEQ ID NO: 2120409 - RNA, 13 nt, Human
uccccaaaugcuu

SEQ ID NO: 2120410 - RNA, 17 nt, Human
ugaaaaucuuauaauuu

SEQ ID NO: 2120411 - RNA, 16 nt, Human
uucucuaggaaauauu

SEQ ID NO: 2120412 - RNA, 15 nt, Human
guucugcagauaaac

SEQ ID NO: 2120413 - RNA, 15 nt, Human
augguuguauuauuu

SEQ ID NO: 2120414 - RNA, 19 nt, Human
caucaaggguacacugccu

SEQ ID NO: 2120415 - RNA, 22 nt, Human
ggcagcuuuccucaaaacuuca

SEQ ID NO: 2120416 - RNA, 11 nt, Human
agugucugcug

SEQ ID NO: 2120417 - RNA, 13 nt, Human
cugagagugaaca

SEQ ID NO: 2120418 - RNA, 15 nt, Human
uuauuuuuaaacugu

SEQ ID NO: 2120419 - RNA, 22 nt, Human
aaagggcauggguuuuauuaua

SEQ ID NO: 2120420 - RNA, 23 nt, Human
aauauuuauuuuaauaauguuuc

SEQ ID NO: 2120421 - RNA, 14 nt, Human
cagagaaguuuucu

SEQ ID NO: 2120422 - RNA, 16 nt, Human
gccuaagugcagcccc

SEQ ID NO: 2120423 - RNA, 17 nt, Human
uaacugauuuguaacaa

SEQ ID NO: 2120424 - RNA, 18 nt, Human
uaauaauguuucaaacau

SEQ ID NO: 2120425 - RNA, 16 nt, Human
uaaaggaauuuaaaaa

SEQ ID NO: 2120426 - RNA, 18 nt, Human
cccacuagacccacugga

SEQ ID NO: 2120427 - RNA, 23 nt, Human
uuguaacaagccuccuuuuaaag

SEQ ID NO: 2120428 - RNA, 22 nt, Human
cugcuggagacauugaggcagg

SEQ ID NO: 2120429 - RNA, 15 nt, Human
auauagaaauguauu

SEQ ID NO: 2120430 - RNA, 20 nt, Human
cugcacuccagccugagcga

SEQ ID NO: 2120431 - RNA, 14 nt, Human
ccugagaccaaggc

SEQ ID NO: 2120432 - RNA, 15 nt, Human
ccucccggccgcgcu

SEQ ID NO: 2120433 - RNA, 19 nt, Human
ccccucuggcuccagcugg

SEQ ID NO: 2120434 - RNA, 12 nt, Human
cuucaacucccu

SEQ ID NO: 2120435 - RNA, 20 nt, Human
aauaagccagacaucaacag

SEQ ID NO: 2120436 - RNA, 21 nt, Human
aauuuuuauauuugaaauauu

SEQ ID NO: 2120437 - RNA, 16 nt, Human
gcagugucugcuggag

SEQ ID NO: 2120438 - RNA, 19 nt, Human
cuucacccugaggugagca

SEQ ID NO: 2120439 - RNA, 23 nt, Human
auaauguguucauucuggaauaa

SEQ ID NO: 2120440 - RNA, 16 nt, Human
cagauccccaagccug

SEQ ID NO: 2120441 - RNA, 19 nt, Human
uaggugacuauuauauuuc

SEQ ID NO: 2120442 - RNA, 16 nt, Human
uuaaauuguaauaggc

SEQ ID NO: 2120443 - RNA, 20 nt, Human
ucucacuuguuuuauuuaac

SEQ ID NO: 2120444 - RNA, 15 nt, Human
ccaggcggguccggg

SEQ ID NO: 2120445 - RNA, 15 nt, Human
uaaauucuuucauuu

SEQ ID NO: 2120446 - RNA, 12 nt, Human
aaaagaaagaaa

SEQ ID NO: 2120447 - RNA, 18 nt, Human
agugcacuaauguguaag

SEQ ID NO: 2120448 - RNA, 22 nt, Human
ugauaguuguaccgcaauguga

SEQ ID NO: 2120449 - RNA, 21 nt, Human
gcgcucggccugcucgcccac

SEQ ID NO: 2120450 - RNA, 19 nt, Human
gcucauggaauuggagcuc

SEQ ID NO: 2120451 - RNA, 19 nt, Human
acuccuguucaugcccaua

SEQ ID NO: 2120452 - RNA, 15 nt, Human
cuucaacucccugcc

SEQ ID NO: 2120453 - RNA, 17 nt, Human
ucauacuucuuaggguu

SEQ ID NO: 2120454 - RNA, 20 nt, Human
caaauguucaucaaugaaug

SEQ ID NO: 2120455 - RNA, 18 nt, Human
ugagcucagcccuggugg

SEQ ID NO: 2120456 - RNA, 13 nt, Human
uagcuuuuuucuc

SEQ ID NO: 2120457 - RNA, 11 nt, Human
cuauuuaauua

SEQ ID NO: 2120458 - RNA, 18 nt, Human
cggagccuccagcugccc

SEQ ID NO: 2120459 - RNA, 22 nt, Human
uaauaucuuaucuuccuauaau

SEQ ID NO: 2120460 - RNA, 15 nt, Human
guuauaaaaauauau

SEQ ID NO: 2120461 - RNA, 16 nt, Human
aagguccuggcaaaga

SEQ ID NO: 2120462 - RNA, 14 nt, Human
auagguuuggacaa

SEQ ID NO: 2120463 - RNA, 20 nt, Human
auaacaaugcuguauuuuaa

SEQ ID NO: 2120464 - RNA, 15 nt, Human
cuugugaggagcugg

SEQ ID NO: 2120465 - RNA, 23 nt, Human
aguaauuggaaaggcagcucuaa

SEQ ID NO: 2120466 - RNA, 21 nt, Human
ucuuaggguuaugauuaagua

SEQ ID NO: 2120467 - RNA, 24 nt, Human
aucugguccuaagucccugcugcc

SEQ ID NO: 2120468 - RNA, 21 nt, Human
uuuucaggcuagauguaugua

SEQ ID NO: 2120469 - RNA, 14 nt, Human
ucuccucaacucug

SEQ ID NO: 2120470 - RNA, 12 nt, Human
uguuugaaagcu

SEQ ID NO: 2120471 - RNA, 15 nt, Human
cuaguaauuggaaag

SEQ ID NO: 2120472 - RNA, 15 nt, Human
uagagaauuuccuua

SEQ ID NO: 2120473 - RNA, 15 nt, Human
ccugcaaagcccagc

SEQ ID NO: 2120474 - RNA, 19 nt, Human
agucaaauugugugaaagg

SEQ ID NO: 2120475 - RNA, 16 nt, Human
auaguaccucugcuau

SEQ ID NO: 2120476 - RNA, 14 nt, Human
cggggagcgagccc

SEQ ID NO: 2120477 - RNA, 14 nt, Human
cuuuuaguuuuuaa

SEQ ID NO: 2120478 - RNA, 16 nt, Human
gaaguaucuugguugu

SEQ ID NO: 2120479 - RNA, 19 nt, Human
aaacaaaaggauaaugaau

SEQ ID NO: 2120480 - RNA, 23 nt, Human
ggucucagugucaaugcagcccc

SEQ ID NO: 2120481 - RNA, 17 nt, Human
augaucaguaugaaaau

SEQ ID NO: 2120482 - RNA, 17 nt, Human
augcccacggcuggagc

SEQ ID NO: 2120483 - RNA, 22 nt, Human
agaugaucaguaugaaaauguc

SEQ ID NO: 2120484 - RNA, 18 nt, Human
aaaaguucugcagauaaa

SEQ ID NO: 2120485 - RNA, 17 nt, Human
acacuguuaucuucacu

SEQ ID NO: 2120486 - RNA, 17 nt, Human
guguccccuauccuacu

SEQ ID NO: 2120487 - RNA, 23 nt, Human
cucagucucccucccuuggggcc

SEQ ID NO: 2120488 - RNA, 20 nt, Human
gaauacucuuauaucuauau

SEQ ID NO: 2120489 - RNA, 20 nt, Human
cugucacgugugggcaaugu

SEQ ID NO: 2120490 - RNA, 20 nt, Human
cuacuuccccuuccuaauuc

SEQ ID NO: 2120491 - RNA, 15 nt, Human
ggccaccugcugagc

SEQ ID NO: 2120492 - RNA, 22 nt, Human
cacuguccauucuuccucccau

SEQ ID NO: 2120493 - RNA, 21 nt, Human
ucaagucuuucacauuuaaau

SEQ ID NO: 2120494 - RNA, 20 nt, Human
cagccugagcgacagugaga

SEQ ID NO: 2120495 - RNA, 23 nt, Human
aacuuguaaaggaauuuaaaaau

SEQ ID NO: 2120496 - RNA, 15 nt, Human
aagccaugugcagcc

SEQ ID NO: 2120497 - RNA, 18 nt, Human
ccugccuaagugcagccc

SEQ ID NO: 2120498 - RNA, 17 nt, Human
ccugcucgcccacuucc

SEQ ID NO: 2120499 - RNA, 13 nt, Human
cacuuugaagagu

SEQ ID NO: 2120500 - RNA, 17 nt, Human
aggccaugggacaggga

SEQ ID NO: 2120501 - RNA, 18 nt, Human
gcuccauuuuuagugaaa

SEQ ID NO: 2120502 - RNA, 13 nt, Human
uaaaaguuuaagu

SEQ ID NO: 2120503 - RNA, 14 nt, Human
aaucucaauauuuc

SEQ ID NO: 2120504 - RNA, 15 nt, Human
augcccauaccccug

SEQ ID NO: 2120505 - RNA, 22 nt, Human
uuauaagaaauaggaaauauuu

SEQ ID NO: 2120506 - RNA, 22 nt, Human
uuuccuuauucagaauuucuaa

SEQ ID NO: 2120507 - RNA, 23 nt, Human
gucucccucccuuggggccuaug

SEQ ID NO: 2120508 - RNA, 13 nt, Human
acaagaaaugaaa

SEQ ID NO: 2120509 - RNA, 16 nt, Human
uccuguaauggaagca

SEQ ID NO: 2120510 - RNA, 23 nt, Human
uuuuauagcuacuaauuuuaaaa

SEQ ID NO: 2120511 - RNA, 17 nt, Human
acuguccauucuuccuc

SEQ ID NO: 2120512 - RNA, 15 nt, Human
uuugauaugugaaca

SEQ ID NO: 2120513 - RNA, 19 nt, Human
auccuacaagacacaguga

SEQ ID NO: 2120514 - RNA, 18 nt, Human
ugaaaaaguucugcagau

SEQ ID NO: 2120515 - RNA, 18 nt, Human
acuguaaagcuuugugca

SEQ ID NO: 2120516 - RNA, 17 nt, Human
cagugaaagaaaauaac

SEQ ID NO: 2120517 - RNA, 17 nt, Human
auucaaugccccugaau

SEQ ID NO: 2120518 - RNA, 21 nt, Human
gaaaacaauaacgauaaaaga

SEQ ID NO: 2120519 - RNA, 22 nt, Human
cuuguaaaggaauuuaaaaauc

SEQ ID NO: 2120520 - RNA, 19 nt, Human
agagaacagggcugaagcu

SEQ ID NO: 2120521 - RNA, 12 nt, Human
cauaaaguaugu

SEQ ID NO: 2120522 - RNA, 18 nt, Human
aaggaugccccguccccc

SEQ ID NO: 2120523 - RNA, 18 nt, Human
uaguaucaaaagaaagaa

SEQ ID NO: 2120524 - RNA, 21 nt, Human
ccggccuuugcaccuccaugg

SEQ ID NO: 2120525 - RNA, 16 nt, Human
augcuaagugaaauaa

SEQ ID NO: 2120526 - RNA, 16 nt, Human
uauuuuaauguuucuu

SEQ ID NO: 2120527 - RNA, 21 nt, Human
cccccucuccucucuuccucc

SEQ ID NO: 2120528 - RNA, 17 nt, Human
agcccuuccccucugca

SEQ ID NO: 2120529 - RNA, 22 nt, Human
cagcacgggggccaaggaugcc

SEQ ID NO: 2120530 - RNA, 19 nt, Human
ccagaucuaugccacaaga

SEQ ID NO: 2120531 - RNA, 16 nt, Human
gucuaucuuugagcgc

SEQ ID NO: 2120532 - RNA, 13 nt, Human
ugccuaauuuguu

SEQ ID NO: 2120533 - RNA, 17 nt, Human
agaaaugaaagcaggga

SEQ ID NO: 2120534 - RNA, 15 nt, Human
ugcagccaccagucc

SEQ ID NO: 2120535 - RNA, 21 nt, Human
auaugcucuaaacauguuuau

SEQ ID NO: 2120536 - RNA, 20 nt, Human
uuuaaauaaaguguuugaaa

SEQ ID NO: 2120537 - RNA, 19 nt, Human
ggccugcucgcccacuucc

SEQ ID NO: 2120538 - RNA, 16 nt, Human
cauggguuuuauuaua

SEQ ID NO: 2120539 - RNA, 21 nt, Human
aagacucgggauuaguacaca

SEQ ID NO: 2120540 - RNA, 19 nt, Human
aagcuuguauuccuuuuuc

SEQ ID NO: 2120541 - RNA, 17 nt, Human
caagacccaaaaggcag

SEQ ID NO: 2120542 - RNA, 14 nt, Human
agaugcuagaacuc

SEQ ID NO: 2120543 - RNA, 18 nt, Human
ugugaccacugcagaaga

SEQ ID NO: 2120544 - RNA, 20 nt, Human
cucccugccccccagcccuc

SEQ ID NO: 2120545 - RNA, 12 nt, Human
cuguuaucuuca

SEQ ID NO: 2120546 - RNA, 21 nt, Human
uaaaagacagugaaagaaaau

SEQ ID NO: 2120547 - RNA, 14 nt, Human
cuaaacauaugaau

SEQ ID NO: 2120548 - RNA, 14 nt, Human
gaacgagacaagca

SEQ ID NO: 2120549 - RNA, 22 nt, Human
cccagcccuccuuaucaaagga

SEQ ID NO: 2120550 - RNA, 17 nt, Human
augccccgucccccucu

SEQ ID NO: 2120551 - RNA, 20 nt, Human
uaugcuauuuauuaaguauu

SEQ ID NO: 2120552 - RNA, 19 nt, Human
gccugaucaccugcccugc

SEQ ID NO: 2120553 - RNA, 21 nt, Human
gccugagaccaaggcccccgg

SEQ ID NO: 2120554 - RNA, 23 nt, Human
ugucuucaggggccacaccaacc

SEQ ID NO: 2120555 - RNA, 20 nt, Human
aauuuuuucucuaggaaaua

SEQ ID NO: 2120556 - RNA, 19 nt, Human
acaauaacgauaaaagaca

SEQ ID NO: 2120557 - RNA, 19 nt, Human
ggagccugaucaccugccc

SEQ ID NO: 2120558 - RNA, 20 nt, Human
ucagaaggaaagaauaacca

SEQ ID NO: 2120559 - RNA, 12 nt, Human
gcccccgggccg

SEQ ID NO: 2120560 - RNA, 13 nt, Human
aaauaaaaauaau

SEQ ID NO: 2120561 - RNA, 18 nt, Human
auagucaaauugugugaa

SEQ ID NO: 2120562 - RNA, 22 nt, Human
caggggccacaccaaccuucug

SEQ ID NO: 2120563 - RNA, 21 nt, Human
ccgacggagccgggaaagaag

SEQ ID NO: 2120564 - RNA, 19 nt, Human
aaacaauaacgauaaaaga

SEQ ID NO: 2120565 - RNA, 17 nt, Human
uauauauuuuuuucuga

SEQ ID NO: 2120566 - RNA, 22 nt, Human
gcuauuugcuguuauuuuaucu

SEQ ID NO: 2120567 - RNA, 16 nt, Human
uguugagguaccucca

SEQ ID NO: 2120568 - RNA, 16 nt, Human
uguaguccuguaaugg

SEQ ID NO: 2120569 - RNA, 21 nt, Human
agucaagggugugugcagcau

SEQ ID NO: 2120570 - RNA, 20 nt, Human
aaugaauacuuuauaaagga

SEQ ID NO: 2120571 - RNA, 15 nt, Human
aaggaauuuaaaaau

SEQ ID NO: 2120572 - RNA, 14 nt, Human
cugcuaguuuauau

SEQ ID NO: 2120573 - RNA, 14 nt, Human
guccauugggcagg

SEQ ID NO: 2120574 - RNA, 21 nt, Human
aaagaaaauaacgauaaaaga

SEQ ID NO: 2120575 - RNA, 20 nt, Human
aaggagccaaacauccuaca

SEQ ID NO: 2120576 - RNA, 13 nt, Human
gaaccuaggguga

SEQ ID NO: 2120577 - RNA, 14 nt, Human
gauaaaagacagug

SEQ ID NO: 2120578 - RNA, 16 nt, Human
cuguucgcgcgccucc

SEQ ID NO: 2120579 - RNA, 12 nt, Human
cagauuuuccug

SEQ ID NO: 2120580 - RNA, 19 nt, Human
uuccucccuucucuucaca

SEQ ID NO: 2120581 - RNA, 19 nt, Human
uaaccucuaaauucuuuca

SEQ ID NO: 2120582 - RNA, 13 nt, Human
ugugcggccuggu

SEQ ID NO: 2120583 - RNA, 21 nt, Human
uacuucccgcuguuccucgcc

SEQ ID NO: 2120584 - RNA, 13 nt, Human
uuuagugaaauau

SEQ ID NO: 2120585 - RNA, 20 nt, Human
uaaaacaagcacuaaacaaa

SEQ ID NO: 2120586 - RNA, 21 nt, Human
uuccuagucuguuuucccucc

SEQ ID NO: 2120587 - RNA, 14 nt, Human
uauuugaaauauug

SEQ ID NO: 2120588 - RNA, 17 nt, Human
gccgcgcugcgcgccgc

SEQ ID NO: 2120589 - RNA, 14 nt, Human
cucagucucccucc

SEQ ID NO: 2120590 - RNA, 15 nt, Human
cgagacaagcagccc

SEQ ID NO: 2120591 - RNA, 16 nt, Human
cagggcuacgcgcgcu

SEQ ID NO: 2120592 - RNA, 15 nt, Human
agugacaagcucaca

SEQ ID NO: 2120593 - RNA, 13 nt, Human
cuuagcccuuccc

SEQ ID NO: 2120594 - RNA, 15 nt, Human
aauugacccacaaga

SEQ ID NO: 2120595 - RNA, 13 nt, Human
gggcugaagcugu

SEQ ID NO: 2120596 - RNA, 17 nt, Human
aguuauuuuuaaacugu

SEQ ID NO: 2120597 - RNA, 21 nt, Human
augugcauauuuuauuauagu

SEQ ID NO: 2120598 - RNA, 22 nt, Human
ucccuagaaagccaugugcagc

SEQ ID NO: 2120599 - RNA, 13 nt, Human
gguccacaacaca

SEQ ID NO: 2120600 - RNA, 22 nt, Human
ccacacuguccauucuuccucc

SEQ ID NO: 2120601 - RNA, 21 nt, Human
uaggugacuauuauauuucca

SEQ ID NO: 2120602 - RNA, 14 nt, Human
aggggaccagagag

SEQ ID NO: 2120603 - RNA, 15 nt, Human
accucccccaucucu

SEQ ID NO: 2120604 - RNA, 19 nt, Human
aauuugauaugugaacagu

SEQ ID NO: 2120605 - RNA, 16 nt, Human
cauuuaguuauaaaaa

SEQ ID NO: 2120606 - RNA, 15 nt, Human
aagccagauuuuccu

SEQ ID NO: 2120607 - RNA, 14 nt, Human
uuauuauauuuaca

SEQ ID NO: 2120608 - RNA, 22 nt, Human
aaacuuuuggaagguauuuaau

SEQ ID NO: 2120609 - RNA, 23 nt, Human
uaagaauucuguugauggaaaua

SEQ ID NO: 2120610 - RNA, 19 nt, Human
uguugaagagguuuuaaag

SEQ ID NO: 2120611 - RNA, 18 nt, Human
ccuguucgcgcgccuccg

SEQ ID NO: 2120612 - RNA, 17 nt, Human
guggcucugugugcucu

SEQ ID NO: 2120613 - RNA, 21 nt, Human
gcacuguggguagacacacau

SEQ ID NO: 2120614 - RNA, 19 nt, Human
cuguacgcgagcgcgcgcg

SEQ ID NO: 2120615 - RNA, 15 nt, Human
gccccauucaacauc

SEQ ID NO: 2120616 - RNA, 18 nt, Human
aacugccaucauuuacuu

SEQ ID NO: 2120617 - RNA, 11 nt, Human
aagucccugcu

SEQ ID NO: 2120618 - RNA, 20 nt, Human
ccagugagacagcucugcau

SEQ ID NO: 2120619 - RNA, 17 nt, Human
ccaguaguuagcuuucu

SEQ ID NO: 2120620 - RNA, 17 nt, Human
cacauguuccccuuggg

SEQ ID NO: 2120621 - RNA, 19 nt, Human
uccagaaagugacaagcuc

SEQ ID NO: 2120622 - RNA, 15 nt, Human
ggccugagaccaagg

SEQ ID NO: 2120623 - RNA, 21 nt, Human
cugcccugcugagucccaggc

SEQ ID NO: 2120624 - RNA, 15 nt, Human
uugccuaauuuguuu

SEQ ID NO: 2120625 - RNA, 12 nt, Human
acccccugggag

SEQ ID NO: 2120626 - RNA, 17 nt, Human
ugaccacugcagaagac

SEQ ID NO: 2120627 - RNA, 16 nt, Human
ccgcauccuagucucu

SEQ ID NO: 2120628 - RNA, 15 nt, Human
ugaaacccugucucu

SEQ ID NO: 2120629 - RNA, 14 nt, Human
uggccaccugcuga

SEQ ID NO: 2120630 - RNA, 17 nt, Human
ucagacauagaauuaac

SEQ ID NO: 2120631 - RNA, 12 nt, Human
guugauggaaau

SEQ ID NO: 2120632 - RNA, 23 nt, Human
aaagauucaaugccccugaauuu

SEQ ID NO: 2120633 - RNA, 18 nt, Human
ggggcuuuaacuccugcu

SEQ ID NO: 2120634 - RNA, 16 nt, Human
accuccuaagaaggca

SEQ ID NO: 2120635 - RNA, 21 nt, Human
auauuuuuuuuuuuaaaaaaa

SEQ ID NO: 2120636 - RNA, 13 nt, Human
ggaaguagaggag

SEQ ID NO: 2120637 - RNA, 20 nt, Human
agcuacuaauuuuaaaaugu

SEQ ID NO: 2120638 - RNA, 12 nt, Human
uaccuccaagga

SEQ ID NO: 2120639 - RNA, 17 nt, Human
gccuccuuuuaaaguaa

SEQ ID NO: 2120640 - RNA, 20 nt, Human
agcuucacuguaaaauaaua

SEQ ID NO: 2120641 - RNA, 12 nt, Human
cccccagcccuc

SEQ ID NO: 2120642 - RNA, 16 nt, Human
ugaaguacucauacau

SEQ ID NO: 2120643 - RNA, 20 nt, Human
uauuuauuacuguaagaaaa

SEQ ID NO: 2120644 - RNA, 16 nt, Human
auacauguuacaacac

SEQ ID NO: 2120645 - RNA, 18 nt, Human
ccaagccuggcaagggaa

SEQ ID NO: 2120646 - RNA, 14 nt, Human
ggacucaccucccc

SEQ ID NO: 2120647 - RNA, 22 nt, Human
caccucccccaucucuucuggg

SEQ ID NO: 2120648 - RNA, 18 nt, Human
cagcuuauugucuaguga

SEQ ID NO: 2120649 - RNA, 12 nt, Human
ccugccagcugg

SEQ ID NO: 2120650 - RNA, 13 nt, Human
cacaacuauauug

SEQ ID NO: 2120651 - RNA, 12 nt, Human
aauacuuuauaa

SEQ ID NO: 2120652 - RNA, 14 nt, Human
uaugaauuacauuu

SEQ ID NO: 2120653 - RNA, 16 nt, Human
cuggguugaagggcag

SEQ ID NO: 2120654 - RNA, 19 nt, Human
caauaaagaguuccuucug

SEQ ID NO: 2120655 - RNA, 18 nt, Human
cuccccaaaugcuuucca

SEQ ID NO: 2120656 - RNA, 19 nt, Human
cuccuuggagacagggccc

SEQ ID NO: 2120657 - RNA, 14 nt, Human
uuuguauaaaauaa

SEQ ID NO: 2120658 - RNA, 22 nt, Human
cccuauccuacuuccccuuccu

SEQ ID NO: 2120659 - RNA, 14 nt, Human
ggcaccucucuggg

SEQ ID NO: 2120660 - RNA, 16 nt, Human
acuuguuuuauuuaac

SEQ ID NO: 2120661 - RNA, 13 nt, Human
uuuaaaaaaaaac

SEQ ID NO: 2120662 - RNA, 16 nt, Human
gcaggcagauguuccu

SEQ ID NO: 2120663 - RNA, 20 nt, Human
agaaggcuguggauuuaaug

SEQ ID NO: 2120664 - RNA, 14 nt, Human
agaaauaggaaaua

SEQ ID NO: 2120665 - RNA, 21 nt, Human
cuuuuguagaagucacauucc

SEQ ID NO: 2120666 - RNA, 16 nt, Human
gcaucccuagaaagcc

SEQ ID NO: 2120667 - RNA, 21 nt, Human
uuccuaauuccacagcugcuc

SEQ ID NO: 2120668 - RNA, 22 nt, Human
uuuauugaggcuuuaaaacuua

SEQ ID NO: 2120669 - RNA, 16 nt, Human
ugacuauuauauuucc

SEQ ID NO: 2120670 - RNA, 17 nt, Human
aucauuuacuuuuaaac

SEQ ID NO: 2120671 - RNA, 19 nt, Human
aaaacguauugcauuuaau

SEQ ID NO: 2120672 - RNA, 12 nt, Human
gguauuuuaauc

SEQ ID NO: 2120673 - RNA, 20 nt, Human
augucgucaaagcugaaaug

SEQ ID NO: 2120674 - RNA, 19 nt, Human
uggaaguaaauguuguuuu

SEQ ID NO: 2120675 - RNA, 19 nt, Human
aaaaucuuauaauuuaaaa

SEQ ID NO: 2120676 - RNA, 18 nt, Human
gccggagccuccagcugc

SEQ ID NO: 2120677 - RNA, 19 nt, Human
uauguagaauauauuuccu

SEQ ID NO: 2120678 - RNA, 15 nt, Human
gucucuugaggcaca

SEQ ID NO: 2120679 - RNA, 21 nt, Human
aagaagagccggagccuccag

SEQ ID NO: 2120680 - RNA, 14 nt, Human
uaauccuaaacaua

SEQ ID NO: 2120681 - RNA, 17 nt, Human
ccuacuuccccuuccua

SEQ ID NO: 2120682 - RNA, 19 nt, Human
cagagucaagggugugugc

SEQ ID NO: 2120683 - RNA, 17 nt, Human
uccagcuggccgggagc

SEQ ID NO: 2120684 - RNA, 12 nt, Human
gaauuggagcuc

SEQ ID NO: 2120685 - RNA, 19 nt, Human
cggccugcucgcccacuuc

SEQ ID NO: 2120686 - RNA, 16 nt, Human
auaugauucaaauguc

SEQ ID NO: 2120687 - RNA, 21 nt, Human
gcccugcugagucccaggcug

SEQ ID NO: 2120688 - RNA, 22 nt, Human
caaggaugccccgucccccucu

SEQ ID NO: 2120689 - RNA, 21 nt, Human
ccauccugccccugagcccau

SEQ ID NO: 2120690 - RNA, 19 nt, Human
cugguccuaagucccugcu

SEQ ID NO: 2120691 - RNA, 17 nt, Human
uagaauauauuuccuua

SEQ ID NO: 2120692 - RNA, 15 nt, Human
cuaagugcagccccg

SEQ ID NO: 2120693 - RNA, 18 nt, Human
uacauaaaguaugugcau

SEQ ID NO: 2120694 - RNA, 22 nt, Human
agccaaacauccuacaagacac

SEQ ID NO: 2120695 - RNA, 21 nt, Human
cuuccaggcuggcgugcagca

SEQ ID NO: 2120696 - RNA, 22 nt, Human
aaacguauucaaacaauuugaa

SEQ ID NO: 2120697 - RNA, 18 nt, Human
gcagugucugcuggagac

SEQ ID NO: 2120698 - RNA, 22 nt, Human
uaaaauaauuuuuauauuugaa

SEQ ID NO: 2120699 - RNA, 16 nt, Human
cauagaaguaaaaaca

SEQ ID NO: 2120700 - RNA, 16 nt, Human
uuccgcauccuagucu

SEQ ID NO: 2120701 - RNA, 21 nt, Human
auuuacaaaugggaaacaaaa

SEQ ID NO: 2120702 - RNA, 16 nt, Human
gcuucuguuccgugcu

SEQ ID NO: 2120703 - RNA, 19 nt, Human
auucuuuacccccugggag

SEQ ID NO: 2120704 - RNA, 22 nt, Human
uauuccuuuuucucuccucucc

SEQ ID NO: 2120705 - RNA, 20 nt, Human
gucauucagauaugauucaa

SEQ ID NO: 2120706 - RNA, 21 nt, Human
ucauucagauaugauucaaau

SEQ ID NO: 2120707 - RNA, 19 nt, Human
aaaagacagugaaagaaaa

SEQ ID NO: 2120708 - RNA, 16 nt, Human
ccugagaccaaggccc

SEQ ID NO: 2120709 - RNA, 21 nt, Human
gaaaaaaagcuuuuuuugaau

SEQ ID NO: 2120710 - RNA, 23 nt, Human
gccugaguguugccuaauuuguu

SEQ ID NO: 2120711 - RNA, 13 nt, Human
aaguucuagugac

SEQ ID NO: 2120712 - RNA, 24 nt, Human
auauucucacagcuccaagaauuu

SEQ ID NO: 2120713 - RNA, 17 nt, Human
caggcuggcgugcagca

SEQ ID NO: 2120714 - RNA, 15 nt, Human
accaaggcugauuaa

SEQ ID NO: 2120715 - RNA, 19 nt, Human
cccugccccccagcccucc

SEQ ID NO: 2120716 - RNA, 18 nt, Human
gcccuggugggcagagag

SEQ ID NO: 2120717 - RNA, 19 nt, Human
uccccagagcuacaggccc

SEQ ID NO: 2120718 - RNA, 17 nt, Human
aauaacgauaaaagaca

SEQ ID NO: 2120719 - RNA, 18 nt, Human
ucucuaggaaauauuuau

SEQ ID NO: 2120720 - RNA, 14 nt, Human
uugugauugauuau

SEQ ID NO: 2120721 - RNA, 18 nt, Human
auuuuagacauucuuuau

SEQ ID NO: 2120722 - RNA, 17 nt, Human
cugguccuaagucccug

SEQ ID NO: 2120723 - RNA, 14 nt, Human
caguucugaagaag

SEQ ID NO: 2120724 - RNA, 14 nt, Human
ccuugaugaagaag

SEQ ID NO: 2120725 - RNA, 19 nt, Human
auuuuagauagaugaagaa

SEQ ID NO: 2120726 - RNA, 16 nt, Human
uguguaagacaaaaag

SEQ ID NO: 2120727 - RNA, 20 nt, Human
uccuccaugaauaucaguua

SEQ ID NO: 2120728 - RNA, 14 nt, Human
uaacuaauuuuaac

SEQ ID NO: 2120729 - RNA, 17 nt, Human
cugaucaccugcccugc

SEQ ID NO: 2120730 - RNA, 22 nt, Human
ugguuguauuauuuuuuaaaaa

SEQ ID NO: 2120731 - RNA, 13 nt, Human
cucugcagcuucc

SEQ ID NO: 2120732 - RNA, 13 nt, Human
augaguugcaguu

SEQ ID NO: 2120733 - RNA, 19 nt, Human
cagcuacuugggaggcuga

SEQ ID NO: 2120734 - RNA, 17 nt, Human
gcuguacgcgagcgcgc

SEQ ID NO: 2120735 - RNA, 12 nt, Human
agaaaacaauaa

SEQ ID NO: 2120736 - RNA, 15 nt, Human
ucaguuuuugugaaa

SEQ ID NO: 2120737 - RNA, 20 nt, Human
auuuugugauugauuauaug

SEQ ID NO: 2120738 - RNA, 13 nt, Human
agccuccagcugc

SEQ ID NO: 2120739 - RNA, 23 nt, Human
aucucuucuggguuccuuccucu

SEQ ID NO: 2120740 - RNA, 17 nt, Human
gugggauacuauuuaau

SEQ ID NO: 2120741 - RNA, 21 nt, Human
caauuuuguuauguauauuuu

SEQ ID NO: 2120742 - RNA, 20 nt, Human
caagccuccuuuuaaaguaa

SEQ ID NO: 2120743 - RNA, 22 nt, Human
aucuucacuuuuauaagaaaua

SEQ ID NO: 2120744 - RNA, 21 nt, Human
ugaaacgaggauugggaaaaa

SEQ ID NO: 2120745 - RNA, 16 nt, Human
ggggcagcaccuccua

SEQ ID NO: 2120746 - RNA, 22 nt, Human
cuucagccugaaagaggaauga

SEQ ID NO: 2120747 - RNA, 22 nt, Human
uguucugauauuggacaguaaa

SEQ ID NO: 2120748 - RNA, 19 nt, Human
ggaauuucuucaacucccu

SEQ ID NO: 2120749 - RNA, 16 nt, Human
uagaauauauuuccuu

SEQ ID NO: 2120750 - RNA, 18 nt, Human
ggaacuggugucuucagg

SEQ ID NO: 2120751 - RNA, 14 nt, Human
gaaaacaauaacga

SEQ ID NO: 2120752 - RNA, 12 nt, Human
guaaaggcaaac

SEQ ID NO: 2120753 - RNA, 22 nt, Human
cgcgcagcucaggcuggcaccg

SEQ ID NO: 2120754 - RNA, 21 nt, Human
acaagaaggaaagauuuuguu

SEQ ID NO: 2120755 - RNA, 18 nt, Human
gaugccccgucccccucu

SEQ ID NO: 2120756 - RNA, 15 nt, Human
cagucucccucccuu

SEQ ID NO: 2120757 - RNA, 13 nt, Human
gagccuccagcug

SEQ ID NO: 2120758 - RNA, 13 nt, Human
caagaaggaaaga

SEQ ID NO: 2120759 - RNA, 21 nt, Human
aguuagcuuucuuccuggauu

SEQ ID NO: 2120760 - RNA, 18 nt, Human
uauagcuacuaauuuuaa

SEQ ID NO: 2120761 - RNA, 16 nt, Human
acugcuaguuuauaua

SEQ ID NO: 2120762 - RNA, 20 nt, Human
ugcugcccuuccccuuccca

SEQ ID NO: 2120763 - RNA, 15 nt, Human
uauuucacuuuagaa

SEQ ID NO: 2120764 - RNA, 16 nt, Human
cuccauccugaggcuc

SEQ ID NO: 2120765 - RNA, 14 nt, Human
cucccggccgcgcu

SEQ ID NO: 2120766 - RNA, 14 nt, Human
cucuugaggcacag

SEQ ID NO: 2120767 - RNA, 22 nt, Human
uauuucuaugaaauauuauguu

SEQ ID NO: 2120768 - RNA, 18 nt, Human
agguccacaacacacaga

SEQ ID NO: 2120769 - RNA, 18 nt, Human
ugcucgcccacuuccucc

SEQ ID NO: 2120770 - RNA, 17 nt, Human
aaaaguugaauuuuaca

SEQ ID NO: 2120771 - RNA, 21 nt, Human
cccuauccuacuuccccuucc

SEQ ID NO: 2120772 - RNA, 19 nt, Human
cuccgcuacuuccagggcu

SEQ ID NO: 2120773 - RNA, 23 nt, Human
gauauuaaccaggggccaugaau

SEQ ID NO: 2120774 - RNA, 17 nt, Human
ccaaaagguauuuuaau

SEQ ID NO: 2120775 - RNA, 16 nt, Human
uugccauaauuacuau

SEQ ID NO: 2120776 - RNA, 19 nt, Human
ucaguuauuauauuuacaa

SEQ ID NO: 2120777 - RNA, 18 nt, Human
cagagucaagggugugug

SEQ ID NO: 2120778 - RNA, 14 nt, Human
cgagccccaggcgg

SEQ ID NO: 2120779 - RNA, 17 nt, Human
ggcccugugcggccugg

SEQ ID NO: 2120780 - RNA, 21 nt, Human
aaaugucuugcuugauuguau

SEQ ID NO: 2120781 - RNA, 14 nt, Human
uaaauaaaaauaau

SEQ ID NO: 2120782 - RNA, 13 nt, Human
cucaccuccccca

SEQ ID NO: 2120783 - RNA, 22 nt, Human
auggaaauguuuacagaucccc

SEQ ID NO: 2120784 - RNA, 18 nt, Human
uaauagguuuggacaaaa

SEQ ID NO: 2120785 - RNA, 22 nt, Human
caagcacuaaacaaagagugaa

SEQ ID NO: 2120786 - RNA, 18 nt, Human
cccacuggacucaccucc

SEQ ID NO: 2120787 - RNA, 20 nt, Human
caggcugagccucagucucc

SEQ ID NO: 2120788 - RNA, 22 nt, Human
uuuauagcuacuaauuuuaaaa

SEQ ID NO: 2120789 - RNA, 18 nt, Human
ugggcacaggguuuaugu

SEQ ID NO: 2120790 - RNA, 18 nt, Human
cuuucacauuuaaauaaa

SEQ ID NO: 2120791 - RNA, 16 nt, Human
aauuuuuaauuauaug

SEQ ID NO: 2120792 - RNA, 18 nt, Human
agccggagccuccagcug

SEQ ID NO: 2120793 - RNA, 17 nt, Human
aaagcagggacuugaac

SEQ ID NO: 2120794 - RNA, 16 nt, Human
uauaugucacuuugcu

SEQ ID NO: 2120795 - RNA, 15 nt, Human
gccuaagugcagccc

SEQ ID NO: 2120796 - RNA, 23 nt, Human
accuccauggaaacgaagcacca

SEQ ID NO: 2120797 - RNA, 22 nt, Human
cuuccccucugcagcuuccagg

SEQ ID NO: 2120798 - RNA, 18 nt, Human
ccucaagcuaugugagcu

SEQ ID NO: 2120799 - RNA, 14 nt, Human
acccaaaaggcaga

SEQ ID NO: 2120800 - RNA, 21 nt, Human
cuucucacauuuauauuuuug

SEQ ID NO: 2120801 - RNA, 19 nt, Human
gcugcaccugugccguccc

SEQ ID NO: 2120802 - RNA, 18 nt, Human
gagucccaggcugagccu

SEQ ID NO: 2120803 - RNA, 14 nt, Human
agcucuaucaccaa

SEQ ID NO: 2120804 - RNA, 17 nt, Human
aaauccuacuuucauaa

SEQ ID NO: 2120805 - RNA, 13 nt, Human
aggauuugaaauu

SEQ ID NO: 2120806 - RNA, 19 nt, Human
aggucuaccaaaaaucuca

SEQ ID NO: 2120807 - RNA, 18 nt, Human
acaagccuccuuuuaaag

SEQ ID NO: 2120808 - RNA, 15 nt, Human
cagcgaguacuuccc

SEQ ID NO: 2120809 - RNA, 13 nt, Human
uauuuaauuauuu

SEQ ID NO: 2120810 - RNA, 15 nt, Human
cuguaaaauaauaac

SEQ ID NO: 2120811 - RNA, 14 nt, Human
ugaagauguagagg

SEQ ID NO: 2120812 - RNA, 13 nt, Human
gggcggcggcccu

SEQ ID NO: 2120813 - RNA, 18 nt, Human
aauccacacugagcugag

SEQ ID NO: 2120814 - RNA, 19 nt, Human
gcccacuuccucccggccg

SEQ ID NO: 2120815 - RNA, 17 nt, Human
uauuuauuaaguauuuu

SEQ ID NO: 2120816 - RNA, 17 nt, Human
gccaugugcagccacca

SEQ ID NO: 2120817 - RNA, 23 nt, Human
aguuauuuuuaauuugguuuuca

SEQ ID NO: 2120818 - RNA, 13 nt, Human
uaagugcagcccc

SEQ ID NO: 2120819 - RNA, 17 nt, Human
aggguguguaaguagau

SEQ ID NO: 2120820 - RNA, 17 nt, Human
caauaacgauaaaagac

SEQ ID NO: 2120821 - RNA, 19 nt, Human
cauggaauuggagcucgug

SEQ ID NO: 2120822 - RNA, 16 nt, Human
ccugccccccagcccu

SEQ ID NO: 2120823 - RNA, 11 nt, Human
uuuuuuuaaaa

SEQ ID NO: 2120824 - RNA, 17 nt, Human
cugcgcucggccugcuc

SEQ ID NO: 2120825 - RNA, 11 nt, Human
ugggggcagca

SEQ ID NO: 2120826 - RNA, 14 nt, Human
cugagucccaggcu

SEQ ID NO: 2120827 - RNA, 16 nt, Human
aauaaaguguuugaaa

SEQ ID NO: 2120828 - RNA, 20 nt, Human
auauguuagagaauuuccuu

SEQ ID NO: 2120829 - RNA, 17 nt, Human
guauuauuuuuuaaaaa

SEQ ID NO: 2120830 - RNA, 15 nt, Human
auaucuauauuuuac

SEQ ID NO: 2120831 - RNA, 19 nt, Human
ucuugugaacccaaagugu

SEQ ID NO: 2120832 - RNA, 17 nt, Human
acuaguuguaauuuuuu

SEQ ID NO: 2120833 - RNA, 13 nt, Human
gaagagccggagc

SEQ ID NO: 2120834 - RNA, 22 nt, Human
uggguuccuuccucugagccuu

SEQ ID NO: 2120835 - RNA, 17 nt, Human
aaauguucaucaaugaa

SEQ ID NO: 2120836 - RNA, 14 nt, Human
cauggccacaucug

SEQ ID NO: 2120837 - RNA, 18 nt, Human
augggggcagcaccuccu

SEQ ID NO: 2120838 - RNA, 12 nt, Human
uuaauaaaccau

SEQ ID NO: 2120839 - RNA, 21 nt, Human
ccaguccauugggcaggcaga

SEQ ID NO: 2120840 - RNA, 12 nt, Human
gaaucuuguaaa

SEQ ID NO: 2120841 - RNA, 15 nt, Human
gucccaggcugagcc

SEQ ID NO: 2120842 - RNA, 16 nt, Human
ccacaagaacccccuu

SEQ ID NO: 2120843 - RNA, 16 nt, Human
auuuuuagugaaauau

SEQ ID NO: 2120844 - RNA, 21 nt, Human
gacagucaccucauggaauug

SEQ ID NO: 2120845 - RNA, 20 nt, Human
uuauugaggcuuuaaaacuu

SEQ ID NO: 2120846 - RNA, 15 nt, Human
guuuuauuauauaua

SEQ ID NO: 2120847 - RNA, 16 nt, Human
cugagcuugcagagau

SEQ ID NO: 2120848 - RNA, 16 nt, Human
uccuagucucuaucau

SEQ ID NO: 2120849 - RNA, 22 nt, Human
cacuaguauuucuaugaaauau

SEQ ID NO: 2120850 - RNA, 22 nt, Human
ggcauuuaggccaugggacagg

SEQ ID NO: 2120851 - RNA, 14 nt, Human
aaauuuaucauuua

SEQ ID NO: 2120852 - RNA, 16 nt, Human
ugacacuuaaaaaugg

SEQ ID NO: 2120853 - RNA, 21 nt, Human
uauaagaaauaggaaauauuu

SEQ ID NO: 2120854 - RNA, 19 nt, Human
aagugugacucauuaaaug

SEQ ID NO: 2120855 - RNA, 18 nt, Human
auaccccuggccaaggaa

SEQ ID NO: 2120856 - RNA, 16 nt, Human
cuucggccuccauccu

SEQ ID NO: 2120857 - RNA, 15 nt, Human
uacaggauuugaaau

SEQ ID NO: 2120858 - RNA, 21 nt, Human
aggcucuuuugggauuuuuga

SEQ ID NO: 2120859 - RNA, 20 nt, Human
gaauucauucacucaacaaa

SEQ ID NO: 2120860 - RNA, 17 nt, Human
cuccuuaucaaaggaca

SEQ ID NO: 2120861 - RNA, 20 nt, Human
auaauccuaaacauaugaau

SEQ ID NO: 2120862 - RNA, 20 nt, Human
aaaagacagugaaagaaaau

SEQ ID NO: 2120863 - RNA, 13 nt, Human
ugguccuaagucc

SEQ ID NO: 2120864 - RNA, 19 nt, Human
gaggcagagguugcaguga

SEQ ID NO: 2120865 - RNA, 14 nt, Human
cuggaaaucagggu

SEQ ID NO: 2120866 - RNA, 19 nt, Human
ugaucaguaugaaaauguc

SEQ ID NO: 2120867 - RNA, 16 nt, Human
uaagaaauaggaaaua

SEQ ID NO: 2120868 - RNA, 19 nt, Human
agcuacuaauuuuaaaaug

SEQ ID NO: 2120869 - RNA, 17 nt, Human
cucacaggagcaucucc

SEQ ID NO: 2120870 - RNA, 20 nt, Human
agaagaacugaaaucauacu

SEQ ID NO: 2120871 - RNA, 16 nt, Human
gacaaggaaaaaauaa

SEQ ID NO: 2120872 - RNA, 21 nt, Human
ugagcucagcccuggugggca

SEQ ID NO: 2120873 - RNA, 11 nt, Human
caauaaaagac

SEQ ID NO: 2120874 - RNA, 14 nt, Human
augauguuuagaaa

SEQ ID NO: 2120875 - RNA, 13 nt, Human
ugaauauaaauuu

SEQ ID NO: 2120876 - RNA, 21 nt, Human
acagugaaagaaaauaacaau

SEQ ID NO: 2120877 - RNA, 20 nt, Human
aucauuuaguuauaaaaaua

SEQ ID NO: 2120878 - RNA, 23 nt, Human
agggcgcggggcggggagcgagc

SEQ ID NO: 2120879 - RNA, 15 nt, Human
auuucacuuuagaaa

SEQ ID NO: 2120880 - RNA, 18 nt, Human
auuuuaacucuauaaugu

SEQ ID NO: 2120881 - RNA, 18 nt, Human
gccuucggccuccauccu

SEQ ID NO: 2120882 - RNA, 19 nt, Human
agacucgggauuaguacac

SEQ ID NO: 2120883 - RNA, 15 nt, Human
agguauuuaauaggu

SEQ ID NO: 2120884 - RNA, 17 nt, Human
uugccaaauauaaauaa

SEQ ID NO: 2120885 - RNA, 20 nt, Human
ugaggcuccacuuggucugu

SEQ ID NO: 2120886 - RNA, 22 nt, Human
aauugacccacaagaaaugaaa

SEQ ID NO: 2120887 - RNA, 19 nt, Human
aagguccuggcaaagauga

SEQ ID NO: 2120888 - RNA, 20 nt, Human
ggguuccuuccucugagccu

SEQ ID NO: 2120889 - RNA, 18 nt, Human
uaauuauuucacuuuaga

SEQ ID NO: 2120890 - RNA, 14 nt, Human
cuggagcucugccc

SEQ ID NO: 2120891 - RNA, 18 nt, Human
gaagagccggagccucca

SEQ ID NO: 2120892 - RNA, 20 nt, Human
cucggacggcuccggacgcu

SEQ ID NO: 2120893 - RNA, 18 nt, Human
accauuuuugaaaccaaa

SEQ ID NO: 2120894 - RNA, 20 nt, Human
cugcacacagcacgggggcc

SEQ ID NO: 2120895 - RNA, 18 nt, Human
auuuauuacuguaagaaa

SEQ ID NO: 2120896 - RNA, 14 nt, Human
aacgucuuaaauau

SEQ ID NO: 2120897 - RNA, 18 nt, Human
aaaagacaaggaaaaaau

SEQ ID NO: 2120898 - RNA, 19 nt, Human
gagcucaccagucccuccc

SEQ ID NO: 2120899 - RNA, 14 nt, Human
ccggagccuccagc

SEQ ID NO: 2120900 - RNA, 17 nt, Human
ugcacaucaaaauaugc

SEQ ID NO: 2120901 - RNA, 17 nt, Human
ucuauaauuuaaauaua

SEQ ID NO: 2120902 - RNA, 19 nt, Human
cagagaugaggccgccaug

SEQ ID NO: 2120903 - RNA, 20 nt, Human
ugagagugaacaaauuuaca

SEQ ID NO: 2120904 - RNA, 15 nt, Human
ugccccccagcccuc

SEQ ID NO: 2120905 - RNA, 14 nt, Human
gggaagacaagaag

SEQ ID NO: 2120906 - RNA, 22 nt, Human
ccggcgcgcucaucccacccgc

SEQ ID NO: 2120907 - RNA, 20 nt, Human
aaauccuugaagauuuacca

SEQ ID NO: 2120908 - RNA, 18 nt, Human
uagcccuuccccucugca

SEQ ID NO: 2120909 - RNA, 15 nt, Human
uccauugggcaggca

SEQ ID NO: 2120910 - RNA, 19 nt, Human
caagcagcccuuagcccuu

SEQ ID NO: 2120911 - RNA, 17 nt, Human
uuugauaugugaacagu

SEQ ID NO: 2120912 - RNA, 20 nt, Human
uguaagaaaauaucacuugu

SEQ ID NO: 2120913 - RNA, 22 nt, Human
ucugcuaugcuauugaaguuuu

SEQ ID NO: 2120914 - RNA, 16 nt, Human
agacauugaggcaggc

SEQ ID NO: 2120915 - RNA, 14 nt, Human
acgagaaaacaaua

SEQ ID NO: 2120916 - RNA, 21 nt, Human
cggcuccggacgcugcugccg

SEQ ID NO: 2120917 - RNA, 21 nt, Human
ugaccauacuaauuauacccc

SEQ ID NO: 2120918 - RNA, 20 nt, Human
augguuuagaaagcuugccc

SEQ ID NO: 2120919 - RNA, 21 nt, Human
auauaugcuaagucuuauaua

SEQ ID NO: 2120920 - RNA, 23 nt, Human
aauaauccucaguuuuugugaaa

SEQ ID NO: 2120921 - RNA, 16 nt, Human
gacauagaauuaacac

SEQ ID NO: 2120922 - RNA, 13 nt, Human
cuucucaacucca

SEQ ID NO: 2120923 - RNA, 14 nt, Human
cgcgcccucuggcu

SEQ ID NO: 2120924 - RNA, 19 nt, Human
gaaaauaacgauaaaagac

SEQ ID NO: 2120925 - RNA, 14 nt, Human
ggccgggagccuga

SEQ ID NO: 2120926 - RNA, 23 nt, Human
caccaaggagccaaacauccuac

SEQ ID NO: 2120927 - RNA, 16 nt, Human
agugagacagcucugc

SEQ ID NO: 2120928 - RNA, 14 nt, Human
ucccugcugcccuu

SEQ ID NO: 2120929 - RNA, 15 nt, Human
ucccacccgcccacc

SEQ ID NO: 2120930 - RNA, 22 nt, Human
guacacugccuucucaacucca

SEQ ID NO: 2120931 - RNA, 21 nt, Human
aucuuuuuuuuaauaaaccau

SEQ ID NO: 2120932 - RNA, 13 nt, Human
guuuaaguucuau

SEQ ID NO: 2120933 - RNA, 20 nt, Human
uggaaacacauguuccccuu

SEQ ID NO: 2120934 - RNA, 20 nt, Human
agcagcccuuagcccuuccc

SEQ ID NO: 2120935 - RNA, 16 nt, Human
cacacuguccauucuu

SEQ ID NO: 2120936 - RNA, 18 nt, Human
gaaaugaaagcagggacu

SEQ ID NO: 2120937 - RNA, 12 nt, Human
ccaggcugagcc

SEQ ID NO: 2120938 - RNA, 18 nt, Human
gcauggccacaucugagc

SEQ ID NO: 2120939 - RNA, 17 nt, Human
auaauuuaaauauaugc

SEQ ID NO: 2120940 - RNA, 13 nt, Human
cugcacuccagcc

SEQ ID NO: 2120941 - RNA, 15 nt, Human
cccccagcccuccuu

SEQ ID NO: 2120942 - RNA, 17 nt, Human
agaugggagaaucacuu

SEQ ID NO: 2120943 - RNA, 12 nt, Human
gcauccuagucu

SEQ ID NO: 2120944 - RNA, 23 nt, Human
guuguaauuuuuuugugggaaau

SEQ ID NO: 2120945 - RNA, 20 nt, Human
cagcuggccgggagccugau

SEQ ID NO: 2120946 - RNA, 18 nt, Human
cuaggcauagcccugccu

SEQ ID NO: 2120947 - RNA, 19 nt, Human
cuccucggacggcuccgga

SEQ ID NO: 2120948 - RNA, 20 nt, Human
gaacguaaucguguccccua

SEQ ID NO: 2120949 - RNA, 23 nt, Human
augaauuaaguuuuuuuuuaaaa

SEQ ID NO: 2120950 - RNA, 22 nt, Human
gagucccaggcugagccucagu

SEQ ID NO: 2120951 - RNA, 15 nt, Human
gcagcucaggcuggc

SEQ ID NO: 2120952 - RNA, 20 nt, Human
uagucucuaucauuaaaguu

SEQ ID NO: 2120953 - RNA, 23 nt, Human
cacauuggaaacaagucagucau

SEQ ID NO: 2120954 - RNA, 15 nt, Human
ccacaucugagcccc

SEQ ID NO: 2120955 - RNA, 20 nt, Human
guccccuauccuacuucccc

SEQ ID NO: 2120956 - RNA, 12 nt, Human
ucccccucuggc

SEQ ID NO: 2120957 - RNA, 13 nt, Human
gcccccgggccga

SEQ ID NO: 2120958 - RNA, 15 nt, Human
ucuaggacugaauua

SEQ ID NO: 2120959 - RNA, 15 nt, Human
agagacagaaagcag

SEQ ID NO: 2120960 - RNA, 19 nt, Human
uguccauucuuccucccau

SEQ ID NO: 2120961 - RNA, 15 nt, Human
uuuaugguuguauua

SEQ ID NO: 2120962 - RNA, 19 nt, Human
uaaugaaguguuuagcaua

SEQ ID NO: 2120963 - RNA, 21 nt, Human
ugcccauccugccccugagcc

SEQ ID NO: 2120964 - RNA, 15 nt, Human
acgagauacagaauu

SEQ ID NO: 2120965 - RNA, 17 nt, Human
ccagggaagacaagaag

SEQ ID NO: 2120966 - RNA, 23 nt, Human
gaggcauuuaggccaugggacag

SEQ ID NO: 2120967 - RNA, 15 nt, Human
uuucccagucuucag

SEQ ID NO: 2120968 - RNA, 14 nt, Human
aauuguauuacaaa

SEQ ID NO: 2120969 - RNA, 18 nt, Human
aaacugccaucauuuacu

SEQ ID NO: 2120970 - RNA, 15 nt, Human
augggacagggagga

SEQ ID NO: 2120971 - RNA, 23 nt, Human
cccacuggacucaccucccccau

SEQ ID NO: 2120972 - RNA, 18 nt, Human
cccaagccuggcaaggga

SEQ ID NO: 2120973 - RNA, 19 nt, Human
ccaccugccuauauuuuuu

SEQ ID NO: 2120974 - RNA, 17 nt, Human
auguuuacagaucccca

SEQ ID NO: 2120975 - RNA, 23 nt, Human
gcuaugcuauugaaguuuuggca

SEQ ID NO: 2120976 - RNA, 17 nt, Human
cgcucaucccacccgcc

SEQ ID NO: 2120977 - RNA, 13 nt, Human
acacuuaaaaaug

SEQ ID NO: 2120978 - RNA, 21 nt, Human
cuauuuaauuauuucacuuua

SEQ ID NO: 2120979 - RNA, 11 nt, Human
gcaugguuuag

SEQ ID NO: 2120980 - RNA, 20 nt, Human
ucauucacucaacaaacaua

SEQ ID NO: 2120981 - RNA, 16 nt, Human
aaauaguuuaugauuc

SEQ ID NO: 2120982 - RNA, 17 nt, Human
ccaaggaugccccgucc

SEQ ID NO: 2120983 - RNA, 16 nt, Human
ugcuguucaugaaaga

SEQ ID NO: 2120984 - RNA, 13 nt, Human
auccugaggcucc

SEQ ID NO: 2120985 - RNA, 20 nt, Human
gccuaauuuguuuucccuuc

SEQ ID NO: 2120986 - RNA, 17 nt, Human
gaagcaccaaucaugaa

SEQ ID NO: 2120987 - RNA, 14 nt, Human
cagucucccucccu

SEQ ID NO: 2120988 - RNA, 11 nt, Human
gcauccuaguc

SEQ ID NO: 2120989 - RNA, 23 nt, Human
agcucugcccauccugccccuga

SEQ ID NO: 2120990 - RNA, 21 nt, Human
gaaauguuuacagauccccaa

SEQ ID NO: 2120991 - RNA, 15 nt, Human
auuuauuaaguauuu

SEQ ID NO: 2120992 - RNA, 23 nt, Human
ggccugcucgcccacuuccuccc

SEQ ID NO: 2120993 - RNA, 23 nt, Human
cuagaauuugauaugugaacagu

SEQ ID NO: 2120994 - RNA, 22 nt, Human
uucauucacucaacaaacauaa

SEQ ID NO: 2120995 - RNA, 15 nt, Human
caggaaguagaggag

SEQ ID NO: 2120996 - RNA, 24 nt, Human
gucgcaggaccaucccggccggcg

SEQ ID NO: 2120997 - RNA, 21 nt, Human
acugccaaaacaucaaccugc

SEQ ID NO: 2120998 - RNA, 13 nt, Human
auauauauuuuuu

SEQ ID NO: 2120999 - RNA, 19 nt, Human
agguaaccucauuaucagu

SEQ ID NO: 2121000 - RNA, 19 nt, Human
cauggccacaucugagccc

SEQ ID NO: 2121001 - RNA, 15 nt, Human
uccgcauccuagucu

SEQ ID NO: 2121002 - RNA, 22 nt, Human
aaucacuggcuguuaaucuuuc

SEQ ID NO: 2121003 - RNA, 14 nt, Human
cuucucuucacagu

SEQ ID NO: 2121004 - RNA, 16 nt, Human
agugaaggauuuaugu

SEQ ID NO: 2121005 - RNA, 16 nt, Human
uguccccuauccuacu

SEQ ID NO: 2121006 - RNA, 23 nt, Human
auguuaaaacugggacaggggag

SEQ ID NO: 2121007 - RNA, 14 nt, Human
aagugugacucauu

SEQ ID NO: 2121008 - RNA, 21 nt, Human
auuauauggcuugaguuuaaa

SEQ ID NO: 2121009 - RNA, 23 nt, Human
auuccugaacaggauauucucac

SEQ ID NO: 2121010 - RNA, 19 nt, Human
uacaaaaaaaaaaaaaaau

SEQ ID NO: 2121011 - RNA, 15 nt, Human
uuuuaggaauacaua

SEQ ID NO: 2121012 - RNA, 21 nt, Human
cacuugaacccgggaggcaga

SEQ ID NO: 2121013 - RNA, 16 nt, Human
agaguuccuucugcuc

SEQ ID NO: 2121014 - RNA, 23 nt, Human
cacagauuugagcucagcccugg

SEQ ID NO: 2121015 - RNA, 23 nt, Human
gggccuaugcagagguccacaac

SEQ ID NO: 2121016 - RNA, 20 nt, Human
acggcuccggacgcugcugc

SEQ ID NO: 2121017 - RNA, 19 nt, Human
cuaguaucaaaagaaagaa

SEQ ID NO: 2121018 - RNA, 20 nt, Human
ggcuaauaucuuaucuuccu

SEQ ID NO: 2121019 - RNA, 18 nt, Human
acauguuacaacacggac

SEQ ID NO: 2121020 - RNA, 17 nt, Human
cuucugaggagcuguug

SEQ ID NO: 2121021 - RNA, 18 nt, Human
auaaaguguuugaaagcu

SEQ ID NO: 2121022 - RNA, 16 nt, Human
cauuuguauaaaauaa

SEQ ID NO: 2121023 - RNA, 20 nt, Human
ccagggcuacgcgcgcuccg

SEQ ID NO: 2121024 - RNA, 12 nt, Human
uccaaagggcau

SEQ ID NO: 2121025 - RNA, 17 nt, Human
gaaugagagacacacug

SEQ ID NO: 2121026 - RNA, 21 nt, Human
uuuuagggguagcauuugugu

SEQ ID NO: 2121027 - RNA, 18 nt, Human
ugggauacuauuuaauua

SEQ ID NO: 2121028 - RNA, 15 nt, Human
aaaugauguuucaua

SEQ ID NO: 2121029 - RNA, 13 nt, Human
ucugcagcuucca

SEQ ID NO: 2121030 - RNA, 17 nt, Human
caggaaucacuggcugu

SEQ ID NO: 2121031 - RNA, 12 nt, Human
gcucagcccugg

SEQ ID NO: 2121032 - RNA, 14 nt, Human
cagagucaagggug

SEQ ID NO: 2121033 - RNA, 16 nt, Human
aaauauaaauaaaaau

SEQ ID NO: 2121034 - RNA, 17 nt, Human
agcuggaaacacauguu

SEQ ID NO: 2121035 - RNA, 17 nt, Human
caggagcaucuccucaa

SEQ ID NO: 2121036 - RNA, 22 nt, Human
uguuuuuccaguaguuagcuuu

SEQ ID NO: 2121037 - RNA, 14 nt, Human
cgagcgcgcgcgcc

SEQ ID NO: 2121038 - RNA, 22 nt, Human
uuccuagucuguuuucccuccu

SEQ ID NO: 2121039 - RNA, 18 nt, Human
acauuugcucauggaauu

SEQ ID NO: 2121040 - RNA, 17 nt, Human
agauagaugaagaagcu

SEQ ID NO: 2121041 - RNA, 21 nt, Human
uguauaaaauaauuuuuauau

SEQ ID NO: 2121042 - RNA, 15 nt, Human
cuugaaaacuuuaug

SEQ ID NO: 2121043 - RNA, 17 nt, Human
acaucgcagacacaugu

SEQ ID NO: 2121044 - RNA, 21 nt, Human
gggagccugaucaccugcccu

SEQ ID NO: 2121045 - RNA, 23 nt, Human
auauaacaaugcuguauuuuaaa

SEQ ID NO: 2121046 - RNA, 16 nt, Human
cccacuggacucaccu

SEQ ID NO: 2121047 - RNA, 15 nt, Human
aucaauuuaaaaaaa

SEQ ID NO: 2121048 - RNA, 17 nt, Human
auuagcauggccacauc

SEQ ID NO: 2121049 - RNA, 16 nt, Human
uguucuaagaagugaa

SEQ ID NO: 2121050 - RNA, 22 nt, Human
caucaucuucuggguuaggccu

SEQ ID NO: 2121051 - RNA, 17 nt, Human
uuucauaagaauucugu

SEQ ID NO: 2121052 - RNA, 12 nt, Human
aaugcagccccc

SEQ ID NO: 2121053 - RNA, 16 nt, Human
acaugaaguccaagca

SEQ ID NO: 2121054 - RNA, 18 nt, Human
caaggcugauuaaaccaa

SEQ ID NO: 2121055 - RNA, 12 nt, Human
acaagacacagu

SEQ ID NO: 2121056 - RNA, 20 nt, Human
agcugccccggggaggggcg

SEQ ID NO: 2121057 - RNA, 23 nt, Human
agcaugucgucaaagcugaaaug

SEQ ID NO: 2121058 - RNA, 19 nt, Human
aaaauaacaauaaaagaca

SEQ ID NO: 2121059 - RNA, 18 nt, Human
gcccacuuccucccggcc

SEQ ID NO: 2121060 - RNA, 13 nt, Human
aacacaacuauau

SEQ ID NO: 2121061 - RNA, 15 nt, Human
acaucaacagauaaa

SEQ ID NO: 2121062 - RNA, 12 nt, Human
uauauuuccuua

SEQ ID NO: 2121063 - RNA, 19 nt, Human
aagccaugugcagccacca

SEQ ID NO: 2121064 - RNA, 17 nt, Human
uucacuuuuauaagaaa

SEQ ID NO: 2121065 - RNA, 15 nt, Human
cgcgcuccgcgcagc

SEQ ID NO: 2121066 - RNA, 22 nt, Human
ugagacucugucucaguccaug

SEQ ID NO: 2121067 - RNA, 16 nt, Human
uaaacuuugauuuuau

SEQ ID NO: 2121068 - RNA, 22 nt, Human
aggacaccauuuuggcaagcuc

SEQ ID NO: 2121069 - RNA, 12 nt, Human
aauaaaguacaa

SEQ ID NO: 2121070 - RNA, 18 nt, Human
uaaugaauacuuuauaaa

SEQ ID NO: 2121071 - RNA, 18 nt, Human
uuuucucuccucucccca

SEQ ID NO: 2121072 - RNA, 17 nt, Human
gacagugaaagaaaaua

SEQ ID NO: 2121073 - RNA, 21 nt, Human
cuguguccucaugagggcugg

SEQ ID NO: 2121074 - RNA, 11 nt, Human
ugugugcagca

SEQ ID NO: 2121075 - RNA, 20 nt, Human
uaauaucuuaucuuccuaua

SEQ ID NO: 2121076 - RNA, 18 nt, Human
acggcuccggacgcugcu

SEQ ID NO: 2121077 - RNA, 18 nt, Human
aaaaucuuauaauuuaaa

SEQ ID NO: 2121078 - RNA, 16 nt, Human
ggcugagccucagucu

SEQ ID NO: 2121079 - RNA, 21 nt, Human
gcaaaauuuuuucucuaggaa

SEQ ID NO: 2121080 - RNA, 15 nt, Human
cuuuucccaacucca

SEQ ID NO: 2121081 - RNA, 21 nt, Human
caucccacccgcccaccgcag

SEQ ID NO: 2121082 - RNA, 18 nt, Human
uuuugugaagcaaaauuu

SEQ ID NO: 2121083 - RNA, 21 nt, Human
auauauuuuuuuuuuuaaaaa

SEQ ID NO: 2121084 - RNA, 19 nt, Human
gaccggccuuugcaccucc

SEQ ID NO: 2121085 - RNA, 19 nt, Human
uuuauaucaauuuaaaaaa

SEQ ID NO: 2121086 - RNA, 20 nt, Human
aggauauucucacagcucca

SEQ ID NO: 2121087 - RNA, 21 nt, Human
gugccguccccagagcuacag

SEQ ID NO: 2121088 - RNA, 21 nt, Human
gauguggggaaguuaggaacu

SEQ ID NO: 2121089 - RNA, 14 nt, Human
gugagcuacaaaug

SEQ ID NO: 2121090 - RNA, 15 nt, Human
auaauccuaaacaua

SEQ ID NO: 2121091 - RNA, 19 nt, Human
uugugggauacuauuuaau

SEQ ID NO: 2121092 - RNA, 20 nt, Human
aauuaaguuuuuuuuuaaaa

SEQ ID NO: 2121093 - RNA, 18 nt, Human
acagagacagaaagcaga

SEQ ID NO: 2121094 - RNA, 19 nt, Human
uguaaagguccuggcaaag

SEQ ID NO: 2121095 - RNA, 17 nt, Human
ugaauauaaauuuauca

SEQ ID NO: 2121096 - RNA, 14 nt, Human
ccggggaggggcgc

SEQ ID NO: 2121097 - RNA, 15 nt, Human
gagcgcgcgcgcccu

SEQ ID NO: 2121098 - RNA, 17 nt, Human
ucuauaauguguucauu

SEQ ID NO: 2121099 - RNA, 22 nt, Human
cgcgcgccuccgcuacuuccag

SEQ ID NO: 2121100 - RNA, 12 nt, Human
cauagaaguaaa

SEQ ID NO: 2121101 - RNA, 17 nt, Human
auuuuaauaauguuuca

SEQ ID NO: 2121102 - RNA, 21 nt, Human
ggaagacaagaaggaaagauu

SEQ ID NO: 2121103 - RNA, 22 nt, Human
gcugguggcgcuggcugcgcuc

SEQ ID NO: 2121104 - RNA, 18 nt, Human
caaguaaaaggaaaugcu

SEQ ID NO: 2121105 - RNA, 22 nt, Human
ugaauggcuaagcaaaauguga

SEQ ID NO: 2121106 - RNA, 19 nt, Human
uccuauaauuuuagacauu

SEQ ID NO: 2121107 - RNA, 15 nt, Human
ccucauguccacugg

SEQ ID NO: 2121108 - RNA, 18 nt, Human
cuaauuagcauggccaca

SEQ ID NO: 2121109 - RNA, 18 nt, Human
ugcccauaccccuggcca

SEQ ID NO: 2121110 - RNA, 19 nt, Human
agcucugcccauccugccc

SEQ ID NO: 2121111 - RNA, 13 nt, Human
acaaggaaaaaau

SEQ ID NO: 2121112 - RNA, 15 nt, Human
uaagucccugcugcc

SEQ ID NO: 2121113 - RNA, 23 nt, Human
augaauaucaguuauuuuuaaac

SEQ ID NO: 2121114 - RNA, 15 nt, Human
uaucaguccaaaggg

SEQ ID NO: 2121115 - RNA, 19 nt, Human
cagauccccaagccuggca

SEQ ID NO: 2121116 - RNA, 15 nt, Human
acagugaaagaaaau

SEQ ID NO: 2121117 - RNA, 14 nt, Human
ugguauguuuucag

SEQ ID NO: 2121118 - RNA, 20 nt, Human
uaggaauugacccacaagaa

SEQ ID NO: 2121119 - RNA, 15 nt, Human
ccucucuuccucccu

SEQ ID NO: 2121120 - RNA, 22 nt, Human
cucugagccuugggaccccuga

SEQ ID NO: 2121121 - RNA, 22 nt, Human
uucugguagcuaaauauauauu

SEQ ID NO: 2121122 - RNA, 14 nt, Human
acauagugaggagc

SEQ ID NO: 2121123 - RNA, 13 nt, Human
ccuccuuuuaaag

SEQ ID NO: 2121124 - RNA, 15 nt, Human
uacuaauuuuaaaau

SEQ ID NO: 2121125 - RNA, 19 nt, Human
ggcugcugguggcgcuggc

SEQ ID NO: 2121126 - RNA, 23 nt, Human
caugcugucuacacuaagagaga

SEQ ID NO: 2121127 - RNA, 11 nt, Human
uuauuuuuaaa

SEQ ID NO: 2121128 - RNA, 20 nt, Human
cagagaaguuuucuggaggu

SEQ ID NO: 2121129 - RNA, 21 nt, Human
gcugagucccaggcugagccu

SEQ ID NO: 2121130 - RNA, 23 nt, Human
uagaagucacauuccugaacagg

SEQ ID NO: 2121131 - RNA, 21 nt, Human
ugaugcuacaggauuugaaau

SEQ ID NO: 2121132 - RNA, 16 nt, Human
uauccuacuuccccuu

SEQ ID NO: 2121133 - RNA, 12 nt, Human
augaccaacauc

SEQ ID NO: 2121134 - RNA, 15 nt, Human
acugaagaagcacca

SEQ ID NO: 2121135 - RNA, 11 nt, Human
ggggaggggcg

SEQ ID NO: 2121136 - RNA, 15 nt, Human
cucgcccacuuccuc

SEQ ID NO: 2121137 - RNA, 19 nt, Human
auacuaauuauacccccug

SEQ ID NO: 2121138 - RNA, 15 nt, Human
gcugguggcgcuggc

SEQ ID NO: 2121139 - RNA, 21 nt, Human
ccuccagcugccccggggagg

SEQ ID NO: 2121140 - RNA, 10 nt, Human
auguuuucag

SEQ ID NO: 2121141 - RNA, 22 nt, Human
cugggacaggggagaaccuagg

SEQ ID NO: 2121142 - RNA, 15 nt, Human
ugauucaaaugucua

SEQ ID NO: 2121143 - RNA, 14 nt, Human
gcgcgcuccgcgca

SEQ ID NO: 2121144 - RNA, 20 nt, Human
cuaauguguaagacaaaaag

SEQ ID NO: 2121145 - RNA, 14 nt, Human
aagucagucauuca

SEQ ID NO: 2121146 - RNA, 19 nt, Human
uaucuauguagaauauauu

SEQ ID NO: 2121147 - RNA, 19 nt, Human
cacggcuggagcugccucu

SEQ ID NO: 2121148 - RNA, 19 nt, Human
caguccauugggcaggcag

SEQ ID NO: 2121149 - RNA, 23 nt, Human
gccgggaaagaagagccggagcc

SEQ ID NO: 2121150 - RNA, 16 nt, Human
ugagccccgaaucuga

SEQ ID NO: 2121151 - RNA, 22 nt, Human
gucucuacuaaaaauacaaaaa

SEQ ID NO: 2121152 - RNA, 13 nt, Human
auugauuauaugu

SEQ ID NO: 2121153 - RNA, 14 nt, Human
cugggucgccggca

SEQ ID NO: 2121154 - RNA, 20 nt, Human
gacggcuccggacgcugcug

SEQ ID NO: 2121155 - RNA, 16 nt, Human
aagcuucacuguaaaa

SEQ ID NO: 2121156 - RNA, 22 nt, Human
uuucuaggacugaauuaugaaa

SEQ ID NO: 2121157 - RNA, 15 nt, Human
guuuuucuuuucauu

SEQ ID NO: 2121158 - RNA, 20 nt, Human
agcccuuccccucugcagcu

SEQ ID NO: 2121159 - RNA, 20 nt, Human
acaagacacagugaccauac

SEQ ID NO: 2121160 - RNA, 19 nt, Human
cuagucuguuuucccuccu

SEQ ID NO: 2121161 - RNA, 16 nt, Human
ugcacaucaaaauaug

SEQ ID NO: 2121162 - RNA, 17 nt, Human
uccugccccugagccca

SEQ ID NO: 2121163 - RNA, 18 nt, Human
acauuuauauuuuuguga

SEQ ID NO: 2121164 - RNA, 18 nt, Human
auuugcuggagcucugcc

SEQ ID NO: 2121165 - RNA, 16 nt, Human
agcuugaaaccuucac

SEQ ID NO: 2121166 - RNA, 19 nt, Human
gcugcccuuccccuuccca

SEQ ID NO: 2121167 - RNA, 14 nt, Human
gaaacgaagcacca

SEQ ID NO: 2121168 - RNA, 15 nt, Human
cggagccuccagcug

SEQ ID NO: 2121169 - RNA, 18 nt, Human
ggaaacaagucagucauu

SEQ ID NO: 2121170 - RNA, 20 nt, Human
cugcugcccuuccccuuccc

SEQ ID NO: 2121171 - RNA, 11 nt, Human
cauaugaaaag

SEQ ID NO: 2121172 - RNA, 14 nt, Human
acuauuauauuucc

SEQ ID NO: 2121173 - RNA, 19 nt, Human
auuuccuuauucagaauuu

SEQ ID NO: 2121174 - RNA, 22 nt, Human
gcacagccucuuagaugcaguu

SEQ ID NO: 2121175 - RNA, 22 nt, Human
gcuaauuagcauggccacaucu

SEQ ID NO: 2121176 - RNA, 15 nt, Human
cgggagccugaucac

SEQ ID NO: 2121177 - RNA, 22 nt, Human
gcgcggcgggagggcgcggggc

SEQ ID NO: 2121178 - RNA, 16 nt, Human
cugcugagucccaggc

SEQ ID NO: 2121179 - RNA, 20 nt, Human
ccugccuaagugcagccccg

SEQ ID NO: 2121180 - RNA, 16 nt, Human
acauuuauauuuuugu

SEQ ID NO: 2121181 - RNA, 15 nt, Human
gaauaaccaacaccc

SEQ ID NO: 2121182 - RNA, 18 nt, Human
aagaaauaggaaauauuu

SEQ ID NO: 2121183 - RNA, 22 nt, Human
accauuucuugagguaaaagca

SEQ ID NO: 2121184 - RNA, 20 nt, Human
agggaagacaagaaggaaag

SEQ ID NO: 2121185 - RNA, 21 nt, Human
gcccauccugccccugagccc

SEQ ID NO: 2121186 - RNA, 22 nt, Human
accuaacgaaguauccuucagc

SEQ ID NO: 2121187 - RNA, 22 nt, Human
auaaaguaugugcauauuuuau

SEQ ID NO: 2121188 - RNA, 20 nt, Human
cugagaccaaggcccccggg

SEQ ID NO: 2121189 - RNA, 18 nt, Human
ucuucuggguuccuuccu

SEQ ID NO: 2121190 - RNA, 22 nt, Human
caaaugggaaacaaaaggauaa

SEQ ID NO: 2121191 - RNA, 18 nt, Human
agucuguuuucccuccuu

SEQ ID NO: 2121192 - RNA, 21 nt, Human
uguccucaugagggcuggaug

SEQ ID NO: 2121193 - RNA, 19 nt, Human
guuguauuauuuuuuaaaa

SEQ ID NO: 2121194 - RNA, 17 nt, Human
gacgagaaaacaauaac

SEQ ID NO: 2121195 - RNA, 12 nt, Human
caacccaaaugu

SEQ ID NO: 2121196 - RNA, 16 nt, Human
uuaauaauuuuuaauu

SEQ ID NO: 2121197 - RNA, 15 nt, Human
uuaauuuguaguguu

SEQ ID NO: 2121198 - RNA, 12 nt, Human
cuccagcugccc

SEQ ID NO: 2121199 - RNA, 14 nt, Human
ucuuccucccauuc

SEQ ID NO: 2121200 - RNA, 13 nt, Human
cugccuucucaac

SEQ ID NO: 2121201 - RNA, 13 nt, Human
ucacauuccugaa

SEQ ID NO: 2121202 - RNA, 15 nt, Human
uucacuguaaaauaa

SEQ ID NO: 2121203 - RNA, 22 nt, Human
aauuuuagacauucuuuaucuu

SEQ ID NO: 2121204 - RNA, 21 nt, Human
ugaaauaaacgucuuaaauau

SEQ ID NO: 2121205 - RNA, 14 nt, Human
ccucugcagcuucc

SEQ ID NO: 2121206 - RNA, 18 nt, Human
ccgggccgacggagccgg

SEQ ID NO: 2121207 - RNA, 18 nt, Human
uuguaaaggaauuuaaaa

SEQ ID NO: 2121208 - RNA, 17 nt, Human
uucacuguaaaauaaua

SEQ ID NO: 2121209 - RNA, 23 nt, Human
gcugccccggggaggggcgcucg

SEQ ID NO: 2121210 - RNA, 19 nt, Human
ucgcccacuuccucccggc

SEQ ID NO: 2121211 - RNA, 18 nt, Human
aacaaugcuguauuuuaa

SEQ ID NO: 2121212 - RNA, 16 nt, Human
auuugaugcuacagga

SEQ ID NO: 2121213 - RNA, 15 nt, Human
gcgagcgcgcgcgcc

SEQ ID NO: 2121214 - RNA, 15 nt, Human
ggaaauauuuuaaug

SEQ ID NO: 2121215 - RNA, 15 nt, Human
ccaugugcagccacc

SEQ ID NO: 2121216 - RNA, 19 nt, Human
auguuuacagauccccaag

SEQ ID NO: 2121217 - RNA, 21 nt, Human
cuaagcuucacuguaaaauaa

SEQ ID NO: 2121218 - RNA, 16 nt, Human
ugcagugucugcugga

SEQ ID NO: 2121219 - RNA, 13 nt, Human
cgcgcccucuggc

SEQ ID NO: 2121220 - RNA, 18 nt, Human
cuucacuguaaaauaaua

SEQ ID NO: 2121221 - RNA, 15 nt, Human
agucuguuuucccuc

SEQ ID NO: 2121222 - RNA, 19 nt, Human
cucaagcuaugugagcuca

SEQ ID NO: 2121223 - RNA, 19 nt, Human
uucuuuaucuuuuuaguau

SEQ ID NO: 2121224 - RNA, 22 nt, Human
ugaguuuuucuuuucauuuacc

SEQ ID NO: 2121225 - RNA, 14 nt, Human
ugagcuugcagaga

SEQ ID NO: 2121226 - RNA, 18 nt, Human
auuuguauaaaauaauuu

SEQ ID NO: 2121227 - RNA, 16 nt, Human
uauaaauuuaucauuu

SEQ ID NO: 2121228 - RNA, 18 nt, Human
aucuauguagaauauauu

SEQ ID NO: 2121229 - RNA, 20 nt, Human
agcuuauugucuagugaaac

SEQ ID NO: 2121230 - RNA, 20 nt, Human
ccauacuaauuauacccccu

SEQ ID NO: 2121231 - RNA, 18 nt, Human
cagggaggacgcucucug

SEQ ID NO: 2121232 - RNA, 20 nt, Human
ccuguucgcgcgccuccgcu

SEQ ID NO: 2121233 - RNA, 20 nt, Human
uuccacagaagcuccaggua

SEQ ID NO: 2121234 - RNA, 16 nt, Human
gccucucucauccacu

SEQ ID NO: 2121235 - RNA, 20 nt, Human
auuacauuuguauaaaauaa

SEQ ID NO: 2121236 - RNA, 17 nt, Human
caucgcagacacaugug

SEQ ID NO: 2121237 - RNA, 13 nt, Human
guggcgcuggcug

SEQ ID NO: 2121238 - RNA, 22 nt, Human
agugagcagucaggaaagagaa

SEQ ID NO: 2121239 - RNA, 22 nt, Human
cagacacaugugcuggccaccu

SEQ ID NO: 2121240 - RNA, 18 nt, Human
uauaacaaugcuguauuu

SEQ ID NO: 2121241 - RNA, 13 nt, Human
aucuggcucugga

SEQ ID NO: 2121242 - RNA, 22 nt, Human
acaugagguacugagagugaac

SEQ ID NO: 2121243 - RNA, 15 nt, Human
cuucugaggagcugu

SEQ ID NO: 2121244 - RNA, 17 nt, Human
gcgcucaucccacccgc

SEQ ID NO: 2121245 - RNA, 15 nt, Human
agccugaaagaggaa

SEQ ID NO: 2121246 - RNA, 16 nt, Human
cuguccauucuuccuc

SEQ ID NO: 2121247 - RNA, 12 nt, Human
agcuuucuuccu

SEQ ID NO: 2121248 - RNA, 15 nt, Human
aaacauaugaauuau

SEQ ID NO: 2121249 - RNA, 15 nt, Human
ugcuugucccugugg

SEQ ID NO: 2121250 - RNA, 14 nt, Human
ggggcggggagcga

SEQ ID NO: 2121251 - RNA, 13 nt, Human
aacaauaaaagac

SEQ ID NO: 2121252 - RNA, 14 nt, Human
agaauauauuuccu

SEQ ID NO: 2121253 - RNA, 13 nt, Human
uucuauaauuuaa

SEQ ID NO: 2121254 - RNA, 19 nt, Human
uggcaaacugccaucauuu

SEQ ID NO: 2121255 - RNA, 17 nt, Human
auuauuuuuuaaaaaaa

SEQ ID NO: 2121256 - RNA, 20 nt, Human
ccagcuugaaaccuucacuu

SEQ ID NO: 2121257 - RNA, 14 nt, Human
agcgcgcgcgcccu

SEQ ID NO: 2121258 - RNA, 17 nt, Human
ggcuggagcugccucuc

SEQ ID NO: 2121259 - RNA, 18 nt, Human
aauuuuagacauucuuua

SEQ ID NO: 2121260 - RNA, 14 nt, Human
caaaugcauuucua

SEQ ID NO: 2121261 - RNA, 22 nt, Human
auauauauuuuuuuuuuuaaaa

SEQ ID NO: 2121262 - RNA, 13 nt, Human
acggggugaaacc

SEQ ID NO: 2121263 - RNA, 15 nt, Human
gccccugcacuccag

SEQ ID NO: 2121264 - RNA, 18 nt, Human
gaaacaaaaggauaauga

SEQ ID NO: 2121265 - RNA, 21 nt, Human
auuuuuucucuaggaaauauu

SEQ ID NO: 2121266 - RNA, 23 nt, Human
auuuuauagcuacuaauuuuaaa

SEQ ID NO: 2121267 - RNA, 12 nt, Human
auuuuaaaagaa

SEQ ID NO: 2121268 - RNA, 21 nt, Human
gcucggccugcucgcccacuu

SEQ ID NO: 2121269 - RNA, 16 nt, Human
uggaaacgaagcacca

SEQ ID NO: 2121270 - RNA, 14 nt, Human
augcuccuccaggg

SEQ ID NO: 2121271 - RNA, 15 nt, Human
aaaauaacaaugaaa

SEQ ID NO: 2121272 - RNA, 23 nt, Human
ucaugcccauaccccuggccaag

SEQ ID NO: 2121273 - RNA, 22 nt, Human
uuguucuugugaacccaaagug

SEQ ID NO: 2121274 - RNA, 22 nt, Human
acggcuggagcugccucucuca

SEQ ID NO: 2121275 - RNA, 13 nt, Human
gggcggggagcga

SEQ ID NO: 2121276 - RNA, 14 nt, Human
aucaccaaggcuga

SEQ ID NO: 2121277 - RNA, 14 nt, Human
aaugauuaugaauu

SEQ ID NO: 2121278 - RNA, 20 nt, Human
ucuaugagggcuaauaucuu

SEQ ID NO: 2121279 - RNA, 15 nt, Human
uugacccacaagaaa

SEQ ID NO: 2121280 - RNA, 10 nt, Human
accugagccc

SEQ ID NO: 2121281 - RNA, 18 nt, Human
cagccucuuagaugcagu

SEQ ID NO: 2121282 - RNA, 18 nt, Human
cauguuccccuugggggu

SEQ ID NO: 2121283 - RNA, 23 nt, Human
ccacaccaaccuucugaggagcu

SEQ ID NO: 2121284 - RNA, 13 nt, Human
cacauuuaaauaa

SEQ ID NO: 2121285 - RNA, 13 nt, Human
gaugcccacggcu

SEQ ID NO: 2121286 - RNA, 14 nt, Human
cccauucaggaugc

SEQ ID NO: 2121287 - RNA, 22 nt, Human
cugugccguccccagagcuaca

SEQ ID NO: 2121288 - RNA, 17 nt, Human
agugauuaccagggacu

SEQ ID NO: 2121289 - RNA, 13 nt, Human
auuuuaaaagaau

SEQ ID NO: 2121290 - RNA, 17 nt, Human
ucuaaauucuuucauuu

SEQ ID NO: 2121291 - RNA, 19 nt, Human
ugagcgcccacuagaccca

SEQ ID NO: 2121292 - RNA, 17 nt, Human
cauuaaaguucuaguga

SEQ ID NO: 2121293 - RNA, 22 nt, Human
ggcuaagcuucacuguaaaaua

SEQ ID NO: 2121294 - RNA, 20 nt, Human
cagucccuccccaaaugcuu

SEQ ID NO: 2121295 - RNA, 20 nt, Human
auaagccagacaucaacaga

SEQ ID NO: 2121296 - RNA, 18 nt, Human
ggccacaucugagccccg

SEQ ID NO: 2121297 - RNA, 18 nt, Human
caugaauuaguuuuauau

SEQ ID NO: 2121298 - RNA, 15 nt, Human
ucaagggugugugca

SEQ ID NO: 2121299 - RNA, 23 nt, Human
ucuuagaugcaguucugaagaag

SEQ ID NO: 2121300 - RNA, 23 nt, Human
uccagguagaggguguguaagua

SEQ ID NO: 2121301 - RNA, 22 nt, Human
ccccuuccuaauuccacagcug

SEQ ID NO: 2121302 - RNA, 16 nt, Human
uggcaauugacuauag

SEQ ID NO: 2121303 - RNA, 18 nt, Human
ccugaggugagcaucauc

SEQ ID NO: 2121304 - RNA, 21 nt, Human
uuguaauuuuuuugugggaaa

SEQ ID NO: 2121305 - RNA, 20 nt, Human
uugaacccgggaggcagagg

SEQ ID NO: 2121306 - RNA, 18 nt, Human
cucccuuggggccuaugc

SEQ ID NO: 2121307 - RNA, 12 nt, Human
cuaagaagugaa

SEQ ID NO: 2121308 - RNA, 16 nt, Human
ucaucaaugaaugaau

SEQ ID NO: 2121309 - RNA, 16 nt, Human
auccuacaagacacag

SEQ ID NO: 2121310 - RNA, 19 nt, Human
gucuuucacauuuaaauaa

SEQ ID NO: 2121311 - RNA, 19 nt, Human
gcauggccacaucugagcc

SEQ ID NO: 2121312 - RNA, 22 nt, Human
uggagacauugaggcaggcacu

SEQ ID NO: 2121313 - RNA, 20 nt, Human
cccugccccccagcccuccu

SEQ ID NO: 2121314 - RNA, 18 nt, Human
aaauaacgauaaaagaca

SEQ ID NO: 2121315 - RNA, 14 nt, Human
auuuucuauaauuu

SEQ ID NO: 2121316 - RNA, 22 nt, Human
auauaugcuaagucuuauauau

SEQ ID NO: 2121317 - RNA, 15 nt, Human
aaagaaagaaaauca

SEQ ID NO: 2121318 - RNA, 13 nt, Human
uuauucacaagac

SEQ ID NO: 2121319 - RNA, 17 nt, Human
aauaugcucuaaacaug

SEQ ID NO: 2121320 - RNA, 14 nt, Human
acuggacucaccuc

SEQ ID NO: 2121321 - RNA, 12 nt, Human
gucauuguucuu

SEQ ID NO: 2121322 - RNA, 16 nt, Human
uaucuuccuauaauuu

SEQ ID NO: 2121323 - RNA, 20 nt, Human
uagaugcaguucugaagaag

SEQ ID NO: 2121324 - RNA, 15 nt, Human
cugcacuccagccug

SEQ ID NO: 2121325 - RNA, 19 nt, Human
cucaccucccccaucucuu

SEQ ID NO: 2121326 - RNA, 15 nt, Human
aaauauaaauaaaaa

SEQ ID NO: 2121327 - RNA, 15 nt, Human
uagaauauauuuccu

SEQ ID NO: 2121328 - RNA, 15 nt, Human
aaugaauggcuaagc

SEQ ID NO: 2121329 - RNA, 14 nt, Human
uaaaagacaaggaa

SEQ ID NO: 2121330 - RNA, 14 nt, Human
ccgcuuaagcuuuc

SEQ ID NO: 2121331 - RNA, 17 nt, Human
auauuuuuuuuuuuaaa

SEQ ID NO: 2121332 - RNA, 14 nt, Human
aucuauguagaaua

SEQ ID NO: 2121333 - RNA, 16 nt, Human
ccucagucucccuccc

SEQ ID NO: 2121334 - RNA, 18 nt, Human
auguuaaaacugggacag

SEQ ID NO: 2121335 - RNA, 18 nt, Human
uuuuagugaaauauuauu

SEQ ID NO: 2121336 - RNA, 16 nt, Human
agggaggacgcucucu

SEQ ID NO: 2121337 - RNA, 19 nt, Human
cucugcauacucauuagga

SEQ ID NO: 2121338 - RNA, 12 nt, Human
cuccauuuuuag

SEQ ID NO: 2121339 - RNA, 17 nt, Human
uaauuuuuauauuugaa

SEQ ID NO: 2121340 - RNA, 14 nt, Human
uggcuugaguuuaa

SEQ ID NO: 2121341 - RNA, 14 nt, Human
cucaacucugagug

SEQ ID NO: 2121342 - RNA, 22 nt, Human
caauaaaagacaaggaaaaaau

SEQ ID NO: 2121343 - RNA, 20 nt, Human
aacaaugcuguauuuuaaaa

SEQ ID NO: 2121344 - RNA, 19 nt, Human
uggggcuuuaacuccugcu

SEQ ID NO: 2121345 - RNA, 14 nt, Human
cguguccccuaucc

SEQ ID NO: 2121346 - RNA, 20 nt, Human
cagcugccccggggaggggc

SEQ ID NO: 2121347 - RNA, 23 nt, Human
acguaaucguguccccuauccua

SEQ ID NO: 2121348 - RNA, 13 nt, Human
auaacgauaaaag

SEQ ID NO: 2121349 - RNA, 18 nt, Human
uuccaagaaauauuccuu

SEQ ID NO: 2121350 - RNA, 19 nt, Human
augaauuacauuuguauaa

SEQ ID NO: 2121351 - RNA, 15 nt, Human
aacgauaaaagacag

SEQ ID NO: 2121352 - RNA, 18 nt, Human
gccuuggggcugaugcag

SEQ ID NO: 2121353 - RNA, 20 nt, Human
agaggagaaacuggaacucu

SEQ ID NO: 2121354 - RNA, 19 nt, Human
gguuccuuccucugagccu

SEQ ID NO: 2121355 - RNA, 16 nt, Human
aaaguugaauuuuaca

SEQ ID NO: 2121356 - RNA, 17 nt, Human
ggccaugggacagggag

SEQ ID NO: 2121357 - RNA, 16 nt, Human
ugcucgcccacuuccu

SEQ ID NO: 2121358 - RNA, 17 nt, Human
aagcacagugaucaagu

SEQ ID NO: 2121359 - RNA, 12 nt, Human
uaagaagacugc

SEQ ID NO: 2121360 - RNA, 13 nt, Human
uuaugcuaaguga

SEQ ID NO: 2121361 - RNA, 20 nt, Human
gcuggagacauugaggcagg

SEQ ID NO: 2121362 - RNA, 21 nt, Human
uuccugacugcuaguuuauau

SEQ ID NO: 2121363 - RNA, 19 nt, Human
augcccacggcuggagcug

SEQ ID NO: 2121364 - RNA, 20 nt, Human
uuaaguuuuuuuuuaaaaaa

SEQ ID NO: 2121365 - RNA, 19 nt, Human
uuauauauauauauuuuuu

SEQ ID NO: 2121366 - RNA, 20 nt, Human
aauuuugugaagcaaaauuu

SEQ ID NO: 2121367 - RNA, 17 nt, Human
cagucucuugaggcaca

SEQ ID NO: 2121368 - RNA, 20 nt, Human
aucccggccggcgcgcucau

SEQ ID NO: 2121369 - RNA, 23 nt, Human
caaauacgugggcauucaaaugu

SEQ ID NO: 2121370 - RNA, 15 nt, Human
gcagagguugcagug

SEQ ID NO: 2121371 - RNA, 19 nt, Human
gagacauugaggcaggcac

SEQ ID NO: 2121372 - RNA, 19 nt, Human
gagccucagucucccuccc

SEQ ID NO: 2121373 - RNA, 13 nt, Human
acuguaaaauaau

SEQ ID NO: 2121374 - RNA, 13 nt, Human
aucaggcuggcca

SEQ ID NO: 2121375 - RNA, 18 nt, Human
gcacuccagccugagcga

SEQ ID NO: 2121376 - RNA, 19 nt, Human
ucuguuuucccuccuugga

SEQ ID NO: 2121377 - RNA, 17 nt, Human
caaauccaaugaaauga

SEQ ID NO: 2121378 - RNA, 21 nt, Human
ugcucaauaaaguacaagagc

SEQ ID NO: 2121379 - RNA, 15 nt, Human
caaggaaaaaauaac

SEQ ID NO: 2121380 - RNA, 13 nt, Human
ucuauaauuuaaa

SEQ ID NO: 2121381 - RNA, 14 nt, Human
ugcucauggaauug

SEQ ID NO: 2121382 - RNA, 21 nt, Human
auuauauuuccaagaaauauu

SEQ ID NO: 2121383 - RNA, 16 nt, Human
uucacauuuaaauaaa

SEQ ID NO: 2121384 - RNA, 17 nt, Human
ucucucacuuguuuuau

SEQ ID NO: 2121385 - RNA, 16 nt, Human
uuagauagaugaagaa

SEQ ID NO: 2121386 - RNA, 22 nt, Human
uuugaugcuacaggauuugaaa

SEQ ID NO: 2121387 - RNA, 21 nt, Human
cuguuaucuucacuuuuauaa

SEQ ID NO: 2121388 - RNA, 16 nt, Human
ccccugcacuccagcc

SEQ ID NO: 2121389 - RNA, 22 nt, Human
agaaugagagacacacugaaga

SEQ ID NO: 2121390 - RNA, 21 nt, Human
ccucuguucugcacacagcac

SEQ ID NO: 2121391 - RNA, 23 nt, Human
gauagauaggucagugcaaauac

SEQ ID NO: 2121392 - RNA, 17 nt, Human
gccugagcgacagugag

SEQ ID NO: 2121393 - RNA, 16 nt, Human
cuagaacucccuuuca

SEQ ID NO: 2121394 - RNA, 18 nt, Human
auggaaguaaauguuguu

SEQ ID NO: 2121395 - RNA, 14 nt, Human
uucccgcuguuccu

SEQ ID NO: 2121396 - RNA, 17 nt, Human
auguugacaugggacau

SEQ ID NO: 2121397 - RNA, 17 nt, Human
aaccuagggugauauua

SEQ ID NO: 2121398 - RNA, 20 nt, Human
uuuaaauagcuuuuuucucu

SEQ ID NO: 2121399 - RNA, 23 nt, Human
cuucaacucccugccccccagcc

SEQ ID NO: 2121400 - RNA, 21 nt, Human
gaagagccggagccuccagcu

SEQ ID NO: 2121401 - RNA, 20 nt, Human
ccaacacccugagguugugu

SEQ ID NO: 2121402 - RNA, 14 nt, Human
ugcuagaacucccu

SEQ ID NO: 2121403 - RNA, 19 nt, Human
acucuuauaucuauauuuu

SEQ ID NO: 2121404 - RNA, 21 nt, Human
cgaaguauccuucagccugaa

SEQ ID NO: 2121405 - RNA, 20 nt, Human
aaggaugccccgucccccuc

SEQ ID NO: 2121406 - RNA, 14 nt, Human
auauauuuccuuau

SEQ ID NO: 2121407 - RNA, 15 nt, Human
gccguccccagagcu

SEQ ID NO: 2121408 - RNA, 21 nt, Human
gccaaauauaaauaaaaauaa

SEQ ID NO: 2121409 - RNA, 19 nt, Human
auucccagccagcacagcc

SEQ ID NO: 2121410 - RNA, 15 nt, Human
agagugugaggaaaa

SEQ ID NO: 2121411 - RNA, 17 nt, Human
gggagcgagccccaggc

SEQ ID NO: 2121412 - RNA, 14 nt, Human
acgcauggaaaagu

SEQ ID NO: 2121413 - RNA, 20 nt, Human
aagucuuucacauuuaaaua

SEQ ID NO: 2121414 - RNA, 15 nt, Human
ccgugggccugagac

SEQ ID NO: 2121415 - RNA, 23 nt, Human
agcccuccuuaucaaaggacacc

SEQ ID NO: 2121416 - RNA, 15 nt, Human
aaaaaagaaacauuu

SEQ ID NO: 2121417 - RNA, 22 nt, Human
gagucaagggugugugcagcau

SEQ ID NO: 2121418 - RNA, 18 nt, Human
caaggcuagaaccaccug

SEQ ID NO: 2121419 - RNA, 22 nt, Human
gaauuucuucaacucccugccc

SEQ ID NO: 2121420 - RNA, 21 nt, Human
aauuuacagagacagaaagca

SEQ ID NO: 2121421 - RNA, 19 nt, Human
auuuacagagacagaaagc

SEQ ID NO: 2121422 - RNA, 21 nt, Human
auuuuccugaaaacccuugcc

SEQ ID NO: 2121423 - RNA, 16 nt, Human
uuuuagugaaauauua

SEQ ID NO: 2121424 - RNA, 18 nt, Human
ggagccgggaaagaagag

SEQ ID NO: 2121425 - RNA, 13 nt, Human
aucauuaaaguuc

SEQ ID NO: 2121426 - RNA, 20 nt, Human
aagcuucacuguaaaauaau

SEQ ID NO: 2121427 - RNA, 22 nt, Human
agaauuuuaugcggcauuuucu

SEQ ID NO: 2121428 - RNA, 19 nt, Human
uggugaacuugguuuuaau

SEQ ID NO: 2121429 - RNA, 17 nt, Human
cucguggaacaguuacc

SEQ ID NO: 2121430 - RNA, 15 nt, Human
auuauuuuuuaaaaa

SEQ ID NO: 2121431 - RNA, 17 nt, Human
uuucccuccuuggagac

SEQ ID NO: 2121432 - RNA, 21 nt, Human
gaagugaaaaucuacacucca

SEQ ID NO: 2121433 - RNA, 13 nt, Human
uaugaaauauuau

SEQ ID NO: 2121434 - RNA, 13 nt, Human
uuaaaaaagaaac

SEQ ID NO: 2121435 - RNA, 11 nt, Human
gcgcuggcugc

SEQ ID NO: 2121436 - RNA, 19 nt, Human
augcagagguccacaacac

SEQ ID NO: 2121437 - RNA, 15 nt, Human
cugccagcuggccuu

SEQ ID NO: 2121438 - RNA, 23 nt, Human
auuuuagauagaugaagaagcua

SEQ ID NO: 2121439 - RNA, 13 nt, Human
uuuuauaugcuau

SEQ ID NO: 2121440 - RNA, 22 nt, Human
uaauaggcguaacuaauuuuaa

SEQ ID NO: 2121441 - RNA, 17 nt, Human
uaugcuaagugaaauaa

SEQ ID NO: 2121442 - RNA, 17 nt, Human
accugcugagccccaag

SEQ ID NO: 2121443 - RNA, 18 nt, Human
cggcuggagcugccucuc

SEQ ID NO: 2121444 - RNA, 21 nt, Human
caguaguuagcuuucuuccug

SEQ ID NO: 2121445 - RNA, 18 nt, Human
ucuaugaaauauuauguu

SEQ ID NO: 2121446 - RNA, 14 nt, Human
cucuggcuccagcu

SEQ ID NO: 2121447 - RNA, 13 nt, Human
aaaaauccuacuu

SEQ ID NO: 2121448 - RNA, 20 nt, Human
aacagucucuugaggcacag

SEQ ID NO: 2121449 - RNA, 12 nt, Human
auucuuccuccc

SEQ ID NO: 2121450 - RNA, 18 nt, Human
cauggaauuggagcucgu

SEQ ID NO: 2121451 - RNA, 15 nt, Human
aaggguacacugccu

SEQ ID NO: 2121452 - RNA, 21 nt, Human
ugaaauggacuuuuguacaua

SEQ ID NO: 2121453 - RNA, 17 nt, Human
ggagggcgcggggcggg

SEQ ID NO: 2121454 - RNA, 14 nt, Human
cgcgcugcgcgccg

SEQ ID NO: 2121455 - RNA, 15 nt, Human
auaaaguguuugaaa

SEQ ID NO: 2121456 - RNA, 24 nt, Human
uuugugggaaauccacacugagcu

SEQ ID NO: 2121457 - RNA, 21 nt, Human
gccugaucaccugcccugcug

SEQ ID NO: 2121458 - RNA, 16 nt, Human
aaauaacaaugaaagu

SEQ ID NO: 2121459 - RNA, 22 nt, Human
gaugcaguuguugcccacagcu

SEQ ID NO: 2121460 - RNA, 19 nt, Human
aagucuuucacauuuaaau

SEQ ID NO: 2121461 - RNA, 19 nt, Human
acucugucucaguccauga

SEQ ID NO: 2121462 - RNA, 18 nt, Human
ucucagguguguugcagu

SEQ ID NO: 2121463 - RNA, 17 nt, Human
acuccugcuagaacagu

SEQ ID NO: 2121464 - RNA, 18 nt, Human
uuguacucugaaaguuuu

SEQ ID NO: 2121465 - RNA, 15 nt, Human
aauacuuuauaaagg

SEQ ID NO: 2121466 - RNA, 19 nt, Human
agaguuuagcuggaaaagu

SEQ ID NO: 2121467 - RNA, 17 nt, Human
uuauauuugaaauauug

SEQ ID NO: 2121468 - RNA, 17 nt, Human
ugacuauuauauuucca

SEQ ID NO: 2121469 - RNA, 13 nt, Human
auuggacaguaaa

SEQ ID NO: 2121470 - RNA, 21 nt, Human
uuucaugcuguucaugaaaga

SEQ ID NO: 2121471 - RNA, 23 nt, Human
uacaaaugggaaacaaaaggaua

SEQ ID NO: 2121472 - RNA, 14 nt, Human
caauugacuauagu

SEQ ID NO: 2121473 - RNA, 22 nt, Human
agacucugucucaguccaugaa

SEQ ID NO: 2121474 - RNA, 18 nt, Human
auguuagagaauuuccuu

SEQ ID NO: 2121475 - RNA, 18 nt, Human
gagccgggaaagaagagc

SEQ ID NO: 2121476 - RNA, 20 nt, Human
auauuuuauaucaauuuaaa

SEQ ID NO: 2121477 - RNA, 14 nt, Human
uaauaucuuaucuu

SEQ ID NO: 2121478 - RNA, 15 nt, Human
agcuaaauauauauu

SEQ ID NO: 2121479 - RNA, 19 nt, Human
guggauuuaauguggaaau

SEQ ID NO: 2121480 - RNA, 14 nt, Human
ugcuucuguuuuau

SEQ ID NO: 2121481 - RNA, 18 nt, Human
auagaauuaacacaugau

SEQ ID NO: 2121482 - RNA, 14 nt, Human
uuaauuauuucacu

SEQ ID NO: 2121483 - RNA, 22 nt, Human
aggaugccccgucccccucugg

SEQ ID NO: 2121484 - RNA, 21 nt, Human
auaauuuuuauauuugaaaua

SEQ ID NO: 2121485 - RNA, 13 nt, Human
gaagaacugaaau

SEQ ID NO: 2121486 - RNA, 16 nt, Human
uuuucucuaggaaaua

SEQ ID NO: 2121487 - RNA, 18 nt, Human
uaucaaaagaaagaaaau

SEQ ID NO: 2121488 - RNA, 13 nt, Human
gccuccagcugcc

SEQ ID NO: 2121489 - RNA, 19 nt, Human
acuuuuauaagaaauagga

SEQ ID NO: 2121490 - RNA, 22 nt, Human
accuuaucuauguagaauauau

SEQ ID NO: 2121491 - RNA, 21 nt, Human
auaguuguaccgcaaugugac

SEQ ID NO: 2121492 - RNA, 14 nt, Human
gcaaagcccagcuu

SEQ ID NO: 2121493 - RNA, 22 nt, Human
gucucagcuucacccugaggug

SEQ ID NO: 2121494 - RNA, 16 nt, Human
gacauugaggcaggca

SEQ ID NO: 2121495 - RNA, 14 nt, Human
uauuaaguauuuua

SEQ ID NO: 2121496 - RNA, 23 nt, Human
cucaggggggugguuuucccauc

SEQ ID NO: 2121497 - RNA, 18 nt, Human
gcgcgcccucuggcugcu

SEQ ID NO: 2121498 - RNA, 16 nt, Human
ugaaauuguauuacaa

SEQ ID NO: 2121499 - RNA, 14 nt, Human
ggcaauagucaaau

SEQ ID NO: 2121500 - RNA, 17 nt, Human
gcaagcucuaucaccaa

SEQ ID NO: 2121501 - RNA, 14 nt, Human
agaauucauucacu

SEQ ID NO: 2121502 - RNA, 23 nt, Human
aggugaucuggcucuggacaggc

SEQ ID NO: 2121503 - RNA, 18 nt, Human
cuccgcgcagcucaggcu

SEQ ID NO: 2121504 - RNA, 15 nt, Human
ccggggaggggcgcu

SEQ ID NO: 2121505 - RNA, 17 nt, Human
ucugguagcuaaauaua

SEQ ID NO: 2121506 - RNA, 17 nt, Human
aucaaggguacacugcc

SEQ ID NO: 2121507 - RNA, 22 nt, Human
acacuguccauucuuccuccca

SEQ ID NO: 2121508 - RNA, 19 nt, Human
cugagccucagucucccuc

SEQ ID NO: 2121509 - RNA, 13 nt, Human
auugggcaggcag

SEQ ID NO: 2121510 - RNA, 15 nt, Human
aagugaaaaucuaca

SEQ ID NO: 2121511 - RNA, 18 nt, Human
uaauuagcauggccacau

SEQ ID NO: 2121512 - RNA, 17 nt, Human
cagucauucagauauga

SEQ ID NO: 2121513 - RNA, 19 nt, Human
auagcuacuaauuuuaaaa

SEQ ID NO: 2121514 - RNA, 21 nt, Human
ggagacauugaggcaggcacu

SEQ ID NO: 2121515 - RNA, 17 nt, Human
acagaaaaguugaauuu

SEQ ID NO: 2121516 - RNA, 21 nt, Human
aagcuccauuuuuagugaaau

SEQ ID NO: 2121517 - RNA, 17 nt, Human
auauuugaaauauugac

SEQ ID NO: 2121518 - RNA, 12 nt, Human
aauaauuuuuaa

SEQ ID NO: 2121519 - RNA, 16 nt, Human
auaucaguuauuuuua

SEQ ID NO: 2121520 - RNA, 17 nt, Human
aaauaacaauaaaagac

SEQ ID NO: 2121521 - RNA, 12 nt, Human
agacagugaaag

SEQ ID NO: 2121522 - RNA, 12 nt, Human
ggcagcaccucc

SEQ ID NO: 2121523 - RNA, 17 nt, Human
ugucuucaggggccaca

SEQ ID NO: 2121524 - RNA, 15 nt, Human
acuuuauaaaggauu

SEQ ID NO: 2121525 - RNA, 12 nt, Human
acaagaaaugaa

SEQ ID NO: 2121526 - RNA, 20 nt, Human
agaugcaguucugaagaaga

SEQ ID NO: 2121527 - RNA, 23 nt, Human
ggccugagaccaaggcccccggg

SEQ ID NO: 2121528 - RNA, 18 nt, Human
uguauuauuuuuuaaaaa

SEQ ID NO: 2121529 - RNA, 14 nt, Human
aaaagaaacauuug

SEQ ID NO: 2121530 - RNA, 22 nt, Human
agcacagccucuuagaugcagu

SEQ ID NO: 2121531 - RNA, 17 nt, Human
ugcccauaccccuggcc

SEQ ID NO: 2121532 - RNA, 21 nt, Human
auggcagcuuuccucaaaacu

SEQ ID NO: 2121533 - RNA, 18 nt, Human
uacuuuauuuucuauaau

SEQ ID NO: 2121534 - RNA, 13 nt, Human
cugggucgccggc

SEQ ID NO: 2121535 - RNA, 13 nt, Human
cucugagccuugg

SEQ ID NO: 2121536 - RNA, 16 nt, Human
uugucaauaaaaucca

SEQ ID NO: 2121537 - RNA, 19 nt, Human
cuggcucuggacaggcacu

SEQ ID NO: 2121538 - RNA, 23 nt, Human
aaagaugaucaguaugaaaaugu

SEQ ID NO: 2121539 - RNA, 18 nt, Human
uagugaaauauuauuuua

SEQ ID NO: 2121540 - RNA, 22 nt, Human
cccugaauuuaaauagcuuuuu

SEQ ID NO: 2121541 - RNA, 12 nt, Human
uuauuucacuuu

SEQ ID NO: 2121542 - RNA, 13 nt, Human
guuauuuuuaaac

SEQ ID NO: 2121543 - RNA, 13 nt, Human
cugugcggccugg

SEQ ID NO: 2121544 - RNA, 16 nt, Human
ugcuguauuuuaaaag

SEQ ID NO: 2121545 - RNA, 13 nt, Human
aguuaccucugcc

SEQ ID NO: 2121546 - RNA, 21 nt, Human
gaaagcagggacuugaaccca

SEQ ID NO: 2121547 - RNA, 15 nt, Human
ccucagucucccucc

SEQ ID NO: 2121548 - RNA, 22 nt, Human
ucuagcaugucgucaaagcuga

SEQ ID NO: 2121549 - RNA, 17 nt, Human
ucaaguuauuuuuaauu

SEQ ID NO: 2121550 - RNA, 23 nt, Human
agccuugggaccccugagcuugc

SEQ ID NO: 2121551 - RNA, 22 nt, Human
gaauaucuccgucaacucauau

SEQ ID NO: 2121552 - RNA, 17 nt, Human
gcccuuccccucugcag

SEQ ID NO: 2121553 - RNA, 20 nt, Human
ggccuaugcagagguccaca

SEQ ID NO: 2121554 - RNA, 17 nt, Human
uaagaaauaggaaauau

SEQ ID NO: 2121555 - RNA, 23 nt, Human
gaaaaucuuauaauuuaaaauau

SEQ ID NO: 2121556 - RNA, 21 nt, Human
acgcucucuggccuucggccu

SEQ ID NO: 2121557 - RNA, 17 nt, Human
cuacaggccccaucugg

SEQ ID NO: 2121558 - RNA, 22 nt, Human
ggcugcugguggcgcuggcugc

SEQ ID NO: 2121559 - RNA, 13 nt, Human
gccacaagaaccc

SEQ ID NO: 2121560 - RNA, 21 nt, Human
guuuguuuauuuguuuuucca

SEQ ID NO: 2121561 - RNA, 12 nt, Human
cagugaaagaaa

SEQ ID NO: 2121562 - RNA, 20 nt, Human
cagcuuccaggcuggcgugc

SEQ ID NO: 2121563 - RNA, 12 nt, Human
acugaaaucaua

SEQ ID NO: 2121564 - RNA, 18 nt, Human
ccugaaagaggaaugaag

SEQ ID NO: 2121565 - RNA, 16 nt, Human
caauaacgauaaaaga

SEQ ID NO: 2121566 - RNA, 15 nt, Human
aucuuauaauuuaaa

SEQ ID NO: 2121567 - RNA, 18 nt, Human
uggcuguuaaucuuucaa

SEQ ID NO: 2121568 - RNA, 13 nt, Human
ccccagcccuccu

SEQ ID NO: 2121569 - RNA, 21 nt, Human
ccauaccccuggccaaggaag

SEQ ID NO: 2121570 - RNA, 21 nt, Human
gccggcgcgcucaucccaccc

SEQ ID NO: 2121571 - RNA, 19 nt, Human
uauuuaaccucuaaauucu

SEQ ID NO: 2121572 - RNA, 23 nt, Human
cuaguaauuggaaaggcagcucu

SEQ ID NO: 2121573 - RNA, 13 nt, Human
auugaggcaggca

SEQ ID NO: 2121574 - RNA, 22 nt, Human
gaggggagcaugggaagugacg

SEQ ID NO: 2121575 - RNA, 23 nt, Human
ucccuagaaagccaugugcagcc

SEQ ID NO: 2121576 - RNA, 19 nt, Human
uacuucuuaggguuaugau

SEQ ID NO: 2121577 - RNA, 15 nt, Human
acaaaugggaaacaa

SEQ ID NO: 2121578 - RNA, 17 nt, Human
uuacagagacagaaagc

SEQ ID NO: 2121579 - RNA, 17 nt, Human
guuuaauaauuuuuaau

SEQ ID NO: 2121580 - RNA, 22 nt, Human
gaugcaguucugaagaagaugg

SEQ ID NO: 2121581 - RNA, 15 nt, Human
uaauuugguuuucac

SEQ ID NO: 2121582 - RNA, 23 nt, Human
auuccugacugcuaguuuauaua

SEQ ID NO: 2121583 - RNA, 12 nt, Human
agcuuuuuucuc

SEQ ID NO: 2121584 - RNA, 13 nt, Human
uuggacgagaaaa

SEQ ID NO: 2121585 - RNA, 15 nt, Human
cauuuacuuuuaaac

SEQ ID NO: 2121586 - RNA, 18 nt, Human
cuuccucugagccuuggg

SEQ ID NO: 2121587 - RNA, 12 nt, Human
uuauuauaguca

SEQ ID NO: 2121588 - RNA, 14 nt, Human
gggcuggaugcucu

SEQ ID NO: 2121589 - RNA, 13 nt, Human
cuaugaaauauua

SEQ ID NO: 2121590 - RNA, 14 nt, Human
gcgagcgcgcgcgc

SEQ ID NO: 2121591 - RNA, 12 nt, Human
cugcccuucccc

SEQ ID NO: 2121592 - RNA, 22 nt, Human
aaacaaggaugaauuaaguuuu

SEQ ID NO: 2121593 - RNA, 23 nt, Human
aaguauccuucagccugaaagag

SEQ ID NO: 2121594 - RNA, 14 nt, Human
acugccaucauuua

SEQ ID NO: 2121595 - RNA, 22 nt, Human
uuuguagaagucacauuccuga

SEQ ID NO: 2121596 - RNA, 22 nt, Human
cuuguacucugaaaguuuugga

SEQ ID NO: 2121597 - RNA, 12 nt, Human
acaccuuaucua

SEQ ID NO: 2121598 - RNA, 14 nt, Human
aguuuuuuuuuaaa

SEQ ID NO: 2121599 - RNA, 24 nt, Human
cauucuggaauaauccuaaacaua

SEQ ID NO: 2121600 - RNA, 17 nt, Human
cccccugcaaagcccag

SEQ ID NO: 2121601 - RNA, 13 nt, Human
cagaaacuccugu

SEQ ID NO: 2121602 - RNA, 20 nt, Human
uaacgauaaaagacagugaa

SEQ ID NO: 2121603 - RNA, 15 nt, Human
ccaucucaggugugu

SEQ ID NO: 2121604 - RNA, 16 nt, Human
uucaugcuguucauga

SEQ ID NO: 2121605 - RNA, 19 nt, Human
aaaccgaacugauguaagu

SEQ ID NO: 2121606 - RNA, 15 nt, Human
auccuagucucuauc

SEQ ID NO: 2121607 - RNA, 17 nt, Human
uguuggcuguuccugca

SEQ ID NO: 2121608 - RNA, 16 nt, Human
ccuagucucuaucauu

SEQ ID NO: 2121609 - RNA, 20 nt, Human
acuagaguuuagcuggaaaa

SEQ ID NO: 2121610 - RNA, 19 nt, Human
gaaggcaccucucuggguu

SEQ ID NO: 2121611 - RNA, 19 nt, Human
cuggccuucggccuccauc

SEQ ID NO: 2121612 - RNA, 15 nt, Human
ucccuuuguccacaa

SEQ ID NO: 2121613 - RNA, 13 nt, Human
ccuuccccuuccc

SEQ ID NO: 2121614 - RNA, 14 nt, Human
gcuggagcucugcc

SEQ ID NO: 2121615 - RNA, 15 nt, Human
ugccucucucaucca

SEQ ID NO: 2121616 - RNA, 14 nt, Human
agaaaauaacaaua

SEQ ID NO: 2121617 - RNA, 14 nt, Human
uaguaucaaaagaa

SEQ ID NO: 2121618 - RNA, 18 nt, Human
ugcaccugugccgucccc

SEQ ID NO: 2121619 - RNA, 17 nt, Human
aaucuuauaauuuaaaa

SEQ ID NO: 2121620 - RNA, 18 nt, Human
cuuuucccaacuccagaa

SEQ ID NO: 2121621 - RNA, 22 nt, Human
ugguagcuaaauauauauuuua

SEQ ID NO: 2121622 - RNA, 12 nt, Human
uacuaaaugcuc

SEQ ID NO: 2121623 - RNA, 17 nt, Human
cgccuccgcuacuucca

SEQ ID NO: 2121624 - RNA, 19 nt, Human
agcagcuuauucacaagac

SEQ ID NO: 2121625 - RNA, 14 nt, Human
ugagaugcuagaac

SEQ ID NO: 2121626 - RNA, 14 nt, Human
ccugccccugagcc

SEQ ID NO: 2121627 - RNA, 14 nt, Human
uucacauuuaaaua

SEQ ID NO: 2121628 - RNA, 21 nt, Human
aauaauccucaguuuuuguga

SEQ ID NO: 2121629 - RNA, 19 nt, Human
ccgggcgugguggugagug

SEQ ID NO: 2121630 - RNA, 21 nt, Human
acucauuaaauggaaguaaau

SEQ ID NO: 2121631 - RNA, 13 nt, Human
auaaauaaaaaua

SEQ ID NO: 2121632 - RNA, 18 nt, Human
aggcauagcccugccuca

SEQ ID NO: 2121633 - RNA, 16 nt, Human
cuuagcccuuccccuc

SEQ ID NO: 2121634 - RNA, 16 nt, Human
ccaggcugagccucag

SEQ ID NO: 2121635 - RNA, 14 nt, Human
acauauauaacaau

SEQ ID NO: 2121636 - RNA, 23 nt, Human
aucaccaaggcugauuaaaccaa

SEQ ID NO: 2121637 - RNA, 20 nt, Human
agcccuggugggcagagagg

SEQ ID NO: 2121638 - RNA, 21 nt, Human
ccagggcuacgcgcgcuccgc

SEQ ID NO: 2121639 - RNA, 20 nt, Human
cacuguggguagacacacau

SEQ ID NO: 2121640 - RNA, 17 nt, Human
agcuucacuguaaaaua

SEQ ID NO: 2121641 - RNA, 13 nt, Human
agaaguaaaaaca

SEQ ID NO: 2121642 - RNA, 18 nt, Human
uauuuucuauaauuuaaa

SEQ ID NO: 2121643 - RNA, 21 nt, Human
uauuauuuuauagcuacuaau

SEQ ID NO: 2121644 - RNA, 20 nt, Human
agccuaguugaucagcuuau

SEQ ID NO: 2121645 - RNA, 14 nt, Human
cagcaucagcaucc

SEQ ID NO: 2121646 - RNA, 15 nt, Human
cgcgccgcgcuccuc

SEQ ID NO: 2121647 - RNA, 15 nt, Human
uggaaacgaagcacc

SEQ ID NO: 2121648 - RNA, 22 nt, Human
gcggguccgggucgcaggacca

SEQ ID NO: 2121649 - RNA, 18 nt, Human
ggcccugugcggccuggu

SEQ ID NO: 2121650 - RNA, 13 nt, Human
ccccucugcagcu

SEQ ID NO: 2121651 - RNA, 15 nt, Human
uuaguuuuuaaagua

SEQ ID NO: 2121652 - RNA, 16 nt, Human
cugagcgacagugaga

SEQ ID NO: 2121653 - RNA, 21 nt, Human
acaugagguacugagagugaa

SEQ ID NO: 2121654 - RNA, 16 nt, Human
uucaaugccccugaau

SEQ ID NO: 2121655 - RNA, 11 nt, Human
aaagauucaau

SEQ ID NO: 2121656 - RNA, 22 nt, Human
cuaccuguucgcgcgccuccgc

SEQ ID NO: 2121657 - RNA, 12 nt, Human
uauaauuuaaaa

SEQ ID NO: 2121658 - RNA, 16 nt, Human
aaugaaagcagggacu

SEQ ID NO: 2121659 - RNA, 14 nt, Human
cuucacccugaggu

SEQ ID NO: 2121660 - RNA, 21 nt, Human
ucgcccacuuccucccggccg

SEQ ID NO: 2121661 - RNA, 20 nt, Human
gacauuugcucauggaauug

SEQ ID NO: 2121662 - RNA, 22 nt, Human
uggaaaguuuaugguuguauua

SEQ ID NO: 2121663 - RNA, 12 nt, Human
cucauggaauug

SEQ ID NO: 2121664 - RNA, 13 nt, Human
uuuaaaaauccua

SEQ ID NO: 2121665 - RNA, 13 nt, Human
acacacaugaagu

SEQ ID NO: 2121666 - RNA, 19 nt, Human
gugacuuaaugccacuaaa

SEQ ID NO: 2121667 - RNA, 18 nt, Human
uauuuuacauaaauuuag

SEQ ID NO: 2121668 - RNA, 21 nt, Human
cugccccggggaggggcgcuc

SEQ ID NO: 2121669 - RNA, 11 nt, Human
ggucacaggaa

SEQ ID NO: 2121670 - RNA, 16 nt, Human
gccaugugcuaguaau

SEQ ID NO: 2121671 - RNA, 17 nt, Human
uggcuaagcaaaaugug

SEQ ID NO: 2121672 - RNA, 23 nt, Human
acgaggauugggaaaaaguaauu

SEQ ID NO: 2121673 - RNA, 13 nt, Human
uaacgauaaaaga

SEQ ID NO: 2121674 - RNA, 21 nt, Human
aauuuguuuucccuucuuaca

SEQ ID NO: 2121675 - RNA, 21 nt, Human
ccaugugcagccaccagucca

SEQ ID NO: 2121676 - RNA, 22 nt, Human
uaccucugcuauuugcuguuau

SEQ ID NO: 2121677 - RNA, 21 nt, Human
acagugauuaccagggacuga

SEQ ID NO: 2121678 - RNA, 20 nt, Human
uaacaagccuccuuuuaaag

SEQ ID NO: 2121679 - RNA, 16 nt, Human
uucaguuauuauauuu

SEQ ID NO: 2121680 - RNA, 14 nt, Human
guuccuucugcucc

SEQ ID NO: 2121681 - RNA, 15 nt, Human
cucccugccccccag

SEQ ID NO: 2121682 - RNA, 21 nt, Human
agaagcuagaaaacaggcaaa

SEQ ID NO: 2121683 - RNA, 17 nt, Human
uaucaguuauuuuuaaa

SEQ ID NO: 2121684 - RNA, 18 nt, Human
auuauuuuuuaaaaaaau

SEQ ID NO: 2121685 - RNA, 19 nt, Human
gaaagaaaauaacaauaaa

SEQ ID NO: 2121686 - RNA, 21 nt, Human
cucaaaacuucagacauagaa

SEQ ID NO: 2121687 - RNA, 14 nt, Human
acuuugauuuuaua

SEQ ID NO: 2121688 - RNA, 16 nt, Human
ggggagcgagccccag

SEQ ID NO: 2121689 - RNA, 20 nt, Human
ucagaauuucuaaaaguuua

SEQ ID NO: 2121690 - RNA, 21 nt, Human
aagucuuucacauuuaaauaa

SEQ ID NO: 2121691 - RNA, 15 nt, Human
caaaauggaauacuc

SEQ ID NO: 2121692 - RNA, 13 nt, Human
auguagaauauau

SEQ ID NO: 2121693 - RNA, 23 nt, Human
uggaaauguuuacagauccccaa

SEQ ID NO: 2121694 - RNA, 16 nt, Human
caaaaggauaaugaau

SEQ ID NO: 2121695 - RNA, 20 nt, Human
cugagccucagucucccucc

SEQ ID NO: 2121696 - RNA, 14 nt, Human
cgcucgcuuccgca

SEQ ID NO: 2121697 - RNA, 22 nt, Human
gaugguucccuugaugaagaag

SEQ ID NO: 2121698 - RNA, 16 nt, Human
ucgcuuccgcauccua

SEQ ID NO: 2121699 - RNA, 16 nt, Human
agaugagagaacaggg

SEQ ID NO: 2121700 - RNA, 15 nt, Human
ugguuuagaaagcuu

SEQ ID NO: 2121701 - RNA, 19 nt, Human
cuucuuacaaugcauucug

SEQ ID NO: 2121702 - RNA, 14 nt, Human
uaaauaguuuauga

SEQ ID NO: 2121703 - RNA, 15 nt, Human
aaauaauuuuuauau

SEQ ID NO: 2121704 - RNA, 20 nt, Human
gcggggcggggagcgagccc

SEQ ID NO: 2121705 - RNA, 14 nt, Human
cugucucaguccau

SEQ ID NO: 2121706 - RNA, 22 nt, Human
uguuucagugcacuaaugugua

SEQ ID NO: 2121707 - RNA, 13 nt, Human
guuguguguggaa

SEQ ID NO: 2121708 - RNA, 20 nt, Human
aauaucuuuuuuuuaauaaa

SEQ ID NO: 2121709 - RNA, 15 nt, Human
cugacucuuaagaag

SEQ ID NO: 2121710 - RNA, 11 nt, Human
ccggccgcgcu

SEQ ID NO: 2121711 - RNA, 22 nt, Human
ucuggguuccuuccucugagcc

SEQ ID NO: 2121712 - RNA, 19 nt, Human
gaauaucuccgucaacuca

SEQ ID NO: 2121713 - RNA, 17 nt, Human
acuguaaagcuuugugc

SEQ ID NO: 2121714 - RNA, 18 nt, Human
acugacucuuaagaagac

SEQ ID NO: 2121715 - RNA, 21 nt, Human
cucagcuucacccugagguga

SEQ ID NO: 2121716 - RNA, 19 nt, Human
augaguaacugauuuguaa

SEQ ID NO: 2121717 - RNA, 19 nt, Human
caccugugccguccccaga

SEQ ID NO: 2121718 - RNA, 20 nt, Human
gauugugccccugcacucca

SEQ ID NO: 2121719 - RNA, 14 nt, Human
cuucccacacuguc

SEQ ID NO: 2121720 - RNA, 23 nt, Human
gcauuguuggcuguuccugcagu

SEQ ID NO: 2121721 - RNA, 20 nt, Human
auuuauugaggcuuuaaaac

SEQ ID NO: 2121722 - RNA, 18 nt, Human
auggcuugaguuuaaauu

SEQ ID NO: 2121723 - RNA, 14 nt, Human
uuuuaaaaaagaaa

SEQ ID NO: 2121724 - RNA, 20 nt, Human
uguaaagcuuugugcagauu

SEQ ID NO: 2121725 - RNA, 19 nt, Human
ccuccauccugaggcucca

SEQ ID NO: 2121726 - RNA, 11 nt, Human
guauggcaaac

SEQ ID NO: 2121727 - RNA, 16 nt, Human
ugaauuaguuuuauau

SEQ ID NO: 2121728 - RNA, 20 nt, Human
auuuucaguuauuauauuua

SEQ ID NO: 2121729 - RNA, 17 nt, Human
ucugugagaugcuagaa

SEQ ID NO: 2121730 - RNA, 22 nt, Human
gucacaggaaguagaggaggcc

SEQ ID NO: 2121731 - RNA, 14 nt, Human
uugccaugugcuag

SEQ ID NO: 2121732 - RNA, 18 nt, Human
gccguccccagagcuaca

SEQ ID NO: 2121733 - RNA, 13 nt, Human
aaaguguuugaaa

SEQ ID NO: 2121734 - RNA, 17 nt, Human
auauuuuacauaaauuu

SEQ ID NO: 2121735 - RNA, 18 nt, Human
gaaaauaacgauaaaaga

SEQ ID NO: 2121736 - RNA, 22 nt, Human
cgguccuugcugcaccugugcc

SEQ ID NO: 2121737 - RNA, 12 nt, Human
cuuaucuuccua

SEQ ID NO: 2121738 - RNA, 14 nt, Human
cugguggcucugug

SEQ ID NO: 2121739 - RNA, 16 nt, Human
cuaaauucuuucauuu

SEQ ID NO: 2121740 - RNA, 23 nt, Human
augucaauucuugccaaauauaa

SEQ ID NO: 2121741 - RNA, 18 nt, Human
uuauuauauauauauauu

SEQ ID NO: 2121742 - RNA, 15 nt, Human
uucggccuccauccu

SEQ ID NO: 2121743 - RNA, 23 nt, Human
caucucuucuggguuccuuccuc

SEQ ID NO: 2121744 - RNA, 14 nt, Human
caccaaccuucuga

SEQ ID NO: 2121745 - RNA, 14 nt, Human
cuuucauaauaagu

SEQ ID NO: 2121746 - RNA, 12 nt, Human
acacugaagaag

SEQ ID NO: 2121747 - RNA, 15 nt, Human
ugucaauaaaaucca

SEQ ID NO: 2121748 - RNA, 18 nt, Human
guauuauuuuuuaaaaaa

SEQ ID NO: 2121749 - RNA, 13 nt, Human
gcuggagcucugc

SEQ ID NO: 2121750 - RNA, 15 nt, Human
acauccuacaagaca

SEQ ID NO: 2121751 - RNA, 16 nt, Human
aaaagcaucacaugaa

SEQ ID NO: 2121752 - RNA, 18 nt, Human
cuccauccugaggcucca

SEQ ID NO: 2121753 - RNA, 18 nt, Human
uaaaagacagugaaagaa

SEQ ID NO: 2121754 - RNA, 12 nt, Human
gcaaagcccagc

SEQ ID NO: 2121755 - RNA, 19 nt, Human
aaagacagugaaagaaaau

SEQ ID NO: 2121756 - RNA, 12 nt, Human
gggaaagaagag

SEQ ID NO: 2121757 - RNA, 22 nt, Human
aucaccaaggcugauuaaacca

SEQ ID NO: 2121758 - RNA, 13 nt, Human
cuccagcugcccc

SEQ ID NO: 2121759 - RNA, 17 nt, Human
aggcuggcgugcagcau

SEQ ID NO: 2121760 - RNA, 21 nt, Human
cuuuccaauaaagaguuccuu

SEQ ID NO: 2121761 - RNA, 17 nt, Human
cugagcgacagugagac

SEQ ID NO: 2121762 - RNA, 23 nt, Human
aagagccuuuuuuugaaaaaaag

SEQ ID NO: 2121763 - RNA, 13 nt, Human
uccagcugccccg

SEQ ID NO: 2121764 - RNA, 18 nt, Human
auuaaguuuuuuuuuaaa

SEQ ID NO: 2121765 - RNA, 17 nt, Human
aaagcuccauuuuuagu

SEQ ID NO: 2121766 - RNA, 23 nt, Human
gccggcgcgcucaucccacccgc

SEQ ID NO: 2121767 - RNA, 21 nt, Human
caacacacagauuugagcuca

SEQ ID NO: 2121768 - RNA, 16 nt, Human
ugauaugugaacaguu

SEQ ID NO: 2121769 - RNA, 17 nt, Human
gucaaagcugaaaugga

SEQ ID NO: 2121770 - RNA, 20 nt, Human
acuucuuaggguuaugauua

SEQ ID NO: 2121771 - RNA, 14 nt, Human
uauaaauaaaaaua

SEQ ID NO: 2121772 - RNA, 18 nt, Human
ucuauguagaauauauuu

SEQ ID NO: 2121773 - RNA, 21 nt, Human
caaggaaaaaauaacaaugaa

SEQ ID NO: 2121774 - RNA, 21 nt, Human
uuauauauauuuuuuucugaa

SEQ ID NO: 2121775 - RNA, 17 nt, Human
guuuaauucugaaagca

SEQ ID NO: 2121776 - RNA, 22 nt, Human
agaaaacaauaacgauaaaaga

SEQ ID NO: 2121777 - RNA, 11 nt, Human
auuuuugaagc

SEQ ID NO: 2121778 - RNA, 13 nt, Human
cgcuuccgcaucc

SEQ ID NO: 2121779 - RNA, 16 nt, Human
ugcuaagucuuauaua

SEQ ID NO: 2121780 - RNA, 21 nt, Human
cacaugaacuuguaaaggaau

SEQ ID NO: 2121781 - RNA, 17 nt, Human
cuggcugcugguggcgc

SEQ ID NO: 2121782 - RNA, 21 nt, Human
cgacagugagacucugucuca

SEQ ID NO: 2121783 - RNA, 14 nt, Human
caagaaggaaagau

SEQ ID NO: 2121784 - RNA, 13 nt, Human
aauaucucuucuc

SEQ ID NO: 2121785 - RNA, 15 nt, Human
gagccuccagcugcc

SEQ ID NO: 2121786 - RNA, 22 nt, Human
cgcgcuccgcgcagcucaggcu

SEQ ID NO: 2121787 - RNA, 19 nt, Human
gagccugaucaccugcccu

SEQ ID NO: 2121788 - RNA, 16 nt, Human
auaauccuaaacauau

SEQ ID NO: 2121789 - RNA, 22 nt, Human
ugggcacuguggguagacacac

SEQ ID NO: 2121790 - RNA, 23 nt, Human
ugaaaaucuuauaauuuaaaaua

SEQ ID NO: 2121791 - RNA, 19 nt, Human
gucaaucagccuaguugau

SEQ ID NO: 2121792 - RNA, 19 nt, Human
uguaguguuggagaagaac

SEQ ID NO: 2121793 - RNA, 19 nt, Human
guccauucuuccucccauu

SEQ ID NO: 2121794 - RNA, 15 nt, Human
ugauuucauucaaua

SEQ ID NO: 2121795 - RNA, 11 nt, Human
gggaaagaaga

SEQ ID NO: 2121796 - RNA, 13 nt, Human
cggccggcgcgcu

SEQ ID NO: 2121797 - RNA, 19 nt, Human
aguuauuuuuaaacuguaa

SEQ ID NO: 2121798 - RNA, 18 nt, Human
cuuuccacagaagcucca

SEQ ID NO: 2121799 - RNA, 17 nt, Human
caucagcaucccuagaa

SEQ ID NO: 2121800 - RNA, 17 nt, Human
guuagagaauuuccuua

SEQ ID NO: 2121801 - RNA, 16 nt, Human
uuucugaaauuuccug

SEQ ID NO: 2121802 - RNA, 10 nt, Human
ccugagcccc

SEQ ID NO: 2121803 - RNA, 16 nt, Human
uacauuuguauaaaau

SEQ ID NO: 2121804 - RNA, 16 nt, Human
aacgagacaagcagcc

SEQ ID NO: 2121805 - RNA, 16 nt, Human
uaccccuggccaagga

SEQ ID NO: 2121806 - RNA, 14 nt, Human
auuauuuuuuaaaa

SEQ ID NO: 2121807 - RNA, 17 nt, Human
cuggcugcgcucggccu

SEQ ID NO: 2121808 - RNA, 14 nt, Human
uauaauuuaaaaua

SEQ ID NO: 2121809 - RNA, 19 nt, Human
cccauggcacucuauguuc

SEQ ID NO: 2121810 - RNA, 20 nt, Human
ucugguagcuaaauauauau

SEQ ID NO: 2121811 - RNA, 18 nt, Human
ucaagggugugugcagca

SEQ ID NO: 2121812 - RNA, 14 nt, Human
ccccugagcuugca

SEQ ID NO: 2121813 - RNA, 13 nt, Human
aacucccugcccc

SEQ ID NO: 2121814 - RNA, 18 nt, Human
cugcagcgaguacuuccc

SEQ ID NO: 2121815 - RNA, 15 nt, Human
agucccugcugcccu

SEQ ID NO: 2121816 - RNA, 20 nt, Human
cgcgcucaucccacccgccc

SEQ ID NO: 2121817 - RNA, 16 nt, Human
ccugcaaagcccagcu

SEQ ID NO: 2121818 - RNA, 22 nt, Human
uaaaacaagcacuaaacaaaga

SEQ ID NO: 2121819 - RNA, 23 nt, Human
uggcuugaguuuaaauuguaaua

SEQ ID NO: 2121820 - RNA, 16 nt, Human
cuaggcauagcccugc

SEQ ID NO: 2121821 - RNA, 23 nt, Human
uaauuuguaguguuggagaagaa

SEQ ID NO: 2121822 - RNA, 16 nt, Human
auacuauuuaauuauu

SEQ ID NO: 2121823 - RNA, 20 nt, Human
ucaaaacuucagacauagaa

SEQ ID NO: 2121824 - RNA, 22 nt, Human
ggguuccuuccucugagccuug

SEQ ID NO: 2121825 - RNA, 14 nt, Human
ccaaauauaaauaa

SEQ ID NO: 2121826 - RNA, 22 nt, Human
agucuuucacauuuaaauaaag

SEQ ID NO: 2121827 - RNA, 16 nt, Human
ccaugugcagccacca

SEQ ID NO: 2121828 - RNA, 14 nt, Human
gagccgggaaagaa

SEQ ID NO: 2121829 - RNA, 23 nt, Human
ggagcaucuccucaacucugagu

SEQ ID NO: 2121830 - RNA, 21 nt, Human
ugagaaggcuguggauuuaau

SEQ ID NO: 2121831 - RNA, 17 nt, Human
agacagugaaagaaaau

SEQ ID NO: 2121832 - RNA, 23 nt, Human
caaagcugaaauggacuuuugua

SEQ ID NO: 2121833 - RNA, 14 nt, Human
uuagagaauuuccu

SEQ ID NO: 2121834 - RNA, 22 nt, Human
cacuuccaagagccuuuuuuug

SEQ ID NO: 2121835 - RNA, 20 nt, Human
uuucuucaacucccugcccc

SEQ ID NO: 2121836 - RNA, 15 nt, Human
gaaaacaaggaugaa

SEQ ID NO: 2121837 - RNA, 14 nt, Human
aagcuacuuauugu

SEQ ID NO: 2121838 - RNA, 15 nt, Human
cgcccacuuccuccc

SEQ ID NO: 2121839 - RNA, 19 nt, Human
ccccugagcuugcagagau

SEQ ID NO: 2121840 - RNA, 23 nt, Human
aauacacuguuaucuucacuuuu

SEQ ID NO: 2121841 - RNA, 19 nt, Human
cucugccucagaaaacaag

SEQ ID NO: 2121842 - RNA, 19 nt, Human
cccugcaaagcccagcuug

SEQ ID NO: 2121843 - RNA, 17 nt, Human
agcuacuaauuuuaaaa

SEQ ID NO: 2121844 - RNA, 14 nt, Human
auuuaauuauuuca

SEQ ID NO: 2121845 - RNA, 12 nt, Human
uaguacacacuu

SEQ ID NO: 2121846 - RNA, 15 nt, Human
agcucuaucaccaag

SEQ ID NO: 2121847 - RNA, 19 nt, Human
guacugagagugaacaaau

SEQ ID NO: 2121848 - RNA, 15 nt, Human
gaaaugauguuucau

SEQ ID NO: 2121849 - RNA, 15 nt, Human
ccaucccggccggcg

SEQ ID NO: 2121850 - RNA, 21 nt, Human
ugguccuaagucccugcugcc

SEQ ID NO: 2121851 - RNA, 18 nt, Human
uuacuguaagaaaauauc

SEQ ID NO: 2121852 - RNA, 21 nt, Human
caucuagcaugucgucaaagc

SEQ ID NO: 2121853 - RNA, 22 nt, Human
cugcucaauaaaguacaagagc

SEQ ID NO: 2121854 - RNA, 18 nt, Human
gcaaagcccagcuugaaa

SEQ ID NO: 2121855 - RNA, 18 nt, Human
auccccaagccuggcaag

SEQ ID NO: 2121856 - RNA, 18 nt, Human
aucuggcucuggacaggc

SEQ ID NO: 2121857 - RNA, 14 nt, Human
cuauuauauuucca

SEQ ID NO: 2121858 - RNA, 15 nt, Human
cugcagauaaacagu

SEQ ID NO: 2121859 - RNA, 11 nt, Human
gccaugggaca

SEQ ID NO: 2121860 - RNA, 16 nt, Human
aggccaugggacaggg

SEQ ID NO: 2121861 - RNA, 14 nt, Human
agagaauuuccuua

SEQ ID NO: 2121862 - RNA, 15 nt, Human
aauauauauuuuaga

SEQ ID NO: 2121863 - RNA, 13 nt, Human
aaaugggaaacaa

SEQ ID NO: 2121864 - RNA, 18 nt, Human
acaaaugggaaacaaaag

SEQ ID NO: 2121865 - RNA, 12 nt, Human
ccagucccuccc

SEQ ID NO: 2121866 - RNA, 15 nt, Human
aguuuauauagaaau

SEQ ID NO: 2121867 - RNA, 12 nt, Human
acaugagguacu

SEQ ID NO: 2121868 - RNA, 19 nt, Human
agaaaauaacaauaaaaga

SEQ ID NO: 2121869 - RNA, 17 nt, Human
uuuuuaauuauauggcu

SEQ ID NO: 2121870 - RNA, 19 nt, Human
uucccuugaugaagaaguu

SEQ ID NO: 2121871 - RNA, 19 nt, Human
gcuggccuugugaggagcu

SEQ ID NO: 2121872 - RNA, 13 nt, Human
cgcgcugcgcgcc

SEQ ID NO: 2121873 - RNA, 15 nt, Human
caguuauuuuuaaac

SEQ ID NO: 2121874 - RNA, 16 nt, Human
gcugcgcgccgcgcuc

SEQ ID NO: 2121875 - RNA, 13 nt, Human
uaguuuauauaga

SEQ ID NO: 2121876 - RNA, 15 nt, Human
auagaaguaaaaaca

SEQ ID NO: 2121877 - RNA, 17 nt, Human
uuauaaucuuucacagg

SEQ ID NO: 2121878 - RNA, 19 nt, Human
agcguugagccaccaagcu

SEQ ID NO: 2121879 - RNA, 18 nt, Human
cuucucacauuuauauuu

SEQ ID NO: 2121880 - RNA, 22 nt, Human
ugaaaaaguucugcagauaaac

SEQ ID NO: 2121881 - RNA, 14 nt, Human
auuuauguuuaauu

SEQ ID NO: 2121882 - RNA, 16 nt, Human
acagagacagaaagca

SEQ ID NO: 2121883 - RNA, 17 nt, Human
uguucuaagaagugaaa

SEQ ID NO: 2121884 - RNA, 12 nt, Human
cacaacacacag

SEQ ID NO: 2121885 - RNA, 14 nt, Human
cacaacacacagau

SEQ ID NO: 2121886 - RNA, 16 nt, Human
gaauauaaauuuauca

SEQ ID NO: 2121887 - RNA, 19 nt, Human
ucccgcuguuccucgccac

SEQ ID NO: 2121888 - RNA, 21 nt, Human
guuguaauuuuuuugugggaa

SEQ ID NO: 2121889 - RNA, 15 nt, Human
cccugcaaagcccag

SEQ ID NO: 2121890 - RNA, 13 nt, Human
cacaacacacaga

SEQ ID NO: 2121891 - RNA, 11 nt, Human
uuauauuuauu

SEQ ID NO: 2121892 - RNA, 19 nt, Human
uaccuccaaggaccggccu

SEQ ID NO: 2121893 - RNA, 14 nt, Human
cagugaaagaaaau

SEQ ID NO: 2121894 - RNA, 13 nt, Human
acuauuauauuuc

SEQ ID NO: 2121895 - RNA, 16 nt, Human
caggaaguagaggagg

SEQ ID NO: 2121896 - RNA, 14 nt, Human
gcugguggcucugu

SEQ ID NO: 2121897 - RNA, 14 nt, Human
acaagagcuuaaca

SEQ ID NO: 2121898 - RNA, 13 nt, Human
auuccucacuuug

SEQ ID NO: 2121899 - RNA, 17 nt, Human
aacaguuaccucugccu

SEQ ID NO: 2121900 - RNA, 17 nt, Human
agucccaggcugagccu

SEQ ID NO: 2121901 - RNA, 14 nt, Human
ugcuaagucuuaua

SEQ ID NO: 2121902 - RNA, 20 nt, Human
gaaaauaacaauaaaagaca

SEQ ID NO: 2121903 - RNA, 16 nt, Human
ggaggggcgcucgcuu

SEQ ID NO: 2121904 - RNA, 16 nt, Human
auuuuuuuuuuuaaaa

SEQ ID NO: 2121905 - RNA, 15 nt, Human
gcgcgccuccgcuac

SEQ ID NO: 2121906 - RNA, 16 nt, Human
caauguucccccucuc

SEQ ID NO: 2121907 - RNA, 21 nt, Human
uaauaggcguaacuaauuuua

SEQ ID NO: 2121908 - RNA, 13 nt, Human
uuaaauuguaaua

SEQ ID NO: 2121909 - RNA, 12 nt, Human
cccucugcagcu

SEQ ID NO: 2121910 - RNA, 18 nt, Human
cagcugcucaauaaagua

SEQ ID NO: 2121911 - RNA, 16 nt, Human
acggcuggagcugccu

SEQ ID NO: 2121912 - RNA, 18 nt, Human
uuugaagcacagugauca

SEQ ID NO: 2121913 - RNA, 16 nt, Human
uuucacauuuaaauaa

SEQ ID NO: 2121914 - RNA, 21 nt, Human
auucauagcagcuuauucaca

SEQ ID NO: 2121915 - RNA, 16 nt, Human
cuguggauuuaaugug

SEQ ID NO: 2121916 - RNA, 22 nt, Human
aaagagugaaggauuuauguuu

SEQ ID NO: 2121917 - RNA, 17 nt, Human
auaaguacaugauaagc

SEQ ID NO: 2121918 - RNA, 19 nt, Human
aaucuacacuccagugaga

SEQ ID NO: 2121919 - RNA, 19 nt, Human
ugcagcgaguacuucccgc

SEQ ID NO: 2121920 - RNA, 17 nt, Human
ugcuguucaugaaagau

SEQ ID NO: 2121921 - RNA, 22 nt, Human
caaugcuguauuuuaaaagaau

SEQ ID NO: 2121922 - RNA, 24 nt, Human
ucucuaucauuaaaguucuaguga

SEQ ID NO: 2121923 - RNA, 15 nt, Human
uauaauuuaaauaua

SEQ ID NO: 2121924 - RNA, 13 nt, Human
cguugagccacca

SEQ ID NO: 2121925 - RNA, 16 nt, Human
cagggacuugaaccca

SEQ ID NO: 2121926 - RNA, 15 nt, Human
auuuuaaaagaauga

SEQ ID NO: 2121927 - RNA, 23 nt, Human
aaugcuccuccagggagucucag

SEQ ID NO: 2121928 - RNA, 19 nt, Human
cgcucugggucgccggcau

SEQ ID NO: 2121929 - RNA, 13 nt, Human
cuuuccaugaguu

SEQ ID NO: 2121930 - RNA, 12 nt, Human
gccccugagccc

SEQ ID NO: 2121931 - RNA, 21 nt, Human
auaguuacccaaauuaagaga

SEQ ID NO: 2121932 - RNA, 21 nt, Human
gguuuucacauuggaaacaag

SEQ ID NO: 2121933 - RNA, 23 nt, Human
uuuguauaaaauaauuuuuauau

SEQ ID NO: 2121934 - RNA, 12 nt, Human
uauuuuaauguu

SEQ ID NO: 2121935 - RNA, 22 nt, Human
uuuauggcacuaguauuucuau

SEQ ID NO: 2121936 - RNA, 12 nt, Human
gucccaggcuga

SEQ ID NO: 2121937 - RNA, 23 nt, Human
ggaugaauuaaguuuuuuuuuaa

SEQ ID NO: 2121938 - RNA, 13 nt, Human
aagacagugaaag

SEQ ID NO: 2121939 - RNA, 18 nt, Human
uucagcagagaaguuuuc

SEQ ID NO: 2121940 - RNA, 17 nt, Human
uucucuaggaaauauuu

SEQ ID NO: 2121941 - RNA, 19 nt, Human
gcugccccggggaggggcg

SEQ ID NO: 2121942 - RNA, 14 nt, Human
uaaccucuaaauuc

SEQ ID NO: 2121943 - RNA, 20 nt, Human
uuauucacuguauguccuug

SEQ ID NO: 2121944 - RNA, 16 nt, Human
aauuucuucaacuccc

SEQ ID NO: 2121945 - RNA, 15 nt, Human
aaaauacaaaaaaaa

SEQ ID NO: 2121946 - RNA, 16 nt, Human
aauuccacagcugcuc

SEQ ID NO: 2121947 - RNA, 21 nt, Human
agggugauauuaaccaggggc

SEQ ID NO: 2121948 - RNA, 21 nt, Human
aagauauuaacugagaaggcu

SEQ ID NO: 2121949 - RNA, 18 nt, Human
agaagcaacccaaauguu

SEQ ID NO: 2121950 - RNA, 23 nt, Human
uugauuuuauaugcuauuuauua

SEQ ID NO: 2121951 - RNA, 18 nt, Human
ggaccaucccggccggcg

SEQ ID NO: 2121952 - RNA, 23 nt, Human
caggaaucacuggcuguuaaucu

SEQ ID NO: 2121953 - RNA, 20 nt, Human
augcaguuguugcccacagc

SEQ ID NO: 2121954 - RNA, 13 nt, Human
agcccagcuugaa

SEQ ID NO: 2121955 - RNA, 20 nt, Human
augcuucuguuuuauaauuu

SEQ ID NO: 2121956 - RNA, 16 nt, Human
gaauggcuaagcaaaa

SEQ ID NO: 2121957 - RNA, 15 nt, Human
ggcuggcgugcagca

SEQ ID NO: 2121958 - RNA, 22 nt, Human
uuuccaagcaaguauuagaaua

SEQ ID NO: 2121959 - RNA, 19 nt, Human
caugaguaacugauuugua

SEQ ID NO: 2121960 - RNA, 22 nt, Human
aaagacagugaaagaaaauaac

SEQ ID NO: 2121961 - RNA, 23 nt, Human
uguugagguaccuccaaggaccg

SEQ ID NO: 2121962 - RNA, 22 nt, Human
uuguaacaagccuccuuuuaaa

SEQ ID NO: 2121963 - RNA, 19 nt, Human
acagugauuaccagggacu

SEQ ID NO: 2121964 - RNA, 11 nt, Human
acuuugaagag

SEQ ID NO: 2121965 - RNA, 16 nt, Human
cgcucaucccacccgc

SEQ ID NO: 2121966 - RNA, 21 nt, Human
gucucagugucaaugcagccc

SEQ ID NO: 2121967 - RNA, 17 nt, Human
aauucuugccaaauaua

SEQ ID NO: 2121968 - RNA, 15 nt, Human
gcuaauaucuuaucu

SEQ ID NO: 2121969 - RNA, 17 nt, Human
ggagcucguggaacagu

SEQ ID NO: 2121970 - RNA, 23 nt, Human
ccccggggaggggcgcucgcuuc

SEQ ID NO: 2121971 - RNA, 18 nt, Human
ggcuccggacgcugcugc

SEQ ID NO: 2121972 - RNA, 20 nt, Human
cacagcacgggggccaagga

SEQ ID NO: 2121973 - RNA, 19 nt, Human
aaaguaugugcauauuuua

SEQ ID NO: 2121974 - RNA, 22 nt, Human
uuccccuuccuaauuccacagc

SEQ ID NO: 2121975 - RNA, 20 nt, Human
ucaauaaaauccauacauuu

SEQ ID NO: 2121976 - RNA, 23 nt, Human
agccaccaguccauugggcaggc

SEQ ID NO: 2121977 - RNA, 22 nt, Human
caucgcaauguaagacucggga

SEQ ID NO: 2121978 - RNA, 18 nt, Human
auucugguagcuaaauau

SEQ ID NO: 2121979 - RNA, 16 nt, Human
cagggcucacagaauu

SEQ ID NO: 2121980 - RNA, 13 nt, Human
gcuacgcgcgcuc

SEQ ID NO: 2121981 - RNA, 21 nt, Human
ucacaugaacuuguaaaggaa

SEQ ID NO: 2121982 - RNA, 22 nt, Human
aauuacauuuguauaaaauaau

SEQ ID NO: 2121983 - RNA, 15 nt, Human
gccgacggagccggg

SEQ ID NO: 2121984 - RNA, 22 nt, Human
augcagagguccacaacacaca

SEQ ID NO: 2121985 - RNA, 15 nt, Human
cuguauguccuuggu

SEQ ID NO: 2121986 - RNA, 15 nt, Human
uaucuucacuuuuau

SEQ ID NO: 2121987 - RNA, 22 nt, Human
gugaacaaauuuacagagacag

SEQ ID NO: 2121988 - RNA, 15 nt, Human
aggguuuggaagcca

SEQ ID NO: 2121989 - RNA, 21 nt, Human
cgagccccaggcggguccggg

SEQ ID NO: 2121990 - RNA, 10 nt, Human
acuuccuccc

SEQ ID NO: 2121991 - RNA, 22 nt, Human
caccagucugacuguuuccauc

SEQ ID NO: 2121992 - RNA, 22 nt, Human
auauuuccuuauucagaauuuc

SEQ ID NO: 2121993 - RNA, 19 nt, Human
uguucaugcccauaccccu

SEQ ID NO: 2121994 - RNA, 17 nt, Human
cuggacucaccuccccc

SEQ ID NO: 2121995 - RNA, 23 nt, Human
agaaugauuaugaauuacauuug

SEQ ID NO: 2121996 - RNA, 17 nt, Human
uccuuggugccuggagc

SEQ ID NO: 2121997 - RNA, 12 nt, Human
auggguuuuauu

SEQ ID NO: 2121998 - RNA, 18 nt, Human
cgcgagcgcgcgcgcccu

SEQ ID NO: 2121999 - RNA, 21 nt, Human
auggaaauacacuguuaucuu

SEQ ID NO: 2122000 - RNA, 19 nt, Human
agaaaauaacgauaaaaga

SEQ ID NO: 2122001 - RNA, 20 nt, Human
ccgcagggugaacugcagcg

SEQ ID NO: 2122002 - RNA, 16 nt, Human
ugugcagccaccaguc

SEQ ID NO: 2122003 - RNA, 12 nt, Human
aagaaaauaaca

SEQ ID NO: 2122004 - RNA, 21 nt, Human
ccggggaggggcgcucgcuuc

SEQ ID NO: 2122005 - RNA, 20 nt, Human
aaugauguuucauaagaauu

SEQ ID NO: 2122006 - RNA, 19 nt, Human
uuguagaagucacauuccu

SEQ ID NO: 2122007 - RNA, 13 nt, Human
ggugugugcagca

SEQ ID NO: 2122008 - RNA, 19 nt, Human
aguauuucuaugaaauauu

SEQ ID NO: 2122009 - RNA, 17 nt, Human
guagaaugggggcagca

SEQ ID NO: 2122010 - RNA, 14 nt, Human
ccaccugcugagcc

SEQ ID NO: 2122011 - RNA, 22 nt, Human
uauccuacuuccccuuccuaau

SEQ ID NO: 2122012 - RNA, 17 nt, Human
aguaaaaggaaaugcuc

SEQ ID NO: 2122013 - RNA, 23 nt, Human
cuuauaucuauauuuuacauaaa

SEQ ID NO: 2122014 - RNA, 13 nt, Human
uuccucugagccu

SEQ ID NO: 2122015 - RNA, 17 nt, Human
acaagaaaugaaagcag

SEQ ID NO: 2122016 - RNA, 18 nt, Human
cuaauguguaagacaaaa

SEQ ID NO: 2122017 - RNA, 17 nt, Human
uacagaaaaguugaauu

SEQ ID NO: 2122018 - RNA, 15 nt, Human
auuauagucacuagu

SEQ ID NO: 2122019 - RNA, 13 nt, Human
caguuauuauauu

SEQ ID NO: 2122020 - RNA, 21 nt, Human
cagugagacagcucugcauac

SEQ ID NO: 2122021 - RNA, 21 nt, Human
cuauguucuaagaagugaaaa

SEQ ID NO: 2122022 - RNA, 20 nt, Human
agagccggagccuccagcug

SEQ ID NO: 2122023 - RNA, 15 nt, Human
gacagggaggacgcu

SEQ ID NO: 2122024 - RNA, 20 nt, Human
caagagccuuuuuuugaaaa

SEQ ID NO: 2122025 - RNA, 19 nt, Human
uggcaagcucuaucaccaa

SEQ ID NO: 2122026 - RNA, 19 nt, Human
uguauacugugugcuaaaa

SEQ ID NO: 2122027 - RNA, 14 nt, Human
ccacccgcccaccg

SEQ ID NO: 2122028 - RNA, 18 nt, Human
ccaaccuggaguugaaaa

SEQ ID NO: 2122029 - RNA, 20 nt, Human
acuaaauugacacuuaaaaa

SEQ ID NO: 2122030 - RNA, 15 nt, Human
ccaaggagccaaaca

SEQ ID NO: 2122031 - RNA, 12 nt, Human
gaugagagaaca

SEQ ID NO: 2122032 - RNA, 13 nt, Human
ucucccucccuug

SEQ ID NO: 2122033 - RNA, 22 nt, Human
auaucuuuuuuuuaauaaacca

SEQ ID NO: 2122034 - RNA, 20 nt, Human
ugcagccaccaguccauugg

SEQ ID NO: 2122035 - RNA, 23 nt, Human
cugaaaucauacuucuuaggguu

SEQ ID NO: 2122036 - RNA, 23 nt, Human
cugccucucucauccacuuucca

SEQ ID NO: 2122037 - RNA, 13 nt, Human
augcuguucauga

SEQ ID NO: 2122038 - RNA, 18 nt, Human
uauuuuguuucagugcac

SEQ ID NO: 2122039 - RNA, 19 nt, Human
accauuuuggcaagcucua

SEQ ID NO: 2122040 - RNA, 23 nt, Human
gcuggccuugugaggagcuggaa

SEQ ID NO: 2122041 - RNA, 14 nt, Human
acaaauccaaugaa

SEQ ID NO: 2122042 - RNA, 11 nt, Human
auacugaaaua

SEQ ID NO: 2122043 - RNA, 18 nt, Human
gaaaauaacaauaaaaga

SEQ ID NO: 2122044 - RNA, 20 nt, Human
cucagcuucacccugaggug

SEQ ID NO: 2122045 - RNA, 21 nt, Human
uauuacuguaagaaaauauca

SEQ ID NO: 2122046 - RNA, 18 nt, Human
uauauuuuuuuuuuuaaa

SEQ ID NO: 2122047 - RNA, 19 nt, Human
aauauuauguuaaaacugg

SEQ ID NO: 2122048 - RNA, 22 nt, Human
cuucaacucccugccccccagc

SEQ ID NO: 2122049 - RNA, 14 nt, Human
cauagaaguaaaaa

SEQ ID NO: 2122050 - RNA, 13 nt, Human
ccacaacacacag

SEQ ID NO: 2122051 - RNA, 19 nt, Human
ccccugcaaagcccagcuu

SEQ ID NO: 2122052 - RNA, 18 nt, Human
agcaaaauuuuuucucua

SEQ ID NO: 2122053 - RNA, 21 nt, Human
agccucuuagaugcaguucug

SEQ ID NO: 2122054 - RNA, 18 nt, Human
auaauccuaaacauauga

SEQ ID NO: 2122055 - RNA, 16 nt, Human
cuggcugcgcucggcc

SEQ ID NO: 2122056 - RNA, 16 nt, Human
gcuguuaaucuuucaa

SEQ ID NO: 2122057 - RNA, 12 nt, Human
aauauauuuccu

SEQ ID NO: 2122058 - RNA, 19 nt, Human
ucugagcauuuaauaugga

SEQ ID NO: 2122059 - RNA, 14 nt, Human
aagaagugaaaauc

SEQ ID NO: 2122060 - RNA, 16 nt, Human
guuuuuuuuuaaaaaa

SEQ ID NO: 2122061 - RNA, 16 nt, Human
aacaauaaaagacaag

SEQ ID NO: 2122062 - RNA, 17 nt, Human
ccagggcuacgcgcgcu

SEQ ID NO: 2122063 - RNA, 17 nt, Human
cugaacaggauauucuc

SEQ ID NO: 2122064 - RNA, 18 nt, Human
caaugccccugaauuuaa

SEQ ID NO: 2122065 - RNA, 19 nt, Human
ggacucaccucccccaucu

SEQ ID NO: 2122066 - RNA, 16 nt, Human
gaaaaaauaacaauga

SEQ ID NO: 2122067 - RNA, 21 nt, Human
uuauuuucuauaauuuaaaua

SEQ ID NO: 2122068 - RNA, 20 nt, Human
uaucauuuaguuauaaaaau

SEQ ID NO: 2122069 - RNA, 21 nt, Human
ucuggguugaagggcaguguu

SEQ ID NO: 2122070 - RNA, 15 nt, Human
agacagcucugcaua

SEQ ID NO: 2122071 - RNA, 15 nt, Human
uuacagagacagaaa

SEQ ID NO: 2122072 - RNA, 22 nt, Human
augguuguauuauuuuuuaaaa

SEQ ID NO: 2122073 - RNA, 20 nt, Human
aucaaccugccagcuggccu

SEQ ID NO: 2122074 - RNA, 17 nt, Human
cucucauccacuuucca

SEQ ID NO: 2122075 - RNA, 16 nt, Human
ccccuucccacacugu

SEQ ID NO: 2122076 - RNA, 23 nt, Human
uauguuaaaacugggacagggga

SEQ ID NO: 2122077 - RNA, 15 nt, Human
auuugguaaggggaa

SEQ ID NO: 2122078 - RNA, 17 nt, Human
ggcuccggacgcugcug

SEQ ID NO: 2122079 - RNA, 13 nt, Human
aagcauuccaacu

SEQ ID NO: 2122080 - RNA, 12 nt, Human
cgcucggccugc

SEQ ID NO: 2122081 - RNA, 15 nt, Human
gcacagccucuuaga

SEQ ID NO: 2122082 - RNA, 13 nt, Human
ccucuggcuccag

SEQ ID NO: 2122083 - RNA, 19 nt, Human
uccuagucucuaucauuaa

SEQ ID NO: 2122084 - RNA, 22 nt, Human
cucuggccuucggccuccaucc

SEQ ID NO: 2122085 - RNA, 12 nt, Human
caugggaaguga

SEQ ID NO: 2122086 - RNA, 16 nt, Human
ccagggcuacgcgcgc

SEQ ID NO: 2122087 - RNA, 17 nt, Human
caugagggcuggaugcu

SEQ ID NO: 2122088 - RNA, 19 nt, Human
aaguugcauagguuuaaua

SEQ ID NO: 2122089 - RNA, 21 nt, Human
agagccggagccuccagcugc

SEQ ID NO: 2122090 - RNA, 23 nt, Human
ugucacgugugggcaauguuccc

SEQ ID NO: 2122091 - RNA, 21 nt, Human
aaaaacguauugcauuuaauu

SEQ ID NO: 2122092 - RNA, 14 nt, Human
cuaagucuuauaua

SEQ ID NO: 2122093 - RNA, 23 nt, Human
ggaggcagagguugcagugagcc

SEQ ID NO: 2122094 - RNA, 20 nt, Human
uccucaugagggcuggaugc

SEQ ID NO: 2122095 - RNA, 15 nt, Human
agccucagucucccu

SEQ ID NO: 2122096 - RNA, 19 nt, Human
auaauuuuuauauuugaaa

SEQ ID NO: 2122097 - RNA, 22 nt, Human
aaugggcacaggguuuauguuu

SEQ ID NO: 2122098 - RNA, 13 nt, Human
cccugcacuccag

SEQ ID NO: 2122099 - RNA, 17 nt, Human
caaagagaaagaggguu

SEQ ID NO: 2122100 - RNA, 22 nt, Human
aaaaaaccugagccccaaaagg

SEQ ID NO: 2122101 - RNA, 22 nt, Human
ccacagcuguaugauucccagc

SEQ ID NO: 2122102 - RNA, 15 nt, Human
cuggaaacacauguu

SEQ ID NO: 2122103 - RNA, 14 nt, Human
acuuuuauaagaaa

SEQ ID NO: 2122104 - RNA, 18 nt, Human
gccuccagcugccccggg

SEQ ID NO: 2122105 - RNA, 18 nt, Human
ccuucggccuccauccug

SEQ ID NO: 2122106 - RNA, 23 nt, Human
accucucuggguugaagggcagu

SEQ ID NO: 2122107 - RNA, 18 nt, Human
aaagaaaaucaggcuggc

SEQ ID NO: 2122108 - RNA, 17 nt, Human
ccuauccuacuuccccu

SEQ ID NO: 2122109 - RNA, 14 nt, Human
auuugaaauuguau

SEQ ID NO: 2122110 - RNA, 13 nt, Human
uuuuaauuugguu

SEQ ID NO: 2122111 - RNA, 15 nt, Human
cucccuuggggccua

SEQ ID NO: 2122112 - RNA, 15 nt, Human
cuccagggagucuca

SEQ ID NO: 2122113 - RNA, 13 nt, Human
augauuccaccua

SEQ ID NO: 2122114 - RNA, 17 nt, Human
auguuucauaagaauuc

SEQ ID NO: 2122115 - RNA, 16 nt, Human
auuauacccccugcaa

SEQ ID NO: 2122116 - RNA, 18 nt, Human
cuccauuuuuagugaaau

SEQ ID NO: 2122117 - RNA, 18 nt, Human
caaaaagcuacuuauugu

SEQ ID NO: 2122118 - RNA, 13 nt, Human
ugggaggcugaga

SEQ ID NO: 2122119 - RNA, 16 nt, Human
acaaauccaaugaaau

SEQ ID NO: 2122120 - RNA, 23 nt, Human
gcccacggcuggagcugccucuc

SEQ ID NO: 2122121 - RNA, 16 nt, Human
gcuccggacgcugcug

SEQ ID NO: 2122122 - RNA, 17 nt, Human
ucccuccccaaaugcuu

SEQ ID NO: 2122123 - RNA, 13 nt, Human
ccaggcugagccu

SEQ ID NO: 2122124 - RNA, 18 nt, Human
gcgcuggcugcgcucggc

SEQ ID NO: 2122125 - RNA, 17 nt, Human
acuugaacccauauuug

SEQ ID NO: 2122126 - RNA, 20 nt, Human
caaauauaaauaaaaauaau

SEQ ID NO: 2122127 - RNA, 23 nt, Human
uguagguagaucuggucuuuaga

SEQ ID NO: 2122128 - RNA, 18 nt, Human
ugccauaauuacuauguc

SEQ ID NO: 2122129 - RNA, 23 nt, Human
gaaaaaguucugcagauaaacag

SEQ ID NO: 2122130 - RNA, 15 nt, Human
uugacacuuaaaaau

SEQ ID NO: 2122131 - RNA, 21 nt, Human
aaaaaguucugcagauaaaca

SEQ ID NO: 2122132 - RNA, 21 nt, Human
ucuucaacucccugcccccca

SEQ ID NO: 2122133 - RNA, 19 nt, Human
uuaauuugguuuucacauu

SEQ ID NO: 2122134 - RNA, 17 nt, Human
aaaaauccuacuuucau

SEQ ID NO: 2122135 - RNA, 16 nt, Human
caugguuuagaaagcu

SEQ ID NO: 2122136 - RNA, 19 nt, Human
aaccgaacugauguaagua

SEQ ID NO: 2122137 - RNA, 20 nt, Human
uggggcuuuaacuccugcua

SEQ ID NO: 2122138 - RNA, 19 nt, Human
acaaauuuacagagacaga

SEQ ID NO: 2122139 - RNA, 16 nt, Human
aucaauuuaaaaaaaa

SEQ ID NO: 2122140 - RNA, 14 nt, Human
accauuuuuacuug

SEQ ID NO: 2122141 - RNA, 14 nt, Human
aauauaaauaaaaa

SEQ ID NO: 2122142 - RNA, 21 nt, Human
uuuauauaagcuuguauuccu

SEQ ID NO: 2122143 - RNA, 17 nt, Human
cggcuggagcugccucu

SEQ ID NO: 2122144 - RNA, 23 nt, Human
auuuaaauagcuuuuuucucuga

SEQ ID NO: 2122145 - RNA, 12 nt, Human
ucuauguagaau

SEQ ID NO: 2122146 - RNA, 14 nt, Human
aaauaggaaauauu

SEQ ID NO: 2122147 - RNA, 22 nt, Human
uaucuauguagaauauauuucc

SEQ ID NO: 2122148 - RNA, 18 nt, Human
cugagaccaaggcccccg

SEQ ID NO: 2122149 - RNA, 17 nt, Human
cauaguaccucugcuau

SEQ ID NO: 2122150 - RNA, 20 nt, Human
ccaaauguucaucaaugaau

SEQ ID NO: 2122151 - RNA, 23 nt, Human
cagagguugcagugagccgagau

SEQ ID NO: 2122152 - RNA, 15 nt, Human
gucaaugcagccccc

SEQ ID NO: 2122153 - RNA, 19 nt, Human
gcaggcacugccaaaacau

SEQ ID NO: 2122154 - RNA, 22 nt, Human
ugcuggagacauugaggcaggc

SEQ ID NO: 2122155 - RNA, 16 nt, Human
uaaacgucuuaaauau

SEQ ID NO: 2122156 - RNA, 17 nt, Human
gcagcauuguuggcugu

SEQ ID NO: 2122157 - RNA, 17 nt, Human
cuucacuguaaaauaau

SEQ ID NO: 2122158 - RNA, 14 nt, Human
cugaggcuccacuu

SEQ ID NO: 2122159 - RNA, 12 nt, Human
uaauuccacagc

SEQ ID NO: 2122160 - RNA, 10 nt, Human
uuuuuaaaaa

SEQ ID NO: 2122161 - RNA, 21 nt, Human
cuagucuguuuucccuccuug

SEQ ID NO: 2122162 - RNA, 16 nt, Human
cacuuaaaaaugguuu

SEQ ID NO: 2122163 - RNA, 17 nt, Human
cccaggcugagccucag

SEQ ID NO: 2122164 - RNA, 15 nt, Human
aaggaaaaaauaaca

SEQ ID NO: 2122165 - RNA, 24 nt, Human
uaauuuaaaauaugcucuaaacau

SEQ ID NO: 2122166 - RNA, 16 nt, Human
ccugaucaccugcccu

SEQ ID NO: 2122167 - RNA, 20 nt, Human
agcauuguuggcuguuccug

SEQ ID NO: 2122168 - RNA, 17 nt, Human
cggccgcgcugcgcgcc

SEQ ID NO: 2122169 - RNA, 22 nt, Human
uugacccacaagaaaugaaagc

SEQ ID NO: 2122170 - RNA, 14 nt, Human
aagcucuaucacca

SEQ ID NO: 2122171 - RNA, 13 nt, Human
caucgcagacaca

SEQ ID NO: 2122172 - RNA, 16 nt, Human
gugagacagcucugca

SEQ ID NO: 2122173 - RNA, 20 nt, Human
aaucuuucacaggggacagg

SEQ ID NO: 2122174 - RNA, 20 nt, Human
cggagccuccagcugccccg

SEQ ID NO: 2122175 - RNA, 19 nt, Human
augugcauauuuuauuaua

SEQ ID NO: 2122176 - RNA, 15 nt, Human
uggcuaauuagcaug

SEQ ID NO: 2122177 - RNA, 12 nt, Human
uaaauauauauu

SEQ ID NO: 2122178 - RNA, 18 nt, Human
aucuuauaauuuaaaaua

SEQ ID NO: 2122179 - RNA, 19 nt, Human
cuuccuaauuccacagcug

SEQ ID NO: 2122180 - RNA, 13 nt, Human
caacaucuaguga

SEQ ID NO: 2122181 - RNA, 16 nt, Human
augaauacuuuauaaa

SEQ ID NO: 2122182 - RNA, 21 nt, Human
cagacacaugugcuggccacc

SEQ ID NO: 2122183 - RNA, 11 nt, Human
gguuuuauuau

SEQ ID NO: 2122184 - RNA, 15 nt, Human
gaauauauuuccuua

SEQ ID NO: 2122185 - RNA, 19 nt, Human
gucccugcugcccuucccc

SEQ ID NO: 2122186 - RNA, 23 nt, Human
ugucaauucuugccaaauauaaa

SEQ ID NO: 2122187 - RNA, 13 nt, Human
auuuuuuaaaaaa

SEQ ID NO: 2122188 - RNA, 12 nt, Human
uuauucacugua

SEQ ID NO: 2122189 - RNA, 14 nt, Human
cacuaaacaaagag

SEQ ID NO: 2122190 - RNA, 20 nt, Human
guuccuuccucugagccuug

SEQ ID NO: 2122191 - RNA, 21 nt, Human
ugccagcuggccuugugagga

SEQ ID NO: 2122192 - RNA, 18 nt, Human
uucaauaucuuuuuuuua

SEQ ID NO: 2122193 - RNA, 17 nt, Human
ccccugaauuuaaauag

SEQ ID NO: 2122194 - RNA, 23 nt, Human
uuguaaagguccuggcaaagaug

SEQ ID NO: 2122195 - RNA, 18 nt, Human
cugaaggguaauuauaua

SEQ ID NO: 2122196 - RNA, 23 nt, Human
gagaaaugagcacgcauggaaaa

SEQ ID NO: 2122197 - RNA, 22 nt, Human
guggcgcuggcugcgcucggcc

SEQ ID NO: 2122198 - RNA, 23 nt, Human
cauccucgaggcccuagcauuuc

SEQ ID NO: 2122199 - RNA, 22 nt, Human
ccauuucuugagguaaaagcau

SEQ ID NO: 2122200 - RNA, 21 nt, Human
uaucuuccuauaauuuuagac

SEQ ID NO: 2122201 - RNA, 16 nt, Human
uaucaaaagaaagaaa

SEQ ID NO: 2122202 - RNA, 16 nt, Human
agcccugccucaagcu

SEQ ID NO: 2122203 - RNA, 17 nt, Human
auggcuaguaucaaaag

SEQ ID NO: 2122204 - RNA, 20 nt, Human
uauaugcuaagucuuauaua

SEQ ID NO: 2122205 - RNA, 13 nt, Human
aaaaaugguuuaa

SEQ ID NO: 2122206 - RNA, 16 nt, Human
uagagaauuuccuuac

SEQ ID NO: 2122207 - RNA, 14 nt, Human
cacaagaaaugaaa

SEQ ID NO: 2122208 - RNA, 15 nt, Human
gauccugcaauucca

SEQ ID NO: 2122209 - RNA, 18 nt, Human
uauaggauguggggaagu

SEQ ID NO: 2122210 - RNA, 20 nt, Human
gaccauacuaauuauacccc

SEQ ID NO: 2122211 - RNA, 23 nt, Human
uaagaaauaggaaauauuuuaau

SEQ ID NO: 2122212 - RNA, 16 nt, Human
ugaauuuaaauagcuu

SEQ ID NO: 2122213 - RNA, 14 nt, Human
acuaauuuuaaaau

SEQ ID NO: 2122214 - RNA, 15 nt, Human
auuucuaugaaauau

SEQ ID NO: 2122215 - RNA, 22 nt, Human
uaaacuguaaagcuuugugcag

SEQ ID NO: 2122216 - RNA, 19 nt, Human
gcacacagcacgggggcca

SEQ ID NO: 2122217 - RNA, 15 nt, Human
ugcaauuccacuuau

SEQ ID NO: 2122218 - RNA, 14 nt, Human
gcuggcgugcagca

SEQ ID NO: 2122219 - RNA, 16 nt, Human
cacuuuccaauaaaga

SEQ ID NO: 2122220 - RNA, 18 nt, Human
auucuugccaaauauaaa

SEQ ID NO: 2122221 - RNA, 16 nt, Human
aaaugggaaacaaaag

SEQ ID NO: 2122222 - RNA, 13 nt, Human
cugaagcuguguc

SEQ ID NO: 2122223 - RNA, 18 nt, Human
ccauccugccccugagcc

SEQ ID NO: 2122224 - RNA, 17 nt, Human
aguuuauauagaaaugu

SEQ ID NO: 2122225 - RNA, 18 nt, Human
acugugugcuaaaacaag

SEQ ID NO: 2122226 - RNA, 12 nt, Human
auuauauuucca

SEQ ID NO: 2122227 - RNA, 18 nt, Human
gccccgucccccucuggc

SEQ ID NO: 2122228 - RNA, 19 nt, Human
agaugcuagaacucccuuu

SEQ ID NO: 2122229 - RNA, 16 nt, Human
ugauacagaaaaguug

SEQ ID NO: 2122230 - RNA, 23 nt, Human
auaucuuuuuuuuaauaaaccau

SEQ ID NO: 2122231 - RNA, 15 nt, Human
aaaagacaaggaaaa

SEQ ID NO: 2122232 - RNA, 15 nt, Human
ucaccagucccuccc

SEQ ID NO: 2122233 - RNA, 19 nt, Human
cacaggaaccacaagacug

SEQ ID NO: 2122234 - RNA, 17 nt, Human
cuuccucugagccuugg

SEQ ID NO: 2122235 - RNA, 12 nt, Human
aaaauaacaaua

SEQ ID NO: 2122236 - RNA, 21 nt, Human
cauuuucuucucacauuuaua

SEQ ID NO: 2122237 - RNA, 21 nt, Human
gcaggaccaucccggccggcg

SEQ ID NO: 2122238 - RNA, 15 nt, Human
ggccuucggccucca

SEQ ID NO: 2122239 - RNA, 19 nt, Human
uucacauuggaaacaaguc

SEQ ID NO: 2122240 - RNA, 14 nt, Human
auugaggcaggcac

SEQ ID NO: 2122241 - RNA, 16 nt, Human
aaauauuuauuuuaau

SEQ ID NO: 2122242 - RNA, 16 nt, Human
acggagccgggaaaga

SEQ ID NO: 2122243 - RNA, 22 nt, Human
agggagucucagcuucacccug

SEQ ID NO: 2122244 - RNA, 23 nt, Human
agccccaaguggaacgagacaag

SEQ ID NO: 2122245 - RNA, 13 nt, Human
aaagaagagccgg

SEQ ID NO: 2122246 - RNA, 13 nt, Human
uaguuuuuaaagu

SEQ ID NO: 2122247 - RNA, 13 nt, Human
caccaaggagcca

SEQ ID NO: 2122248 - RNA, 20 nt, Human
uuugccgcuuaagcuuucag

SEQ ID NO: 2122249 - RNA, 21 nt, Human
uuuuaauuugguuuucacauu

SEQ ID NO: 2122250 - RNA, 13 nt, Human
uuuaaaaaagaaa

SEQ ID NO: 2122251 - RNA, 17 nt, Human
cucugauccgagcucag

SEQ ID NO: 2122252 - RNA, 16 nt, Human
augccccgucccccuc

SEQ ID NO: 2122253 - RNA, 20 nt, Human
acaccuuaucuauguagaau

SEQ ID NO: 2122254 - RNA, 16 nt, Human
cuacacuccagugaga

SEQ ID NO: 2122255 - RNA, 21 nt, Human
cgcccacuuccucccggccgc

SEQ ID NO: 2122256 - RNA, 22 nt, Human
ccucccuuggggccuaugcaga

SEQ ID NO: 2122257 - RNA, 21 nt, Human
uggggcuuuaacuccugcuag

SEQ ID NO: 2122258 - RNA, 17 nt, Human
acaaaugcauuucuaaa

SEQ ID NO: 2122259 - RNA, 18 nt, Human
gacauuugcucauggaau

SEQ ID NO: 2122260 - RNA, 20 nt, Human
uaucuccgucaacucauauu

SEQ ID NO: 2122261 - RNA, 14 nt, Human
agguugcagugagc

SEQ ID NO: 2122262 - RNA, 19 nt, Human
cagaaagcagaacagugau

SEQ ID NO: 2122263 - RNA, 23 nt, Human
auuucugagcauuuaauauggau

SEQ ID NO: 2122264 - RNA, 21 nt, Human
gguccuugcugcaccugugcc

SEQ ID NO: 2122265 - RNA, 17 nt, Human
uaauuugguuuucacau

SEQ ID NO: 2122266 - RNA, 23 nt, Human
cauuguggucacaggaaguagag

SEQ ID NO: 2122267 - RNA, 16 nt, Human
augagcacgcauggaa

SEQ ID NO: 2122268 - RNA, 16 nt, Human
ggagccuccagcugcc

SEQ ID NO: 2122269 - RNA, 18 nt, Human
uaaaagacaaggaaaaaa

SEQ ID NO: 2122270 - RNA, 11 nt, Human
uuauauuucca

SEQ ID NO: 2122271 - RNA, 17 nt, Human
gacucaccucccccauc

SEQ ID NO: 2122272 - RNA, 11 nt, Human
ugcagugagcc

SEQ ID NO: 2122273 - RNA, 16 nt, Human
gucuguuuucccuccu

SEQ ID NO: 2122274 - RNA, 13 nt, Human
cuucuuucaugaa

SEQ ID NO: 2122275 - RNA, 23 nt, Human
agcagcccuuagcccuuccccuc

SEQ ID NO: 2122276 - RNA, 16 nt, Human
guuucacaccuuaucu

SEQ ID NO: 2122277 - RNA, 13 nt, Human
aacaagccuccuu

SEQ ID NO: 2122278 - RNA, 15 nt, Human
cuccucaacucugag

SEQ ID NO: 2122279 - RNA, 14 nt, Human
gcgcugcgcgccgc

SEQ ID NO: 2122280 - RNA, 18 nt, Human
uuauuacuguaagaaaau

SEQ ID NO: 2122281 - RNA, 21 nt, Human
uccccuugggggugguggaug

SEQ ID NO: 2122282 - RNA, 16 nt, Human
gccgcgcugcgcgccg

SEQ ID NO: 2122283 - RNA, 13 nt, Human
auaauuuuagaca

SEQ ID NO: 2122284 - RNA, 16 nt, Human
uuauauuuccaagaaa

SEQ ID NO: 2122285 - RNA, 16 nt, Human
guuccuuccucugagc

SEQ ID NO: 2122286 - RNA, 20 nt, Human
auuuccuuauucagaauuuc

SEQ ID NO: 2122287 - RNA, 15 nt, Human
uccaagccucauguc

SEQ ID NO: 2122288 - RNA, 22 nt, Human
ccgggaggcagagguugcagug

SEQ ID NO: 2122289 - RNA, 19 nt, Human
uuaaauggaaguaaauguu

SEQ ID NO: 2122290 - RNA, 14 nt, Human
cggagccuccagcu

SEQ ID NO: 2122291 - RNA, 17 nt, Human
cucuuuugggauuuuug

SEQ ID NO: 2122292 - RNA, 15 nt, Human
ccuguucgcgcgccu

SEQ ID NO: 2122293 - RNA, 19 nt, Human
gcuguacgcgagcgcgcgc

SEQ ID NO: 2122294 - RNA, 12 nt, Human
cagacacaugug

SEQ ID NO: 2122295 - RNA, 17 nt, Human
caagccuccuuuuaaag

SEQ ID NO: 2122296 - RNA, 15 nt, Human
uugcucauggaauug

SEQ ID NO: 2122297 - RNA, 15 nt, Human
cacuuggucugugag

SEQ ID NO: 2122298 - RNA, 19 nt, Human
uuuuaucugcuaugcuauu

SEQ ID NO: 2122299 - RNA, 22 nt, Human
auguccuuggugccuggagccu

SEQ ID NO: 2122300 - RNA, 15 nt, Human
uccuaagucccugcu

SEQ ID NO: 2122301 - RNA, 20 nt, Human
cccggccgcgcugcgcgccg

SEQ ID NO: 2122302 - RNA, 16 nt, Human
aaauccacacugagcu

SEQ ID NO: 2122303 - RNA, 22 nt, Human
cuaagcuucacuguaaaauaau

SEQ ID NO: 2122304 - RNA, 18 nt, Human
uaaguuuuuuuuuaaaaa

SEQ ID NO: 2122305 - RNA, 16 nt, Human
ucuuuuaguuuuuaaa

SEQ ID NO: 2122306 - RNA, 13 nt, Human
ucuuauaauuuaa

SEQ ID NO: 2122307 - RNA, 22 nt, Human
cuuaucuauguagaauauauuu

SEQ ID NO: 2122308 - RNA, 18 nt, Human
gaauuuccuuacucuuga

SEQ ID NO: 2122309 - RNA, 14 nt, Human
ucucuaucauuaaa

SEQ ID NO: 2122310 - RNA, 11 nt, Human
ccuucccacac

SEQ ID NO: 2122311 - RNA, 13 nt, Human
uuauguuuaauuc

SEQ ID NO: 2122312 - RNA, 17 nt, Human
uaaaagacaaggaaaaa

SEQ ID NO: 2122313 - RNA, 15 nt, Human
gagaugcuagaacuc

SEQ ID NO: 2122314 - RNA, 21 nt, Human
uucagcucagcuaaugaagug

SEQ ID NO: 2122315 - RNA, 16 nt, Human
cuucacuguaaaauaa

SEQ ID NO: 2122316 - RNA, 15 nt, Human
uauauauauauauuu

SEQ ID NO: 2122317 - RNA, 13 nt, Human
agcucugcccauc

SEQ ID NO: 2122318 - RNA, 15 nt, Human
caaauccaaugaaau

SEQ ID NO: 2122319 - RNA, 21 nt, Human
accaacacccugagguugugu

SEQ ID NO: 2122320 - RNA, 20 nt, Human
gggaggcagagguugcagug

SEQ ID NO: 2122321 - RNA, 21 nt, Human
uguaaaauggugugaccacug

SEQ ID NO: 2122322 - RNA, 13 nt, Human
cugaauuuaaaua

SEQ ID NO: 2122323 - RNA, 16 nt, Human
uuugcuguuauuuuau

SEQ ID NO: 2122324 - RNA, 20 nt, Human
uggaauaauccuaaacauau

SEQ ID NO: 2122325 - RNA, 21 nt, Human
aggacagcccuucuuuccaca

SEQ ID NO: 2122326 - RNA, 16 nt, Human
gaaauguauucuuuua

SEQ ID NO: 2122327 - RNA, 13 nt, Human
ugccagcuggccu

SEQ ID NO: 2122328 - RNA, 18 nt, Human
ccugcucgcccacuuccu

SEQ ID NO: 2122329 - RNA, 16 nt, Human
augcuguauuuuaaaa

SEQ ID NO: 2122330 - RNA, 15 nt, Human
aauauaaauaaaaau

SEQ ID NO: 2122331 - RNA, 15 nt, Human
uauaaauaaaaauaa

SEQ ID NO: 2122332 - RNA, 18 nt, Human
aaguugauaugccuuuuc

SEQ ID NO: 2122333 - RNA, 19 nt, Human
agugaggagcuuugaaacg

SEQ ID NO: 2122334 - RNA, 19 nt, Human
guccaggucuaccaaaaau

SEQ ID NO: 2122335 - RNA, 17 nt, Human
gccggagccuccagcug

SEQ ID NO: 2122336 - RNA, 15 nt, Human
ccuugccaugugcua

SEQ ID NO: 2122337 - RNA, 20 nt, Human
cuggcuaauuagcauggcca

SEQ ID NO: 2122338 - RNA, 15 nt, Human
uugaagcacagugau

SEQ ID NO: 2122339 - RNA, 18 nt, Human
accaccugccuauauuuu

SEQ ID NO: 2122340 - RNA, 14 nt, Human
gcuggcaccgcugu

SEQ ID NO: 2122341 - RNA, 16 nt, Human
cgcccacuuccucccg

SEQ ID NO: 2122342 - RNA, 17 nt, Human
uccacaacacacagauu

SEQ ID NO: 2122343 - RNA, 17 nt, Human
cacuuuccaauaaagag

SEQ ID NO: 2122344 - RNA, 23 nt, Human
gggaaagaagagccggagccucc

SEQ ID NO: 2122345 - RNA, 13 nt, Human
uaaauauauauuu

SEQ ID NO: 2122346 - RNA, 19 nt, Human
cuagaguuuagcuggaaaa

SEQ ID NO: 2122347 - RNA, 19 nt, Human
uguuaucuucacuuuuaua

SEQ ID NO: 2122348 - RNA, 19 nt, Human
aauuuuguuauguauauuu

SEQ ID NO: 2122349 - RNA, 16 nt, Human
cuaguuuauauagaaa

SEQ ID NO: 2122350 - RNA, 12 nt, Human
uaagaaggcacc

SEQ ID NO: 2122351 - RNA, 17 nt, Human
aauaaaguguuugaaag

SEQ ID NO: 2122352 - RNA, 18 nt, Human
ugaggcaggcacugccaa

SEQ ID NO: 2122353 - RNA, 23 nt, Human
ugcauagguuuaauaauuuuuaa

SEQ ID NO: 2122354 - RNA, 22 nt, Human
aucaucaagucuuucacauuua

SEQ ID NO: 2122355 - RNA, 22 nt, Human
auauuuacaaaugggaaacaaa

SEQ ID NO: 2122356 - RNA, 14 nt, Human
aauauuauuuuaua

SEQ ID NO: 2122357 - RNA, 18 nt, Human
uguccauucuuccuccca

SEQ ID NO: 2122358 - RNA, 20 nt, Human
cugagguuguguguggaagg

SEQ ID NO: 2122359 - RNA, 17 nt, Human
uaaauuuaucauuuagu

SEQ ID NO: 2122360 - RNA, 13 nt, Human
acaauaaaagaca

SEQ ID NO: 2122361 - RNA, 21 nt, Human
cuaguaucaaaagaaagaaaa

SEQ ID NO: 2122362 - RNA, 12 nt, Human
cggcccugugcg

SEQ ID NO: 2122363 - RNA, 13 nt, Human
uagcauggccaca

SEQ ID NO: 2122364 - RNA, 19 nt, Human
uuggcaagcucuaucacca

SEQ ID NO: 2122365 - RNA, 23 nt, Human
aggaccggccuuugcaccuccau

SEQ ID NO: 2122366 - RNA, 22 nt, Human
ggacagcccuucuuuccacaga

SEQ ID NO: 2122367 - RNA, 17 nt, Human
aaaguacaagagcuuaa

SEQ ID NO: 2122368 - RNA, 14 nt, Human
cuugagguaaaagc

SEQ ID NO: 2122369 - RNA, 20 nt, Human
caccgcagggugaacugcag

SEQ ID NO: 2122370 - RNA, 17 nt, Human
ccccaguuguuucuacu

SEQ ID NO: 2122371 - RNA, 14 nt, Human
agugucuugaauug

SEQ ID NO: 2122372 - RNA, 19 nt, Human
ccauccugccccugagccc

SEQ ID NO: 2122373 - RNA, 19 nt, Human
uccauccugaggcuccacu

SEQ ID NO: 2122374 - RNA, 15 nt, Human
uuagugaaauauuau

SEQ ID NO: 2122375 - RNA, 16 nt, Human
gaaagaagagccggag

SEQ ID NO: 2122376 - RNA, 12 nt, Human
aaaaaaacguau

SEQ ID NO: 2122377 - RNA, 17 nt, Human
aaagaaacauuugguaa

SEQ ID NO: 2122378 - RNA, 20 nt, Human
gggagccccaauucgauccc

SEQ ID NO: 2122379 - RNA, 23 nt, Human
caccucauggaauuggagcucgu

SEQ ID NO: 2122380 - RNA, 17 nt, Human
ggcucuggacaggcacu

SEQ ID NO: 2122381 - RNA, 19 nt, Human
cugcgcgccgcgcuccucg

SEQ ID NO: 2122382 - RNA, 15 nt, Human
aggcaccucucuggg

SEQ ID NO: 2122383 - RNA, 22 nt, Human
cagaucuaugccacaagaaccc

SEQ ID NO: 2122384 - RNA, 21 nt, Human
agaauucuguugauggaaaua

SEQ ID NO: 2122385 - RNA, 16 nt, Human
ccuacaugagguacug

SEQ ID NO: 2122386 - RNA, 15 nt, Human
ccugccccccagccc

SEQ ID NO: 2122387 - RNA, 16 nt, Human
gaaucacuugaacccg

SEQ ID NO: 2122388 - RNA, 11 nt, Human
uucacagggga

SEQ ID NO: 2122389 - RNA, 18 nt, Human
ugagccaccaagcuggug

SEQ ID NO: 2122390 - RNA, 17 nt, Human
gccuaagugcagccccg

SEQ ID NO: 2122391 - RNA, 17 nt, Human
agucugacuguuuccau

SEQ ID NO: 2122392 - RNA, 23 nt, Human
gcuggcgugcagcaucagcaucc

SEQ ID NO: 2122393 - RNA, 14 nt, Human
auggaaguaaaugu

SEQ ID NO: 2122394 - RNA, 16 nt, Human
uucccaacuccagaaa

SEQ ID NO: 2122395 - RNA, 12 nt, Human
aggggcgcucgc

SEQ ID NO: 2122396 - RNA, 21 nt, Human
uacaugagguacugagaguga

SEQ ID NO: 2122397 - RNA, 16 nt, Human
aaauauuauguuaaaa

SEQ ID NO: 2122398 - RNA, 12 nt, Human
uuuuuuuuaaaa

SEQ ID NO: 2122399 - RNA, 12 nt, Human
gaaaauaacaau

SEQ ID NO: 2122400 - RNA, 14 nt, Human
aaaagacagugaaa

SEQ ID NO: 2122401 - RNA, 17 nt, Human
cugguggcgcuggcugc

SEQ ID NO: 2122402 - RNA, 23 nt, Human
aaagcccagcuugaaaccuucac

SEQ ID NO: 2122403 - RNA, 20 nt, Human
cucgcccacuuccucccggc

SEQ ID NO: 2122404 - RNA, 14 nt, Human
ucaacucauauuuu

SEQ ID NO: 2122405 - RNA, 23 nt, Human
caauaacgauaaaagacagugaa

SEQ ID NO: 2122406 - RNA, 17 nt, Human
gcucggccugcucgccc

SEQ ID NO: 2122407 - RNA, 19 nt, Human
ugaucaccugcccugcuga

SEQ ID NO: 2122408 - RNA, 14 nt, Human
gauaugugaacagu

SEQ ID NO: 2122409 - RNA, 14 nt, Human
agaauuugauaugu

SEQ ID NO: 2122410 - RNA, 23 nt, Human
acuuuccaauaaagaguuccuuc

SEQ ID NO: 2122411 - RNA, 15 nt, Human
aauaacgauaaaaga

SEQ ID NO: 2122412 - RNA, 16 nt, Human
ucuucucagaaggaaa

SEQ ID NO: 2122413 - RNA, 17 nt, Human
uccgucaacucauauuu

SEQ ID NO: 2122414 - RNA, 12 nt, Human
cuuuaucuuuuu

SEQ ID NO: 2122415 - RNA, 17 nt, Human
auuuaguuauaaaaaua

SEQ ID NO: 2122416 - RNA, 22 nt, Human
auaacaaugcuguauuuuaaaa

SEQ ID NO: 2122417 - RNA, 16 nt, Human
aucaaguuauuuuuaa

SEQ ID NO: 2122418 - RNA, 15 nt, Human
guguugcagugucug

SEQ ID NO: 2122419 - RNA, 19 nt, Human
accuccuaagaaggcaccu

SEQ ID NO: 2122420 - RNA, 11 nt, Human
agaauauauuu

SEQ ID NO: 2122421 - RNA, 14 nt, Human
acacugaagaagca

SEQ ID NO: 2122422 - RNA, 13 nt, Human
uccucccggccgc

SEQ ID NO: 2122423 - RNA, 23 nt, Human
ggacggcuccggacgcugcugcc

SEQ ID NO: 2122424 - RNA, 21 nt, Human
gagcaucuccucaacucugag

SEQ ID NO: 2122425 - RNA, 16 nt, Human
uucugaaauuuccugg

SEQ ID NO: 2122426 - RNA, 21 nt, Human
cucaguccaugaagauguaga

SEQ ID NO: 2122427 - RNA, 18 nt, Human
augagcacgcauggaaaa

SEQ ID NO: 2122428 - RNA, 16 nt, Human
auuccuuaagauauua

SEQ ID NO: 2122429 - RNA, 21 nt, Human
aaugaauggcuaagcaaaaug

SEQ ID NO: 2122430 - RNA, 13 nt, Human
agagguccacaac

SEQ ID NO: 2122431 - RNA, 16 nt, Human
ucuaaaaguuuaaguu

SEQ ID NO: 2122432 - RNA, 21 nt, Human
uagggugauauuaaccagggg

SEQ ID NO: 2122433 - RNA, 14 nt, Human
aucucuucucagaa

SEQ ID NO: 2122434 - RNA, 16 nt, Human
ccuccuuuuaaaguaa

SEQ ID NO: 2122435 - RNA, 15 nt, Human
acuuuuauaagaaau

SEQ ID NO: 2122436 - RNA, 15 nt, Human
cugaaagaggaauga

SEQ ID NO: 2122437 - RNA, 17 nt, Human
uagaagucacauuccug

SEQ ID NO: 2122438 - RNA, 20 nt, Human
uuuagacauucuuuaucuuu

SEQ ID NO: 2122439 - RNA, 15 nt, Human
uuauagcuacuaauu

SEQ ID NO: 2122440 - RNA, 22 nt, Human
uuugcuguuauuuuaucugcua

SEQ ID NO: 2122441 - RNA, 15 nt, Human
ggagccuccagcugc

SEQ ID NO: 2122442 - RNA, 12 nt, Human
ggaggcugagau

SEQ ID NO: 2122443 - RNA, 20 nt, Human
gaaacaagucagucauucag

SEQ ID NO: 2122444 - RNA, 22 nt, Human
agacccacuggacucaccuccc

SEQ ID NO: 2122445 - RNA, 13 nt, Human
ccucccccaucuc

SEQ ID NO: 2122446 - RNA, 15 nt, Human
gggaaagaagagccg

SEQ ID NO: 2122447 - RNA, 22 nt, Human
cugccaaaacaucaaccugcca

SEQ ID NO: 2122448 - RNA, 12 nt, Human
gguuuauauaag

SEQ ID NO: 2122449 - RNA, 14 nt, Human
uuaaacuuugauuu

SEQ ID NO: 2122450 - RNA, 15 nt, Human
aguaaauguuguuuu

SEQ ID NO: 2122451 - RNA, 19 nt, Human
cccacuggacucaccuccc

SEQ ID NO: 2122452 - RNA, 15 nt, Human
auuguagcauccugg

SEQ ID NO: 2122453 - RNA, 22 nt, Human
ucuuccuggauuccucacuuug

SEQ ID NO: 2122454 - RNA, 22 nt, Human
aaaucaggguuaguauugucca

SEQ ID NO: 2122455 - RNA, 15 nt, Human
ucuugaggcacagaa

SEQ ID NO: 2122456 - RNA, 11 nt, Human
cuguuuuauaa

SEQ ID NO: 2122457 - RNA, 22 nt, Human
uuuuauagcuacuaauuuuaaa

SEQ ID NO: 2122458 - RNA, 14 nt, Human
auuuccaagaaaua

SEQ ID NO: 2122459 - RNA, 22 nt, Human
accccugagcuugcagagauga

SEQ ID NO: 2122460 - RNA, 23 nt, Human
augaaacuuuuggaagguauuua

SEQ ID NO: 2122461 - RNA, 20 nt, Human
aaagacagugaaagaaaaua

SEQ ID NO: 2122462 - RNA, 17 nt, Human
uguaaaggaauuuaaaa

SEQ ID NO: 2122463 - RNA, 17 nt, Human
cccaucucagguguguu

SEQ ID NO: 2122464 - RNA, 16 nt, Human
gccaaggaagaucccu

SEQ ID NO: 2122465 - RNA, 12 nt, Human
cuacaagacaca

SEQ ID NO: 2122466 - RNA, 21 nt, Human
uugaggcacagaaacuccugu

SEQ ID NO: 2122467 - RNA, 22 nt, Human
uagaaauguauucuuuuaguuu

SEQ ID NO: 2122468 - RNA, 15 nt, Human
cuggacucaccuccc

SEQ ID NO: 2122469 - RNA, 20 nt, Human
caccuccuaagaaggcaccu

SEQ ID NO: 2122470 - RNA, 13 nt, Human
uguauauuuuaua

SEQ ID NO: 2122471 - RNA, 16 nt, Human
aguuuauauagaaaug

SEQ ID NO: 2122472 - RNA, 15 nt, Human
auuuuacauggcugg

SEQ ID NO: 2122473 - RNA, 22 nt, Human
cccacuuccucccggccgcgcu

SEQ ID NO: 2122474 - RNA, 16 nt, Human
cuuauaauuuaaaaua

SEQ ID NO: 2122475 - RNA, 18 nt, Human
uauuuucaguuauuauau

SEQ ID NO: 2122476 - RNA, 20 nt, Human
gaugcccacggcuggagcug

SEQ ID NO: 2122477 - RNA, 19 nt, Human
uaucucauuuccaagcaag

SEQ ID NO: 2122478 - RNA, 15 nt, Human
uuuaauaauuuuuaa

SEQ ID NO: 2122479 - RNA, 15 nt, Human
gaagauguagaggag

SEQ ID NO: 2122480 - RNA, 16 nt, Human
guugauggaaauacac

SEQ ID NO: 2122481 - RNA, 23 nt, Human
ucaauaucuuuuuuuuaauaaac

SEQ ID NO: 2122482 - RNA, 17 nt, Human
aaggugaucuggcucug

SEQ ID NO: 2122483 - RNA, 18 nt, Human
cucuauguucuaagaagu

SEQ ID NO: 2122484 - RNA, 15 nt, Human
ucuggcuccagcugg

SEQ ID NO: 2122485 - RNA, 13 nt, Human
aggcauagcccug

SEQ ID NO: 2122486 - RNA, 16 nt, Human
aaaauccauacauuug

SEQ ID NO: 2122487 - RNA, 17 nt, Human
cuacacuccagugagac

SEQ ID NO: 2122488 - RNA, 21 nt, Human
ccugaucaccugcccugcuga

SEQ ID NO: 2122489 - RNA, 18 nt, Human
uguacuuuauuuucuaua

SEQ ID NO: 2122490 - RNA, 21 nt, Human
ggaaagaauaaccaacacccu

SEQ ID NO: 2122491 - RNA, 20 nt, Human
acuccagugagacagcucug

SEQ ID NO: 2122492 - RNA, 14 nt, Human
gaggcacagaaacu

SEQ ID NO: 2122493 - RNA, 21 nt, Human
aacuuguaaaggaauuuaaaa

SEQ ID NO: 2122494 - RNA, 22 nt, Human
cuuccuaauuccacagcugcuc

SEQ ID NO: 2122495 - RNA, 21 nt, Human
aauucauucacucaacaaaca

SEQ ID NO: 2122496 - RNA, 18 nt, Human
uuauuauagucacuaguu

SEQ ID NO: 2122497 - RNA, 17 nt, Human
aaacauccuacaagaca

SEQ ID NO: 2122498 - RNA, 18 nt, Human
cuuuccaugaguugcagu

SEQ ID NO: 2122499 - RNA, 14 nt, Human
cugcugguggcgcu

SEQ ID NO: 2122500 - RNA, 17 nt, Human
caaccuucugaggagcu

SEQ ID NO: 2122501 - RNA, 21 nt, Human
ccucccuuggggccuaugcag

SEQ ID NO: 2122502 - RNA, 16 nt, Human
uuagagaauuuccuua

SEQ ID NO: 2122503 - RNA, 16 nt, Human
cugcacuccagccuga

SEQ ID NO: 2122504 - RNA, 19 nt, Human
guauucuuuuaguuuuuaa

SEQ ID NO: 2122505 - RNA, 22 nt, Human
agaagcaccaaucaugaauuag

SEQ ID NO: 2122506 - RNA, 15 nt, Human
aaauauuuauuuuaa

SEQ ID NO: 2122507 - RNA, 22 nt, Human
aaacauguuuaucguauuugau

SEQ ID NO: 2122508 - RNA, 20 nt, Human
auauauuuuuuuuuuuaaaa

SEQ ID NO: 2122509 - RNA, 15 nt, Human
gcaacccaaauguuc

SEQ ID NO: 2122510 - RNA, 22 nt, Human
auucugagguaaccucauuauc

SEQ ID NO: 2122511 - RNA, 12 nt, Human
ucuuucaugaag

SEQ ID NO: 2122512 - RNA, 17 nt, Human
ucucacuuguuuuauuu

SEQ ID NO: 2122513 - RNA, 18 nt, Human
aaauauuuauuuuaauaa

SEQ ID NO: 2122514 - RNA, 21 nt, Human
aauuaaguuuuuuuuuaaaaa

SEQ ID NO: 2122515 - RNA, 13 nt, Human
aucucaauauuuc

SEQ ID NO: 2122516 - RNA, 19 nt, Human
gcuguuccucgccacgcuc

SEQ ID NO: 2122517 - RNA, 14 nt, Human
ugagcucaccaguc

SEQ ID NO: 2122518 - RNA, 23 nt, Human
uccaaacugacucuuaagaagac

SEQ ID NO: 2122519 - RNA, 22 nt, Human
auuuucuucucacauuuauauu

SEQ ID NO: 2122520 - RNA, 19 nt, Human
acuauuauauuuccaagaa

SEQ ID NO: 2122521 - RNA, 19 nt, Human
uacucuuauaucuauauuu

SEQ ID NO: 2122522 - RNA, 14 nt, Human
ucaaugcagccccc

SEQ ID NO: 2122523 - RNA, 12 nt, Human
gaaggggcggcg

SEQ ID NO: 2122524 - RNA, 14 nt, Human
uuauaucuauauuu

SEQ ID NO: 2122525 - RNA, 11 nt, Human
auaauuuaaau

SEQ ID NO: 2122526 - RNA, 22 nt, Human
aaugauguuucauaagaauucu

SEQ ID NO: 2122527 - RNA, 16 nt, Human
uacaaaugggaaacaa

SEQ ID NO: 2122528 - RNA, 14 nt, Human
agacaucaacagau

SEQ ID NO: 2122529 - RNA, 20 nt, Human
aguuuuuuuuuaaaaaagaa

SEQ ID NO: 2122530 - RNA, 12 nt, Human
cuggcuccagcu

SEQ ID NO: 2122531 - RNA, 15 nt, Human
ucuuauaauuuaaaa

SEQ ID NO: 2122532 - RNA, 16 nt, Human
uuguaaaggaauuuaa

SEQ ID NO: 2122533 - RNA, 14 nt, Human
gaaggugaucuggc

SEQ ID NO: 2122534 - RNA, 17 nt, Human
gccgggaaagaagagcc

SEQ ID NO: 2122535 - RNA, 14 nt, Human
cccugaggugagca

SEQ ID NO: 2122536 - RNA, 16 nt, Human
ccuaugcagaggucca

SEQ ID NO: 2122537 - RNA, 20 nt, Human
cuugccauaauuacuauguc

SEQ ID NO: 2122538 - RNA, 17 nt, Human
uacaaaugcauuucuaa

SEQ ID NO: 2122539 - RNA, 18 nt, Human
gagccgguccuugcugca

SEQ ID NO: 2122540 - RNA, 18 nt, Human
cagagacagaaagcagaa

SEQ ID NO: 2122541 - RNA, 20 nt, Human
cuggccuucggccuccaucc

SEQ ID NO: 2122542 - RNA, 21 nt, Human
aaacaauaacgauaaaagaca

SEQ ID NO: 2122543 - RNA, 18 nt, Human
ccuugggaccccugagcu

SEQ ID NO: 2122544 - RNA, 19 nt, Human
cgccacgcucugggucgcc

SEQ ID NO: 2122545 - RNA, 16 nt, Human
aggguguguaaguaga

SEQ ID NO: 2122546 - RNA, 15 nt, Human
cccugcugcccuucc

SEQ ID NO: 2122547 - RNA, 22 nt, Human
ggacaguaaaauccacagacca

SEQ ID NO: 2122548 - RNA, 19 nt, Human
uggaaauguuuacagaucc

SEQ ID NO: 2122549 - RNA, 19 nt, Human
uagugagcagucaggaaag

SEQ ID NO: 2122550 - RNA, 14 nt, Human
cggccggcgcgcuc

SEQ ID NO: 2122551 - RNA, 23 nt, Human
auaaaguaugugcauauuuuauu

SEQ ID NO: 2122552 - RNA, 15 nt, Human
uauuuauuuuaauaa

SEQ ID NO: 2122553 - RNA, 20 nt, Human
uuucauaagaauucuguuga

SEQ ID NO: 2122554 - RNA, 18 nt, Human
acugccuucucaacucca

SEQ ID NO: 2122555 - RNA, 22 nt, Human
aagcugguggcucugugugcuc

SEQ ID NO: 2122556 - RNA, 15 nt, Human
uagauaggccauggg

SEQ ID NO: 2122557 - RNA, 13 nt, Human
cgaguacuucccg

SEQ ID NO: 2122558 - RNA, 19 nt, Human
cuggacucaccucccccau

SEQ ID NO: 2122559 - RNA, 14 nt, Human
uccagauccuggaa

SEQ ID NO: 2122560 - RNA, 22 nt, Human
caugaguaacugauuuguaaca

SEQ ID NO: 2122561 - RNA, 20 nt, Human
ucugaaaguuuuggaaacgu

SEQ ID NO: 2122562 - RNA, 14 nt, Human
agcucguggaacag

SEQ ID NO: 2122563 - RNA, 12 nt, Human
ugacauuagaug

SEQ ID NO: 2122564 - RNA, 20 nt, Human
agaauucuguugauggaaau

SEQ ID NO: 2122565 - RNA, 15 nt, Human
cagccagcacagccu

SEQ ID NO: 2122566 - RNA, 14 nt, Human
auuauauauauuuu

SEQ ID NO: 2122567 - RNA, 15 nt, Human
gccuaauuuguuuuc

SEQ ID NO: 2122568 - RNA, 12 nt, Human
aggaaauauuuu

SEQ ID NO: 2122569 - RNA, 22 nt, Human
aaccuacacgagauacagaauu

SEQ ID NO: 2122570 - RNA, 20 nt, Human
ccaucugguccuaagucccu

SEQ ID NO: 2122571 - RNA, 14 nt, Human
aauauuauguuaaa

SEQ ID NO: 2122572 - RNA, 14 nt, Human
ccucuccucucuuc

SEQ ID NO: 2122573 - RNA, 17 nt, Human
ccugagcuugcagagau

SEQ ID NO: 2122574 - RNA, 22 nt, Human
guguccccuauccuacuucccc

SEQ ID NO: 2122575 - RNA, 14 nt, Human
ggcuccagcuggcc

SEQ ID NO: 2122576 - RNA, 17 nt, Human
acaaaugggaaacaaaa

SEQ ID NO: 2122577 - RNA, 22 nt, Human
gacucaccucccccaucucuuc

SEQ ID NO: 2122578 - RNA, 16 nt, Human
aagcuacuuauuguag

SEQ ID NO: 2122579 - RNA, 19 nt, Human
caacucccugccccccagc

SEQ ID NO: 2122580 - RNA, 16 nt, Human
gcgcagcucaggcugg

SEQ ID NO: 2122581 - RNA, 16 nt, Human
ucuucaacucccugcc

SEQ ID NO: 2122582 - RNA, 13 nt, Human
aaguaaaggcaaa

SEQ ID NO: 2122583 - RNA, 17 nt, Human
augaauaucaguuauuu

SEQ ID NO: 2122584 - RNA, 18 nt, Human
cccucuggcuccagcugg

SEQ ID NO: 2122585 - RNA, 17 nt, Human
cgcgagcgcgcgcgccc

SEQ ID NO: 2122586 - RNA, 16 nt, Human
cggagccuccagcugc

SEQ ID NO: 2122587 - RNA, 17 nt, Human
gaaaaucaggcuggcca

SEQ ID NO: 2122588 - RNA, 14 nt, Human
aaaagaaagaaaau

SEQ ID NO: 2122589 - RNA, 19 nt, Human
uuuccaagaaauauuccuu

SEQ ID NO: 2122590 - RNA, 12 nt, Human
aagagcuuaaca

SEQ ID NO: 2122591 - RNA, 14 nt, Human
ugagacucugucuc

SEQ ID NO: 2122592 - RNA, 23 nt, Human
aguacucauacauguuacaacac

SEQ ID NO: 2122593 - RNA, 23 nt, Human
cccggccggcgcgcucaucccac

SEQ ID NO: 2122594 - RNA, 17 nt, Human
uggacaaaauggaauac

SEQ ID NO: 2122595 - RNA, 16 nt, Human
ucuuggggaauauguu

SEQ ID NO: 2122596 - RNA, 22 nt, Human
aguauguuagugcaaauuguca

SEQ ID NO: 2122597 - RNA, 20 nt, Human
guugagccaccaagcuggug

SEQ ID NO: 2122598 - RNA, 11 nt, Human
auacucuuaua

SEQ ID NO: 2122599 - RNA, 19 nt, Human
cccugccucaagcuaugug

SEQ ID NO: 2122600 - RNA, 18 nt, Human
uuuaguuauaaaaauaua

SEQ ID NO: 2122601 - RNA, 21 nt, Human
caagacccaaaaggcagaagc

SEQ ID NO: 2122602 - RNA, 22 nt, Human
acuuauuguagcauccuggaau

SEQ ID NO: 2122603 - RNA, 19 nt, Human
ucaccaaggcugauuaaac

SEQ ID NO: 2122604 - RNA, 19 nt, Human
uauauuuuuuguuaaauga

SEQ ID NO: 2122605 - RNA, 15 nt, Human
uacaaaugcauuucu

SEQ ID NO: 2122606 - RNA, 20 nt, Human
uguuggugaacuugguuuua

SEQ ID NO: 2122607 - RNA, 20 nt, Human
uaauucugguagcuaaauau

SEQ ID NO: 2122608 - RNA, 20 nt, Human
aagacagugaaagaaaauaa

SEQ ID NO: 2122609 - RNA, 16 nt, Human
cugagcauuuaauaug

SEQ ID NO: 2122610 - RNA, 21 nt, Human
ucccugcugcccuuccccuuc

SEQ ID NO: 2122611 - RNA, 16 nt, Human
agguugcagugagccg

SEQ ID NO: 2122612 - RNA, 16 nt, Human
ccaccugcugagcccc

SEQ ID NO: 2122613 - RNA, 20 nt, Human
auacucuuauaucuauauuu

SEQ ID NO: 2122614 - RNA, 18 nt, Human
ggcucuggacaggcacua

SEQ ID NO: 2122615 - RNA, 20 nt, Human
uacaucccuuaccugggaaa

SEQ ID NO: 2122616 - RNA, 16 nt, Human
aaaauaacaauaaaag

SEQ ID NO: 2122617 - RNA, 11 nt, Human
gagguaaaagc

SEQ ID NO: 2122618 - RNA, 19 nt, Human
uguggauuuaauguggaaa

SEQ ID NO: 2122619 - RNA, 20 nt, Human
ucgcaggaccaucccggccg

SEQ ID NO: 2122620 - RNA, 21 nt, Human
aauaauguuucaaacauauau

SEQ ID NO: 2122621 - RNA, 13 nt, Human
cgagccccaggcg

SEQ ID NO: 2122622 - RNA, 14 nt, Human
gcugauuaaaccaa

SEQ ID NO: 2122623 - RNA, 20 nt, Human
aggcugagaugggagaauca

SEQ ID NO: 2122624 - RNA, 17 nt, Human
uaaccucuaaauucuuu

SEQ ID NO: 2122625 - RNA, 16 nt, Human
gagcucgugggacagu

SEQ ID NO: 2122626 - RNA, 22 nt, Human
agacucgggauuaguacacacu

SEQ ID NO: 2122627 - RNA, 14 nt, Human
agucugacuguuuc

SEQ ID NO: 2122628 - RNA, 16 nt, Human
ccccaucucuucuggg

SEQ ID NO: 2122629 - RNA, 19 nt, Human
uuucaugcuguucaugaaa

SEQ ID NO: 2122630 - RNA, 20 nt, Human
ggccaugggacagggaggac

SEQ ID NO: 2122631 - RNA, 13 nt, Human
aguaugaaaaugu

SEQ ID NO: 2122632 - RNA, 21 nt, Human
agacaagaaggaaagauuuug

SEQ ID NO: 2122633 - RNA, 19 nt, Human
cucuguucugcacacagca

SEQ ID NO: 2122634 - RNA, 20 nt, Human
ggcuccggacgcugcugccg

SEQ ID NO: 2122635 - RNA, 23 nt, Human
cuggccgggagccugaucaccug

SEQ ID NO: 2122636 - RNA, 14 nt, Human
auugucuagugaaa

SEQ ID NO: 2122637 - RNA, 15 nt, Human
ccuggugggcagaga

SEQ ID NO: 2122638 - RNA, 16 nt, Human
auccaaugaaaugagu

SEQ ID NO: 2122639 - RNA, 16 nt, Human
ccugagcuugcagaga

SEQ ID NO: 2122640 - RNA, 16 nt, Human
aaaauaauccucaguu

SEQ ID NO: 2122641 - RNA, 16 nt, Human
cgcuguuccucgccac

SEQ ID NO: 2122642 - RNA, 22 nt, Human
acauccuacaagacacagugac

SEQ ID NO: 2122643 - RNA, 22 nt, Human
cuaagucccugcugcccuuccc

SEQ ID NO: 2122644 - RNA, 22 nt, Human
aauaugccccauucaacaucua

SEQ ID NO: 2122645 - RNA, 18 nt, Human
gcagcccuuagcccuucc

SEQ ID NO: 2122646 - RNA, 20 nt, Human
cuaaaugucaaucagccuag

SEQ ID NO: 2122647 - RNA, 23 nt, Human
uguggaaggugaucuggcucugg

SEQ ID NO: 2122648 - RNA, 15 nt, Human
auaauuuugugaagc

SEQ ID NO: 2122649 - RNA, 11 nt, Human
acugggacagg

SEQ ID NO: 2122650 - RNA, 17 nt, Human
ccugccccccagcccuc

SEQ ID NO: 2122651 - RNA, 19 nt, Human
ugccucaagcuaugugagc

SEQ ID NO: 2122652 - RNA, 18 nt, Human
uucaaugccccugaauuu

SEQ ID NO: 2122653 - RNA, 13 nt, Human
caucugagccccg

SEQ ID NO: 2122654 - RNA, 21 nt, Human
uugaagcacagugaucaaguu

SEQ ID NO: 2122655 - RNA, 23 nt, Human
ggaacaguuaccucugccucaga

SEQ ID NO: 2122656 - RNA, 17 nt, Human
agcuacaggccccaucu

SEQ ID NO: 2122657 - RNA, 14 nt, Human
agggcuaauaucuu

SEQ ID NO: 2122658 - RNA, 15 nt, Human
uucacauuuaaauaa

SEQ ID NO: 2122659 - RNA, 15 nt, Human
ccagcacagccucuu

SEQ ID NO: 2122660 - RNA, 21 nt, Human
accagagccugaguguugccu

SEQ ID NO: 2122661 - RNA, 18 nt, Human
gagcgacagugagacucu

SEQ ID NO: 2122662 - RNA, 13 nt, Human
ccugagcuugcag

SEQ ID NO: 2122663 - RNA, 14 nt, Human
agcguugagccacc

SEQ ID NO: 2122664 - RNA, 14 nt, Human
agcuggaaacacau

SEQ ID NO: 2122665 - RNA, 23 nt, Human
ucuccauguacuggcaagaccug

SEQ ID NO: 2122666 - RNA, 23 nt, Human
cagagucaagggugugugcagca

SEQ ID NO: 2122667 - RNA, 21 nt, Human
auuccuuuuucucuccucucc

SEQ ID NO: 2122668 - RNA, 16 nt, Human
agccuacuaaaugcuc

SEQ ID NO: 2122669 - RNA, 15 nt, Human
uaaaaggaaaugcuc

SEQ ID NO: 2122670 - RNA, 15 nt, Human
aaaaauaacaaugaa

SEQ ID NO: 2122671 - RNA, 23 nt, Human
uacuuccagggcuacgcgcgcuc

SEQ ID NO: 2122672 - RNA, 21 nt, Human
gccuuuucccaacuccagaaa

SEQ ID NO: 2122673 - RNA, 19 nt, Human
auuucuucaacucccugcc

SEQ ID NO: 2122674 - RNA, 14 nt, Human
ucagucucccuccc

SEQ ID NO: 2122675 - RNA, 21 nt, Human
cuugaggcacagaaacuccug

SEQ ID NO: 2122676 - RNA, 18 nt, Human
ggcgcuggcugcgcucgg

SEQ ID NO: 2122677 - RNA, 15 nt, Human
uaaaagacaaggaaa

SEQ ID NO: 2122678 - RNA, 16 nt, Human
gagaaacuggaacucu

SEQ ID NO: 2122679 - RNA, 14 nt, Human
gacggagccgggaa

SEQ ID NO: 2122680 - RNA, 19 nt, Human
uauuuuaauaauguuucaa

SEQ ID NO: 2122681 - RNA, 22 nt, Human
gauaaaagacagugaaagaaaa

SEQ ID NO: 2122682 - RNA, 18 nt, Human
aaauggaaguaaauguug

SEQ ID NO: 2122683 - RNA, 21 nt, Human
gagccggagccuccagcugcc

SEQ ID NO: 2122684 - RNA, 13 nt, Human
auuuucaugcugu

SEQ ID NO: 2122685 - RNA, 15 nt, Human
cuaagcaaaauguga

SEQ ID NO: 2122686 - RNA, 23 nt, Human
acucuauguucuaagaagugaaa

SEQ ID NO: 2122687 - RNA, 15 nt, Human
ggacucaccuccccc

SEQ ID NO: 2122688 - RNA, 17 nt, Human
acuuccagauccuggaa

SEQ ID NO: 2122689 - RNA, 21 nt, Human
ggcgcuggcugcgcucggccu

SEQ ID NO: 2122690 - RNA, 21 nt, Human
uccauccugaggcuccacuug

SEQ ID NO: 2122691 - RNA, 22 nt, Human
uugccuaggcauagcccugccu

SEQ ID NO: 2122692 - RNA, 23 nt, Human
gaaugagagacacacugaagaag

SEQ ID NO: 2122693 - RNA, 16 nt, Human
cccuauccuacuuccc

SEQ ID NO: 2122694 - RNA, 15 nt, Human
auguuagagaauuuc

SEQ ID NO: 2122695 - RNA, 16 nt, Human
aaaaauuccaagugau

SEQ ID NO: 2122696 - RNA, 19 nt, Human
aagcauuccaacuaucuca

SEQ ID NO: 2122697 - RNA, 23 nt, Human
cgagccccaggcggguccggguc

SEQ ID NO: 2122698 - RNA, 19 nt, Human
aucuauguagaauauauuu

SEQ ID NO: 2122699 - RNA, 14 nt, Human
ggcauucaaaugua

SEQ ID NO: 2122700 - RNA, 22 nt, Human
agcgcgcgcgcccucuggcugc

SEQ ID NO: 2122701 - RNA, 14 nt, Human
cuggccgggagccu

SEQ ID NO: 2122702 - RNA, 13 nt, Human
ccaaggaugcccc

SEQ ID NO: 2122703 - RNA, 14 nt, Human
cucaccccuugcca

SEQ ID NO: 2122704 - RNA, 16 nt, Human
auuccaccuacaugag

SEQ ID NO: 2122705 - RNA, 19 nt, Human
ucagguguguugcaguguc

SEQ ID NO: 2122706 - RNA, 16 nt, Human
cuuuaugcuaagugaa

SEQ ID NO: 2122707 - RNA, 15 nt, Human
ccgucccccucuggc

SEQ ID NO: 2122708 - RNA, 14 nt, Human
caucucaggugugu

SEQ ID NO: 2122709 - RNA, 12 nt, Human
cucuaucauuaa

SEQ ID NO: 2122710 - RNA, 14 nt, Human
ccaugggacaggga

SEQ ID NO: 2122711 - RNA, 13 nt, Human
aggcuagauguau

SEQ ID NO: 2122712 - RNA, 20 nt, Human
ccuccugccuaagugcagcc

SEQ ID NO: 2122713 - RNA, 15 nt, Human
auuucauucaauauc

SEQ ID NO: 2122714 - RNA, 14 nt, Human
ugcaccuccaugga

SEQ ID NO: 2122715 - RNA, 16 nt, Human
uccugcaauuccacuu

SEQ ID NO: 2122716 - RNA, 20 nt, Human
ucacaugaacuuguaaagga

SEQ ID NO: 2122717 - RNA, 21 nt, Human
cccacuggacucaccuccccc

SEQ ID NO: 2122718 - RNA, 21 nt, Human
uggggaauauguuagagaauu

SEQ ID NO: 2122719 - RNA, 18 nt, Human
uuuaauuugguuuucaca

SEQ ID NO: 2122720 - RNA, 21 nt, Human
uaguauuucuaugaaauauua

SEQ ID NO: 2122721 - RNA, 18 nt, Human
caugaagauguagaggag

SEQ ID NO: 2122722 - RNA, 21 nt, Human
cuaccaaaaaucucaauauuu

SEQ ID NO: 2122723 - RNA, 18 nt, Human
agauauuaacugagaagg

SEQ ID NO: 2122724 - RNA, 17 nt, Human
agcuaaauauauauuuu

SEQ ID NO: 2122725 - RNA, 15 nt, Human
uaacgauaaaagaca

SEQ ID NO: 2122726 - RNA, 15 nt, Human
ugccccgucccccuc

SEQ ID NO: 2122727 - RNA, 13 nt, Human
gguuuuaaagcuu

SEQ ID NO: 2122728 - RNA, 18 nt, Human
gcugcugccgugggccug

SEQ ID NO: 2122729 - RNA, 22 nt, Human
cucagcccuggugggcagagag

SEQ ID NO: 2122730 - RNA, 21 nt, Human
uucccgcuguuccucgccacg

SEQ ID NO: 2122731 - RNA, 15 nt, Human
ucagucucccucccu

SEQ ID NO: 2122732 - RNA, 15 nt, Human
cccugagguugugug

SEQ ID NO: 2122733 - RNA, 18 nt, Human
ugccuaauuuguuuuccc

SEQ ID NO: 2122734 - RNA, 17 nt, Human
cucaugagggcuggaug

SEQ ID NO: 2122735 - RNA, 14 nt, Human
uauguauauuuuau

SEQ ID NO: 2122736 - RNA, 16 nt, Human
ccuccuuaucaaagga

SEQ ID NO: 2122737 - RNA, 19 nt, Human
auaucaguuauuuuuaaac

SEQ ID NO: 2122738 - RNA, 12 nt, Human
uagcauuucucc

SEQ ID NO: 2122739 - RNA, 22 nt, Human
aauaauccuaaacauaugaauu

SEQ ID NO: 2122740 - RNA, 18 nt, Human
acaaaugcauuucuaaag

SEQ ID NO: 2122741 - RNA, 23 nt, Human
ugaaaugaguuuuucuuuucauu

SEQ ID NO: 2122742 - RNA, 14 nt, Human
auuuauuaaguauu

SEQ ID NO: 2122743 - RNA, 19 nt, Human
guacaagagcuuaacagug

SEQ ID NO: 2122744 - RNA, 23 nt, Human
aggagcuguugagguaccuccaa

SEQ ID NO: 2122745 - RNA, 19 nt, Human
acagucaccucauggaauu

SEQ ID NO: 2122746 - RNA, 14 nt, Human
accacaagacugca

SEQ ID NO: 2122747 - RNA, 17 nt, Human
cuaucucauuuccaagc

SEQ ID NO: 2122748 - RNA, 15 nt, Human
gugaacuugguuuua

SEQ ID NO: 2122749 - RNA, 17 nt, Human
uccauccugaggcucca

SEQ ID NO: 2122750 - RNA, 21 nt, Human
gcuacaggccccaucuggucc

SEQ ID NO: 2122751 - RNA, 20 nt, Human
acggacgaaccuugaaaacu

SEQ ID NO: 2122752 - RNA, 21 nt, Human
uacauaaaguaugugcauauu

SEQ ID NO: 2122753 - RNA, 22 nt, Human
uguauacugugugcuaaaacaa

SEQ ID NO: 2122754 - RNA, 13 nt, Human
aaauccuugaaga

SEQ ID NO: 2122755 - RNA, 23 nt, Human
ugauguuucauaagaauucuguu

SEQ ID NO: 2122756 - RNA, 12 nt, Human
auaacuggaaac

SEQ ID NO: 2122757 - RNA, 13 nt, Human
ugaaagaaaauaa

SEQ ID NO: 2122758 - RNA, 21 nt, Human
augucauuugcuggagcucug

SEQ ID NO: 2122759 - RNA, 20 nt, Human
aauuguaggugacuauuaua

SEQ ID NO: 2122760 - RNA, 22 nt, Human
acauggcuggagcuagaauuug

SEQ ID NO: 2122761 - RNA, 16 nt, Human
cgcuuccgcauccuag

SEQ ID NO: 2122762 - RNA, 16 nt, Human
uuuauauuugaaauau

SEQ ID NO: 2122763 - RNA, 15 nt, Human
cagcuggccuuguga

SEQ ID NO: 2122764 - RNA, 23 nt, Human
cccagcccuccuuaucaaaggac

SEQ ID NO: 2122765 - RNA, 18 nt, Human
cagauaugauucaaaugu

SEQ ID NO: 2122766 - RNA, 15 nt, Human
gcucgcuuccgcauc

SEQ ID NO: 2122767 - RNA, 20 nt, Human
guucugcagauaaacaguag

SEQ ID NO: 2122768 - RNA, 20 nt, Human
agccuuuuuuugaaaaaaag

SEQ ID NO: 2122769 - RNA, 13 nt, Human
agaauauauuucc

SEQ ID NO: 2122770 - RNA, 22 nt, Human
aucuauguagaauauauuuccu

SEQ ID NO: 2122771 - RNA, 15 nt, Human
cauuuaguuauaaaa

SEQ ID NO: 2122772 - RNA, 16 nt, Human
uaaaauccauacauuu

SEQ ID NO: 2122773 - RNA, 14 nt, Human
cgcugcgcgccgcg

SEQ ID NO: 2122774 - RNA, 15 nt, Human
aagccuggcaaggga

SEQ ID NO: 2122775 - RNA, 21 nt, Human
agcccuucuuuccacagaagc

SEQ ID NO: 2122776 - RNA, 14 nt, Human
gccgcgcuccucgg

SEQ ID NO: 2122777 - RNA, 13 nt, Human
gagacagcucugc

SEQ ID NO: 2122778 - RNA, 22 nt, Human
agaaagugacaagcucacagac

SEQ ID NO: 2122779 - RNA, 12 nt, Human
cuuaagcuuuca

SEQ ID NO: 2122780 - RNA, 14 nt, Human
aucaguuauuuuua

SEQ ID NO: 2122781 - RNA, 15 nt, Human
gcuguauuuuaaaag

SEQ ID NO: 2122782 - RNA, 19 nt, Human
ccucucuuccucccuggaa

SEQ ID NO: 2122783 - RNA, 14 nt, Human
aaccagagccugag

SEQ ID NO: 2122784 - RNA, 18 nt, Human
caguuguugcccacagcu

SEQ ID NO: 2122785 - RNA, 23 nt, Human
ggaugguucccuugaugaagaag

SEQ ID NO: 2122786 - RNA, 15 nt, Human
uccauccugaggcuc

SEQ ID NO: 2122787 - RNA, 16 nt, Human
aagacugcacaucaaa

SEQ ID NO: 2122788 - RNA, 16 nt, Human
cauuucuaaagccauu

SEQ ID NO: 2122789 - RNA, 18 nt, Human
ugugcuggccaccugcug

SEQ ID NO: 2122790 - RNA, 17 nt, Human
gggaaauccacacugag

SEQ ID NO: 2122791 - RNA, 22 nt, Human
gcuaaaacaagcacuaaacaaa

SEQ ID NO: 2122792 - RNA, 13 nt, Human
uauauuuuagaua

SEQ ID NO: 2122793 - RNA, 18 nt, Human
cugagucccaggcugagc

SEQ ID NO: 2122794 - RNA, 13 nt, Human
aggaaaaaauaac

SEQ ID NO: 2122795 - RNA, 21 nt, Human
caccagucugacuguuuccau

SEQ ID NO: 2122796 - RNA, 16 nt, Human
gaccaaggcccccggg

SEQ ID NO: 2122797 - RNA, 22 nt, Human
aagacccaaaaggcagaagcaa

SEQ ID NO: 2122798 - RNA, 19 nt, Human
aaauaugccccauucaaca

SEQ ID NO: 2122799 - RNA, 16 nt, Human
cccccagcccuccuua

SEQ ID NO: 2122800 - RNA, 18 nt, Human
gaaaauaucacuugucaa

SEQ ID NO: 2122801 - RNA, 12 nt, Human
ucuuaagaagac

SEQ ID NO: 2122802 - RNA, 15 nt, Human
cgcucggccugcucg

SEQ ID NO: 2122803 - RNA, 19 nt, Human
ggagccuccagcugccccg

SEQ ID NO: 2122804 - RNA, 20 nt, Human
gaaacauuugguaaggggaa

SEQ ID NO: 2122805 - RNA, 22 nt, Human
cuggugucuucaggggccacac

SEQ ID NO: 2122806 - RNA, 14 nt, Human
auuuaaauauaugc

SEQ ID NO: 2122807 - RNA, 16 nt, Human
cuuuuaguuuuuaaag

SEQ ID NO: 2122808 - RNA, 18 nt, Human
auggccacaucugagccc

SEQ ID NO: 2122809 - RNA, 16 nt, Human
aguaaaggcaaacuua

SEQ ID NO: 2122810 - RNA, 20 nt, Human
cugcucgcccacuuccuccc

SEQ ID NO: 2122811 - RNA, 13 nt, Human
cccggccgcgcug

SEQ ID NO: 2122812 - RNA, 17 nt, Human
cagacaucaacagauaa

SEQ ID NO: 2122813 - RNA, 18 nt, Human
agauccccaagccuggca

SEQ ID NO: 2122814 - RNA, 23 nt, Human
auucugagguaaccucauuauca

SEQ ID NO: 2122815 - RNA, 14 nt, Human
auauuugaaauauu

SEQ ID NO: 2122816 - RNA, 14 nt, Human
cugccagcuggccu

SEQ ID NO: 2122817 - RNA, 18 nt, Human
guuuaugguuguauuauu

SEQ ID NO: 2122818 - RNA, 22 nt, Human
aaagcuuugugcagauucuuua

SEQ ID NO: 2122819 - RNA, 21 nt, Human
augcuacaggauuugaaauug

SEQ ID NO: 2122820 - RNA, 13 nt, Human
agcgacagugaga

SEQ ID NO: 2122821 - RNA, 21 nt, Human
augaauacuuuauaaaggauu

SEQ ID NO: 2122822 - RNA, 18 nt, Human
acacuguuaucuucacuu

SEQ ID NO: 2122823 - RNA, 17 nt, Human
cgucaacucauauuuuc

SEQ ID NO: 2122824 - RNA, 20 nt, Human
caucccuagaaagccaugug

SEQ ID NO: 2122825 - RNA, 21 nt, Human
ugaauuaugaaacuuuuggaa

SEQ ID NO: 2122826 - RNA, 13 nt, Human
auauuuuauuaua

SEQ ID NO: 2122827 - RNA, 22 nt, Human
ugaagcaaaauuuuuucucuag

SEQ ID NO: 2122828 - RNA, 14 nt, Human
ugugaaaagcucca

SEQ ID NO: 2122829 - RNA, 21 nt, Human
gaauuuaaauagcuuuuuucu

SEQ ID NO: 2122830 - RNA, 19 nt, Human
cugccaaaacaucaaccug

SEQ ID NO: 2122831 - RNA, 21 nt, Human
caggcacuaucuggguuuugg

SEQ ID NO: 2122832 - RNA, 15 nt, Human
aaugauuaugaauua

SEQ ID NO: 2122833 - RNA, 14 nt, Human
uuuuauaagaaaua

SEQ ID NO: 2122834 - RNA, 17 nt, Human
augauuaaguaaugaua

SEQ ID NO: 2122835 - RNA, 14 nt, Human
cugcaaagcccagc

SEQ ID NO: 2122836 - RNA, 19 nt, Human
caaagugucuugaauugua

SEQ ID NO: 2122837 - RNA, 20 nt, Human
auacugugugcuaaaacaag

SEQ ID NO: 2122838 - RNA, 20 nt, Human
gcauuguuggcuguuccugc

SEQ ID NO: 2122839 - RNA, 20 nt, Human
acggagccgggaaagaagag

SEQ ID NO: 2122840 - RNA, 13 nt, Human
gagccggagccuc

SEQ ID NO: 2122841 - RNA, 19 nt, Human
uugugccccugcacuccag

SEQ ID NO: 2122842 - RNA, 20 nt, Human
gccgggcgugguggugagug

SEQ ID NO: 2122843 - RNA, 19 nt, Human
aagcuaugugagcucacca

SEQ ID NO: 2122844 - RNA, 22 nt, Human
auauuuuagauagaugaagaag

SEQ ID NO: 2122845 - RNA, 14 nt, Human
aaauauuauuuuau

SEQ ID NO: 2122846 - RNA, 19 nt, Human
cuuacucuugauuguggga

SEQ ID NO: 2122847 - RNA, 16 nt, Human
auuuaguuauaaaaau

SEQ ID NO: 2122848 - RNA, 18 nt, Human
cugagggcauagaaguaa

SEQ ID NO: 2122849 - RNA, 13 nt, Human
gcgcgccuccgcu

SEQ ID NO: 2122850 - RNA, 20 nt, Human
uguaauaggcguaacuaauu

SEQ ID NO: 2122851 - RNA, 19 nt, Human
ugcuauuugcuguuauuuu

SEQ ID NO: 2122852 - RNA, 16 nt, Human
cuggccuucggccucc

SEQ ID NO: 2122853 - RNA, 15 nt, Human
cucgugggacaguca

SEQ ID NO: 2122854 - RNA, 21 nt, Human
gccucaagcuaugugagcuca

SEQ ID NO: 2122855 - RNA, 21 nt, Human
gcgccgcgcuccucggacggc

SEQ ID NO: 2122856 - RNA, 22 nt, Human
aauuguaggugacuauuauauu

SEQ ID NO: 2122857 - RNA, 15 nt, Human
aucaaaggacaccau

SEQ ID NO: 2122858 - RNA, 11 nt, Human
aaccugagccc

SEQ ID NO: 2122859 - RNA, 18 nt, Human
gaagcaaaauuuuuucuc

SEQ ID NO: 2122860 - RNA, 21 nt, Human
uauuguagcauccuggaauau

SEQ ID NO: 2122861 - RNA, 19 nt, Human
gcuccgcgcagcucaggcu

SEQ ID NO: 2122862 - RNA, 17 nt, Human
uugcaguuuuuuccuag

SEQ ID NO: 2122863 - RNA, 18 nt, Human
acuguuaucuucacuuuu

SEQ ID NO: 2122864 - RNA, 16 nt, Human
aagcauuuagauguau

SEQ ID NO: 2122865 - RNA, 18 nt, Human
ugaagagugugaggaaaa

SEQ ID NO: 2122866 - RNA, 15 nt, Human
uaaaguaaaggcaaa

SEQ ID NO: 2122867 - RNA, 15 nt, Human
ucacaggacagcccu

SEQ ID NO: 2122868 - RNA, 19 nt, Human
gcagggugaacugcagcga

SEQ ID NO: 2122869 - RNA, 12 nt, Human
auuuaucauuua

SEQ ID NO: 2122870 - RNA, 15 nt, Human
aaucucaauauuuca

SEQ ID NO: 2122871 - RNA, 16 nt, Human
aagaaauauuccuuaa

SEQ ID NO: 2122872 - RNA, 17 nt, Human
uuuccaugaguugcagu

SEQ ID NO: 2122873 - RNA, 16 nt, Human
uaaugaauacuuuaua

SEQ ID NO: 2122874 - RNA, 13 nt, Human
aacucuauaaugu

SEQ ID NO: 2122875 - RNA, 19 nt, Human
aaugaauggcuaagcaaaa

SEQ ID NO: 2122876 - RNA, 13 nt, Human
agcuaaauauaua

SEQ ID NO: 2122877 - RNA, 14 nt, Human
gaaagcagaacagu

SEQ ID NO: 2122878 - RNA, 22 nt, Human
gagccucagucucccucccuug

SEQ ID NO: 2122879 - RNA, 18 nt, Human
gaccccugagcuugcaga

SEQ ID NO: 2122880 - RNA, 19 nt, Human
acuucccgcuguuccucgc

SEQ ID NO: 2122881 - RNA, 12 nt, Human
caggacagcccu

SEQ ID NO: 2122882 - RNA, 13 nt, Human
cagaaaaguugaa

SEQ ID NO: 2122883 - RNA, 17 nt, Human
gcagcaucagcaucccu

SEQ ID NO: 2122884 - RNA, 15 nt, Human
ugcuguauuuuaaaa

SEQ ID NO: 2122885 - RNA, 20 nt, Human
uccaagccucauguccacug

SEQ ID NO: 2122886 - RNA, 13 nt, Human
uaaacauguuuau

SEQ ID NO: 2122887 - RNA, 17 nt, Human
gggcaguguucccuggg

SEQ ID NO: 2122888 - RNA, 13 nt, Human
ucugaaauuuccu

SEQ ID NO: 2122889 - RNA, 13 nt, Human
aagaaaauaacga

SEQ ID NO: 2122890 - RNA, 15 nt, Human
ggcaauagucaaauu

SEQ ID NO: 2122891 - RNA, 12 nt, Human
ugugaggagcug

SEQ ID NO: 2122892 - RNA, 13 nt, Human
aagcuucuguucc

SEQ ID NO: 2122893 - RNA, 15 nt, Human
uuauaugcuauuuau

SEQ ID NO: 2122894 - RNA, 18 nt, Human
ugccuaggcauagcccug

SEQ ID NO: 2122895 - RNA, 15 nt, Human
auuuaauuauuucac

SEQ ID NO: 2122896 - RNA, 20 nt, Human
aaacuuuaugcuaagugaaa

SEQ ID NO: 2122897 - RNA, 12 nt, Human
auauaaauaaaa

SEQ ID NO: 2122898 - RNA, 17 nt, Human
gcugcccuuccccuucc

SEQ ID NO: 2122899 - RNA, 22 nt, Human
acuuugauuuuauaugcuauuu

SEQ ID NO: 2122900 - RNA, 14 nt, Human
uaaagcuuccauug

SEQ ID NO: 2122901 - RNA, 16 nt, Human
acauuugcucauggaa

SEQ ID NO: 2122902 - RNA, 14 nt, Human
uauauuuuacauaa

SEQ ID NO: 2122903 - RNA, 21 nt, Human
auguuuacagauccccaagcc

SEQ ID NO: 2122904 - RNA, 12 nt, Human
uuccugaacagg

SEQ ID NO: 2122905 - RNA, 24 nt, Human
uggccgggagccugaucaccugcc

SEQ ID NO: 2122906 - RNA, 19 nt, Human
caagaaggaaagauuuugu

SEQ ID NO: 2122907 - RNA, 23 nt, Human
uaggauggcuaguaucaaaagaa

SEQ ID NO: 2122908 - RNA, 14 nt, Human
aaaauacaaaaaaa

SEQ ID NO: 2122909 - RNA, 22 nt, Human
agcagcauaaauguugacaugg

SEQ ID NO: 2122910 - RNA, 17 nt, Human
agagacagaaagcagaa

SEQ ID NO: 2122911 - RNA, 21 nt, Human
gaagucacauuccugaacagg

SEQ ID NO: 2122912 - RNA, 23 nt, Human
cgcaggaccaucccggccggcgc

SEQ ID NO: 2122913 - RNA, 19 nt, Human
cucacauuuauauuuuugu

SEQ ID NO: 2122914 - RNA, 22 nt, Human
cauuuaaauaaaguguuugaaa

SEQ ID NO: 2122915 - RNA, 20 nt, Human
uaaaagacagugaaagaaaa

SEQ ID NO: 2122916 - RNA, 16 nt, Human
cacgugugggcaaugu

SEQ ID NO: 2122917 - RNA, 20 nt, Human
cugauauuggacaguaaaau

SEQ ID NO: 2122918 - RNA, 14 nt, Human
aacucauauuuuca

SEQ ID NO: 2122919 - RNA, 22 nt, Human
aaguggaacgagacaagcagcc

SEQ ID NO: 2122920 - RNA, 17 nt, Human
cauuguuggcuguuccu

SEQ ID NO: 2122921 - RNA, 10 nt, Human
caacucccug

SEQ ID NO: 2122922 - RNA, 12 nt, Human
ucugcacacagc

SEQ ID NO: 2122923 - RNA, 17 nt, Human
ucuauguagaauauauu

SEQ ID NO: 2122924 - RNA, 13 nt, Human
agccgggaaagaa

SEQ ID NO: 2122925 - RNA, 13 nt, Human
cccuccuuaucaa

SEQ ID NO: 2122926 - RNA, 15 nt, Human
caagcucacagaccu

SEQ ID NO: 2122927 - RNA, 16 nt, Human
ccacuuccucccggcc

SEQ ID NO: 2122928 - RNA, 14 nt, Human
auuuguauaaaaua

SEQ ID NO: 2122929 - RNA, 19 nt, Human
gaauacucuuauaucuaua

SEQ ID NO: 2122930 - RNA, 14 nt, Human
agucucccucccuu

SEQ ID NO: 2122931 - RNA, 23 nt, Human
uugaaguuuuggcaauugacuau

SEQ ID NO: 2122932 - RNA, 18 nt, Human
cagaaagcagaacaguga

SEQ ID NO: 2122933 - RNA, 17 nt, Human
gucucagcuucacccug

SEQ ID NO: 2122934 - RNA, 21 nt, Human
aggguuaugauuaaguaauga

SEQ ID NO: 2122935 - RNA, 21 nt, Human
aagacaagaaggaaagauuuu

SEQ ID NO: 2122936 - RNA, 22 nt, Human
uuuacauggcuggagcuagaau

SEQ ID NO: 2122937 - RNA, 20 nt, Human
ucuucuggguuccuuccucu

SEQ ID NO: 2122938 - RNA, 19 nt, Human
acauuuguauaaaauaauu

SEQ ID NO: 2122939 - RNA, 19 nt, Human
cuggggcuuuaacuccugc

SEQ ID NO: 2122940 - RNA, 17 nt, Human
aagcuuuuuuugaauca

SEQ ID NO: 2122941 - RNA, 23 nt, Human
cagcaccuccuaagaaggcaccu

SEQ ID NO: 2122942 - RNA, 20 nt, Human
uguaaaggaauuuaaaaauc

SEQ ID NO: 2122943 - RNA, 17 nt, Human
cucaggcuggcaccgcu

SEQ ID NO: 2122944 - RNA, 16 nt, Human
caugggacagggagga

SEQ ID NO: 2122945 - RNA, 20 nt, Human
aaaaaccugagccccaaaag

SEQ ID NO: 2122946 - RNA, 20 nt, Human
gauuauauauauuuuuuucu

SEQ ID NO: 2122947 - RNA, 21 nt, Human
ccuaauuuguuuucccuucuu

SEQ ID NO: 2122948 - RNA, 21 nt, Human
ccuccccaaaugcuuuccaug

SEQ ID NO: 2122949 - RNA, 17 nt, Human
aaccucuaaauucuuuc

SEQ ID NO: 2122950 - RNA, 18 nt, Human
agagaaugagagacacac

SEQ ID NO: 2122951 - RNA, 16 nt, Human
auccuugaagauuuac

SEQ ID NO: 2122952 - RNA, 16 nt, Human
aaaaugugauauguac

SEQ ID NO: 2122953 - RNA, 17 nt, Human
cugccucagaaaacaag

SEQ ID NO: 2122954 - RNA, 18 nt, Human
gaaguaaauguuguuuua

SEQ ID NO: 2122955 - RNA, 21 nt, Human
acuauuauauuuccaagaaau

SEQ ID NO: 2122956 - RNA, 22 nt, Human
auucaaugccccugaauuuaaa

SEQ ID NO: 2122957 - RNA, 16 nt, Human
aaaguguuugaaagcu

SEQ ID NO: 2122958 - RNA, 11 nt, Human
caacucccugc

SEQ ID NO: 2122959 - RNA, 18 nt, Human
cuaauaucuuaucuuccu

SEQ ID NO: 2122960 - RNA, 16 nt, Human
gaagccagaucuaugc

SEQ ID NO: 2122961 - RNA, 21 nt, Human
cuggccuucggccuccauccu

SEQ ID NO: 2122962 - RNA, 21 nt, Human
auccccaagccuggcaaggga

SEQ ID NO: 2122963 - RNA, 15 nt, Human
gugaccacugcagaa

SEQ ID NO: 2122964 - RNA, 19 nt, Human
agagccggagccuccagcu

SEQ ID NO: 2122965 - RNA, 20 nt, Human
caaacauccuacaagacaca

SEQ ID NO: 2122966 - RNA, 13 nt, Human
agcuucuguuccg

SEQ ID NO: 2122967 - RNA, 18 nt, Human
accaagcugguggcucug

SEQ ID NO: 2122968 - RNA, 12 nt, Human
gaagaccucauu

SEQ ID NO: 2122969 - RNA, 12 nt, Human
uuuuauauuuga

SEQ ID NO: 2122970 - RNA, 15 nt, Human
cacaggacagcccuu

SEQ ID NO: 2122971 - RNA, 18 nt, Human
cugcucaauaaaguacaa

SEQ ID NO: 2122972 - RNA, 16 nt, Human
auugucuagugaaacu

SEQ ID NO: 2122973 - RNA, 14 nt, Human
aguacuucccgcug

SEQ ID NO: 2122974 - RNA, 16 nt, Human
cacgggggccaaggau

SEQ ID NO: 2122975 - RNA, 15 nt, Human
aagaaaauaacaaua

SEQ ID NO: 2122976 - RNA, 14 nt, Human
cuuggucugugaga

SEQ ID NO: 2122977 - RNA, 23 nt, Human
uaucuauguagaauauauuuccu

SEQ ID NO: 2122978 - RNA, 20 nt, Human
aagggcuguuauaaucuuuc

SEQ ID NO: 2122979 - RNA, 23 nt, Human
gcuuuggucuaucuuugagcgcc

SEQ ID NO: 2122980 - RNA, 19 nt, Human
gccgcgcugcgcgccgcgc

SEQ ID NO: 2122981 - RNA, 17 nt, Human
auuuucuauaauuuaaa

SEQ ID NO: 2122982 - RNA, 19 nt, Human
auugaggacacugauaugg

SEQ ID NO: 2122983 - RNA, 15 nt, Human
gccucuuagaugcag

SEQ ID NO: 2122984 - RNA, 15 nt, Human
uccacaaguaaaagg

SEQ ID NO: 2122985 - RNA, 14 nt, Human
guauuuuaaaagaa

SEQ ID NO: 2122986 - RNA, 18 nt, Human
acaugaacuuguaaagga

SEQ ID NO: 2122987 - RNA, 22 nt, Human
aagaauuucuaggacugaauua

SEQ ID NO: 2122988 - RNA, 20 nt, Human
aaaacuuauccuccaugaau

SEQ ID NO: 2122989 - RNA, 18 nt, Human
agcuuugugcagauucuu

SEQ ID NO: 2122990 - RNA, 13 nt, Human
ugaaauuguauua

SEQ ID NO: 2122991 - RNA, 14 nt, Human
ccucagucucccuc

SEQ ID NO: 2122992 - RNA, 16 nt, Human
cucagcccuggugggc

SEQ ID NO: 2122993 - RNA, 18 nt, Human
ccggagccuccagcugcc

SEQ ID NO: 2122994 - RNA, 15 nt, Human
uuaauucugaaagca

SEQ ID NO: 2122995 - RNA, 14 nt, Human
uuccgcauccuagu

SEQ ID NO: 2122996 - RNA, 22 nt, Human
aucucuucuggguuccuuccuc

SEQ ID NO: 2122997 - RNA, 18 nt, Human
agugucaaugcagccccc

SEQ ID NO: 2122998 - RNA, 17 nt, Human
auaaaguaugugcauau

SEQ ID NO: 2122999 - RNA, 17 nt, Human
ugaaggauuuauguuua

SEQ ID NO: 2123000 - RNA, 22 nt, Human
uuaaaaaaaaaacguauugcau

SEQ ID NO: 2123001 - RNA, 13 nt, Human
ccaccugccuaua

SEQ ID NO: 2123002 - RNA, 15 nt, Human
uuucucugauacaga

SEQ ID NO: 2123003 - RNA, 22 nt, Human
acagaaaaguugaauuuuacau

SEQ ID NO: 2123004 - RNA, 19 nt, Human
agccuccagcugccccggg

SEQ ID NO: 2123005 - RNA, 17 nt, Human
ccgcgcagcucaggcug

SEQ ID NO: 2123006 - RNA, 18 nt, Human
uuuauggcacuaguauuu

SEQ ID NO: 2123007 - RNA, 18 nt, Human
uguauucuuuuaguuuuu

SEQ ID NO: 2123008 - RNA, 16 nt, Human
aucuauauuuuacaua

SEQ ID NO: 2123009 - RNA, 12 nt, Human
uucucuaggaaa

SEQ ID NO: 2123010 - RNA, 22 nt, Human
gacacaugugcuggccaccugc

SEQ ID NO: 2123011 - RNA, 21 nt, Human
aaguuuaugguuguauuauuu

SEQ ID NO: 2123012 - RNA, 17 nt, Human
gcaccugugccgucccc

SEQ ID NO: 2123013 - RNA, 15 nt, Human
aauauauuuccuuau

SEQ ID NO: 2123014 - RNA, 20 nt, Human
ugauuucugagcauuuaaua

SEQ ID NO: 2123015 - RNA, 16 nt, Human
gcuucacuguaaaaua

SEQ ID NO: 2123016 - RNA, 13 nt, Human
aagacaaggaaaa

SEQ ID NO: 2123017 - RNA, 15 nt, Human
uuccaagaaauauuc

SEQ ID NO: 2123018 - RNA, 14 nt, Human
uugauggaaauaca

SEQ ID NO: 2123019 - RNA, 17 nt, Human
uuccaagugauugaaac

SEQ ID NO: 2123020 - RNA, 23 nt, Human
ugcagagguccacaacacacaga

SEQ ID NO: 2123021 - RNA, 12 nt, Human
gccggcgcgcuc

SEQ ID NO: 2123022 - RNA, 16 nt, Human
gaucaaguuauuuuua

SEQ ID NO: 2123023 - RNA, 18 nt, Human
ccgcuacuuccagggcua

SEQ ID NO: 2123024 - RNA, 14 nt, Human
aaccugagccccaa

SEQ ID NO: 2123025 - RNA, 17 nt, Human
uaacgauaaaagacagu

SEQ ID NO: 2123026 - RNA, 19 nt, Human
cugacugcuaguuuauaua

SEQ ID NO: 2123027 - RNA, 20 nt, Human
uaagugaaauaagccagaca

SEQ ID NO: 2123028 - RNA, 21 nt, Human
ugaacaaauuuacagagacag

SEQ ID NO: 2123029 - RNA, 14 nt, Human
cagccaccagucca

SEQ ID NO: 2123030 - RNA, 20 nt, Human
agagacacacugaagaagca

SEQ ID NO: 2123031 - RNA, 21 nt, Human
agcccuuccccucugcagcuu

SEQ ID NO: 2123032 - RNA, 23 nt, Human
cuagacccacuggacucaccucc

SEQ ID NO: 2123033 - RNA, 22 nt, Human
cauuuaguuauaaaaauauaua

SEQ ID NO: 2123034 - RNA, 14 nt, Human
uauaauuuaaauau

SEQ ID NO: 2123035 - RNA, 13 nt, Human
aaaauaacgauaa

SEQ ID NO: 2123036 - RNA, 17 nt, Human
gcaucuccucaacucug

SEQ ID NO: 2123037 - RNA, 21 nt, Human
gaaggaaagaauaaccaacac

SEQ ID NO: 2123038 - RNA, 14 nt, Human
acaagcagcccuua

SEQ ID NO: 2123039 - RNA, 18 nt, Human
uuacaaaugggaaacaaa

SEQ ID NO: 2123040 - RNA, 23 nt, Human
acuaguuguaauuuuuuuguggg

SEQ ID NO: 2123041 - RNA, 18 nt, Human
agccgggaaagaagagcc

SEQ ID NO: 2123042 - RNA, 23 nt, Human
ggauguggggaaguuaggaacug

SEQ ID NO: 2123043 - RNA, 22 nt, Human
agaaauaggaaauauuuuaaug

SEQ ID NO: 2123044 - RNA, 14 nt, Human
auauuuauuuuaau

SEQ ID NO: 2123045 - RNA, 16 nt, Human
uggggauagugaggca

SEQ ID NO: 2123046 - RNA, 22 nt, Human
gugugaccacugcagaagacag

SEQ ID NO: 2123047 - RNA, 19 nt, Human
acuauuuaauuauuucacu

SEQ ID NO: 2123048 - RNA, 21 nt, Human
agcauuuguguugaagagguu

SEQ ID NO: 2123049 - RNA, 16 nt, Human
auaucaauuuaaaaaa

SEQ ID NO: 2123050 - RNA, 20 nt, Human
uuugcaagccagauuuuccu

SEQ ID NO: 2123051 - RNA, 23 nt, Human
agcuggaaacacauguuccccuu

SEQ ID NO: 2123052 - RNA, 16 nt, Human
cacuaguauuucuaug

SEQ ID NO: 2123053 - RNA, 22 nt, Human
agaauuugauaugugaacaguu

SEQ ID NO: 2123054 - RNA, 15 nt, Human
uauuuucaugcuguu

SEQ ID NO: 2123055 - RNA, 12 nt, Human
cugaggagcugu

SEQ ID NO: 2123056 - RNA, 21 nt, Human
aaaauuuuuucucuaggaaau

SEQ ID NO: 2123057 - RNA, 22 nt, Human
caucucuucuggguuccuuccu

SEQ ID NO: 2123058 - RNA, 22 nt, Human
acccugaggugagcaucaucuu

SEQ ID NO: 2123059 - RNA, 16 nt, Human
gacaagcucacagacc

SEQ ID NO: 2123060 - RNA, 23 nt, Human
agaguuuagcuggaaaaguaugu

SEQ ID NO: 2123061 - RNA, 21 nt, Human
uuuuauggcacuaguauuucu

SEQ ID NO: 2123062 - RNA, 16 nt, Human
cugaucaccugcccug

SEQ ID NO: 2123063 - RNA, 14 nt, Human
aagcaucacaugaa

SEQ ID NO: 2123064 - RNA, 15 nt, Human
ucauaagaauucugu

SEQ ID NO: 2123065 - RNA, 15 nt, Human
agggcucacagaauu

SEQ ID NO: 2123066 - RNA, 19 nt, Human
cggccuccauccugaggcu

SEQ ID NO: 2123067 - RNA, 22 nt, Human
uguugcccacagcuguaugauu

SEQ ID NO: 2123068 - RNA, 13 nt, Human
cagcucaggcugg

SEQ ID NO: 2123069 - RNA, 22 nt, Human
cgcccacuuccucccggccgcg

SEQ ID NO: 2123070 - RNA, 19 nt, Human
uauauuuccaagaaauauu

SEQ ID NO: 2123071 - RNA, 16 nt, Human
ugagaugcuagaacuc

SEQ ID NO: 2123072 - RNA, 22 nt, Human
gcuccgcgcagcucaggcuggc

SEQ ID NO: 2123073 - RNA, 21 nt, Human
aagauacugaaauaaacgucu

SEQ ID NO: 2123074 - RNA, 16 nt, Human
ugcuauugaaguuuug

SEQ ID NO: 2123075 - RNA, 20 nt, Human
cugguggcgcuggcugcgcu

SEQ ID NO: 2123076 - RNA, 17 nt, Human
gcgcgcuccgcgcagcu

SEQ ID NO: 2123077 - RNA, 18 nt, Human
uccuaauuccacagcugc

SEQ ID NO: 2123078 - RNA, 21 nt, Human
agucuguuuucccuccuugga

SEQ ID NO: 2123079 - RNA, 16 nt, Human
cugcugagccccaagu

SEQ ID NO: 2123080 - RNA, 13 nt, Human
acuaauuuuaaaa

SEQ ID NO: 2123081 - RNA, 15 nt, Human
gacaguauggcagcu

SEQ ID NO: 2123082 - RNA, 17 nt, Human
ucgcagacacaugugcu

SEQ ID NO: 2123083 - RNA, 15 nt, Human
uguuaaaugauuuca

SEQ ID NO: 2123084 - RNA, 22 nt, Human
aaauguugacaugggacauuug

SEQ ID NO: 2123085 - RNA, 22 nt, Human
aucuccgucaacucauauuuuc

SEQ ID NO: 2123086 - RNA, 19 nt, Human
agccugaucaccugcccug

SEQ ID NO: 2123087 - RNA, 22 nt, Human
aagagccuuuuuuugaaaaaaa

SEQ ID NO: 2123088 - RNA, 20 nt, Human
uaauaaguugcauagguuua

SEQ ID NO: 2123089 - RNA, 14 nt, Human
aucaaaagaaagaa

SEQ ID NO: 2123090 - RNA, 23 nt, Human
acugcuaguuuauauagaaaugu

SEQ ID NO: 2123091 - RNA, 16 nt, Human
agagguccacaacaca

SEQ ID NO: 2123092 - RNA, 15 nt, Human
ucuaugaaauauuau

SEQ ID NO: 2123093 - RNA, 14 nt, Human
auuauuucacuuua

SEQ ID NO: 2123094 - RNA, 16 nt, Human
uauucagaauuucuaa

SEQ ID NO: 2123095 - RNA, 20 nt, Human
gaaauacacuguuaucuuca

SEQ ID NO: 2123096 - RNA, 21 nt, Human
cuggccaccugcugagcccca

SEQ ID NO: 2123097 - RNA, 20 nt, Human
caaacugccaucauuuacuu

SEQ ID NO: 2123098 - RNA, 11 nt, Human
uaguuagcuuu

SEQ ID NO: 2123099 - RNA, 22 nt, Human
agcccuccuuaucaaaggacac

SEQ ID NO: 2123100 - RNA, 23 nt, Human
ucggccuccauccugaggcucca

SEQ ID NO: 2123101 - RNA, 14 nt, Human
agcugccucucuca

SEQ ID NO: 2123102 - RNA, 18 nt, Human
gcuauaggauguggggaa

SEQ ID NO: 2123103 - RNA, 19 nt, Human
acugccaucauuuacuuuu

SEQ ID NO: 2123104 - RNA, 17 nt, Human
aauaacaauaaaagaca

SEQ ID NO: 2123105 - RNA, 16 nt, Human
uaggaaauauuuuaau

SEQ ID NO: 2123106 - RNA, 20 nt, Human
agaagagccggagccuccag

SEQ ID NO: 2123107 - RNA, 15 nt, Human
uccgcuacuuccagg

SEQ ID NO: 2123108 - RNA, 22 nt, Human
ccgcgcagcucaggcuggcacc

SEQ ID NO: 2123109 - RNA, 13 nt, Human
uuuaacuccugcu

SEQ ID NO: 2123110 - RNA, 22 nt, Human
ucugcuggagacauugaggcag

SEQ ID NO: 2123111 - RNA, 23 nt, Human
gucucagcuucacccugagguga

SEQ ID NO: 2123112 - RNA, 15 nt, Human
cccugccccccagcc

SEQ ID NO: 2123113 - RNA, 13 nt, Human
auaaaaauauaua

SEQ ID NO: 2123114 - RNA, 18 nt, Human
cugcccuuccccuuccca

SEQ ID NO: 2123115 - RNA, 17 nt, Human
auucagaauuucuaaaa

SEQ ID NO: 2123116 - RNA, 12 nt, Human
uauuauuuuuua

SEQ ID NO: 2123117 - RNA, 22 nt, Human
cugaggcuccacuuggucugug

SEQ ID NO: 2123118 - RNA, 17 nt, Human
cugccucucucauccac

SEQ ID NO: 2123119 - RNA, 19 nt, Human
auaaaagacagugaaagaa

SEQ ID NO: 2123120 - RNA, 21 nt, Human
gaaaugaguuuuucuuuucau

SEQ ID NO: 2123121 - RNA, 21 nt, Human
uuuguauaaaauaauuuuuau

SEQ ID NO: 2123122 - RNA, 13 nt, Human
gacaaggaaaaaa

SEQ ID NO: 2123123 - RNA, 18 nt, Human
gagccucagucucccucc

SEQ ID NO: 2123124 - RNA, 22 nt, Human
ccugcugcccuuccccuuccca

SEQ ID NO: 2123125 - RNA, 23 nt, Human
cucauguccacugguucuucuug

SEQ ID NO: 2123126 - RNA, 15 nt, Human
gagccggagccucca

SEQ ID NO: 2123127 - RNA, 14 nt, Human
aaagaggaaugaag

SEQ ID NO: 2123128 - RNA, 16 nt, Human
uucuauaauuuaaaua

SEQ ID NO: 2123129 - RNA, 21 nt, Human
accaccugccuauauuuuuug

SEQ ID NO: 2123130 - RNA, 17 nt, Human
aaauauaaauaaaaaua

SEQ ID NO: 2123131 - RNA, 18 nt, Human
ccacaucugagccccgaa

SEQ ID NO: 2123132 - RNA, 22 nt, Human
cacagauuugagcucagcccug

SEQ ID NO: 2123133 - RNA, 15 nt, Human
acaugugcuggccac

SEQ ID NO: 2123134 - RNA, 18 nt, Human
gaaggugaucuggcucug

SEQ ID NO: 2123135 - RNA, 15 nt, Human
uagggugauauuaac

SEQ ID NO: 2123136 - RNA, 18 nt, Human
uuuuaucugcuaugcuau

SEQ ID NO: 2123137 - RNA, 23 nt, Human
cuuuccaauaaagaguuccuucu

SEQ ID NO: 2123138 - RNA, 15 nt, Human
uccuacaagacacag

SEQ ID NO: 2123139 - RNA, 23 nt, Human
uuuauaugcuucuguuuuauaau

SEQ ID NO: 2123140 - RNA, 23 nt, Human
ucugauacagaaaaguugaauuu

SEQ ID NO: 2123141 - RNA, 20 nt, Human
cggcccugugcggccugguc

SEQ ID NO: 2123142 - RNA, 18 nt, Human
uguugcagugucugcugg

SEQ ID NO: 2123143 - RNA, 20 nt, Human
gcagagaugaggccgccaug

SEQ ID NO: 2123144 - RNA, 19 nt, Human
augaaagcagggacuugaa

SEQ ID NO: 2123145 - RNA, 23 nt, Human
agucccugcugcccuuccccuuc

SEQ ID NO: 2123146 - RNA, 13 nt, Human
aggggcgcucgcu

SEQ ID NO: 2123147 - RNA, 17 nt, Human
ucccugcugcccuuccc

SEQ ID NO: 2123148 - RNA, 17 nt, Human
cgauaaaagacagugaa

SEQ ID NO: 2123149 - RNA, 15 nt, Human
gcccugugcggccug

SEQ ID NO: 2123150 - RNA, 15 nt, Human
auauugacuuuuuau

SEQ ID NO: 2123151 - RNA, 13 nt, Human
guuuucccaucuc

SEQ ID NO: 2123152 - RNA, 22 nt, Human
aaauaacaaugaaaguugauaa

SEQ ID NO: 2123153 - RNA, 20 nt, Human
uuaacacaugauccugcaau

SEQ ID NO: 2123154 - RNA, 14 nt, Human
gagagugaacaaau

SEQ ID NO: 2123155 - RNA, 22 nt, Human
uggcgcuggcugcgcucggccu

SEQ ID NO: 2123156 - RNA, 17 nt, Human
guuuuaggaauacauaa

SEQ ID NO: 2123157 - RNA, 22 nt, Human
cgcuggcugcgcucggccugcu

SEQ ID NO: 2123158 - RNA, 15 nt, Human
aagcacuaaacaaag

SEQ ID NO: 2123159 - RNA, 22 nt, Human
aauuuuuucucuaggaaauauu

SEQ ID NO: 2123160 - RNA, 16 nt, Human
gaagauguagaggaga

SEQ ID NO: 2123161 - RNA, 18 nt, Human
cuuugagcgcccacuaga

SEQ ID NO: 2123162 - RNA, 14 nt, Human
ucucagaaggaaag

SEQ ID NO: 2123163 - RNA, 16 nt, Human
cuucccacacugucca

SEQ ID NO: 2123164 - RNA, 21 nt, Human
cuggcugcgcucggccugcuc

SEQ ID NO: 2123165 - RNA, 14 nt, Human
cuaggacugaauua

SEQ ID NO: 2123166 - RNA, 23 nt, Human
guaauuccguagguuauuuucag

SEQ ID NO: 2123167 - RNA, 16 nt, Human
ccuuccccucugcagc

SEQ ID NO: 2123168 - RNA, 16 nt, Human
aucaguuauuuuuaaa

SEQ ID NO: 2123169 - RNA, 18 nt, Human
ugcagugucugcuggaga

SEQ ID NO: 2123170 - RNA, 23 nt, Human
gggaaacaaaaggauaaugaaua

SEQ ID NO: 2123171 - RNA, 12 nt, Human
aauuuaaauaua

SEQ ID NO: 2123172 - RNA, 23 nt, Human
ucuaccaaaaaucucaauauuuc

SEQ ID NO: 2123173 - RNA, 23 nt, Human
aagagccggagccuccagcugcc

SEQ ID NO: 2123174 - RNA, 19 nt, Human
ccugccuaagugcagcccc

SEQ ID NO: 2123175 - RNA, 14 nt, Human
aagcaacccaaaug

SEQ ID NO: 2123176 - RNA, 21 nt, Human
aaugugacuuaaugccacuaa

SEQ ID NO: 2123177 - RNA, 17 nt, Human
uuauuacuguaagaaaa

SEQ ID NO: 2123178 - RNA, 15 nt, Human
uuauauauauuuuuu

SEQ ID NO: 2123179 - RNA, 11 nt, Human
auuuaaaaauc

SEQ ID NO: 2123180 - RNA, 23 nt, Human
uuucccaucucagguguguugca

SEQ ID NO: 2123181 - RNA, 20 nt, Human
cuucaacucccugcccccca

SEQ ID NO: 2123182 - RNA, 15 nt, Human
gcuguuaaucuuuca

SEQ ID NO: 2123183 - RNA, 17 nt, Human
accugugccguccccag

SEQ ID NO: 2123184 - RNA, 20 nt, Human
guguggaaggugaucuggcu

SEQ ID NO: 2123185 - RNA, 15 nt, Human
augugcagccaccag

SEQ ID NO: 2123186 - RNA, 22 nt, Human
cuccuccagggagucucagcuu

SEQ ID NO: 2123187 - RNA, 14 nt, Human
gagcucagcccugg

SEQ ID NO: 2123188 - RNA, 10 nt, Human
ggggaggggc

SEQ ID NO: 2123189 - RNA, 18 nt, Human
cagauuugagcucagccc

SEQ ID NO: 2123190 - RNA, 14 nt, Human
ccaucccggccggc

SEQ ID NO: 2123191 - RNA, 13 nt, Human
cgcgagcgcgcgc

SEQ ID NO: 2123192 - RNA, 18 nt, Human
augauguuucauaagaau

SEQ ID NO: 2123193 - RNA, 14 nt, Human
guccacaaguaaaa

SEQ ID NO: 2123194 - RNA, 15 nt, Human
acuauuauauuucca

SEQ ID NO: 2123195 - RNA, 15 nt, Human
ccggagccuccagcu

SEQ ID NO: 2123196 - RNA, 12 nt, Human
uauucacaagac

SEQ ID NO: 2123197 - RNA, 22 nt, Human
aacugauguaaguaaacggucu

SEQ ID NO: 2123198 - RNA, 14 nt, Human
uggcucugugugcu

SEQ ID NO: 2123199 - RNA, 20 nt, Human
aaaacaagcacuaaacaaag

SEQ ID NO: 2123200 - RNA, 17 nt, Human
caaggcccccgggccga

SEQ ID NO: 2123201 - RNA, 21 nt, Human
ucccuggggcuuuaacuccug

SEQ ID NO: 2123202 - RNA, 18 nt, Human
ggcacagaaacuccuguu

SEQ ID NO: 2123203 - RNA, 18 nt, Human
uggagggaagccuugggg

SEQ ID NO: 2123204 - RNA, 13 nt, Human
uuuguuucagugc

SEQ ID NO: 2123205 - RNA, 13 nt, Human
cucgccacgcucu

SEQ ID NO: 2123206 - RNA, 14 nt, Human
uucuaugaaauauu

SEQ ID NO: 2123207 - RNA, 21 nt, Human
aaacgaggauugggaaaaagu

SEQ ID NO: 2123208 - RNA, 19 nt, Human
cuucuggguuccuuccucu

SEQ ID NO: 2123209 - RNA, 16 nt, Human
agggcaguguucccug

SEQ ID NO: 2123210 - RNA, 20 nt, Human
accucauggaauuggagcuc

SEQ ID NO: 2123211 - RNA, 18 nt, Human
ggccuugugaggagcugg

SEQ ID NO: 2123212 - RNA, 17 nt, Human
uaucuuuuuuuuaauaa

SEQ ID NO: 2123213 - RNA, 17 nt, Human
uaucaauuuaaaaaaaa

SEQ ID NO: 2123214 - RNA, 13 nt, Human
cugaaauuuccug

SEQ ID NO: 2123215 - RNA, 16 nt, Human
uuccuuacucuugauu

SEQ ID NO: 2123216 - RNA, 19 nt, Human
auuguaggugacuauuaua

SEQ ID NO: 2123217 - RNA, 14 nt, Human
cugaacccagggaa

SEQ ID NO: 2123218 - RNA, 19 nt, Human
cuuccagauccuggaaauc

SEQ ID NO: 2123219 - RNA, 16 nt, Human
auauuuccaagaaaua

SEQ ID NO: 2123220 - RNA, 23 nt, Human
uuagaugcaguucugaagaagau

SEQ ID NO: 2123221 - RNA, 15 nt, Human
ugcuucuguuuuaua

SEQ ID NO: 2123222 - RNA, 14 nt, Human
aagcugaguguuuc

SEQ ID NO: 2123223 - RNA, 21 nt, Human
aaugucauuguucuugugaac

SEQ ID NO: 2123224 - RNA, 22 nt, Human
gaauaaccaacacccugagguu

SEQ ID NO: 2123225 - RNA, 23 nt, Human
uccaacuaucucauuuccaagca

SEQ ID NO: 2123226 - RNA, 14 nt, Human
ugagcucagcccug

SEQ ID NO: 2123227 - RNA, 15 nt, Human
ggcaagcucuaucac

SEQ ID NO: 2123228 - RNA, 22 nt, Human
cuagucucuaucauuaaaguuc

SEQ ID NO: 2123229 - RNA, 23 nt, Human
uagauguauagguugaugguggu

SEQ ID NO: 2123230 - RNA, 21 nt, Human
cccccucuggcuccagcuggc

SEQ ID NO: 2123231 - RNA, 20 nt, Human
gaagagccggagccuccagc

SEQ ID NO: 2123232 - RNA, 18 nt, Human
cacaaguaaaaggaaaug

SEQ ID NO: 2123233 - RNA, 13 nt, Human
cacuguaaaauaa

SEQ ID NO: 2123234 - RNA, 17 nt, Human
gcgcccucuggcugcug

SEQ ID NO: 2123235 - RNA, 18 nt, Human
uccaggcuggcgugcagc

SEQ ID NO: 2123236 - RNA, 17 nt, Human
auaaaguacaagagcuu

SEQ ID NO: 2123237 - RNA, 14 nt, Human
cuaagcauuccaac

SEQ ID NO: 2123238 - RNA, 22 nt, Human
aagucccugcugcccuuccccu

SEQ ID NO: 2123239 - RNA, 21 nt, Human
cuggguuuuggggggacgcua

SEQ ID NO: 2123240 - RNA, 19 nt, Human
ggcaccgcuguacgcgagc

SEQ ID NO: 2123241 - RNA, 13 nt, Human
uuauaaaaauaua

SEQ ID NO: 2123242 - RNA, 14 nt, Human
aaaacuucagacau

SEQ ID NO: 2123243 - RNA, 14 nt, Human
uauauauauauuuu

SEQ ID NO: 2123244 - RNA, 13 nt, Human
cuuccucccauuc

SEQ ID NO: 2123245 - RNA, 16 nt, Human
ucaguuuuugugaaaa

SEQ ID NO: 2123246 - RNA, 14 nt, Human
uaauuauuucacuu

SEQ ID NO: 2123247 - RNA, 23 nt, Human
ccccucuggcuccagcuggccgg

SEQ ID NO: 2123248 - RNA, 17 nt, Human
agguuuuaaagcuucca

SEQ ID NO: 2123249 - RNA, 17 nt, Human
cggcccugugcggccug

SEQ ID NO: 2123250 - RNA, 21 nt, Human
gccacgcucugggucgccggc

SEQ ID NO: 2123251 - RNA, 14 nt, Human
augggccauaugaa

SEQ ID NO: 2123252 - RNA, 21 nt, Human
gaacagucucuugaggcacag

SEQ ID NO: 2123253 - RNA, 18 nt, Human
auagcuacuaauuuuaaa

SEQ ID NO: 2123254 - RNA, 13 nt, Human
uacagagacagaa

SEQ ID NO: 2123255 - RNA, 22 nt, Human
cuggguuccuuccucugagccu

SEQ ID NO: 2123256 - RNA, 19 nt, Human
auauauuuuuuuuuuuaaa

SEQ ID NO: 2123257 - RNA, 18 nt, Human
uuaucauuuaguuauaaa

SEQ ID NO: 2123258 - RNA, 16 nt, Human
aagaaaauaacaauaa

SEQ ID NO: 2123259 - RNA, 14 nt, Human
aauggcuaagcaaa

SEQ ID NO: 2123260 - RNA, 12 nt, Human
gauaaaagacag

SEQ ID NO: 2123261 - RNA, 19 nt, Human
cgcccacuagacccacugg

SEQ ID NO: 2123262 - RNA, 23 nt, Human
gccccugcacuccagccugagcg

SEQ ID NO: 2123263 - RNA, 16 nt, Human
ucuuggucucaguguc

SEQ ID NO: 2123264 - RNA, 23 nt, Human
cuuaagaagacugcauuauauuu

SEQ ID NO: 2123265 - RNA, 24 nt, Human
cuggcuaauuagcauggccacauc

SEQ ID NO: 2123266 - RNA, 12 nt, Human
uuuuuucugaaa

SEQ ID NO: 2123267 - RNA, 19 nt, Human
uccacaaguaaaaggaaau

SEQ ID NO: 2123268 - RNA, 12 nt, Human
uacuauuuaauu

SEQ ID NO: 2123269 - RNA, 12 nt, Human
cauuauauuuau

SEQ ID NO: 2123270 - RNA, 22 nt, Human
uacaugagguacugagagugaa

SEQ ID NO: 2123271 - RNA, 16 nt, Human
cccuuuacccccauga

SEQ ID NO: 2123272 - RNA, 15 nt, Human
aaacaauuugaauau

SEQ ID NO: 2123273 - RNA, 16 nt, Human
uauaucaauuuaaaaa

SEQ ID NO: 2123274 - RNA, 13 nt, Human
gauuguaaaaugg

SEQ ID NO: 2123275 - RNA, 15 nt, Human
aagaaggaaagauuu

SEQ ID NO: 2123276 - RNA, 20 nt, Human
ugagucccaggcugagccuc

SEQ ID NO: 2123277 - RNA, 19 nt, Human
caaguaaaaggaaaugcuc

SEQ ID NO: 2123278 - RNA, 16 nt, Human
auccuccaugaauauc

SEQ ID NO: 2123279 - RNA, 17 nt, Human
cugugcggccuggucua

SEQ ID NO: 2123280 - RNA, 16 nt, Human
ggcgggagggcgcggg

SEQ ID NO: 2123281 - RNA, 15 nt, Human
gaauuuaaauagcuu

SEQ ID NO: 2123282 - RNA, 13 nt, Human
gggaaagaagagc

SEQ ID NO: 2123283 - RNA, 14 nt, Human
ugcuggagcucugc

SEQ ID NO: 2123284 - RNA, 21 nt, Human
agcuacuuauuguagcauccu

SEQ ID NO: 2123285 - RNA, 23 nt, Human
ggccuccauccugaggcuccacu

SEQ ID NO: 2123286 - RNA, 15 nt, Human
ucaaaggacaccauu

SEQ ID NO: 2123287 - RNA, 20 nt, Human
auuacuguaagaaaauauca

SEQ ID NO: 2123288 - RNA, 12 nt, Human
ccccuugccaua

SEQ ID NO: 2123289 - RNA, 21 nt, Human
guccccuauccuacuuccccu

SEQ ID NO: 2123290 - RNA, 18 nt, Human
cuggggcuuuaacuccug

SEQ ID NO: 2123291 - RNA, 17 nt, Human
uauuuuuuucugaaauu

SEQ ID NO: 2123292 - RNA, 21 nt, Human
aagaaauaggaaauauuuuaa

SEQ ID NO: 2123293 - RNA, 21 nt, Human
ccaaagugugacucauuaaau

SEQ ID NO: 2123294 - RNA, 23 nt, Human
caacggggugaaacccugucucu

SEQ ID NO: 2123295 - RNA, 17 nt, Human
gcaaauugucacaggac

SEQ ID NO: 2123296 - RNA, 15 nt, Human
cauuccaagccucau

SEQ ID NO: 2123297 - RNA, 23 nt, Human
aaauuuacagagacagaaagcag

SEQ ID NO: 2123298 - RNA, 13 nt, Human
aucuacacuccag

SEQ ID NO: 2123299 - RNA, 21 nt, Human
cuggaaacacauguuccccuu

SEQ ID NO: 2123300 - RNA, 14 nt, Human
uauuauauuuccaa

SEQ ID NO: 2123301 - RNA, 19 nt, Human
uuugccaaguucuccacua

SEQ ID NO: 2123302 - RNA, 15 nt, Human
cacuuccucccggcc

SEQ ID NO: 2123303 - RNA, 14 nt, Human
uuaugauuaaguaa

SEQ ID NO: 2123304 - RNA, 22 nt, Human
cggccugcucgcccacuuccuc

SEQ ID NO: 2123305 - RNA, 19 nt, Human
ugcuugucccuguggaagu

SEQ ID NO: 2123306 - RNA, 14 nt, Human
gauuaguacacacu

SEQ ID NO: 2123307 - RNA, 16 nt, Human
ggaugccccguccccc

SEQ ID NO: 2123308 - RNA, 18 nt, Human
cacuccagugagacagcu

SEQ ID NO: 2123309 - RNA, 16 nt, Human
gacauuugcucaugga

SEQ ID NO: 2123310 - RNA, 21 nt, Human
aacuuauccuccaugaauauc

SEQ ID NO: 2123311 - RNA, 14 nt, Human
cccugccucaagcu

SEQ ID NO: 2123312 - RNA, 20 nt, Human
augaagauacugaaauaaac

SEQ ID NO: 2123313 - RNA, 15 nt, Human
acaagacccaaaagg

SEQ ID NO: 2123314 - RNA, 14 nt, Human
guugaauuuuacau

SEQ ID NO: 2123315 - RNA, 16 nt, Human
ccucauuaucagucca

SEQ ID NO: 2123316 - RNA, 16 nt, Human
ugcaugguuuagaaag

SEQ ID NO: 2123317 - RNA, 17 nt, Human
gccccccagcccuccuu

SEQ ID NO: 2123318 - RNA, 19 nt, Human
aauuuuuauauuugaaaua

SEQ ID NO: 2123319 - RNA, 14 nt, Human
caucaucuucuggg

SEQ ID NO: 2123320 - RNA, 16 nt, Human
ugugagaugcuagaac

SEQ ID NO: 2123321 - RNA, 18 nt, Human
uggccaccugcugagccc

SEQ ID NO: 2123322 - RNA, 15 nt, Human
auaucaauuuaaaaa

SEQ ID NO: 2123323 - RNA, 14 nt, Human
gcuuuaacuccugc

SEQ ID NO: 2123324 - RNA, 14 nt, Human
ccugcugagcccca

SEQ ID NO: 2123325 - RNA, 22 nt, Human
gaaaaucuuauaauuuaaaaua

SEQ ID NO: 2123326 - RNA, 14 nt, Human
cucaacaaacauaa

SEQ ID NO: 2123327 - RNA, 18 nt, Human
ugaagcuguguccucaug

SEQ ID NO: 2123328 - RNA, 12 nt, Human
gacagugaaaga

SEQ ID NO: 2123329 - RNA, 22 nt, Human
uucaauaucuuuuuuuuaauaa

SEQ ID NO: 2123330 - RNA, 14 nt, Human
agccuccagcugcc

SEQ ID NO: 2123331 - RNA, 21 nt, Human
cccccauuguggucacaggaa

SEQ ID NO: 2123332 - RNA, 20 nt, Human
cccugcacuccagccugagc

SEQ ID NO: 2123333 - RNA, 20 nt, Human
aguuguuucuacuacaugga

SEQ ID NO: 2123334 - RNA, 14 nt, Human
ugaucaccugcccu

SEQ ID NO: 2123335 - RNA, 13 nt, Human
cauuuguauaaaa

SEQ ID NO: 2123336 - RNA, 16 nt, Human
ccugagcgacagugag

SEQ ID NO: 2123337 - RNA, 17 nt, Human
gacaaggaaaaaauaac

SEQ ID NO: 2123338 - RNA, 17 nt, Human
ccacugcagaagacagu

SEQ ID NO: 2123339 - RNA, 17 nt, Human
agaagagccggagccuc

SEQ ID NO: 2123340 - RNA, 14 nt, Human
aauaguuuaugauu

SEQ ID NO: 2123341 - RNA, 17 nt, Human
ccaagcugguggcucug

SEQ ID NO: 2123342 - RNA, 22 nt, Human
aggcccccgggccgacggagcc

SEQ ID NO: 2123343 - RNA, 13 nt, Human
cuauuauauuucc

SEQ ID NO: 2123344 - RNA, 19 nt, Human
gguuuaauaauuuuuaauu

SEQ ID NO: 2123345 - RNA, 17 nt, Human
ccacuggacucaccucc

SEQ ID NO: 2123346 - RNA, 18 nt, Human
acucuuaagaagacugca

SEQ ID NO: 2123347 - RNA, 19 nt, Human
auuguaguccuguaaugga

SEQ ID NO: 2123348 - RNA, 23 nt, Human
uuuccaucaaggguacacugccu

SEQ ID NO: 2123349 - RNA, 23 nt, Human
cuggggcuuuaacuccugcuaga

SEQ ID NO: 2123350 - RNA, 19 nt, Human
acuggacucaccuccccca

SEQ ID NO: 2123351 - RNA, 14 nt, Human
acagaauuuuaugc

SEQ ID NO: 2123352 - RNA, 20 nt, Human
uuacaaauccaaugaaauga

SEQ ID NO: 2123353 - RNA, 15 nt, Human
agucucuaucauuaa

SEQ ID NO: 2123354 - RNA, 17 nt, Human
cgcgccuccgcuacuuc

SEQ ID NO: 2123355 - RNA, 14 nt, Human
cgugcuugucccug

SEQ ID NO: 2123356 - RNA, 15 nt, Human
ucauaauaaguugca

SEQ ID NO: 2123357 - RNA, 23 nt, Human
ucuaggacugaauuaugaaacuu

SEQ ID NO: 2123358 - RNA, 16 nt, Human
gccaaggaugccccgu

SEQ ID NO: 2123359 - RNA, 14 nt, Human
guagcuaaauauau

SEQ ID NO: 2123360 - RNA, 12 nt, Human
acacuuaaaaau

SEQ ID NO: 2123361 - RNA, 14 nt, Human
ugacacuuaaaaau

SEQ ID NO: 2123362 - RNA, 17 nt, Human
aauguuguuuuaggaau

SEQ ID NO: 2123363 - RNA, 22 nt, Human
uugaaaaucuuauaauuuaaaa

SEQ ID NO: 2123364 - RNA, 18 nt, Human
ccacuuggucugugagau

SEQ ID NO: 2123365 - RNA, 13 nt, Human
ugcauuucuaaag

SEQ ID NO: 2123366 - RNA, 13 nt, Human
ugugcuggccacc

SEQ ID NO: 2123367 - RNA, 20 nt, Human
ugguuguauuauuuuuuaaa

SEQ ID NO: 2123368 - RNA, 16 nt, Human
aauuacauuuguauaa

SEQ ID NO: 2123369 - RNA, 15 nt, Human
uaucaauuuaaaaaa

SEQ ID NO: 2123370 - RNA, 17 nt, Human
cuauauuuuacauaaau

SEQ ID NO: 2123371 - RNA, 14 nt, Human
uuucugaaauuucc

SEQ ID NO: 2123372 - RNA, 17 nt, Human
agguccacaacacacag

SEQ ID NO: 2123373 - RNA, 15 nt, Human
gccucagucucccuc

SEQ ID NO: 2123374 - RNA, 20 nt, Human
guauuauuuuuuaaaaaaau

SEQ ID NO: 2123375 - RNA, 13 nt, Human
auaacuggaaacu

SEQ ID NO: 2123376 - RNA, 18 nt, Human
guuucaaacauauauaac

SEQ ID NO: 2123377 - RNA, 23 nt, Human
uguugcccacagcuguaugauuc

SEQ ID NO: 2123378 - RNA, 15 nt, Human
aguucugaagaagau

SEQ ID NO: 2123379 - RNA, 22 nt, Human
auauaaauaaaaauaauccuca

SEQ ID NO: 2123380 - RNA, 14 nt, Human
cuuguacucugaaa

SEQ ID NO: 2123381 - RNA, 20 nt, Human
uagaagucacauuccugaac

SEQ ID NO: 2123382 - RNA, 14 nt, Human
ccugccccccagcc

SEQ ID NO: 2123383 - RNA, 18 nt, Human
ccuuugcaccuccaugga

SEQ ID NO: 2123384 - RNA, 16 nt, Human
acaugaacuuguaaag

SEQ ID NO: 2123385 - RNA, 15 nt, Human
agaauaccacaggaa

SEQ ID NO: 2123386 - RNA, 16 nt, Human
gcuuccauuguugucu

SEQ ID NO: 2123387 - RNA, 17 nt, Human
agccuccagcugccccg

SEQ ID NO: 2123388 - RNA, 13 nt, Human
agaaaugaaagca

SEQ ID NO: 2123389 - RNA, 13 nt, Human
caacucccugccc

SEQ ID NO: 2123390 - RNA, 16 nt, Human
cugagccucagucucc

SEQ ID NO: 2123391 - RNA, 14 nt, Human
uugaaauuguauua

SEQ ID NO: 2123392 - RNA, 12 nt, Human
aauuuuaaaaug

SEQ ID NO: 2123393 - RNA, 15 nt, Human
uuaaguauuuuauua

SEQ ID NO: 2123394 - RNA, 15 nt, Human
ugcagauaaacagua

SEQ ID NO: 2123395 - RNA, 15 nt, Human
auaggaaauauuuua

SEQ ID NO: 2123396 - RNA, 13 nt, Human
ugaaaaucuuaua

SEQ ID NO: 2123397 - RNA, 12 nt, Human
aucguguccccu

SEQ ID NO: 2123398 - RNA, 17 nt, Human
ugguucccuugaugaag

SEQ ID NO: 2123399 - RNA, 18 nt, Human
uuccuaauaaagcuucug

SEQ ID NO: 2123400 - RNA, 17 nt, Human
gaagauacugaaauaaa

SEQ ID NO: 2123401 - RNA, 14 nt, Human
cucaggcuggcacc

SEQ ID NO: 2123402 - RNA, 19 nt, Human
uauauuuuugugauuuugu

SEQ ID NO: 2123403 - RNA, 20 nt, Human
acagcccuucuuuccacaga

SEQ ID NO: 2123404 - RNA, 21 nt, Human
cugcgcucggccugcucgccc

SEQ ID NO: 2123405 - RNA, 11 nt, Human
agacacaugug

SEQ ID NO: 2123406 - RNA, 15 nt, Human
acucaacaaacauaa

SEQ ID NO: 2123407 - RNA, 17 nt, Human
ugaaauauuauuuuaua

SEQ ID NO: 2123408 - RNA, 14 nt, Human
ugcuguauuuuaaa

SEQ ID NO: 2123409 - RNA, 16 nt, Human
cuagaaccaccugccu

SEQ ID NO: 2123410 - RNA, 17 nt, Human
ccaaaaaucucaauauu

SEQ ID NO: 2123411 - RNA, 16 nt, Human
agucucuaucauuaaa

SEQ ID NO: 2123412 - RNA, 16 nt, Human
cagcuuuccucaaaac

SEQ ID NO: 2123413 - RNA, 21 nt, Human
cuccagggagucucagcuuca

SEQ ID NO: 2123414 - RNA, 23 nt, Human
gcgcuggcugcgcucggccugcu

SEQ ID NO: 2123415 - RNA, 11 nt, Human
cgauaaaagac

SEQ ID NO: 2123416 - RNA, 13 nt, Human
uuuuaaaaaagaa

SEQ ID NO: 2123417 - RNA, 19 nt, Human
aaugagcacgcauggaaaa

SEQ ID NO: 2123418 - RNA, 14 nt, Human
ccucggacggcucc

SEQ ID NO: 2123419 - RNA, 20 nt, Human
agccuuggggcugaugcagu

SEQ ID NO: 2123420 - RNA, 16 nt, Human
ucagcagagaaguuuu

SEQ ID NO: 2123421 - RNA, 12 nt, Human
cggccggcgcgc

SEQ ID NO: 2123422 - RNA, 16 nt, Human
ugaaguccaagcauuu

SEQ ID NO: 2123423 - RNA, 14 nt, Human
auaaauaaaaauaa

SEQ ID NO: 2123424 - RNA, 14 nt, Human
aaauauaaauaaaa

SEQ ID NO: 2123425 - RNA, 21 nt, Human
ugccuaggcauagcccugccu

SEQ ID NO: 2123426 - RNA, 18 nt, Human
auuuaggccaugggacag

SEQ ID NO: 2123427 - RNA, 16 nt, Human
cgcgcgcuccgcgcag

SEQ ID NO: 2123428 - RNA, 20 nt, Human
acaagacccaaaaggcagaa

SEQ ID NO: 2123429 - RNA, 19 nt, Human
caaggaugccccguccccc

SEQ ID NO: 2123430 - RNA, 22 nt, Human
uggacgagaaaacaauaacgau

SEQ ID NO: 2123431 - RNA, 12 nt, Human
uugggcaggcag

SEQ ID NO: 2123432 - RNA, 17 nt, Human
cguaaucguguccccua

SEQ ID NO: 2123433 - RNA, 15 nt, Human
aggcagauguuccua

SEQ ID NO: 2123434 - RNA, 18 nt, Human
aagggaauuucuucaacu

SEQ ID NO: 2123435 - RNA, 20 nt, Human
ugagcgcccacuagacccac

SEQ ID NO: 2123436 - RNA, 19 nt, Human
uaucacuugucaauaaaau

SEQ ID NO: 2123437 - RNA, 13 nt, Human
cccaaaaggcaga

SEQ ID NO: 2123438 - RNA, 18 nt, Human
ucuucaacucccugcccc

SEQ ID NO: 2123439 - RNA, 19 nt, Human
ugcacacagcacgggggcc

SEQ ID NO: 2123440 - RNA, 18 nt, Human
aaaguaacccuacaaaac

SEQ ID NO: 2123441 - RNA, 18 nt, Human
ccuuccuaauuccacagc

SEQ ID NO: 2123442 - RNA, 19 nt, Human
gacggagccgggaaagaag

SEQ ID NO: 2123443 - RNA, 19 nt, Human
gccccccagcccuccuuau

SEQ ID NO: 2123444 - RNA, 19 nt, Human
aguuguaauuuuuuugugg

SEQ ID NO: 2123445 - RNA, 22 nt, Human
aauuuaaaaaaaaaccugagcc

SEQ ID NO: 2123446 - RNA, 22 nt, Human
uauuucagauaaucacaauaca

SEQ ID NO: 2123447 - RNA, 15 nt, Human
auaucuuaucuuccu

SEQ ID NO: 2123448 - RNA, 14 nt, Human
acuuggucugugag

SEQ ID NO: 2123449 - RNA, 20 nt, Human
uaucuucacuuuuauaagaa

SEQ ID NO: 2123450 - RNA, 22 nt, Human
uaagaauucuguugauggaaau

SEQ ID NO: 2123451 - RNA, 23 nt, Human
ucaaugccccugaauuuaaauag

SEQ ID NO: 2123452 - RNA, 17 nt, Human
ccccuggccaaggaaga

SEQ ID NO: 2123453 - RNA, 13 nt, Human
cgcccucuggcug

SEQ ID NO: 2123454 - RNA, 20 nt, Human
aauaauuuuuauauuugaaa

SEQ ID NO: 2123455 - RNA, 17 nt, Human
ugcagcgaguacuuccc

SEQ ID NO: 2123456 - RNA, 19 nt, Human
ucucuaucauuaaaguucu

SEQ ID NO: 2123457 - RNA, 18 nt, Human
agcugcucaauaaaguac

SEQ ID NO: 2123458 - RNA, 20 nt, Human
uggauuuaauguggaaauga

SEQ ID NO: 2123459 - RNA, 18 nt, Human
gccccugcacuccagccu

SEQ ID NO: 2123460 - RNA, 16 nt, Human
gggccgacggagccgg

SEQ ID NO: 2123461 - RNA, 17 nt, Human
aacugccaucauuuacu

SEQ ID NO: 2123462 - RNA, 20 nt, Human
cuuauucacaagacccaaaa

SEQ ID NO: 2123463 - RNA, 13 nt, Human
aucaaugaaugaa

SEQ ID NO: 2123464 - RNA, 17 nt, Human
uuaaauggucaauuuug

SEQ ID NO: 2123465 - RNA, 17 nt, Human
aaauaacgauaaaagac

SEQ ID NO: 2123466 - RNA, 16 nt, Human
gagcaucaucuucugg

SEQ ID NO: 2123467 - RNA, 15 nt, Human
cgaagcaccaucauu

SEQ ID NO: 2123468 - RNA, 15 nt, Human
ugagcucaccagucc

SEQ ID NO: 2123469 - RNA, 17 nt, Human
agaacucccuuucaaca

SEQ ID NO: 2123470 - RNA, 18 nt, Human
uaauuuuaacucuauaau

SEQ ID NO: 2123471 - RNA, 17 nt, Human
gcgccuccgcuacuucc

SEQ ID NO: 2123472 - RNA, 22 nt, Human
uuaccucugccucagaaaacaa

SEQ ID NO: 2123473 - RNA, 17 nt, Human
uaugugcauauuuuauu

SEQ ID NO: 2123474 - RNA, 21 nt, Human
gaaaaguauguuagugcaaau

SEQ ID NO: 2123475 - RNA, 23 nt, Human
uagauaggucagugcaaauacuc

SEQ ID NO: 2123476 - RNA, 22 nt, Human
agcauuguuggcuguuccugca

SEQ ID NO: 2123477 - RNA, 13 nt, Human
uauuuauuuuaau

SEQ ID NO: 2123478 - RNA, 19 nt, Human
gcuuguauuccuuuuucuc

SEQ ID NO: 2123479 - RNA, 19 nt, Human
uggccacaucugagccccg

SEQ ID NO: 2123480 - RNA, 21 nt, Human
accaaggagccaaacauccua

SEQ ID NO: 2123481 - RNA, 17 nt, Human
ugaaauaagccagacau

SEQ ID NO: 2123482 - RNA, 14 nt, Human
agaaaugaaagcag

SEQ ID NO: 2123483 - RNA, 16 nt, Human
uaacaauaaaagacaa

SEQ ID NO: 2123484 - RNA, 19 nt, Human
gugaacuugguuuuaauua

SEQ ID NO: 2123485 - RNA, 13 nt, Human
agccucagucucc

SEQ ID NO: 2123486 - RNA, 15 nt, Human
aggaacuggugucuu

SEQ ID NO: 2123487 - RNA, 13 nt, Human
aaaauaacaauga

SEQ ID NO: 2123488 - RNA, 12 nt, Human
uauuuuuuucug

SEQ ID NO: 2123489 - RNA, 15 nt, Human
uggauuccucacuuu

SEQ ID NO: 2123490 - RNA, 23 nt, Human
aauguauucuuuuaguuuuuaaa

SEQ ID NO: 2123491 - RNA, 19 nt, Human
auuauuuuuuaaaaaaauu

SEQ ID NO: 2123492 - RNA, 13 nt, Human
uuuucuuuucauu

SEQ ID NO: 2123493 - RNA, 21 nt, Human
gcgcucaucccacccgcccac

SEQ ID NO: 2123494 - RNA, 22 nt, Human
gcauccuagucucuaucauuaa

SEQ ID NO: 2123495 - RNA, 22 nt, Human
gugccucaccccuugccauaau

SEQ ID NO: 2123496 - RNA, 17 nt, Human
cuccuaagaaggcaccu

SEQ ID NO: 2123497 - RNA, 16 nt, Human
cuuccucccuggaauc

SEQ ID NO: 2123498 - RNA, 21 nt, Human
ccaaauauaaauaaaaauaau

SEQ ID NO: 2123499 - RNA, 14 nt, Human
uacuaauuuuaaaa

SEQ ID NO: 2123500 - RNA, 21 nt, Human
aucuuguaaagguccuggcaa

SEQ ID NO: 2123501 - RNA, 16 nt, Human
gacuauuauauuucca

SEQ ID NO: 2123502 - RNA, 14 nt, Human
aaagagaacuucca

SEQ ID NO: 2123503 - RNA, 18 nt, Human
uuuuauaucaauuuaaaa

SEQ ID NO: 2123504 - RNA, 18 nt, Human
uagaauauauuuccuuau

SEQ ID NO: 2123505 - RNA, 18 nt, Human
aauaucaguuauuuuuaa

SEQ ID NO: 2123506 - RNA, 15 nt, Human
uaggaaauauuuauu

SEQ ID NO: 2123507 - RNA, 19 nt, Human
cucauggaauuggagcucg

SEQ ID NO: 2123508 - RNA, 16 nt, Human
cuucuggguuccuucc

SEQ ID NO: 2123509 - RNA, 17 nt, Human
cgcgcugcgcgccgcgc

SEQ ID NO: 2123510 - RNA, 18 nt, Human
auuuuuagugaaauauua

SEQ ID NO: 2123511 - RNA, 20 nt, Human
uauacugugugcuaaaacaa

SEQ ID NO: 2123512 - RNA, 20 nt, Human
ucuucagcagagaaguuuuc

SEQ ID NO: 2123513 - RNA, 15 nt, Human
uggacucaccucccc

SEQ ID NO: 2123514 - RNA, 23 nt, Human
gaaaacaauaacgauaaaagaca

SEQ ID NO: 2123515 - RNA, 22 nt, Human
uccgcauccuagucucuaucau

SEQ ID NO: 2123516 - RNA, 15 nt, Human
ugauaugugaacagu

SEQ ID NO: 2123517 - RNA, 16 nt, Human
gucuucaggggccaca

SEQ ID NO: 2123518 - RNA, 17 nt, Human
cauccuagucucuauca

SEQ ID NO: 2123519 - RNA, 20 nt, Human
aaaugauguuucauaagaau

SEQ ID NO: 2123520 - RNA, 12 nt, Human
caagaaggaaag

SEQ ID NO: 2123521 - RNA, 14 nt, Human
gucccaggcugagc

SEQ ID NO: 2123522 - RNA, 21 nt, Human
cuaaauugacacuuaaaaaug

SEQ ID NO: 2123523 - RNA, 14 nt, Human
aagucccugcugcc

SEQ ID NO: 2123524 - RNA, 14 nt, Human
acccgcccaccgca

SEQ ID NO: 2123525 - RNA, 14 nt, Human
gaaugauuaugaau

SEQ ID NO: 2123526 - RNA, 15 nt, Human
cucaacaaacauaau

SEQ ID NO: 2123527 - RNA, 17 nt, Human
uauauuguagauaauac

SEQ ID NO: 2123528 - RNA, 23 nt, Human
uuuauuaggaguaccauaauucu

SEQ ID NO: 2123529 - RNA, 16 nt, Human
uuauaauuuaaaauau

SEQ ID NO: 2123530 - RNA, 23 nt, Human
gggagccugaucaccugcccugc

SEQ ID NO: 2123531 - RNA, 21 nt, Human
cugaaauaaacgucuuaaaua

SEQ ID NO: 2123532 - RNA, 17 nt, Human
gauaaaagacagugaaa

SEQ ID NO: 2123533 - RNA, 16 nt, Human
gcauccuagucucuau

SEQ ID NO: 2123534 - RNA, 12 nt, Human
auucugaaagca

SEQ ID NO: 2123535 - RNA, 22 nt, Human
caaacaauuugaauauaaauuu

SEQ ID NO: 2123536 - RNA, 20 nt, Human
aauucuugccaaauauaaau

SEQ ID NO: 2123537 - RNA, 13 nt, Human
cggccgcgcugcg

SEQ ID NO: 2123538 - RNA, 15 nt, Human
guccuugcugcaccu

SEQ ID NO: 2123539 - RNA, 13 nt, Human
caauaaagaguuc

SEQ ID NO: 2123540 - RNA, 23 nt, Human
acuggcuaauuagcauggccaca

SEQ ID NO: 2123541 - RNA, 17 nt, Human
agugagacagcucugca

SEQ ID NO: 2123542 - RNA, 23 nt, Human
aacuccugcuagaacagucucuu

SEQ ID NO: 2123543 - RNA, 17 nt, Human
gaagaccucauuuugaa

SEQ ID NO: 2123544 - RNA, 15 nt, Human
auauaaauaaaaaua

SEQ ID NO: 2123545 - RNA, 22 nt, Human
cauaaauguugacaugggacau

SEQ ID NO: 2123546 - RNA, 19 nt, Human
aaaauaacgauaaaagaca

SEQ ID NO: 2123547 - RNA, 17 nt, Human
uccucugagccuuggga

SEQ ID NO: 2123548 - RNA, 15 nt, Human
agaaaacaauaacga

SEQ ID NO: 2123549 - RNA, 23 nt, Human
aggaugguucccuugaugaagaa

SEQ ID NO: 2123550 - RNA, 12 nt, Human
gcgagcgcgcgc

SEQ ID NO: 2123551 - RNA, 22 nt, Human
cagcccuggugggcagagaggu

SEQ ID NO: 2123552 - RNA, 12 nt, Human
ucaccccuugcc

SEQ ID NO: 2123553 - RNA, 14 nt, Human
auuguccaggucua

SEQ ID NO: 2123554 - RNA, 22 nt, Human
uagacacacaugaaguccaagc

SEQ ID NO: 2123555 - RNA, 13 nt, Human
caucccacccgcc

SEQ ID NO: 2123556 - RNA, 16 nt, Human
guuggcuguuccugca

SEQ ID NO: 2123557 - RNA, 16 nt, Human
ccuggugggcagagag

SEQ ID NO: 2123558 - RNA, 17 nt, Human
uaugccacaagaacccc

SEQ ID NO: 2123559 - RNA, 19 nt, Human
gacagucaccucauggaau

SEQ ID NO: 2123560 - RNA, 18 nt, Human
uaauuuuagacauucuuu

SEQ ID NO: 2123561 - RNA, 17 nt, Human
cccugcugcccuucccc

SEQ ID NO: 2123562 - RNA, 13 nt, Human
acaagagcuuaac

SEQ ID NO: 2123563 - RNA, 18 nt, Human
uguggucacaggaaguag

SEQ ID NO: 2123564 - RNA, 18 nt, Human
uuuguuaaaugauuucau

SEQ ID NO: 2123565 - RNA, 20 nt, Human
uaugcuucuguuuuauaauu

SEQ ID NO: 2123566 - RNA, 18 nt, Human
aagaccucauuuugaagg

SEQ ID NO: 2123567 - RNA, 17 nt, Human
cucgugggacagucacc

SEQ ID NO: 2123568 - RNA, 22 nt, Human
uaauucugguagcuaaauauau

SEQ ID NO: 2123569 - RNA, 17 nt, Human
cuggagggaagccuugg

SEQ ID NO: 2123570 - RNA, 17 nt, Human
cuauccuacuuccccuu

SEQ ID NO: 2123571 - RNA, 16 nt, Human
aucaaaagaaagaaaa

SEQ ID NO: 2123572 - RNA, 16 nt, Human
ccuaagugcagccccg

SEQ ID NO: 2123573 - RNA, 14 nt, Human
gcguugagccacca

SEQ ID NO: 2123574 - RNA, 21 nt, Human
cuccauggaaacgaagcacca

SEQ ID NO: 2123575 - RNA, 16 nt, Human
cuuggagacagggccc

SEQ ID NO: 2123576 - RNA, 16 nt, Human
agaauauauuuccuua

SEQ ID NO: 2123577 - RNA, 22 nt, Human
ugauugugggauacuauuuaau

SEQ ID NO: 2123578 - RNA, 15 nt, Human
augaauuaaguuuuu

SEQ ID NO: 2123579 - RNA, 13 nt, Human
gcgcucggccugc

SEQ ID NO: 2123580 - RNA, 12 nt, Human
caaccugccagc

SEQ ID NO: 2123581 - RNA, 18 nt, Human
auaggaaauauuuuaaug

SEQ ID NO: 2123582 - RNA, 13 nt, Human
ucuacuaaaaaua

SEQ ID NO: 2123583 - RNA, 18 nt, Human
auguuccuaauaaagcuu

SEQ ID NO: 2123584 - RNA, 12 nt, Human
caccuccuaaga

SEQ ID NO: 2123585 - RNA, 23 nt, Human
cuagucuguuuucccuccuugga

SEQ ID NO: 2123586 - RNA, 17 nt, Human
uaugcuauugaaguuuu

SEQ ID NO: 2123587 - RNA, 16 nt, Human
ugagcucagcccuggu

SEQ ID NO: 2123588 - RNA, 22 nt, Human
uauaagaaauaggaaauauuuu

SEQ ID NO: 2123589 - RNA, 17 nt, Human
augcuguucaugaaaga

SEQ ID NO: 2123590 - RNA, 13 nt, Human
augcuagaacucc

SEQ ID NO: 2123591 - RNA, 23 nt, Human
ggucuaucuuugagcgcccacua

SEQ ID NO: 2123592 - RNA, 20 nt, Human
cuuccccucugcagcuucca

SEQ ID NO: 2123593 - RNA, 20 nt, Human
aggugacuauuauauuucca

SEQ ID NO: 2123594 - RNA, 18 nt, Human
ccucuggcuccagcuggc

SEQ ID NO: 2123595 - RNA, 15 nt, Human
ugagcucagcccugg

SEQ ID NO: 2123596 - RNA, 21 nt, Human
gcuccgcgcagcucaggcugg

SEQ ID NO: 2123597 - RNA, 17 nt, Human
ccugucgguuuauucac

SEQ ID NO: 2123598 - RNA, 17 nt, Human
cuaagcuucacuguaaa

SEQ ID NO: 2123599 - RNA, 13 nt, Human
gcucucuggccuu

SEQ ID NO: 2123600 - RNA, 14 nt, Human
uaaaauccauacau

SEQ ID NO: 2123601 - RNA, 20 nt, Human
cgcucggccugcucgcccac

SEQ ID NO: 2123602 - RNA, 17 nt, Human
aaagacaaggaaaaaau

SEQ ID NO: 2123603 - RNA, 13 nt, Human
cuaggcauagccc

SEQ ID NO: 2123604 - RNA, 21 nt, Human
ggcaccgcuguacgcgagcgc

SEQ ID NO: 2123605 - RNA, 13 nt, Human
aguuguaauuuuu

SEQ ID NO: 2123606 - RNA, 14 nt, Human
agauguagaggaga

SEQ ID NO: 2123607 - RNA, 14 nt, Human
agcucaccaguccc

SEQ ID NO: 2123608 - RNA, 16 nt, Human
ccacuuggucugugag

SEQ ID NO: 2123609 - RNA, 23 nt, Human
uauuuuauuaggaguaccauaau

SEQ ID NO: 2123610 - RNA, 14 nt, Human
aacgauaaaagaca

SEQ ID NO: 2123611 - RNA, 16 nt, Human
gcagcaucagcauccc

SEQ ID NO: 2123612 - RNA, 17 nt, Human
auaucuuaucuuccuau

SEQ ID NO: 2123613 - RNA, 20 nt, Human
accgcuguacgcgagcgcgc

SEQ ID NO: 2123614 - RNA, 13 nt, Human
aaaugaaagcagg

SEQ ID NO: 2123615 - RNA, 20 nt, Human
uuguaggugacuauuauauu

SEQ ID NO: 2123616 - RNA, 22 nt, Human
aaacauccuacaagacacagug

SEQ ID NO: 2123617 - RNA, 12 nt, Human
uucagccugaaa

SEQ ID NO: 2123618 - RNA, 13 nt, Human
aauuuuuauauuu

SEQ ID NO: 2123619 - RNA, 14 nt, Human
caaggcuagaacca

SEQ ID NO: 2123620 - RNA, 13 nt, Human
acaagaaggaaag

SEQ ID NO: 2123621 - RNA, 19 nt, Human
auuuucaguuauuauauuu

SEQ ID NO: 2123622 - RNA, 14 nt, Human
ucccacccgcccac

SEQ ID NO: 2123623 - RNA, 17 nt, Human
cuaauaucuuaucuucc

SEQ ID NO: 2123624 - RNA, 18 nt, Human
gcuccgcgcagcucaggc

SEQ ID NO: 2123625 - RNA, 13 nt, Human
ugagcgacaguga

SEQ ID NO: 2123626 - RNA, 11 nt, Human
aauuuaaauau

SEQ ID NO: 2123627 - RNA, 13 nt, Human
cucagaaaacaag

SEQ ID NO: 2123628 - RNA, 23 nt, Human
cugagaaggcuguggauuuaaug

SEQ ID NO: 2123629 - RNA, 12 nt, Human
gacgagaaaaca

SEQ ID NO: 2123630 - RNA, 21 nt, Human
uuacaaugcauucugagguaa

SEQ ID NO: 2123631 - RNA, 15 nt, Human
uaacaauaaaagaca

SEQ ID NO: 2123632 - RNA, 21 nt, Human
uacauaaauuuaguauuuugu

SEQ ID NO: 2123633 - RNA, 16 nt, Human
ugugcauauuuuauua

SEQ ID NO: 2123634 - RNA, 23 nt, Human
cagcugccccggggaggggcgcu

SEQ ID NO: 2123635 - RNA, 19 nt, Human
acuaucucauuuccaagca

SEQ ID NO: 2123636 - RNA, 13 nt, Human
agcugccucucuc

SEQ ID NO: 2123637 - RNA, 23 nt, Human
uguucccuggggcuuuaacuccu

SEQ ID NO: 2123638 - RNA, 21 nt, Human
caucucagguguguugcagug

SEQ ID NO: 2123639 - RNA, 15 nt, Human
uuuagugaaauauua

SEQ ID NO: 2123640 - RNA, 18 nt, Human
acaaaaggauaaugaaua

SEQ ID NO: 2123641 - RNA, 16 nt, Human
aaaagcuccauuuuua

SEQ ID NO: 2123642 - RNA, 18 nt, Human
uuucucugauacagaaaa

SEQ ID NO: 2123643 - RNA, 13 nt, Human
aaacauccuacaa

SEQ ID NO: 2123644 - RNA, 14 nt, Human
ggaaagaagagccg

SEQ ID NO: 2123645 - RNA, 15 nt, Human
auauuuuuuguuaaa

SEQ ID NO: 2123646 - RNA, 13 nt, Human
aacgucacaucuu

SEQ ID NO: 2123647 - RNA, 13 nt, Human
auugucuagugaa

SEQ ID NO: 2123648 - RNA, 17 nt, Human
aaccuucugaggagcug

SEQ ID NO: 2123649 - RNA, 16 nt, Human
ucuuauaauuuaaaau

SEQ ID NO: 2123650 - RNA, 17 nt, Human
agccgggaaagaagagc

SEQ ID NO: 2123651 - RNA, 23 nt, Human
aucacagcuacuugggaggcuga

SEQ ID NO: 2123652 - RNA, 16 nt, Human
aaagcuacuuauugua

SEQ ID NO: 2123653 - RNA, 20 nt, Human
ugaaaaucuuauaauuuaaa

SEQ ID NO: 2123654 - RNA, 14 nt, Human
auuucuaugaaaua

SEQ ID NO: 2123655 - RNA, 20 nt, Human
acuuuauuuucuauaauuua

SEQ ID NO: 2123656 - RNA, 18 nt, Human
ugcauagguuuaauaauu

SEQ ID NO: 2123657 - RNA, 16 nt, Human
agcuaaauauauauuu

SEQ ID NO: 2123658 - RNA, 17 nt, Human
caccugcugagccccaa

SEQ ID NO: 2123659 - RNA, 23 nt, Human
ucccgcuguuccucgccacgcuc

SEQ ID NO: 2123660 - RNA, 22 nt, Human
caaauuuacagagacagaaagc

SEQ ID NO: 2123661 - RNA, 20 nt, Human
aagucacauuccugaacagg

SEQ ID NO: 2123662 - RNA, 22 nt, Human
ugaccauacuaauuauaccccc

SEQ ID NO: 2123663 - RNA, 16 nt, Human
uaaaagacaaggaaaa

SEQ ID NO: 2123664 - RNA, 17 nt, Human
guucgcgcgccuccgcu

SEQ ID NO: 2123665 - RNA, 18 nt, Human
agccugaucaccugcccu

SEQ ID NO: 2123666 - RNA, 23 nt, Human
ucuagcaugucgucaaagcugaa

SEQ ID NO: 2123667 - RNA, 21 nt, Human
auacuauuuaauuauuucacu

SEQ ID NO: 2123668 - RNA, 15 nt, Human
agucaccucauggaa

SEQ ID NO: 2123669 - RNA, 16 nt, Human
uggcaagcucuaucac

SEQ ID NO: 2123670 - RNA, 19 nt, Human
ccccuucccacacugucca

SEQ ID NO: 2123671 - RNA, 17 nt, Human
gcugccucucucaucca

SEQ ID NO: 2123672 - RNA, 14 nt, Human
ugacuauuauauuu

SEQ ID NO: 2123673 - RNA, 22 nt, Human
cgugcuugucccuguggaagua

SEQ ID NO: 2123674 - RNA, 14 nt, Human
cauuuacuuuuaaa

SEQ ID NO: 2123675 - RNA, 23 nt, Human
gguggcgcuggcugcgcucggcc

SEQ ID NO: 2123676 - RNA, 19 nt, Human
uaguuuaugauuccaccua

SEQ ID NO: 2123677 - RNA, 11 nt, Human
aauuuaaauag

SEQ ID NO: 2123678 - RNA, 22 nt, Human
uggaagccagaucuaugccaca

SEQ ID NO: 2123679 - RNA, 14 nt, Human
cacuguccauucuu

SEQ ID NO: 2123680 - RNA, 17 nt, Human
cauuuguauaaaauaau

SEQ ID NO: 2123681 - RNA, 15 nt, Human
uuuaguauuuuguuu

SEQ ID NO: 2123682 - RNA, 16 nt, Human
aacuugguuuuaauua

SEQ ID NO: 2123683 - RNA, 20 nt, Human
auguuucuuggggaauaugu

SEQ ID NO: 2123684 - RNA, 14 nt, Human
uugggaaaaaguaa

SEQ ID NO: 2123685 - RNA, 11 nt, Human
ccacaucugag

SEQ ID NO: 2123686 - RNA, 20 nt, Human
ggagccugaucaccugcccu

SEQ ID NO: 2123687 - RNA, 19 nt, Human
uguuggacgagaaaacaau

SEQ ID NO: 2123688 - RNA, 22 nt, Human
ggggugguuuucccaucucagg

SEQ ID NO: 2123689 - RNA, 20 nt, Human
acaugagguacugagaguga

SEQ ID NO: 2123690 - RNA, 14 nt, Human
cucccuuggggccu

SEQ ID NO: 2123691 - RNA, 19 nt, Human
agagccuuuuuuugaaaaa

SEQ ID NO: 2123692 - RNA, 19 nt, Human
auuaaguuuuuuuuuaaaa

SEQ ID NO: 2123693 - RNA, 17 nt, Human
acccacuggacucaccu

SEQ ID NO: 2123694 - RNA, 13 nt, Human
uauauauuuuuuu

SEQ ID NO: 2123695 - RNA, 21 nt, Human
aggaagaucccuuuguccaca

SEQ ID NO: 2123696 - RNA, 17 nt, Human
uccauucuuccucccau

SEQ ID NO: 2123697 - RNA, 17 nt, Human
guccaaagggcaugggu

SEQ ID NO: 2123698 - RNA, 17 nt, Human
uuuaaaaaaaaaacgua

SEQ ID NO: 2123699 - RNA, 22 nt, Human
ugugagcucaccagucccuccc

SEQ ID NO: 2123700 - RNA, 11 nt, Human
ccugagcccca

SEQ ID NO: 2123701 - RNA, 17 nt, Human
ccugcugcccuuccccu

SEQ ID NO: 2123702 - RNA, 16 nt, Human
ucagucucccucccuu

SEQ ID NO: 2123703 - RNA, 19 nt, Human
cucuaaauucuuucauuuu

SEQ ID NO: 2123704 - RNA, 16 nt, Human
caaguaaaaggaaaug

SEQ ID NO: 2123705 - RNA, 22 nt, Human
cuggagacauugaggcaggcac

SEQ ID NO: 2123706 - RNA, 21 nt, Human
acagcccuucuuuccacagaa

SEQ ID NO: 2123707 - RNA, 19 nt, Human
ggagcuggaaacacauguu

SEQ ID NO: 2123708 - RNA, 18 nt, Human
ucaacucauauuuucaug

SEQ ID NO: 2123709 - RNA, 21 nt, Human
cagcucaggcuggcaccgcug

SEQ ID NO: 2123710 - RNA, 21 nt, Human
cauucaaauguauuacagugg

SEQ ID NO: 2123711 - RNA, 16 nt, Human
agauagaugaagaagc

SEQ ID NO: 2123712 - RNA, 16 nt, Human
uagaaaacaggcaaau

SEQ ID NO: 2123713 - RNA, 23 nt, Human
ugccccggggaggggcgcucgcu

SEQ ID NO: 2123714 - RNA, 13 nt, Human
accaacacccuga

SEQ ID NO: 2123715 - RNA, 18 nt, Human
cuguuuucccuccuugga

SEQ ID NO: 2123716 - RNA, 16 nt, Human
ucucuaggaaauauuu

SEQ ID NO: 2123717 - RNA, 14 nt, Human
gcucgcccacuucc

SEQ ID NO: 2123718 - RNA, 18 nt, Human
aauuuuuuugugggaaau

SEQ ID NO: 2123719 - RNA, 12 nt, Human
aguuauaaaaau

SEQ ID NO: 2123720 - RNA, 14 nt, Human
gcugcccuuccccu

SEQ ID NO: 2123721 - RNA, 13 nt, Human
uacuuuauuuucu

SEQ ID NO: 2123722 - RNA, 20 nt, Human
gcgcugcgcgccgcgcuccu

SEQ ID NO: 2123723 - RNA, 23 nt, Human
aaaauaucacuugucaauaaaau

SEQ ID NO: 2123724 - RNA, 18 nt, Human
uggcucuggacaggcacu

SEQ ID NO: 2123725 - RNA, 20 nt, Human
uuaaauggucaauuuuguua

SEQ ID NO: 2123726 - RNA, 18 nt, Human
cugcugcccuuccccuuc

SEQ ID NO: 2123727 - RNA, 15 nt, Human
agguguguugcagug

SEQ ID NO: 2123728 - RNA, 18 nt, Human
ugaacuugguuuuaauua

SEQ ID NO: 2123729 - RNA, 19 nt, Human
ugaaaccaaaccagagccu

SEQ ID NO: 2123730 - RNA, 14 nt, Human
uaaauuuaucauuu

SEQ ID NO: 2123731 - RNA, 21 nt, Human
gauaaaagacagugaaagaaa

SEQ ID NO: 2123732 - RNA, 16 nt, Human
acuaguuucccuugca

SEQ ID NO: 2123733 - RNA, 17 nt, Human
ccugugccguccccaga

SEQ ID NO: 2123734 - RNA, 21 nt, Human
ugaauuguaggugacuauuau

SEQ ID NO: 2123735 - RNA, 15 nt, Human
cuuaagaagacugca

SEQ ID NO: 2123736 - RNA, 20 nt, Human
cagugaaagaaaauaacgau

SEQ ID NO: 2123737 - RNA, 21 nt, Human
gaugcccacggcuggagcugc

SEQ ID NO: 2123738 - RNA, 14 nt, Human
aaaggaauuuaaaa

SEQ ID NO: 2123739 - RNA, 24 nt, Human
cauaugaaaaggcuaagcuucacu

SEQ ID NO: 2123740 - RNA, 16 nt, Human
ggcauggguuuuauua

SEQ ID NO: 2123741 - RNA, 15 nt, Human
gacucaccuccccca

SEQ ID NO: 2123742 - RNA, 21 nt, Human
ccuagucucuaucauuaaagu

SEQ ID NO: 2123743 - RNA, 12 nt, Human
cuugguuuuaau

SEQ ID NO: 2123744 - RNA, 14 nt, Human
uauaucuauauuuu

SEQ ID NO: 2123745 - RNA, 15 nt, Human
aagaagugaaaaucu

SEQ ID NO: 2123746 - RNA, 14 nt, Human
aacuuugauuuuau

SEQ ID NO: 2123747 - RNA, 15 nt, Human
aagccuccuuuuaaa

SEQ ID NO: 2123748 - RNA, 13 nt, Human
gugagcaucaucu

SEQ ID NO: 2123749 - RNA, 16 nt, Human
ucugcagauaaacagu

SEQ ID NO: 2123750 - RNA, 18 nt, Human
uggucaauuuuguuaugu

SEQ ID NO: 2123751 - RNA, 15 nt, Human
ggccuccauccugag

SEQ ID NO: 2123752 - RNA, 15 nt, Human
agcaccaucauuccc

SEQ ID NO: 2123753 - RNA, 16 nt, Human
guugagguaccuccaa

SEQ ID NO: 2123754 - RNA, 19 nt, Human
caggcagauguuccuaaua

SEQ ID NO: 2123755 - RNA, 17 nt, Human
aguauuucuaugaaaua

SEQ ID NO: 2123756 - RNA, 20 nt, Human
uaaaagacaaggaaaaaaua

SEQ ID NO: 2123757 - RNA, 20 nt, Human
aaaaucuuauaauuuaaaau

SEQ ID NO: 2123758 - RNA, 15 nt, Human
ugggacagggaggac

SEQ ID NO: 2123759 - RNA, 14 nt, Human
ccuuaucaaaggac

SEQ ID NO: 2123760 - RNA, 12 nt, Human
uaaaugcucaau

SEQ ID NO: 2123761 - RNA, 20 nt, Human
cuauguagaauauauuuccu

SEQ ID NO: 2123762 - RNA, 16 nt, Human
agugucaaugcagccc

SEQ ID NO: 2123763 - RNA, 17 nt, Human
uuaauaauuuuuaauua

SEQ ID NO: 2123764 - RNA, 22 nt, Human
ccuuccccucugcagcuuccag

SEQ ID NO: 2123765 - RNA, 22 nt, Human
ucugguagcuaaauauauauuu

SEQ ID NO: 2123766 - RNA, 21 nt, Human
gacagugaaagaaaauaacaa

SEQ ID NO: 2123767 - RNA, 21 nt, Human
ccuuccccucugcagcuucca

SEQ ID NO: 2123768 - RNA, 16 nt, Human
ucaaaagaaagaaaau

SEQ ID NO: 2123769 - RNA, 17 nt, Human
aagcuuccauuguuguc

SEQ ID NO: 2123770 - RNA, 18 nt, Human
aggaaaaaauaacaauga

SEQ ID NO: 2123771 - RNA, 22 nt, Human
cggagccgggaaagaagagccg

SEQ ID NO: 2123772 - RNA, 15 nt, Human
gcugcgcucggccug

SEQ ID NO: 2123773 - RNA, 12 nt, Human
cuccaaggaccg

SEQ ID NO: 2123774 - RNA, 16 nt, Human
acuaaacaaagaguga

SEQ ID NO: 2123775 - RNA, 14 nt, Human
auaaaauaauuuuu

SEQ ID NO: 2123776 - RNA, 13 nt, Human
ugauuauauguca

SEQ ID NO: 2123777 - RNA, 23 nt, Human
cuuauuguagcauccuggaauau

SEQ ID NO: 2123778 - RNA, 17 nt, Human
aagacaaggaaaaaaua

SEQ ID NO: 2123779 - RNA, 23 nt, Human
uuauagcuacuaauuuuaaaaug

SEQ ID NO: 2123780 - RNA, 15 nt, Human
cuacuaauuuuaaaa

SEQ ID NO: 2123781 - RNA, 18 nt, Human
caagcuaugugagcucac

SEQ ID NO: 2123782 - RNA, 22 nt, Human
aacucccugccccccagcccuc

SEQ ID NO: 2123783 - RNA, 18 nt, Human
aguccauugggcaggcag

SEQ ID NO: 2123784 - RNA, 14 nt, Human
auacaaaaaaaaaa

SEQ ID NO: 2123785 - RNA, 15 nt, Human
guugaagagguuuua

SEQ ID NO: 2123786 - RNA, 13 nt, Human
ccucauggaauug

SEQ ID NO: 2123787 - RNA, 14 nt, Human
cugcugagucccag

SEQ ID NO: 2123788 - RNA, 16 nt, Human
acuguauguccuuggu

SEQ ID NO: 2123789 - RNA, 12 nt, Human
ccuucagccuga

SEQ ID NO: 2123790 - RNA, 12 nt, Human
ugagagacacac

SEQ ID NO: 2123791 - RNA, 18 nt, Human
uaggugacuauuauauuu

SEQ ID NO: 2123792 - RNA, 20 nt, Human
uccagccugagcgacaguga

SEQ ID NO: 2123793 - RNA, 16 nt, Human
ugcauagguuuaauaa

SEQ ID NO: 2123794 - RNA, 22 nt, Human
agcuaaugaaguguuuagcaua

SEQ ID NO: 2123795 - RNA, 21 nt, Human
aaauaauuuuuauauuugaaa

SEQ ID NO: 2123796 - RNA, 18 nt, Human
ugugcauauuuuauuaua

SEQ ID NO: 2123797 - RNA, 14 nt, Human
auguagaauauauu

SEQ ID NO: 2123798 - RNA, 15 nt, Human
aauuauuucacuuua

SEQ ID NO: 2123799 - RNA, 19 nt, Human
uguuugccgcuuaagcuuu

SEQ ID NO: 2123800 - RNA, 16 nt, Human
aaauauuccuuaagau

SEQ ID NO: 2123801 - RNA, 14 nt, Human
acccgggaggcaga

SEQ ID NO: 2123802 - RNA, 18 nt, Human
gaggcuccacuuggucug

SEQ ID NO: 2123803 - RNA, 18 nt, Human
caagccucauguccacug

SEQ ID NO: 2123804 - RNA, 21 nt, Human
aaaagguauuuuaaucaccaa

SEQ ID NO: 2123805 - RNA, 15 nt, Human
aaauguauucuuuua

SEQ ID NO: 2123806 - RNA, 14 nt, Human
auuuauuuuaauaa

SEQ ID NO: 2123807 - RNA, 13 nt, Human
uuucuaaaaguuu

SEQ ID NO: 2123808 - RNA, 13 nt, Human
cuugcugcaccug

SEQ ID NO: 2123809 - RNA, 21 nt, Human
aguuguugcccacagcuguau

SEQ ID NO: 2123810 - RNA, 12 nt, Human
accccugagcuu

SEQ ID NO: 2123811 - RNA, 14 nt, Human
ggaaguagaggagg

SEQ ID NO: 2123812 - RNA, 17 nt, Human
cuaguuguaauuuuuuu

SEQ ID NO: 2123813 - RNA, 15 nt, Human
gaccacugcagaaga

SEQ ID NO: 2123814 - RNA, 21 nt, Human
gacugcuaguuuauauagaaa

SEQ ID NO: 2123815 - RNA, 22 nt, Human
aggcuccacuuggucugugaga

SEQ ID NO: 2123816 - RNA, 14 nt, Human
aagagugaaggauu

SEQ ID NO: 2123817 - RNA, 19 nt, Human
cucuugaggcacagaaacu

SEQ ID NO: 2123818 - RNA, 19 nt, Human
accccugagcuugcagaga

SEQ ID NO: 2123819 - RNA, 13 nt, Human
aauuauuucacuu

SEQ ID NO: 2123820 - RNA, 20 nt, Human
aagaugguaccaccagucug

SEQ ID NO: 2123821 - RNA, 19 nt, Human
ccaaggcccccgggccgac

SEQ ID NO: 2123822 - RNA, 21 nt, Human
agucucccucccuuggggccu

SEQ ID NO: 2123823 - RNA, 20 nt, Human
cgcauccuagucucuaucau

SEQ ID NO: 2123824 - RNA, 16 nt, Human
aacaauuugaauauaa

SEQ ID NO: 2123825 - RNA, 23 nt, Human
cacacuguccauucuuccuccca

SEQ ID NO: 2123826 - RNA, 14 nt, Human
cagauccuggaaau

SEQ ID NO: 2123827 - RNA, 20 nt, Human
gagcaucaucuucuggguua

SEQ ID NO: 2123828 - RNA, 14 nt, Human
ucccuugaugaaga

SEQ ID NO: 2123829 - RNA, 21 nt, Human
ugccuguaaucacagcuacuu

SEQ ID NO: 2123830 - RNA, 13 nt, Human
cccuuccccuucc

SEQ ID NO: 2123831 - RNA, 15 nt, Human
acaggguuuauguuu

SEQ ID NO: 2123832 - RNA, 13 nt, Human
uuuugaaucauca

SEQ ID NO: 2123833 - RNA, 22 nt, Human
acagauuugagcucagcccugg

SEQ ID NO: 2123834 - RNA, 22 nt, Human
gcuccuccagggagucucagcu

SEQ ID NO: 2123835 - RNA, 18 nt, Human
uuuugugggaaauccaca

SEQ ID NO: 2123836 - RNA, 14 nt, Human
auccaaugaaauga

SEQ ID NO: 2123837 - RNA, 16 nt, Human
ccuucccacacugucc

SEQ ID NO: 2123838 - RNA, 16 nt, Human
aauugacccacaagaa

SEQ ID NO: 2123839 - RNA, 14 nt, Human
ggccuucggccucc

SEQ ID NO: 2123840 - RNA, 14 nt, Human
cagauuugagcuca

SEQ ID NO: 2123841 - RNA, 11 nt, Human
gccuccagcug

SEQ ID NO: 2123842 - RNA, 22 nt, Human
gaaauaagccagacaucaacag

SEQ ID NO: 2123843 - RNA, 22 nt, Human
cuccugccuaagugcagccccg

SEQ ID NO: 2123844 - RNA, 20 nt, Human
gcgcggggcggggagcgagc

SEQ ID NO: 2123845 - RNA, 18 nt, Human
aguauuuuguuucagugc

SEQ ID NO: 2123846 - RNA, 13 nt, Human
aagugcagccccg

SEQ ID NO: 2123847 - RNA, 12 nt, Human
cgcgccuccgcu

SEQ ID NO: 2123848 - RNA, 23 nt, Human
ugaauuacauuuguauaaaauaa

SEQ ID NO: 2123849 - RNA, 21 nt, Human
acucuuauaucuauauuuuac

SEQ ID NO: 2123850 - RNA, 22 nt, Human
gaauuaaguuuuuuuuuaaaaa

SEQ ID NO: 2123851 - RNA, 17 nt, Human
aagacagugaaagaaaa

SEQ ID NO: 2123852 - RNA, 17 nt, Human
gaucuggcucuggacag

SEQ ID NO: 2123853 - RNA, 16 nt, Human
ccacuuauaggaauug

SEQ ID NO: 2123854 - RNA, 15 nt, Human
cgcauccuagucucu

SEQ ID NO: 2123855 - RNA, 21 nt, Human
caagacugcacaucaaaauau

SEQ ID NO: 2123856 - RNA, 20 nt, Human
ugccccccagcccuccuuau

SEQ ID NO: 2123857 - RNA, 17 nt, Human
ucuggaggucucugaac

SEQ ID NO: 2123858 - RNA, 16 nt, Human
ccauuuuuagugaaau

SEQ ID NO: 2123859 - RNA, 17 nt, Human
gcaugguuuagaaagcu

SEQ ID NO: 2123860 - RNA, 17 nt, Human
cccacuagacccacugg

SEQ ID NO: 2123861 - RNA, 22 nt, Human
cggggagcgagccccaggcggg

SEQ ID NO: 2123862 - RNA, 17 nt, Human
uccucacuuugaagagu

SEQ ID NO: 2123863 - RNA, 15 nt, Human
ucugcagauaaacag

SEQ ID NO: 2123864 - RNA, 16 nt, Human
ugacaagcucacagac

SEQ ID NO: 2123865 - RNA, 15 nt, Human
ugaaauuguauuaca

SEQ ID NO: 2123866 - RNA, 15 nt, Human
uaguauggcaaacug

SEQ ID NO: 2123867 - RNA, 23 nt, Human
aucauuaaaguucuagugaccga

SEQ ID NO: 2123868 - RNA, 18 nt, Human
uccucgccacgcucuggg

SEQ ID NO: 2123869 - RNA, 21 nt, Human
gauuauauauauuuuuuucug

SEQ ID NO: 2123870 - RNA, 18 nt, Human
cugagccuugggaccccu

SEQ ID NO: 2123871 - RNA, 19 nt, Human
cggggcggggagcgagccc

SEQ ID NO: 2123872 - RNA, 15 nt, Human
guccauucuuccucc

SEQ ID NO: 2123873 - RNA, 13 nt, Human
aguguuugaaagc

SEQ ID NO: 2123874 - RNA, 17 nt, Human
cucccuggaaucuugua

SEQ ID NO: 2123875 - RNA, 12 nt, Human
aaggaugccccg

SEQ ID NO: 2123876 - RNA, 12 nt, Human
aguguuugaaag

SEQ ID NO: 2123877 - RNA, 22 nt, Human
agucauucagauaugauucaaa

SEQ ID NO: 2123878 - RNA, 18 nt, Human
guuaguauuguccagguc

SEQ ID NO: 2123879 - RNA, 16 nt, Human
agguacuucaaauccu

SEQ ID NO: 2123880 - RNA, 14 nt, Human
caucauuuacuuuu

SEQ ID NO: 2123881 - RNA, 15 nt, Human
cuacaagacacagug

SEQ ID NO: 2123882 - RNA, 16 nt, Human
uuaaauagcuuuuuuc

SEQ ID NO: 2123883 - RNA, 15 nt, Human
acucaccucccccau

SEQ ID NO: 2123884 - RNA, 16 nt, Human
guccauucuuccuccc

SEQ ID NO: 2123885 - RNA, 21 nt, Human
auuuaauagguuuggacaaaa

SEQ ID NO: 2123886 - RNA, 14 nt, Human
ggaccaucccggcc

SEQ ID NO: 2123887 - RNA, 16 nt, Human
uauguucuaagaagug

SEQ ID NO: 2123888 - RNA, 16 nt, Human
ugccucaccccuugcc

SEQ ID NO: 2123889 - RNA, 22 nt, Human
gcccacggcuggagcugccucu

SEQ ID NO: 2123890 - RNA, 15 nt, Human
ucccccaucucuucu

SEQ ID NO: 2123891 - RNA, 14 nt, Human
uaaaguaugugcau

SEQ ID NO: 2123892 - RNA, 14 nt, Human
acccugaggugagc

SEQ ID NO: 2123893 - RNA, 21 nt, Human
auuauauuuauuacuguaaga

SEQ ID NO: 2123894 - RNA, 19 nt, Human
guaaagcuuugugcagauu

SEQ ID NO: 2123895 - RNA, 19 nt, Human
cuguuauuuuaucugcuau

SEQ ID NO: 2123896 - RNA, 22 nt, Human
ccauacuaauuauacccccugc

SEQ ID NO: 2123897 - RNA, 14 nt, Human
auauauuuuagaua

SEQ ID NO: 2123898 - RNA, 18 nt, Human
acuggacucaccuccccc

SEQ ID NO: 2123899 - RNA, 20 nt, Human
cuguccauucuuccucccau

SEQ ID NO: 2123900 - RNA, 19 nt, Human
auuuucuauaauuuaaaua

SEQ ID NO: 2123901 - RNA, 21 nt, Human
gcauggccacaucugagcccc

SEQ ID NO: 2123902 - RNA, 13 nt, Human
ccuuugcaccucc

SEQ ID NO: 2123903 - RNA, 15 nt, Human
cugcccuuccccuuc

SEQ ID NO: 2123904 - RNA, 15 nt, Human
aaaacaggcaaauuc

SEQ ID NO: 2123905 - RNA, 17 nt, Human
uucugagcauuuaauau

SEQ ID NO: 2123906 - RNA, 13 nt, Human
uguccacaaguaa

SEQ ID NO: 2123907 - RNA, 14 nt, Human
agagguccacaaca

SEQ ID NO: 2123908 - RNA, 20 nt, Human
aaagacaaggaaaaaauaac

SEQ ID NO: 2123909 - RNA, 14 nt, Human
gccucagucucccu

SEQ ID NO: 2123910 - RNA, 12 nt, Human
aucauuuacuuu

SEQ ID NO: 2123911 - RNA, 18 nt, Human
aaagagugaaggauuuau

SEQ ID NO: 2123912 - RNA, 21 nt, Human
uuauguuuaauucugaaagca

SEQ ID NO: 2123913 - RNA, 21 nt, Human
uugccuaggcauagcccugcc

SEQ ID NO: 2123914 - RNA, 19 nt, Human
ugcucgcccacuuccuccc

SEQ ID NO: 2123915 - RNA, 16 nt, Human
ggcagagagguaggga

SEQ ID NO: 2123916 - RNA, 15 nt, Human
cauguccacugguuc

SEQ ID NO: 2123917 - RNA, 13 nt, Human
gcuguacgcgagc

SEQ ID NO: 2123918 - RNA, 15 nt, Human
ucugucucaguccau

SEQ ID NO: 2123919 - RNA, 15 nt, Human
ucuauauuuuacaua

SEQ ID NO: 2123920 - RNA, 13 nt, Human
uaacaauaaaaga

SEQ ID NO: 2123921 - RNA, 22 nt, Human
aaaugauguuucauaagaauuc

SEQ ID NO: 2123922 - RNA, 13 nt, Human
uaccccuggccaa

SEQ ID NO: 2123923 - RNA, 17 nt, Human
agaaucacuugaacccg

SEQ ID NO: 2123924 - RNA, 18 nt, Human
agucuucagcagagaagu

SEQ ID NO: 2123925 - RNA, 20 nt, Human
cugccgugggccugagacca

SEQ ID NO: 2123926 - RNA, 13 nt, Human
aguguuuagcaua

SEQ ID NO: 2123927 - RNA, 11 nt, Human
accauuuuuac

SEQ ID NO: 2123928 - RNA, 15 nt, Human
uccagauccuggaaa

SEQ ID NO: 2123929 - RNA, 16 nt, Human
uggucugugagaugcu

SEQ ID NO: 2123930 - RNA, 18 nt, Human
uaggaaauauuuuaaugu

SEQ ID NO: 2123931 - RNA, 19 nt, Human
cucggccugcucgcccacu

SEQ ID NO: 2123932 - RNA, 16 nt, Human
acaccaaccuucugag

SEQ ID NO: 2123933 - RNA, 14 nt, Human
uccacuuggucugu

SEQ ID NO: 2123934 - RNA, 21 nt, Human
uagaugagagaacagggcuga

SEQ ID NO: 2123935 - RNA, 13 nt, Human
cgcugcgcgccgc

SEQ ID NO: 2123936 - RNA, 17 nt, Human
caccucccccaucucuu

SEQ ID NO: 2123937 - RNA, 23 nt, Human
ggcugcgcucggccugcucgccc

SEQ ID NO: 2123938 - RNA, 21 nt, Human
auuuguauaaaauaauuuuua

SEQ ID NO: 2123939 - RNA, 16 nt, Human
uuucuauaauuuaaau

SEQ ID NO: 2123940 - RNA, 22 nt, Human
uuugaaacgaggauugggaaaa

SEQ ID NO: 2123941 - RNA, 21 nt, Human
aaaauaugccccauucaacau

SEQ ID NO: 2123942 - RNA, 19 nt, Human
uauuuaauuauuucacuuu

SEQ ID NO: 2123943 - RNA, 18 nt, Human
cccgggccgacggagccg

SEQ ID NO: 2123944 - RNA, 16 nt, Human
acaaggaugaauuaag

SEQ ID NO: 2123945 - RNA, 20 nt, Human
uaugaaaaggcuaagcuuca

SEQ ID NO: 2123946 - RNA, 15 nt, Human
cucguggaacaguua

SEQ ID NO: 2123947 - RNA, 20 nt, Human
gcgcgcucaucccacccgcc

SEQ ID NO: 2123948 - RNA, 23 nt, Human
uaaaagacagugaaagaaaauaa

SEQ ID NO: 2123949 - RNA, 16 nt, Human
cacuggacucaccucc

SEQ ID NO: 2123950 - RNA, 20 nt, Human
ugagagacacacugaagaag

SEQ ID NO: 2123951 - RNA, 17 nt, Human
gugccuguaaucacagc

SEQ ID NO: 2123952 - RNA, 14 nt, Human
cucaccagucccuc

SEQ ID NO: 2123953 - RNA, 12 nt, Human
aaaugaaagcag

SEQ ID NO: 2123954 - RNA, 22 nt, Human
acaccuuguacuuuauuuucua

SEQ ID NO: 2123955 - RNA, 14 nt, Human
cccacacuguccau

SEQ ID NO: 2123956 - RNA, 19 nt, Human
ugagguaaccucauuauca

SEQ ID NO: 2123957 - RNA, 23 nt, Human
auuauauggcuugaguuuaaauu

SEQ ID NO: 2123958 - RNA, 19 nt, Human
ccccuauccuacuuccccu

SEQ ID NO: 2123959 - RNA, 21 nt, Human
gacagaaagcagaacagugau

SEQ ID NO: 2123960 - RNA, 18 nt, Human
uucugauauuggacagua

SEQ ID NO: 2123961 - RNA, 13 nt, Human
cauggaaaaguuu

SEQ ID NO: 2123962 - RNA, 16 nt, Human
cucucuuccucccugg

SEQ ID NO: 2123963 - RNA, 13 nt, Human
ggcaggcacugcc

SEQ ID NO: 2123964 - RNA, 22 nt, Human
agagccggagccuccagcugcc

SEQ ID NO: 2123965 - RNA, 15 nt, Human
ugccgugggccugag

SEQ ID NO: 2123966 - RNA, 15 nt, Human
aauucugaaagcaac

SEQ ID NO: 2123967 - RNA, 13 nt, Human
cuuaucaaaggac

SEQ ID NO: 2123968 - RNA, 17 nt, Human
agcgacagugagacucu

SEQ ID NO: 2123969 - RNA, 13 nt, Human
agacagcucugca

SEQ ID NO: 2123970 - RNA, 14 nt, Human
uguauucuuuuagu

SEQ ID NO: 2123971 - RNA, 21 nt, Human
cacuaucuggguuuugggggg

SEQ ID NO: 2123972 - RNA, 15 nt, Human
agacaaggaaaaaau

SEQ ID NO: 2123973 - RNA, 18 nt, Human
ccugcaaagcccagcuug

SEQ ID NO: 2123974 - RNA, 21 nt, Human
caaagcccagcuugaaaccuu

SEQ ID NO: 2123975 - RNA, 17 nt, Human
uaauuccacagcugcuc

SEQ ID NO: 2123976 - RNA, 13 nt, Human
acagcccuucuuu

SEQ ID NO: 2123977 - RNA, 21 nt, Human
cuuguuggacgagaaaacaau

SEQ ID NO: 2123978 - RNA, 18 nt, Human
gaagcaccaaucaugaau

SEQ ID NO: 2123979 - RNA, 18 nt, Human
aagucuuucacauuuaaa

SEQ ID NO: 2123980 - RNA, 17 nt, Human
acacuaagagagaauga

SEQ ID NO: 2123981 - RNA, 14 nt, Human
gagcuuuuguagaa

SEQ ID NO: 2123982 - RNA, 19 nt, Human
agacagugaaagaaaauaa

SEQ ID NO: 2123983 - RNA, 14 nt, Human
uugcuggagcucug

SEQ ID NO: 2123984 - RNA, 19 nt, Human
cccuuccccucugcagcuu

SEQ ID NO: 2123985 - RNA, 21 nt, Human
gcuggccaccugcugagcccc

SEQ ID NO: 2123986 - RNA, 19 nt, Human
cucucacuuguuuuauuua

SEQ ID NO: 2123987 - RNA, 18 nt, Human
uauauuuccuuauucaga

SEQ ID NO: 2123988 - RNA, 24 nt, Human
ugucuugaauuguaggugacuauu

SEQ ID NO: 2123989 - RNA, 17 nt, Human
cugcacuccagccugag

SEQ ID NO: 2123990 - RNA, 19 nt, Human
uaccccuggccaaggaaga

SEQ ID NO: 2123991 - RNA, 19 nt, Human
cuccagcuggccgggagcc

SEQ ID NO: 2123992 - RNA, 20 nt, Human
auucccagccagcacagccu

SEQ ID NO: 2123993 - RNA, 14 nt, Human
ccaaugaaaugagu

SEQ ID NO: 2123994 - RNA, 15 nt, Human
cccaucucaggugug

SEQ ID NO: 2123995 - RNA, 23 nt, Human
gaccccugagcuugcagagauga

SEQ ID NO: 2123996 - RNA, 17 nt, Human
ccucuggcuccagcugg

SEQ ID NO: 2123997 - RNA, 14 nt, Human
cauuuaguuauaaa

SEQ ID NO: 2123998 - RNA, 16 nt, Human
gaguuccuucugcucc

SEQ ID NO: 2123999 - RNA, 23 nt, Human
caaaauggaauacucuuauaucu

SEQ ID NO: 2124000 - RNA, 21 nt, Human
aaucaccaaggcugauuaaac

SEQ ID NO: 2124001 - RNA, 20 nt, Human
gagccucagucucccucccu

SEQ ID NO: 2124002 - RNA, 19 nt, Human
auucagaauuucuaaaagu

SEQ ID NO: 2124003 - RNA, 19 nt, Human
gcggcccugugcggccugg

SEQ ID NO: 2124004 - RNA, 19 nt, Staphylococcus aureus subsp. aureus N315
uuuuuucaauucuagucag

SEQ ID NO: 2124005 - RNA, 21 nt, Staphylococcus aureus subsp. aureus N315
uuuugcgaccggauguuucuu

SEQ ID NO: 2124006 - RNA, 17 nt, Staphylococcus aureus subsp. aureus N315
uuuugcgaaaauaucau

SEQ ID NO: 2124007 - RNA, 16 nt, Staphylococcus aureus subsp. aureus N315
uuuuacaaguuguuca

SEQ ID NO: 2124008 - RNA, 22 nt, Staphylococcus aureus subsp. aureus N315
uuuuacaaacuucacaucaugu

SEQ ID NO: 2124009 - RNA, 13 nt, Staphylococcus aureus subsp. aureus N315
uuugucguuacua

SEQ ID NO: 2124010 - RNA, 20 nt, Staphylococcus aureus subsp. aureus N315
uuuuaauuguacuuaaaccu

SEQ ID NO: 2124011 - RNA, 22 nt, Staphylococcus aureus subsp. aureus N315
uuuuauggcgguuugaaaauga

SEQ ID NO: 2124012 - RNA, 22 nt, Staphylococcus aureus subsp. aureus N315
uuuguaauugaugauuacucca

SEQ ID NO: 2124013 - RNA, 13 nt, Staphylococcus aureus subsp. aureus N315
uuuaaaaaguaau

SEQ ID NO: 2124014 - RNA, 12 nt, Staphylococcus aureus subsp. aureus N315
uuuaaaaguaac

SEQ ID NO: 2124015 - RNA, 13 nt, Staphylococcus aureus subsp. aureus N315
uuuaaacgcucau

SEQ ID NO: 2124016 - RNA, 17 nt, Staphylococcus aureus subsp. aureus N315
uuuaaaaaauuuaaugu

SEQ ID NO: 2124017 - RNA, 21 nt, Staphylococcus aureus subsp. aureus N315
uuuaaacaugaacaaucagau

SEQ ID NO: 2124018 - RNA, 16 nt, Staphylococcus aureus subsp. aureus N315
uuguaugauaaccauu

SEQ ID NO: 2124019 - RNA, 20 nt, Staphylococcus aureus subsp. aureus N315
uuguaugacggugaaaguuc

SEQ ID NO: 2124020 - RNA, 17 nt, Staphylococcus aureus subsp. aureus N315
uuguaaaaauacauaau

SEQ ID NO: 2124021 - RNA, 20 nt, Staphylococcus aureus subsp. aureus N315
uugguauaucgaaagguaac

SEQ ID NO: 2124022 - RNA, 20 nt, Staphylococcus aureus subsp. aureus N315
uuuaacuuccuaaaauuuac

SEQ ID NO: 2124023 - RNA, 20 nt, Staphylococcus aureus subsp. aureus N315
uuuaacaaugcgauuaaacu

SEQ ID NO: 2124024 - RNA, 23 nt, Staphylococcus aureus subsp. aureus N315
uuuaacaauacuacuuaaugacu

SEQ ID NO: 2124025 - RNA, 22 nt, Staphylococcus aureus subsp. aureus N315
uuuaaagcuaaauguuaaugcu

SEQ ID NO: 2124026 - RNA, 12 nt, Staphylococcus aureus subsp. aureus N315
uuuaaaugauau

SEQ ID NO: 2124027 - RNA, 16 nt, Staphylococcus aureus subsp. aureus N315
uuuaauaaguuaaugu

SEQ ID NO: 2124028 - RNA, 18 nt, Staphylococcus aureus subsp. aureus N315
uuuaggugcuuuaaugcc

SEQ ID NO: 2124029 - RNA, 19 nt, Staphylococcus aureus subsp. aureus N315
uuuaacuucugauucuuca

SEQ ID NO: 2124030 - RNA, 17 nt, Staphylococcus aureus subsp. aureus N315
uuuauuuuagcagcagu

SEQ ID NO: 2124031 - RNA, 17 nt, Staphylococcus aureus subsp. aureus N315
uuuauuuaaucguaaca

SEQ ID NO: 2124032 - RNA, 21 nt, Staphylococcus aureus subsp. aureus N315
uuuauaaguaucgccaucauu

SEQ ID NO: 2124033 - RNA, 14 nt, Staphylococcus aureus subsp. aureus N315
uuuaguuaaaguac

SEQ ID NO: 2124034 - RNA, 19 nt, Staphylococcus aureus subsp. aureus N315
uuucauaaauuguuuuaca

SEQ ID NO: 2124035 - RNA, 22 nt, Staphylococcus aureus subsp. aureus N315
uuucauaccuugauuauaugcu

SEQ ID NO: 2124036 - RNA, 17 nt, Staphylococcus aureus subsp. aureus N315
uuucauaaacucuuaca

SEQ ID NO: 2124037 - RNA, 20 nt, Staphylococcus aureus subsp. aureus N315
uuucaacuuuuuaauaauac

SEQ ID NO: 2124038 - RNA, 20 nt, Staphylococcus aureus subsp. aureus N315
uuuccaaauugcaaaguaac

SEQ ID NO: 2124039 - RNA, 21 nt, Staphylococcus aureus subsp. aureus N315
uugaagcuaauucauauucaa

SEQ ID NO: 2124040 - RNA, 15 nt, Staphylococcus aureus subsp. aureus N315
uugaaucuuguugaa

SEQ ID NO: 2124041 - RNA, 19 nt, Staphylococcus aureus subsp. aureus N315
uuccuaauuauauuaauga

SEQ ID NO: 2124042 - RNA, 19 nt, Staphylococcus aureus subsp. aureus N315
uugagaaagacuauauaac

SEQ ID NO: 2124043 - RNA, 20 nt, Staphylococcus aureus subsp. aureus N315
uugauuuugaaucacauuaa

SEQ ID NO: 2124044 - RNA, 20 nt, Staphylococcus aureus subsp. aureus N315
uuggcaugucgguuaaucca

SEQ ID NO: 2124045 - RNA, 19 nt, Staphylococcus aureus subsp. aureus N315
uuggaaauaucuuacugcu

SEQ ID NO: 2124046 - RNA, 19 nt, Staphylococcus aureus subsp. aureus N315
uugcucgcgcucuucuuca

SEQ ID NO: 2124047 - RNA, 15 nt, Staphylococcus aureus subsp. aureus N315
uugcuaaaauaucaa

SEQ ID NO: 2124048 - RNA, 17 nt, Staphylococcus aureus subsp. aureus N315
uuaugcggucuaaaugc

SEQ ID NO: 2124049 - RNA, 12 nt, Staphylococcus aureus subsp. aureus N315
uuauuaaaucag

SEQ ID NO: 2124050 - RNA, 21 nt, Staphylococcus aureus subsp. aureus N315
uucaaaugcuuaauaaaauca

SEQ ID NO: 2124051 - RNA, 14 nt, Staphylococcus aureus subsp. aureus N315
uucaacauaacuca

SEQ ID NO: 2124052 - RNA, 19 nt, Staphylococcus aureus subsp. aureus N315
uucaaauggacuaacguca

SEQ ID NO: 2124053 - RNA, 13 nt, Staphylococcus aureus subsp. aureus N315
uucaaauuauaac

SEQ ID NO: 2124054 - RNA, 19 nt, Staphylococcus aureus subsp. aureus N315
uucaccaucuguaacuaau

SEQ ID NO: 2124055 - RNA, 13 nt, Staphylococcus aureus subsp. aureus N315
uucaguuaaauca

SEQ ID NO: 2124056 - RNA, 15 nt, Staphylococcus aureus subsp. aureus N315
uucauacauaacaca

SEQ ID NO: 2124057 - RNA, 13 nt, Staphylococcus aureus subsp. aureus N315
uucauaaaugcuu

SEQ ID NO: 2124058 - RNA, 17 nt, Staphylococcus aureus subsp. aureus N315
uucauauucaaauuuac

SEQ ID NO: 2124059 - RNA, 17 nt, Staphylococcus aureus subsp. aureus N315
uucaucaaacaacauca

SEQ ID NO: 2124060 - RNA, 11 nt, Staphylococcus aureus subsp. aureus N315
uuaaucgcauu

SEQ ID NO: 2124061 - RNA, 15 nt, Staphylococcus aureus subsp. aureus N315
uuaaucgggcuauau

SEQ ID NO: 2124062 - RNA, 17 nt, Staphylococcus aureus subsp. aureus N315
uuacaaaugaagguguu

SEQ ID NO: 2124063 - RNA, 19 nt, Staphylococcus aureus subsp. aureus N315
uuaauuuuucuaaaugauu

SEQ ID NO: 2124064 - RNA, 15 nt, Staphylococcus aureus subsp. aureus N315
uuaacugcaaacuug

SEQ ID NO: 2124065 - RNA, 15 nt, Staphylococcus aureus subsp. aureus N315
uuaacuugaaauguu

SEQ ID NO: 2124066 - RNA, 20 nt, Staphylococcus aureus subsp. aureus N315
uuaacaaugcgauuaaacuc

SEQ ID NO: 2124067 - RNA, 12 nt, Staphylococcus aureus subsp. aureus N315
uuaacaacuuua

SEQ ID NO: 2124068 - RNA, 15 nt, Staphylococcus aureus subsp. aureus N315
uuaaauugaaauguu

SEQ ID NO: 2124069 - RNA, 13 nt, Staphylococcus aureus subsp. aureus N315
uuaacaucugaau

SEQ ID NO: 2124070 - RNA, 18 nt, Staphylococcus aureus subsp. aureus N315
uuaacaauuuuaucugaa

SEQ ID NO: 2124071 - RNA, 21 nt, Staphylococcus aureus subsp. aureus N315
uuaaauucaucuuaucaagaa

SEQ ID NO: 2124072 - RNA, 14 nt, Staphylococcus aureus subsp. aureus N315
uuaucagguuaaca

SEQ ID NO: 2124073 - RNA, 19 nt, Staphylococcus aureus subsp. aureus N315
uuauauuuugaaucaguau

SEQ ID NO: 2124074 - RNA, 18 nt, Staphylococcus aureus subsp. aureus N315
uuaucuguaauuaaucca

SEQ ID NO: 2124075 - RNA, 22 nt, Staphylococcus aureus subsp. aureus N315
uuaucucuuacguccuaauccc

SEQ ID NO: 2124076 - RNA, 18 nt, Staphylococcus aureus subsp. aureus N315
uuaucugaagcuaaaugc

SEQ ID NO: 2124077 - RNA, 14 nt, Staphylococcus aureus subsp. aureus N315
uuaugaggcugagu

SEQ ID NO: 2124078 - RNA, 13 nt, Staphylococcus aureus subsp. aureus N315
uuagucaauguau

SEQ ID NO: 2124079 - RNA, 23 nt, Staphylococcus aureus subsp. aureus N315
uuauauaagucauacgcaaugau

SEQ ID NO: 2124080 - RNA, 15 nt, Staphylococcus aureus subsp. aureus N315
uuaguaauaacaucu

SEQ ID NO: 2124081 - RNA, 17 nt, Staphylococcus aureus subsp. aureus N315
uuagggaaauguagauu

SEQ ID NO: 2124082 - RNA, 12 nt, Staphylococcus aureus subsp. aureus N315
uuacuuaaucug

SEQ ID NO: 2124083 - RNA, 22 nt, Staphylococcus aureus subsp. aureus N315
uuacuuuucuaaacaacuucug

SEQ ID NO: 2124084 - RNA, 16 nt, Staphylococcus aureus subsp. aureus N315
uuacuuuggaaauuua

SEQ ID NO: 2124085 - RNA, 19 nt, Staphylococcus aureus subsp. aureus N315
ugguaaguauaauuaaacu

SEQ ID NO: 2124086 - RNA, 20 nt, Staphylococcus aureus subsp. aureus N315
uguaccaucacuaaaguaaa

SEQ ID NO: 2124087 - RNA, 14 nt, Staphylococcus aureus subsp. aureus N315
uguaccaguaacaa

SEQ ID NO: 2124088 - RNA, 23 nt, Staphylococcus aureus subsp. aureus N315
uguaauuuucacuuucaaugaca

SEQ ID NO: 2124089 - RNA, 18 nt, Staphylococcus aureus subsp. aureus N315
uguugaauaauuaauguu

SEQ ID NO: 2124090 - RNA, 21 nt, Staphylococcus aureus subsp. aureus N315
uguucuucccacauacuuuua

SEQ ID NO: 2124091 - RNA, 15 nt, Staphylococcus aureus subsp. aureus N315
uguuaucuugcuuau

SEQ ID NO: 2124092 - RNA, 17 nt, Staphylococcus aureus subsp. aureus N315
uguuauccaaaacauuu

SEQ ID NO: 2124093 - RNA, 14 nt, Staphylococcus aureus subsp. aureus N315
uguuaaaugacgcu

SEQ ID NO: 2124094 - RNA, 16 nt, Staphylococcus aureus subsp. aureus N315
uguuaauaaccgaaau

SEQ ID NO: 2124095 - RNA, 17 nt, Staphylococcus aureus subsp. aureus N315
uguuaacugaauuucgu

SEQ ID NO: 2124096 - RNA, 21 nt, Staphylococcus aureus subsp. aureus N315
uguucaaaucacaaguuuaca

SEQ ID NO: 2124097 - RNA, 22 nt, Staphylococcus aureus subsp. aureus N315
uguguacguuucaauguaucaa

SEQ ID NO: 2124098 - RNA, 21 nt, Staphylococcus aureus subsp. aureus N315
uguguaaauauaaauaugaau

SEQ ID NO: 2124099 - RNA, 14 nt, Staphylococcus aureus subsp. aureus N315
uguggucuaaccau

SEQ ID NO: 2124100 - RNA, 19 nt, Staphylococcus aureus subsp. aureus N315
uggccaaccaccauaugcu

SEQ ID NO: 2124101 - RNA, 16 nt, Staphylococcus aureus subsp. aureus N315
uggagcguaaaguuuu

SEQ ID NO: 2124102 - RNA, 18 nt, Staphylococcus aureus subsp. aureus N315
uaaagauggcugcaucaa

SEQ ID NO: 2124103 - RNA, 16 nt, Staphylococcus aureus subsp. aureus N315
uaaacuuuucuucaag

SEQ ID NO: 2124104 - RNA, 16 nt, Staphylococcus aureus subsp. aureus N315
uaaagauaagaugguu

SEQ ID NO: 2124105 - RNA, 13 nt, Staphylococcus aureus subsp. aureus N315
uaaaauaccagau

SEQ ID NO: 2124106 - RNA, 14 nt, Staphylococcus aureus subsp. aureus N315
uaaaaucaacuuuu

SEQ ID NO: 2124107 - RNA, 19 nt, Staphylococcus aureus subsp. aureus N315
uaaacauuuagauuucaug

SEQ ID NO: 2124108 - RNA, 17 nt, Staphylococcus aureus subsp. aureus N315
uaaacauuuauauagau

SEQ ID NO: 2124109 - RNA, 17 nt, Staphylococcus aureus subsp. aureus N315
uaaaaacguucaaucgu

SEQ ID NO: 2124110 - RNA, 18 nt, Staphylococcus aureus subsp. aureus N315
uaaaaaucuuaugauguc

SEQ ID NO: 2124111 - RNA, 21 nt, Staphylococcus aureus subsp. aureus N315
uaaaaguacuaacccaacgau

SEQ ID NO: 2124112 - RNA, 23 nt, Staphylococcus aureus subsp. aureus N315
uaaaacacggucgccaacaguaa

SEQ ID NO: 2124113 - RNA, 15 nt, Staphylococcus aureus subsp. aureus N315
uaaaguuuuguucaa

SEQ ID NO: 2124114 - RNA, 19 nt, Staphylococcus aureus subsp. aureus N315
uaaauacaaaaauauagcu

SEQ ID NO: 2124115 - RNA, 16 nt, Staphylococcus aureus subsp. aureus N315
uaaauccgcuuguuca

SEQ ID NO: 2124116 - RNA, 23 nt, Staphylococcus aureus subsp. aureus N315
uaaaucuuuuagcuuuuguaaag

SEQ ID NO: 2124117 - RNA, 23 nt, Staphylococcus aureus subsp. aureus N315
uaaaugaaacuuugugugcuuua

SEQ ID NO: 2124118 - RNA, 18 nt, Staphylococcus aureus subsp. aureus N315
uaacaaggccugcaucac

SEQ ID NO: 2124119 - RNA, 16 nt, Staphylococcus aureus subsp. aureus N315
uaacaauaacaccugu

SEQ ID NO: 2124120 - RNA, 14 nt, Staphylococcus aureus subsp. aureus N315
uaacaaauuagaau

SEQ ID NO: 2124121 - RNA, 13 nt, Staphylococcus aureus subsp. aureus N315
uaacccacauuaa

SEQ ID NO: 2124122 - RNA, 16 nt, Staphylococcus aureus subsp. aureus N315
uaacaccaauugaaua

SEQ ID NO: 2124123 - RNA, 20 nt, Staphylococcus aureus subsp. aureus N315
uaacauuugcuaguagaguu

SEQ ID NO: 2124124 - RNA, 21 nt, Staphylococcus aureus subsp. aureus N315
uaacaauuacgacaagaauua

SEQ ID NO: 2124125 - RNA, 14 nt, Staphylococcus aureus subsp. aureus N315
uaacauuugucaua

SEQ ID NO: 2124126 - RNA, 20 nt, Staphylococcus aureus subsp. aureus N315
uaacauuugucauaauagau

SEQ ID NO: 2124127 - RNA, 14 nt, Staphylococcus aureus subsp. aureus N315
uaaccaaucaucgc

SEQ ID NO: 2124128 - RNA, 15 nt, Staphylococcus aureus subsp. aureus N315
uaacgcaaugucuug

SEQ ID NO: 2124129 - RNA, 23 nt, Staphylococcus aureus subsp. aureus N315
uaauuaaaagugcaaguccaaau

SEQ ID NO: 2124130 - RNA, 18 nt, Staphylococcus aureus subsp. aureus N315
uaauguuugcuuuuugua

SEQ ID NO: 2124131 - RNA, 23 nt, Staphylococcus aureus subsp. aureus N315
uaauguuucuucaauugucucaa

SEQ ID NO: 2124132 - RNA, 12 nt, Staphylococcus aureus subsp. aureus N315
uaaugauuaacu

SEQ ID NO: 2124133 - RNA, 18 nt, Staphylococcus aureus subsp. aureus N315
uaaugcaccugugauaac

SEQ ID NO: 2124134 - RNA, 23 nt, Staphylococcus aureus subsp. aureus N315
uaaugccaccguggaauuuacca

SEQ ID NO: 2124135 - RNA, 13 nt, Staphylococcus aureus subsp. aureus N315
uaauucuuaaucg

SEQ ID NO: 2124136 - RNA, 19 nt, Staphylococcus aureus subsp. aureus N315
uaauucuucaucuucuuca

SEQ ID NO: 2124137 - RNA, 23 nt, Staphylococcus aureus subsp. aureus N315
uaauucuucucgcauacugucau

SEQ ID NO: 2124138 - RNA, 17 nt, Staphylococcus aureus subsp. aureus N315
uaauuucuucuucugua

SEQ ID NO: 2124139 - RNA, 19 nt, Staphylococcus aureus subsp. aureus N315
uaauucaaguguauuaaag

SEQ ID NO: 2124140 - RNA, 21 nt, Staphylococcus aureus subsp. aureus N315
uaauuacaauauaauuuccua

SEQ ID NO: 2124141 - RNA, 16 nt, Staphylococcus aureus subsp. aureus N315
uacagccauugacaca

SEQ ID NO: 2124142 - RNA, 21 nt, Staphylococcus aureus subsp. aureus N315
uacagauuccugcaaaauguu

SEQ ID NO: 2124143 - RNA, 15 nt, Staphylococcus aureus subsp. aureus N315
uacaccacuuaggau

SEQ ID NO: 2124144 - RNA, 18 nt, Staphylococcus aureus subsp. aureus N315
uacagaucucaauccaau

SEQ ID NO: 2124145 - RNA, 14 nt, Staphylococcus aureus subsp. aureus N315
uacagagaaucaau

SEQ ID NO: 2124146 - RNA, 18 nt, Staphylococcus aureus subsp. aureus N315
uaauuuuuugacacgucg

SEQ ID NO: 2124147 - RNA, 13 nt, Staphylococcus aureus subsp. aureus N315
uaauuuuguuuca

SEQ ID NO: 2124148 - RNA, 14 nt, Staphylococcus aureus subsp. aureus N315
uaauuuuuaaucuu

SEQ ID NO: 2124149 - RNA, 20 nt, Staphylococcus aureus subsp. aureus N315
uaauuuuggauuuuuuugua

SEQ ID NO: 2124150 - RNA, 18 nt, Staphylococcus aureus subsp. aureus N315
uaauuuuaccuguuucuu

SEQ ID NO: 2124151 - RNA, 21 nt, Staphylococcus aureus subsp. aureus N315
uacacaaugcccuuaaagcac

SEQ ID NO: 2124152 - RNA, 18 nt, Staphylococcus aureus subsp. aureus N315
uacaauauucaauaauuc

SEQ ID NO: 2124153 - RNA, 21 nt, Staphylococcus aureus subsp. aureus N315
uaacuguucuuucgucuugua

SEQ ID NO: 2124154 - RNA, 16 nt, Staphylococcus aureus subsp. aureus N315
uaacugcaaacuugau

SEQ ID NO: 2124155 - RNA, 15 nt, Staphylococcus aureus subsp. aureus N315
uaacucaagugauuu

SEQ ID NO: 2124156 - RNA, 22 nt, Staphylococcus aureus subsp. aureus N315
uaaguaguugguggaugucaug

SEQ ID NO: 2124157 - RNA, 22 nt, Staphylococcus aureus subsp. aureus N315
uaaguuaauuuaucguuuagua

SEQ ID NO: 2124158 - RNA, 15 nt, Staphylococcus aureus subsp. aureus N315
uaaugauaguguaug

SEQ ID NO: 2124159 - RNA, 17 nt, Staphylococcus aureus subsp. aureus N315
uaaugauaguguaugaa

SEQ ID NO: 2124160 - RNA, 14 nt, Staphylococcus aureus subsp. aureus N315
uaauaguuaacgau

SEQ ID NO: 2124161 - RNA, 18 nt, Staphylococcus aureus subsp. aureus N315
uaauaggauuauuaucaa

SEQ ID NO: 2124162 - RNA, 20 nt, Staphylococcus aureus subsp. aureus N315
uaauaggcuauguaaaucgu

SEQ ID NO: 2124163 - RNA, 15 nt, Staphylococcus aureus subsp. aureus N315
uaauagauaaugcac

SEQ ID NO: 2124164 - RNA, 15 nt, Staphylococcus aureus subsp. aureus N315
uagcauaaaauuucu

SEQ ID NO: 2124165 - RNA, 20 nt, Staphylococcus aureus subsp. aureus N315
uagcauuucuuuauuagaau

SEQ ID NO: 2124166 - RNA, 12 nt, Staphylococcus aureus subsp. aureus N315
uagcaauaucau

SEQ ID NO: 2124167 - RNA, 20 nt, Staphylococcus aureus subsp. aureus N315
uagcaacgagcuuagcaguu

SEQ ID NO: 2124168 - RNA, 20 nt, Staphylococcus aureus subsp. aureus N315
uagacuuauuugaaugcaaa

SEQ ID NO: 2124169 - RNA, 18 nt, Staphylococcus aureus subsp. aureus N315
uagaaaagcaguaagaga

SEQ ID NO: 2124170 - RNA, 19 nt, Staphylococcus aureus subsp. aureus N315
uagaauucuaaaagaauua

SEQ ID NO: 2124171 - RNA, 20 nt, Staphylococcus aureus subsp. aureus N315
uacuuuaaaauuguauagaa

SEQ ID NO: 2124172 - RNA, 13 nt, Staphylococcus aureus subsp. aureus N315
uacuuuaacaguu

SEQ ID NO: 2124173 - RNA, 19 nt, Staphylococcus aureus subsp. aureus N315
uacuuuaacaguuguaauc

SEQ ID NO: 2124174 - RNA, 15 nt, Staphylococcus aureus subsp. aureus N315
uacuuuaucguugua

SEQ ID NO: 2124175 - RNA, 14 nt, Staphylococcus aureus subsp. aureus N315
uacuauuuaaucuu

SEQ ID NO: 2124176 - RNA, 23 nt, Staphylococcus aureus subsp. aureus N315
uacuacugucucaucuucuaaau

SEQ ID NO: 2124177 - RNA, 15 nt, Staphylococcus aureus subsp. aureus N315
uacuaacugaagaca

SEQ ID NO: 2124178 - RNA, 15 nt, Staphylococcus aureus subsp. aureus N315
uacucauauugaaua

SEQ ID NO: 2124179 - RNA, 22 nt, Staphylococcus aureus subsp. aureus N315
uacugcaauuauuuuucaaaua

SEQ ID NO: 2124180 - RNA, 20 nt, Staphylococcus aureus subsp. aureus N315
uaccgacaccuauacauaac

SEQ ID NO: 2124181 - RNA, 16 nt, Staphylococcus aureus subsp. aureus N315
uacauauguguaugau

SEQ ID NO: 2124182 - RNA, 21 nt, Staphylococcus aureus subsp. aureus N315
uacauauucucugcuucuaaa

SEQ ID NO: 2124183 - RNA, 14 nt, Staphylococcus aureus subsp. aureus N315
uacagguaaugcaa

SEQ ID NO: 2124184 - RNA, 15 nt, Staphylococcus aureus subsp. aureus N315
uacagguaaugcaag

SEQ ID NO: 2124185 - RNA, 17 nt, Staphylococcus aureus subsp. aureus N315
uaccaauuuuuagcauu

SEQ ID NO: 2124186 - RNA, 17 nt, Staphylococcus aureus subsp. aureus N315
uaccaccccaacuugca

SEQ ID NO: 2124187 - RNA, 22 nt, Staphylococcus aureus subsp. aureus N315
uaccaucuucgacuacaaguuu

SEQ ID NO: 2124188 - RNA, 22 nt, Staphylococcus aureus subsp. aureus N315
guuaauaaugacugacacuuua

SEQ ID NO: 2124189 - RNA, 15 nt, Staphylococcus aureus subsp. aureus N315
guuauuaaccaucau

SEQ ID NO: 2124190 - RNA, 19 nt, Staphylococcus aureus subsp. aureus N315
guucauagugguguuuaua

SEQ ID NO: 2124191 - RNA, 23 nt, Staphylococcus aureus subsp. aureus N315
guugugauauauaguaggguauu

SEQ ID NO: 2124192 - RNA, 18 nt, Staphylococcus aureus subsp. aureus N315
ucccauuaaaauugcagc

SEQ ID NO: 2124193 - RNA, 17 nt, Staphylococcus aureus subsp. aureus N315
ucauuuuucguuguuca

SEQ ID NO: 2124194 - RNA, 16 nt, Staphylococcus aureus subsp. aureus N315
ucauuuggcguucaac

SEQ ID NO: 2124195 - RNA, 22 nt, Staphylococcus aureus subsp. aureus N315
ucauuugaacaucauuuaauug

SEQ ID NO: 2124196 - RNA, 13 nt, Staphylococcus aureus subsp. aureus N315
ucauuuguuguua

SEQ ID NO: 2124197 - RNA, 14 nt, Staphylococcus aureus subsp. aureus N315
ucauuuucauugua

SEQ ID NO: 2124198 - RNA, 15 nt, Staphylococcus aureus subsp. aureus N315
ucauuaguuguauca

SEQ ID NO: 2124199 - RNA, 16 nt, Staphylococcus aureus subsp. aureus N315
ucauuaguuguaucag

SEQ ID NO: 2124200 - RNA, 20 nt, Staphylococcus aureus subsp. aureus N315
ucauuguaaauuuguuaucu

SEQ ID NO: 2124201 - RNA, 22 nt, Staphylococcus aureus subsp. aureus N315
uccaaucaacuucauauaaugc

SEQ ID NO: 2124202 - RNA, 20 nt, Staphylococcus aureus subsp. aureus N315
ucauauggcaauguuaacug

SEQ ID NO: 2124203 - RNA, 20 nt, Staphylococcus aureus subsp. aureus N315
ucauauucacaucuuuagcu

SEQ ID NO: 2124204 - RNA, 21 nt, Staphylococcus aureus subsp. aureus N315
ucaucuaaaaugaguuguuca

SEQ ID NO: 2124205 - RNA, 13 nt, Staphylococcus aureus subsp. aureus N315
ucaucuauucaac

SEQ ID NO: 2124206 - RNA, 16 nt, Staphylococcus aureus subsp. aureus N315
ucaucuucaauucuua

SEQ ID NO: 2124207 - RNA, 14 nt, Staphylococcus aureus subsp. aureus N315
ucaauuucaccuug

SEQ ID NO: 2124208 - RNA, 19 nt, Staphylococcus aureus subsp. aureus N315
ucaauuuuaccauguuuua

SEQ ID NO: 2124209 - RNA, 20 nt, Staphylococcus aureus subsp. aureus N315
ucaauguauauuuaacauca

SEQ ID NO: 2124210 - RNA, 20 nt, Staphylococcus aureus subsp. aureus N315
ucaauuaauuuaaaugcuua

SEQ ID NO: 2124211 - RNA, 18 nt, Staphylococcus aureus subsp. aureus N315
ucacaugccaucuuugua

SEQ ID NO: 2124212 - RNA, 18 nt, Staphylococcus aureus subsp. aureus N315
ucacucggcagauguuca

SEQ ID NO: 2124213 - RNA, 17 nt, Staphylococcus aureus subsp. aureus N315
ucacuaauggauaugau

SEQ ID NO: 2124214 - RNA, 19 nt, Staphylococcus aureus subsp. aureus N315
ucagauacauuaucaagaa

SEQ ID NO: 2124215 - RNA, 14 nt, Staphylococcus aureus subsp. aureus N315
ucaauaugaccuuu

SEQ ID NO: 2124216 - RNA, 15 nt, Staphylococcus aureus subsp. aureus N315
ucaauaucaaauuug

SEQ ID NO: 2124217 - RNA, 17 nt, Staphylococcus aureus subsp. aureus N315
ucaauacuuucacuuug

SEQ ID NO: 2124218 - RNA, 22 nt, Staphylococcus aureus subsp. aureus N315
ucaaacaagauucauacacugc

SEQ ID NO: 2124219 - RNA, 17 nt, Staphylococcus aureus subsp. aureus N315
ucaaaucggcuauacau

SEQ ID NO: 2124220 - RNA, 13 nt, Staphylococcus aureus subsp. aureus N315
ucaaauaauguga

SEQ ID NO: 2124221 - RNA, 15 nt, Staphylococcus aureus subsp. aureus N315
ucaacacacuauuau

SEQ ID NO: 2124222 - RNA, 11 nt, Staphylococcus aureus subsp. aureus N315
ucaacaucaug

SEQ ID NO: 2124223 - RNA, 18 nt, Staphylococcus aureus subsp. aureus N315
uauuuucauaaacucuua

SEQ ID NO: 2124224 - RNA, 21 nt, Staphylococcus aureus subsp. aureus N315
uauuuucauuuuaguuauacu

SEQ ID NO: 2124225 - RNA, 22 nt, Staphylococcus aureus subsp. aureus N315
uauuuacaauguuaucuugcuu

SEQ ID NO: 2124226 - RNA, 15 nt, Staphylococcus aureus subsp. aureus N315
uauuuaauuuuucua

SEQ ID NO: 2124227 - RNA, 14 nt, Staphylococcus aureus subsp. aureus N315
uauuuaauguuuua

SEQ ID NO: 2124228 - RNA, 19 nt, Staphylococcus aureus subsp. aureus N315
uauuuacccaacauaucac

SEQ ID NO: 2124229 - RNA, 21 nt, Staphylococcus aureus subsp. aureus N315
uauuuaucuuuuaaaaucguu

SEQ ID NO: 2124230 - RNA, 12 nt, Staphylococcus aureus subsp. aureus N315
uauuuuguuuua

SEQ ID NO: 2124231 - RNA, 17 nt, Staphylococcus aureus subsp. aureus N315
uauuuuguccagacaac

SEQ ID NO: 2124232 - RNA, 19 nt, Staphylococcus aureus subsp. aureus N315
ucaaaaauguuaucuagua

SEQ ID NO: 2124233 - RNA, 11 nt, Staphylococcus aureus subsp. aureus N315
ucaaaacugcc

SEQ ID NO: 2124234 - RNA, 21 nt, Staphylococcus aureus subsp. aureus N315
uauuacuacauaauuuaucaa

SEQ ID NO: 2124235 - RNA, 15 nt, Staphylococcus aureus subsp. aureus N315
uaugcuguguaucau

SEQ ID NO: 2124236 - RNA, 21 nt, Staphylococcus aureus subsp. aureus N315
uauugauugugacuuguauca

SEQ ID NO: 2124237 - RNA, 16 nt, Staphylococcus aureus subsp. aureus N315
uauucuuggcguauuu

SEQ ID NO: 2124238 - RNA, 21 nt, Staphylococcus aureus subsp. aureus N315
uauugaauuugaauaaguggu

SEQ ID NO: 2124239 - RNA, 22 nt, Staphylococcus aureus subsp. aureus N315
uauugaauuugaauaagugguu

SEQ ID NO: 2124240 - RNA, 20 nt, Staphylococcus aureus subsp. aureus N315
uauucuggaugguuaucacu

SEQ ID NO: 2124241 - RNA, 16 nt, Staphylococcus aureus subsp. aureus N315
uauuauaaaauagaag

SEQ ID NO: 2124242 - RNA, 14 nt, Staphylococcus aureus subsp. aureus N315
uauuaguauucaaa

SEQ ID NO: 2124243 - RNA, 15 nt, Staphylococcus aureus subsp. aureus N315
uaucuucuaauucca

SEQ ID NO: 2124244 - RNA, 22 nt, Staphylococcus aureus subsp. aureus N315
uaucuucagauucccaaauagu

SEQ ID NO: 2124245 - RNA, 20 nt, Staphylococcus aureus subsp. aureus N315
uaucuuacugcuguucucua

SEQ ID NO: 2124246 - RNA, 19 nt, Staphylococcus aureus subsp. aureus N315
uaucucuuuucuauucaaa

SEQ ID NO: 2124247 - RNA, 22 nt, Staphylococcus aureus subsp. aureus N315
uaugaugaacuuaaugcuucaa

SEQ ID NO: 2124248 - RNA, 14 nt, Staphylococcus aureus subsp. aureus N315
uaugauauugauug

SEQ ID NO: 2124249 - RNA, 22 nt, Staphylococcus aureus subsp. aureus N315
ugaaguuaacuauaacaauagu

SEQ ID NO: 2124250 - RNA, 13 nt, Staphylococcus aureus subsp. aureus N315
ugaaugaaccuuu

SEQ ID NO: 2124251 - RNA, 16 nt, Staphylococcus aureus subsp. aureus N315
ugaaaugauacauuau

SEQ ID NO: 2124252 - RNA, 14 nt, Staphylococcus aureus subsp. aureus N315
ugaaaucaaugguu

SEQ ID NO: 2124253 - RNA, 22 nt, Staphylococcus aureus subsp. aureus N315
ugaaauaccuccugauugcugc

SEQ ID NO: 2124254 - RNA, 20 nt, Staphylococcus aureus subsp. aureus N315
ugaaagucaacaauugcuaa

SEQ ID NO: 2124255 - RNA, 13 nt, Staphylococcus aureus subsp. aureus N315
ugaacuuaaugcu

SEQ ID NO: 2124256 - RNA, 20 nt, Staphylococcus aureus subsp. aureus N315
ucuuucuucagaaccuugaa

SEQ ID NO: 2124257 - RNA, 16 nt, Staphylococcus aureus subsp. aureus N315
ugaccuucaguuucua

SEQ ID NO: 2124258 - RNA, 23 nt, Staphylococcus aureus subsp. aureus N315
ugaccuacuuuuucaauaugugg

SEQ ID NO: 2124259 - RNA, 13 nt, Staphylococcus aureus subsp. aureus N315
ugacgaguagauu

SEQ ID NO: 2124260 - RNA, 12 nt, Staphylococcus aureus subsp. aureus N315
ugacauuucuga

SEQ ID NO: 2124261 - RNA, 23 nt, Staphylococcus aureus subsp. aureus N315
ugacaguuuuaaaugaaacuuug

SEQ ID NO: 2124262 - RNA, 16 nt, Staphylococcus aureus subsp. aureus N315
ugaugcgcuucuaacu

SEQ ID NO: 2124263 - RNA, 22 nt, Staphylococcus aureus subsp. aureus N315
ugauuagcgcaccaauuaucaa

SEQ ID NO: 2124264 - RNA, 17 nt, Staphylococcus aureus subsp. aureus N315
ugauuaaaguguuucaa

SEQ ID NO: 2124265 - RNA, 18 nt, Staphylococcus aureus subsp. aureus N315
ugauuuuaccuguuucua

SEQ ID NO: 2124266 - RNA, 16 nt, Staphylococcus aureus subsp. aureus N315
ugauuuguuacuucua

SEQ ID NO: 2124267 - RNA, 15 nt, Staphylococcus aureus subsp. aureus N315
ugauucguauucaaa

SEQ ID NO: 2124268 - RNA, 14 nt, Staphylococcus aureus subsp. aureus N315
ugcaaugcaaaucu

SEQ ID NO: 2124269 - RNA, 11 nt, Staphylococcus aureus subsp. aureus N315
ugcaaugcaaa

SEQ ID NO: 2124270 - RNA, 13 nt, Staphylococcus aureus subsp. aureus N315
ugcauacauaucu

SEQ ID NO: 2124271 - RNA, 17 nt, Staphylococcus aureus subsp. aureus N315
ucuagagauaacuagaa

SEQ ID NO: 2124272 - RNA, 16 nt, Staphylococcus aureus subsp. aureus N315
ucuauauaaaguugac

SEQ ID NO: 2124273 - RNA, 14 nt, Staphylococcus aureus subsp. aureus N315
ucuagguuagaauu

SEQ ID NO: 2124274 - RNA, 17 nt, Staphylococcus aureus subsp. aureus N315
ucuaguguucucauuau

SEQ ID NO: 2124275 - RNA, 22 nt, Staphylococcus aureus subsp. aureus N315
ucucauuaaccuuacauaggau

SEQ ID NO: 2124276 - RNA, 22 nt, Staphylococcus aureus subsp. aureus N315
ucguagcaugacauuaaggcuu

SEQ ID NO: 2124277 - RNA, 21 nt, Staphylococcus aureus subsp. aureus N315
ucggcaugaugcgcuucuaac

SEQ ID NO: 2124278 - RNA, 13 nt, Staphylococcus aureus subsp. aureus N315
gcuuaaaccuuaa

SEQ ID NO: 2124279 - RNA, 22 nt, Staphylococcus aureus subsp. aureus N315
gcuuugaguguguccaucauuu

SEQ ID NO: 2124280 - RNA, 18 nt, Staphylococcus aureus subsp. aureus N315
gcugauacccaaucauuc

SEQ ID NO: 2124281 - RNA, 18 nt, Staphylococcus aureus subsp. aureus N315
gccuaggaguaucuguuu

SEQ ID NO: 2124282 - RNA, 16 nt, Staphylococcus aureus subsp. aureus N315
gucgagauuuuauaag

SEQ ID NO: 2124283 - RNA, 14 nt, Staphylococcus aureus subsp. aureus N315
gugauuuuaccugu

SEQ ID NO: 2124284 - RNA, 12 nt, Staphylococcus aureus subsp. aureus N315
gugacaacauua

SEQ ID NO: 2124285 - RNA, 18 nt, Staphylococcus aureus subsp. aureus N315
gugaagaaaaaaugauau

SEQ ID NO: 2124286 - RNA, 18 nt, Staphylococcus aureus subsp. aureus N315
guacauauguguaugaua

SEQ ID NO: 2124287 - RNA, 15 nt, Staphylococcus aureus subsp. aureus N315
guacauaaauaccug

SEQ ID NO: 2124288 - RNA, 19 nt, Staphylococcus aureus subsp. aureus N315
guacaauaauuagucauca

SEQ ID NO: 2124289 - RNA, 14 nt, Staphylococcus aureus subsp. aureus N315
guaaaucaugacau

SEQ ID NO: 2124290 - RNA, 12 nt, Staphylococcus aureus subsp. aureus N315
gguuaacacguu

SEQ ID NO: 2124291 - RNA, 18 nt, Staphylococcus aureus subsp. aureus N315
gucacauguaccacauuu

SEQ ID NO: 2124292 - RNA, 16 nt, Staphylococcus aureus subsp. aureus N315
guacguuaaucaguga

SEQ ID NO: 2124293 - RNA, 21 nt, Staphylococcus aureus subsp. aureus N315
ggucuacgaucaaaaucaugc

SEQ ID NO: 2124294 - RNA, 17 nt, Staphylococcus aureus subsp. aureus N315
ggucuucgcaaucauua

SEQ ID NO: 2124295 - RNA, 17 nt, Staphylococcus aureus subsp. aureus N315
ggauugaaaaaagcuag

SEQ ID NO: 2124296 - RNA, 20 nt, Staphylococcus aureus subsp. aureus N315
cugauuuuauaaaguuugua

SEQ ID NO: 2124297 - RNA, 18 nt, Staphylococcus aureus subsp. aureus N315
cuccaguggaaaugauaa

SEQ ID NO: 2124298 - RNA, 20 nt, Staphylococcus aureus subsp. aureus N315
cuauaaauacuuuugcauca

SEQ ID NO: 2124299 - RNA, 15 nt, Staphylococcus aureus subsp. aureus N315
cuauaauagcgucau

SEQ ID NO: 2124300 - RNA, 15 nt, Staphylococcus aureus subsp. aureus N315
cuaguuauuucauag

SEQ ID NO: 2124301 - RNA, 16 nt, Staphylococcus aureus subsp. aureus N315
cuagucuuuaacuuua

SEQ ID NO: 2124302 - RNA, 15 nt, Staphylococcus aureus subsp. aureus N315
cuaucuacaccauua

SEQ ID NO: 2124303 - RNA, 23 nt, Staphylococcus aureus subsp. aureus N315
cuauucacgaaauuacuuuaaca

SEQ ID NO: 2124304 - RNA, 16 nt, Staphylococcus aureus subsp. aureus N315
cuaauucaaguguauu

SEQ ID NO: 2124305 - RNA, 12 nt, Staphylococcus aureus subsp. aureus N315
cuaaugcuauau

SEQ ID NO: 2124306 - RNA, 15 nt, Staphylococcus aureus subsp. aureus N315
cuacaauuaaaguga

SEQ ID NO: 2124307 - RNA, 18 nt, Staphylococcus aureus subsp. aureus N315
cuaacucauaaucaacau

SEQ ID NO: 2124308 - RNA, 21 nt, Staphylococcus aureus subsp. aureus N315
cuaaccuauuaaaauaaacca

SEQ ID NO: 2124309 - RNA, 15 nt, Staphylococcus aureus subsp. aureus N315
cuaauagcauuugua

SEQ ID NO: 2124310 - RNA, 22 nt, Staphylococcus aureus subsp. aureus N315
cuaauaaaaccgguacuuucau

SEQ ID NO: 2124311 - RNA, 20 nt, Staphylococcus aureus subsp. aureus N315
cuaaaaacagcaguaagaca

SEQ ID NO: 2124312 - RNA, 21 nt, Staphylococcus aureus subsp. aureus N315
cguuucgucagauucaaacgu

SEQ ID NO: 2124313 - RNA, 14 nt, Staphylococcus aureus subsp. aureus N315
cuaaagauauagaa

SEQ ID NO: 2124314 - RNA, 19 nt, Staphylococcus aureus subsp. aureus N315
cuaaacuauaauaauugga

SEQ ID NO: 2124315 - RNA, 15 nt, Staphylococcus aureus subsp. aureus N315
cuaaacgcuaaaauu

SEQ ID NO: 2124316 - RNA, 15 nt, Staphylococcus aureus subsp. aureus N315
cuaaaccucaacauu

SEQ ID NO: 2124317 - RNA, 17 nt, Staphylococcus aureus subsp. aureus N315
cuaaacauuuuauacuc

SEQ ID NO: 2124318 - RNA, 14 nt, Staphylococcus aureus subsp. aureus N315
cuaaaaaugcuuua

SEQ ID NO: 2124319 - RNA, 22 nt, Staphylococcus aureus subsp. aureus N315
cuaaaaaaacagcaguaagaua

SEQ ID NO: 2124320 - RNA, 22 nt, Staphylococcus aureus subsp. aureus N315
cuaaaaauucuggauuaaaccc

SEQ ID NO: 2124321 - RNA, 21 nt, Staphylococcus aureus subsp. aureus N315
cuaaaacaugauacgugguuu

SEQ ID NO: 2124322 - RNA, 16 nt, Staphylococcus aureus subsp. aureus N315
cguuuaauaccuauga

SEQ ID NO: 2124323 - RNA, 21 nt, Staphylococcus aureus subsp. aureus N315
cguaauguguuaauacuucau

SEQ ID NO: 2124324 - RNA, 18 nt, Staphylococcus aureus subsp. aureus N315
cggugucaauauuguagg

SEQ ID NO: 2124325 - RNA, 18 nt, Staphylococcus aureus subsp. aureus N315
cuguguacguuucaaugu

SEQ ID NO: 2124326 - RNA, 14 nt, Staphylococcus aureus subsp. aureus N315
cuucaacgucaucu

SEQ ID NO: 2124327 - RNA, 22 nt, Staphylococcus aureus subsp. aureus N315
cuuacugcuguuuuuagguuau

SEQ ID NO: 2124328 - RNA, 20 nt, Staphylococcus aureus subsp. aureus N315
cuuacugcuuuuuuauucua

SEQ ID NO: 2124329 - RNA, 16 nt, Staphylococcus aureus subsp. aureus N315
cuuacuuuucuaaaca

SEQ ID NO: 2124330 - RNA, 13 nt, Staphylococcus aureus subsp. aureus N315
cuuacauugauaa

SEQ ID NO: 2124331 - RNA, 20 nt, Staphylococcus aureus subsp. aureus N315
cuucccaucuuuuagguaau

SEQ ID NO: 2124332 - RNA, 16 nt, Staphylococcus aureus subsp. aureus N315
cuucaauugucucaau

SEQ ID NO: 2124333 - RNA, 20 nt, Staphylococcus aureus subsp. aureus N315
cuucaccaacuuuuuuaaca

SEQ ID NO: 2124334 - RNA, 22 nt, Staphylococcus aureus subsp. aureus N315
cuucauuaguugcauaaucaau

SEQ ID NO: 2124335 - RNA, 18 nt, Staphylococcus aureus subsp. aureus N315
cuucuuuuucuugcauac

SEQ ID NO: 2124336 - RNA, 16 nt, Staphylococcus aureus subsp. aureus N315
cuucuuugaaaucaau

SEQ ID NO: 2124337 - RNA, 13 nt, Staphylococcus aureus subsp. aureus N315
cuucuucaacaau

SEQ ID NO: 2124338 - RNA, 16 nt, Staphylococcus aureus subsp. aureus N315
cuucucacaacugcau

SEQ ID NO: 2124339 - RNA, 19 nt, Staphylococcus aureus subsp. aureus N315
gaaaaacuguaaaucauca

SEQ ID NO: 2124340 - RNA, 20 nt, Staphylococcus aureus subsp. aureus N315
gaaaaacuuuucauggaguc

SEQ ID NO: 2124341 - RNA, 20 nt, Staphylococcus aureus subsp. aureus N315
gaaaauaaucgaacagaaaa

SEQ ID NO: 2124342 - RNA, 19 nt, Staphylococcus aureus subsp. aureus N315
gaaaauaccucuacauuau

SEQ ID NO: 2124343 - RNA, 14 nt, Staphylococcus aureus subsp. aureus N315
cuuuccucguauuu

SEQ ID NO: 2124344 - RNA, 19 nt, Staphylococcus aureus subsp. aureus N315
cuugauuuaaaccaucaau

SEQ ID NO: 2124345 - RNA, 22 nt, Staphylococcus aureus subsp. aureus N315
cugcaccuaaggcuaaugauaa

SEQ ID NO: 2124346 - RNA, 13 nt, Staphylococcus aureus subsp. aureus N315
gaauaaauugaua

SEQ ID NO: 2124347 - RNA, 18 nt, Staphylococcus aureus subsp. aureus N315
gaccaacuugcacauuau

SEQ ID NO: 2124348 - RNA, 11 nt, Staphylococcus aureus subsp. aureus N315
gaccaacuugc

SEQ ID NO: 2124349 - RNA, 15 nt, Staphylococcus aureus subsp. aureus N315
gaagaaugauacugu

SEQ ID NO: 2124350 - RNA, 20 nt, Staphylococcus aureus subsp. aureus N315
gacgaucuucaugaacagca

SEQ ID NO: 2124351 - RNA, 14 nt, Staphylococcus aureus subsp. aureus N315
gcacgagaaauguc

SEQ ID NO: 2124352 - RNA, 15 nt, Staphylococcus aureus subsp. aureus N315
gcacgagcaacaucu

SEQ ID NO: 2124353 - RNA, 15 nt, Staphylococcus aureus subsp. aureus N315
gcaauacgcaauguu

SEQ ID NO: 2124354 - RNA, 12 nt, Staphylococcus aureus subsp. aureus N315
gcacauuccauc

SEQ ID NO: 2124355 - RNA, 22 nt, Staphylococcus aureus subsp. aureus N315
gcauaugguaaaucgucauuau

SEQ ID NO: 2124356 - RNA, 16 nt, Staphylococcus aureus subsp. aureus N315
gcauauucuauuguug

SEQ ID NO: 2124357 - RNA, 16 nt, Staphylococcus aureus subsp. aureus N315
gcagcgauacguuuau

SEQ ID NO: 2124358 - RNA, 18 nt, Staphylococcus aureus subsp. aureus N315
gauuaaaauaugacacau

SEQ ID NO: 2124359 - RNA, 19 nt, Staphylococcus aureus subsp. aureus N315
gauugccaccguuauaccc

SEQ ID NO: 2124360 - RNA, 18 nt, Staphylococcus aureus subsp. aureus N315
gcaaaaauaauaugaauu

SEQ ID NO: 2124361 - RNA, 22 nt, Staphylococcus aureus subsp. aureus N315
gauggcguaagcaguuaauaag

SEQ ID NO: 2124362 - RNA, 18 nt, Staphylococcus aureus subsp. aureus N315
gaugauuuauuaacucau

SEQ ID NO: 2124363 - RNA, 13 nt, Staphylococcus aureus subsp. aureus N315
gaugagaaauguu

SEQ ID NO: 2124364 - RNA, 21 nt, Staphylococcus aureus subsp. aureus N315
gaugagaaauguuaacgauag

SEQ ID NO: 2124365 - RNA, 17 nt, Staphylococcus aureus subsp. aureus N315
gaugauauucaacuuga

SEQ ID NO: 2124366 - RNA, 16 nt, Staphylococcus aureus subsp. aureus N315
gaucuaaaugaucuuu

SEQ ID NO: 2124367 - RNA, 20 nt, Staphylococcus aureus subsp. aureus N315
gauauuuauucuaaguuaaa

SEQ ID NO: 2124368 - RNA, 14 nt, Staphylococcus aureus subsp. aureus N315
gaucaagugcagau

SEQ ID NO: 2124369 - RNA, 16 nt, Staphylococcus aureus subsp. aureus N315
gauagucauaacgauu

SEQ ID NO: 2124370 - RNA, 13 nt, Staphylococcus aureus subsp. aureus N315
gauacugauauuu

SEQ ID NO: 2124371 - RNA, 20 nt, Staphylococcus aureus subsp. aureus N315
gauaaguuuuugaauaucua

SEQ ID NO: 2124372 - RNA, 19 nt, Staphylococcus aureus subsp. aureus N315
gauaauaaagucaguuaac

SEQ ID NO: 2124373 - RNA, 19 nt, Staphylococcus aureus subsp. aureus N315
gauaauuaaaauaagauau

SEQ ID NO: 2124374 - RNA, 22 nt, Staphylococcus aureus subsp. aureus N315
gauaaugcauguggacguugau

SEQ ID NO: 2124375 - RNA, 13 nt, Staphylococcus aureus subsp. aureus N315
cgaagaaugauac

SEQ ID NO: 2124376 - RNA, 15 nt, Staphylococcus aureus subsp. aureus N315
ccuuuaccaguauca

SEQ ID NO: 2124377 - RNA, 16 nt, Staphylococcus aureus subsp. aureus N315
ccuuucgauaaacuac

SEQ ID NO: 2124378 - RNA, 20 nt, Staphylococcus aureus subsp. aureus N315
ccuucaguuucuacuguaua

SEQ ID NO: 2124379 - RNA, 19 nt, Staphylococcus aureus subsp. aureus N315
cgaguaugguugauuacaa

SEQ ID NO: 2124380 - RNA, 15 nt, Staphylococcus aureus subsp. aureus N315
cgauacugcuuugga

SEQ ID NO: 2124381 - RNA, 17 nt, Staphylococcus aureus subsp. aureus N315
cgauauuucuaguugca

SEQ ID NO: 2124382 - RNA, 17 nt, Staphylococcus aureus subsp. aureus N315
cgauucaauuuaacguu

SEQ ID NO: 2124383 - RNA, 15 nt, Staphylococcus aureus subsp. aureus N315
cgauuaucugacauu

SEQ ID NO: 2124384 - RNA, 13 nt, Staphylococcus aureus subsp. aureus N315
cgauucaaccuua

SEQ ID NO: 2124385 - RNA, 23 nt, Staphylococcus aureus subsp. aureus N315
cagauagaaugucgauauuucua

SEQ ID NO: 2124386 - RNA, 14 nt, Staphylococcus aureus subsp. aureus N315
cacgaacaacauua

SEQ ID NO: 2124387 - RNA, 17 nt, Staphylococcus aureus subsp. aureus N315
caccuuguuuaaguuuu

SEQ ID NO: 2124388 - RNA, 21 nt, Staphylococcus aureus subsp. aureus N315
cacuuucaguaauuguuacua

SEQ ID NO: 2124389 - RNA, 19 nt, Staphylococcus aureus subsp. aureus N315
cacuuuuagaaucaaccgu

SEQ ID NO: 2124390 - RNA, 16 nt, Staphylococcus aureus subsp. aureus N315
cacuguuaaagucugu

SEQ ID NO: 2124391 - RNA, 18 nt, Staphylococcus aureus subsp. aureus N315
cauauaaugguugaauaa

SEQ ID NO: 2124392 - RNA, 19 nt, Staphylococcus aureus subsp. aureus N315
cauaaccuugcuuugcaua

SEQ ID NO: 2124393 - RNA, 19 nt, Staphylococcus aureus subsp. aureus N315
cauaaccuguaauugauga

SEQ ID NO: 2124394 - RNA, 22 nt, Staphylococcus aureus subsp. aureus N315
caucauuuauaugauguucaau

SEQ ID NO: 2124395 - RNA, 22 nt, Staphylococcus aureus subsp. aureus N315
caucauuuaaauauuucacgau

SEQ ID NO: 2124396 - RNA, 15 nt, Staphylococcus aureus subsp. aureus N315
caucauuuucaauac

SEQ ID NO: 2124397 - RNA, 14 nt, Staphylococcus aureus subsp. aureus N315
caucauaaucugcu

SEQ ID NO: 2124398 - RNA, 24 nt, Staphylococcus aureus subsp. aureus N315
caucaugaacuuuuauugccauaa

SEQ ID NO: 2124399 - RNA, 19 nt, Staphylococcus aureus subsp. aureus N315
cauauauauucguuacaaa

SEQ ID NO: 2124400 - RNA, 13 nt, Staphylococcus aureus subsp. aureus N315
cauuguaacucaa

SEQ ID NO: 2124401 - RNA, 19 nt, Staphylococcus aureus subsp. aureus N315
cauuguugauaaauggaaa

SEQ ID NO: 2124402 - RNA, 19 nt, Staphylococcus aureus subsp. aureus N315
cauucauaauuuguugaua

SEQ ID NO: 2124403 - RNA, 14 nt, Staphylococcus aureus subsp. aureus N315
cauucauuugcaaa

SEQ ID NO: 2124404 - RNA, 12 nt, Staphylococcus aureus subsp. aureus N315
ccaaguuaaugc

SEQ ID NO: 2124405 - RNA, 14 nt, Staphylococcus aureus subsp. aureus N315
ccaagaacguguuu

SEQ ID NO: 2124406 - RNA, 20 nt, Staphylococcus aureus subsp. aureus N315
caugccagaugcaaugauac

SEQ ID NO: 2124407 - RNA, 21 nt, Staphylococcus aureus subsp. aureus N315
caucucuuauaaguucaacca

SEQ ID NO: 2124408 - RNA, 15 nt, Staphylococcus aureus subsp. aureus N315
ccagccauuaaaccu

SEQ ID NO: 2124409 - RNA, 18 nt, Staphylococcus aureus subsp. aureus N315
cccguaauaauuuacagg

SEQ ID NO: 2124410 - RNA, 17 nt, Staphylococcus aureus subsp. aureus N315
augauuuauuaacucau

SEQ ID NO: 2124411 - RNA, 17 nt, Staphylococcus aureus subsp. aureus N315
augauucuacagcacug

SEQ ID NO: 2124412 - RNA, 16 nt, Staphylococcus aureus subsp. aureus N315
augaugcgaaaccuuu

SEQ ID NO: 2124413 - RNA, 22 nt, Staphylococcus aureus subsp. aureus N315
augaucuuuguagccuucaacu

SEQ ID NO: 2124414 - RNA, 18 nt, Staphylococcus aureus subsp. aureus N315
augaggaucaacugaaau

SEQ ID NO: 2124415 - RNA, 15 nt, Staphylococcus aureus subsp. aureus N315
aucugacauuguugc

SEQ ID NO: 2124416 - RNA, 17 nt, Staphylococcus aureus subsp. aureus N315
aucugaaucaguuacug

SEQ ID NO: 2124417 - RNA, 17 nt, Staphylococcus aureus subsp. aureus N315
augacuaagauaucugg

SEQ ID NO: 2124418 - RNA, 21 nt, Staphylococcus aureus subsp. aureus N315
augcaaaucaaauacaucaau

SEQ ID NO: 2124419 - RNA, 19 nt, Staphylococcus aureus subsp. aureus N315
augcacaauauucguagca

SEQ ID NO: 2124420 - RNA, 12 nt, Staphylococcus aureus subsp. aureus N315
augcacaauauu

SEQ ID NO: 2124421 - RNA, 21 nt, Staphylococcus aureus subsp. aureus N315
auuaauuuacucaaaccaucu

SEQ ID NO: 2124422 - RNA, 12 nt, Staphylococcus aureus subsp. aureus N315
auuaaucauuua

SEQ ID NO: 2124423 - RNA, 15 nt, Staphylococcus aureus subsp. aureus N315
auuaaugguauugau

SEQ ID NO: 2124424 - RNA, 20 nt, Staphylococcus aureus subsp. aureus N315
auuaauaagcauuaauguuc

SEQ ID NO: 2124425 - RNA, 23 nt, Staphylococcus aureus subsp. aureus N315
auuaacauuuugaaucauacgaa

SEQ ID NO: 2124426 - RNA, 15 nt, Staphylococcus aureus subsp. aureus N315
auuaaccaucaugac

SEQ ID NO: 2124427 - RNA, 22 nt, Staphylococcus aureus subsp. aureus N315
auuauauuuuucuucaguuaaa

SEQ ID NO: 2124428 - RNA, 14 nt, Staphylococcus aureus subsp. aureus N315
auuauaauaaauag

SEQ ID NO: 2124429 - RNA, 16 nt, Staphylococcus aureus subsp. aureus N315
auuauaaccgcuacaa

SEQ ID NO: 2124430 - RNA, 21 nt, Staphylococcus aureus subsp. aureus N315
auuagagccuacucauauuca

SEQ ID NO: 2124431 - RNA, 21 nt, Staphylococcus aureus subsp. aureus N315
auuagcaaauauuauuaaauc

SEQ ID NO: 2124432 - RNA, 19 nt, Staphylococcus aureus subsp. aureus N315
auuacugcagcaucauaau

SEQ ID NO: 2124433 - RNA, 22 nt, Staphylococcus aureus subsp. aureus N315
auuacuccaauuaccaaugaau

SEQ ID NO: 2124434 - RNA, 15 nt, Staphylococcus aureus subsp. aureus N315
auuaucuauccauuu

SEQ ID NO: 2124435 - RNA, 20 nt, Staphylococcus aureus subsp. aureus N315
auuaucguaauuguuaaacc

SEQ ID NO: 2124436 - RNA, 17 nt, Staphylococcus aureus subsp. aureus N315
auuauccauucuuuguu

SEQ ID NO: 2124437 - RNA, 18 nt, Staphylococcus aureus subsp. aureus N315
auuccacuacaaucauac

SEQ ID NO: 2124438 - RNA, 16 nt, Staphylococcus aureus subsp. aureus N315
auucauuacaaccauu

SEQ ID NO: 2124439 - RNA, 12 nt, Staphylococcus aureus subsp. aureus N315
auuccaaucuau

SEQ ID NO: 2124440 - RNA, 22 nt, Staphylococcus aureus subsp. aureus N315
auucauucguacuuccaauacu

SEQ ID NO: 2124441 - RNA, 22 nt, Staphylococcus aureus subsp. aureus N315
auguaccgaauccuucaucaau

SEQ ID NO: 2124442 - RNA, 17 nt, Staphylococcus aureus subsp. aureus N315
auguacgaaaauuuugu

SEQ ID NO: 2124443 - RNA, 13 nt, Staphylococcus aureus subsp. aureus N315
auguagcuuugug

SEQ ID NO: 2124444 - RNA, 16 nt, Staphylococcus aureus subsp. aureus N315
auggucauguguugca

SEQ ID NO: 2124445 - RNA, 19 nt, Staphylococcus aureus subsp. aureus N315
augcugaaauguagacaau

SEQ ID NO: 2124446 - RNA, 24 nt, Staphylococcus aureus subsp. aureus N315
aucgccuuggccaggugauugacg

SEQ ID NO: 2124447 - RNA, 15 nt, Staphylococcus aureus subsp. aureus N315
aucuauuuuucgauu

SEQ ID NO: 2124448 - RNA, 18 nt, Staphylococcus aureus subsp. aureus N315
aucguuaucuuuaaguaa

SEQ ID NO: 2124449 - RNA, 16 nt, Staphylococcus aureus subsp. aureus N315
aucucguuuuuacaug

SEQ ID NO: 2124450 - RNA, 13 nt, Staphylococcus aureus subsp. aureus N315
aucucuguauuga

SEQ ID NO: 2124451 - RNA, 16 nt, Staphylococcus aureus subsp. aureus N315
aucaugcucauuugau

SEQ ID NO: 2124452 - RNA, 15 nt, Staphylococcus aureus subsp. aureus N315
aucauuuucaauacu

SEQ ID NO: 2124453 - RNA, 22 nt, Staphylococcus aureus subsp. aureus N315
aucauguauauggcaucaucac

SEQ ID NO: 2124454 - RNA, 19 nt, Staphylococcus aureus subsp. aureus N315
aucauguauauggcaucau

SEQ ID NO: 2124455 - RNA, 22 nt, Staphylococcus aureus subsp. aureus N315
aucauggucaacuuuuuuaacu

SEQ ID NO: 2124456 - RNA, 22 nt, Staphylococcus aureus subsp. aureus N315
auccaauuuaauagcuuguaca

SEQ ID NO: 2124457 - RNA, 12 nt, Staphylococcus aureus subsp. aureus N315
aucauaucgauu

SEQ ID NO: 2124458 - RNA, 16 nt, Staphylococcus aureus subsp. aureus N315
auauuggacuuugcug

SEQ ID NO: 2124459 - RNA, 15 nt, Staphylococcus aureus subsp. aureus N315
auauugauagcaccg

SEQ ID NO: 2124460 - RNA, 12 nt, Staphylococcus aureus subsp. aureus N315
auccaucuacac

SEQ ID NO: 2124461 - RNA, 15 nt, Staphylococcus aureus subsp. aureus N315
auccauucaauguuu

SEQ ID NO: 2124462 - RNA, 23 nt, Staphylococcus aureus subsp. aureus N315
auuuaauaggcuauguaaaucgu

SEQ ID NO: 2124463 - RNA, 19 nt, Staphylococcus aureus subsp. aureus N315
auuuaggaguauccugauu

SEQ ID NO: 2124464 - RNA, 21 nt, Staphylococcus aureus subsp. aureus N315
auuuaguuuuuuuaaaguuua

SEQ ID NO: 2124465 - RNA, 16 nt, Staphylococcus aureus subsp. aureus N315
auuuaauuauuucucu

SEQ ID NO: 2124466 - RNA, 21 nt, Staphylococcus aureus subsp. aureus N315
auuuaauaauaccaucugaau

SEQ ID NO: 2124467 - RNA, 20 nt, Staphylococcus aureus subsp. aureus N315
auuuaacggaaauacaauga

SEQ ID NO: 2124468 - RNA, 21 nt, Staphylococcus aureus subsp. aureus N315
auuucaucaaauccaaaaucu

SEQ ID NO: 2124469 - RNA, 14 nt, Staphylococcus aureus subsp. aureus N315
auuuauuaauccau

SEQ ID NO: 2124470 - RNA, 17 nt, Staphylococcus aureus subsp. aureus N315
auuuaucuuuuaaaauc

SEQ ID NO: 2124471 - RNA, 17 nt, Staphylococcus aureus subsp. aureus N315
auuuauuuuauaauaac

SEQ ID NO: 2124472 - RNA, 15 nt, Staphylococcus aureus subsp. aureus N315
auuucaauuaucaaa

SEQ ID NO: 2124473 - RNA, 15 nt, Staphylococcus aureus subsp. aureus N315
auuucuacucgaaac

SEQ ID NO: 2124474 - RNA, 17 nt, Staphylococcus aureus subsp. aureus N315
auuucuauacaaucauu

SEQ ID NO: 2124475 - RNA, 21 nt, Staphylococcus aureus subsp. aureus N315
auuugaauaagugguuguucc

SEQ ID NO: 2124476 - RNA, 13 nt, Staphylococcus aureus subsp. aureus N315
auuucugucccac

SEQ ID NO: 2124477 - RNA, 19 nt, Staphylococcus aureus subsp. aureus N315
auuucuucuccuucaaugu

SEQ ID NO: 2124478 - RNA, 18 nt, Staphylococcus aureus subsp. aureus N315
auuuuaauaaaaucaucu

SEQ ID NO: 2124479 - RNA, 23 nt, Staphylococcus aureus subsp. aureus N315
auuuuaccuugagcagcaucaau

SEQ ID NO: 2124480 - RNA, 16 nt, Staphylococcus aureus subsp. aureus N315
auuuguaaacaguaug

SEQ ID NO: 2124481 - RNA, 15 nt, Staphylococcus aureus subsp. aureus N315
auuugccauauacac

SEQ ID NO: 2124482 - RNA, 19 nt, Staphylococcus aureus subsp. aureus N315
auuuucaaauuucuaacuu

SEQ ID NO: 2124483 - RNA, 18 nt, Staphylococcus aureus subsp. aureus N315
auuuuaucugaaucugcu

SEQ ID NO: 2124484 - RNA, 13 nt, Staphylococcus aureus subsp. aureus N315
auuuuaucugaau

SEQ ID NO: 2124485 - RNA, 21 nt, Staphylococcus aureus subsp. aureus N315
auuuucaauuagaaaauaucu

SEQ ID NO: 2124486 - RNA, 17 nt, Staphylococcus aureus subsp. aureus N315
auuuugaaucacauuaa

SEQ ID NO: 2124487 - RNA, 20 nt, Staphylococcus aureus subsp. aureus N315
caaaaaaucgaacaaaugaa

SEQ ID NO: 2124488 - RNA, 15 nt, Staphylococcus aureus subsp. aureus N315
caaaaaaagcugauu

SEQ ID NO: 2124489 - RNA, 13 nt, Staphylococcus aureus subsp. aureus N315
auuuuuucaaugu

SEQ ID NO: 2124490 - RNA, 14 nt, Staphylococcus aureus subsp. aureus N315
auuuuucaaauguu

SEQ ID NO: 2124491 - RNA, 19 nt, Staphylococcus aureus subsp. aureus N315
caaaaucaacccaucaugu

SEQ ID NO: 2124492 - RNA, 20 nt, Staphylococcus aureus subsp. aureus N315
caaaagcgcaggcgaaccga

SEQ ID NO: 2124493 - RNA, 22 nt, Staphylococcus aureus subsp. aureus N315
caaaacaauauacccagaugaa

SEQ ID NO: 2124494 - RNA, 16 nt, Staphylococcus aureus subsp. aureus N315
caagauuaugacaaca

SEQ ID NO: 2124495 - RNA, 18 nt, Staphylococcus aureus subsp. aureus N315
caacuuguauuguuugua

SEQ ID NO: 2124496 - RNA, 22 nt, Staphylococcus aureus subsp. aureus N315
caacuuuguuuucaguaacuga

SEQ ID NO: 2124497 - RNA, 21 nt, Staphylococcus aureus subsp. aureus N315
caacugauaauugaugugccu

SEQ ID NO: 2124498 - RNA, 21 nt, Staphylococcus aureus subsp. aureus N315
caaaguucguaauugucuuua

SEQ ID NO: 2124499 - RNA, 16 nt, Staphylococcus aureus subsp. aureus N315
caaaguauauacuaau

SEQ ID NO: 2124500 - RNA, 22 nt, Staphylococcus aureus subsp. aureus N315
caacacguuguuguugaccacc

SEQ ID NO: 2124501 - RNA, 14 nt, Staphylococcus aureus subsp. aureus N315
caccccaacucgca

SEQ ID NO: 2124502 - RNA, 14 nt, Staphylococcus aureus subsp. aureus N315
caccccaacuugca

SEQ ID NO: 2124503 - RNA, 15 nt, Staphylococcus aureus subsp. aureus N315
caauggcagaugauu

SEQ ID NO: 2124504 - RNA, 13 nt, Staphylococcus aureus subsp. aureus N315
caauuaaaucgau

SEQ ID NO: 2124505 - RNA, 20 nt, Staphylococcus aureus subsp. aureus N315
caauuaauuuagucauuaca

SEQ ID NO: 2124506 - RNA, 21 nt, Staphylococcus aureus subsp. aureus N315
caauuaauuuagucauuacaa

SEQ ID NO: 2124507 - RNA, 20 nt, Staphylococcus aureus subsp. aureus N315
caauucucuuaucuugauuu

SEQ ID NO: 2124508 - RNA, 20 nt, Staphylococcus aureus subsp. aureus N315
caauugaaucuuuguuauau

SEQ ID NO: 2124509 - RNA, 18 nt, Staphylococcus aureus subsp. aureus N315
caaugacauccauacaaa

SEQ ID NO: 2124510 - RNA, 21 nt, Staphylococcus aureus subsp. aureus N315
cacagcggaauacagaugaug

SEQ ID NO: 2124511 - RNA, 16 nt, Staphylococcus aureus subsp. aureus N315
cacaucuuuuugauaa

SEQ ID NO: 2124512 - RNA, 17 nt, Staphylococcus aureus subsp. aureus N315
cacauuguuuacaaagu

SEQ ID NO: 2124513 - RNA, 16 nt, Staphylococcus aureus subsp. aureus N315
cacauucccguuaaua

SEQ ID NO: 2124514 - RNA, 13 nt, Staphylococcus aureus subsp. aureus N315
agguaaaucuguu

SEQ ID NO: 2124515 - RNA, 21 nt, Staphylococcus aureus subsp. aureus N315
aggucaaaaaauuaaucaauu

SEQ ID NO: 2124516 - RNA, 15 nt, Staphylococcus aureus subsp. aureus N315
aggaucaacugaaau

SEQ ID NO: 2124517 - RNA, 17 nt, Staphylococcus aureus subsp. aureus N315
aggauaagaacgagaau

SEQ ID NO: 2124518 - RNA, 22 nt, Staphylococcus aureus subsp. aureus N315
aggaaugauauaccuugauuca

SEQ ID NO: 2124519 - RNA, 16 nt, Staphylococcus aureus subsp. aureus N315
agcuucuuaaaucaac

SEQ ID NO: 2124520 - RNA, 15 nt, Staphylococcus aureus subsp. aureus N315
agcugcuuuaaggaa

SEQ ID NO: 2124521 - RNA, 14 nt, Staphylococcus aureus subsp. aureus N315
auauaaagcuuuga

SEQ ID NO: 2124522 - RNA, 20 nt, Staphylococcus aureus subsp. aureus N315
auauaaagucguaucauaua

SEQ ID NO: 2124523 - RNA, 14 nt, Staphylococcus aureus subsp. aureus N315
auauaaauaucaau

SEQ ID NO: 2124524 - RNA, 20 nt, Staphylococcus aureus subsp. aureus N315
auauaaaucaaauauacuuu

SEQ ID NO: 2124525 - RNA, 14 nt, Staphylococcus aureus subsp. aureus N315
auauaaaucauuuc

SEQ ID NO: 2124526 - RNA, 22 nt, Staphylococcus aureus subsp. aureus N315
auauagcauaaaauuucugcuu

SEQ ID NO: 2124527 - RNA, 22 nt, Staphylococcus aureus subsp. aureus N315
auauagaguaguucggaugaga

SEQ ID NO: 2124528 - RNA, 14 nt, Staphylococcus aureus subsp. aureus N315
auauucacaucuuu

SEQ ID NO: 2124529 - RNA, 22 nt, Staphylococcus aureus subsp. aureus N315
auauucaccuacaacaccaauu

SEQ ID NO: 2124530 - RNA, 13 nt, Staphylococcus aureus subsp. aureus N315
auauucucugcuu

SEQ ID NO: 2124531 - RNA, 13 nt, Staphylococcus aureus subsp. aureus N315
auauucguuacaa

SEQ ID NO: 2124532 - RNA, 17 nt, Staphylococcus aureus subsp. aureus N315
auauucguuacaaauga

SEQ ID NO: 2124533 - RNA, 15 nt, Staphylococcus aureus subsp. aureus N315
auauucucugcuucu

SEQ ID NO: 2124534 - RNA, 14 nt, Staphylococcus aureus subsp. aureus N315
auaucuuuuccaaa

SEQ ID NO: 2124535 - RNA, 12 nt, Staphylococcus aureus subsp. aureus N315
auaucuuucaau

SEQ ID NO: 2124536 - RNA, 17 nt, Staphylococcus aureus subsp. aureus N315
auaucuugcuuggauaa

SEQ ID NO: 2124537 - RNA, 20 nt, Staphylococcus aureus subsp. aureus N315
auaucucaagauauccauua

SEQ ID NO: 2124538 - RNA, 13 nt, Staphylococcus aureus subsp. aureus N315
auaguaaucgauu

SEQ ID NO: 2124539 - RNA, 20 nt, Staphylococcus aureus subsp. aureus N315
auagucauaacgauuguugc

SEQ ID NO: 2124540 - RNA, 23 nt, Staphylococcus aureus subsp. aureus N315
auagucaucuguuaauucaggau

SEQ ID NO: 2124541 - RNA, 19 nt, Staphylococcus aureus subsp. aureus N315
auaguccgcguguacuuua

SEQ ID NO: 2124542 - RNA, 16 nt, Staphylococcus aureus subsp. aureus N315
auagucauuacauuuu

SEQ ID NO: 2124543 - RNA, 19 nt, Staphylococcus aureus subsp. aureus N315
auaguggaugcucguauag

SEQ ID NO: 2124544 - RNA, 19 nt, Staphylococcus aureus subsp. aureus N315
auauaaaacggacaaguuu

SEQ ID NO: 2124545 - RNA, 16 nt, Staphylococcus aureus subsp. aureus N315
auagcuaaugcauuau

SEQ ID NO: 2124546 - RNA, 20 nt, Staphylococcus aureus subsp. aureus N315
auaggaucaccuauuaggau

SEQ ID NO: 2124547 - RNA, 21 nt, Staphylococcus aureus subsp. aureus N315
auacuuucacuuuuuauauca

SEQ ID NO: 2124548 - RNA, 17 nt, Staphylococcus aureus subsp. aureus N315
auacuuuugcaucacag

SEQ ID NO: 2124549 - RNA, 18 nt, Staphylococcus aureus subsp. aureus N315
auacuuucuaagauacgu

SEQ ID NO: 2124550 - RNA, 18 nt, Staphylococcus aureus subsp. aureus N315
auagaaaugacgauaccu

SEQ ID NO: 2124551 - RNA, 20 nt, Staphylococcus aureus subsp. aureus N315
auaaccuuuaaaacaucauu

SEQ ID NO: 2124552 - RNA, 22 nt, Staphylococcus aureus subsp. aureus N315
aguuugaucauaauucaguguu

SEQ ID NO: 2124553 - RNA, 17 nt, Staphylococcus aureus subsp. aureus N315
aguuugaucauaauuca

SEQ ID NO: 2124554 - RNA, 22 nt, Staphylococcus aureus subsp. aureus N315
auaaccaccaucccauuaaacc

SEQ ID NO: 2124555 - RNA, 14 nt, Staphylococcus aureus subsp. aureus N315
auaaccauaaugaa

SEQ ID NO: 2124556 - RNA, 15 nt, Staphylococcus aureus subsp. aureus N315
auaauaaaucgaauu

SEQ ID NO: 2124557 - RNA, 17 nt, Staphylococcus aureus subsp. aureus N315
auaaguuacuagcauua

SEQ ID NO: 2124558 - RNA, 23 nt, Staphylococcus aureus subsp. aureus N315
auaauaccuucaauugacauuaa

SEQ ID NO: 2124559 - RNA, 18 nt, Staphylococcus aureus subsp. aureus N315
auaauagccauucgaugc

SEQ ID NO: 2124560 - RNA, 13 nt, Staphylococcus aureus subsp. aureus N315
auacaaauugauu

SEQ ID NO: 2124561 - RNA, 23 nt, Staphylococcus aureus subsp. aureus N315
auacaaaucguaaacauaaugac

SEQ ID NO: 2124562 - RNA, 13 nt, Staphylococcus aureus subsp. aureus N315
auacaaaguacag

SEQ ID NO: 2124563 - RNA, 17 nt, Staphylococcus aureus subsp. aureus N315
auacaaaaauauagcua

SEQ ID NO: 2124564 - RNA, 18 nt, Staphylococcus aureus subsp. aureus N315
auaauaugugcaugagac

SEQ ID NO: 2124565 - RNA, 22 nt, Staphylococcus aureus subsp. aureus N315
auaauaggauaccacaucgcau

SEQ ID NO: 2124566 - RNA, 17 nt, Staphylococcus aureus subsp. aureus N315
auaauagaaagcgcauu

SEQ ID NO: 2124567 - RNA, 16 nt, Staphylococcus aureus subsp. aureus N315
auacgauuuguucaau

SEQ ID NO: 2124568 - RNA, 24 nt, Staphylococcus aureus subsp. aureus N315
auacgagcuuugcucauagaugac

SEQ ID NO: 2124569 - RNA, 19 nt, Staphylococcus aureus subsp. aureus N315
auaccuauuccuauuacua

SEQ ID NO: 2124570 - RNA, 22 nt, Staphylococcus aureus subsp. aureus N315
auaccuaaugcgacaucgccaa

SEQ ID NO: 2124571 - RNA, 16 nt, Staphylococcus aureus subsp. aureus N315
aguauuaaauuugugu

SEQ ID NO: 2124572 - RNA, 13 nt, Staphylococcus aureus subsp. aureus N315
aguauaauccauc

SEQ ID NO: 2124573 - RNA, 21 nt, Staphylococcus aureus subsp. aureus N315
aguagacgguaucaucugcau

SEQ ID NO: 2124574 - RNA, 13 nt, Staphylococcus aureus subsp. aureus N315
agugaaauaccuc

SEQ ID NO: 2124575 - RNA, 14 nt, Staphylococcus aureus subsp. aureus N315
aguugguaucgauu

SEQ ID NO: 2124576 - RNA, 15 nt, Staphylococcus aureus subsp. aureus N315
aguuucguuguacag

SEQ ID NO: 2124577 - RNA, 21 nt, Staphylococcus aureus subsp. aureus N315
aguuuccauaaauaaaaugcu

SEQ ID NO: 2124578 - RNA, 19 nt, Staphylococcus aureus subsp. aureus N315
aguuauuuauucagcauug

SEQ ID NO: 2124579 - RNA, 21 nt, Staphylococcus aureus subsp. aureus N315
aguuaaagacuagccauaccu

SEQ ID NO: 2124580 - RNA, 18 nt, Staphylococcus aureus subsp. aureus N315
aguguugacuuuaucaau

SEQ ID NO: 2124581 - RNA, 20 nt, Staphylococcus aureus subsp. aureus N315
agugcuuuuuuaccagcaug

SEQ ID NO: 2124582 - RNA, 20 nt, Staphylococcus aureus subsp. aureus N315
agugauuucuucauuaucaa

SEQ ID NO: 2124583 - RNA, 15 nt, Staphylococcus aureus subsp. aureus N315
agugauucaggauug

SEQ ID NO: 2124584 - RNA, 15 nt, Staphylococcus aureus subsp. aureus N315
agaaauaaucacauu

SEQ ID NO: 2124585 - RNA, 21 nt, Staphylococcus aureus subsp. aureus N315
agaaauacauccauacuucua

SEQ ID NO: 2124586 - RNA, 15 nt, Staphylococcus aureus subsp. aureus N315
agaacaagaauuaug

SEQ ID NO: 2124587 - RNA, 18 nt, Staphylococcus aureus subsp. aureus N315
agaaauucgaaaagaaau

SEQ ID NO: 2124588 - RNA, 20 nt, Staphylococcus aureus subsp. aureus N315
agaaggggacuuaaccauuu

SEQ ID NO: 2124589 - RNA, 18 nt, Staphylococcus aureus subsp. aureus N315
agaaguuuccaacguuau

SEQ ID NO: 2124590 - RNA, 10 nt, Staphylococcus aureus subsp. aureus N315
agacagaaau

SEQ ID NO: 2124591 - RNA, 15 nt, Staphylococcus aureus subsp. aureus N315
agaauugcaacgcau

SEQ ID NO: 2124592 - RNA, 21 nt, Staphylococcus aureus subsp. aureus N315
agaauuucgaaaagaaauucu

SEQ ID NO: 2124593 - RNA, 23 nt, Staphylococcus aureus subsp. aureus N315
agaauuucuuuucgaaaaucucu

SEQ ID NO: 2124594 - RNA, 17 nt, Staphylococcus aureus subsp. aureus N315
agaauguguuaaucaac

SEQ ID NO: 2124595 - RNA, 22 nt, Staphylococcus aureus subsp. aureus N315
agauaggauuuacaccuauacc

SEQ ID NO: 2124596 - RNA, 20 nt, Staphylococcus aureus subsp. aureus N315
agacuuuccaccauaugugg

SEQ ID NO: 2124597 - RNA, 16 nt, Staphylococcus aureus subsp. aureus N315
agacgauuucaaugag

SEQ ID NO: 2124598 - RNA, 17 nt, Staphylococcus aureus subsp. aureus N315
agauuuuguauuagcau

SEQ ID NO: 2124599 - RNA, 17 nt, Staphylococcus aureus subsp. aureus N315
agauuuuaaacgcucau

SEQ ID NO: 2124600 - RNA, 15 nt, Staphylococcus aureus subsp. aureus N315
agauuuauaaauguu

SEQ ID NO: 2124601 - RNA, 14 nt, Staphylococcus aureus subsp. aureus N315
agcguaauggauua

SEQ ID NO: 2124602 - RNA, 23 nt, Staphylococcus aureus subsp. aureus N315
uaaaauuugugcauucaucaaug

SEQ ID NO: 2124603 - RNA, 22 nt, Staphylococcus aureus subsp. aureus N315
uaaaauuugaauugacuuacau

SEQ ID NO: 2124604 - RNA, 20 nt, Staphylococcus aureus subsp. aureus N315
uaaaauguuaggugaaacca

SEQ ID NO: 2124605 - RNA, 22 nt, Staphylococcus aureus subsp. aureus N315
uaaaauuggaacacgaaauggu

SEQ ID NO: 2124606 - RNA, 19 nt, Staphylococcus aureus subsp. aureus N315
uaaaaguuaccuacuacau

SEQ ID NO: 2124607 - RNA, 16 nt, Staphylococcus aureus subsp. aureus N315
uaaaacgacucauuau

SEQ ID NO: 2124608 - RNA, 12 nt, Staphylococcus aureus subsp. aureus N315
uaaaacuuacau

SEQ ID NO: 2124609 - RNA, 15 nt, Staphylococcus aureus subsp. aureus N315
uaaagguaccacugu

SEQ ID NO: 2124610 - RNA, 14 nt, Staphylococcus aureus subsp. aureus N315
uaaauaaaauuguu

SEQ ID NO: 2124611 - RNA, 19 nt, Staphylococcus aureus subsp. aureus N315
uaaaguuuaaauauucacg

SEQ ID NO: 2124612 - RNA, 20 nt, Staphylococcus aureus subsp. aureus N315
uaaagcauaucucaagauau

SEQ ID NO: 2124613 - RNA, 15 nt, Staphylococcus aureus subsp. aureus N315
uaaagacaccuucaa

SEQ ID NO: 2124614 - RNA, 18 nt, Staphylococcus aureus subsp. aureus N315
uaaagauuaaaauaugac

SEQ ID NO: 2124615 - RNA, 14 nt, Staphylococcus aureus subsp. aureus N315
uaaaucaugacaua

SEQ ID NO: 2124616 - RNA, 17 nt, Staphylococcus aureus subsp. aureus N315
uaaaucauagaggcaca

SEQ ID NO: 2124617 - RNA, 20 nt, Staphylococcus aureus subsp. aureus N315
uaaaucacuagcuaaugcac

SEQ ID NO: 2124618 - RNA, 22 nt, Staphylococcus aureus subsp. aureus N315
uaaauauuggaauacucuucaa

SEQ ID NO: 2124619 - RNA, 23 nt, Staphylococcus aureus subsp. aureus N315
uaaauaaacucaccaaguucacu

SEQ ID NO: 2124620 - RNA, 20 nt, Staphylococcus aureus subsp. aureus N315
uaaauaacaccgguacuuug

SEQ ID NO: 2124621 - RNA, 12 nt, Staphylococcus aureus subsp. aureus N315
uaaauguaucac

SEQ ID NO: 2124622 - RNA, 18 nt, Staphylococcus aureus subsp. aureus N315
uaaaugcagcuguauaac

SEQ ID NO: 2124623 - RNA, 18 nt, Staphylococcus aureus subsp. aureus N315
uaaaugauuaauaacaua

SEQ ID NO: 2124624 - RNA, 20 nt, Staphylococcus aureus subsp. aureus N315
uaaaugaucaucguauagau

SEQ ID NO: 2124625 - RNA, 16 nt, Staphylococcus aureus subsp. aureus N315
uaaaucuacuacuaau

SEQ ID NO: 2124626 - RNA, 22 nt, Staphylococcus aureus subsp. aureus N315
uaaaucuauauaaaguugacaa

SEQ ID NO: 2124627 - RNA, 17 nt, Staphylococcus aureus subsp. aureus N315
uaacaaacauuaaucua

SEQ ID NO: 2124628 - RNA, 18 nt, Staphylococcus aureus subsp. aureus N315
uaaauugcacgucuugua

SEQ ID NO: 2124629 - RNA, 16 nt, Staphylococcus aureus subsp. aureus N315
uaaauuuaaauguguu

SEQ ID NO: 2124630 - RNA, 21 nt, Staphylococcus aureus subsp. aureus N315
uaaauuaagcaugacacucau

SEQ ID NO: 2124631 - RNA, 19 nt, Staphylococcus aureus subsp. aureus N315
uaaauguuauuaaccauca

SEQ ID NO: 2124632 - RNA, 20 nt, Staphylococcus aureus subsp. aureus N315
uaaauugacuuuaauugcuc

SEQ ID NO: 2124633 - RNA, 21 nt, Staphylococcus aureus subsp. aureus N315
uaacaauuuuguugcaugacu

SEQ ID NO: 2124634 - RNA, 21 nt, Staphylococcus aureus subsp. aureus N315
uaacaauacgcaauuagaguu

SEQ ID NO: 2124635 - RNA, 14 nt, Staphylococcus aureus subsp. aureus N315
uaacacgaacugca

SEQ ID NO: 2124636 - RNA, 17 nt, Staphylococcus aureus subsp. aureus N315
uaaugacuauaacacca

SEQ ID NO: 2124637 - RNA, 16 nt, Staphylococcus aureus subsp. aureus N315
uaaucuucuguuuaua

SEQ ID NO: 2124638 - RNA, 17 nt, Staphylococcus aureus subsp. aureus N315
uaaucuggguuguaauc

SEQ ID NO: 2124639 - RNA, 19 nt, Staphylococcus aureus subsp. aureus N315
uaaugaagauuuuguugaa

SEQ ID NO: 2124640 - RNA, 14 nt, Staphylococcus aureus subsp. aureus N315
uaaucugcaacgau

SEQ ID NO: 2124641 - RNA, 18 nt, Staphylococcus aureus subsp. aureus N315
uaauccgauuuugauaua

SEQ ID NO: 2124642 - RNA, 22 nt, Staphylococcus aureus subsp. aureus N315
uaauacguuuugcuaauucaag

SEQ ID NO: 2124643 - RNA, 20 nt, Staphylococcus aureus subsp. aureus N315
uaauacguuuaauaaugguu

SEQ ID NO: 2124644 - RNA, 14 nt, Staphylococcus aureus subsp. aureus N315
uaaugaugacauca

SEQ ID NO: 2124645 - RNA, 13 nt, Staphylococcus aureus subsp. aureus N315
uaaugauauuaag

SEQ ID NO: 2124646 - RNA, 16 nt, Staphylococcus aureus subsp. aureus N315
uaaugauaaauuaaag

SEQ ID NO: 2124647 - RNA, 16 nt, Staphylococcus aureus subsp. aureus N315
uaaugcugcuucuuca

SEQ ID NO: 2124648 - RNA, 16 nt, Staphylococcus aureus subsp. aureus N315
uaauggcaacuaagau

SEQ ID NO: 2124649 - RNA, 15 nt, Staphylococcus aureus subsp. aureus N315
uaauuaauguuucuu

SEQ ID NO: 2124650 - RNA, 18 nt, Staphylococcus aureus subsp. aureus N315
uaauuacagguuuaauug

SEQ ID NO: 2124651 - RNA, 14 nt, Staphylococcus aureus subsp. aureus N315
uaauuaauacauca

SEQ ID NO: 2124652 - RNA, 23 nt, Staphylococcus aureus subsp. aureus N315
uaauucaucuugcgccuuguuca

SEQ ID NO: 2124653 - RNA, 18 nt, Staphylococcus aureus subsp. aureus N315
uaauuccaguauuaacug

SEQ ID NO: 2124654 - RNA, 19 nt, Staphylococcus aureus subsp. aureus N315
uaaggaugauuuauuaacu

SEQ ID NO: 2124655 - RNA, 20 nt, Staphylococcus aureus subsp. aureus N315
uaaguuugucuuugaacaua

SEQ ID NO: 2124656 - RNA, 15 nt, Staphylococcus aureus subsp. aureus N315
uaaguuugucuuuga

SEQ ID NO: 2124657 - RNA, 21 nt, Staphylococcus aureus subsp. aureus N315
uaauaaaaccaccuguuugca

SEQ ID NO: 2124658 - RNA, 13 nt, Staphylococcus aureus subsp. aureus N315
uaauacaucuaau

SEQ ID NO: 2124659 - RNA, 21 nt, Staphylococcus aureus subsp. aureus N315
uaauacaucaucaaguucacc

SEQ ID NO: 2124660 - RNA, 14 nt, Staphylococcus aureus subsp. aureus N315
uaauaauguaucau

SEQ ID NO: 2124661 - RNA, 14 nt, Staphylococcus aureus subsp. aureus N315
uaauaacaaauagu

SEQ ID NO: 2124662 - RNA, 22 nt, Staphylococcus aureus subsp. aureus N315
uaauaagagaacuuuucaaaca

SEQ ID NO: 2124663 - RNA, 21 nt, Staphylococcus aureus subsp. aureus N315
uaacuuuuuaauaauuguauc

SEQ ID NO: 2124664 - RNA, 21 nt, Staphylococcus aureus subsp. aureus N315
uaagauaauuuucaauuagaa

SEQ ID NO: 2124665 - RNA, 21 nt, Staphylococcus aureus subsp. aureus N315
uaagagucuucuuacugcaau

SEQ ID NO: 2124666 - RNA, 16 nt, Staphylococcus aureus subsp. aureus N315
guugugcaauaccugu

SEQ ID NO: 2124667 - RNA, 18 nt, Staphylococcus aureus subsp. aureus N315
guuuauuuaauaacgaag

SEQ ID NO: 2124668 - RNA, 23 nt, Staphylococcus aureus subsp. aureus N315
guuuagaaagaauacaguuacuu

SEQ ID NO: 2124669 - RNA, 14 nt, Staphylococcus aureus subsp. aureus N315
guuuaagaauguac

SEQ ID NO: 2124670 - RNA, 23 nt, Staphylococcus aureus subsp. aureus N315
guuaaaaucgcagcaaugacacu

SEQ ID NO: 2124671 - RNA, 21 nt, Staphylococcus aureus subsp. aureus N315
guuaaaaccuuuucaaauuau

SEQ ID NO: 2124672 - RNA, 14 nt, Staphylococcus aureus subsp. aureus N315
guuaaucaacguau

SEQ ID NO: 2124673 - RNA, 16 nt, Staphylococcus aureus subsp. aureus N315
guuaauuucaacauua

SEQ ID NO: 2124674 - RNA, 16 nt, Staphylococcus aureus subsp. aureus N315
aaguuauuuauucagc

SEQ ID NO: 2124675 - RNA, 12 nt, Staphylococcus aureus subsp. aureus N315
aaguuauuuugu

SEQ ID NO: 2124676 - RNA, 18 nt, Staphylococcus aureus subsp. aureus N315
aaguuauuuaguacauag

SEQ ID NO: 2124677 - RNA, 16 nt, Staphylococcus aureus subsp. aureus N315
guuauuaaccaucaug

SEQ ID NO: 2124678 - RNA, 20 nt, Staphylococcus aureus subsp. aureus N315
guucaaauaacgcaaugucu

SEQ ID NO: 2124679 - RNA, 15 nt, Staphylococcus aureus subsp. aureus N315
guuacauauugcauu

SEQ ID NO: 2124680 - RNA, 18 nt, Staphylococcus aureus subsp. aureus N315
guuaccaaguaaugauac

SEQ ID NO: 2124681 - RNA, 16 nt, Staphylococcus aureus subsp. aureus N315
aaguguuucaacauau

SEQ ID NO: 2124682 - RNA, 21 nt, Staphylococcus aureus subsp. aureus N315
guguauauguggcacucauaa

SEQ ID NO: 2124683 - RNA, 20 nt, Staphylococcus aureus subsp. aureus N315
guguaacuuuaucacuguau

SEQ ID NO: 2124684 - RNA, 18 nt, Staphylococcus aureus subsp. aureus N315
guguaauaaagcaauguu

SEQ ID NO: 2124685 - RNA, 18 nt, Staphylococcus aureus subsp. aureus N315
aagugccguccauuucca

SEQ ID NO: 2124686 - RNA, 15 nt, Staphylococcus aureus subsp. aureus N315
aagugacaacauuau

SEQ ID NO: 2124687 - RNA, 18 nt, Staphylococcus aureus subsp. aureus N315
gugcaacuuuaagacuuu

SEQ ID NO: 2124688 - RNA, 22 nt, Staphylococcus aureus subsp. aureus N315
ucacgauagauuuaucaccuuu

SEQ ID NO: 2124689 - RNA, 14 nt, Staphylococcus aureus subsp. aureus N315
ucacucacuucaac

SEQ ID NO: 2124690 - RNA, 15 nt, Staphylococcus aureus subsp. aureus N315
aauacaaauauuaag

SEQ ID NO: 2124691 - RNA, 12 nt, Staphylococcus aureus subsp. aureus N315
aauacacuugau

SEQ ID NO: 2124692 - RNA, 14 nt, Staphylococcus aureus subsp. aureus N315
aauacaagucuuua

SEQ ID NO: 2124693 - RNA, 19 nt, Staphylococcus aureus subsp. aureus N315
ucaacgucgaauguuucuu

SEQ ID NO: 2124694 - RNA, 18 nt, Staphylococcus aureus subsp. aureus N315
ucacaucuuuagcuaugu

SEQ ID NO: 2124695 - RNA, 18 nt, Staphylococcus aureus subsp. aureus N315
ucacaugugaaauaaucc

SEQ ID NO: 2124696 - RNA, 18 nt, Staphylococcus aureus subsp. aureus N315
ucaugacauaaaacuuac

SEQ ID NO: 2124697 - RNA, 19 nt, Staphylococcus aureus subsp. aureus N315
uccaaauucauuuguauua

SEQ ID NO: 2124698 - RNA, 17 nt, Staphylococcus aureus subsp. aureus N315
ucauauucaauguuuua

SEQ ID NO: 2124699 - RNA, 23 nt, Staphylococcus aureus subsp. aureus N315
ucaguaggacauauaaauguuga

SEQ ID NO: 2124700 - RNA, 18 nt, Staphylococcus aureus subsp. aureus N315
ucaugaaaauaagcauca

SEQ ID NO: 2124701 - RNA, 13 nt, Staphylococcus aureus subsp. aureus N315
ucaucuuucaaau

SEQ ID NO: 2124702 - RNA, 16 nt, Staphylococcus aureus subsp. aureus N315
ucaguaaaaacgaaau

SEQ ID NO: 2124703 - RNA, 19 nt, Staphylococcus aureus subsp. aureus N315
ucagguucaaaauugcuga

SEQ ID NO: 2124704 - RNA, 19 nt, Staphylococcus aureus subsp. aureus N315
uacccaaaaaauuguauaa

SEQ ID NO: 2124705 - RNA, 13 nt, Staphylococcus aureus subsp. aureus N315
uaccauuccaaaa

SEQ ID NO: 2124706 - RNA, 18 nt, Staphylococcus aureus subsp. aureus N315
uaauuuuucuaaaugauu

SEQ ID NO: 2124707 - RNA, 13 nt, Staphylococcus aureus subsp. aureus N315
uaauuuuacucug

SEQ ID NO: 2124708 - RNA, 17 nt, Staphylococcus aureus subsp. aureus N315
uaauuuucaauuagaaa

SEQ ID NO: 2124709 - RNA, 15 nt, Staphylococcus aureus subsp. aureus N315
uaccuaauaggauca

SEQ ID NO: 2124710 - RNA, 19 nt, Staphylococcus aureus subsp. aureus N315
uagaugcuaauguaaucug

SEQ ID NO: 2124711 - RNA, 15 nt, Staphylococcus aureus subsp. aureus N315
uagauaaaucaagaa

SEQ ID NO: 2124712 - RNA, 21 nt, Staphylococcus aureus subsp. aureus N315
uagauagacuuucuugaugaa

SEQ ID NO: 2124713 - RNA, 18 nt, Staphylococcus aureus subsp. aureus N315
uagagauuguaagaauua

SEQ ID NO: 2124714 - RNA, 23 nt, Staphylococcus aureus subsp. aureus N315
uagaaucuacgauuuucaagacc

SEQ ID NO: 2124715 - RNA, 15 nt, Staphylococcus aureus subsp. aureus N315
uagaaugaauaauuc

SEQ ID NO: 2124716 - RNA, 17 nt, Staphylococcus aureus subsp. aureus N315
uagaauuaguacuugaa

SEQ ID NO: 2124717 - RNA, 23 nt, Staphylococcus aureus subsp. aureus N315
uagagaacgcuuuauuacuuuaa

SEQ ID NO: 2124718 - RNA, 13 nt, Staphylococcus aureus subsp. aureus N315
uacucauuuagcu

SEQ ID NO: 2124719 - RNA, 14 nt, Staphylococcus aureus subsp. aureus N315
uacuauggcauuau

SEQ ID NO: 2124720 - RNA, 19 nt, Staphylococcus aureus subsp. aureus N315
uacuuagcguacgauauag

SEQ ID NO: 2124721 - RNA, 12 nt, Staphylococcus aureus subsp. aureus N315
uacuucguauug

SEQ ID NO: 2124722 - RNA, 20 nt, Staphylococcus aureus subsp. aureus N315
uacuuaaugacuucuuuaua

SEQ ID NO: 2124723 - RNA, 19 nt, Staphylococcus aureus subsp. aureus N315
uacuuaaaccuaacauaac

SEQ ID NO: 2124724 - RNA, 16 nt, Staphylococcus aureus subsp. aureus N315
uacucuaacuuaccau

SEQ ID NO: 2124725 - RNA, 20 nt, Staphylococcus aureus subsp. aureus N315
uauaaaaauuuauucaaaau

SEQ ID NO: 2124726 - RNA, 18 nt, Staphylococcus aureus subsp. aureus N315
uauaagccuuuucaaaca

SEQ ID NO: 2124727 - RNA, 15 nt, Staphylococcus aureus subsp. aureus N315
uauaaauuaucagaa

SEQ ID NO: 2124728 - RNA, 15 nt, Staphylococcus aureus subsp. aureus N315
uauaacauucuucaa

SEQ ID NO: 2124729 - RNA, 14 nt, Staphylococcus aureus subsp. aureus N315
uauaguucuauugc

SEQ ID NO: 2124730 - RNA, 19 nt, Staphylococcus aureus subsp. aureus N315
uauagcaucauaaaguaaa

SEQ ID NO: 2124731 - RNA, 21 nt, Staphylococcus aureus subsp. aureus N315
uauagauucauguaaauaguu

SEQ ID NO: 2124732 - RNA, 15 nt, Staphylococcus aureus subsp. aureus N315
uaucaauugaaugaa

SEQ ID NO: 2124733 - RNA, 17 nt, Staphylococcus aureus subsp. aureus N315
uauccugauuuaauguu

SEQ ID NO: 2124734 - RNA, 18 nt, Staphylococcus aureus subsp. aureus N315
uaucauuguucauacgcu

SEQ ID NO: 2124735 - RNA, 13 nt, Staphylococcus aureus subsp. aureus N315
uaguauauucaac

SEQ ID NO: 2124736 - RNA, 22 nt, Staphylococcus aureus subsp. aureus N315
uaguagacgguaucaucugcau

SEQ ID NO: 2124737 - RNA, 22 nt, Staphylococcus aureus subsp. aureus N315
uaggaaacgguucaaaaguaaa

SEQ ID NO: 2124738 - RNA, 22 nt, Staphylococcus aureus subsp. aureus N315
uagugacauuugcaugcuucaa

SEQ ID NO: 2124739 - RNA, 20 nt, Staphylococcus aureus subsp. aureus N315
ucaaaaauuaaucaccuuau

SEQ ID NO: 2124740 - RNA, 22 nt, Staphylococcus aureus subsp. aureus N315
uauuuuuuggacuggguuguua

SEQ ID NO: 2124741 - RNA, 16 nt, Staphylococcus aureus subsp. aureus N315
uauuuuuuauguuuua

SEQ ID NO: 2124742 - RNA, 18 nt, Staphylococcus aureus subsp. aureus N315
ucaacaaagugcaauuau

SEQ ID NO: 2124743 - RNA, 19 nt, Staphylococcus aureus subsp. aureus N315
ucaacauuacaugcaccuu

SEQ ID NO: 2124744 - RNA, 15 nt, Staphylococcus aureus subsp. aureus N315
ucaacauuuuuucua

SEQ ID NO: 2124745 - RNA, 18 nt, Staphylococcus aureus subsp. aureus N315
ucaacaauugcuaaucca

SEQ ID NO: 2124746 - RNA, 17 nt, Staphylococcus aureus subsp. aureus N315
uauuucacucuacaauc

SEQ ID NO: 2124747 - RNA, 19 nt, Staphylococcus aureus subsp. aureus N315
uauuuaccacaaauaucaa

SEQ ID NO: 2124748 - RNA, 19 nt, Staphylococcus aureus subsp. aureus N315
uauuuaaaaugcuuguuca

SEQ ID NO: 2124749 - RNA, 16 nt, Staphylococcus aureus subsp. aureus N315
uauuuuuaugauucua

SEQ ID NO: 2124750 - RNA, 14 nt, Staphylococcus aureus subsp. aureus N315
uauuuucuugugua

SEQ ID NO: 2124751 - RNA, 22 nt, Staphylococcus aureus subsp. aureus N315
uauuuuuaaaugauucuuuaua

SEQ ID NO: 2124752 - RNA, 19 nt, Staphylococcus aureus subsp. aureus N315
uauuucuuuucauuaucau

SEQ ID NO: 2124753 - RNA, 21 nt, Staphylococcus aureus subsp. aureus N315
uauuuguagccuacaaccuuu

SEQ ID NO: 2124754 - RNA, 16 nt, Staphylococcus aureus subsp. aureus N315
uauuuggaaguuuuca

SEQ ID NO: 2124755 - RNA, 17 nt, Staphylococcus aureus subsp. aureus N315
uauguguuguguaucag

SEQ ID NO: 2124756 - RNA, 14 nt, Staphylococcus aureus subsp. aureus N315
uauguaacuacuau

SEQ ID NO: 2124757 - RNA, 20 nt, Staphylococcus aureus subsp. aureus N315
uauguagcaggcaacuuuua

SEQ ID NO: 2124758 - RNA, 18 nt, Staphylococcus aureus subsp. aureus N315
uauucgcuuaaaaacgcu

SEQ ID NO: 2124759 - RNA, 10 nt, Staphylococcus aureus subsp. aureus N315
uauucuguaa

SEQ ID NO: 2124760 - RNA, 17 nt, Staphylococcus aureus subsp. aureus N315
uaugcuaaacuugcauc

SEQ ID NO: 2124761 - RNA, 19 nt, Staphylococcus aureus subsp. aureus N315
uauggaaaauguuaucaau

SEQ ID NO: 2124762 - RNA, 15 nt, Staphylococcus aureus subsp. aureus N315
ugauaaauaaugcau

SEQ ID NO: 2124763 - RNA, 21 nt, Staphylococcus aureus subsp. aureus N315
ugauaaaaggggaaaucauuu

SEQ ID NO: 2124764 - RNA, 21 nt, Staphylococcus aureus subsp. aureus N315
ugaggccauaagccauaugcu

SEQ ID NO: 2124765 - RNA, 14 nt, Staphylococcus aureus subsp. aureus N315
ugaugaacuuaaug

SEQ ID NO: 2124766 - RNA, 13 nt, Staphylococcus aureus subsp. aureus N315
ugaugaacuucua

SEQ ID NO: 2124767 - RNA, 20 nt, Staphylococcus aureus subsp. aureus N315
ugaugaaugauugcauugau

SEQ ID NO: 2124768 - RNA, 20 nt, Staphylococcus aureus subsp. aureus N315
ugaugaacauaccugcauau

SEQ ID NO: 2124769 - RNA, 18 nt, Staphylococcus aureus subsp. aureus N315
ugaugaacauaccugcau

SEQ ID NO: 2124770 - RNA, 20 nt, Staphylococcus aureus subsp. aureus N315
ugaucuuuuuuauauucaac

SEQ ID NO: 2124771 - RNA, 15 nt, Staphylococcus aureus subsp. aureus N315
ugcagauuagguuac

SEQ ID NO: 2124772 - RNA, 15 nt, Staphylococcus aureus subsp. aureus N315
ugaugucauaugcac

SEQ ID NO: 2124773 - RNA, 12 nt, Staphylococcus aureus subsp. aureus N315
ugcauauucacg

SEQ ID NO: 2124774 - RNA, 13 nt, Staphylococcus aureus subsp. aureus N315
ucuuccaaucaac

SEQ ID NO: 2124775 - RNA, 22 nt, Staphylococcus aureus subsp. aureus N315
ucuucaauucuuacaccugcaa

SEQ ID NO: 2124776 - RNA, 14 nt, Staphylococcus aureus subsp. aureus N315
ucuucaaaacguuu

SEQ ID NO: 2124777 - RNA, 20 nt, Staphylococcus aureus subsp. aureus N315
ucuuggcauuuuuucauuau

SEQ ID NO: 2124778 - RNA, 14 nt, Staphylococcus aureus subsp. aureus N315
ucuuucuuguucua

SEQ ID NO: 2124779 - RNA, 21 nt, Staphylococcus aureus subsp. aureus N315
ucuuucauaaauuguuuuaca

SEQ ID NO: 2124780 - RNA, 18 nt, Staphylococcus aureus subsp. aureus N315
ugaaaguaaauuacaguu

SEQ ID NO: 2124781 - RNA, 20 nt, Staphylococcus aureus subsp. aureus N315
ugaaauuucgacaucuagau

SEQ ID NO: 2124782 - RNA, 14 nt, Staphylococcus aureus subsp. aureus N315
ugaaauuaaauuug

SEQ ID NO: 2124783 - RNA, 16 nt, Staphylococcus aureus subsp. aureus N315
ugaacgauauucuaca

SEQ ID NO: 2124784 - RNA, 22 nt, Staphylococcus aureus subsp. aureus N315
ugaacgauauucuacaugaauc

SEQ ID NO: 2124785 - RNA, 19 nt, Staphylococcus aureus subsp. aureus N315
ucgucuacuauuuuuucua

SEQ ID NO: 2124786 - RNA, 13 nt, Staphylococcus aureus subsp. aureus N315
uccuuuguuugua

SEQ ID NO: 2124787 - RNA, 21 nt, Staphylococcus aureus subsp. aureus N315
uccuuggaaacgauauagacc

SEQ ID NO: 2124788 - RNA, 14 nt, Staphylococcus aureus subsp. aureus N315
ucgacauugauguc

SEQ ID NO: 2124789 - RNA, 17 nt, Staphylococcus aureus subsp. aureus N315
ucccuuuuaucuuuaua

SEQ ID NO: 2124790 - RNA, 15 nt, Staphylococcus aureus subsp. aureus N315
ucccguuaauaucau

SEQ ID NO: 2124791 - RNA, 23 nt, Staphylococcus aureus subsp. aureus N315
aauaccgaauaauuuugauauag

SEQ ID NO: 2124792 - RNA, 21 nt, Staphylococcus aureus subsp. aureus N315
ucgcuucgguuaacuguucua

SEQ ID NO: 2124793 - RNA, 13 nt, Staphylococcus aureus subsp. aureus N315
ucggacgauugaa

SEQ ID NO: 2124794 - RNA, 15 nt, Staphylococcus aureus subsp. aureus N315
acagugacugauuca

SEQ ID NO: 2124795 - RNA, 18 nt, Staphylococcus aureus subsp. aureus N315
acauaaauuaagcaugac

SEQ ID NO: 2124796 - RNA, 19 nt, Staphylococcus aureus subsp. aureus N315
acauccccaaaaauagauu

SEQ ID NO: 2124797 - RNA, 14 nt, Staphylococcus aureus subsp. aureus N315
acauaugcagugac

SEQ ID NO: 2124798 - RNA, 20 nt, Staphylococcus aureus subsp. aureus N315
acaucuagaugaaauugugu

SEQ ID NO: 2124799 - RNA, 16 nt, Staphylococcus aureus subsp. aureus N315
acaucuacaucaaauu

SEQ ID NO: 2124800 - RNA, 17 nt, Staphylococcus aureus subsp. aureus N315
acaucuucauguaugaa

SEQ ID NO: 2124801 - RNA, 12 nt, Staphylococcus aureus subsp. aureus N315
acauuugucaua

SEQ ID NO: 2124802 - RNA, 16 nt, Staphylococcus aureus subsp. aureus N315
acaaucuuaucauaau

SEQ ID NO: 2124803 - RNA, 13 nt, Staphylococcus aureus subsp. aureus N315
acaauaugauuaa

SEQ ID NO: 2124804 - RNA, 21 nt, Staphylococcus aureus subsp. aureus N315
acaauauucguaaauccuuua

SEQ ID NO: 2124805 - RNA, 22 nt, Staphylococcus aureus subsp. aureus N315
acaauauagaaaaugaguacaa

SEQ ID NO: 2124806 - RNA, 15 nt, Staphylococcus aureus subsp. aureus N315
acaauuaaagugaau

SEQ ID NO: 2124807 - RNA, 15 nt, Staphylococcus aureus subsp. aureus N315
acaauggaugccgcu

SEQ ID NO: 2124808 - RNA, 15 nt, Staphylococcus aureus subsp. aureus N315
acaauuuagaugagu

SEQ ID NO: 2124809 - RNA, 13 nt, Staphylococcus aureus subsp. aureus N315
acaauuugcauaa

SEQ ID NO: 2124810 - RNA, 18 nt, Staphylococcus aureus subsp. aureus N315
acaauuuuugggaagaau

SEQ ID NO: 2124811 - RNA, 16 nt, Staphylococcus aureus subsp. aureus N315
acaagcauuuuucaau

SEQ ID NO: 2124812 - RNA, 15 nt, Staphylococcus aureus subsp. aureus N315
acaaaaguaugauuu

SEQ ID NO: 2124813 - RNA, 15 nt, Staphylococcus aureus subsp. aureus N315
aauuuuuuagugaaa

SEQ ID NO: 2124814 - RNA, 12 nt, Staphylococcus aureus subsp. aureus N315
acaaaaagacuu

SEQ ID NO: 2124815 - RNA, 13 nt, Staphylococcus aureus subsp. aureus N315
aauguuuaacaau

SEQ ID NO: 2124816 - RNA, 17 nt, Staphylococcus aureus subsp. aureus N315
aauguugauagccaccu

SEQ ID NO: 2124817 - RNA, 14 nt, Staphylococcus aureus subsp. aureus N315
aauuuuuauucugu

SEQ ID NO: 2124818 - RNA, 23 nt, Staphylococcus aureus subsp. aureus N315
aauuuuuauuuacacacaugaua

SEQ ID NO: 2124819 - RNA, 17 nt, Staphylococcus aureus subsp. aureus N315
aauguuaacugcaaacu

SEQ ID NO: 2124820 - RNA, 14 nt, Staphylococcus aureus subsp. aureus N315
aauguuaucuugcu

SEQ ID NO: 2124821 - RNA, 14 nt, Staphylococcus aureus subsp. aureus N315
aauguuaggugaaa

SEQ ID NO: 2124822 - RNA, 20 nt, Staphylococcus aureus subsp. aureus N315
aauguuccuuguuuuaaacu

SEQ ID NO: 2124823 - RNA, 15 nt, Staphylococcus aureus subsp. aureus N315
aauguucagguucaa

SEQ ID NO: 2124824 - RNA, 18 nt, Staphylococcus aureus subsp. aureus N315
aauguucagguucaaaau

SEQ ID NO: 2124825 - RNA, 11 nt, Staphylococcus aureus subsp. aureus N315
acaacauguuu

SEQ ID NO: 2124826 - RNA, 23 nt, Staphylococcus aureus subsp. aureus N315
acaaagaauuucgaaaagaaauu

SEQ ID NO: 2124827 - RNA, 14 nt, Staphylococcus aureus subsp. aureus N315
acaaauaguucaaa

SEQ ID NO: 2124828 - RNA, 21 nt, Staphylococcus aureus subsp. aureus N315
acacgcgguaaaacgaaguca

SEQ ID NO: 2124829 - RNA, 23 nt, Staphylococcus aureus subsp. aureus N315
acuaguguaccuuguuucaagcu

SEQ ID NO: 2124830 - RNA, 17 nt, Staphylococcus aureus subsp. aureus N315
acuauaaauacaaauau

SEQ ID NO: 2124831 - RNA, 23 nt, Staphylococcus aureus subsp. aureus N315
acucauuauaaaugaaucgcuuu

SEQ ID NO: 2124832 - RNA, 20 nt, Staphylococcus aureus subsp. aureus N315
acugccauucuuuuucucaa

SEQ ID NO: 2124833 - RNA, 19 nt, Staphylococcus aureus subsp. aureus N315
acugcaaacacaguacaaa

SEQ ID NO: 2124834 - RNA, 16 nt, Staphylococcus aureus subsp. aureus N315
acugauuucgcccacc

SEQ ID NO: 2124835 - RNA, 19 nt, Staphylococcus aureus subsp. aureus N315
acucgcuauauguaaagcu

SEQ ID NO: 2124836 - RNA, 13 nt, Staphylococcus aureus subsp. aureus N315
acuaaaaucacuu

SEQ ID NO: 2124837 - RNA, 20 nt, Staphylococcus aureus subsp. aureus N315
acuaaaacaugauacguggu

SEQ ID NO: 2124838 - RNA, 13 nt, Staphylococcus aureus subsp. aureus N315
acguuuuaagcca

SEQ ID NO: 2124839 - RNA, 12 nt, Staphylococcus aureus subsp. aureus N315
acuaaaugaauu

SEQ ID NO: 2124840 - RNA, 13 nt, Staphylococcus aureus subsp. aureus N315
acuagauaguuua

SEQ ID NO: 2124841 - RNA, 15 nt, Staphylococcus aureus subsp. aureus N315
acguuuccaaucuau

SEQ ID NO: 2124842 - RNA, 15 nt, Staphylococcus aureus subsp. aureus N315
acguuucaauguauc

SEQ ID NO: 2124843 - RNA, 13 nt, Staphylococcus aureus subsp. aureus N315
acgguauaucauc

SEQ ID NO: 2124844 - RNA, 13 nt, Staphylococcus aureus subsp. aureus N315
acgggaacaucau

SEQ ID NO: 2124845 - RNA, 19 nt, Staphylococcus aureus subsp. aureus N315
aauccaucuaauucaaugu

SEQ ID NO: 2124846 - RNA, 14 nt, Staphylococcus aureus subsp. aureus N315
aaucgcauuuuguu

SEQ ID NO: 2124847 - RNA, 22 nt, Staphylococcus aureus subsp. aureus N315
uuguauuguuuguagaaauuag

SEQ ID NO: 2124848 - RNA, 14 nt, Staphylococcus aureus subsp. aureus N315
uuguaaacuucuuu

SEQ ID NO: 2124849 - RNA, 22 nt, Staphylococcus aureus subsp. aureus N315
uugucguucucguguaaaaugc

SEQ ID NO: 2124850 - RNA, 22 nt, Staphylococcus aureus subsp. aureus N315
uugugguaaugauuuugcuuua

SEQ ID NO: 2124851 - RNA, 13 nt, Staphylococcus aureus subsp. aureus N315
uuuaaaaaguuaa

SEQ ID NO: 2124852 - RNA, 16 nt, Staphylococcus aureus subsp. aureus N315
uugugauaauucuuca

SEQ ID NO: 2124853 - RNA, 20 nt, Staphylococcus aureus subsp. aureus N315
uugugccaacaaagcuucca

SEQ ID NO: 2124854 - RNA, 12 nt, Staphylococcus aureus subsp. aureus N315
aaucaucacaca

SEQ ID NO: 2124855 - RNA, 19 nt, Staphylococcus aureus subsp. aureus N315
aaucaucacacauaaaugu

SEQ ID NO: 2124856 - RNA, 21 nt, Staphylococcus aureus subsp. aureus N315
aaucauaauacuucucaauuu

SEQ ID NO: 2124857 - RNA, 21 nt, Staphylococcus aureus subsp. aureus N315
aaucauucauggccaaauguu

SEQ ID NO: 2124858 - RNA, 15 nt, Staphylococcus aureus subsp. aureus N315
uugccucguccauug

SEQ ID NO: 2124859 - RNA, 19 nt, Staphylococcus aureus subsp. aureus N315
aaucagguuuaaacaguuu

SEQ ID NO: 2124860 - RNA, 18 nt, Staphylococcus aureus subsp. aureus N315
uugcacgucuuguaucaa

SEQ ID NO: 2124861 - RNA, 18 nt, Staphylococcus aureus subsp. aureus N315
uugauuuuuugaaauguu

SEQ ID NO: 2124862 - RNA, 19 nt, Staphylococcus aureus subsp. aureus N315
uugauucauuucgauuaau

SEQ ID NO: 2124863 - RNA, 16 nt, Staphylococcus aureus subsp. aureus N315
uucuguaauaauauca

SEQ ID NO: 2124864 - RNA, 18 nt, Staphylococcus aureus subsp. aureus N315
uugauuaacacaauccuu

SEQ ID NO: 2124865 - RNA, 15 nt, Staphylococcus aureus subsp. aureus N315
uugauggauauucaa

SEQ ID NO: 2124866 - RNA, 19 nt, Staphylococcus aureus subsp. aureus N315
uugaugaugaugugcuuua

SEQ ID NO: 2124867 - RNA, 20 nt, Staphylococcus aureus subsp. aureus N315
aaugaaaguaccuaaaauag

SEQ ID NO: 2124868 - RNA, 12 nt, Staphylococcus aureus subsp. aureus N315
aaucuuuuaacu

SEQ ID NO: 2124869 - RNA, 14 nt, Staphylococcus aureus subsp. aureus N315
uuuuauaaaucauu

SEQ ID NO: 2124870 - RNA, 13 nt, Staphylococcus aureus subsp. aureus N315
uuuuuaucaugau

SEQ ID NO: 2124871 - RNA, 12 nt, Staphylococcus aureus subsp. aureus N315
uuuuuaucaugu

SEQ ID NO: 2124872 - RNA, 12 nt, Staphylococcus aureus subsp. aureus N315
uuuuuaauauac

SEQ ID NO: 2124873 - RNA, 17 nt, Staphylococcus aureus subsp. aureus N315
aaugauggguauuuugu

SEQ ID NO: 2124874 - RNA, 13 nt, Staphylococcus aureus subsp. aureus N315
aauggccauuuga

SEQ ID NO: 2124875 - RNA, 16 nt, Staphylococcus aureus subsp. aureus N315
aauggucgugcuugcg

SEQ ID NO: 2124876 - RNA, 15 nt, Staphylococcus aureus subsp. aureus N315
aaugugaccuuaugu

SEQ ID NO: 2124877 - RNA, 14 nt, Staphylococcus aureus subsp. aureus N315
aaugucuuucaaau

SEQ ID NO: 2124878 - RNA, 17 nt, Staphylococcus aureus subsp. aureus N315
aaugguucauagugaaa

SEQ ID NO: 2124879 - RNA, 14 nt, Staphylococcus aureus subsp. aureus N315
aauguaacauuaaa

SEQ ID NO: 2124880 - RNA, 15 nt, Staphylococcus aureus subsp. aureus N315
uuucugaaaugauac

SEQ ID NO: 2124881 - RNA, 18 nt, Staphylococcus aureus subsp. aureus N315
uuucuggccacuaaugca

SEQ ID NO: 2124882 - RNA, 23 nt, Staphylococcus aureus subsp. aureus N315
uuugaaagacauuuaaauauaac

SEQ ID NO: 2124883 - RNA, 20 nt, Staphylococcus aureus subsp. aureus N315
uuucguaauguguuaauacu

SEQ ID NO: 2124884 - RNA, 17 nt, Staphylococcus aureus subsp. aureus N315
uuuaauuguuuaauaac

SEQ ID NO: 2124885 - RNA, 13 nt, Staphylococcus aureus subsp. aureus N315
uuuaauuaaagca

SEQ ID NO: 2124886 - RNA, 16 nt, Staphylococcus aureus subsp. aureus N315
uuuaauuuuuaaugua

SEQ ID NO: 2124887 - RNA, 20 nt, Staphylococcus aureus subsp. aureus N315
uuuaaaguaaccacaacaau

SEQ ID NO: 2124888 - RNA, 17 nt, Staphylococcus aureus subsp. aureus N315
uuuaaaccuguuaaugu

SEQ ID NO: 2124889 - RNA, 23 nt, Staphylococcus aureus subsp. aureus N315
uuuaaaccguguucuuuaaugua

SEQ ID NO: 2124890 - RNA, 18 nt, Staphylococcus aureus subsp. aureus N315
uuugacuucaguacaauc

SEQ ID NO: 2124891 - RNA, 18 nt, Staphylococcus aureus subsp. aureus N315
uuugacauaaaaaauaac

SEQ ID NO: 2124892 - RNA, 14 nt, Staphylococcus aureus subsp. aureus N315
uuugauaaugauag

SEQ ID NO: 2124893 - RNA, 15 nt, Staphylococcus aureus subsp. aureus N315
uuugauccaaaguac

SEQ ID NO: 2124894 - RNA, 21 nt, Staphylococcus aureus subsp. aureus N315
uuugauaacaauuuuaaaucu

SEQ ID NO: 2124895 - RNA, 17 nt, Staphylococcus aureus subsp. aureus N315
uuugauuaaaaucugcu

SEQ ID NO: 2124896 - RNA, 14 nt, Staphylococcus aureus subsp. aureus N315
uuugcauacauauc

SEQ ID NO: 2124897 - RNA, 20 nt, Staphylococcus aureus subsp. aureus N315
uuugcaacaauauaauauac

SEQ ID NO: 2124898 - RNA, 20 nt, Staphylococcus aureus subsp. aureus N315
uuugccccucauucacaaug

SEQ ID NO: 2124899 - RNA, 16 nt, Staphylococcus aureus subsp. aureus N315
uuuuaauuaauuauca

SEQ ID NO: 2124900 - RNA, 22 nt, Staphylococcus aureus subsp. aureus N315
uuuuaauaaugcagauucuuca

SEQ ID NO: 2124901 - RNA, 17 nt, Staphylococcus aureus subsp. aureus N315
uuugucuuuuuuaucau

SEQ ID NO: 2124902 - RNA, 15 nt, Staphylococcus aureus subsp. aureus N315
uuugguuucuuaaca

SEQ ID NO: 2124903 - RNA, 22 nt, Staphylococcus aureus subsp. aureus N315
uuuggaaagaugggauuucacu

SEQ ID NO: 2124904 - RNA, 16 nt, Staphylococcus aureus subsp. aureus N315
uucagggucaacauca

SEQ ID NO: 2124905 - RNA, 15 nt, Staphylococcus aureus subsp. aureus N315
uucaucaauaaggca

SEQ ID NO: 2124906 - RNA, 16 nt, Staphylococcus aureus subsp. aureus N315
uucauauuguuuagga

SEQ ID NO: 2124907 - RNA, 16 nt, Staphylococcus aureus subsp. aureus N315
uucauggccaaauguu

SEQ ID NO: 2124908 - RNA, 18 nt, Staphylococcus aureus subsp. aureus N315
uucaugcacuuuaacaua

SEQ ID NO: 2124909 - RNA, 17 nt, Staphylococcus aureus subsp. aureus N315
uucacgauauaacauua

SEQ ID NO: 2124910 - RNA, 22 nt, Staphylococcus aureus subsp. aureus N315
uucagauauacuguauaguaac

SEQ ID NO: 2124911 - RNA, 14 nt, Staphylococcus aureus subsp. aureus N315
uucauuguaacuca

SEQ ID NO: 2124912 - RNA, 20 nt, Staphylococcus aureus subsp. aureus N315
uucauuuguaggaaacgguu

SEQ ID NO: 2124913 - RNA, 14 nt, Staphylococcus aureus subsp. aureus N315
uucauuauaugguu

SEQ ID NO: 2124914 - RNA, 14 nt, Staphylococcus aureus subsp. aureus N315
aaucacgcuaacau

SEQ ID NO: 2124915 - RNA, 13 nt, Staphylococcus aureus subsp. aureus N315
uucuaccaauaau

SEQ ID NO: 2124916 - RNA, 23 nt, Staphylococcus aureus subsp. aureus N315
uucguuuugcuaaccaucauaaa

SEQ ID NO: 2124917 - RNA, 20 nt, Staphylococcus aureus subsp. aureus N315
uucguugcacuuuaauauca

SEQ ID NO: 2124918 - RNA, 23 nt, Staphylococcus aureus subsp. aureus N315
uucgacacgcccgacaucauaaa

SEQ ID NO: 2124919 - RNA, 19 nt, Staphylococcus aureus subsp. aureus N315
uucgaauuuaacaucuuug

SEQ ID NO: 2124920 - RNA, 16 nt, Staphylococcus aureus subsp. aureus N315
uucgaauuuaacaucu

SEQ ID NO: 2124921 - RNA, 20 nt, Staphylococcus aureus subsp. aureus N315
uuaaaucacuagcuaaugca

SEQ ID NO: 2124922 - RNA, 13 nt, Staphylococcus aureus subsp. aureus N315
uuaaauaucauac

SEQ ID NO: 2124923 - RNA, 23 nt, Staphylococcus aureus subsp. aureus N315
uuaaauaaugauaaauuaaagcu

SEQ ID NO: 2124924 - RNA, 20 nt, Staphylococcus aureus subsp. aureus N315
uuaaauacgccaaauaucag

SEQ ID NO: 2124925 - RNA, 22 nt, Staphylococcus aureus subsp. aureus N315
uuaaauacgccaaauaucagua

SEQ ID NO: 2124926 - RNA, 18 nt, Staphylococcus aureus subsp. aureus N315
uuaaaugugcaauuagaa

SEQ ID NO: 2124927 - RNA, 15 nt, Staphylococcus aureus subsp. aureus N315
uuaaaugaaacuuug

SEQ ID NO: 2124928 - RNA, 15 nt, Staphylococcus aureus subsp. aureus N315
uuaaagcaucuucaa

SEQ ID NO: 2124929 - RNA, 14 nt, Staphylococcus aureus subsp. aureus N315
uuaaacaagcauca

SEQ ID NO: 2124930 - RNA, 22 nt, Staphylococcus aureus subsp. aureus N315
uuaacagcgugaauauaaguaa

SEQ ID NO: 2124931 - RNA, 15 nt, Staphylococcus aureus subsp. aureus N315
uuaacauuauccauu

SEQ ID NO: 2124932 - RNA, 17 nt, Staphylococcus aureus subsp. aureus N315
uuaaauuuucaucauaa

SEQ ID NO: 2124933 - RNA, 18 nt, Staphylococcus aureus subsp. aureus N315
uuaaucauuuaucuagac

SEQ ID NO: 2124934 - RNA, 22 nt, Staphylococcus aureus subsp. aureus N315
uuacauuuuaauaaaaucaucu

SEQ ID NO: 2124935 - RNA, 19 nt, Staphylococcus aureus subsp. aureus N315
uuaaucuucgucauaagga

SEQ ID NO: 2124936 - RNA, 20 nt, Staphylococcus aureus subsp. aureus N315
uuacacuuuucuuaucaguu

SEQ ID NO: 2124937 - RNA, 16 nt, Staphylococcus aureus subsp. aureus N315
uuaucauuauucgcau

SEQ ID NO: 2124938 - RNA, 16 nt, Staphylococcus aureus subsp. aureus N315
uuauaaccacaccaug

SEQ ID NO: 2124939 - RNA, 15 nt, Staphylococcus aureus subsp. aureus N315
uuauaacgugcuuuu

SEQ ID NO: 2124940 - RNA, 15 nt, Staphylococcus aureus subsp. aureus N315
uuagcuugcuuacaa

SEQ ID NO: 2124941 - RNA, 18 nt, Staphylococcus aureus subsp. aureus N315
uuaguaauuuuuaaaucu

SEQ ID NO: 2124942 - RNA, 18 nt, Staphylococcus aureus subsp. aureus N315
uuagagauuguaagaauu

SEQ ID NO: 2124943 - RNA, 18 nt, Staphylococcus aureus subsp. aureus N315
uuagacuaaaaaacuaac

SEQ ID NO: 2124944 - RNA, 14 nt, Staphylococcus aureus subsp. aureus N315
uuagauaauaagga

SEQ ID NO: 2124945 - RNA, 21 nt, Staphylococcus aureus subsp. aureus N315
uuagcaaaaauauuuaaacua

SEQ ID NO: 2124946 - RNA, 17 nt, Staphylococcus aureus subsp. aureus N315
uuagauauauaaagguu

SEQ ID NO: 2124947 - RNA, 20 nt, Staphylococcus aureus subsp. aureus N315
uuacuauggcauuauugccu

SEQ ID NO: 2124948 - RNA, 17 nt, Staphylococcus aureus subsp. aureus N315
uuacguaaucuaauaca

SEQ ID NO: 2124949 - RNA, 21 nt, Staphylococcus aureus subsp. aureus N315
uuacgccaacaagguuucaag

SEQ ID NO: 2124950 - RNA, 13 nt, Staphylococcus aureus subsp. aureus N315
uguuauugcuuau

SEQ ID NO: 2124951 - RNA, 15 nt, Staphylococcus aureus subsp. aureus N315
uguucaaagacacgg

SEQ ID NO: 2124952 - RNA, 14 nt, Staphylococcus aureus subsp. aureus N315
uguuauuaaacgca

SEQ ID NO: 2124953 - RNA, 22 nt, Staphylococcus aureus subsp. aureus N315
ugugcaauuagaauauauguau

SEQ ID NO: 2124954 - RNA, 22 nt, Staphylococcus aureus subsp. aureus N315
aauauacuugaagcaucgauuu

SEQ ID NO: 2124955 - RNA, 13 nt, Staphylococcus aureus subsp. aureus N315
aauauauguauaa

SEQ ID NO: 2124956 - RNA, 14 nt, Staphylococcus aureus subsp. aureus N315
aauauaguaauugu

SEQ ID NO: 2124957 - RNA, 14 nt, Staphylococcus aureus subsp. aureus N315
ugcucagugcauuu

SEQ ID NO: 2124958 - RNA, 14 nt, Staphylococcus aureus subsp. aureus N315
ugcucauugcauuu

SEQ ID NO: 2124959 - RNA, 19 nt, Staphylococcus aureus subsp. aureus N315
ugcuuuuuuuauaaguauu

SEQ ID NO: 2124960 - RNA, 20 nt, Staphylococcus aureus subsp. aureus N315
ugcuucuguaaacgauacug

SEQ ID NO: 2124961 - RNA, 17 nt, Staphylococcus aureus subsp. aureus N315
ugcuucucacaacugca

SEQ ID NO: 2124962 - RNA, 16 nt, Staphylococcus aureus subsp. aureus N315
ugcuuggauaauugca

SEQ ID NO: 2124963 - RNA, 12 nt, Staphylococcus aureus subsp. aureus N315
ugcuuuccaaau

SEQ ID NO: 2124964 - RNA, 17 nt, Staphylococcus aureus subsp. aureus N315
ugcuucgcaucacugca

SEQ ID NO: 2124965 - RNA, 17 nt, Staphylococcus aureus subsp. aureus N315
ugcuucgcacaacugca

SEQ ID NO: 2124966 - RNA, 16 nt, Staphylococcus aureus subsp. aureus N315
aauauaaaaacaaaag

SEQ ID NO: 2124967 - RNA, 17 nt, Staphylococcus aureus subsp. aureus N315
aauauaacaucaaauag

SEQ ID NO: 2124968 - RNA, 12 nt, Staphylococcus aureus subsp. aureus N315
aauauacaauag

SEQ ID NO: 2124969 - RNA, 24 nt, Staphylococcus aureus subsp. aureus N315
aauaucuaauucuguuucaaagcu

SEQ ID NO: 2124970 - RNA, 18 nt, Staphylococcus aureus subsp. aureus N315
aauaugagacaauacgau

SEQ ID NO: 2124971 - RNA, 21 nt, Staphylococcus aureus subsp. aureus N315
aauauuuagauuggucaaacu

SEQ ID NO: 2124972 - RNA, 19 nt, Staphylococcus aureus subsp. aureus N315
aauauucuuaucauucauu

SEQ ID NO: 2124973 - RNA, 13 nt, Staphylococcus aureus subsp. aureus N315
aauauucuuauca

SEQ ID NO: 2124974 - RNA, 17 nt, Staphylococcus aureus subsp. aureus N315
aauauucacgacuugau

SEQ ID NO: 2124975 - RNA, 23 nt, Staphylococcus aureus subsp. aureus N315
aauauggaauuucauauaaugaa

SEQ ID NO: 2124976 - RNA, 15 nt, Staphylococcus aureus subsp. aureus N315
aauauguguuaacug

SEQ ID NO: 2124977 - RNA, 19 nt, Staphylococcus aureus subsp. aureus N315
aaucacgauuuucaaguaa

SEQ ID NO: 2124978 - RNA, 15 nt, Staphylococcus aureus subsp. aureus N315
uguaguaaaaaucac

SEQ ID NO: 2124979 - RNA, 20 nt, Staphylococcus aureus subsp. aureus N315
aaucaccuuauugaugaaaa

SEQ ID NO: 2124980 - RNA, 13 nt, Staphylococcus aureus subsp. aureus N315
uguaaugauauua

SEQ ID NO: 2124981 - RNA, 13 nt, Staphylococcus aureus subsp. aureus N315
ugguugcuucuua

SEQ ID NO: 2124982 - RNA, 17 nt, Staphylococcus aureus subsp. aureus N315
uggucauguguugcaau

SEQ ID NO: 2124983 - RNA, 18 nt, Staphylococcus aureus subsp. aureus N315
uggucugauuuugcauuu

SEQ ID NO: 2124984 - RNA, 21 nt, Staphylococcus aureus subsp. aureus N315
aauauuucuaaaccauuuuca

SEQ ID NO: 2124985 - RNA, 21 nt, Staphylococcus aureus subsp. aureus N315
uggaauuggcauccaggcaac

SEQ ID NO: 2124986 - RNA, 13 nt, Staphylococcus aureus subsp. aureus N315
aaaugaaccauuu

SEQ ID NO: 2124987 - RNA, 17 nt, Staphylococcus aureus subsp. aureus N315
aaauggacuaacgucau

SEQ ID NO: 2124988 - RNA, 16 nt, Staphylococcus aureus subsp. aureus N315
aaaucaacaucaucuu

SEQ ID NO: 2124989 - RNA, 18 nt, Staphylococcus aureus subsp. aureus N315
aaaucaaaaauaauuaug

SEQ ID NO: 2124990 - RNA, 24 nt, Staphylococcus aureus subsp. aureus N315
aaaucuaauccugguauaauggac

SEQ ID NO: 2124991 - RNA, 18 nt, Staphylococcus aureus subsp. aureus N315
aaauuaggcauucaucua

SEQ ID NO: 2124992 - RNA, 13 nt, Staphylococcus aureus subsp. aureus N315
aaauuaucauuaa

SEQ ID NO: 2124993 - RNA, 17 nt, Staphylococcus aureus subsp. aureus N315
aaauucauuuguauuaa

SEQ ID NO: 2124994 - RNA, 13 nt, Staphylococcus aureus subsp. aureus N315
aaauuguauagaa

SEQ ID NO: 2124995 - RNA, 19 nt, Staphylococcus aureus subsp. aureus N315
aaaagccaucuuaccuuua

SEQ ID NO: 2124996 - RNA, 15 nt, Staphylococcus aureus subsp. aureus N315
aaaagauuagaugau

SEQ ID NO: 2124997 - RNA, 18 nt, Staphylococcus aureus subsp. aureus N315
aaaagagguuuucauuaa

SEQ ID NO: 2124998 - RNA, 18 nt, Staphylococcus aureus subsp. aureus N315
aacaacuaagauauauug

SEQ ID NO: 2124999 - RNA, 23 nt, Staphylococcus aureus subsp. aureus N315
aacaacuuuguuuucaguaacug

SEQ ID NO: 2125000 - RNA, 12 nt, Staphylococcus aureus subsp. aureus N315
aacaaguacaau

SEQ ID NO: 2125001 - RNA, 19 nt, Staphylococcus aureus subsp. aureus N315
aacaaugcagcuguauuua

SEQ ID NO: 2125002 - RNA, 19 nt, Staphylococcus aureus subsp. aureus N315
aaauaucauaccguacaaa

SEQ ID NO: 2125003 - RNA, 18 nt, Staphylococcus aureus subsp. aureus N315
aaauaucaguaauaauac

SEQ ID NO: 2125004 - RNA, 13 nt, Staphylococcus aureus subsp. aureus N315
aaauaugauugaa

SEQ ID NO: 2125005 - RNA, 18 nt, Staphylococcus aureus subsp. aureus N315
aaauagcuauuaaaauag

SEQ ID NO: 2125006 - RNA, 16 nt, Staphylococcus aureus subsp. aureus N315
aaauaggcauaaugaa

SEQ ID NO: 2125007 - RNA, 16 nt, Staphylococcus aureus subsp. aureus N315
aaagugcgauuaucag

SEQ ID NO: 2125008 - RNA, 17 nt, Staphylococcus aureus subsp. aureus N315
aaaaauuaaucaccuua

SEQ ID NO: 2125009 - RNA, 15 nt, Staphylococcus aureus subsp. aureus N315
aaacuucacaucaug

SEQ ID NO: 2125010 - RNA, 19 nt, Staphylococcus aureus subsp. aureus N315
aaacuuaagaauacaugac

SEQ ID NO: 2125011 - RNA, 20 nt, Staphylococcus aureus subsp. aureus N315
aaagauuuuguugaacguuu

SEQ ID NO: 2125012 - RNA, 16 nt, Staphylococcus aureus subsp. aureus N315
aaagaugggauuucac

SEQ ID NO: 2125013 - RNA, 19 nt, Staphylococcus aureus subsp. aureus N315
aaacgauucauuauauggu

SEQ ID NO: 2125014 - RNA, 12 nt, Staphylococcus aureus subsp. aureus N315
aaaaaauggauu

SEQ ID NO: 2125015 - RNA, 13 nt, Staphylococcus aureus subsp. aureus N315
aaaaaacaaauau

SEQ ID NO: 2125016 - RNA, 21 nt, Staphylococcus aureus subsp. aureus N315
aaccauugaaugaaucccaua

SEQ ID NO: 2125017 - RNA, 15 nt, Staphylococcus aureus subsp. aureus N315
aaccauccauaggau

SEQ ID NO: 2125018 - RNA, 15 nt, Staphylococcus aureus subsp. aureus N315
aacaucuugauauuc

SEQ ID NO: 2125019 - RNA, 20 nt, Staphylococcus aureus subsp. aureus N315
aacaugaaugauauugauuu

SEQ ID NO: 2125020 - RNA, 21 nt, Staphylococcus aureus subsp. aureus N315
aacauuuugccccucauucac

SEQ ID NO: 2125021 - RNA, 14 nt, Staphylococcus aureus subsp. aureus N315
aacauuagcauuaa

SEQ ID NO: 2125022 - RNA, 15 nt, Staphylococcus aureus subsp. aureus N315
aacauguucguuaua

SEQ ID NO: 2125023 - RNA, 17 nt, Staphylococcus aureus subsp. aureus N315
aaccaauuauuaaagcu

SEQ ID NO: 2125024 - RNA, 23 nt, Staphylococcus aureus subsp. aureus N315
aaccaaucaucgcaaauacauaa

SEQ ID NO: 2125025 - RNA, 21 nt, Staphylococcus aureus subsp. aureus N315
aaccaaaaaauccaagcgcuu

SEQ ID NO: 2125026 - RNA, 17 nt, Staphylococcus aureus subsp. aureus N315
aaccacgucuuaaucgg

SEQ ID NO: 2125027 - RNA, 19 nt, Staphylococcus aureus subsp. aureus N315
aacgaugcuacuuaaagcu

SEQ ID NO: 2125028 - RNA, 17 nt, Staphylococcus aureus subsp. aureus N315
aacgcauauucuauugu

SEQ ID NO: 2125029 - RNA, 17 nt, Staphylococcus aureus subsp. aureus N315
aacgauagugguacuau

SEQ ID NO: 2125030 - RNA, 14 nt, Staphylococcus aureus subsp. aureus N315
aacgaugcuacuua

SEQ ID NO: 2125031 - RNA, 15 nt, Staphylococcus aureus subsp. aureus N315
aacgguaauuucuau

SEQ ID NO: 2125032 - RNA, 23 nt, Staphylococcus aureus subsp. aureus N315
aaucauuuguguauaaaugucau

SEQ ID NO: 2125033 - RNA, 16 nt, Staphylococcus aureus subsp. aureus N315
aaucauagcauuaaga

SEQ ID NO: 2125034 - RNA, 15 nt, Staphylococcus aureus subsp. aureus N315
aaucauaauaagauu

SEQ ID NO: 2125035 - RNA, 20 nt, Staphylococcus aureus subsp. aureus N315
aaucaucacacauaaauguu

SEQ ID NO: 2125036 - RNA, 14 nt, Staphylococcus aureus subsp. aureus N315
aaucccauaaugac

SEQ ID NO: 2125037 - RNA, 22 nt, Staphylococcus aureus subsp. aureus N315
aaucccaaguuacaauaucaua

SEQ ID NO: 2125038 - RNA, 19 nt, Staphylococcus aureus subsp. aureus N315
aauaguuaagauuuuaacu

SEQ ID NO: 2125039 - RNA, 20 nt, Staphylococcus aureus subsp. aureus N315
aauaguagccuagauaccaa

SEQ ID NO: 2125040 - RNA, 17 nt, Staphylococcus aureus subsp. aureus N315
aauaguaaugaugugaa

SEQ ID NO: 2125041 - RNA, 17 nt, Staphylococcus aureus subsp. aureus N315
aauagcuauauuuuugu

SEQ ID NO: 2125042 - RNA, 13 nt, Staphylococcus aureus subsp. aureus N315
aauauaacaucaa

SEQ ID NO: 2125043 - RNA, 20 nt, Staphylococcus aureus subsp. aureus N315
aauccuuuauauuuaguuag

SEQ ID NO: 2125044 - RNA, 14 nt, Staphylococcus aureus subsp. aureus N315
aaucgaacagaaaa

SEQ ID NO: 2125045 - RNA, 20 nt, Staphylococcus aureus subsp. aureus N315
aaucgaagggcggucaauuu

SEQ ID NO: 2125046 - RNA, 15 nt, Staphylococcus aureus subsp. aureus N315
aaucgauauaaugaa

SEQ ID NO: 2125047 - RNA, 12 nt, Staphylococcus aureus subsp. aureus N315
aaucucauugau

SEQ ID NO: 2125048 - RNA, 17 nt, Staphylococcus aureus subsp. aureus N315
aaucguauuuuuaagcu

SEQ ID NO: 2125049 - RNA, 17 nt, Staphylococcus aureus subsp. aureus N315
aaucguaauaauuuugu

SEQ ID NO: 2125050 - RNA, 16 nt, Staphylococcus aureus subsp. aureus N315
aauuuaauauuauaag

SEQ ID NO: 2125051 - RNA, 15 nt, Staphylococcus aureus subsp. aureus N315
aauuuaauguuuuca

SEQ ID NO: 2125052 - RNA, 17 nt, Staphylococcus aureus subsp. aureus N315
aauuuaucaauuucuau

SEQ ID NO: 2125053 - RNA, 15 nt, Staphylococcus aureus subsp. aureus N315
aauuucaauuuaugu

SEQ ID NO: 2125054 - RNA, 13 nt, Staphylococcus aureus subsp. aureus N315
aauuuauuuugua

SEQ ID NO: 2125055 - RNA, 13 nt, Staphylococcus aureus subsp. aureus N315
aauucucuuuguu

SEQ ID NO: 2125056 - RNA, 16 nt, Staphylococcus aureus subsp. aureus N315
aauucuuuuacagcaa

SEQ ID NO: 2125057 - RNA, 20 nt, Staphylococcus aureus subsp. aureus N315
aauuuaauaggcuauguaaa

SEQ ID NO: 2125058 - RNA, 20 nt, Staphylococcus aureus subsp. aureus N315
aauugacaguuuccauaaau

SEQ ID NO: 2125059 - RNA, 13 nt, Staphylococcus aureus subsp. aureus N315
aauugaacuuugu

SEQ ID NO: 2125060 - RNA, 23 nt, Staphylococcus aureus subsp. aureus N315
aauuaucauaaagauaagauggu

SEQ ID NO: 2125061 - RNA, 18 nt, Staphylococcus aureus subsp. aureus N315
aauuauuucaauuaucaa

SEQ ID NO: 2125062 - RNA, 14 nt, Staphylococcus aureus subsp. aureus N315
aauuauuugauauu

SEQ ID NO: 2125063 - RNA, 20 nt, Staphylococcus aureus subsp. aureus N315
aauuauuuucucgauacaaa

SEQ ID NO: 2125064 - RNA, 12 nt, Staphylococcus aureus subsp. aureus N315
aauucaacuuuu

SEQ ID NO: 2125065 - RNA, 17 nt, Staphylococcus aureus subsp. aureus N315
aauguuaggugcuuggu

SEQ ID NO: 2125066 - RNA, 21 nt, Staphylococcus aureus subsp. aureus N315
aauguuacacaaauuaaaacu

SEQ ID NO: 2125067 - RNA, 21 nt, Staphylococcus aureus subsp. aureus N315
aauguuauugcuuauuuuugu

SEQ ID NO: 2125068 - RNA, 21 nt, Staphylococcus aureus subsp. aureus N315
aauuaauuccuggugcaauaa

SEQ ID NO: 2125069 - RNA, 12 nt, Staphylococcus aureus subsp. aureus N315
aauuaauuuugu

SEQ ID NO: 2125070 - RNA, 20 nt, Staphylococcus aureus subsp. aureus N315
aauuaauucgccuaaauggu

SEQ ID NO: 2125071 - RNA, 18 nt, Staphylococcus aureus subsp. aureus N315
aauuaaucccuucaaaau

SEQ ID NO: 2125072 - RNA, 19 nt, Staphylococcus aureus subsp. aureus N315
aauuacaggaauugcuuua

SEQ ID NO: 2125073 - RNA, 21 nt, Staphylococcus aureus subsp. aureus N315
aauguuaacugcaaacuugau

SEQ ID NO: 2125074 - RNA, 10 nt, Staphylococcus aureus subsp. aureus N315
aaugauauua

SEQ ID NO: 2125075 - RNA, 17 nt, Staphylococcus aureus subsp. aureus N315
aaugaguaugacgaaau

SEQ ID NO: 2125076 - RNA, 21 nt, Staphylococcus aureus subsp. aureus N315
aaugaugcacuaaauuagcaa

SEQ ID NO: 2125077 - RNA, 22 nt, Staphylococcus aureus subsp. aureus N315
aaugauucuuaucuuuaaucaa

SEQ ID NO: 2125078 - RNA, 16 nt, Staphylococcus aureus subsp. aureus N315
aaugauuguuuuaagu

SEQ ID NO: 2125079 - RNA, 20 nt, Staphylococcus aureus subsp. aureus N315
aauggcaauuaaaacuauaa

SEQ ID NO: 2125080 - RNA, 14 nt, Staphylococcus aureus subsp. aureus N315
aauggcaccauacu

SEQ ID NO: 2125081 - RNA, 19 nt, Staphylococcus aureus subsp. aureus N315
aauggcaccauacuucguu

SEQ ID NO: 2125082 - RNA, 18 nt, Staphylococcus aureus subsp. aureus N315
aaugucgauauuucuagu

SEQ ID NO: 2125083 - RNA, 15 nt, Staphylococcus aureus subsp. aureus N315
aauguacuuuucugu

SEQ ID NO: 2125084 - RNA, 15 nt, Staphylococcus aureus subsp. aureus N315
aauguacuaggaccu

SEQ ID NO: 2125085 - RNA, 16 nt, Staphylococcus aureus subsp. aureus N315
aauguaaugauacaaa

SEQ ID NO: 2125086 - RNA, 18 nt, Staphylococcus aureus subsp. aureus N315
aauaacuuaugguauuua

SEQ ID NO: 2125087 - RNA, 14 nt, Staphylococcus aureus subsp. aureus N315
aauaaaaucaucuu

SEQ ID NO: 2125088 - RNA, 14 nt, Staphylococcus aureus subsp. aureus N315
aaguuuauuuaugu

SEQ ID NO: 2125089 - RNA, 16 nt, Staphylococcus aureus subsp. aureus N315
aaguuuauacuuaaua

SEQ ID NO: 2125090 - RNA, 22 nt, Staphylococcus aureus subsp. aureus N315
aagucaguuaacggcguauuca

SEQ ID NO: 2125091 - RNA, 13 nt, Staphylococcus aureus subsp. aureus N315
aauaauaaaauag

SEQ ID NO: 2125092 - RNA, 15 nt, Staphylococcus aureus subsp. aureus N315
aauaauacgcuugau

SEQ ID NO: 2125093 - RNA, 15 nt, Staphylococcus aureus subsp. aureus N315
aauaauuuaacuaau

SEQ ID NO: 2125094 - RNA, 23 nt, Staphylococcus aureus subsp. aureus N315
aauacaaaccuaucaucaaucgu

SEQ ID NO: 2125095 - RNA, 15 nt, Staphylococcus aureus subsp. aureus N315
aauagaacgaaauag

SEQ ID NO: 2125096 - RNA, 22 nt, Staphylococcus aureus subsp. aureus N315
aauagaaaugacgauaccuuua

SEQ ID NO: 2125097 - RNA, 21 nt, Staphylococcus aureus subsp. aureus N315
aauacgaaguguuauaaauag

SEQ ID NO: 2125098 - RNA, 15 nt, Staphylococcus aureus subsp. aureus N315
aauaccuucaauuga

SEQ ID NO: 2125099 - RNA, 20 nt, Staphylococcus aureus subsp. aureus N315
aauaccucuacauuauauug

SEQ ID NO: 2125100 - RNA, 20 nt, Staphylococcus aureus subsp. aureus N315
aaguauauugcuuauguaca

SEQ ID NO: 2125101 - RNA, 17 nt, Staphylococcus aureus subsp. aureus N315
aaguaguggauaaucac

SEQ ID NO: 2125102 - RNA, 23 nt, Staphylococcus aureus subsp. aureus N315
aaguauuuucuuaguuugacauc

SEQ ID NO: 2125103 - RNA, 22 nt, Staphylococcus aureus subsp. aureus N315
aacuaauuuaaagcaucauaua

SEQ ID NO: 2125104 - RNA, 15 nt, Staphylococcus aureus subsp. aureus N315
aacuacuauuaguau

SEQ ID NO: 2125105 - RNA, 20 nt, Staphylococcus aureus subsp. aureus N315
aagcaaauuaguaugacuua

SEQ ID NO: 2125106 - RNA, 15 nt, Staphylococcus aureus subsp. aureus N315
aagaugcucauugca

SEQ ID NO: 2125107 - RNA, 16 nt, Staphylococcus aureus subsp. aureus N315
aagaucgauacuuuuu

SEQ ID NO: 2125108 - RNA, 20 nt, Staphylococcus aureus subsp. aureus N315
aagaucauuuucaacauaau

SEQ ID NO: 2125109 - RNA, 14 nt, Staphylococcus aureus subsp. aureus N315
aagccuucuauaua

SEQ ID NO: 2125110 - RNA, 14 nt, Staphylococcus aureus subsp. aureus N315
aaaauuaaaauguu

SEQ ID NO: 2125111 - RNA, 19 nt, Staphylococcus aureus subsp. aureus N315
accaccugauaaugcaugu

SEQ ID NO: 2125112 - RNA, 15 nt, Staphylococcus aureus subsp. aureus N315
accaccauaugcuaa

SEQ ID NO: 2125113 - RNA, 15 nt, Staphylococcus aureus subsp. aureus N315
accaccccaacuugc

SEQ ID NO: 2125114 - RNA, 24 nt, Staphylococcus aureus subsp. aureus N315
accaauuaauuguaaagcaugaau

SEQ ID NO: 2125115 - RNA, 11 nt, Staphylococcus aureus subsp. aureus N315
accaaucgaag

SEQ ID NO: 2125116 - RNA, 18 nt, Staphylococcus aureus subsp. aureus N315
accaaaaaacagaggucu

SEQ ID NO: 2125117 - RNA, 18 nt, Staphylococcus aureus subsp. aureus N315
acauuucugaugcuagcu

SEQ ID NO: 2125118 - RNA, 14 nt, Staphylococcus aureus subsp. aureus N315
acauugccacuuuu

SEQ ID NO: 2125119 - RNA, 20 nt, Staphylococcus aureus subsp. aureus N315
acauuaaagaaaauaucuga

SEQ ID NO: 2125120 - RNA, 13 nt, Staphylococcus aureus subsp. aureus N315
acauuaaguuaaa

SEQ ID NO: 2125121 - RNA, 22 nt, Staphylococcus aureus subsp. aureus N315
acauuaacaaggccugcaucac

SEQ ID NO: 2125122 - RNA, 19 nt, Staphylococcus aureus subsp. aureus N315
acauuaaaaugauaucuga

SEQ ID NO: 2125123 - RNA, 14 nt, Staphylococcus aureus subsp. aureus N315
acaugguaucuuua

SEQ ID NO: 2125124 - RNA, 15 nt, Staphylococcus aureus subsp. aureus N315
acauacagucaauac

SEQ ID NO: 2125125 - RNA, 21 nt, Staphylococcus aureus subsp. aureus N315
acauauguuguuucuaaugcu

SEQ ID NO: 2125126 - RNA, 18 nt, Staphylococcus aureus subsp. aureus N315
acaaaauacccugcuuua

SEQ ID NO: 2125127 - RNA, 12 nt, Staphylococcus aureus subsp. aureus N315
aauuuuuaacaa

SEQ ID NO: 2125128 - RNA, 15 nt, Staphylococcus aureus subsp. aureus N315
aauuuuaccaucaau

SEQ ID NO: 2125129 - RNA, 17 nt, Staphylococcus aureus subsp. aureus N315
acaaacgcacugcugca

SEQ ID NO: 2125130 - RNA, 14 nt, Staphylococcus aureus subsp. aureus N315
accugcuucuguaa

SEQ ID NO: 2125131 - RNA, 21 nt, Staphylococcus aureus subsp. aureus N315
acucaacacgauagucauaac

SEQ ID NO: 2125132 - RNA, 19 nt, Staphylococcus aureus subsp. aureus N315
acuauuuuuaaaugauucu

SEQ ID NO: 2125133 - RNA, 21 nt, Staphylococcus aureus subsp. aureus N315
acuauuaaauaaucgcccauc

SEQ ID NO: 2125134 - RNA, 19 nt, Staphylococcus aureus subsp. aureus N315
acuauuccguuucauugau

SEQ ID NO: 2125135 - RNA, 16 nt, Staphylococcus aureus subsp. aureus N315
acguugauuaacacau

SEQ ID NO: 2125136 - RNA, 15 nt, Staphylococcus aureus subsp. aureus N315
acucacugcacuuau

SEQ ID NO: 2125137 - RNA, 22 nt, Staphylococcus aureus subsp. aureus N315
acuuuaacauaucgcgcaucaa

SEQ ID NO: 2125138 - RNA, 20 nt, Staphylococcus aureus subsp. aureus N315
acuuuaacauaucgcgcauc

SEQ ID NO: 2125139 - RNA, 16 nt, Staphylococcus aureus subsp. aureus N315
acuuggugauguaaua

SEQ ID NO: 2125140 - RNA, 16 nt, Staphylococcus aureus subsp. aureus N315
acuugauucuacuuca

SEQ ID NO: 2125141 - RNA, 22 nt, Staphylococcus aureus subsp. aureus N315
acuucuuucaaaaacaguuaca

SEQ ID NO: 2125142 - RNA, 21 nt, Staphylococcus aureus subsp. aureus N315
acuguauaccucuuagcacuu

SEQ ID NO: 2125143 - RNA, 22 nt, Staphylococcus aureus subsp. aureus N315
acugcuaauuuuuucaucauuc

SEQ ID NO: 2125144 - RNA, 16 nt, Staphylococcus aureus subsp. aureus N315
agcacgagaaauguca

SEQ ID NO: 2125145 - RNA, 15 nt, Staphylococcus aureus subsp. aureus N315
agcaauuuucgauau

SEQ ID NO: 2125146 - RNA, 22 nt, Staphylococcus aureus subsp. aureus N315
acuuucuaagauacguugaugu

SEQ ID NO: 2125147 - RNA, 18 nt, Staphylococcus aureus subsp. aureus N315
acuuuaugaaauuucagu

SEQ ID NO: 2125148 - RNA, 23 nt, Staphylococcus aureus subsp. aureus N315
agcacaccuaauucauauauacu

SEQ ID NO: 2125149 - RNA, 14 nt, Staphylococcus aureus subsp. aureus N315
agcaucgaacaauc

SEQ ID NO: 2125150 - RNA, 18 nt, Staphylococcus aureus subsp. aureus N315
agcaucuccaauuuaauc

SEQ ID NO: 2125151 - RNA, 17 nt, Staphylococcus aureus subsp. aureus N315
agcauuaaauuccaugu

SEQ ID NO: 2125152 - RNA, 24 nt, Staphylococcus aureus subsp. aureus N315
agcaguauauaucaaauacauuuc

SEQ ID NO: 2125153 - RNA, 23 nt, Staphylococcus aureus subsp. aureus N315
agcucugaaggagacauuuccca

SEQ ID NO: 2125154 - RNA, 17 nt, Staphylococcus aureus subsp. aureus N315
aucaauugcgauauacg

SEQ ID NO: 2125155 - RNA, 13 nt, Staphylococcus aureus subsp. aureus N315
aucaauuaaacuu

SEQ ID NO: 2125156 - RNA, 12 nt, Staphylococcus aureus subsp. aureus N315
aucaauuaaacu

SEQ ID NO: 2125157 - RNA, 15 nt, Staphylococcus aureus subsp. aureus N315
aucaaugguugaugu

SEQ ID NO: 2125158 - RNA, 17 nt, Staphylococcus aureus subsp. aureus N315
auauguguuucuagcuu

SEQ ID NO: 2125159 - RNA, 20 nt, Staphylococcus aureus subsp. aureus N315
auauuauaaaaacagcagug

SEQ ID NO: 2125160 - RNA, 14 nt, Staphylococcus aureus subsp. aureus N315
auauuagaacauuu

SEQ ID NO: 2125161 - RNA, 13 nt, Staphylococcus aureus subsp. aureus N315
auauuauguuagu

SEQ ID NO: 2125162 - RNA, 14 nt, Staphylococcus aureus subsp. aureus N315
auauuacaccauug

SEQ ID NO: 2125163 - RNA, 18 nt, Staphylococcus aureus subsp. aureus N315
auauuaauaaucuucugu

SEQ ID NO: 2125164 - RNA, 14 nt, Staphylococcus aureus subsp. aureus N315
aucaaaguaucagu

SEQ ID NO: 2125165 - RNA, 21 nt, Staphylococcus aureus subsp. aureus N315
aucaaacuuggcaaugaaauu

SEQ ID NO: 2125166 - RNA, 15 nt, Staphylococcus aureus subsp. aureus N315
auagguauaaucauu

SEQ ID NO: 2125167 - RNA, 16 nt, Staphylococcus aureus subsp. aureus N315
auauaaaacugugcau

SEQ ID NO: 2125168 - RNA, 13 nt, Staphylococcus aureus subsp. aureus N315
auauaaaucauuu

SEQ ID NO: 2125169 - RNA, 14 nt, Staphylococcus aureus subsp. aureus N315
auauaaauguugac

SEQ ID NO: 2125170 - RNA, 20 nt, Staphylococcus aureus subsp. aureus N315
auauaacuauggucaucaau

SEQ ID NO: 2125171 - RNA, 18 nt, Staphylococcus aureus subsp. aureus N315
auauaagaaauccaccua

SEQ ID NO: 2125172 - RNA, 22 nt, Staphylococcus aureus subsp. aureus N315
auauagcggugucaauauugua

SEQ ID NO: 2125173 - RNA, 18 nt, Staphylococcus aureus subsp. aureus N315
auauaauaccccaaauag

SEQ ID NO: 2125174 - RNA, 23 nt, Staphylococcus aureus subsp. aureus N315
auauaauuucaauuuauguugcg

SEQ ID NO: 2125175 - RNA, 17 nt, Staphylococcus aureus subsp. aureus N315
auaucuauuuaucauac

SEQ ID NO: 2125176 - RNA, 15 nt, Staphylococcus aureus subsp. aureus N315
auaucuguugcauua

SEQ ID NO: 2125177 - RNA, 21 nt, Staphylococcus aureus subsp. aureus N315
auacucaucuguccgauaucu

SEQ ID NO: 2125178 - RNA, 17 nt, Staphylococcus aureus subsp. aureus N315
auacucaauaaaauugg

SEQ ID NO: 2125179 - RNA, 20 nt, Staphylococcus aureus subsp. aureus N315
auacucaguuuauugaggau

SEQ ID NO: 2125180 - RNA, 22 nt, Staphylococcus aureus subsp. aureus N315
auacuucguugucacuauugca

SEQ ID NO: 2125181 - RNA, 15 nt, Staphylococcus aureus subsp. aureus N315
auacuucguauugaa

SEQ ID NO: 2125182 - RNA, 23 nt, Staphylococcus aureus subsp. aureus N315
auacuaagcgcucauaaacgauu

SEQ ID NO: 2125183 - RNA, 19 nt, Staphylococcus aureus subsp. aureus N315
auagaauuuuucauauacu

SEQ ID NO: 2125184 - RNA, 13 nt, Staphylococcus aureus subsp. aureus N315
auagagaaauacu

SEQ ID NO: 2125185 - RNA, 22 nt, Staphylococcus aureus subsp. aureus N315
auagaagaacgaagaaugauac

SEQ ID NO: 2125186 - RNA, 22 nt, Staphylococcus aureus subsp. aureus N315
auagcaucuaugauuguaugac

SEQ ID NO: 2125187 - RNA, 21 nt, Staphylococcus aureus subsp. aureus N315
auacaguuguuauuuuugcua

SEQ ID NO: 2125188 - RNA, 18 nt, Staphylococcus aureus subsp. aureus N315
auacaaaacaaauccauu

SEQ ID NO: 2125189 - RNA, 12 nt, Staphylococcus aureus subsp. aureus N315
auacaaaggauu

SEQ ID NO: 2125190 - RNA, 22 nt, Staphylococcus aureus subsp. aureus N315
auacaucggaauucaaccaauu

SEQ ID NO: 2125191 - RNA, 14 nt, Staphylococcus aureus subsp. aureus N315
auacaucaauaucu

SEQ ID NO: 2125192 - RNA, 12 nt, Staphylococcus aureus subsp. aureus N315
auacauugauaa

SEQ ID NO: 2125193 - RNA, 14 nt, Staphylococcus aureus subsp. aureus N315
auaauaaauaggau

SEQ ID NO: 2125194 - RNA, 17 nt, Staphylococcus aureus subsp. aureus N315
auaauaucgaugacuuu

SEQ ID NO: 2125195 - RNA, 16 nt, Staphylococcus aureus subsp. aureus N315
auaauacguuuugcua

SEQ ID NO: 2125196 - RNA, 18 nt, Staphylococcus aureus subsp. aureus N315
aguuugauagaugauaca

SEQ ID NO: 2125197 - RNA, 23 nt, Staphylococcus aureus subsp. aureus N315
auaacauugaacgauaacaauuu

SEQ ID NO: 2125198 - RNA, 21 nt, Staphylococcus aureus subsp. aureus N315
auaacauccccuucuugagca

SEQ ID NO: 2125199 - RNA, 15 nt, Staphylococcus aureus subsp. aureus N315
aguuuuuuuucauag

SEQ ID NO: 2125200 - RNA, 13 nt, Staphylococcus aureus subsp. aureus N315
auaacgugcuuuu

SEQ ID NO: 2125201 - RNA, 18 nt, Staphylococcus aureus subsp. aureus N315
agucaauuucuuuaaagu

SEQ ID NO: 2125202 - RNA, 22 nt, Staphylococcus aureus subsp. aureus N315
agucuuuuuuaagcuuaucaac

SEQ ID NO: 2125203 - RNA, 15 nt, Staphylococcus aureus subsp. aureus N315
aguuuacgaucauaa

SEQ ID NO: 2125204 - RNA, 19 nt, Staphylococcus aureus subsp. aureus N315
aguuuagguugauuucugc

SEQ ID NO: 2125205 - RNA, 13 nt, Staphylococcus aureus subsp. aureus N315
aguuuaucugagu

SEQ ID NO: 2125206 - RNA, 18 nt, Staphylococcus aureus subsp. aureus N315
aguugcauaaucaauuuc

SEQ ID NO: 2125207 - RNA, 12 nt, Staphylococcus aureus subsp. aureus N315
aguaacuuuguc

SEQ ID NO: 2125208 - RNA, 14 nt, Staphylococcus aureus subsp. aureus N315
aguauguugucaua

SEQ ID NO: 2125209 - RNA, 14 nt, Staphylococcus aureus subsp. aureus N315
aguaugcauauuca

SEQ ID NO: 2125210 - RNA, 16 nt, Staphylococcus aureus subsp. aureus N315
aguauaaucagcaaug

SEQ ID NO: 2125211 - RNA, 20 nt, Staphylococcus aureus subsp. aureus N315
aguaguugacugaacgaaaa

SEQ ID NO: 2125212 - RNA, 22 nt, Staphylococcus aureus subsp. aureus N315
aguaguucggaugagaaauguu

SEQ ID NO: 2125213 - RNA, 14 nt, Staphylococcus aureus subsp. aureus N315
aguaaaaauacauu

SEQ ID NO: 2125214 - RNA, 16 nt, Staphylococcus aureus subsp. aureus N315
agguuucacaaauucu

SEQ ID NO: 2125215 - RNA, 15 nt, Staphylococcus aureus subsp. aureus N315
agggugaauuaguaa

SEQ ID NO: 2125216 - RNA, 22 nt, Staphylococcus aureus subsp. aureus N315
aggcuuaaauauaaugauccag

SEQ ID NO: 2125217 - RNA, 18 nt, Staphylococcus aureus subsp. aureus N315
augcuuaaaaacaauauu

SEQ ID NO: 2125218 - RNA, 20 nt, Staphylococcus aureus subsp. aureus N315
augcuguguaucaucauaau

SEQ ID NO: 2125219 - RNA, 13 nt, Staphylococcus aureus subsp. aureus N315
augcuucaauauu

SEQ ID NO: 2125220 - RNA, 19 nt, Staphylococcus aureus subsp. aureus N315
augcuucaaaaauuaauca

SEQ ID NO: 2125221 - RNA, 13 nt, Staphylococcus aureus subsp. aureus N315
auggaaaaguuuu

SEQ ID NO: 2125222 - RNA, 19 nt, Staphylococcus aureus subsp. aureus N315
augcuuuaugugcagcuug

SEQ ID NO: 2125223 - RNA, 11 nt, Staphylococcus aureus subsp. aureus N315
augaugcacua

SEQ ID NO: 2125224 - RNA, 15 nt, Staphylococcus aureus subsp. aureus N315
auguaccgaauccuu

SEQ ID NO: 2125225 - RNA, 17 nt, Staphylococcus aureus subsp. aureus N315
auguaaucauuauagca

SEQ ID NO: 2125226 - RNA, 18 nt, Staphylococcus aureus subsp. aureus N315
auggugaacuguuaaacu

SEQ ID NO: 2125227 - RNA, 14 nt, Staphylococcus aureus subsp. aureus N315
auguagaauuucuu

SEQ ID NO: 2125228 - RNA, 22 nt, Staphylococcus aureus subsp. aureus N315
augucguucaagaacaaucaau

SEQ ID NO: 2125229 - RNA, 21 nt, Staphylococcus aureus subsp. aureus N315
auguuuuagugacaaacauuu

SEQ ID NO: 2125230 - RNA, 22 nt, Staphylococcus aureus subsp. aureus N315
auguuuucguuugcaaucaucu

SEQ ID NO: 2125231 - RNA, 22 nt, Staphylococcus aureus subsp. aureus N315
auuaaaaggaugugacaaauac

SEQ ID NO: 2125232 - RNA, 17 nt, Staphylococcus aureus subsp. aureus N315
auuaaaugcaauacauu

SEQ ID NO: 2125233 - RNA, 13 nt, Staphylococcus aureus subsp. aureus N315
auuaaaguagcag

SEQ ID NO: 2125234 - RNA, 21 nt, Staphylococcus aureus subsp. aureus N315
auuaaaggaaaucaauccauc

SEQ ID NO: 2125235 - RNA, 14 nt, Staphylococcus aureus subsp. aureus N315
auguuuaaacauuu

SEQ ID NO: 2125236 - RNA, 17 nt, Staphylococcus aureus subsp. aureus N315
auguuggaucggcauug

SEQ ID NO: 2125237 - RNA, 17 nt, Staphylococcus aureus subsp. aureus N315
auguucccuuaccauuu

SEQ ID NO: 2125238 - RNA, 22 nt, Staphylococcus aureus subsp. aureus N315
augugaaauaaucccaaccauu

SEQ ID NO: 2125239 - RNA, 22 nt, Staphylococcus aureus subsp. aureus N315
augugaacaucuaguuauuuca

SEQ ID NO: 2125240 - RNA, 12 nt, Staphylococcus aureus subsp. aureus N315
augugaugauua

SEQ ID NO: 2125241 - RNA, 19 nt, Staphylococcus aureus subsp. aureus N315
augugaugcuugaauguuu

SEQ ID NO: 2125242 - RNA, 15 nt, Staphylococcus aureus subsp. aureus N315
augugcuuuaucaac

SEQ ID NO: 2125243 - RNA, 20 nt, Staphylococcus aureus subsp. aureus N315
auguuccauauaaccuauuu

SEQ ID NO: 2125244 - RNA, 21 nt, Staphylococcus aureus subsp. aureus N315
auguuccccauuaauuaacaa

SEQ ID NO: 2125245 - RNA, 22 nt, Staphylococcus aureus subsp. aureus N315
auuaagaaugcaccaacaauag

SEQ ID NO: 2125246 - RNA, 14 nt, Staphylococcus aureus subsp. aureus N315
auuaguaaugauua

SEQ ID NO: 2125247 - RNA, 18 nt, Staphylococcus aureus subsp. aureus N315
auuauaaaugaaucgcuu

SEQ ID NO: 2125248 - RNA, 22 nt, Staphylococcus aureus subsp. aureus N315
auuauaaccacaccaugcugca

SEQ ID NO: 2125249 - RNA, 21 nt, Staphylococcus aureus subsp. aureus N315
auuagcgcaccaauuaucaac

SEQ ID NO: 2125250 - RNA, 15 nt, Staphylococcus aureus subsp. aureus N315
auucacauacauuuu

SEQ ID NO: 2125251 - RNA, 19 nt, Staphylococcus aureus subsp. aureus N315
auucaauauuaaucauaau

SEQ ID NO: 2125252 - RNA, 17 nt, Staphylococcus aureus subsp. aureus N315
auucaaauaaaucaaac

SEQ ID NO: 2125253 - RNA, 21 nt, Staphylococcus aureus subsp. aureus N315
auuauuucuagcauguaagcu

SEQ ID NO: 2125254 - RNA, 18 nt, Staphylococcus aureus subsp. aureus N315
auucaucucagcaauacu

SEQ ID NO: 2125255 - RNA, 14 nt, Staphylococcus aureus subsp. aureus N315
auucaguucaaaca

SEQ ID NO: 2125256 - RNA, 22 nt, Staphylococcus aureus subsp. aureus N315
auucauaagaaaaauguguuaa

SEQ ID NO: 2125257 - RNA, 23 nt, Staphylococcus aureus subsp. aureus N315
auucauacacugcacaucauaau

SEQ ID NO: 2125258 - RNA, 16 nt, Staphylococcus aureus subsp. aureus N315
auucauaucauuagau

SEQ ID NO: 2125259 - RNA, 15 nt, Staphylococcus aureus subsp. aureus N315
auuauuuaaaaugcu

SEQ ID NO: 2125260 - RNA, 13 nt, Staphylococcus aureus subsp. aureus N315
auuaucauuaacc

SEQ ID NO: 2125261 - RNA, 23 nt, Staphylococcus aureus subsp. aureus N315
auuauaauuuuguuucacuacgu

SEQ ID NO: 2125262 - RNA, 15 nt, Staphylococcus aureus subsp. aureus N315
auuauaauagcuuuc

SEQ ID NO: 2125263 - RNA, 17 nt, Staphylococcus aureus subsp. aureus N315
auuauagccuauccauu

SEQ ID NO: 2125264 - RNA, 17 nt, Staphylococcus aureus subsp. aureus N315
auugaauucucgccaac

SEQ ID NO: 2125265 - RNA, 23 nt, Staphylococcus aureus subsp. aureus N315
auucucuaacuuuaccaauauca

SEQ ID NO: 2125266 - RNA, 19 nt, Staphylococcus aureus subsp. aureus N315
auucugcccugcaaugcaa

SEQ ID NO: 2125267 - RNA, 22 nt, Staphylococcus aureus subsp. aureus N315
auucggcucguccaauaaugaa

SEQ ID NO: 2125268 - RNA, 18 nt, Staphylococcus aureus subsp. aureus N315
auuccuuggugucgaaau

SEQ ID NO: 2125269 - RNA, 13 nt, Staphylococcus aureus subsp. aureus N315
auuccuuaaaccg

SEQ ID NO: 2125270 - RNA, 22 nt, Staphylococcus aureus subsp. aureus N315
auuguaaaugaucaucguauag

SEQ ID NO: 2125271 - RNA, 21 nt, Staphylococcus aureus subsp. aureus N315
auuguaagauaacgagugaaa

SEQ ID NO: 2125272 - RNA, 19 nt, Staphylococcus aureus subsp. aureus N315
auuguuagauaaucucauu

SEQ ID NO: 2125273 - RNA, 15 nt, Staphylococcus aureus subsp. aureus N315
auuuaaaaugauucu

SEQ ID NO: 2125274 - RNA, 18 nt, Staphylococcus aureus subsp. aureus N315
auuuaaaggcauaauaac

SEQ ID NO: 2125275 - RNA, 17 nt, Staphylococcus aureus subsp. aureus N315
auuguuucaccagcuug

SEQ ID NO: 2125276 - RNA, 19 nt, Staphylococcus aureus subsp. aureus N315
auugcaaugcuaucaugcc

SEQ ID NO: 2125277 - RNA, 18 nt, Staphylococcus aureus subsp. aureus N315
auugauauggaucauaau

SEQ ID NO: 2125278 - RNA, 21 nt, Staphylococcus aureus subsp. aureus N315
auugauuacaccacuuaggau

SEQ ID NO: 2125279 - RNA, 22 nt, Staphylococcus aureus subsp. aureus N315
auugauucuacagcaucaccua

SEQ ID NO: 2125280 - RNA, 21 nt, Staphylococcus aureus subsp. aureus N315
aucgacuuuuacaaucaucac

SEQ ID NO: 2125281 - RNA, 16 nt, Staphylococcus aureus subsp. aureus N315
aucgauacuaauaucu

SEQ ID NO: 2125282 - RNA, 15 nt, Staphylococcus aureus subsp. aureus N315
aucuacuauuuaauc

SEQ ID NO: 2125283 - RNA, 12 nt, Staphylococcus aureus subsp. aureus N315
aucuauuuagcu

SEQ ID NO: 2125284 - RNA, 19 nt, Staphylococcus aureus subsp. aureus N315
aucuauuuaauaauguauc

SEQ ID NO: 2125285 - RNA, 13 nt, Staphylococcus aureus subsp. aureus N315
aucggcuuugacg

SEQ ID NO: 2125286 - RNA, 17 nt, Staphylococcus aureus subsp. aureus N315
aucggcaccaguagcua

SEQ ID NO: 2125287 - RNA, 14 nt, Staphylococcus aureus subsp. aureus N315
aucuucaugaacag

SEQ ID NO: 2125288 - RNA, 11 nt, Staphylococcus aureus subsp. aureus N315
aucuuuaucag

SEQ ID NO: 2125289 - RNA, 22 nt, Staphylococcus aureus subsp. aureus N315
aucuguagauuagcuuaaguaa

SEQ ID NO: 2125290 - RNA, 23 nt, Staphylococcus aureus subsp. aureus N315
aucuuuugcguccucaugacauu

SEQ ID NO: 2125291 - RNA, 13 nt, Staphylococcus aureus subsp. aureus N315
augaaugauauug

SEQ ID NO: 2125292 - RNA, 13 nt, Staphylococcus aureus subsp. aureus N315
augacuaacgaaa

SEQ ID NO: 2125293 - RNA, 16 nt, Staphylococcus aureus subsp. aureus N315
augaguaugacgaaau

SEQ ID NO: 2125294 - RNA, 11 nt, Staphylococcus aureus subsp. aureus N315
augaguacaac

SEQ ID NO: 2125295 - RNA, 17 nt, Staphylococcus aureus subsp. aureus N315
augagguucaguagaau

SEQ ID NO: 2125296 - RNA, 16 nt, Staphylococcus aureus subsp. aureus N315
augauagccgcuucau

SEQ ID NO: 2125297 - RNA, 21 nt, Staphylococcus aureus subsp. aureus N315
caccaguuugugguaaugauu

SEQ ID NO: 2125298 - RNA, 21 nt, Staphylococcus aureus subsp. aureus N315
cacaguggauuacagaugaug

SEQ ID NO: 2125299 - RNA, 17 nt, Staphylococcus aureus subsp. aureus N315
caauuuuccguguuuau

SEQ ID NO: 2125300 - RNA, 19 nt, Staphylococcus aureus subsp. aureus N315
cacauuccaucuuaaaaca

SEQ ID NO: 2125301 - RNA, 15 nt, Staphylococcus aureus subsp. aureus N315
caaauguaacauuaa

SEQ ID NO: 2125302 - RNA, 19 nt, Staphylococcus aureus subsp. aureus N315
caaaucguuucaugcacuu

SEQ ID NO: 2125303 - RNA, 11 nt, Staphylococcus aureus subsp. aureus N315
caacaacuuuu

SEQ ID NO: 2125304 - RNA, 16 nt, Staphylococcus aureus subsp. aureus N315
caacaaaaagaauuuc

SEQ ID NO: 2125305 - RNA, 17 nt, Staphylococcus aureus subsp. aureus N315
caacaaauugugauuua

SEQ ID NO: 2125306 - RNA, 15 nt, Staphylococcus aureus subsp. aureus N315
auuuaguaucucauu

SEQ ID NO: 2125307 - RNA, 15 nt, Staphylococcus aureus subsp. aureus N315
auuuagucauuacaa

SEQ ID NO: 2125308 - RNA, 15 nt, Staphylococcus aureus subsp. aureus N315
auuuaguaucaugau

SEQ ID NO: 2125309 - RNA, 13 nt, Staphylococcus aureus subsp. aureus N315
caaaguuaaccau

SEQ ID NO: 2125310 - RNA, 13 nt, Staphylococcus aureus subsp. aureus N315
caacaucuucaac

SEQ ID NO: 2125311 - RNA, 16 nt, Staphylococcus aureus subsp. aureus N315
caaccaccauaugcua

SEQ ID NO: 2125312 - RNA, 18 nt, Staphylococcus aureus subsp. aureus N315
caaccucugauguguuau

SEQ ID NO: 2125313 - RNA, 21 nt, Staphylococcus aureus subsp. aureus N315
caauaugaccuuuaugugcau

SEQ ID NO: 2125314 - RNA, 18 nt, Staphylococcus aureus subsp. aureus N315
caauauuuucauguccau

SEQ ID NO: 2125315 - RNA, 13 nt, Staphylococcus aureus subsp. aureus N315
caaucacuauauu

SEQ ID NO: 2125316 - RNA, 14 nt, Staphylococcus aureus subsp. aureus N315
caauauaguaccaa

SEQ ID NO: 2125317 - RNA, 17 nt, Staphylococcus aureus subsp. aureus N315
caaucguaacuaacaug

SEQ ID NO: 2125318 - RNA, 19 nt, Staphylococcus aureus subsp. aureus N315
caaugcuuccaucacauca

SEQ ID NO: 2125319 - RNA, 18 nt, Staphylococcus aureus subsp. aureus N315
caauuaauguaaugauac

SEQ ID NO: 2125320 - RNA, 15 nt, Staphylococcus aureus subsp. aureus N315
caauuaauguaauga

SEQ ID NO: 2125321 - RNA, 13 nt, Staphylococcus aureus subsp. aureus N315
caauuauuucauc

SEQ ID NO: 2125322 - RNA, 15 nt, Staphylococcus aureus subsp. aureus N315
caauuauggauaaaa

SEQ ID NO: 2125323 - RNA, 14 nt, Staphylococcus aureus subsp. aureus N315
caauuaucaaacgg

SEQ ID NO: 2125324 - RNA, 23 nt, Staphylococcus aureus subsp. aureus N315
caauguugcauccccagccauuu

SEQ ID NO: 2125325 - RNA, 11 nt, Staphylococcus aureus subsp. aureus N315
caauucaaacu

SEQ ID NO: 2125326 - RNA, 17 nt, Staphylococcus aureus subsp. aureus N315
caauuauuuuucaaaua

SEQ ID NO: 2125327 - RNA, 15 nt, Staphylococcus aureus subsp. aureus N315
caauucgcgucauuu

SEQ ID NO: 2125328 - RNA, 20 nt, Staphylococcus aureus subsp. aureus N315
caauugauuacaccacuuag

SEQ ID NO: 2125329 - RNA, 13 nt, Staphylococcus aureus subsp. aureus N315
caauugauugcuc

SEQ ID NO: 2125330 - RNA, 21 nt, Staphylococcus aureus subsp. aureus N315
caacguauaagugauaucagu

SEQ ID NO: 2125331 - RNA, 17 nt, Staphylococcus aureus subsp. aureus N315
caacugagaaaucuuaa

SEQ ID NO: 2125332 - RNA, 16 nt, Staphylococcus aureus subsp. aureus N315
ccaucccauuaaacca

SEQ ID NO: 2125333 - RNA, 20 nt, Staphylococcus aureus subsp. aureus N315
ccauaaugacuauaacacca

SEQ ID NO: 2125334 - RNA, 15 nt, Staphylococcus aureus subsp. aureus N315
ccaucacgauauguu

SEQ ID NO: 2125335 - RNA, 22 nt, Staphylococcus aureus subsp. aureus N315
aaauaguagacgguaucaucug

SEQ ID NO: 2125336 - RNA, 20 nt, Staphylococcus aureus subsp. aureus N315
aaauagaugagaaaguaaaa

SEQ ID NO: 2125337 - RNA, 12 nt, Staphylococcus aureus subsp. aureus N315
aaauauaaugau

SEQ ID NO: 2125338 - RNA, 21 nt, Staphylococcus aureus subsp. aureus N315
aaauauaauagaaauaaucac

SEQ ID NO: 2125339 - RNA, 16 nt, Staphylococcus aureus subsp. aureus N315
aaauaacaauagugac

SEQ ID NO: 2125340 - RNA, 16 nt, Staphylococcus aureus subsp. aureus N315
aaauaaaaauauugcg

SEQ ID NO: 2125341 - RNA, 19 nt, Staphylococcus aureus subsp. aureus N315
aaauacuauauauaaugaa

SEQ ID NO: 2125342 - RNA, 15 nt, Staphylococcus aureus subsp. aureus N315
aaauaccucuacauu

SEQ ID NO: 2125343 - RNA, 22 nt, Staphylococcus aureus subsp. aureus N315
ccaauuguuucagcuuguccau

SEQ ID NO: 2125344 - RNA, 20 nt, Staphylococcus aureus subsp. aureus N315
ccaccaccugcaauuuguaa

SEQ ID NO: 2125345 - RNA, 12 nt, Staphylococcus aureus subsp. aureus N315
ccaaaaauugua

SEQ ID NO: 2125346 - RNA, 21 nt, Staphylococcus aureus subsp. aureus N315
ccaaaaauuguaaaaccuuac

SEQ ID NO: 2125347 - RNA, 19 nt, Staphylococcus aureus subsp. aureus N315
cauuuggcguaaugauauu

SEQ ID NO: 2125348 - RNA, 19 nt, Staphylococcus aureus subsp. aureus N315
cauuucugucccacuccca

SEQ ID NO: 2125349 - RNA, 22 nt, Staphylococcus aureus subsp. aureus N315
cauuugcaacaauauaauauac

SEQ ID NO: 2125350 - RNA, 19 nt, Staphylococcus aureus subsp. aureus N315
cauuuguucaucugauaau

SEQ ID NO: 2125351 - RNA, 20 nt, Staphylococcus aureus subsp. aureus N315
cauuuauguguuggcuuuua

SEQ ID NO: 2125352 - RNA, 22 nt, Staphylococcus aureus subsp. aureus N315
cauuuaauggucuaauaucaau

SEQ ID NO: 2125353 - RNA, 15 nt, Staphylococcus aureus subsp. aureus N315
cauuguuauuuauac

SEQ ID NO: 2125354 - RNA, 15 nt, Staphylococcus aureus subsp. aureus N315
cauuguauguugaaa

SEQ ID NO: 2125355 - RNA, 16 nt, Staphylococcus aureus subsp. aureus N315
caugcucauuugauaa

SEQ ID NO: 2125356 - RNA, 13 nt, Staphylococcus aureus subsp. aureus N315
caugccuucauga

SEQ ID NO: 2125357 - RNA, 17 nt, Staphylococcus aureus subsp. aureus N315
caugcgauucaaucuaa

SEQ ID NO: 2125358 - RNA, 13 nt, Staphylococcus aureus subsp. aureus N315
cauucuuccaaca

SEQ ID NO: 2125359 - RNA, 13 nt, Staphylococcus aureus subsp. aureus N315
cauuauuugauaa

SEQ ID NO: 2125360 - RNA, 18 nt, Staphylococcus aureus subsp. aureus N315
cauuaucaccuucaaacu

SEQ ID NO: 2125361 - RNA, 21 nt, Staphylococcus aureus subsp. aureus N315
cauuauuaaauagaugagaaa

SEQ ID NO: 2125362 - RNA, 20 nt, Staphylococcus aureus subsp. aureus N315
cauuaaugauagcaaugaau

SEQ ID NO: 2125363 - RNA, 20 nt, Staphylococcus aureus subsp. aureus N315
cauuacauuuggcguaauga

SEQ ID NO: 2125364 - RNA, 18 nt, Staphylococcus aureus subsp. aureus N315
cauguuuggaugaacaaa

SEQ ID NO: 2125365 - RNA, 14 nt, Staphylococcus aureus subsp. aureus N315
cauuaaaaugauau

SEQ ID NO: 2125366 - RNA, 23 nt, Staphylococcus aureus subsp. aureus N315
cauguuuuguaccugcuucugua

SEQ ID NO: 2125367 - RNA, 16 nt, Staphylococcus aureus subsp. aureus N315
cauuaaaccaaucaau

SEQ ID NO: 2125368 - RNA, 19 nt, Staphylococcus aureus subsp. aureus N315
cauuaaauauuauuuugca

SEQ ID NO: 2125369 - RNA, 21 nt, Staphylococcus aureus subsp. aureus N315
caguaauugugacgaccgugu

SEQ ID NO: 2125370 - RNA, 18 nt, Staphylococcus aureus subsp. aureus N315
caguggauuacagaugau

SEQ ID NO: 2125371 - RNA, 13 nt, Staphylococcus aureus subsp. aureus N315
cauaugauuacaa

SEQ ID NO: 2125372 - RNA, 15 nt, Staphylococcus aureus subsp. aureus N315
cauauaauaugugca

SEQ ID NO: 2125373 - RNA, 18 nt, Staphylococcus aureus subsp. aureus N315
cauauauauucguuacaa

SEQ ID NO: 2125374 - RNA, 18 nt, Staphylococcus aureus subsp. aureus N315
cauaugacuuuauuucua

SEQ ID NO: 2125375 - RNA, 20 nt, Staphylococcus aureus subsp. aureus N315
cauaguauacauaauucaau

SEQ ID NO: 2125376 - RNA, 14 nt, Staphylococcus aureus subsp. aureus N315
cauaguaaucgauu

SEQ ID NO: 2125377 - RNA, 17 nt, Staphylococcus aureus subsp. aureus N315
cauauaaagucguauca

SEQ ID NO: 2125378 - RNA, 20 nt, Staphylococcus aureus subsp. aureus N315
cauaccaaaaacauuaacca

SEQ ID NO: 2125379 - RNA, 18 nt, Staphylococcus aureus subsp. aureus N315
cauaaaauaccagaugaa

SEQ ID NO: 2125380 - RNA, 18 nt, Staphylococcus aureus subsp. aureus N315
caguuuauugaggauaau

SEQ ID NO: 2125381 - RNA, 13 nt, Staphylococcus aureus subsp. aureus N315
caguuucaaucgc

SEQ ID NO: 2125382 - RNA, 22 nt, Staphylococcus aureus subsp. aureus N315
caguuggagguccauaaucuuu

SEQ ID NO: 2125383 - RNA, 16 nt, Staphylococcus aureus subsp. aureus N315
caucaugaaauuagau

SEQ ID NO: 2125384 - RNA, 23 nt, Staphylococcus aureus subsp. aureus N315
caucauaaaugacgucucuaaca

SEQ ID NO: 2125385 - RNA, 19 nt, Staphylococcus aureus subsp. aureus N315
caucaauaaauauugauuc

SEQ ID NO: 2125386 - RNA, 22 nt, Staphylococcus aureus subsp. aureus N315
caucauuuuucguuguucauaa

SEQ ID NO: 2125387 - RNA, 20 nt, Staphylococcus aureus subsp. aureus N315
cacguaauugaguuguugca

SEQ ID NO: 2125388 - RNA, 16 nt, Staphylococcus aureus subsp. aureus N315
aaacuucuaucacacg

SEQ ID NO: 2125389 - RNA, 13 nt, Staphylococcus aureus subsp. aureus N315
aaagaaaucucua

SEQ ID NO: 2125390 - RNA, 19 nt, Staphylococcus aureus subsp. aureus N315
cacuuuuauggagugauau

SEQ ID NO: 2125391 - RNA, 13 nt, Staphylococcus aureus subsp. aureus N315
aaagaauaaaugu

SEQ ID NO: 2125392 - RNA, 16 nt, Staphylococcus aureus subsp. aureus N315
cacuaacucaauauga

SEQ ID NO: 2125393 - RNA, 13 nt, Staphylococcus aureus subsp. aureus N315
aaauguuaacgau

SEQ ID NO: 2125394 - RNA, 15 nt, Staphylococcus aureus subsp. aureus N315
aaauggaaagacguu

SEQ ID NO: 2125395 - RNA, 22 nt, Staphylococcus aureus subsp. aureus N315
aaauggaaccacgucuuaaucg

SEQ ID NO: 2125396 - RNA, 21 nt, Staphylococcus aureus subsp. aureus N315
aaauggugcgaauaauaauac

SEQ ID NO: 2125397 - RNA, 21 nt, Staphylococcus aureus subsp. aureus N315
aaaugacgugcuuuuaaaugu

SEQ ID NO: 2125398 - RNA, 19 nt, Staphylococcus aureus subsp. aureus N315
aaauuggaaucccaaugcu

SEQ ID NO: 2125399 - RNA, 13 nt, Staphylococcus aureus subsp. aureus N315
aaauugcaaugcu

SEQ ID NO: 2125400 - RNA, 18 nt, Staphylococcus aureus subsp. aureus N315
aaauuugugauuaugcau

SEQ ID NO: 2125401 - RNA, 18 nt, Staphylococcus aureus subsp. aureus N315
aacaaaagaucgauacuu

SEQ ID NO: 2125402 - RNA, 14 nt, Staphylococcus aureus subsp. aureus N315
aacaaaaagaauuu

SEQ ID NO: 2125403 - RNA, 21 nt, Staphylococcus aureus subsp. aureus N315
ccuaagcauaauucaacuuaa

SEQ ID NO: 2125404 - RNA, 13 nt, Staphylococcus aureus subsp. aureus N315
ccuaaugcgacau

SEQ ID NO: 2125405 - RNA, 19 nt, Staphylococcus aureus subsp. aureus N315
ccuaccauuacugcagcau

SEQ ID NO: 2125406 - RNA, 18 nt, Staphylococcus aureus subsp. aureus N315
cgcacaucuaagugauau

SEQ ID NO: 2125407 - RNA, 18 nt, Staphylococcus aureus subsp. aureus N315
cgaucuaacaauugcaga

SEQ ID NO: 2125408 - RNA, 16 nt, Staphylococcus aureus subsp. aureus N315
cgaacaugaaugauau

SEQ ID NO: 2125409 - RNA, 13 nt, Staphylococcus aureus subsp. aureus N315
cgaaauaguucaa

SEQ ID NO: 2125410 - RNA, 15 nt, Staphylococcus aureus subsp. aureus N315
ccuuugguucaauca

SEQ ID NO: 2125411 - RNA, 13 nt, Staphylococcus aureus subsp. aureus N315
cgaaaauaucauu

SEQ ID NO: 2125412 - RNA, 12 nt, Staphylococcus aureus subsp. aureus N315
cgaaaguacaag

SEQ ID NO: 2125413 - RNA, 18 nt, Staphylococcus aureus subsp. aureus N315
ccuguuacuuucacauuu

SEQ ID NO: 2125414 - RNA, 18 nt, Staphylococcus aureus subsp. aureus N315
cgacaucgccaauuugau

SEQ ID NO: 2125415 - RNA, 15 nt, Staphylococcus aureus subsp. aureus N315
aacaaucagauaagu

SEQ ID NO: 2125416 - RNA, 17 nt, Staphylococcus aureus subsp. aureus N315
aacaauacauaaugguu

SEQ ID NO: 2125417 - RNA, 14 nt, Staphylococcus aureus subsp. aureus N315
aacauuauuaaaca

SEQ ID NO: 2125418 - RNA, 16 nt, Staphylococcus aureus subsp. aureus N315
cgggcuauauuugaua

SEQ ID NO: 2125419 - RNA, 17 nt, Staphylococcus aureus subsp. aureus N315
cggauuaucuaacucau

SEQ ID NO: 2125420 - RNA, 20 nt, Staphylococcus aureus subsp. aureus N315
aacagcacauuuuuaguuag

SEQ ID NO: 2125421 - RNA, 21 nt, Staphylococcus aureus subsp. aureus N315
aacagcggaauacagaugaug

SEQ ID NO: 2125422 - RNA, 12 nt, Staphylococcus aureus subsp. aureus N315
aacagauacuuc

SEQ ID NO: 2125423 - RNA, 21 nt, Staphylococcus aureus subsp. aureus N315
gcgccuuguucaauucagcaa

SEQ ID NO: 2125424 - RNA, 22 nt, Staphylococcus aureus subsp. aureus N315
aagcaugacacucauucaauuu

SEQ ID NO: 2125425 - RNA, 17 nt, Staphylococcus aureus subsp. aureus N315
aagcugucuuacugcug

SEQ ID NO: 2125426 - RNA, 17 nt, Staphylococcus aureus subsp. aureus N315
aagccugauguaccacu

SEQ ID NO: 2125427 - RNA, 19 nt, Staphylococcus aureus subsp. aureus N315
gcgcuguuccaaauucauu

SEQ ID NO: 2125428 - RNA, 15 nt, Staphylococcus aureus subsp. aureus N315
gcugcaucaauauga

SEQ ID NO: 2125429 - RNA, 21 nt, Staphylococcus aureus subsp. aureus N315
gcuaauuuuuucaucauucaa

SEQ ID NO: 2125430 - RNA, 14 nt, Staphylococcus aureus subsp. aureus N315
gcuacaauuuccua

SEQ ID NO: 2125431 - RNA, 16 nt, Staphylococcus aureus subsp. aureus N315
gcuaauccauacguau

SEQ ID NO: 2125432 - RNA, 14 nt, Staphylococcus aureus subsp. aureus N315
gcuaaaauuuccuc

SEQ ID NO: 2125433 - RNA, 20 nt, Staphylococcus aureus subsp. aureus N315
gcuaauaaaaccgguacuuu

SEQ ID NO: 2125434 - RNA, 21 nt, Staphylococcus aureus subsp. aureus N315
gcguuuaauaacauugaacga

SEQ ID NO: 2125435 - RNA, 13 nt, Staphylococcus aureus subsp. aureus N315
guauggauguauu

SEQ ID NO: 2125436 - RNA, 16 nt, Staphylococcus aureus subsp. aureus N315
guauggacuaagauau

SEQ ID NO: 2125437 - RNA, 21 nt, Staphylococcus aureus subsp. aureus N315
guauuagccaauaaaauguca

SEQ ID NO: 2125438 - RNA, 20 nt, Staphylococcus aureus subsp. aureus N315
guauuuugcgcuucuaguag

SEQ ID NO: 2125439 - RNA, 18 nt, Staphylococcus aureus subsp. aureus N315
gucaaaucgaaauuucca

SEQ ID NO: 2125440 - RNA, 15 nt, Staphylococcus aureus subsp. aureus N315
gucacgaucaaauuu

SEQ ID NO: 2125441 - RNA, 23 nt, Staphylococcus aureus subsp. aureus N315
guaacuaacauguuauugcuuau

SEQ ID NO: 2125442 - RNA, 15 nt, Staphylococcus aureus subsp. aureus N315
guaauaaaaugauga

SEQ ID NO: 2125443 - RNA, 13 nt, Staphylococcus aureus subsp. aureus N315
guaccaauugauu

SEQ ID NO: 2125444 - RNA, 17 nt, Staphylococcus aureus subsp. aureus N315
guaauaguuaacgauag

SEQ ID NO: 2125445 - RNA, 15 nt, Staphylococcus aureus subsp. aureus N315
aaguauguugucaua

SEQ ID NO: 2125446 - RNA, 18 nt, Staphylococcus aureus subsp. aureus N315
aaguaguucagcaaguuu

SEQ ID NO: 2125447 - RNA, 13 nt, Staphylococcus aureus subsp. aureus N315
guauauacgauug

SEQ ID NO: 2125448 - RNA, 16 nt, Staphylococcus aureus subsp. aureus N315
guauaugaaucgauau

SEQ ID NO: 2125449 - RNA, 22 nt, Staphylococcus aureus subsp. aureus N315
ggucuucgcaaucauuagcgaa

SEQ ID NO: 2125450 - RNA, 14 nt, Staphylococcus aureus subsp. aureus N315
aaguaaugauauua

SEQ ID NO: 2125451 - RNA, 17 nt, Staphylococcus aureus subsp. aureus N315
gguaaauuuaucauuuu

SEQ ID NO: 2125452 - RNA, 15 nt, Staphylococcus aureus subsp. aureus N315
ggucaauuuuaccau

SEQ ID NO: 2125453 - RNA, 21 nt, Staphylococcus aureus subsp. aureus N315
aaguaaauguuuuauguauuu

SEQ ID NO: 2125454 - RNA, 19 nt, Staphylococcus aureus subsp. aureus N315
aaguaagcagagccauaau

SEQ ID NO: 2125455 - RNA, 16 nt, Staphylococcus aureus subsp. aureus N315
ggaacaugauucauga

SEQ ID NO: 2125456 - RNA, 11 nt, Staphylococcus aureus subsp. aureus N315
ggacaauguag

SEQ ID NO: 2125457 - RNA, 21 nt, Staphylococcus aureus subsp. aureus N315
gcaacgcgauugcuaaacgcu

SEQ ID NO: 2125458 - RNA, 16 nt, Staphylococcus aureus subsp. aureus N315
gcaauaucaucauuua

SEQ ID NO: 2125459 - RNA, 15 nt, Staphylococcus aureus subsp. aureus N315
gcacaauauuuacca

SEQ ID NO: 2125460 - RNA, 17 nt, Staphylococcus aureus subsp. aureus N315
gauuguaccaguaacaa

SEQ ID NO: 2125461 - RNA, 23 nt, Staphylococcus aureus subsp. aureus N315
gauuucguuagacucacuucuua

SEQ ID NO: 2125462 - RNA, 14 nt, Staphylococcus aureus subsp. aureus N315
gauucccaaauagu

SEQ ID NO: 2125463 - RNA, 15 nt, Staphylococcus aureus subsp. aureus N315
gauuaucuaacucau

SEQ ID NO: 2125464 - RNA, 17 nt, Staphylococcus aureus subsp. aureus N315
gauuaucuaacucauaa

SEQ ID NO: 2125465 - RNA, 23 nt, Staphylococcus aureus subsp. aureus N315
aacuuagcuuagucaauguauau

SEQ ID NO: 2125466 - RNA, 22 nt, Staphylococcus aureus subsp. aureus N315
aacuuuuuaauaauuguaucgu

SEQ ID NO: 2125467 - RNA, 20 nt, Staphylococcus aureus subsp. aureus N315
gaucgcccauacuaaauaag

SEQ ID NO: 2125468 - RNA, 16 nt, Staphylococcus aureus subsp. aureus N315
gaucuaaaauaucauc

SEQ ID NO: 2125469 - RNA, 18 nt, Staphylococcus aureus subsp. aureus N315
gaucguaacauuagcaug

SEQ ID NO: 2125470 - RNA, 13 nt, Staphylococcus aureus subsp. aureus N315
gauaaaaugauau

SEQ ID NO: 2125471 - RNA, 18 nt, Staphylococcus aureus subsp. aureus N315
gauagaaugucgauauuu

SEQ ID NO: 2125472 - RNA, 15 nt, Staphylococcus aureus subsp. aureus N315
gauaggauuuacacc

SEQ ID NO: 2125473 - RNA, 18 nt, Staphylococcus aureus subsp. aureus N315
aacucaaaaagccaacac

SEQ ID NO: 2125474 - RNA, 13 nt, Staphylococcus aureus subsp. aureus N315
aacuacaauucau

SEQ ID NO: 2125475 - RNA, 16 nt, Staphylococcus aureus subsp. aureus N315
aacuaauaacaaauag

SEQ ID NO: 2125476 - RNA, 14 nt, Staphylococcus aureus subsp. aureus N315
aacguucacuuggu

SEQ ID NO: 2125477 - RNA, 18 nt, Staphylococcus aureus subsp. aureus N315
aacguuauucguuaacaa

SEQ ID NO: 2125478 - RNA, 20 nt, Staphylococcus aureus subsp. aureus N315
gacugcaaauacgaguguuu

SEQ ID NO: 2125479 - RNA, 21 nt, Staphylococcus aureus subsp. aureus N315
gagauauauuaauguuugaug

SEQ ID NO: 2125480 - RNA, 23 nt, Staphylococcus aureus subsp. aureus N315
gagaugaucagggaaaucaucug

SEQ ID NO: 2125481 - RNA, 18 nt, Staphylococcus aureus subsp. aureus N315
aagagaacuuuucaaaca

SEQ ID NO: 2125482 - RNA, 21 nt, Staphylococcus aureus subsp. aureus N315
aagagcaauuaaagucaauuu

SEQ ID NO: 2125483 - RNA, 12 nt, Staphylococcus aureus subsp. aureus N315
gccaucaauauu

SEQ ID NO: 2125484 - RNA, 15 nt, Staphylococcus aureus subsp. aureus N315
aagaauaaacaacau

SEQ ID NO: 2125485 - RNA, 15 nt, Staphylococcus aureus subsp. aureus N315
aagaauaugauauug

SEQ ID NO: 2125486 - RNA, 14 nt, Staphylococcus aureus subsp. aureus N315
aagaauauuuaagu

SEQ ID NO: 2125487 - RNA, 21 nt, Staphylococcus aureus subsp. aureus N315
gcauauucgcuuaaaaacgcu

SEQ ID NO: 2125488 - RNA, 16 nt, Staphylococcus aureus subsp. aureus N315
gcauaauucaacuuaa

SEQ ID NO: 2125489 - RNA, 22 nt, Staphylococcus aureus subsp. aureus N315
gcagugaucuuuuuuauauuca

SEQ ID NO: 2125490 - RNA, 15 nt, Staphylococcus aureus subsp. aureus N315
gcauuacuacaaacu

SEQ ID NO: 2125491 - RNA, 16 nt, Staphylococcus aureus subsp. aureus N315
gcauuuaaacaaagcu

SEQ ID NO: 2125492 - RNA, 19 nt, Staphylococcus aureus subsp. aureus N315
gcauuuuguuucaacauuu

SEQ ID NO: 2125493 - RNA, 16 nt, Staphylococcus aureus subsp. aureus N315
gaacauaccugcauau

SEQ ID NO: 2125494 - RNA, 19 nt, Staphylococcus aureus subsp. aureus N315
gaaaugacgauaccuuuaa

SEQ ID NO: 2125495 - RNA, 14 nt, Staphylococcus aureus subsp. aureus N315
gaagaaaucaucga

SEQ ID NO: 2125496 - RNA, 17 nt, Staphylococcus aureus subsp. aureus N315
gacauuuaaauauaacc

SEQ ID NO: 2125497 - RNA, 17 nt, Staphylococcus aureus subsp. aureus N315
aacgauaagauagcuau

SEQ ID NO: 2125498 - RNA, 13 nt, Staphylococcus aureus subsp. aureus N315
aacgagauuacac

SEQ ID NO: 2125499 - RNA, 17 nt, Staphylococcus aureus subsp. aureus N315
gaauuauuuaaaaugcu

SEQ ID NO: 2125500 - RNA, 17 nt, Staphylococcus aureus subsp. aureus N315
gaccacggucuugauau

SEQ ID NO: 2125501 - RNA, 14 nt, Staphylococcus aureus subsp. aureus N315
cugaaauguagaca

SEQ ID NO: 2125502 - RNA, 15 nt, Staphylococcus aureus subsp. aureus N315
cuucuuucaauuaau

SEQ ID NO: 2125503 - RNA, 13 nt, Staphylococcus aureus subsp. aureus N315
cuucuccaaucau

SEQ ID NO: 2125504 - RNA, 14 nt, Staphylococcus aureus subsp. aureus N315
cuucuaucuucaca

SEQ ID NO: 2125505 - RNA, 14 nt, Staphylococcus aureus subsp. aureus N315
cuucuaaccacuuc

SEQ ID NO: 2125506 - RNA, 14 nt, Staphylococcus aureus subsp. aureus N315
cuucuaacugaauu

SEQ ID NO: 2125507 - RNA, 13 nt, Staphylococcus aureus subsp. aureus N315
cuucuuacugcaa

SEQ ID NO: 2125508 - RNA, 21 nt, Staphylococcus aureus subsp. aureus N315
cuucacugaaaauuuguauaa

SEQ ID NO: 2125509 - RNA, 22 nt, Staphylococcus aureus subsp. aureus N315
cuuauauacguugauuaacaca

SEQ ID NO: 2125510 - RNA, 22 nt, Staphylococcus aureus subsp. aureus N315
cuuaucagcauuaaucguauuu

SEQ ID NO: 2125511 - RNA, 17 nt, Staphylococcus aureus subsp. aureus N315
cuuaauucuucaucaau

SEQ ID NO: 2125512 - RNA, 19 nt, Staphylococcus aureus subsp. aureus N315
cgucaucaaaacguuugaa

SEQ ID NO: 2125513 - RNA, 22 nt, Staphylococcus aureus subsp. aureus N315
cguauucuucaauaacaccuuu

SEQ ID NO: 2125514 - RNA, 19 nt, Staphylococcus aureus subsp. aureus N315
cguuuugcuaaccaucaua

SEQ ID NO: 2125515 - RNA, 14 nt, Staphylococcus aureus subsp. aureus N315
cguuuuuauuacaa

SEQ ID NO: 2125516 - RNA, 22 nt, Staphylococcus aureus subsp. aureus N315
cuacuuugaagggagcauuuca

SEQ ID NO: 2125517 - RNA, 22 nt, Staphylococcus aureus subsp. aureus N315
cuaauaucaauuuuuacuaaau

SEQ ID NO: 2125518 - RNA, 15 nt, Staphylococcus aureus subsp. aureus N315
cuaauacauacugau

SEQ ID NO: 2125519 - RNA, 19 nt, Staphylococcus aureus subsp. aureus N315
cuaacuuuagggugcuuuu

SEQ ID NO: 2125520 - RNA, 22 nt, Staphylococcus aureus subsp. aureus N315
cuacaauuuuccuuccaauaau

SEQ ID NO: 2125521 - RNA, 14 nt, Staphylococcus aureus subsp. aureus N315
cuacaccaccugca

SEQ ID NO: 2125522 - RNA, 17 nt, Staphylococcus aureus subsp. aureus N315
cuacacuccccuuauca

SEQ ID NO: 2125523 - RNA, 17 nt, Staphylococcus aureus subsp. aureus N315
cuacagguaaugcaagu

SEQ ID NO: 2125524 - RNA, 23 nt, Staphylococcus aureus subsp. aureus N315
cuaccaauacguuuccaaucuau

SEQ ID NO: 2125525 - RNA, 18 nt, Staphylococcus aureus subsp. aureus N315
cucccuucaaaguuuuca

SEQ ID NO: 2125526 - RNA, 20 nt, Staphylococcus aureus subsp. aureus N315
uuuuuaugcuuuaaaucgau

SEQ ID NO: 2125527 - RNA, 12 nt, Staphylococcus aureus subsp. aureus N315
uuuuguugcuca

SEQ ID NO: 2125528 - RNA, 21 nt, Staphylococcus aureus subsp. aureus N315
uuuuaaaaaacauaccugcau

SEQ ID NO: 2125529 - RNA, 14 nt, Staphylococcus aureus subsp. aureus N315
uuuuaaaauuauca

SEQ ID NO: 2125530 - RNA, 13 nt, Staphylococcus aureus subsp. aureus N315
uuuugguuguucu

SEQ ID NO: 2125531 - RNA, 19 nt, Staphylococcus aureus subsp. aureus N315
uuuugcuuuguuugcuucu

SEQ ID NO: 2125532 - RNA, 23 nt, Staphylococcus aureus subsp. aureus N315
uuuuggagccccuuacaacuuua

SEQ ID NO: 2125533 - RNA, 15 nt, Staphylococcus aureus subsp. aureus N315
uuuuggcaauagcac

SEQ ID NO: 2125534 - RNA, 14 nt, Staphylococcus aureus subsp. aureus N315
uuucuaguuuaaca

SEQ ID NO: 2125535 - RNA, 18 nt, Staphylococcus aureus subsp. aureus N315
uuucuauggcacaaauga

SEQ ID NO: 2125536 - RNA, 14 nt, Staphylococcus aureus subsp. aureus N315
uuucuagcaacuga

SEQ ID NO: 2125537 - RNA, 19 nt, Staphylococcus aureus subsp. aureus N315
uuuccaaucuauuaaugcu

SEQ ID NO: 2125538 - RNA, 18 nt, Staphylococcus aureus subsp. aureus N315
uuugaaucauuugaugcu

SEQ ID NO: 2125539 - RNA, 18 nt, Staphylococcus aureus subsp. aureus N315
uuugagauauauuaaugu

SEQ ID NO: 2125540 - RNA, 17 nt, Staphylococcus aureus subsp. aureus N315
uuugcuguccacuauau

SEQ ID NO: 2125541 - RNA, 15 nt, Staphylococcus aureus subsp. aureus N315
uugaaauguuuauca

SEQ ID NO: 2125542 - RNA, 18 nt, Staphylococcus aureus subsp. aureus N315
uucuuuuuuuguuaccaa

SEQ ID NO: 2125543 - RNA, 12 nt, Staphylococcus aureus subsp. aureus N315
uucuuugucauc

SEQ ID NO: 2125544 - RNA, 18 nt, Staphylococcus aureus subsp. aureus N315
uuguaggaagaccacuau

SEQ ID NO: 2125545 - RNA, 21 nt, Staphylococcus aureus subsp. aureus N315
uuguaacucaauaugaaaccu

SEQ ID NO: 2125546 - RNA, 22 nt, Staphylococcus aureus subsp. aureus N315
uuggcucuuuuuauuuauaacu

SEQ ID NO: 2125547 - RNA, 20 nt, Staphylococcus aureus subsp. aureus N315
uuuauuaaagaaacaugauu

SEQ ID NO: 2125548 - RNA, 14 nt, Staphylococcus aureus subsp. aureus N315
uuuagaauaguuac

SEQ ID NO: 2125549 - RNA, 17 nt, Staphylococcus aureus subsp. aureus N315
uuuacuuuuccuugauu

SEQ ID NO: 2125550 - RNA, 19 nt, Staphylococcus aureus subsp. aureus N315
uuuaucuccuaaagguaac

SEQ ID NO: 2125551 - RNA, 18 nt, Staphylococcus aureus subsp. aureus N315
uuuaauauuguuaauuca

SEQ ID NO: 2125552 - RNA, 19 nt, Staphylococcus aureus subsp. aureus N315
uuuaauauugacauuuaca

SEQ ID NO: 2125553 - RNA, 18 nt, Staphylococcus aureus subsp. aureus N315
uuuaaugccggucauaac

SEQ ID NO: 2125554 - RNA, 22 nt, Staphylococcus aureus subsp. aureus N315
uuuaaugagcuuuucuaaugcu

SEQ ID NO: 2125555 - RNA, 20 nt, Staphylococcus aureus subsp. aureus N315
uuuaaugauuuuucaucaau

SEQ ID NO: 2125556 - RNA, 20 nt, Staphylococcus aureus subsp. aureus N315
uuuacauggcuuagguuuaa

SEQ ID NO: 2125557 - RNA, 12 nt, Staphylococcus aureus subsp. aureus N315
uuuacaaucaac

SEQ ID NO: 2125558 - RNA, 19 nt, Staphylococcus aureus subsp. aureus N315
uucccguuaauaucaugcu

SEQ ID NO: 2125559 - RNA, 22 nt, Staphylococcus aureus subsp. aureus N315
uucgaaaagaaauucuacaaac

SEQ ID NO: 2125560 - RNA, 14 nt, Staphylococcus aureus subsp. aureus N315
uucgaacuaucaau

SEQ ID NO: 2125561 - RNA, 22 nt, Staphylococcus aureus subsp. aureus N315
uucgaagucauaugcauacacu

SEQ ID NO: 2125562 - RNA, 19 nt, Staphylococcus aureus subsp. aureus N315
uucguuuuaauaaauuguu

SEQ ID NO: 2125563 - RNA, 13 nt, Staphylococcus aureus subsp. aureus N315
uucuaauacaaac

SEQ ID NO: 2125564 - RNA, 19 nt, Staphylococcus aureus subsp. aureus N315
uucuaauacaccaaaucca

SEQ ID NO: 2125565 - RNA, 17 nt, Staphylococcus aureus subsp. aureus N315
uucuaacgguaaauaac

SEQ ID NO: 2125566 - RNA, 13 nt, Staphylococcus aureus subsp. aureus N315
uucuacaaacaau

SEQ ID NO: 2125567 - RNA, 16 nt, Staphylococcus aureus subsp. aureus N315
uucuaguagcuugaau

SEQ ID NO: 2125568 - RNA, 21 nt, Staphylococcus aureus subsp. aureus N315
uucuacucuagcggaacguaa

SEQ ID NO: 2125569 - RNA, 15 nt, Staphylococcus aureus subsp. aureus N315
uucguacuuccaaua

SEQ ID NO: 2125570 - RNA, 17 nt, Staphylococcus aureus subsp. aureus N315
uucuguccaaaaagguu

SEQ ID NO: 2125571 - RNA, 17 nt, Staphylococcus aureus subsp. aureus N315
uucuguaauaauaucac

SEQ ID NO: 2125572 - RNA, 20 nt, Staphylococcus aureus subsp. aureus N315
uucugucccacucccuaaua

SEQ ID NO: 2125573 - RNA, 16 nt, Staphylococcus aureus subsp. aureus N315
uucuucagguguuuua

SEQ ID NO: 2125574 - RNA, 16 nt, Staphylococcus aureus subsp. aureus N315
uucuucaccaacuuuu

SEQ ID NO: 2125575 - RNA, 18 nt, Staphylococcus aureus subsp. aureus N315
uucuuauuuauucauaac

SEQ ID NO: 2125576 - RNA, 21 nt, Staphylococcus aureus subsp. aureus N315
uucucugcuucuaaaacauca

SEQ ID NO: 2125577 - RNA, 17 nt, Staphylococcus aureus subsp. aureus N315
uucucuaacuuuaccaa

SEQ ID NO: 2125578 - RNA, 22 nt, Staphylococcus aureus subsp. aureus N315
uucuauguagcaggcaacuuuu

SEQ ID NO: 2125579 - RNA, 17 nt, Staphylococcus aureus subsp. aureus N315
uucuccaacgucauaac

SEQ ID NO: 2125580 - RNA, 15 nt, Staphylococcus aureus subsp. aureus N315
uuaauuguuaaauca

SEQ ID NO: 2125581 - RNA, 20 nt, Staphylococcus aureus subsp. aureus N315
uuaauuuguauuuaaaauca

SEQ ID NO: 2125582 - RNA, 15 nt, Staphylococcus aureus subsp. aureus N315
uuaccuuuuaaaccu

SEQ ID NO: 2125583 - RNA, 17 nt, Staphylococcus aureus subsp. aureus N315
uuauacacuuacaaaua

SEQ ID NO: 2125584 - RNA, 20 nt, Staphylococcus aureus subsp. aureus N315
uuagcaaaaauauuuaaacu

SEQ ID NO: 2125585 - RNA, 20 nt, Staphylococcus aureus subsp. aureus N315
uuagauauauuugaaaggua

SEQ ID NO: 2125586 - RNA, 15 nt, Staphylococcus aureus subsp. aureus N315
uguuuuuacaaaugu

SEQ ID NO: 2125587 - RNA, 17 nt, Staphylococcus aureus subsp. aureus N315
uguuguacauguauugg

SEQ ID NO: 2125588 - RNA, 14 nt, Staphylococcus aureus subsp. aureus N315
uguuuaaauaucau

SEQ ID NO: 2125589 - RNA, 14 nt, Staphylococcus aureus subsp. aureus N315
uuaaaucaacauca

SEQ ID NO: 2125590 - RNA, 14 nt, Staphylococcus aureus subsp. aureus N315
uuaaauaaugauaa

SEQ ID NO: 2125591 - RNA, 14 nt, Staphylococcus aureus subsp. aureus N315
uuaaacaucuauaa

SEQ ID NO: 2125592 - RNA, 20 nt, Staphylococcus aureus subsp. aureus N315
uuaaaagugguuuuacugcu

SEQ ID NO: 2125593 - RNA, 19 nt, Staphylococcus aureus subsp. aureus N315
uuaaaacaugacaacuuca

SEQ ID NO: 2125594 - RNA, 12 nt, Staphylococcus aureus subsp. aureus N315
uuaaacaaauaa

SEQ ID NO: 2125595 - RNA, 16 nt, Staphylococcus aureus subsp. aureus N315
uuaauacgauaauaac

SEQ ID NO: 2125596 - RNA, 20 nt, Staphylococcus aureus subsp. aureus N315
uuaauuaaaauacaaauuac

SEQ ID NO: 2125597 - RNA, 13 nt, Staphylococcus aureus subsp. aureus N315
uuaauaacgauaa

SEQ ID NO: 2125598 - RNA, 16 nt, Staphylococcus aureus subsp. aureus N315
uuaauacaagucuuua

SEQ ID NO: 2125599 - RNA, 20 nt, Staphylococcus aureus subsp. aureus N315
uuaaaucaccaacaacuuug

SEQ ID NO: 2125600 - RNA, 19 nt, Staphylococcus aureus subsp. aureus N315
uuaaauagaugagaaagua

SEQ ID NO: 2125601 - RNA, 21 nt, Staphylococcus aureus subsp. aureus N315
uuaaaugauauugaaagugua

SEQ ID NO: 2125602 - RNA, 21 nt, Staphylococcus aureus subsp. aureus N315
uuaagucauuacguaacauca

SEQ ID NO: 2125603 - RNA, 19 nt, Staphylococcus aureus subsp. aureus N315
uucaauaaaaaugguauuc

SEQ ID NO: 2125604 - RNA, 13 nt, Staphylococcus aureus subsp. aureus N315
uucaaguuaugcu

SEQ ID NO: 2125605 - RNA, 20 nt, Staphylococcus aureus subsp. aureus N315
uucaauucuagucaaccuug

SEQ ID NO: 2125606 - RNA, 16 nt, Staphylococcus aureus subsp. aureus N315
uucaaugucuacuuug

SEQ ID NO: 2125607 - RNA, 21 nt, Staphylococcus aureus subsp. aureus N315
uucacgauuuuuaaaaugcuu

SEQ ID NO: 2125608 - RNA, 13 nt, Staphylococcus aureus subsp. aureus N315
uuauuuaaaaugc

SEQ ID NO: 2125609 - RNA, 22 nt, Staphylococcus aureus subsp. aureus N315
uuauuuacaccugcuaguucag

SEQ ID NO: 2125610 - RNA, 13 nt, Staphylococcus aureus subsp. aureus N315
uucaaauaaauca

SEQ ID NO: 2125611 - RNA, 15 nt, Staphylococcus aureus subsp. aureus N315
uucaaaaauuaauca

SEQ ID NO: 2125612 - RNA, 23 nt, Staphylococcus aureus subsp. aureus N315
uuauuccaaauuugaaacaaugc

SEQ ID NO: 2125613 - RNA, 15 nt, Staphylococcus aureus subsp. aureus N315
uuccaaacacacugu

SEQ ID NO: 2125614 - RNA, 22 nt, Staphylococcus aureus subsp. aureus N315
uuccaaagaaagcuaauaucaa

SEQ ID NO: 2125615 - RNA, 13 nt, Staphylococcus aureus subsp. aureus N315
uucauugcuuggu

SEQ ID NO: 2125616 - RNA, 21 nt, Staphylococcus aureus subsp. aureus N315
uucauuguauguugaaaguga

SEQ ID NO: 2125617 - RNA, 16 nt, Staphylococcus aureus subsp. aureus N315
uucauuugaaauaguu

SEQ ID NO: 2125618 - RNA, 15 nt, Staphylococcus aureus subsp. aureus N315
uucauuacaaacuug

SEQ ID NO: 2125619 - RNA, 15 nt, Staphylococcus aureus subsp. aureus N315
uucauguaaauaguu

SEQ ID NO: 2125620 - RNA, 15 nt, Staphylococcus aureus subsp. aureus N315
uucaucucagcaaua

SEQ ID NO: 2125621 - RNA, 21 nt, Staphylococcus aureus subsp. aureus N315
ugucuuccaaucaacuucaua

SEQ ID NO: 2125622 - RNA, 21 nt, Staphylococcus aureus subsp. aureus N315
uguaaauuacaaaaguaugau

SEQ ID NO: 2125623 - RNA, 15 nt, Staphylococcus aureus subsp. aureus N315
uguauaguaaccuuu

SEQ ID NO: 2125624 - RNA, 18 nt, Staphylococcus aureus subsp. aureus N315
ugguuagagaaaaaucug

SEQ ID NO: 2125625 - RNA, 16 nt, Staphylococcus aureus subsp. aureus N315
ugcuuuuaauaguguu

SEQ ID NO: 2125626 - RNA, 20 nt, Staphylococcus aureus subsp. aureus N315
uggaaagaugggauuucacu

SEQ ID NO: 2125627 - RNA, 19 nt, Staphylococcus aureus subsp. aureus N315
uggcuugaaguuguuucuc

SEQ ID NO: 2125628 - RNA, 23 nt, Staphylococcus aureus subsp. aureus N315
uaaaaacaaagguuuguaagaca

SEQ ID NO: 2125629 - RNA, 18 nt, Staphylococcus aureus subsp. aureus N315
uaaaaaaucaguuuuuaa

SEQ ID NO: 2125630 - RNA, 23 nt, Staphylococcus aureus subsp. aureus N315
uaaaaacgauucauuauaugguu

SEQ ID NO: 2125631 - RNA, 17 nt, Staphylococcus aureus subsp. aureus N315
uaaaaugcucccuucaa

SEQ ID NO: 2125632 - RNA, 19 nt, Staphylococcus aureus subsp. aureus N315
uaaauauaaaccagcugau

SEQ ID NO: 2125633 - RNA, 20 nt, Staphylococcus aureus subsp. aureus N315
uaaauaucauaaaugcauac

SEQ ID NO: 2125634 - RNA, 18 nt, Staphylococcus aureus subsp. aureus N315
uaaagcugcgauauaacu

SEQ ID NO: 2125635 - RNA, 20 nt, Staphylococcus aureus subsp. aureus N315
uaaaggaagacauacucaca

SEQ ID NO: 2125636 - RNA, 15 nt, Staphylococcus aureus subsp. aureus N315
uaaagcuaaugcaag

SEQ ID NO: 2125637 - RNA, 16 nt, Staphylococcus aureus subsp. aureus N315
uaaagcauaucucaag

SEQ ID NO: 2125638 - RNA, 13 nt, Staphylococcus aureus subsp. aureus N315
uaaacgaucaacu

SEQ ID NO: 2125639 - RNA, 14 nt, Staphylococcus aureus subsp. aureus N315
uaaccuacuuugau

SEQ ID NO: 2125640 - RNA, 19 nt, Staphylococcus aureus subsp. aureus N315
uaaauguuuauaucuuuua

SEQ ID NO: 2125641 - RNA, 21 nt, Staphylococcus aureus subsp. aureus N315
uaaauuacccacaucuuuuua

SEQ ID NO: 2125642 - RNA, 19 nt, Staphylococcus aureus subsp. aureus N315
uaaauuacucaauuugaag

SEQ ID NO: 2125643 - RNA, 16 nt, Staphylococcus aureus subsp. aureus N315
uaaaucaaacuuuuca

SEQ ID NO: 2125644 - RNA, 16 nt, Staphylococcus aureus subsp. aureus N315
uaaaucaagaaauguu

SEQ ID NO: 2125645 - RNA, 17 nt, Staphylococcus aureus subsp. aureus N315
uaaaucaagaaauguua

SEQ ID NO: 2125646 - RNA, 14 nt, Staphylococcus aureus subsp. aureus N315
uaaauauugauaua

SEQ ID NO: 2125647 - RNA, 19 nt, Staphylococcus aureus subsp. aureus N315
uaaaucauacgagaaauua

SEQ ID NO: 2125648 - RNA, 23 nt, Staphylococcus aureus subsp. aureus N315
uaaaucauuucguucauauggca

SEQ ID NO: 2125649 - RNA, 21 nt, Staphylococcus aureus subsp. aureus N315
uaacaugugcaaguauaaucc

SEQ ID NO: 2125650 - RNA, 16 nt, Staphylococcus aureus subsp. aureus N315
uaacagcuaaaaauuc

SEQ ID NO: 2125651 - RNA, 15 nt, Staphylococcus aureus subsp. aureus N315
uaaauuguguuucuu

SEQ ID NO: 2125652 - RNA, 16 nt, Staphylococcus aureus subsp. aureus N315
uaaauuuacgaaagua

SEQ ID NO: 2125653 - RNA, 14 nt, Staphylococcus aureus subsp. aureus N315
uaaauugaaauguu

SEQ ID NO: 2125654 - RNA, 22 nt, Staphylococcus aureus subsp. aureus N315
uaaucuaaaaauagauguacaa

SEQ ID NO: 2125655 - RNA, 22 nt, Staphylococcus aureus subsp. aureus N315
uaaucguuccaacaacuaagau

SEQ ID NO: 2125656 - RNA, 23 nt, Staphylococcus aureus subsp. aureus N315
uaaucuauggaaaauguuaucaa

SEQ ID NO: 2125657 - RNA, 12 nt, Staphylococcus aureus subsp. aureus N315
uaaucuuauucg

SEQ ID NO: 2125658 - RNA, 17 nt, Staphylococcus aureus subsp. aureus N315
uaaucuuaggugucauc

SEQ ID NO: 2125659 - RNA, 19 nt, Staphylococcus aureus subsp. aureus N315
uaauaauucauaaaugcuu

SEQ ID NO: 2125660 - RNA, 15 nt, Staphylococcus aureus subsp. aureus N315
uaauauccugcaguu

SEQ ID NO: 2125661 - RNA, 20 nt, Staphylococcus aureus subsp. aureus N315
uaauaccuaugauauaugcu

SEQ ID NO: 2125662 - RNA, 12 nt, Staphylococcus aureus subsp. aureus N315
uaauauugaaua

SEQ ID NO: 2125663 - RNA, 17 nt, Staphylococcus aureus subsp. aureus N315
uaauauuauucuuuaua

SEQ ID NO: 2125664 - RNA, 13 nt, Staphylococcus aureus subsp. aureus N315
uaauaaaaucauc

SEQ ID NO: 2125665 - RNA, 18 nt, Staphylococcus aureus subsp. aureus N315
uaaguaagauuuaaacau

SEQ ID NO: 2125666 - RNA, 13 nt, Staphylococcus aureus subsp. aureus N315
uaagguacauaaa

SEQ ID NO: 2125667 - RNA, 17 nt, Staphylococcus aureus subsp. aureus N315
uaagcauuaauguucaa

SEQ ID NO: 2125668 - RNA, 16 nt, Staphylococcus aureus subsp. aureus N315
uaagaugacugaacca

SEQ ID NO: 2125669 - RNA, 14 nt, Staphylococcus aureus subsp. aureus N315
uaagacauaugcag

SEQ ID NO: 2125670 - RNA, 22 nt, Staphylococcus aureus subsp. aureus N315
uaagaauuguugaucaugagac

SEQ ID NO: 2125671 - RNA, 16 nt, Staphylococcus aureus subsp. aureus N315
uacaaacuugguauug

SEQ ID NO: 2125672 - RNA, 16 nt, Staphylococcus aureus subsp. aureus N315
uacaaaccuaucauca

SEQ ID NO: 2125673 - RNA, 19 nt, Staphylococcus aureus subsp. aureus N315
uacaaaccuaucaucaauc

SEQ ID NO: 2125674 - RNA, 21 nt, Staphylococcus aureus subsp. aureus N315
uaauuggcaccucuaccaguu

SEQ ID NO: 2125675 - RNA, 18 nt, Staphylococcus aureus subsp. aureus N315
uaauuguuaaacccucau

SEQ ID NO: 2125676 - RNA, 14 nt, Staphylococcus aureus subsp. aureus N315
uaauuuaaaugcuu

SEQ ID NO: 2125677 - RNA, 17 nt, Staphylococcus aureus subsp. aureus N315
uaaugcucuauauaucc

SEQ ID NO: 2125678 - RNA, 17 nt, Staphylococcus aureus subsp. aureus N315
uaaugcuaauuuaacug

SEQ ID NO: 2125679 - RNA, 15 nt, Staphylococcus aureus subsp. aureus N315
uacaggcaaugcaag

SEQ ID NO: 2125680 - RNA, 19 nt, Staphylococcus aureus subsp. aureus N315
uacacguuucguugcugau

SEQ ID NO: 2125681 - RNA, 18 nt, Staphylococcus aureus subsp. aureus N315
uacacucaaacaagauuc

SEQ ID NO: 2125682 - RNA, 17 nt, Staphylococcus aureus subsp. aureus N315
uacaccugcaauauagc

SEQ ID NO: 2125683 - RNA, 17 nt, Staphylococcus aureus subsp. aureus N315
guuuuauucaauugauu

SEQ ID NO: 2125684 - RNA, 17 nt, Staphylococcus aureus subsp. aureus N315
guuuuaaauaaaugacu

SEQ ID NO: 2125685 - RNA, 14 nt, Staphylococcus aureus subsp. aureus N315
guuuuaaaugaaac

SEQ ID NO: 2125686 - RNA, 22 nt, Staphylococcus aureus subsp. aureus N315
guuugucguuacuaccuauuaa

SEQ ID NO: 2125687 - RNA, 17 nt, Staphylococcus aureus subsp. aureus N315
guuuugcuaaccaucau

SEQ ID NO: 2125688 - RNA, 14 nt, Staphylococcus aureus subsp. aureus N315
guuuugcaacauuu

SEQ ID NO: 2125689 - RNA, 16 nt, Staphylococcus aureus subsp. aureus N315
guuugauagaugauac

SEQ ID NO: 2125690 - RNA, 18 nt, Staphylococcus aureus subsp. aureus N315
guuuggauaaaaugauau

SEQ ID NO: 2125691 - RNA, 20 nt, Staphylococcus aureus subsp. aureus N315
guuugaaggugauaauguac

SEQ ID NO: 2125692 - RNA, 23 nt, Staphylococcus aureus subsp. aureus N315
guugcacaaauugcaauggcaac

SEQ ID NO: 2125693 - RNA, 16 nt, Staphylococcus aureus subsp. aureus N315
guugcuucuuaucaac

SEQ ID NO: 2125694 - RNA, 15 nt, Staphylococcus aureus subsp. aureus N315
uaguauaaauaucau

SEQ ID NO: 2125695 - RNA, 22 nt, Staphylococcus aureus subsp. aureus N315
uaguauagcgcagcaaaugcuu

SEQ ID NO: 2125696 - RNA, 23 nt, Staphylococcus aureus subsp. aureus N315
uagucauuacaaaucaugacaua

SEQ ID NO: 2125697 - RNA, 12 nt, Staphylococcus aureus subsp. aureus N315
uaguaguguauu

SEQ ID NO: 2125698 - RNA, 20 nt, Staphylococcus aureus subsp. aureus N315
uaguacggcugcuuuaacug

SEQ ID NO: 2125699 - RNA, 23 nt, Staphylococcus aureus subsp. aureus N315
uaguacguuugcauauccuucaa

SEQ ID NO: 2125700 - RNA, 17 nt, Staphylococcus aureus subsp. aureus N315
uaguacaaaauugucuc

SEQ ID NO: 2125701 - RNA, 13 nt, Staphylococcus aureus subsp. aureus N315
uagugagcguauu

SEQ ID NO: 2125702 - RNA, 21 nt, Staphylococcus aureus subsp. aureus N315
uagucuuuuuuaagcuuauca

SEQ ID NO: 2125703 - RNA, 17 nt, Staphylococcus aureus subsp. aureus N315
uaguguuauauuguauu

SEQ ID NO: 2125704 - RNA, 23 nt, Staphylococcus aureus subsp. aureus N315
uaguugaucaaaaagacagcagu

SEQ ID NO: 2125705 - RNA, 15 nt, Staphylococcus aureus subsp. aureus N315
uaguuguacuucuuu

SEQ ID NO: 2125706 - RNA, 21 nt, Staphylococcus aureus subsp. aureus N315
uaguucaaauugaacuucuuu

SEQ ID NO: 2125707 - RNA, 20 nt, Staphylococcus aureus subsp. aureus N315
uaguuaaaguacuuacaaau

SEQ ID NO: 2125708 - RNA, 22 nt, Staphylococcus aureus subsp. aureus N315
uauagaggauauuuauucuaag

SEQ ID NO: 2125709 - RNA, 22 nt, Staphylococcus aureus subsp. aureus N315
uauagauuuuguauuagcaucu

SEQ ID NO: 2125710 - RNA, 21 nt, Staphylococcus aureus subsp. aureus N315
uauaggcccuaacgguagaau

SEQ ID NO: 2125711 - RNA, 20 nt, Staphylococcus aureus subsp. aureus N315
uauauuacucaaaauuaaag

SEQ ID NO: 2125712 - RNA, 18 nt, Staphylococcus aureus subsp. aureus N315
uauauauuccuuaaaccg

SEQ ID NO: 2125713 - RNA, 12 nt, Staphylococcus aureus subsp. aureus N315
uauauauucaau

SEQ ID NO: 2125714 - RNA, 18 nt, Staphylococcus aureus subsp. aureus N315
uauaguaagaaaaguuac

SEQ ID NO: 2125715 - RNA, 18 nt, Staphylococcus aureus subsp. aureus N315
uauauaauuuauuuagca

SEQ ID NO: 2125716 - RNA, 15 nt, Staphylococcus aureus subsp. aureus N315
uauauauccauucaa

SEQ ID NO: 2125717 - RNA, 18 nt, Staphylococcus aureus subsp. aureus N315
uauaaguagcucaaaaca

SEQ ID NO: 2125718 - RNA, 23 nt, Staphylococcus aureus subsp. aureus N315
uauaauacuguauuuuaacguca

SEQ ID NO: 2125719 - RNA, 13 nt, Staphylococcus aureus subsp. aureus N315
uauaaguagcuca

SEQ ID NO: 2125720 - RNA, 19 nt, Staphylococcus aureus subsp. aureus N315
uauaauuuauuuagcaucu

SEQ ID NO: 2125721 - RNA, 20 nt, Staphylococcus aureus subsp. aureus N315
uauaaauaaaaauacauaau

SEQ ID NO: 2125722 - RNA, 16 nt, Staphylococcus aureus subsp. aureus N315
uauaaagacaccuuca

SEQ ID NO: 2125723 - RNA, 22 nt, Staphylococcus aureus subsp. aureus N315
uauaaauuucuucauaguucaa

SEQ ID NO: 2125724 - RNA, 18 nt, Staphylococcus aureus subsp. aureus N315
uauaaaaagugaagauau

SEQ ID NO: 2125725 - RNA, 14 nt, Staphylococcus aureus subsp. aureus N315
uaucuuuugcuucg

SEQ ID NO: 2125726 - RNA, 23 nt, Staphylococcus aureus subsp. aureus N315
uaucuaacaaucguuuuaaugcc

SEQ ID NO: 2125727 - RNA, 18 nt, Staphylococcus aureus subsp. aureus N315
uaucuacuauuuguuuua

SEQ ID NO: 2125728 - RNA, 19 nt, Staphylococcus aureus subsp. aureus N315
uaucaagaauauaacgaau

SEQ ID NO: 2125729 - RNA, 23 nt, Staphylococcus aureus subsp. aureus N315
uaucaaaaaauacguuuaaugua

SEQ ID NO: 2125730 - RNA, 15 nt, Staphylococcus aureus subsp. aureus N315
uauauuuuuaucauc

SEQ ID NO: 2125731 - RNA, 16 nt, Staphylococcus aureus subsp. aureus N315
uaucaagauguuugca

SEQ ID NO: 2125732 - RNA, 22 nt, Staphylococcus aureus subsp. aureus N315
uaucaagauguuugcaacauau

SEQ ID NO: 2125733 - RNA, 13 nt, Staphylococcus aureus subsp. aureus N315
uaucauacuucaa

SEQ ID NO: 2125734 - RNA, 18 nt, Staphylococcus aureus subsp. aureus N315
uauuaaauugcguacuug

SEQ ID NO: 2125735 - RNA, 19 nt, Staphylococcus aureus subsp. aureus N315
uauuaaacgcaauuaaccu

SEQ ID NO: 2125736 - RNA, 13 nt, Staphylococcus aureus subsp. aureus N315
uauguuguuucua

SEQ ID NO: 2125737 - RNA, 18 nt, Staphylococcus aureus subsp. aureus N315
uauguucgauuauucuua

SEQ ID NO: 2125738 - RNA, 15 nt, Staphylococcus aureus subsp. aureus N315
uauguugcuuaucaa

SEQ ID NO: 2125739 - RNA, 23 nt, Staphylococcus aureus subsp. aureus N315
uaugauaaauauuguguuuagga

SEQ ID NO: 2125740 - RNA, 18 nt, Staphylococcus aureus subsp. aureus N315
uaugacuuauuuuucauc

SEQ ID NO: 2125741 - RNA, 19 nt, Staphylococcus aureus subsp. aureus N315
uauucacgcguucaaaugu

SEQ ID NO: 2125742 - RNA, 20 nt, Staphylococcus aureus subsp. aureus N315
uauuccgcaacuuguauugu

SEQ ID NO: 2125743 - RNA, 17 nt, Staphylococcus aureus subsp. aureus N315
uauuauuggauuugaag

SEQ ID NO: 2125744 - RNA, 16 nt, Staphylococcus aureus subsp. aureus N315
uauuauuacuuaucug

SEQ ID NO: 2125745 - RNA, 13 nt, Staphylococcus aureus subsp. aureus N315
uauuauugucauc

SEQ ID NO: 2125746 - RNA, 19 nt, Staphylococcus aureus subsp. aureus N315
uauuauuuaaauuuucauc

SEQ ID NO: 2125747 - RNA, 18 nt, Staphylococcus aureus subsp. aureus N315
uauuauuuuaauagcauu

SEQ ID NO: 2125748 - RNA, 17 nt, Staphylococcus aureus subsp. aureus N315
uauucgauaauauaacu

SEQ ID NO: 2125749 - RNA, 13 nt, Staphylococcus aureus subsp. aureus N315
uauuguaaucacu

SEQ ID NO: 2125750 - RNA, 19 nt, Staphylococcus aureus subsp. aureus N315
uagaucaauauucuaugcu

SEQ ID NO: 2125751 - RNA, 12 nt, Staphylococcus aureus subsp. aureus N315
uagcuaaugcau

SEQ ID NO: 2125752 - RNA, 16 nt, Staphylococcus aureus subsp. aureus N315
uagcuauauuuuugua

SEQ ID NO: 2125753 - RNA, 20 nt, Staphylococcus aureus subsp. aureus N315
uagcuggcuuuuuaauuguu

SEQ ID NO: 2125754 - RNA, 22 nt, Staphylococcus aureus subsp. aureus N315
uagcuuaauaauuaauaagcau

SEQ ID NO: 2125755 - RNA, 16 nt, Staphylococcus aureus subsp. aureus N315
uaggaccuacaauuuu

SEQ ID NO: 2125756 - RNA, 21 nt, Staphylococcus aureus subsp. aureus N315
uacuguuuaaauaaaauuguu

SEQ ID NO: 2125757 - RNA, 15 nt, Staphylococcus aureus subsp. aureus N315
uacuguauaagugcu

SEQ ID NO: 2125758 - RNA, 23 nt, Staphylococcus aureus subsp. aureus N315
uagaaagaauacaguuacuucag

SEQ ID NO: 2125759 - RNA, 17 nt, Staphylococcus aureus subsp. aureus N315
uacgucauaaaauacca

SEQ ID NO: 2125760 - RNA, 22 nt, Staphylococcus aureus subsp. aureus N315
uacuaacguaaaggugauauuu

SEQ ID NO: 2125761 - RNA, 13 nt, Staphylococcus aureus subsp. aureus N315
uacuaaaccgauu

SEQ ID NO: 2125762 - RNA, 15 nt, Staphylococcus aureus subsp. aureus N315
uacgguuauggugug

SEQ ID NO: 2125763 - RNA, 20 nt, Staphylococcus aureus subsp. aureus N315
uaccuuaucaguguaaguuu

SEQ ID NO: 2125764 - RNA, 14 nt, Staphylococcus aureus subsp. aureus N315
uaccuuuaauuguu

SEQ ID NO: 2125765 - RNA, 16 nt, Staphylococcus aureus subsp. aureus N315
uaccuauuaauaucau

SEQ ID NO: 2125766 - RNA, 19 nt, Staphylococcus aureus subsp. aureus N315
uaccaacaagguucuaaau

SEQ ID NO: 2125767 - RNA, 22 nt, Staphylococcus aureus subsp. aureus N315
uacauucuauguagcaggcaac

SEQ ID NO: 2125768 - RNA, 14 nt, Staphylococcus aureus subsp. aureus N315
uacauuaucaagaa

SEQ ID NO: 2125769 - RNA, 14 nt, Staphylococcus aureus subsp. aureus N315
uacauguacauuau

SEQ ID NO: 2125770 - RNA, 17 nt, Staphylococcus aureus subsp. aureus N315
uacauuacauauaucaa

SEQ ID NO: 2125771 - RNA, 21 nt, Staphylococcus aureus subsp. aureus N315
uccuucaaagauuuuaccuug

SEQ ID NO: 2125772 - RNA, 14 nt, Staphylococcus aureus subsp. aureus N315
uccuuugauguuca

SEQ ID NO: 2125773 - RNA, 18 nt, Staphylococcus aureus subsp. aureus N315
uccuuggugucgaaauug

SEQ ID NO: 2125774 - RNA, 14 nt, Staphylococcus aureus subsp. aureus N315
uccucuauuguauc

SEQ ID NO: 2125775 - RNA, 22 nt, Staphylococcus aureus subsp. aureus N315
uccucuaacgguauaucaucca

SEQ ID NO: 2125776 - RNA, 13 nt, Staphylococcus aureus subsp. aureus N315
ucgacaucuagau

SEQ ID NO: 2125777 - RNA, 16 nt, Staphylococcus aureus subsp. aureus N315
ucgaacuuuuguucua

SEQ ID NO: 2125778 - RNA, 12 nt, Staphylococcus aureus subsp. aureus N315
uccggaacaaua

SEQ ID NO: 2125779 - RNA, 21 nt, Staphylococcus aureus subsp. aureus N315
ucagucucuaaaacuuuuuca

SEQ ID NO: 2125780 - RNA, 23 nt, Staphylococcus aureus subsp. aureus N315
ucagucucuaaaacuuuuucaau

SEQ ID NO: 2125781 - RNA, 22 nt, Staphylococcus aureus subsp. aureus N315
ucaucaauaaauauugauucua

SEQ ID NO: 2125782 - RNA, 13 nt, Staphylococcus aureus subsp. aureus N315
ucaucaaugguga

SEQ ID NO: 2125783 - RNA, 13 nt, Staphylococcus aureus subsp. aureus N315
ucaucauguucua

SEQ ID NO: 2125784 - RNA, 23 nt, Staphylococcus aureus subsp. aureus N315
ucaugacacguccaccaacuuua

SEQ ID NO: 2125785 - RNA, 16 nt, Staphylococcus aureus subsp. aureus N315
ucaugcauaaucauca

SEQ ID NO: 2125786 - RNA, 16 nt, Staphylococcus aureus subsp. aureus N315
ucaugugucauaaucc

SEQ ID NO: 2125787 - RNA, 18 nt, Staphylococcus aureus subsp. aureus N315
ucauucuagcaucgaugu

SEQ ID NO: 2125788 - RNA, 17 nt, Staphylococcus aureus subsp. aureus N315
ucauucguacuuccaau

SEQ ID NO: 2125789 - RNA, 16 nt, Staphylococcus aureus subsp. aureus N315
uccacgcucacauuaa

SEQ ID NO: 2125790 - RNA, 21 nt, Staphylococcus aureus subsp. aureus N315
uauuuuaaauuacaacuuuua

SEQ ID NO: 2125791 - RNA, 13 nt, Staphylococcus aureus subsp. aureus N315
uauuugucuuuga

SEQ ID NO: 2125792 - RNA, 16 nt, Staphylococcus aureus subsp. aureus N315
uauuugaaaaaguguu

SEQ ID NO: 2125793 - RNA, 19 nt, Staphylococcus aureus subsp. aureus N315
uauuuaaaggguguuuaga

SEQ ID NO: 2125794 - RNA, 20 nt, Staphylococcus aureus subsp. aureus N315
uauuuaaaaugcuuguucaa

SEQ ID NO: 2125795 - RNA, 16 nt, Staphylococcus aureus subsp. aureus N315
uauuucuucauuugua

SEQ ID NO: 2125796 - RNA, 18 nt, Staphylococcus aureus subsp. aureus N315
ucacgauuaauaaaauuc

SEQ ID NO: 2125797 - RNA, 23 nt, Staphylococcus aureus subsp. aureus N315
ucagcuuuuucacauugccuaag

SEQ ID NO: 2125798 - RNA, 20 nt, Staphylococcus aureus subsp. aureus N315
ugcuagcuuucuuuuucauc

SEQ ID NO: 2125799 - RNA, 18 nt, Staphylococcus aureus subsp. aureus N315
ugcgugcuuaauuacaau

SEQ ID NO: 2125800 - RNA, 18 nt, Staphylococcus aureus subsp. aureus N315
ugcugcuguacaauuucg

SEQ ID NO: 2125801 - RNA, 13 nt, Staphylococcus aureus subsp. aureus N315
ugcuuuaacugua

SEQ ID NO: 2125802 - RNA, 20 nt, Staphylococcus aureus subsp. aureus N315
ugcuuggauaauugcauuac

SEQ ID NO: 2125803 - RNA, 14 nt, Staphylococcus aureus subsp. aureus N315
ugcuugguuugauu

SEQ ID NO: 2125804 - RNA, 18 nt, Staphylococcus aureus subsp. aureus N315
ugcuucguuuuuaguguu

SEQ ID NO: 2125805 - RNA, 17 nt, Staphylococcus aureus subsp. aureus N315
ugcuuaauuuauguguu

SEQ ID NO: 2125806 - RNA, 16 nt, Staphylococcus aureus subsp. aureus N315
ugcuguuuuauucaau

SEQ ID NO: 2125807 - RNA, 14 nt, Staphylococcus aureus subsp. aureus N315
ugccaucaauuucu

SEQ ID NO: 2125808 - RNA, 21 nt, Staphylococcus aureus subsp. aureus N315
ugauauugaaaguguaugcau

SEQ ID NO: 2125809 - RNA, 23 nt, Staphylococcus aureus subsp. aureus N315
ugauaucgaaacgcuuugcagau

SEQ ID NO: 2125810 - RNA, 23 nt, Staphylococcus aureus subsp. aureus N315
ugauauuucgguuagucuuaauc

SEQ ID NO: 2125811 - RNA, 16 nt, Staphylococcus aureus subsp. aureus N315
ugauagcuaaugcauu

SEQ ID NO: 2125812 - RNA, 16 nt, Staphylococcus aureus subsp. aureus N315
ugauacguacguugau

SEQ ID NO: 2125813 - RNA, 18 nt, Staphylococcus aureus subsp. aureus N315
ugauacugcuucgcuaau

SEQ ID NO: 2125814 - RNA, 23 nt, Staphylococcus aureus subsp. aureus N315
ugauacguacguugauguguugc

SEQ ID NO: 2125815 - RNA, 23 nt, Staphylococcus aureus subsp. aureus N315
ugaguauuaaauuugaaaguaaa

SEQ ID NO: 2125816 - RNA, 15 nt, Staphylococcus aureus subsp. aureus N315
ugaguaugacgaaau

SEQ ID NO: 2125817 - RNA, 17 nt, Staphylococcus aureus subsp. aureus N315
ugaggaauaugaauugc

SEQ ID NO: 2125818 - RNA, 16 nt, Staphylococcus aureus subsp. aureus N315
ugauuguaccaguaac

SEQ ID NO: 2125819 - RNA, 20 nt, Staphylococcus aureus subsp. aureus N315
ugcaacaccugguacauaaa

SEQ ID NO: 2125820 - RNA, 16 nt, Staphylococcus aureus subsp. aureus N315
ugcaacuacgauaccg

SEQ ID NO: 2125821 - RNA, 15 nt, Staphylococcus aureus subsp. aureus N315
ugauggauauucaau

SEQ ID NO: 2125822 - RNA, 23 nt, Staphylococcus aureus subsp. aureus N315
ugauuaaaaguguugacuuuauc

SEQ ID NO: 2125823 - RNA, 16 nt, Staphylococcus aureus subsp. aureus N315
ugauguguugcauuac

SEQ ID NO: 2125824 - RNA, 13 nt, Staphylococcus aureus subsp. aureus N315
ugauguuacaauc

SEQ ID NO: 2125825 - RNA, 16 nt, Staphylococcus aureus subsp. aureus N315
ugaugucauguauugu

SEQ ID NO: 2125826 - RNA, 14 nt, Staphylococcus aureus subsp. aureus N315
ugaugaaugauugc

SEQ ID NO: 2125827 - RNA, 19 nt, Staphylococcus aureus subsp. aureus N315
ucuuguuucaaacaaagcu

SEQ ID NO: 2125828 - RNA, 16 nt, Staphylococcus aureus subsp. aureus N315
ucuuguucuaauuguu

SEQ ID NO: 2125829 - RNA, 22 nt, Staphylococcus aureus subsp. aureus N315
ucuuuucgaaauucucuuuguu

SEQ ID NO: 2125830 - RNA, 19 nt, Staphylococcus aureus subsp. aureus N315
ucuuuugauagcuaaugca

SEQ ID NO: 2125831 - RNA, 13 nt, Staphylococcus aureus subsp. aureus N315
ucuuuuguuuuca

SEQ ID NO: 2125832 - RNA, 21 nt, Staphylococcus aureus subsp. aureus N315
ucuuuuguuuucacuguuuua

SEQ ID NO: 2125833 - RNA, 21 nt, Staphylococcus aureus subsp. aureus N315
ucuucgcgaccguguuguuga

SEQ ID NO: 2125834 - RNA, 21 nt, Staphylococcus aureus subsp. aureus N315
ucuuggacuaauaauugucca

SEQ ID NO: 2125835 - RNA, 13 nt, Staphylococcus aureus subsp. aureus N315
ucuucuuguuuua

SEQ ID NO: 2125836 - RNA, 14 nt, Staphylococcus aureus subsp. aureus N315
ucuucagaaccuug

SEQ ID NO: 2125837 - RNA, 15 nt, Staphylococcus aureus subsp. aureus N315
ucuuauuugauucua

SEQ ID NO: 2125838 - RNA, 20 nt, Staphylococcus aureus subsp. aureus N315
ucugguucuuuacuaaagau

SEQ ID NO: 2125839 - RNA, 17 nt, Staphylococcus aureus subsp. aureus N315
ucugguaaaaaaauaac

SEQ ID NO: 2125840 - RNA, 16 nt, Staphylococcus aureus subsp. aureus N315
ucuuaucaauuagcca

SEQ ID NO: 2125841 - RNA, 12 nt, Staphylococcus aureus subsp. aureus N315
ucugaaucugaa

SEQ ID NO: 2125842 - RNA, 23 nt, Staphylococcus aureus subsp. aureus N315
ucuauuaaugcucuauauaucca

SEQ ID NO: 2125843 - RNA, 20 nt, Staphylococcus aureus subsp. aureus N315
ucguuagaugaaugccuaau

SEQ ID NO: 2125844 - RNA, 19 nt, Staphylococcus aureus subsp. aureus N315
gcuuuuaugcaugcgcaaa

SEQ ID NO: 2125845 - RNA, 15 nt, Staphylococcus aureus subsp. aureus N315
gcuugauuaacauuu

SEQ ID NO: 2125846 - RNA, 19 nt, Staphylococcus aureus subsp. aureus N315
gcuugaccuucaguuucua

SEQ ID NO: 2125847 - RNA, 20 nt, Staphylococcus aureus subsp. aureus N315
gcuuuuuucaauucuaguca

SEQ ID NO: 2125848 - RNA, 12 nt, Staphylococcus aureus subsp. aureus N315
gcuccagucauu

SEQ ID NO: 2125849 - RNA, 18 nt, Staphylococcus aureus subsp. aureus N315
gcucaaucgcaucuguua

SEQ ID NO: 2125850 - RNA, 21 nt, Staphylococcus aureus subsp. aureus N315
gcuauuauuuccuguuacuuu

SEQ ID NO: 2125851 - RNA, 17 nt, Staphylococcus aureus subsp. aureus N315
gcuauacucauuuucug

SEQ ID NO: 2125852 - RNA, 22 nt, Staphylococcus aureus subsp. aureus N315
gcuagcauaucuuuaucauuau

SEQ ID NO: 2125853 - RNA, 17 nt, Staphylococcus aureus subsp. aureus N315
gcggaagauaggauuua

SEQ ID NO: 2125854 - RNA, 18 nt, Staphylococcus aureus subsp. aureus N315
gcggaagauaggauuugc

SEQ ID NO: 2125855 - RNA, 22 nt, Staphylococcus aureus subsp. aureus N315
gccuacuauaaauacgucaucu

SEQ ID NO: 2125856 - RNA, 17 nt, Staphylococcus aureus subsp. aureus N315
gggagugggacagaaau

SEQ ID NO: 2125857 - RNA, 24 nt, Staphylococcus aureus subsp. aureus N315
gggaugggccccaacacagagaau

SEQ ID NO: 2125858 - RNA, 18 nt, Staphylococcus aureus subsp. aureus N315
ggggugggacgacgaaau

SEQ ID NO: 2125859 - RNA, 22 nt, Staphylococcus aureus subsp. aureus N315
guaacaagcauuuuucaauuau

SEQ ID NO: 2125860 - RNA, 17 nt, Staphylococcus aureus subsp. aureus N315
guaaacauaaugacauc

SEQ ID NO: 2125861 - RNA, 20 nt, Staphylococcus aureus subsp. aureus N315
guaaaaaaagacaugagauu

SEQ ID NO: 2125862 - RNA, 19 nt, Staphylococcus aureus subsp. aureus N315
guaauauuuuuguugcaau

SEQ ID NO: 2125863 - RNA, 21 nt, Staphylococcus aureus subsp. aureus N315
guaauacaagcaauacgauug

SEQ ID NO: 2125864 - RNA, 15 nt, Staphylococcus aureus subsp. aureus N315
guaauagaacgaaau

SEQ ID NO: 2125865 - RNA, 17 nt, Staphylococcus aureus subsp. aureus N315
guaauagcaaccauauu

SEQ ID NO: 2125866 - RNA, 16 nt, Staphylococcus aureus subsp. aureus N315
guaauagcaaccauau

SEQ ID NO: 2125867 - RNA, 14 nt, Staphylococcus aureus subsp. aureus N315
gucaccuucuauau

SEQ ID NO: 2125868 - RNA, 17 nt, Staphylococcus aureus subsp. aureus N315
gucauaaugaacgauau

SEQ ID NO: 2125869 - RNA, 13 nt, Staphylococcus aureus subsp. aureus N315
guccaccaacuuu

SEQ ID NO: 2125870 - RNA, 19 nt, Staphylococcus aureus subsp. aureus N315
gugaaaguuuuugucuuaa

SEQ ID NO: 2125871 - RNA, 13 nt, Staphylococcus aureus subsp. aureus N315
gucucuaguaucu

SEQ ID NO: 2125872 - RNA, 13 nt, Staphylococcus aureus subsp. aureus N315
cgcuuuuucauag

SEQ ID NO: 2125873 - RNA, 23 nt, Staphylococcus aureus subsp. aureus N315
cgccucaaacggagcaacgauac

SEQ ID NO: 2125874 - RNA, 21 nt, Staphylococcus aureus subsp. aureus N315
ccuaaaucuuuaaauguauca

SEQ ID NO: 2125875 - RNA, 22 nt, Staphylococcus aureus subsp. aureus N315
ccgauuguuaauuuaaagucuu

SEQ ID NO: 2125876 - RNA, 17 nt, Staphylococcus aureus subsp. aureus N315
ccuuaauaucaugcaca

SEQ ID NO: 2125877 - RNA, 18 nt, Staphylococcus aureus subsp. aureus N315
ccuuugcuuaaaccuuaa

SEQ ID NO: 2125878 - RNA, 21 nt, Staphylococcus aureus subsp. aureus N315
ccuuuuugucucucaacauuu

SEQ ID NO: 2125879 - RNA, 16 nt, Staphylococcus aureus subsp. aureus N315
cgauuuaauuaaaaca

SEQ ID NO: 2125880 - RNA, 22 nt, Staphylococcus aureus subsp. aureus N315
cuuuuuaaaggaccacuuagau

SEQ ID NO: 2125881 - RNA, 20 nt, Staphylococcus aureus subsp. aureus N315
cuuuugauguuuaugacaaa

SEQ ID NO: 2125882 - RNA, 15 nt, Staphylococcus aureus subsp. aureus N315
cuuuuacaaucauca

SEQ ID NO: 2125883 - RNA, 17 nt, Staphylococcus aureus subsp. aureus N315
cuuuuauggagugauau

SEQ ID NO: 2125884 - RNA, 16 nt, Staphylococcus aureus subsp. aureus N315
cuuuuaauaguguuau

SEQ ID NO: 2125885 - RNA, 17 nt, Staphylococcus aureus subsp. aureus N315
cuuuuuaggaaugauag

SEQ ID NO: 2125886 - RNA, 20 nt, Staphylococcus aureus subsp. aureus N315
cuuuuuguguaucuguaaca

SEQ ID NO: 2125887 - RNA, 16 nt, Staphylococcus aureus subsp. aureus N315
gaaaagaacacgauau

SEQ ID NO: 2125888 - RNA, 14 nt, Staphylococcus aureus subsp. aureus N315
gaaauagaaauguc

SEQ ID NO: 2125889 - RNA, 20 nt, Staphylococcus aureus subsp. aureus N315
cuuguaaacucaugacacgu

SEQ ID NO: 2125890 - RNA, 18 nt, Staphylococcus aureus subsp. aureus N315
cuuuaauuuucuugccau

SEQ ID NO: 2125891 - RNA, 19 nt, Staphylococcus aureus subsp. aureus N315
cuuuaauugcucuuuaaca

SEQ ID NO: 2125892 - RNA, 19 nt, Staphylococcus aureus subsp. aureus N315
cuuuaauugucucaucauu

SEQ ID NO: 2125893 - RNA, 14 nt, Staphylococcus aureus subsp. aureus N315
cuuguuuuaaacuu

SEQ ID NO: 2125894 - RNA, 16 nt, Staphylococcus aureus subsp. aureus N315
gaaauuucgacaucua

SEQ ID NO: 2125895 - RNA, 16 nt, Staphylococcus aureus subsp. aureus N315
gaaauugacaguuucc

SEQ ID NO: 2125896 - RNA, 19 nt, Staphylococcus aureus subsp. aureus N315
gaaauuguucuaauacacc

SEQ ID NO: 2125897 - RNA, 12 nt, Staphylococcus aureus subsp. aureus N315
gaacaucugaaa

SEQ ID NO: 2125898 - RNA, 14 nt, Staphylococcus aureus subsp. aureus N315
gaacaguacgauua

SEQ ID NO: 2125899 - RNA, 16 nt, Staphylococcus aureus subsp. aureus N315
gaacuaagaugugcau

SEQ ID NO: 2125900 - RNA, 16 nt, Staphylococcus aureus subsp. aureus N315
cugguacuacuaucca

SEQ ID NO: 2125901 - RNA, 17 nt, Staphylococcus aureus subsp. aureus N315
cuucauauuuagguaau

SEQ ID NO: 2125902 - RNA, 20 nt, Staphylococcus aureus subsp. aureus N315
cuucauaagucacaguaucu

SEQ ID NO: 2125903 - RNA, 21 nt, Staphylococcus aureus subsp. aureus N315
cuuauacguuacggcuuugua

SEQ ID NO: 2125904 - RNA, 18 nt, Staphylococcus aureus subsp. aureus N315
cuucgauggcugcaacaa

SEQ ID NO: 2125905 - RNA, 19 nt, Staphylococcus aureus subsp. aureus N315
cuucgauggcugcaacaau

SEQ ID NO: 2125906 - RNA, 15 nt, Staphylococcus aureus subsp. aureus N315
cuucgcacaacugca

SEQ ID NO: 2125907 - RNA, 13 nt, Staphylococcus aureus subsp. aureus N315
cuuauaaguucaa

SEQ ID NO: 2125908 - RNA, 23 nt, Staphylococcus aureus subsp. aureus N315
gacuuuuaaaaaacauaccugca

SEQ ID NO: 2125909 - RNA, 19 nt, Staphylococcus aureus subsp. aureus N315
gacuuauuccgcaacuugu

SEQ ID NO: 2125910 - RNA, 19 nt, Staphylococcus aureus subsp. aureus N315
gacugaacgaaaaugcgcu

SEQ ID NO: 2125911 - RNA, 20 nt, Staphylococcus aureus subsp. aureus N315
gacugaacgaaaaugcgcuu

SEQ ID NO: 2125912 - RNA, 20 nt, Staphylococcus aureus subsp. aureus N315
gacugaacgaaaauucgcuu

SEQ ID NO: 2125913 - RNA, 20 nt, Staphylococcus aureus subsp. aureus N315
gacugaaugagaaugugcuu

SEQ ID NO: 2125914 - RNA, 13 nt, Staphylococcus aureus subsp. aureus N315
gagaucuaacaau

SEQ ID NO: 2125915 - RNA, 20 nt, Staphylococcus aureus subsp. aureus N315
gacacaucacuauacgcaau

SEQ ID NO: 2125916 - RNA, 18 nt, Staphylococcus aureus subsp. aureus N315
gaaugacguuaucaucuc

SEQ ID NO: 2125917 - RNA, 16 nt, Staphylococcus aureus subsp. aureus N315
gaauuugcacaaagau

SEQ ID NO: 2125918 - RNA, 19 nt, Staphylococcus aureus subsp. aureus N315
gaauccaauuucucuaugu

SEQ ID NO: 2125919 - RNA, 19 nt, Staphylococcus aureus subsp. aureus N315
gaauagaugucacuguuaa

SEQ ID NO: 2125920 - RNA, 13 nt, Staphylococcus aureus subsp. aureus N315
gaauaaucaucca

SEQ ID NO: 2125921 - RNA, 12 nt, Staphylococcus aureus subsp. aureus N315
cucacaacugca

SEQ ID NO: 2125922 - RNA, 16 nt, Staphylococcus aureus subsp. aureus N315
cucauugugcuugaua

SEQ ID NO: 2125923 - RNA, 23 nt, Staphylococcus aureus subsp. aureus N315
cuacuuugucugcaauuucauag

SEQ ID NO: 2125924 - RNA, 17 nt, Staphylococcus aureus subsp. aureus N315
cuacaggcaaugcaagu

SEQ ID NO: 2125925 - RNA, 18 nt, Staphylococcus aureus subsp. aureus N315
cucaaguaaucaagcaau

SEQ ID NO: 2125926 - RNA, 18 nt, Staphylococcus aureus subsp. aureus N315
cuauauauauaugcaucc

SEQ ID NO: 2125927 - RNA, 17 nt, Staphylococcus aureus subsp. aureus N315
cuauauaaaguugacaa

SEQ ID NO: 2125928 - RNA, 15 nt, Staphylococcus aureus subsp. aureus N315
cuauacaaucauuua

SEQ ID NO: 2125929 - RNA, 17 nt, Staphylococcus aureus subsp. aureus N315
cugaucgcauguuugua

SEQ ID NO: 2125930 - RNA, 15 nt, Staphylococcus aureus subsp. aureus N315
cucuagugcuuuguc

SEQ ID NO: 2125931 - RNA, 20 nt, Staphylococcus aureus subsp. aureus N315
cucugaaaaacuucuuaacu

SEQ ID NO: 2125932 - RNA, 23 nt, Staphylococcus aureus subsp. aureus N315
cucugauuacauauacgacauuu

SEQ ID NO: 2125933 - RNA, 13 nt, Staphylococcus aureus subsp. aureus N315
cucuuguguuuca

SEQ ID NO: 2125934 - RNA, 18 nt, Staphylococcus aureus subsp. aureus N315
cugaaugugguacaagau

SEQ ID NO: 2125935 - RNA, 21 nt, Staphylococcus aureus subsp. aureus N315
cugaacgaaaauucgcuugua

SEQ ID NO: 2125936 - RNA, 21 nt, Staphylococcus aureus subsp. aureus N315
cugaaucaguuacugcgcuuu

SEQ ID NO: 2125937 - RNA, 20 nt, Staphylococcus aureus subsp. aureus N315
cgucuauacuccaguuuaua

SEQ ID NO: 2125938 - RNA, 13 nt, Staphylococcus aureus subsp. aureus N315
cgucuguuucaua

SEQ ID NO: 2125939 - RNA, 22 nt, Staphylococcus aureus subsp. aureus N315
cguucauauaugauaaauauug

SEQ ID NO: 2125940 - RNA, 21 nt, Staphylococcus aureus subsp. aureus N315
cguuauaaguacaaauaauac

SEQ ID NO: 2125941 - RNA, 17 nt, Staphylococcus aureus subsp. aureus N315
cguuaaaucacauauga

SEQ ID NO: 2125942 - RNA, 15 nt, Staphylococcus aureus subsp. aureus N315
gcauuaaauuccaug

SEQ ID NO: 2125943 - RNA, 14 nt, Staphylococcus aureus subsp. aureus N315
gcauugaccaccuu

SEQ ID NO: 2125944 - RNA, 22 nt, Staphylococcus aureus subsp. aureus N315
gccaacaaagcuuccaaauguu

SEQ ID NO: 2125945 - RNA, 14 nt, Staphylococcus aureus subsp. aureus N315
gcaucccgaaaguu

SEQ ID NO: 2125946 - RNA, 11 nt, Staphylococcus aureus subsp. aureus N315
gcaaucaucug

SEQ ID NO: 2125947 - RNA, 21 nt, Staphylococcus aureus subsp. aureus N315
gauuuaucaccuuuaggcaaa

SEQ ID NO: 2125948 - RNA, 22 nt, Staphylococcus aureus subsp. aureus N315
gcaaaucccuucucaacgauaa

SEQ ID NO: 2125949 - RNA, 18 nt, Staphylococcus aureus subsp. aureus N315
gauuauagguauaagaau

SEQ ID NO: 2125950 - RNA, 15 nt, Staphylococcus aureus subsp. aureus N315
gauuagaugauauuu

SEQ ID NO: 2125951 - RNA, 14 nt, Staphylococcus aureus subsp. aureus N315
gauuacgcucauau

SEQ ID NO: 2125952 - RNA, 16 nt, Staphylococcus aureus subsp. aureus N315
gaugguggggucauaa

SEQ ID NO: 2125953 - RNA, 20 nt, Staphylococcus aureus subsp. aureus N315
gaugcuaauguaaucugaac

SEQ ID NO: 2125954 - RNA, 19 nt, Staphylococcus aureus subsp. aureus N315
gauaaaugaauugucuuaa

SEQ ID NO: 2125955 - RNA, 18 nt, Staphylococcus aureus subsp. aureus N315
gauauucgcgaacguuau

SEQ ID NO: 2125956 - RNA, 12 nt, Staphylococcus aureus subsp. aureus N315
gaucgauacuuu

SEQ ID NO: 2125957 - RNA, 21 nt, Staphylococcus aureus subsp. aureus N315
cagaacugccaauauaacauu

SEQ ID NO: 2125958 - RNA, 18 nt, Staphylococcus aureus subsp. aureus N315
cacuuuuuuguucaauca

SEQ ID NO: 2125959 - RNA, 23 nt, Staphylococcus aureus subsp. aureus N315
cagcaaauaaaaucauaacgaca

SEQ ID NO: 2125960 - RNA, 16 nt, Staphylococcus aureus subsp. aureus N315
cacuaaauucaauaau

SEQ ID NO: 2125961 - RNA, 14 nt, Staphylococcus aureus subsp. aureus N315
caucaaguugauaa

SEQ ID NO: 2125962 - RNA, 14 nt, Staphylococcus aureus subsp. aureus N315
caucaauauugaua

SEQ ID NO: 2125963 - RNA, 22 nt, Staphylococcus aureus subsp. aureus N315
caucggcaccaguagcuaaugc

SEQ ID NO: 2125964 - RNA, 19 nt, Staphylococcus aureus subsp. aureus N315
caguaaucaaaguaucagu

SEQ ID NO: 2125965 - RNA, 23 nt, Staphylococcus aureus subsp. aureus N315
caguauaaguuucuggcauaucg

SEQ ID NO: 2125966 - RNA, 15 nt, Staphylococcus aureus subsp. aureus N315
caguaauauguugcu

SEQ ID NO: 2125967 - RNA, 22 nt, Staphylococcus aureus subsp. aureus N315
cauaauaaaucuaucuacucaa

SEQ ID NO: 2125968 - RNA, 17 nt, Staphylococcus aureus subsp. aureus N315
cauaccuaauaacgcau

SEQ ID NO: 2125969 - RNA, 14 nt, Staphylococcus aureus subsp. aureus N315
cauaccugcauauu

SEQ ID NO: 2125970 - RNA, 16 nt, Staphylococcus aureus subsp. aureus N315
cauacagccauugaca

SEQ ID NO: 2125971 - RNA, 14 nt, Staphylococcus aureus subsp. aureus N315
cauacgcaaugauu

SEQ ID NO: 2125972 - RNA, 14 nt, Staphylococcus aureus subsp. aureus N315
cauacacuaucauu

SEQ ID NO: 2125973 - RNA, 19 nt, Staphylococcus aureus subsp. aureus N315
cauaaugaacgauauucua

SEQ ID NO: 2125974 - RNA, 20 nt, Staphylococcus aureus subsp. aureus N315
cauaaucucuuuacaccauu

SEQ ID NO: 2125975 - RNA, 20 nt, Staphylococcus aureus subsp. aureus N315
cagcuucuuuaacaauugau

SEQ ID NO: 2125976 - RNA, 19 nt, Staphylococcus aureus subsp. aureus N315
ccaaucuauuuuaaacuca

SEQ ID NO: 2125977 - RNA, 17 nt, Staphylococcus aureus subsp. aureus N315
ccacaaucacaguauga

SEQ ID NO: 2125978 - RNA, 17 nt, Staphylococcus aureus subsp. aureus N315
cauugcacuaugcauaa

SEQ ID NO: 2125979 - RNA, 15 nt, Staphylococcus aureus subsp. aureus N315
cauugauaagucuug

SEQ ID NO: 2125980 - RNA, 22 nt, Staphylococcus aureus subsp. aureus N315
cauugauaaauuuuuaguuaaa

SEQ ID NO: 2125981 - RNA, 18 nt, Staphylococcus aureus subsp. aureus N315
cauuuaguuaaauacaaa

SEQ ID NO: 2125982 - RNA, 12 nt, Staphylococcus aureus subsp. aureus N315
cauuuaguuaaa

SEQ ID NO: 2125983 - RNA, 17 nt, Staphylococcus aureus subsp. aureus N315
cauuuauaugauguuca

SEQ ID NO: 2125984 - RNA, 19 nt, Staphylococcus aureus subsp. aureus N315
cauuuaucaacaauggaaa

SEQ ID NO: 2125985 - RNA, 12 nt, Staphylococcus aureus subsp. aureus N315
cauuuuguuuca

SEQ ID NO: 2125986 - RNA, 16 nt, Staphylococcus aureus subsp. aureus N315
cauuugaacaucauuu

SEQ ID NO: 2125987 - RNA, 20 nt, Staphylococcus aureus subsp. aureus N315
cauuucugucccacucccua

SEQ ID NO: 2125988 - RNA, 23 nt, Staphylococcus aureus subsp. aureus N315
ccaaaagaaauuuaauacaauuc

SEQ ID NO: 2125989 - RNA, 23 nt, Staphylococcus aureus subsp. aureus N315
cauuacauuuggcguaaugauau

SEQ ID NO: 2125990 - RNA, 17 nt, Staphylococcus aureus subsp. aureus N315
cauuaauuucaugugca

SEQ ID NO: 2125991 - RNA, 17 nt, Staphylococcus aureus subsp. aureus N315
cauuacaaaucaugaca

SEQ ID NO: 2125992 - RNA, 20 nt, Staphylococcus aureus subsp. aureus N315
cauuacgccaccaguuucaa

SEQ ID NO: 2125993 - RNA, 15 nt, Staphylococcus aureus subsp. aureus N315
cauuaaaucugauuc

SEQ ID NO: 2125994 - RNA, 12 nt, Staphylococcus aureus subsp. aureus N315
cauuaaguuaaa

SEQ ID NO: 2125995 - RNA, 20 nt, Staphylococcus aureus subsp. aureus N315
cauuauuacugauuguuaac

SEQ ID NO: 2125996 - RNA, 16 nt, Staphylococcus aureus subsp. aureus N315
cauuaguuaugugcua

SEQ ID NO: 2125997 - RNA, 20 nt, Staphylococcus aureus subsp. aureus N315
ccagcuugaccgccuaugau

SEQ ID NO: 2125998 - RNA, 22 nt, Staphylococcus aureus subsp. aureus N315
ccauuaucgcuguaaagucguu

SEQ ID NO: 2125999 - RNA, 14 nt, Staphylococcus aureus subsp. aureus N315
ccaucauaaauguu

SEQ ID NO: 2126000 - RNA, 23 nt, Staphylococcus aureus subsp. aureus N315
aucacuauguagaaugaaacuuu

SEQ ID NO: 2126001 - RNA, 13 nt, Staphylococcus aureus subsp. aureus N315
auauuuaaccuuu

SEQ ID NO: 2126002 - RNA, 19 nt, Staphylococcus aureus subsp. aureus N315
auauuaugccauucauuaa

SEQ ID NO: 2126003 - RNA, 12 nt, Staphylococcus aureus subsp. aureus N315
auauuuaaacuc

SEQ ID NO: 2126004 - RNA, 14 nt, Staphylococcus aureus subsp. aureus N315
auauuuaaaugucu

SEQ ID NO: 2126005 - RNA, 23 nt, Staphylococcus aureus subsp. aureus N315
auauuagugacauuugcaugcuu

SEQ ID NO: 2126006 - RNA, 19 nt, Staphylococcus aureus subsp. aureus N315
auauuaaugaauauaggca

SEQ ID NO: 2126007 - RNA, 20 nt, Staphylococcus aureus subsp. aureus N315
auaugacuuuuuauuaguau

SEQ ID NO: 2126008 - RNA, 13 nt, Staphylococcus aureus subsp. aureus N315
auaugaauuggau

SEQ ID NO: 2126009 - RNA, 19 nt, Staphylococcus aureus subsp. aureus N315
auaugauuaaauaaucaac

SEQ ID NO: 2126010 - RNA, 13 nt, Staphylococcus aureus subsp. aureus N315
auaugauuacaac

SEQ ID NO: 2126011 - RNA, 23 nt, Staphylococcus aureus subsp. aureus N315
auaucauauuugaauacuuuauu

SEQ ID NO: 2126012 - RNA, 16 nt, Staphylococcus aureus subsp. aureus N315
auagcgcagcaaaugc

SEQ ID NO: 2126013 - RNA, 23 nt, Staphylococcus aureus subsp. aureus N315
aucaagugcagauguugguucau

SEQ ID NO: 2126014 - RNA, 21 nt, Staphylococcus aureus subsp. aureus N315
aucaacugaaauuuuuccgau

SEQ ID NO: 2126015 - RNA, 23 nt, Staphylococcus aureus subsp. aureus N315
aucaauccucuaacgguauauca

SEQ ID NO: 2126016 - RNA, 16 nt, Staphylococcus aureus subsp. aureus N315
aucaauuucuauuuca

SEQ ID NO: 2126017 - RNA, 18 nt, Staphylococcus aureus subsp. aureus N315
aucaaagauuuuguugaa

SEQ ID NO: 2126018 - RNA, 22 nt, Staphylococcus aureus subsp. aureus N315
auauuuguagccuacaaccuuu

SEQ ID NO: 2126019 - RNA, 12 nt, Staphylococcus aureus subsp. aureus N315
aucaaaaccgcu

SEQ ID NO: 2126020 - RNA, 21 nt, Staphylococcus aureus subsp. aureus N315
auauuuuuuaaaaugauagcu

SEQ ID NO: 2126021 - RNA, 18 nt, Staphylococcus aureus subsp. aureus N315
auagauuaaaaaaucauu

SEQ ID NO: 2126022 - RNA, 21 nt, Staphylococcus aureus subsp. aureus N315
auagcauuucuuuauuagaau

SEQ ID NO: 2126023 - RNA, 20 nt, Staphylococcus aureus subsp. aureus N315
auacuccaguuuauaacugg

SEQ ID NO: 2126024 - RNA, 16 nt, Staphylococcus aureus subsp. aureus N315
auaaucuuuaacauuu

SEQ ID NO: 2126025 - RNA, 23 nt, Staphylococcus aureus subsp. aureus N315
auaauuaacugcggcaugcgauu

SEQ ID NO: 2126026 - RNA, 18 nt, Staphylococcus aureus subsp. aureus N315
auaauguuuucauuggau

SEQ ID NO: 2126027 - RNA, 17 nt, Staphylococcus aureus subsp. aureus N315
auacacugcacaucaua

SEQ ID NO: 2126028 - RNA, 19 nt, Staphylococcus aureus subsp. aureus N315
auaauuuaaagaacuauuu

SEQ ID NO: 2126029 - RNA, 13 nt, Staphylococcus aureus subsp. aureus N315
auaauugcauuac

SEQ ID NO: 2126030 - RNA, 22 nt, Staphylococcus aureus subsp. aureus N315
auaauugaugugccuuucuaau

SEQ ID NO: 2126031 - RNA, 16 nt, Staphylococcus aureus subsp. aureus N315
auaauuaccuuuccau

SEQ ID NO: 2126032 - RNA, 12 nt, Staphylococcus aureus subsp. aureus N315
auaaucgccauc

SEQ ID NO: 2126033 - RNA, 22 nt, Staphylococcus aureus subsp. aureus N315
auaaucaagaauauaagugauu

SEQ ID NO: 2126034 - RNA, 14 nt, Staphylococcus aureus subsp. aureus N315
auaacaaaacgauu

SEQ ID NO: 2126035 - RNA, 15 nt, Staphylococcus aureus subsp. aureus N315
auaaauuaaauuuug

SEQ ID NO: 2126036 - RNA, 19 nt, Staphylococcus aureus subsp. aureus N315
aguuuuuaaaauuaucaau

SEQ ID NO: 2126037 - RNA, 15 nt, Staphylococcus aureus subsp. aureus N315
aguuuaaucgcauug

SEQ ID NO: 2126038 - RNA, 17 nt, Staphylococcus aureus subsp. aureus N315
aguuuaucugaguuaua

SEQ ID NO: 2126039 - RNA, 22 nt, Staphylococcus aureus subsp. aureus N315
aguuuucauuuuuucaaugucu

SEQ ID NO: 2126040 - RNA, 21 nt, Staphylococcus aureus subsp. aureus N315
aguuguuauauucuagauuca

SEQ ID NO: 2126041 - RNA, 13 nt, Staphylococcus aureus subsp. aureus N315
auaaauagauaau

SEQ ID NO: 2126042 - RNA, 21 nt, Staphylococcus aureus subsp. aureus N315
auaaauaagcaguaagaugac

SEQ ID NO: 2126043 - RNA, 17 nt, Staphylococcus aureus subsp. aureus N315
auaaacuuuaugaaauu

SEQ ID NO: 2126044 - RNA, 22 nt, Staphylococcus aureus subsp. aureus N315
aguugaagcuaauucauauuca

SEQ ID NO: 2126045 - RNA, 24 nt, Staphylococcus aureus subsp. aureus N315
aguguagcacaagauucaacuugu

SEQ ID NO: 2126046 - RNA, 14 nt, Staphylococcus aureus subsp. aureus N315
aguaaaaacgaaau

SEQ ID NO: 2126047 - RNA, 18 nt, Staphylococcus aureus subsp. aureus N315
aguaucuauacaauuaug

SEQ ID NO: 2126048 - RNA, 20 nt, Staphylococcus aureus subsp. aureus N315
aguauagcgcagcaaaugcu

SEQ ID NO: 2126049 - RNA, 21 nt, Staphylococcus aureus subsp. aureus N315
aguauccagaguuaaagucau

SEQ ID NO: 2126050 - RNA, 18 nt, Staphylococcus aureus subsp. aureus N315
aguacagcgguuuguaug

SEQ ID NO: 2126051 - RNA, 17 nt, Staphylococcus aureus subsp. aureus N315
aguaauauucaacuugu

SEQ ID NO: 2126052 - RNA, 18 nt, Staphylococcus aureus subsp. aureus N315
aguaauguuccauauaac

SEQ ID NO: 2126053 - RNA, 18 nt, Staphylococcus aureus subsp. aureus N315
aguaugagacgcauugca

SEQ ID NO: 2126054 - RNA, 16 nt, Staphylococcus aureus subsp. aureus N315
aguccaaauaauaucu

SEQ ID NO: 2126055 - RNA, 16 nt, Staphylococcus aureus subsp. aureus N315
agucauaugugccaua

SEQ ID NO: 2126056 - RNA, 14 nt, Staphylococcus aureus subsp. aureus N315
agucauaugcauac

SEQ ID NO: 2126057 - RNA, 22 nt, Staphylococcus aureus subsp. aureus N315
aggcgcuacaauguuauauugg

SEQ ID NO: 2126058 - RNA, 14 nt, Staphylococcus aureus subsp. aureus N315
aggauuauuaucaa

SEQ ID NO: 2126059 - RNA, 15 nt, Staphylococcus aureus subsp. aureus N315
aggauuauuaucaaa

SEQ ID NO: 2126060 - RNA, 15 nt, Staphylococcus aureus subsp. aureus N315
aggauguucaucaac

SEQ ID NO: 2126061 - RNA, 20 nt, Staphylococcus aureus subsp. aureus N315
agcaauucuugaaaaguuug

SEQ ID NO: 2126062 - RNA, 21 nt, Staphylococcus aureus subsp. aureus N315
agaugucgaaaaguauaugaa

SEQ ID NO: 2126063 - RNA, 18 nt, Staphylococcus aureus subsp. aureus N315
agcaaauuaguaugacuu

SEQ ID NO: 2126064 - RNA, 19 nt, Staphylococcus aureus subsp. aureus N315
agcaacucaggaauagaug

SEQ ID NO: 2126065 - RNA, 12 nt, Staphylococcus aureus subsp. aureus N315
agaucaauauca

SEQ ID NO: 2126066 - RNA, 13 nt, Staphylococcus aureus subsp. aureus N315
agacucaauuuca

SEQ ID NO: 2126067 - RNA, 15 nt, Staphylococcus aureus subsp. aureus N315
agcaugaaucgcauu

SEQ ID NO: 2126068 - RNA, 19 nt, Staphylococcus aureus subsp. aureus N315
agccauaccuuauuucagc

SEQ ID NO: 2126069 - RNA, 16 nt, Staphylococcus aureus subsp. aureus N315
agcugaacguaaguuu

SEQ ID NO: 2126070 - RNA, 12 nt, Staphylococcus aureus subsp. aureus N315
agcuaaugcauu

SEQ ID NO: 2126071 - RNA, 19 nt, Staphylococcus aureus subsp. aureus N315
agcuaauucauauucaaau

SEQ ID NO: 2126072 - RNA, 14 nt, Staphylococcus aureus subsp. aureus N315
agcuaguugaaccg

SEQ ID NO: 2126073 - RNA, 17 nt, Staphylococcus aureus subsp. aureus N315
aucgaaagaugauauau

SEQ ID NO: 2126074 - RNA, 22 nt, Staphylococcus aureus subsp. aureus N315
aucuugcuuggauaauugcauu

SEQ ID NO: 2126075 - RNA, 20 nt, Staphylococcus aureus subsp. aureus N315
aucuuguuggauuuuaacaa

SEQ ID NO: 2126076 - RNA, 21 nt, Staphylococcus aureus subsp. aureus N315
aucuguuuuagguuuguugcu

SEQ ID NO: 2126077 - RNA, 17 nt, Staphylococcus aureus subsp. aureus N315
aucuucaacuucgauau

SEQ ID NO: 2126078 - RNA, 18 nt, Staphylococcus aureus subsp. aureus N315
aucuauuuuaaacucauc

SEQ ID NO: 2126079 - RNA, 16 nt, Staphylococcus aureus subsp. aureus N315
aucuauuuaucauacu

SEQ ID NO: 2126080 - RNA, 19 nt, Staphylococcus aureus subsp. aureus N315
aucuauggaaaauguuauc

SEQ ID NO: 2126081 - RNA, 13 nt, Staphylococcus aureus subsp. aureus N315
aucuaccauguuu

SEQ ID NO: 2126082 - RNA, 15 nt, Staphylococcus aureus subsp. aureus N315
aucuauaaauacuuu

SEQ ID NO: 2126083 - RNA, 20 nt, Staphylococcus aureus subsp. aureus N315
augcaugcuucucaauuugu

SEQ ID NO: 2126084 - RNA, 23 nt, Staphylococcus aureus subsp. aureus N315
augauuagcgcaccaauuaucaa

SEQ ID NO: 2126085 - RNA, 22 nt, Staphylococcus aureus subsp. aureus N315
augauaacucguaaucauagca

SEQ ID NO: 2126086 - RNA, 12 nt, Staphylococcus aureus subsp. aureus N315
augauaaccauu

SEQ ID NO: 2126087 - RNA, 22 nt, Staphylococcus aureus subsp. aureus N315
augauaauuuaauaacguacau

SEQ ID NO: 2126088 - RNA, 22 nt, Staphylococcus aureus subsp. aureus N315
augauaaucguuuuuacuguaa

SEQ ID NO: 2126089 - RNA, 13 nt, Staphylococcus aureus subsp. aureus N315
augauauucaacu

SEQ ID NO: 2126090 - RNA, 20 nt, Staphylococcus aureus subsp. aureus N315
augacgagaauuaaagucug

SEQ ID NO: 2126091 - RNA, 15 nt, Staphylococcus aureus subsp. aureus N315
augaauaaugcaauu

SEQ ID NO: 2126092 - RNA, 15 nt, Staphylococcus aureus subsp. aureus N315
augaaucaacaauuu

SEQ ID NO: 2126093 - RNA, 18 nt, Staphylococcus aureus subsp. aureus N315
augaauaaucaaaguucg

SEQ ID NO: 2126094 - RNA, 21 nt, Staphylococcus aureus subsp. aureus N315
augaauugaguauuaaauuug

SEQ ID NO: 2126095 - RNA, 19 nt, Staphylococcus aureus subsp. aureus N315
augacauugugaaaguuuu

SEQ ID NO: 2126096 - RNA, 16 nt, Staphylococcus aureus subsp. aureus N315
aucuuuuauaaugaac

SEQ ID NO: 2126097 - RNA, 18 nt, Staphylococcus aureus subsp. aureus N315
aucuuugacauguguuaa

SEQ ID NO: 2126098 - RNA, 22 nt, Staphylococcus aureus subsp. aureus N315
augaaauuggaauagauguuga

SEQ ID NO: 2126099 - RNA, 17 nt, Staphylococcus aureus subsp. aureus N315
augaaaauaagcuugua

SEQ ID NO: 2126100 - RNA, 19 nt, Staphylococcus aureus subsp. aureus N315
augaaacuuugugugcuuu

SEQ ID NO: 2126101 - RNA, 12 nt, Staphylococcus aureus subsp. aureus N315
auugaucugauu

SEQ ID NO: 2126102 - RNA, 17 nt, Staphylococcus aureus subsp. aureus N315
auugauuucagcaccga

SEQ ID NO: 2126103 - RNA, 14 nt, Staphylococcus aureus subsp. aureus N315
auugaaacuaauaa

SEQ ID NO: 2126104 - RNA, 16 nt, Staphylococcus aureus subsp. aureus N315
auucuucaucaugacu

SEQ ID NO: 2126105 - RNA, 20 nt, Staphylococcus aureus subsp. aureus N315
auugagacaacauuguugau

SEQ ID NO: 2126106 - RNA, 14 nt, Staphylococcus aureus subsp. aureus N315
auugcuaauccaua

SEQ ID NO: 2126107 - RNA, 17 nt, Staphylococcus aureus subsp. aureus N315
auugcuaauccauacgu

SEQ ID NO: 2126108 - RNA, 13 nt, Staphylococcus aureus subsp. aureus N315
auuguaaucuauu

SEQ ID NO: 2126109 - RNA, 16 nt, Staphylococcus aureus subsp. aureus N315
auuggcaguaguugac

SEQ ID NO: 2126110 - RNA, 16 nt, Staphylococcus aureus subsp. aureus N315
auuauuaauaaaggga

SEQ ID NO: 2126111 - RNA, 15 nt, Staphylococcus aureus subsp. aureus N315
auuauuuaaucuauu

SEQ ID NO: 2126112 - RNA, 23 nt, Staphylococcus aureus subsp. aureus N315
auuaugcccgauaauucuaacuu

SEQ ID NO: 2126113 - RNA, 14 nt, Staphylococcus aureus subsp. aureus N315
auuauuaccauaac

SEQ ID NO: 2126114 - RNA, 16 nt, Staphylococcus aureus subsp. aureus N315
auuaugacaacauaac

SEQ ID NO: 2126115 - RNA, 22 nt, Staphylococcus aureus subsp. aureus N315
auuaacacgaacugcauaggua

SEQ ID NO: 2126116 - RNA, 20 nt, Staphylococcus aureus subsp. aureus N315
auuaaauguuuacgaaguuc

SEQ ID NO: 2126117 - RNA, 20 nt, Staphylococcus aureus subsp. aureus N315
auuaaauuuguuauaccugg

SEQ ID NO: 2126118 - RNA, 16 nt, Staphylococcus aureus subsp. aureus N315
auucaucuguugauaa

SEQ ID NO: 2126119 - RNA, 20 nt, Staphylococcus aureus subsp. aureus N315
auucauuaagcuuuguuuga

SEQ ID NO: 2126120 - RNA, 22 nt, Staphylococcus aureus subsp. aureus N315
auucauggccaaauguugauaa

SEQ ID NO: 2126121 - RNA, 15 nt, Staphylococcus aureus subsp. aureus N315
auucauuaauaggau

SEQ ID NO: 2126122 - RNA, 14 nt, Staphylococcus aureus subsp. aureus N315
auucagugcaauga

SEQ ID NO: 2126123 - RNA, 19 nt, Staphylococcus aureus subsp. aureus N315
auucugcagcgacaucuuu

SEQ ID NO: 2126124 - RNA, 19 nt, Staphylococcus aureus subsp. aureus N315
auucuagagauaacuagaa

SEQ ID NO: 2126125 - RNA, 18 nt, Staphylococcus aureus subsp. aureus N315
auucuaauacaaaccuau

SEQ ID NO: 2126126 - RNA, 18 nt, Staphylococcus aureus subsp. aureus N315
auucuacaggcaaugcaa

SEQ ID NO: 2126127 - RNA, 18 nt, Staphylococcus aureus subsp. aureus N315
auucuacagguaaugcaa

SEQ ID NO: 2126128 - RNA, 15 nt, Staphylococcus aureus subsp. aureus N315
auucgauaauauaac

SEQ ID NO: 2126129 - RNA, 13 nt, Staphylococcus aureus subsp. aureus N315
auucgcuuguuca

SEQ ID NO: 2126130 - RNA, 14 nt, Staphylococcus aureus subsp. aureus N315
augccaacacguuu

SEQ ID NO: 2126131 - RNA, 20 nt, Staphylococcus aureus subsp. aureus N315
augcuuuuuuuacaauauga

SEQ ID NO: 2126132 - RNA, 21 nt, Staphylococcus aureus subsp. aureus N315
augcuuagcgaacgcuagcau

SEQ ID NO: 2126133 - RNA, 19 nt, Staphylococcus aureus subsp. aureus N315
augcuucgcacaacugcau

SEQ ID NO: 2126134 - RNA, 16 nt, Staphylococcus aureus subsp. aureus N315
auggaauagucccuuu

SEQ ID NO: 2126135 - RNA, 20 nt, Staphylococcus aureus subsp. aureus N315
auggcaucaucaccauacua

SEQ ID NO: 2126136 - RNA, 20 nt, Staphylococcus aureus subsp. aureus N315
augguaaguauaauuaaacu

SEQ ID NO: 2126137 - RNA, 20 nt, Staphylococcus aureus subsp. aureus N315
augucaaaucggcuauacau

SEQ ID NO: 2126138 - RNA, 20 nt, Staphylococcus aureus subsp. aureus N315
augguugaauaacacuagaa

SEQ ID NO: 2126139 - RNA, 21 nt, Staphylococcus aureus subsp. aureus N315
augggccccaacacagagaau

SEQ ID NO: 2126140 - RNA, 19 nt, Staphylococcus aureus subsp. aureus N315
augggagugggacagaaau

SEQ ID NO: 2126141 - RNA, 21 nt, Staphylococcus aureus subsp. aureus N315
auguugcauccccagccauuu

SEQ ID NO: 2126142 - RNA, 21 nt, Staphylococcus aureus subsp. aureus N315
auguugaauguggaacaugau

SEQ ID NO: 2126143 - RNA, 17 nt, Staphylococcus aureus subsp. aureus N315
auguguaugaucaagcu

SEQ ID NO: 2126144 - RNA, 23 nt, Staphylococcus aureus subsp. aureus N315
caaaggcgcaccaugugccuuug

SEQ ID NO: 2126145 - RNA, 17 nt, Staphylococcus aureus subsp. aureus N315
caaagcugucaacuugu

SEQ ID NO: 2126146 - RNA, 17 nt, Staphylococcus aureus subsp. aureus N315
auuguuccuucgauagu

SEQ ID NO: 2126147 - RNA, 14 nt, Staphylococcus aureus subsp. aureus N315
auuuaaacuaguaa

SEQ ID NO: 2126148 - RNA, 13 nt, Staphylococcus aureus subsp. aureus N315
auuuaaaaguuua

SEQ ID NO: 2126149 - RNA, 12 nt, Staphylococcus aureus subsp. aureus N315
caacaauucgau

SEQ ID NO: 2126150 - RNA, 15 nt, Staphylococcus aureus subsp. aureus N315
caaauugaacuucuu

SEQ ID NO: 2126151 - RNA, 14 nt, Staphylococcus aureus subsp. aureus N315
caacaagguuucaa

SEQ ID NO: 2126152 - RNA, 18 nt, Staphylococcus aureus subsp. aureus N315
caacgucaucugcuugua

SEQ ID NO: 2126153 - RNA, 17 nt, Staphylococcus aureus subsp. aureus N315
caagucuaguucgaaca

SEQ ID NO: 2126154 - RNA, 22 nt, Staphylococcus aureus subsp. aureus N315
caagucuuuacucuacacucaa

SEQ ID NO: 2126155 - RNA, 14 nt, Staphylococcus aureus subsp. aureus N315
caagucauuaucca

SEQ ID NO: 2126156 - RNA, 22 nt, Staphylococcus aureus subsp. aureus N315
caauacuuuuuauauaauucgu

SEQ ID NO: 2126157 - RNA, 20 nt, Staphylococcus aureus subsp. aureus N315
caauaugaccuuuaugugca

SEQ ID NO: 2126158 - RNA, 19 nt, Staphylococcus aureus subsp. aureus N315
caauaucuucuaauuccau

SEQ ID NO: 2126159 - RNA, 15 nt, Staphylococcus aureus subsp. aureus N315
caauauugauaucga

SEQ ID NO: 2126160 - RNA, 14 nt, Staphylococcus aureus subsp. aureus N315
caauacaaaucgau

SEQ ID NO: 2126161 - RNA, 12 nt, Staphylococcus aureus subsp. aureus N315
caauaaugugca

SEQ ID NO: 2126162 - RNA, 15 nt, Staphylococcus aureus subsp. aureus N315
caauaacaggugcuu

SEQ ID NO: 2126163 - RNA, 19 nt, Staphylococcus aureus subsp. aureus N315
caaguuuauaaauuucgau

SEQ ID NO: 2126164 - RNA, 21 nt, Staphylococcus aureus subsp. aureus N315
caauccaauauacaaugcuga

SEQ ID NO: 2126165 - RNA, 18 nt, Staphylococcus aureus subsp. aureus N315
caaucgucacaucacguu

SEQ ID NO: 2126166 - RNA, 20 nt, Staphylococcus aureus subsp. aureus N315
caauuuauguaaauucaaaa

SEQ ID NO: 2126167 - RNA, 15 nt, Staphylococcus aureus subsp. aureus N315
caauuucauuugaaa

SEQ ID NO: 2126168 - RNA, 18 nt, Staphylococcus aureus subsp. aureus N315
acauuacauuuaguacau

SEQ ID NO: 2126169 - RNA, 16 nt, Staphylococcus aureus subsp. aureus N315
acauguuccgcuacaa

SEQ ID NO: 2126170 - RNA, 12 nt, Staphylococcus aureus subsp. aureus N315
accaauuagcau

SEQ ID NO: 2126171 - RNA, 16 nt, Staphylococcus aureus subsp. aureus N315
accaauuguuucagcu

SEQ ID NO: 2126172 - RNA, 20 nt, Staphylococcus aureus subsp. aureus N315
acauucccguuaauaucaug

SEQ ID NO: 2126173 - RNA, 14 nt, Staphylococcus aureus subsp. aureus N315
accauuaauuacau

SEQ ID NO: 2126174 - RNA, 17 nt, Staphylococcus aureus subsp. aureus N315
accaguuugaucauaau

SEQ ID NO: 2126175 - RNA, 20 nt, Staphylococcus aureus subsp. aureus N315
accauauuuaugguguagcu

SEQ ID NO: 2126176 - RNA, 17 nt, Staphylococcus aureus subsp. aureus N315
accaguagcuaaugcaa

SEQ ID NO: 2126177 - RNA, 17 nt, Staphylococcus aureus subsp. aureus N315
aauuuguguucaaauca

SEQ ID NO: 2126178 - RNA, 17 nt, Staphylococcus aureus subsp. aureus N315
aauuugaagauuuuguu

SEQ ID NO: 2126179 - RNA, 16 nt, Staphylococcus aureus subsp. aureus N315
aauuugauuaaauucu

SEQ ID NO: 2126180 - RNA, 19 nt, Staphylococcus aureus subsp. aureus N315
aauuugaggauacauaaau

SEQ ID NO: 2126181 - RNA, 21 nt, Staphylococcus aureus subsp. aureus N315
acacauccucauaauuaucau

SEQ ID NO: 2126182 - RNA, 15 nt, Staphylococcus aureus subsp. aureus N315
acacuuuucuuauca

SEQ ID NO: 2126183 - RNA, 16 nt, Staphylococcus aureus subsp. aureus N315
acagcaguaagauauu

SEQ ID NO: 2126184 - RNA, 23 nt, Staphylococcus aureus subsp. aureus N315
acagagaaauucgaaaagaaauu

SEQ ID NO: 2126185 - RNA, 23 nt, Staphylococcus aureus subsp. aureus N315
acaucaugugucuuccaaucaac

SEQ ID NO: 2126186 - RNA, 17 nt, Staphylococcus aureus subsp. aureus N315
acauauuuuaacuauga

SEQ ID NO: 2126187 - RNA, 20 nt, Staphylococcus aureus subsp. aureus N315
acaucaaauuuuucgacauc

SEQ ID NO: 2126188 - RNA, 22 nt, Staphylococcus aureus subsp. aureus N315
acaucauaauaaaucuaucuac

SEQ ID NO: 2126189 - RNA, 21 nt, Staphylococcus aureus subsp. aureus N315
acuuuguggauucucuuuaua

SEQ ID NO: 2126190 - RNA, 15 nt, Staphylococcus aureus subsp. aureus N315
acuuugugugcuuua

SEQ ID NO: 2126191 - RNA, 13 nt, Staphylococcus aureus subsp. aureus N315
acuuuguucaugu

SEQ ID NO: 2126192 - RNA, 19 nt, Staphylococcus aureus subsp. aureus N315
acuuuaacaguuguaauca

SEQ ID NO: 2126193 - RNA, 15 nt, Staphylococcus aureus subsp. aureus N315
acuuuaauuaaagca

SEQ ID NO: 2126194 - RNA, 20 nt, Staphylococcus aureus subsp. aureus N315
acuuucaguaauuguuacua

SEQ ID NO: 2126195 - RNA, 13 nt, Staphylococcus aureus subsp. aureus N315
acuugauaucauc

SEQ ID NO: 2126196 - RNA, 18 nt, Staphylococcus aureus subsp. aureus N315
acuuggauuaccguuaaa

SEQ ID NO: 2126197 - RNA, 18 nt, Staphylococcus aureus subsp. aureus N315
acuuguaucaucgccaug

SEQ ID NO: 2126198 - RNA, 15 nt, Staphylococcus aureus subsp. aureus N315
acuucauauaaugcu

SEQ ID NO: 2126199 - RNA, 20 nt, Staphylococcus aureus subsp. aureus N315
acuuccaucaauccaacuac

SEQ ID NO: 2126200 - RNA, 15 nt, Staphylococcus aureus subsp. aureus N315
acuuaacuuaagcuc

SEQ ID NO: 2126201 - RNA, 10 nt, Staphylococcus aureus subsp. aureus N315
acuuaaaccu

SEQ ID NO: 2126202 - RNA, 18 nt, Staphylococcus aureus subsp. aureus N315
acuuaaauggaugauagu

SEQ ID NO: 2126203 - RNA, 23 nt, Staphylococcus aureus subsp. aureus N315
acuuauuuuauacgaaucacagu

SEQ ID NO: 2126204 - RNA, 21 nt, Staphylococcus aureus subsp. aureus N315
acuuaucuguagauuagcuua

SEQ ID NO: 2126205 - RNA, 20 nt, Staphylococcus aureus subsp. aureus N315
acuguugguuugaucauuug

SEQ ID NO: 2126206 - RNA, 16 nt, Staphylococcus aureus subsp. aureus N315
acucaaaauuaaagcu

SEQ ID NO: 2126207 - RNA, 19 nt, Staphylococcus aureus subsp. aureus N315
acugagaaaucuuaaagau

SEQ ID NO: 2126208 - RNA, 15 nt, Staphylococcus aureus subsp. aureus N315
acucguaaucauagc

SEQ ID NO: 2126209 - RNA, 16 nt, Staphylococcus aureus subsp. aureus N315
acguaaugaaucaauu

SEQ ID NO: 2126210 - RNA, 17 nt, Staphylococcus aureus subsp. aureus N315
acuauuaucuauccauu

SEQ ID NO: 2126211 - RNA, 17 nt, Staphylococcus aureus subsp. aureus N315
acuaauuuaaagcauca

SEQ ID NO: 2126212 - RNA, 22 nt, Staphylococcus aureus subsp. aureus N315
acgguucaaaaguaaaagcuuu

SEQ ID NO: 2126213 - RNA, 15 nt, Staphylococcus aureus subsp. aureus N315
acgaaauaguucaaa

SEQ ID NO: 2126214 - RNA, 21 nt, Staphylococcus aureus subsp. aureus N315
accuaaaucuuuaaauguauc

SEQ ID NO: 2126215 - RNA, 20 nt, Staphylococcus aureus subsp. aureus N315
accuaaggcuaaugauaauc

SEQ ID NO: 2126216 - RNA, 23 nt, Staphylococcus aureus subsp. aureus N315
acgauacaucguguugcucgccu

SEQ ID NO: 2126217 - RNA, 15 nt, Staphylococcus aureus subsp. aureus N315
acgacuugauagcau

SEQ ID NO: 2126218 - RNA, 23 nt, Staphylococcus aureus subsp. aureus N315
acgccuggaaucgcguuuaacaa

SEQ ID NO: 2126219 - RNA, 18 nt, Staphylococcus aureus subsp. aureus N315
acgcgcuucaucaaugga

SEQ ID NO: 2126220 - RNA, 21 nt, Staphylococcus aureus subsp. aureus N315
acgcuagcauaucuuuaucau

SEQ ID NO: 2126221 - RNA, 21 nt, Staphylococcus aureus subsp. aureus N315
uuaauaaccuuuaaaacauca

SEQ ID NO: 2126222 - RNA, 13 nt, Staphylococcus aureus subsp. aureus N315
uuaauuaaaguua

SEQ ID NO: 2126223 - RNA, 21 nt, Staphylococcus aureus subsp. aureus N315
uuaauuacaggaauugcuuua

SEQ ID NO: 2126224 - RNA, 15 nt, Staphylococcus aureus subsp. aureus N315
uuaauuuuaccauca

SEQ ID NO: 2126225 - RNA, 18 nt, Staphylococcus aureus subsp. aureus N315
uuaauucgccuaaauggu

SEQ ID NO: 2126226 - RNA, 18 nt, Staphylococcus aureus subsp. aureus N315
uuaagugcaauaacacca

SEQ ID NO: 2126227 - RNA, 17 nt, Staphylococcus aureus subsp. aureus N315
uuaaguauuuaaauaac

SEQ ID NO: 2126228 - RNA, 13 nt, Staphylococcus aureus subsp. aureus N315
uuaauaaaguaau

SEQ ID NO: 2126229 - RNA, 23 nt, Staphylococcus aureus subsp. aureus N315
uuaacugguugauaaauaaacuc

SEQ ID NO: 2126230 - RNA, 14 nt, Staphylococcus aureus subsp. aureus N315
uuaagaaaaguuac

SEQ ID NO: 2126231 - RNA, 15 nt, Staphylococcus aureus subsp. aureus N315
uuaagaauacaugac

SEQ ID NO: 2126232 - RNA, 18 nt, Staphylococcus aureus subsp. aureus N315
uguuugaauggcaaauau

SEQ ID NO: 2126233 - RNA, 19 nt, Staphylococcus aureus subsp. aureus N315
uguuugacuucaguacaau

SEQ ID NO: 2126234 - RNA, 19 nt, Staphylococcus aureus subsp. aureus N315
uguuuguaaaucaaguguu

SEQ ID NO: 2126235 - RNA, 21 nt, Staphylococcus aureus subsp. aureus N315
uguuuguuacauauugcauuu

SEQ ID NO: 2126236 - RNA, 18 nt, Staphylococcus aureus subsp. aureus N315
uuaacggaaauacaauga

SEQ ID NO: 2126237 - RNA, 21 nt, Staphylococcus aureus subsp. aureus N315
uuaaaagugucugguucuuua

SEQ ID NO: 2126238 - RNA, 13 nt, Staphylococcus aureus subsp. aureus N315
uguuuucaguaac

SEQ ID NO: 2126239 - RNA, 14 nt, Staphylococcus aureus subsp. aureus N315
uuaaaacgaaguua

SEQ ID NO: 2126240 - RNA, 17 nt, Staphylococcus aureus subsp. aureus N315
uguguuaauacuucaua

SEQ ID NO: 2126241 - RNA, 13 nt, Staphylococcus aureus subsp. aureus N315
uguuaauacuuca

SEQ ID NO: 2126242 - RNA, 22 nt, Staphylococcus aureus subsp. aureus N315
uguuaagagguuuugcacuaau

SEQ ID NO: 2126243 - RNA, 20 nt, Staphylococcus aureus subsp. aureus N315
uguuguaagguggacuucua

SEQ ID NO: 2126244 - RNA, 13 nt, Staphylococcus aureus subsp. aureus N315
uuauauaaauuac

SEQ ID NO: 2126245 - RNA, 20 nt, Staphylococcus aureus subsp. aureus N315
uuauagccuucauuugcgau

SEQ ID NO: 2126246 - RNA, 13 nt, Staphylococcus aureus subsp. aureus N315
uuacuccuuacaa

SEQ ID NO: 2126247 - RNA, 15 nt, Staphylococcus aureus subsp. aureus N315
uuacgaaaguagaau

SEQ ID NO: 2126248 - RNA, 15 nt, Staphylococcus aureus subsp. aureus N315
uuaccuuuuaaggca

SEQ ID NO: 2126249 - RNA, 19 nt, Staphylococcus aureus subsp. aureus N315
uuauauugagacaacauug

SEQ ID NO: 2126250 - RNA, 23 nt, Staphylococcus aureus subsp. aureus N315
uuaugucuuaggcgcuacaaugu

SEQ ID NO: 2126251 - RNA, 15 nt, Staphylococcus aureus subsp. aureus N315
uuauguacuacauac

SEQ ID NO: 2126252 - RNA, 13 nt, Staphylococcus aureus subsp. aureus N315
uuauucuaauaca

SEQ ID NO: 2126253 - RNA, 14 nt, Staphylococcus aureus subsp. aureus N315
uuauuccaaauuug

SEQ ID NO: 2126254 - RNA, 20 nt, Staphylococcus aureus subsp. aureus N315
uucaauuaauuuaaaugcuu

SEQ ID NO: 2126255 - RNA, 16 nt, Staphylococcus aureus subsp. aureus N315
uucaaucgucacauca

SEQ ID NO: 2126256 - RNA, 12 nt, Staphylococcus aureus subsp. aureus N315
uucaaagcgaua

SEQ ID NO: 2126257 - RNA, 17 nt, Staphylococcus aureus subsp. aureus N315
uucaaaacuagcaguaa

SEQ ID NO: 2126258 - RNA, 13 nt, Staphylococcus aureus subsp. aureus N315
uucaaaauaguaa

SEQ ID NO: 2126259 - RNA, 14 nt, Staphylococcus aureus subsp. aureus N315
uucaaaaauaguaa

SEQ ID NO: 2126260 - RNA, 14 nt, Staphylococcus aureus subsp. aureus N315
uucaacuuuaauca

SEQ ID NO: 2126261 - RNA, 16 nt, Staphylococcus aureus subsp. aureus N315
uucaagaacaaucaau

SEQ ID NO: 2126262 - RNA, 13 nt, Staphylococcus aureus subsp. aureus N315
uucaaauuuacca

SEQ ID NO: 2126263 - RNA, 21 nt, Staphylococcus aureus subsp. aureus N315
uucaaaucuggcacuuaagcu

SEQ ID NO: 2126264 - RNA, 16 nt, Staphylococcus aureus subsp. aureus N315
uucaacauauaaauca

SEQ ID NO: 2126265 - RNA, 20 nt, Staphylococcus aureus subsp. aureus N315
uugaauuugaauaagugguu

SEQ ID NO: 2126266 - RNA, 22 nt, Staphylococcus aureus subsp. aureus N315
uugaaguaugcacaucauugau

SEQ ID NO: 2126267 - RNA, 19 nt, Staphylococcus aureus subsp. aureus N315
uugauauggcguauucacc

SEQ ID NO: 2126268 - RNA, 23 nt, Staphylococcus aureus subsp. aureus N315
uugauaucuacagagaaucaauu

SEQ ID NO: 2126269 - RNA, 21 nt, Staphylococcus aureus subsp. aureus N315
uugauauaaaaagugaaagua

SEQ ID NO: 2126270 - RNA, 20 nt, Staphylococcus aureus subsp. aureus N315
uugauaacaaaacgauugau

SEQ ID NO: 2126271 - RNA, 18 nt, Staphylococcus aureus subsp. aureus N315
uugauaaaugcgguugau

SEQ ID NO: 2126272 - RNA, 23 nt, Staphylococcus aureus subsp. aureus N315
uucugaauguauucagucaguaa

SEQ ID NO: 2126273 - RNA, 22 nt, Staphylococcus aureus subsp. aureus N315
uucuuggucugcuguaucauca

SEQ ID NO: 2126274 - RNA, 13 nt, Staphylococcus aureus subsp. aureus N315
uucuagcuuuagu

SEQ ID NO: 2126275 - RNA, 13 nt, Staphylococcus aureus subsp. aureus N315
uucauauaaugcu

SEQ ID NO: 2126276 - RNA, 14 nt, Staphylococcus aureus subsp. aureus N315
uucauaaucauaau

SEQ ID NO: 2126277 - RNA, 15 nt, Staphylococcus aureus subsp. aureus N315
uucaguuaaaauaac

SEQ ID NO: 2126278 - RNA, 15 nt, Staphylococcus aureus subsp. aureus N315
uucgauuguaauaac

SEQ ID NO: 2126279 - RNA, 14 nt, Staphylococcus aureus subsp. aureus N315
uuuauuaaagaaac

SEQ ID NO: 2126280 - RNA, 15 nt, Staphylococcus aureus subsp. aureus N315
uuuaugacaaaguuc

SEQ ID NO: 2126281 - RNA, 16 nt, Staphylococcus aureus subsp. aureus N315
uuuauagaaaauuaac

SEQ ID NO: 2126282 - RNA, 20 nt, Staphylococcus aureus subsp. aureus N315
uuuauugagauagaaauuac

SEQ ID NO: 2126283 - RNA, 14 nt, Staphylococcus aureus subsp. aureus N315
uuucaucaaaucca

SEQ ID NO: 2126284 - RNA, 15 nt, Staphylococcus aureus subsp. aureus N315
uuucaugauuuacua

SEQ ID NO: 2126285 - RNA, 13 nt, Staphylococcus aureus subsp. aureus N315
uuucagaaugaac

SEQ ID NO: 2126286 - RNA, 11 nt, Staphylococcus aureus subsp. aureus N315
uuuacuuaauc

SEQ ID NO: 2126287 - RNA, 18 nt, Staphylococcus aureus subsp. aureus N315
uuuaagucauuacguaac

SEQ ID NO: 2126288 - RNA, 14 nt, Staphylococcus aureus subsp. aureus N315
uuuaggcaaauaac

SEQ ID NO: 2126289 - RNA, 17 nt, Staphylococcus aureus subsp. aureus N315
uuuagugaaaaaguuuc

SEQ ID NO: 2126290 - RNA, 22 nt, Staphylococcus aureus subsp. aureus N315
uuuaggaaugaauaaagcuaac

SEQ ID NO: 2126291 - RNA, 17 nt, Staphylococcus aureus subsp. aureus N315
aaucgaaaauaucaauu

SEQ ID NO: 2126292 - RNA, 13 nt, Staphylococcus aureus subsp. aureus N315
uuggcuugcuuca

SEQ ID NO: 2126293 - RNA, 19 nt, Staphylococcus aureus subsp. aureus N315
uugcuagugcucuugcaau

SEQ ID NO: 2126294 - RNA, 18 nt, Staphylococcus aureus subsp. aureus N315
aauugcuuucacauuguu

SEQ ID NO: 2126295 - RNA, 16 nt, Staphylococcus aureus subsp. aureus N315
aauugcucuuuaacaa

SEQ ID NO: 2126296 - RNA, 19 nt, Staphylococcus aureus subsp. aureus N315
aauugcugacaccuauauu

SEQ ID NO: 2126297 - RNA, 16 nt, Staphylococcus aureus subsp. aureus N315
aauugauuauaaugau

SEQ ID NO: 2126298 - RNA, 15 nt, Staphylococcus aureus subsp. aureus N315
aauugacuuuaauug

SEQ ID NO: 2126299 - RNA, 20 nt, Staphylococcus aureus subsp. aureus N315
aauugaucagcauuuaagcu

SEQ ID NO: 2126300 - RNA, 13 nt, Staphylococcus aureus subsp. aureus N315
aauugaauagguc

SEQ ID NO: 2126301 - RNA, 15 nt, Staphylococcus aureus subsp. aureus N315
aauuuagaugcauaa

SEQ ID NO: 2126302 - RNA, 20 nt, Staphylococcus aureus subsp. aureus N315
aauuuagcaaauauuucugg

SEQ ID NO: 2126303 - RNA, 17 nt, Staphylococcus aureus subsp. aureus N315
aauuuaggcaugucaaa

SEQ ID NO: 2126304 - RNA, 20 nt, Staphylococcus aureus subsp. aureus N315
aauuuaguucaccauuucgu

SEQ ID NO: 2126305 - RNA, 20 nt, Staphylococcus aureus subsp. aureus N315
aauuuaguuauaauuucugu

SEQ ID NO: 2126306 - RNA, 12 nt, Staphylococcus aureus subsp. aureus N315
aauuuagugaaa

SEQ ID NO: 2126307 - RNA, 17 nt, Staphylococcus aureus subsp. aureus N315
aauuuagucauuacaaa

SEQ ID NO: 2126308 - RNA, 13 nt, Staphylococcus aureus subsp. aureus N315
aauuuauucaaaa

SEQ ID NO: 2126309 - RNA, 17 nt, Staphylococcus aureus subsp. aureus N315
aauuuauuauaaaauag

SEQ ID NO: 2126310 - RNA, 17 nt, Staphylococcus aureus subsp. aureus N315
aauuuauguugcguuaa

SEQ ID NO: 2126311 - RNA, 12 nt, Staphylococcus aureus subsp. aureus N315
aauuuaaaugcu

SEQ ID NO: 2126312 - RNA, 19 nt, Staphylococcus aureus subsp. aureus N315
aauuuaaaugauauugaaa

SEQ ID NO: 2126313 - RNA, 13 nt, Staphylococcus aureus subsp. aureus N315
aauuguuaaaccc

SEQ ID NO: 2126314 - RNA, 18 nt, Staphylococcus aureus subsp. aureus N315
aauugguuuuuagugaaa

SEQ ID NO: 2126315 - RNA, 22 nt, Staphylococcus aureus subsp. aureus N315
aauuauuaacgcaaaaauacuc

SEQ ID NO: 2126316 - RNA, 15 nt, Staphylococcus aureus subsp. aureus N315
aauuauggagcggaa

SEQ ID NO: 2126317 - RNA, 18 nt, Staphylococcus aureus subsp. aureus N315
aauuaguucguguuugaa

SEQ ID NO: 2126318 - RNA, 16 nt, Staphylococcus aureus subsp. aureus N315
aauuaucuuaagucau

SEQ ID NO: 2126319 - RNA, 13 nt, Staphylococcus aureus subsp. aureus N315
aauucaacgucau

SEQ ID NO: 2126320 - RNA, 15 nt, Staphylococcus aureus subsp. aureus N315
aauuauuuuucaaau

SEQ ID NO: 2126321 - RNA, 19 nt, Staphylococcus aureus subsp. aureus N315
aauuauuuucucgauacaa

SEQ ID NO: 2126322 - RNA, 23 nt, Staphylococcus aureus subsp. aureus N315
aauuauuucccuggaaaaugauu

SEQ ID NO: 2126323 - RNA, 21 nt, Staphylococcus aureus subsp. aureus N315
aauucaggauggaaugauacg

SEQ ID NO: 2126324 - RNA, 14 nt, Staphylococcus aureus subsp. aureus N315
aauuccaucaucuc

SEQ ID NO: 2126325 - RNA, 14 nt, Staphylococcus aureus subsp. aureus N315
aauucccaaccuuc

SEQ ID NO: 2126326 - RNA, 19 nt, Staphylococcus aureus subsp. aureus N315
aauuagccccaguauagaa

SEQ ID NO: 2126327 - RNA, 21 nt, Staphylococcus aureus subsp. aureus N315
aauuaggaauccaauuucucu

SEQ ID NO: 2126328 - RNA, 20 nt, Staphylococcus aureus subsp. aureus N315
aauuacaggaauugcuuuaa

SEQ ID NO: 2126329 - RNA, 14 nt, Staphylococcus aureus subsp. aureus N315
aauuaaucccuuca

SEQ ID NO: 2126330 - RNA, 18 nt, Staphylococcus aureus subsp. aureus N315
aauuaccguuuauuucgu

SEQ ID NO: 2126331 - RNA, 17 nt, Staphylococcus aureus subsp. aureus N315
aauuaaaacaugacaac

SEQ ID NO: 2126332 - RNA, 14 nt, Staphylococcus aureus subsp. aureus N315
aaugcuauauuucg

SEQ ID NO: 2126333 - RNA, 16 nt, Staphylococcus aureus subsp. aureus N315
aaugcauugcacuugu

SEQ ID NO: 2126334 - RNA, 21 nt, Staphylococcus aureus subsp. aureus N315
aaucuggcacuuaagcuuuaa

SEQ ID NO: 2126335 - RNA, 21 nt, Staphylococcus aureus subsp. aureus N315
aaucuuaaagauuuuucagcu

SEQ ID NO: 2126336 - RNA, 13 nt, Staphylococcus aureus subsp. aureus N315
aaucuuauuuugu

SEQ ID NO: 2126337 - RNA, 17 nt, Staphylococcus aureus subsp. aureus N315
aaucuucuaauuaagaa

SEQ ID NO: 2126338 - RNA, 19 nt, Staphylococcus aureus subsp. aureus N315
aaugcaaaucaaauacauc

SEQ ID NO: 2126339 - RNA, 12 nt, Staphylococcus aureus subsp. aureus N315
uuuucaacuuua

SEQ ID NO: 2126340 - RNA, 18 nt, Staphylococcus aureus subsp. aureus N315
uuuugagucaauucgacu

SEQ ID NO: 2126341 - RNA, 13 nt, Staphylococcus aureus subsp. aureus N315
uuuugaaauggua

SEQ ID NO: 2126342 - RNA, 14 nt, Staphylococcus aureus subsp. aureus N315
uuuucuauggcaca

SEQ ID NO: 2126343 - RNA, 17 nt, Staphylococcus aureus subsp. aureus N315
uuuguucaguuaaaucu

SEQ ID NO: 2126344 - RNA, 16 nt, Staphylococcus aureus subsp. aureus N315
uuucuaauuaaacgcu

SEQ ID NO: 2126345 - RNA, 22 nt, Staphylococcus aureus subsp. aureus N315
uuuuauauaauucgugauuaca

SEQ ID NO: 2126346 - RNA, 23 nt, Staphylococcus aureus subsp. aureus N315
uuuuauguccagccauuaaaccu

SEQ ID NO: 2126347 - RNA, 23 nt, Staphylococcus aureus subsp. aureus N315
uuuuauucgauaauauaacugca

SEQ ID NO: 2126348 - RNA, 20 nt, Staphylococcus aureus subsp. aureus N315
uuuuauuauugucaucaugu

SEQ ID NO: 2126349 - RNA, 15 nt, Staphylococcus aureus subsp. aureus N315
uuuuaacagcugcag

SEQ ID NO: 2126350 - RNA, 18 nt, Staphylococcus aureus subsp. aureus N315
uuuuauaauaaaugucac

SEQ ID NO: 2126351 - RNA, 12 nt, Staphylococcus aureus subsp. aureus N315
uuuuaaaguaac

SEQ ID NO: 2126352 - RNA, 16 nt, Staphylococcus aureus subsp. aureus N315
uuuuaaaauuaaaccu

SEQ ID NO: 2126353 - RNA, 16 nt, Staphylococcus aureus subsp. aureus N315
ugcuaauuuaacugcg

SEQ ID NO: 2126354 - RNA, 17 nt, Staphylococcus aureus subsp. aureus N315
ugcuacaccaccugcag

SEQ ID NO: 2126355 - RNA, 13 nt, Staphylococcus aureus subsp. aureus N315
ugcuacaauuucc

SEQ ID NO: 2126356 - RNA, 16 nt, Staphylococcus aureus subsp. aureus N315
ugcuaauuuuuucauc

SEQ ID NO: 2126357 - RNA, 14 nt, Staphylococcus aureus subsp. aureus N315
ugcuaauucaagaa

SEQ ID NO: 2126358 - RNA, 19 nt, Staphylococcus aureus subsp. aureus N315
ugcgugcuuaauuacaaua

SEQ ID NO: 2126359 - RNA, 13 nt, Staphylococcus aureus subsp. aureus N315
uggauaauugcau

SEQ ID NO: 2126360 - RNA, 15 nt, Staphylococcus aureus subsp. aureus N315
uggcaacguucuacu

SEQ ID NO: 2126361 - RNA, 12 nt, Staphylococcus aureus subsp. aureus N315
aauaguucaaau

SEQ ID NO: 2126362 - RNA, 19 nt, Staphylococcus aureus subsp. aureus N315
aauaguuaaaguagaaccu

SEQ ID NO: 2126363 - RNA, 20 nt, Staphylococcus aureus subsp. aureus N315
aauagugucaucaccuuguu

SEQ ID NO: 2126364 - RNA, 15 nt, Staphylococcus aureus subsp. aureus N315
aauaguaaagugaaa

SEQ ID NO: 2126365 - RNA, 13 nt, Staphylococcus aureus subsp. aureus N315
aauagaugagaaa

SEQ ID NO: 2126366 - RNA, 15 nt, Staphylococcus aureus subsp. aureus N315
ugccguuugaagucu

SEQ ID NO: 2126367 - RNA, 12 nt, Staphylococcus aureus subsp. aureus N315
ugucauucuagu

SEQ ID NO: 2126368 - RNA, 22 nt, Staphylococcus aureus subsp. aureus N315
uguauauauauguaaaugaaau

SEQ ID NO: 2126369 - RNA, 14 nt, Staphylococcus aureus subsp. aureus N315
uguaacguacaauu

SEQ ID NO: 2126370 - RNA, 23 nt, Staphylococcus aureus subsp. aureus N315
uguaacacacuuauaaucuauaa

SEQ ID NO: 2126371 - RNA, 15 nt, Staphylococcus aureus subsp. aureus N315
uguaaaaccauagau

SEQ ID NO: 2126372 - RNA, 15 nt, Staphylococcus aureus subsp. aureus N315
uguaaaauuaaaugc

SEQ ID NO: 2126373 - RNA, 14 nt, Staphylococcus aureus subsp. aureus N315
ugucccaaugcuga

SEQ ID NO: 2126374 - RNA, 22 nt, Staphylococcus aureus subsp. aureus N315
aaucaaagauuuauaaauguuu

SEQ ID NO: 2126375 - RNA, 14 nt, Staphylococcus aureus subsp. aureus N315
ugggacgacgaaau

SEQ ID NO: 2126376 - RNA, 23 nt, Staphylococcus aureus subsp. aureus N315
guuaguacggcugcuuuaacugu

SEQ ID NO: 2126377 - RNA, 13 nt, Staphylococcus aureus subsp. aureus N315
guguuugcucaaa

SEQ ID NO: 2126378 - RNA, 17 nt, Staphylococcus aureus subsp. aureus N315
guucauuggcaauauac

SEQ ID NO: 2126379 - RNA, 13 nt, Staphylococcus aureus subsp. aureus N315
guucauaaugauc

SEQ ID NO: 2126380 - RNA, 14 nt, Staphylococcus aureus subsp. aureus N315
guucaucaacauga

SEQ ID NO: 2126381 - RNA, 17 nt, Staphylococcus aureus subsp. aureus N315
gugauauagauggcuuu

SEQ ID NO: 2126382 - RNA, 21 nt, Staphylococcus aureus subsp. aureus N315
gugcuuuaaugccggucauaa

SEQ ID NO: 2126383 - RNA, 14 nt, Staphylococcus aureus subsp. aureus N315
guuuuaaucuuauu

SEQ ID NO: 2126384 - RNA, 13 nt, Staphylococcus aureus subsp. aureus N315
guuuguccuuuaa

SEQ ID NO: 2126385 - RNA, 13 nt, Staphylococcus aureus subsp. aureus N315
guugguuuaucag

SEQ ID NO: 2126386 - RNA, 22 nt, Staphylococcus aureus subsp. aureus N315
guuuuaccccuguugaauauac

SEQ ID NO: 2126387 - RNA, 19 nt, Staphylococcus aureus subsp. aureus N315
guuuuagaauaguuaccaa

SEQ ID NO: 2126388 - RNA, 15 nt, Staphylococcus aureus subsp. aureus N315
uaaaauaaucgguaa

SEQ ID NO: 2126389 - RNA, 15 nt, Staphylococcus aureus subsp. aureus N315
uaaaauaguucuuua

SEQ ID NO: 2126390 - RNA, 13 nt, Staphylococcus aureus subsp. aureus N315
uaaaaugcauagc

SEQ ID NO: 2126391 - RNA, 16 nt, Staphylococcus aureus subsp. aureus N315
uaaaauaguucuuuaa

SEQ ID NO: 2126392 - RNA, 19 nt, Staphylococcus aureus subsp. aureus N315
uaaaaagaagaucccucaa

SEQ ID NO: 2126393 - RNA, 15 nt, Staphylococcus aureus subsp. aureus N315
uaaaaagguacuaau

SEQ ID NO: 2126394 - RNA, 21 nt, Staphylococcus aureus subsp. aureus N315
uaaaaagugaaaguauuagau

SEQ ID NO: 2126395 - RNA, 19 nt, Staphylococcus aureus subsp. aureus N315
uaaaaaucaaagaggcaca

SEQ ID NO: 2126396 - RNA, 19 nt, Staphylococcus aureus subsp. aureus N315
uaaaaaauacucccuucaa

SEQ ID NO: 2126397 - RNA, 13 nt, Staphylococcus aureus subsp. aureus N315
uacaucaauuucu

SEQ ID NO: 2126398 - RNA, 20 nt, Staphylococcus aureus subsp. aureus N315
uaccaaagaaaucaccagau

SEQ ID NO: 2126399 - RNA, 18 nt, Staphylococcus aureus subsp. aureus N315
uaccaauacguuuccaau

SEQ ID NO: 2126400 - RNA, 15 nt, Staphylococcus aureus subsp. aureus N315
uaccaauuagcauga

SEQ ID NO: 2126401 - RNA, 22 nt, Staphylococcus aureus subsp. aureus N315
uacacuaaaaccuauuccuaau

SEQ ID NO: 2126402 - RNA, 21 nt, Staphylococcus aureus subsp. aureus N315
uacagaugaugcuucgcauca

SEQ ID NO: 2126403 - RNA, 20 nt, Staphylococcus aureus subsp. aureus N315
uacauaauuuaucaauuucu

SEQ ID NO: 2126404 - RNA, 21 nt, Staphylococcus aureus subsp. aureus N315
uacaaguugaucaaaaauguu

SEQ ID NO: 2126405 - RNA, 20 nt, Staphylococcus aureus subsp. aureus N315
uacaagucuuuacucuacac

SEQ ID NO: 2126406 - RNA, 19 nt, Staphylococcus aureus subsp. aureus N315
uacaacuguuggaauaccu

SEQ ID NO: 2126407 - RNA, 20 nt, Staphylococcus aureus subsp. aureus N315
uacaacuguuggaauaccuu

SEQ ID NO: 2126408 - RNA, 13 nt, Staphylococcus aureus subsp. aureus N315
uacaaauugauuu

SEQ ID NO: 2126409 - RNA, 17 nt, Staphylococcus aureus subsp. aureus N315
uacaauuuuccuuccaa

SEQ ID NO: 2126410 - RNA, 23 nt, Staphylococcus aureus subsp. aureus N315
uaaugucuucauaaucguauuca

SEQ ID NO: 2126411 - RNA, 22 nt, Staphylococcus aureus subsp. aureus N315
uaaugugcgucacucacuucaa

SEQ ID NO: 2126412 - RNA, 16 nt, Staphylococcus aureus subsp. aureus N315
uaauguacauguauaa

SEQ ID NO: 2126413 - RNA, 14 nt, Staphylococcus aureus subsp. aureus N315
uaauguauuaauug

SEQ ID NO: 2126414 - RNA, 19 nt, Staphylococcus aureus subsp. aureus N315
uaaucagugaaauaucaag

SEQ ID NO: 2126415 - RNA, 15 nt, Staphylococcus aureus subsp. aureus N315
uaauuuaucuuaauc

SEQ ID NO: 2126416 - RNA, 15 nt, Staphylococcus aureus subsp. aureus N315
uaauuuaaaauaguu

SEQ ID NO: 2126417 - RNA, 19 nt, Staphylococcus aureus subsp. aureus N315
uacaaaguuaaccauacau

SEQ ID NO: 2126418 - RNA, 18 nt, Staphylococcus aureus subsp. aureus N315
uaauagccauucgaugcu

SEQ ID NO: 2126419 - RNA, 23 nt, Staphylococcus aureus subsp. aureus N315
uaauaugaauuuagaugcauaaa

SEQ ID NO: 2126420 - RNA, 19 nt, Staphylococcus aureus subsp. aureus N315
uaagucuaauguuggaaaa

SEQ ID NO: 2126421 - RNA, 21 nt, Staphylococcus aureus subsp. aureus N315
uaaguaucggugauuuaauug

SEQ ID NO: 2126422 - RNA, 19 nt, Staphylococcus aureus subsp. aureus N315
uaagugauaaauaaugcau

SEQ ID NO: 2126423 - RNA, 22 nt, Staphylococcus aureus subsp. aureus N315
uaagugauuucuucauuaucaa

SEQ ID NO: 2126424 - RNA, 21 nt, Staphylococcus aureus subsp. aureus N315
uaaguaguuguuauauucuag

SEQ ID NO: 2126425 - RNA, 20 nt, Staphylococcus aureus subsp. aureus N315
uaacuugaacagauucaccu

SEQ ID NO: 2126426 - RNA, 15 nt, Staphylococcus aureus subsp. aureus N315
uaacuuacuuuugua

SEQ ID NO: 2126427 - RNA, 14 nt, Staphylococcus aureus subsp. aureus N315
uaacuauggucauc

SEQ ID NO: 2126428 - RNA, 15 nt, Staphylococcus aureus subsp. aureus N315
uaacguucacuuggu

SEQ ID NO: 2126429 - RNA, 15 nt, Staphylococcus aureus subsp. aureus N315
uaacuacacuuaaua

SEQ ID NO: 2126430 - RNA, 15 nt, Staphylococcus aureus subsp. aureus N315
uaacguuucuuugua

SEQ ID NO: 2126431 - RNA, 14 nt, Staphylococcus aureus subsp. aureus N315
uaaccauaaugaac

SEQ ID NO: 2126432 - RNA, 21 nt, Staphylococcus aureus subsp. aureus N315
uaacauccugcuuauuaauug

SEQ ID NO: 2126433 - RNA, 15 nt, Staphylococcus aureus subsp. aureus N315
uccaaguuaaugcac

SEQ ID NO: 2126434 - RNA, 19 nt, Staphylococcus aureus subsp. aureus N315
ucauuuucauucagucaac

SEQ ID NO: 2126435 - RNA, 21 nt, Staphylococcus aureus subsp. aureus N315
ucauuuuuaucccacuccuua

SEQ ID NO: 2126436 - RNA, 18 nt, Staphylococcus aureus subsp. aureus N315
ucauuguguauuguuuua

SEQ ID NO: 2126437 - RNA, 13 nt, Staphylococcus aureus subsp. aureus N315
ucauugaucgauu

SEQ ID NO: 2126438 - RNA, 22 nt, Staphylococcus aureus subsp. aureus N315
ucauuucaauauuaaaauacgg

SEQ ID NO: 2126439 - RNA, 15 nt, Staphylococcus aureus subsp. aureus N315
ucauuuguucaucug

SEQ ID NO: 2126440 - RNA, 12 nt, Staphylococcus aureus subsp. aureus N315
ucauucaccuug

SEQ ID NO: 2126441 - RNA, 12 nt, Staphylococcus aureus subsp. aureus N315
ucauguuugauu

SEQ ID NO: 2126442 - RNA, 20 nt, Staphylococcus aureus subsp. aureus N315
ucaucuuagacgcuguuuua

SEQ ID NO: 2126443 - RNA, 17 nt, Staphylococcus aureus subsp. aureus N315
ucaugugucauaaucca

SEQ ID NO: 2126444 - RNA, 20 nt, Staphylococcus aureus subsp. aureus N315
ucaugugucuuccaaucaac

SEQ ID NO: 2126445 - RNA, 14 nt, Staphylococcus aureus subsp. aureus N315
ucauguauugucca

SEQ ID NO: 2126446 - RNA, 16 nt, Staphylococcus aureus subsp. aureus N315
ucaucauuaaaucuga

SEQ ID NO: 2126447 - RNA, 20 nt, Staphylococcus aureus subsp. aureus N315
ucauagaugacgaucuauaa

SEQ ID NO: 2126448 - RNA, 21 nt, Staphylococcus aureus subsp. aureus N315
ucauauauugacucgaccuuu

SEQ ID NO: 2126449 - RNA, 15 nt, Staphylococcus aureus subsp. aureus N315
ucauaguuaucgauu

SEQ ID NO: 2126450 - RNA, 18 nt, Staphylococcus aureus subsp. aureus N315
ucauacgagaaauuagaa

SEQ ID NO: 2126451 - RNA, 18 nt, Staphylococcus aureus subsp. aureus N315
ucauaaugaacgauauuc

SEQ ID NO: 2126452 - RNA, 15 nt, Staphylococcus aureus subsp. aureus N315
ucauaauaaucguaa

SEQ ID NO: 2126453 - RNA, 18 nt, Staphylococcus aureus subsp. aureus N315
ucauaaacugaaucgauu

SEQ ID NO: 2126454 - RNA, 22 nt, Staphylococcus aureus subsp. aureus N315
uccauuagaacuaagaugugca

SEQ ID NO: 2126455 - RNA, 17 nt, Staphylococcus aureus subsp. aureus N315
uccaauuuaaaaugauu

SEQ ID NO: 2126456 - RNA, 12 nt, Staphylococcus aureus subsp. aureus N315
uccaauuccaau

SEQ ID NO: 2126457 - RNA, 19 nt, Staphylococcus aureus subsp. aureus N315
aauaauugcuuuagaaagu

SEQ ID NO: 2126458 - RNA, 23 nt, Staphylococcus aureus subsp. aureus N315
aauaauuagauuuaaaaugucau

SEQ ID NO: 2126459 - RNA, 21 nt, Staphylococcus aureus subsp. aureus N315
ucagauagguacuuaucugaa

SEQ ID NO: 2126460 - RNA, 18 nt, Staphylococcus aureus subsp. aureus N315
ucagaugauuuaauucug

SEQ ID NO: 2126461 - RNA, 16 nt, Staphylococcus aureus subsp. aureus N315
ucaggaauagauguca

SEQ ID NO: 2126462 - RNA, 21 nt, Staphylococcus aureus subsp. aureus N315
aauaaccacuuugaauugguu

SEQ ID NO: 2126463 - RNA, 20 nt, Staphylococcus aureus subsp. aureus N315
aauaaccuuuaaaacaucau

SEQ ID NO: 2126464 - RNA, 16 nt, Staphylococcus aureus subsp. aureus N315
aauaauaauugcuuua

SEQ ID NO: 2126465 - RNA, 22 nt, Staphylococcus aureus subsp. aureus N315
aauaaucgaacagaaaaucguu

SEQ ID NO: 2126466 - RNA, 16 nt, Staphylococcus aureus subsp. aureus N315
ucacaaguuuacaggu

SEQ ID NO: 2126467 - RNA, 15 nt, Staphylococcus aureus subsp. aureus N315
ucaccuucuauauug

SEQ ID NO: 2126468 - RNA, 13 nt, Staphylococcus aureus subsp. aureus N315
uaucuauaugcau

SEQ ID NO: 2126469 - RNA, 18 nt, Staphylococcus aureus subsp. aureus N315
uaucugacauuguugcua

SEQ ID NO: 2126470 - RNA, 20 nt, Staphylococcus aureus subsp. aureus N315
uaucucugaaaaacuucuua

SEQ ID NO: 2126471 - RNA, 14 nt, Staphylococcus aureus subsp. aureus N315
uaucugcuuuucua

SEQ ID NO: 2126472 - RNA, 12 nt, Staphylococcus aureus subsp. aureus N315
uaucuguuguua

SEQ ID NO: 2126473 - RNA, 12 nt, Staphylococcus aureus subsp. aureus N315
uaucuguuucua

SEQ ID NO: 2126474 - RNA, 13 nt, Staphylococcus aureus subsp. aureus N315
uaugaaaaguaaa

SEQ ID NO: 2126475 - RNA, 23 nt, Staphylococcus aureus subsp. aureus N315
uauuaaaguaaaauauacuugaa

SEQ ID NO: 2126476 - RNA, 16 nt, Staphylococcus aureus subsp. aureus N315
uauuaaaauuaaaacu

SEQ ID NO: 2126477 - RNA, 21 nt, Staphylococcus aureus subsp. aureus N315
uauuaaaagcaugauacucaa

SEQ ID NO: 2126478 - RNA, 12 nt, Staphylococcus aureus subsp. aureus N315
uaugauguucaa

SEQ ID NO: 2126479 - RNA, 19 nt, Staphylococcus aureus subsp. aureus N315
uaugauuaggauuagcguu

SEQ ID NO: 2126480 - RNA, 23 nt, Staphylococcus aureus subsp. aureus N315
uaugauccuuuaaugcuuuagca

SEQ ID NO: 2126481 - RNA, 20 nt, Staphylococcus aureus subsp. aureus N315
uauuaaauuuguguucaaau

SEQ ID NO: 2126482 - RNA, 19 nt, Staphylococcus aureus subsp. aureus N315
uauuacugauuguuaacga

SEQ ID NO: 2126483 - RNA, 19 nt, Staphylococcus aureus subsp. aureus N315
uauuaauuuuucaaauguu

SEQ ID NO: 2126484 - RNA, 15 nt, Staphylococcus aureus subsp. aureus N315
uauuauaauuguuca

SEQ ID NO: 2126485 - RNA, 21 nt, Staphylococcus aureus subsp. aureus N315
uauaccucuuagcacuuggau

SEQ ID NO: 2126486 - RNA, 22 nt, Staphylococcus aureus subsp. aureus N315
uauagaauucacgcaauaucau

SEQ ID NO: 2126487 - RNA, 16 nt, Staphylococcus aureus subsp. aureus N315
uauauauuaaaguaaa

SEQ ID NO: 2126488 - RNA, 23 nt, Staphylococcus aureus subsp. aureus N315
uauaugccgauugcucuaaucca

SEQ ID NO: 2126489 - RNA, 13 nt, Staphylococcus aureus subsp. aureus N315
uauauucaacuua

SEQ ID NO: 2126490 - RNA, 12 nt, Staphylococcus aureus subsp. aureus N315
uauaauugauug

SEQ ID NO: 2126491 - RNA, 19 nt, Staphylococcus aureus subsp. aureus N315
uagguauaguguuugacaa

SEQ ID NO: 2126492 - RNA, 16 nt, Staphylococcus aureus subsp. aureus N315
uauauucaacuuauua

SEQ ID NO: 2126493 - RNA, 16 nt, Staphylococcus aureus subsp. aureus N315
uauauuuuaguucaca

SEQ ID NO: 2126494 - RNA, 17 nt, Staphylococcus aureus subsp. aureus N315
uauauuuguauaugcaa

SEQ ID NO: 2126495 - RNA, 18 nt, Staphylococcus aureus subsp. aureus N315
uaucagcuuguuucaggu

SEQ ID NO: 2126496 - RNA, 18 nt, Staphylococcus aureus subsp. aureus N315
ucaauaucuucuucuaac

SEQ ID NO: 2126497 - RNA, 13 nt, Staphylococcus aureus subsp. aureus N315
ucaauguaucaag

SEQ ID NO: 2126498 - RNA, 18 nt, Staphylococcus aureus subsp. aureus N315
ucaauuguuacuuuaacu

SEQ ID NO: 2126499 - RNA, 21 nt, Staphylococcus aureus subsp. aureus N315
ucaauucgcgucauuuguuca

SEQ ID NO: 2126500 - RNA, 14 nt, Staphylococcus aureus subsp. aureus N315
ucaauaacaccuuu

SEQ ID NO: 2126501 - RNA, 12 nt, Staphylococcus aureus subsp. aureus N315
ucaaguaacuca

SEQ ID NO: 2126502 - RNA, 18 nt, Staphylococcus aureus subsp. aureus N315
ucaagcuuaauaagcuga

SEQ ID NO: 2126503 - RNA, 18 nt, Staphylococcus aureus subsp. aureus N315
ucaaagcgauaaaguaug

SEQ ID NO: 2126504 - RNA, 22 nt, Staphylococcus aureus subsp. aureus N315
ucaaaucacaaguuuacagguu

SEQ ID NO: 2126505 - RNA, 16 nt, Staphylococcus aureus subsp. aureus N315
ucaaaguuuaauugcu

SEQ ID NO: 2126506 - RNA, 12 nt, Staphylococcus aureus subsp. aureus N315
ucaagaacaauc

SEQ ID NO: 2126507 - RNA, 15 nt, Staphylococcus aureus subsp. aureus N315
ucaacuuguuuccua

SEQ ID NO: 2126508 - RNA, 19 nt, Staphylococcus aureus subsp. aureus N315
uacuaacguuuuaaagguu

SEQ ID NO: 2126509 - RNA, 21 nt, Staphylococcus aureus subsp. aureus N315
uacguguguaguagcaccgau

SEQ ID NO: 2126510 - RNA, 17 nt, Staphylococcus aureus subsp. aureus N315
uacguuuaauaaugguu

SEQ ID NO: 2126511 - RNA, 18 nt, Staphylococcus aureus subsp. aureus N315
uacuaaaaguguuaugaa

SEQ ID NO: 2126512 - RNA, 21 nt, Staphylococcus aureus subsp. aureus N315
uagaaaauaugacgaucuuca

SEQ ID NO: 2126513 - RNA, 14 nt, Staphylococcus aureus subsp. aureus N315
uagaaaacaucuua

SEQ ID NO: 2126514 - RNA, 14 nt, Staphylococcus aureus subsp. aureus N315
aaguugcuuagcuu

SEQ ID NO: 2126515 - RNA, 19 nt, Staphylococcus aureus subsp. aureus N315
aaguuguugaaauuucugu

SEQ ID NO: 2126516 - RNA, 17 nt, Staphylococcus aureus subsp. aureus N315
aaguuugauagaugaua

SEQ ID NO: 2126517 - RNA, 19 nt, Staphylococcus aureus subsp. aureus N315
aaguuuucagagauucugu

SEQ ID NO: 2126518 - RNA, 21 nt, Staphylococcus aureus subsp. aureus N315
uagcguuagauaccucuugua

SEQ ID NO: 2126519 - RNA, 15 nt, Staphylococcus aureus subsp. aureus N315
uagccuuuucuagcu

SEQ ID NO: 2126520 - RNA, 21 nt, Staphylococcus aureus subsp. aureus N315
uaggauuguuuuuaagucguu

SEQ ID NO: 2126521 - RNA, 14 nt, Staphylococcus aureus subsp. aureus N315
uaggauuuacaccu

SEQ ID NO: 2126522 - RNA, 16 nt, Staphylococcus aureus subsp. aureus N315
uaggaccucuuauuua

SEQ ID NO: 2126523 - RNA, 18 nt, Staphylococcus aureus subsp. aureus N315
aauaaaccuacaauauag

SEQ ID NO: 2126524 - RNA, 18 nt, Staphylococcus aureus subsp. aureus N315
aauaaaucacgccauaau

SEQ ID NO: 2126525 - RNA, 19 nt, Staphylococcus aureus subsp. aureus N315
aauaaaaccgguacuuuca

SEQ ID NO: 2126526 - RNA, 21 nt, Staphylococcus aureus subsp. aureus N315
aauaaaaaccaauauuucugg

SEQ ID NO: 2126527 - RNA, 20 nt, Staphylococcus aureus subsp. aureus N315
ucgaacaaucggaagcauau

SEQ ID NO: 2126528 - RNA, 20 nt, Staphylococcus aureus subsp. aureus N315
uccuucgcuaugaccaugau

SEQ ID NO: 2126529 - RNA, 21 nt, Staphylococcus aureus subsp. aureus N315
ucgauuaucugacauuguugc

SEQ ID NO: 2126530 - RNA, 17 nt, Staphylococcus aureus subsp. aureus N315
ucgauauuuguuucgua

SEQ ID NO: 2126531 - RNA, 20 nt, Staphylococcus aureus subsp. aureus N315
ucgauauuucuaguugcaau

SEQ ID NO: 2126532 - RNA, 17 nt, Staphylococcus aureus subsp. aureus N315
uccuauuacuacauaau

SEQ ID NO: 2126533 - RNA, 21 nt, Staphylococcus aureus subsp. aureus N315
uccuauuguuuuagcaauuug

SEQ ID NO: 2126534 - RNA, 18 nt, Staphylococcus aureus subsp. aureus N315
ugauucauuacaaccauu

SEQ ID NO: 2126535 - RNA, 16 nt, Staphylococcus aureus subsp. aureus N315
ugauuacaacuuauuc

SEQ ID NO: 2126536 - RNA, 14 nt, Staphylococcus aureus subsp. aureus N315
ugauucaauauagu

SEQ ID NO: 2126537 - RNA, 14 nt, Staphylococcus aureus subsp. aureus N315
ugcaauugccuuau

SEQ ID NO: 2126538 - RNA, 23 nt, Staphylococcus aureus subsp. aureus N315
ugcaauaccuccccaacuuaaua

SEQ ID NO: 2126539 - RNA, 16 nt, Staphylococcus aureus subsp. aureus N315
ugcaaauuaucauuaa

SEQ ID NO: 2126540 - RNA, 14 nt, Staphylococcus aureus subsp. aureus N315
ugauuuguuugauu

SEQ ID NO: 2126541 - RNA, 13 nt, Staphylococcus aureus subsp. aureus N315
ugauuuuaaucua

SEQ ID NO: 2126542 - RNA, 20 nt, Staphylococcus aureus subsp. aureus N315
ugauuuggguaauguuuuua

SEQ ID NO: 2126543 - RNA, 13 nt, Staphylococcus aureus subsp. aureus N315
ugauuuuguuuca

SEQ ID NO: 2126544 - RNA, 18 nt, Staphylococcus aureus subsp. aureus N315
ugauagcuaaugcauuau

SEQ ID NO: 2126545 - RNA, 18 nt, Staphylococcus aureus subsp. aureus N315
ugauaucacuauacaauc

SEQ ID NO: 2126546 - RNA, 20 nt, Staphylococcus aureus subsp. aureus N315
ugacguaauuaauagguuau

SEQ ID NO: 2126547 - RNA, 14 nt, Staphylococcus aureus subsp. aureus N315
ugacuuuauuucua

SEQ ID NO: 2126548 - RNA, 20 nt, Staphylococcus aureus subsp. aureus N315
ugacuuuaaaucuuguucua

SEQ ID NO: 2126549 - RNA, 15 nt, Staphylococcus aureus subsp. aureus N315
ugccacauucgagcu

SEQ ID NO: 2126550 - RNA, 19 nt, Staphylococcus aureus subsp. aureus N315
ugcauuuagaugauucuua

SEQ ID NO: 2126551 - RNA, 19 nt, Staphylococcus aureus subsp. aureus N315
ucuccaacucuaacagcuu

SEQ ID NO: 2126552 - RNA, 13 nt, Staphylococcus aureus subsp. aureus N315
ucuauuauuagag

SEQ ID NO: 2126553 - RNA, 22 nt, Staphylococcus aureus subsp. aureus N315
ucuauauaaaaacuguucauac

SEQ ID NO: 2126554 - RNA, 14 nt, Staphylococcus aureus subsp. aureus N315
ucuauagguuuaua

SEQ ID NO: 2126555 - RNA, 22 nt, Staphylococcus aureus subsp. aureus N315
ucuagugcuuugucuuggaugu

SEQ ID NO: 2126556 - RNA, 23 nt, Staphylococcus aureus subsp. aureus N315
ucuaaguuaaaaccuuuucaaau

SEQ ID NO: 2126557 - RNA, 14 nt, Staphylococcus aureus subsp. aureus N315
ucuaagauacguug

SEQ ID NO: 2126558 - RNA, 19 nt, Staphylococcus aureus subsp. aureus N315
ucuaaagguaccacuguau

SEQ ID NO: 2126559 - RNA, 19 nt, Staphylococcus aureus subsp. aureus N315
ucguuucuguuucaucacc

SEQ ID NO: 2126560 - RNA, 18 nt, Staphylococcus aureus subsp. aureus N315
ucugcggauuaucuaacu

SEQ ID NO: 2126561 - RNA, 23 nt, Staphylococcus aureus subsp. aureus N315
aauagaaucuaaggccauuugua

SEQ ID NO: 2126562 - RNA, 17 nt, Staphylococcus aureus subsp. aureus N315
aauacuuuuuaacuggu

SEQ ID NO: 2126563 - RNA, 16 nt, Staphylococcus aureus subsp. aureus N315
aauacuuucacuuuuu

SEQ ID NO: 2126564 - RNA, 19 nt, Staphylococcus aureus subsp. aureus N315
aauacuaagauuagcuaug

SEQ ID NO: 2126565 - RNA, 21 nt, Staphylococcus aureus subsp. aureus N315
aauacuaagauuagcuaugaa

SEQ ID NO: 2126566 - RNA, 21 nt, Staphylococcus aureus subsp. aureus N315
aauacuacuguugacauuuga

SEQ ID NO: 2126567 - RNA, 17 nt, Staphylococcus aureus subsp. aureus N315
aauacucuucaaucuac

SEQ ID NO: 2126568 - RNA, 21 nt, Staphylococcus aureus subsp. aureus N315
aauacuguauuuuaacgucau

SEQ ID NO: 2126569 - RNA, 15 nt, Staphylococcus aureus subsp. aureus N315
ucuguaauuaaucca

SEQ ID NO: 2126570 - RNA, 12 nt, Staphylococcus aureus subsp. aureus N315
ucuuguaauguu

SEQ ID NO: 2126571 - RNA, 21 nt, Staphylococcus aureus subsp. aureus N315
ucuugauuauauuuuucuuca

SEQ ID NO: 2126572 - RNA, 16 nt, Staphylococcus aureus subsp. aureus N315
ucuguuguuucgaugg

SEQ ID NO: 2126573 - RNA, 12 nt, Staphylococcus aureus subsp. aureus N315
ucuuuuguuuua

SEQ ID NO: 2126574 - RNA, 16 nt, Staphylococcus aureus subsp. aureus N315
ucuuuuuguuguuuua

SEQ ID NO: 2126575 - RNA, 12 nt, Staphylococcus aureus subsp. aureus N315
ugaaaaaguaaa

SEQ ID NO: 2126576 - RNA, 15 nt, Staphylococcus aureus subsp. aureus N315
ucuuuauauucucca

SEQ ID NO: 2126577 - RNA, 20 nt, Staphylococcus aureus subsp. aureus N315
ucuuuuaauagaucuuugua

SEQ ID NO: 2126578 - RNA, 16 nt, Staphylococcus aureus subsp. aureus N315
ucuuuuagcuuuugua

SEQ ID NO: 2126579 - RNA, 12 nt, Staphylococcus aureus subsp. aureus N315
ucuuuucuuuga

SEQ ID NO: 2126580 - RNA, 20 nt, Staphylococcus aureus subsp. aureus N315
ucuuuucgaaaaucucugua

SEQ ID NO: 2126581 - RNA, 20 nt, Staphylococcus aureus subsp. aureus N315
ugaauaguagugauaucgcu

SEQ ID NO: 2126582 - RNA, 14 nt, Staphylococcus aureus subsp. aureus N315
ugaauaucacuuua

SEQ ID NO: 2126583 - RNA, 16 nt, Staphylococcus aureus subsp. aureus N315
ugaaucaguuacugcg

SEQ ID NO: 2126584 - RNA, 14 nt, Staphylococcus aureus subsp. aureus N315
ugaacgguagaaua

SEQ ID NO: 2126585 - RNA, 17 nt, Staphylococcus aureus subsp. aureus N315
ugaaugauugcauugau

SEQ ID NO: 2126586 - RNA, 19 nt, Staphylococcus aureus subsp. aureus N315
ugacauggcacgauaauug

SEQ ID NO: 2126587 - RNA, 16 nt, Staphylococcus aureus subsp. aureus N315
ugacauaucgauauuc

SEQ ID NO: 2126588 - RNA, 13 nt, Staphylococcus aureus subsp. aureus N315
agcuaaaaguuuc

SEQ ID NO: 2126589 - RNA, 14 nt, Staphylococcus aureus subsp. aureus N315
agcuaaacgacauu

SEQ ID NO: 2126590 - RNA, 18 nt, Staphylococcus aureus subsp. aureus N315
agcuaaaugcucaagcca

SEQ ID NO: 2126591 - RNA, 16 nt, Staphylococcus aureus subsp. aureus N315
agcuacaaauaaugag

SEQ ID NO: 2126592 - RNA, 16 nt, Staphylococcus aureus subsp. aureus N315
agcucaugaaucagau

SEQ ID NO: 2126593 - RNA, 15 nt, Staphylococcus aureus subsp. aureus N315
agcguacgauauagu

SEQ ID NO: 2126594 - RNA, 22 nt, Staphylococcus aureus subsp. aureus N315
agcuuguuuguuacauauugca

SEQ ID NO: 2126595 - RNA, 14 nt, Staphylococcus aureus subsp. aureus N315
agcuuuaguuacua

SEQ ID NO: 2126596 - RNA, 20 nt, Staphylococcus aureus subsp. aureus N315
agcuucuuuaacaauugauu

SEQ ID NO: 2126597 - RNA, 20 nt, Staphylococcus aureus subsp. aureus N315
agcuuauuaagcuugaaaca

SEQ ID NO: 2126598 - RNA, 16 nt, Staphylococcus aureus subsp. aureus N315
aggaccacucaauucu

SEQ ID NO: 2126599 - RNA, 20 nt, Staphylococcus aureus subsp. aureus N315
agcuuucuuuuucaucuuuc

SEQ ID NO: 2126600 - RNA, 18 nt, Staphylococcus aureus subsp. aureus N315
agcuuuuaaacgaucacu

SEQ ID NO: 2126601 - RNA, 21 nt, Staphylococcus aureus subsp. aureus N315
agcuuuuacgccuucuuuaua

SEQ ID NO: 2126602 - RNA, 21 nt, Staphylococcus aureus subsp. aureus N315
aggaacguguucuaaaaguug

SEQ ID NO: 2126603 - RNA, 18 nt, Staphylococcus aureus subsp. aureus N315
aggaucaagugcagaugu

SEQ ID NO: 2126604 - RNA, 22 nt, Staphylococcus aureus subsp. aureus N315
aggauaugcuguguaucaucau

SEQ ID NO: 2126605 - RNA, 16 nt, Staphylococcus aureus subsp. aureus N315
aggaugauuuauuaac

SEQ ID NO: 2126606 - RNA, 20 nt, Staphylococcus aureus subsp. aureus N315
aggauguucaucaacaugau

SEQ ID NO: 2126607 - RNA, 20 nt, Staphylococcus aureus subsp. aureus N315
aggauuguuuuuaagucguu

SEQ ID NO: 2126608 - RNA, 19 nt, Staphylococcus aureus subsp. aureus N315
aggcaacuuuuauuacuua

SEQ ID NO: 2126609 - RNA, 17 nt, Staphylococcus aureus subsp. aureus N315
agauuuguagcuugaau

SEQ ID NO: 2126610 - RNA, 20 nt, Staphylococcus aureus subsp. aureus N315
agcauaugguaaaucgucau

SEQ ID NO: 2126611 - RNA, 14 nt, Staphylococcus aureus subsp. aureus N315
agcauuuucaaugu

SEQ ID NO: 2126612 - RNA, 20 nt, Staphylococcus aureus subsp. aureus N315
agccaugauacgaugcguga

SEQ ID NO: 2126613 - RNA, 21 nt, Staphylococcus aureus subsp. aureus N315
agcgaaaguaucuaugaaauu

SEQ ID NO: 2126614 - RNA, 21 nt, Staphylococcus aureus subsp. aureus N315
aucauuuguguauaaauguca

SEQ ID NO: 2126615 - RNA, 16 nt, Staphylococcus aureus subsp. aureus N315
aucauuuaauugaugu

SEQ ID NO: 2126616 - RNA, 24 nt, Staphylococcus aureus subsp. aureus N315
aucauugaauguuggaucggcauu

SEQ ID NO: 2126617 - RNA, 19 nt, Staphylococcus aureus subsp. aureus N315
aucauuauacgugcuuuaa

SEQ ID NO: 2126618 - RNA, 19 nt, Staphylococcus aureus subsp. aureus N315
aucauuauucgcaucucca

SEQ ID NO: 2126619 - RNA, 22 nt, Staphylococcus aureus subsp. aureus N315
aucauggcuuauacacuuacaa

SEQ ID NO: 2126620 - RNA, 22 nt, Staphylococcus aureus subsp. aureus N315
aucauuaaaucugauucauuaa

SEQ ID NO: 2126621 - RNA, 15 nt, Staphylococcus aureus subsp. aureus N315
aucaugugacauaac

SEQ ID NO: 2126622 - RNA, 21 nt, Staphylococcus aureus subsp. aureus N315
auccaugugguucauuagcau

SEQ ID NO: 2126623 - RNA, 15 nt, Staphylococcus aureus subsp. aureus N315
auccugccaauauau

SEQ ID NO: 2126624 - RNA, 14 nt, Staphylococcus aureus subsp. aureus N315
aucaucgccagcau

SEQ ID NO: 2126625 - RNA, 16 nt, Staphylococcus aureus subsp. aureus N315
aucaugccuucaugaa

SEQ ID NO: 2126626 - RNA, 21 nt, Staphylococcus aureus subsp. aureus N315
aucaguuguguaauaaagcaa

SEQ ID NO: 2126627 - RNA, 20 nt, Staphylococcus aureus subsp. aureus N315
aucaaguuuacgaucauaaa

SEQ ID NO: 2126628 - RNA, 20 nt, Staphylococcus aureus subsp. aureus N315
aucaaucguuaauuuccaau

SEQ ID NO: 2126629 - RNA, 16 nt, Staphylococcus aureus subsp. aureus N315
auauuucuaaaccauu

SEQ ID NO: 2126630 - RNA, 20 nt, Staphylococcus aureus subsp. aureus N315
auauuuagauuggucaaacu

SEQ ID NO: 2126631 - RNA, 14 nt, Staphylococcus aureus subsp. aureus N315
auauuuaacauuuu

SEQ ID NO: 2126632 - RNA, 12 nt, Staphylococcus aureus subsp. aureus N315
aucaaaaguuug

SEQ ID NO: 2126633 - RNA, 23 nt, Staphylococcus aureus subsp. aureus N315
auauuuucugcgauauagcuuug

SEQ ID NO: 2126634 - RNA, 16 nt, Staphylococcus aureus subsp. aureus N315
auauucauucuagcau

SEQ ID NO: 2126635 - RNA, 16 nt, Staphylococcus aureus subsp. aureus N315
auaugauuaaagcgau

SEQ ID NO: 2126636 - RNA, 16 nt, Staphylococcus aureus subsp. aureus N315
auaugacacauacacc

SEQ ID NO: 2126637 - RNA, 17 nt, Staphylococcus aureus subsp. aureus N315
auaugaguuacaugguu

SEQ ID NO: 2126638 - RNA, 20 nt, Staphylococcus aureus subsp. aureus N315
auaugaauuuagaugcauaa

SEQ ID NO: 2126639 - RNA, 12 nt, Staphylococcus aureus subsp. aureus N315
auaucuuauaac

SEQ ID NO: 2126640 - RNA, 22 nt, Staphylococcus aureus subsp. aureus N315
auaucaacauguuccgcuacaa

SEQ ID NO: 2126641 - RNA, 14 nt, Staphylococcus aureus subsp. aureus N315
auaucaagauguuu

SEQ ID NO: 2126642 - RNA, 21 nt, Staphylococcus aureus subsp. aureus N315
auauauuaaaacaaugaggau

SEQ ID NO: 2126643 - RNA, 18 nt, Staphylococcus aureus subsp. aureus N315
auauaguggugguacuuu

SEQ ID NO: 2126644 - RNA, 19 nt, Staphylococcus aureus subsp. aureus N315
auauauagauuaaaccgca

SEQ ID NO: 2126645 - RNA, 20 nt, Staphylococcus aureus subsp. aureus N315
auacaggaaauugaagcguu

SEQ ID NO: 2126646 - RNA, 21 nt, Staphylococcus aureus subsp. aureus N315
auacagaucucaauccaauua

SEQ ID NO: 2126647 - RNA, 13 nt, Staphylococcus aureus subsp. aureus N315
auagcucaauuga

SEQ ID NO: 2126648 - RNA, 16 nt, Staphylococcus aureus subsp. aureus N315
auacacuuacaaauau

SEQ ID NO: 2126649 - RNA, 22 nt, Staphylococcus aureus subsp. aureus N315
auaauuaauuuguccauccauu

SEQ ID NO: 2126650 - RNA, 15 nt, Staphylococcus aureus subsp. aureus N315
auaauucagaugaau

SEQ ID NO: 2126651 - RNA, 12 nt, Staphylococcus aureus subsp. aureus N315
auaauuaaacua

SEQ ID NO: 2126652 - RNA, 13 nt, Staphylococcus aureus subsp. aureus N315
auaauguuuccau

SEQ ID NO: 2126653 - RNA, 14 nt, Staphylococcus aureus subsp. aureus N315
auaauggacgguau

SEQ ID NO: 2126654 - RNA, 21 nt, Staphylococcus aureus subsp. aureus N315
auaauccgagucauacucauc

SEQ ID NO: 2126655 - RNA, 19 nt, Staphylococcus aureus subsp. aureus N315
auaaauuuugaauuacaga

SEQ ID NO: 2126656 - RNA, 15 nt, Staphylococcus aureus subsp. aureus N315
auaaauuagaugaaa

SEQ ID NO: 2126657 - RNA, 20 nt, Staphylococcus aureus subsp. aureus N315
auaaaugcuaaaaguauaaa

SEQ ID NO: 2126658 - RNA, 17 nt, Staphylococcus aureus subsp. aureus N315
auaaauuuuuaguuaaa

SEQ ID NO: 2126659 - RNA, 19 nt, Staphylococcus aureus subsp. aureus N315
auaaaaaucuuaugauguc

SEQ ID NO: 2126660 - RNA, 19 nt, Staphylococcus aureus subsp. aureus N315
auaaaaacucuaaaaguug

SEQ ID NO: 2126661 - RNA, 17 nt, Staphylococcus aureus subsp. aureus N315
auaaauauugaacaauu

SEQ ID NO: 2126662 - RNA, 17 nt, Staphylococcus aureus subsp. aureus N315
auaaauagagaacagca

SEQ ID NO: 2126663 - RNA, 19 nt, Staphylococcus aureus subsp. aureus N315
auaaaucuaauacuuucaa

SEQ ID NO: 2126664 - RNA, 22 nt, Staphylococcus aureus subsp. aureus N315
auaaaucauuaguuguaucagu

SEQ ID NO: 2126665 - RNA, 13 nt, Staphylococcus aureus subsp. aureus N315
auaaaaugcuaca

SEQ ID NO: 2126666 - RNA, 16 nt, Staphylococcus aureus subsp. aureus N315
auaaaaucaucuuaac

SEQ ID NO: 2126667 - RNA, 13 nt, Staphylococcus aureus subsp. aureus N315
auaaaaucauaac

SEQ ID NO: 2126668 - RNA, 14 nt, Staphylococcus aureus subsp. aureus N315
agugcaauuauuuc

SEQ ID NO: 2126669 - RNA, 17 nt, Staphylococcus aureus subsp. aureus N315
aguguuuuauagauuca

SEQ ID NO: 2126670 - RNA, 17 nt, Staphylococcus aureus subsp. aureus N315
aguguuuaugaaagucu

SEQ ID NO: 2126671 - RNA, 23 nt, Staphylococcus aureus subsp. aureus N315
aguuaaaucuuuaacuucugauu

SEQ ID NO: 2126672 - RNA, 21 nt, Staphylococcus aureus subsp. aureus N315
aguuaauaaacgcuucauagu

SEQ ID NO: 2126673 - RNA, 14 nt, Staphylococcus aureus subsp. aureus N315
aguguuuaaaugcu

SEQ ID NO: 2126674 - RNA, 21 nt, Staphylococcus aureus subsp. aureus N315
aguuacgcucaucuaaaauga

SEQ ID NO: 2126675 - RNA, 15 nt, Staphylococcus aureus subsp. aureus N315
agucgacaugauucu

SEQ ID NO: 2126676 - RNA, 20 nt, Staphylococcus aureus subsp. aureus N315
aguccuucuuugaaaucaau

SEQ ID NO: 2126677 - RNA, 14 nt, Staphylococcus aureus subsp. aureus N315
agucaugucccaua

SEQ ID NO: 2126678 - RNA, 23 nt, Staphylococcus aureus subsp. aureus N315
agucauugcaaaugcaauaggau

SEQ ID NO: 2126679 - RNA, 21 nt, Staphylococcus aureus subsp. aureus N315
aguaaugcuguacuauauuca

SEQ ID NO: 2126680 - RNA, 14 nt, Staphylococcus aureus subsp. aureus N315
agguauaaucauuu

SEQ ID NO: 2126681 - RNA, 17 nt, Staphylococcus aureus subsp. aureus N315
agguaauaaagcugauu

SEQ ID NO: 2126682 - RNA, 17 nt, Staphylococcus aureus subsp. aureus N315
agggaguaccaagaaau

SEQ ID NO: 2126683 - RNA, 20 nt, Staphylococcus aureus subsp. aureus N315
auuaauuuguccauccauuu

SEQ ID NO: 2126684 - RNA, 15 nt, Staphylococcus aureus subsp. aureus N315
auuaauuaucauaaa

SEQ ID NO: 2126685 - RNA, 15 nt, Staphylococcus aureus subsp. aureus N315
auuacaaaucaugac

SEQ ID NO: 2126686 - RNA, 16 nt, Staphylococcus aureus subsp. aureus N315
auuacccuuuaaacuc

SEQ ID NO: 2126687 - RNA, 22 nt, Staphylococcus aureus subsp. aureus N315
auuauuaggcggccaguccauu

SEQ ID NO: 2126688 - RNA, 16 nt, Staphylococcus aureus subsp. aureus N315
auuauuauuacaauga

SEQ ID NO: 2126689 - RNA, 18 nt, Staphylococcus aureus subsp. aureus N315
auucacgacuugauagca

SEQ ID NO: 2126690 - RNA, 18 nt, Staphylococcus aureus subsp. aureus N315
auucaccuaucaacgauu

SEQ ID NO: 2126691 - RNA, 14 nt, Staphylococcus aureus subsp. aureus N315
auucacgauauaac

SEQ ID NO: 2126692 - RNA, 15 nt, Staphylococcus aureus subsp. aureus N315
auucaccaauuaggu

SEQ ID NO: 2126693 - RNA, 15 nt, Staphylococcus aureus subsp. aureus N315
auuauuacaaugaaa

SEQ ID NO: 2126694 - RNA, 14 nt, Staphylococcus aureus subsp. aureus N315
auuauguagcuuug

SEQ ID NO: 2126695 - RNA, 22 nt, Staphylococcus aureus subsp. aureus N315
auuauggagcggaagauaggau

SEQ ID NO: 2126696 - RNA, 21 nt, Staphylococcus aureus subsp. aureus N315
auuaugacaacauaacaaaga

SEQ ID NO: 2126697 - RNA, 21 nt, Staphylococcus aureus subsp. aureus N315
auuaucuaacucauaaucaac

SEQ ID NO: 2126698 - RNA, 17 nt, Staphylococcus aureus subsp. aureus N315
auuaucuacuauuuguu

SEQ ID NO: 2126699 - RNA, 17 nt, Staphylococcus aureus subsp. aureus N315
auuagcaauuuggucau

SEQ ID NO: 2126700 - RNA, 22 nt, Staphylococcus aureus subsp. aureus N315
auuacucuggucugugauauuc

SEQ ID NO: 2126701 - RNA, 20 nt, Staphylococcus aureus subsp. aureus N315
auuacuccaauuaccaauga

SEQ ID NO: 2126702 - RNA, 15 nt, Staphylococcus aureus subsp. aureus N315
auucccaaagcgaau

SEQ ID NO: 2126703 - RNA, 23 nt, Staphylococcus aureus subsp. aureus N315
auuuccaucauuuguguaaauga

SEQ ID NO: 2126704 - RNA, 15 nt, Staphylococcus aureus subsp. aureus N315
auuuccuauuaggau

SEQ ID NO: 2126705 - RNA, 15 nt, Staphylococcus aureus subsp. aureus N315
auuucagcauuugcu

SEQ ID NO: 2126706 - RNA, 17 nt, Staphylococcus aureus subsp. aureus N315
auuucauuuaugcgauu

SEQ ID NO: 2126707 - RNA, 15 nt, Staphylococcus aureus subsp. aureus N315
auuucaugugucaca

SEQ ID NO: 2126708 - RNA, 19 nt, Staphylococcus aureus subsp. aureus N315
auuucaugugucacaauga

SEQ ID NO: 2126709 - RNA, 21 nt, Staphylococcus aureus subsp. aureus N315
auuuauaacgacguaauccuu

SEQ ID NO: 2126710 - RNA, 22 nt, Staphylococcus aureus subsp. aureus N315
auuuauacuauaaauacaaaua

SEQ ID NO: 2126711 - RNA, 12 nt, Staphylococcus aureus subsp. aureus N315
auuuaaucuauu

SEQ ID NO: 2126712 - RNA, 20 nt, Staphylococcus aureus subsp. aureus N315
auuuaauuuuucuaaaugau

SEQ ID NO: 2126713 - RNA, 20 nt, Staphylococcus aureus subsp. aureus N315
auuuaucugcaaaaugcauu

SEQ ID NO: 2126714 - RNA, 22 nt, Staphylococcus aureus subsp. aureus N315
auuuaucaccuuuaggcaaaua

SEQ ID NO: 2126715 - RNA, 19 nt, Staphylococcus aureus subsp. aureus N315
auuucagaaauacauccau

SEQ ID NO: 2126716 - RNA, 22 nt, Staphylococcus aureus subsp. aureus N315
auuucaccaguagucacuguuu

SEQ ID NO: 2126717 - RNA, 17 nt, Staphylococcus aureus subsp. aureus N315
auuucaagguauacaca

SEQ ID NO: 2126718 - RNA, 15 nt, Staphylococcus aureus subsp. aureus N315
auugugaaaucuauu

SEQ ID NO: 2126719 - RNA, 22 nt, Staphylococcus aureus subsp. aureus N315
auuguauuguuuucaucaugca

SEQ ID NO: 2126720 - RNA, 12 nt, Staphylococcus aureus subsp. aureus N315
auuggcagauag

SEQ ID NO: 2126721 - RNA, 15 nt, Staphylococcus aureus subsp. aureus N315
auugcgguuggcucu

SEQ ID NO: 2126722 - RNA, 18 nt, Staphylococcus aureus subsp. aureus N315
auuuuaggcaauguaaug

SEQ ID NO: 2126723 - RNA, 23 nt, Staphylococcus aureus subsp. aureus N315
auuuucaaauuucuaacuuguuu

SEQ ID NO: 2126724 - RNA, 22 nt, Staphylococcus aureus subsp. aureus N315
auuuucaaagacguacaugcuu

SEQ ID NO: 2126725 - RNA, 14 nt, Staphylococcus aureus subsp. aureus N315
auuuucaaauuucu

SEQ ID NO: 2126726 - RNA, 20 nt, Staphylococcus aureus subsp. aureus N315
auuuuauugaguaucaugcu

SEQ ID NO: 2126727 - RNA, 16 nt, Staphylococcus aureus subsp. aureus N315
auuuuaugauuugauu

SEQ ID NO: 2126728 - RNA, 23 nt, Staphylococcus aureus subsp. aureus N315
auuuuauauauccuguuucauau

SEQ ID NO: 2126729 - RNA, 21 nt, Staphylococcus aureus subsp. aureus N315
auuuuagucgucgaaaugccu

SEQ ID NO: 2126730 - RNA, 23 nt, Staphylococcus aureus subsp. aureus N315
auuuucuugccaucaauuucugu

SEQ ID NO: 2126731 - RNA, 19 nt, Staphylococcus aureus subsp. aureus N315
auuuuaaacaugaacaauc

SEQ ID NO: 2126732 - RNA, 17 nt, Staphylococcus aureus subsp. aureus N315
auuuggaggugaugaga

SEQ ID NO: 2126733 - RNA, 12 nt, Staphylococcus aureus subsp. aureus N315
caaaagaugaaa

SEQ ID NO: 2126734 - RNA, 17 nt, Staphylococcus aureus subsp. aureus N315
caaaacgcauuucaugu

SEQ ID NO: 2126735 - RNA, 22 nt, Staphylococcus aureus subsp. aureus N315
caaaaccgcuauaaaauuuuga

SEQ ID NO: 2126736 - RNA, 20 nt, Staphylococcus aureus subsp. aureus N315
caaaaauacuccuuucauac

SEQ ID NO: 2126737 - RNA, 12 nt, Staphylococcus aureus subsp. aureus N315
caaaaaauugua

SEQ ID NO: 2126738 - RNA, 13 nt, Staphylococcus aureus subsp. aureus N315
auuuuuaucaucu

SEQ ID NO: 2126739 - RNA, 17 nt, Staphylococcus aureus subsp. aureus N315
auuuuuacuaaaucauu

SEQ ID NO: 2126740 - RNA, 22 nt, Staphylococcus aureus subsp. aureus N315
auuuuguaauggcuauucgauu

SEQ ID NO: 2126741 - RNA, 22 nt, Staphylococcus aureus subsp. aureus N315
auuuuuauauaaaauuucauau

SEQ ID NO: 2126742 - RNA, 18 nt, Staphylococcus aureus subsp. aureus N315
auuuuuuagacaaauguu

SEQ ID NO: 2126743 - RNA, 17 nt, Staphylococcus aureus subsp. aureus N315
caacacguuuuaagcca

SEQ ID NO: 2126744 - RNA, 15 nt, Staphylococcus aureus subsp. aureus N315
caaauuauuaacgca

SEQ ID NO: 2126745 - RNA, 15 nt, Staphylococcus aureus subsp. aureus N315
caaauucaacuuuaa

SEQ ID NO: 2126746 - RNA, 18 nt, Staphylococcus aureus subsp. aureus N315
caaauguugaauguggaa

SEQ ID NO: 2126747 - RNA, 19 nt, Staphylococcus aureus subsp. aureus N315
caaauguucagguucaaaa

SEQ ID NO: 2126748 - RNA, 13 nt, Staphylococcus aureus subsp. aureus N315
caacaauugcuaa

SEQ ID NO: 2126749 - RNA, 17 nt, Staphylococcus aureus subsp. aureus N315
caaauuuaggcauguca

SEQ ID NO: 2126750 - RNA, 14 nt, Staphylococcus aureus subsp. aureus N315
caaauugugauuua

SEQ ID NO: 2126751 - RNA, 20 nt, Staphylococcus aureus subsp. aureus N315
caaagaaccacgcaucaugu

SEQ ID NO: 2126752 - RNA, 13 nt, Staphylococcus aureus subsp. aureus N315
caaaguagacauu

SEQ ID NO: 2126753 - RNA, 19 nt, Staphylococcus aureus subsp. aureus N315
caaaguaauaugagugaaa

SEQ ID NO: 2126754 - RNA, 16 nt, Staphylococcus aureus subsp. aureus N315
caaaauauacuaaauu

SEQ ID NO: 2126755 - RNA, 19 nt, Staphylococcus aureus subsp. aureus N315
caaacauuccucuauugua

SEQ ID NO: 2126756 - RNA, 15 nt, Staphylococcus aureus subsp. aureus N315
augacaucaauaucu

SEQ ID NO: 2126757 - RNA, 13 nt, Staphylococcus aureus subsp. aureus N315
augaaggcuuuga

SEQ ID NO: 2126758 - RNA, 16 nt, Staphylococcus aureus subsp. aureus N315
augaaagcaucuugca

SEQ ID NO: 2126759 - RNA, 22 nt, Staphylococcus aureus subsp. aureus N315
augaaaugucugccaaaccuuu

SEQ ID NO: 2126760 - RNA, 18 nt, Staphylococcus aureus subsp. aureus N315
augaaaauaccucuacau

SEQ ID NO: 2126761 - RNA, 15 nt, Staphylococcus aureus subsp. aureus N315
aucuugguucagcuu

SEQ ID NO: 2126762 - RNA, 24 nt, Staphylococcus aureus subsp. aureus N315
aucuuuaaucaaaggaucauguuc

SEQ ID NO: 2126763 - RNA, 17 nt, Staphylococcus aureus subsp. aureus N315
augcacuuuaacauaac

SEQ ID NO: 2126764 - RNA, 21 nt, Staphylococcus aureus subsp. aureus N315
augcaucaacagauacuucag

SEQ ID NO: 2126765 - RNA, 19 nt, Staphylococcus aureus subsp. aureus N315
augauucuuuauaagcuuu

SEQ ID NO: 2126766 - RNA, 20 nt, Staphylococcus aureus subsp. aureus N315
aucguuaauuuccaauaucu

SEQ ID NO: 2126767 - RNA, 20 nt, Staphylococcus aureus subsp. aureus N315
augcugcaagucucauaucu

SEQ ID NO: 2126768 - RNA, 14 nt, Staphylococcus aureus subsp. aureus N315
auguauugcuauaa

SEQ ID NO: 2126769 - RNA, 18 nt, Staphylococcus aureus subsp. aureus N315
auguaacguuucuuugua

SEQ ID NO: 2126770 - RNA, 13 nt, Staphylococcus aureus subsp. aureus N315
auguaugcuugua

SEQ ID NO: 2126771 - RNA, 19 nt, Staphylococcus aureus subsp. aureus N315
auguauaucgacaccauuu

SEQ ID NO: 2126772 - RNA, 20 nt, Staphylococcus aureus subsp. aureus N315
auguauguuuuaucaauauu

SEQ ID NO: 2126773 - RNA, 15 nt, Staphylococcus aureus subsp. aureus N315
augguucguccauuc

SEQ ID NO: 2126774 - RNA, 20 nt, Staphylococcus aureus subsp. aureus N315
augguuuucuuuuucuauac

SEQ ID NO: 2126775 - RNA, 19 nt, Staphylococcus aureus subsp. aureus N315
augcccaaccacgauaucu

SEQ ID NO: 2126776 - RNA, 16 nt, Staphylococcus aureus subsp. aureus N315
caaguuuauaaucuuu

SEQ ID NO: 2126777 - RNA, 13 nt, Staphylococcus aureus subsp. aureus N315
caaguugaucaaa

SEQ ID NO: 2126778 - RNA, 20 nt, Staphylococcus aureus subsp. aureus N315
caagugucaaauacguauca

SEQ ID NO: 2126779 - RNA, 19 nt, Staphylococcus aureus subsp. aureus N315
caaguuaugcugucaaaca

SEQ ID NO: 2126780 - RNA, 14 nt, Staphylococcus aureus subsp. aureus N315
caauaauaugccau

SEQ ID NO: 2126781 - RNA, 16 nt, Staphylococcus aureus subsp. aureus N315
caauaacaggugcuua

SEQ ID NO: 2126782 - RNA, 17 nt, Staphylococcus aureus subsp. aureus N315
caacuuagaauuuacaa

SEQ ID NO: 2126783 - RNA, 19 nt, Staphylococcus aureus subsp. aureus N315
caacuugcacacuauugua

SEQ ID NO: 2126784 - RNA, 13 nt, Staphylococcus aureus subsp. aureus N315
caacuuuucauau

SEQ ID NO: 2126785 - RNA, 21 nt, Staphylococcus aureus subsp. aureus N315
caagauuggcugugcuauaau

SEQ ID NO: 2126786 - RNA, 12 nt, Staphylococcus aureus subsp. aureus N315
caagauuccauc

SEQ ID NO: 2126787 - RNA, 16 nt, Staphylococcus aureus subsp. aureus N315
caaugugagauauaaa

SEQ ID NO: 2126788 - RNA, 20 nt, Staphylococcus aureus subsp. aureus N315
caauuguugcaaaauacgau

SEQ ID NO: 2126789 - RNA, 19 nt, Staphylococcus aureus subsp. aureus N315
caauacgaaguuucauguu

SEQ ID NO: 2126790 - RNA, 23 nt, Staphylococcus aureus subsp. aureus N315
caaucauuguaaaugaucaucgu

SEQ ID NO: 2126791 - RNA, 20 nt, Staphylococcus aureus subsp. aureus N315
caaugaggauuguguaauga

SEQ ID NO: 2126792 - RNA, 23 nt, Staphylococcus aureus subsp. aureus N315
caccaacuuuuuuaacagcugca

SEQ ID NO: 2126793 - RNA, 14 nt, Staphylococcus aureus subsp. aureus N315
cagacuccuaaauu

SEQ ID NO: 2126794 - RNA, 21 nt, Staphylococcus aureus subsp. aureus N315
aaagacugaaccguauaaugc

SEQ ID NO: 2126795 - RNA, 12 nt, Staphylococcus aureus subsp. aureus N315
cacuucguauug

SEQ ID NO: 2126796 - RNA, 21 nt, Staphylococcus aureus subsp. aureus N315
cagaaauuuaauauuguuaau

SEQ ID NO: 2126797 - RNA, 22 nt, Staphylococcus aureus subsp. aureus N315
cagcauuaccagcaauuucgau

SEQ ID NO: 2126798 - RNA, 22 nt, Staphylococcus aureus subsp. aureus N315
caucuaaccuuuucaucaguug

SEQ ID NO: 2126799 - RNA, 18 nt, Staphylococcus aureus subsp. aureus N315
caucuaaauaguuuuuca

SEQ ID NO: 2126800 - RNA, 19 nt, Staphylococcus aureus subsp. aureus N315
caucuugagauuuucaaca

SEQ ID NO: 2126801 - RNA, 21 nt, Staphylococcus aureus subsp. aureus N315
caucuuuaagcccuuccccua

SEQ ID NO: 2126802 - RNA, 20 nt, Staphylococcus aureus subsp. aureus N315
caugauaaaguauguuguca

SEQ ID NO: 2126803 - RNA, 16 nt, Staphylococcus aureus subsp. aureus N315
caugacagcaucauca

SEQ ID NO: 2126804 - RNA, 24 nt, Staphylococcus aureus subsp. aureus N315
cauaaugaacaagggccauccauu

SEQ ID NO: 2126805 - RNA, 17 nt, Staphylococcus aureus subsp. aureus N315
cauaacuagcaauuuga

SEQ ID NO: 2126806 - RNA, 21 nt, Staphylococcus aureus subsp. aureus N315
cauaacaauuuuguugcauga

SEQ ID NO: 2126807 - RNA, 13 nt, Staphylococcus aureus subsp. aureus N315
cauacguaucaaa

SEQ ID NO: 2126808 - RNA, 15 nt, Staphylococcus aureus subsp. aureus N315
cauacuucguuguca

SEQ ID NO: 2126809 - RNA, 15 nt, Staphylococcus aureus subsp. aureus N315
cauauguaauacaaa

SEQ ID NO: 2126810 - RNA, 18 nt, Staphylococcus aureus subsp. aureus N315
cauagauaauugcuauaa

SEQ ID NO: 2126811 - RNA, 14 nt, Staphylococcus aureus subsp. aureus N315
cauagaccuaugaa

SEQ ID NO: 2126812 - RNA, 23 nt, Staphylococcus aureus subsp. aureus N315
cauauuuugccucaauaucuuua

SEQ ID NO: 2126813 - RNA, 15 nt, Staphylococcus aureus subsp. aureus N315
caucacgauauguug

SEQ ID NO: 2126814 - RNA, 21 nt, Staphylococcus aureus subsp. aureus N315
cauccaugugguucauuagca

SEQ ID NO: 2126815 - RNA, 17 nt, Staphylococcus aureus subsp. aureus N315
caguauguggauacaaa

SEQ ID NO: 2126816 - RNA, 17 nt, Staphylococcus aureus subsp. aureus N315
aaaucuucaagugccau

SEQ ID NO: 2126817 - RNA, 14 nt, Staphylococcus aureus subsp. aureus N315
aaaucuucuccaau

SEQ ID NO: 2126818 - RNA, 16 nt, Staphylococcus aureus subsp. aureus N315
aaaucucuguauugag

SEQ ID NO: 2126819 - RNA, 16 nt, Staphylococcus aureus subsp. aureus N315
aaaucuuuuagcuuuu

SEQ ID NO: 2126820 - RNA, 23 nt, Staphylococcus aureus subsp. aureus N315
aaaugaauguuaagacauaugca

SEQ ID NO: 2126821 - RNA, 14 nt, Staphylococcus aureus subsp. aureus N315
ccauugcacuaugc

SEQ ID NO: 2126822 - RNA, 22 nt, Staphylococcus aureus subsp. aureus N315
aaaucgauacuaauaucuucuu

SEQ ID NO: 2126823 - RNA, 15 nt, Staphylococcus aureus subsp. aureus N315
aaauccuuaaaugga

SEQ ID NO: 2126824 - RNA, 15 nt, Staphylococcus aureus subsp. aureus N315
aaagggaauggauua

SEQ ID NO: 2126825 - RNA, 20 nt, Staphylococcus aureus subsp. aureus N315
aaagcuguaguuucaacuuu

SEQ ID NO: 2126826 - RNA, 19 nt, Staphylococcus aureus subsp. aureus N315
aaagcuccagucauuuguu

SEQ ID NO: 2126827 - RNA, 23 nt, Staphylococcus aureus subsp. aureus N315
ccacaaguggaacgggauuuuga

SEQ ID NO: 2126828 - RNA, 13 nt, Staphylococcus aureus subsp. aureus N315
aaaucaucauaac

SEQ ID NO: 2126829 - RNA, 22 nt, Staphylococcus aureus subsp. aureus N315
aaaucacuugguaaaacaucgu

SEQ ID NO: 2126830 - RNA, 16 nt, Staphylococcus aureus subsp. aureus N315
aaaucauucauuugca

SEQ ID NO: 2126831 - RNA, 19 nt, Staphylococcus aureus subsp. aureus N315
cgaucaaauuuaauaauac

SEQ ID NO: 2126832 - RNA, 23 nt, Staphylococcus aureus subsp. aureus N315
cgaucaaauuuaauaauaccauc

SEQ ID NO: 2126833 - RNA, 14 nt, Staphylococcus aureus subsp. aureus N315
cgauuaaaugaugc

SEQ ID NO: 2126834 - RNA, 19 nt, Staphylococcus aureus subsp. aureus N315
cgauuauauacuaguucaa

SEQ ID NO: 2126835 - RNA, 18 nt, Staphylococcus aureus subsp. aureus N315
cgccauuguccaacugcu

SEQ ID NO: 2126836 - RNA, 16 nt, Staphylococcus aureus subsp. aureus N315
aacaacuaagauauau

SEQ ID NO: 2126837 - RNA, 21 nt, Staphylococcus aureus subsp. aureus N315
cgaauucaacgaaagugauuu

SEQ ID NO: 2126838 - RNA, 16 nt, Staphylococcus aureus subsp. aureus N315
cgauaucuaagucgau

SEQ ID NO: 2126839 - RNA, 19 nt, Staphylococcus aureus subsp. aureus N315
cgauaucagcuaaguuaaa

SEQ ID NO: 2126840 - RNA, 16 nt, Staphylococcus aureus subsp. aureus N315
aacacaguacaaauaa

SEQ ID NO: 2126841 - RNA, 21 nt, Staphylococcus aureus subsp. aureus N315
ccucuguuuuguugguguuua

SEQ ID NO: 2126842 - RNA, 13 nt, Staphylococcus aureus subsp. aureus N315
aaauuuaccaguu

SEQ ID NO: 2126843 - RNA, 14 nt, Staphylococcus aureus subsp. aureus N315
aaauuuaauaauac

SEQ ID NO: 2126844 - RNA, 21 nt, Staphylococcus aureus subsp. aureus N315
aaauuguaugaauaauauggu

SEQ ID NO: 2126845 - RNA, 14 nt, Staphylococcus aureus subsp. aureus N315
aacauauaaaucau

SEQ ID NO: 2126846 - RNA, 13 nt, Staphylococcus aureus subsp. aureus N315
aaccacgauaucu

SEQ ID NO: 2126847 - RNA, 16 nt, Staphylococcus aureus subsp. aureus N315
aaccacgcaucaugua

SEQ ID NO: 2126848 - RNA, 22 nt, Staphylococcus aureus subsp. aureus N315
aaccacuuuuuuguucaaucac

SEQ ID NO: 2126849 - RNA, 19 nt, Staphylococcus aureus subsp. aureus N315
aaccaacuuucucaaguaa

SEQ ID NO: 2126850 - RNA, 19 nt, Staphylococcus aureus subsp. aureus N315
aaccagcuaaaccaucugu

SEQ ID NO: 2126851 - RNA, 14 nt, Staphylococcus aureus subsp. aureus N315
cgcuucuaacucac

SEQ ID NO: 2126852 - RNA, 15 nt, Staphylococcus aureus subsp. aureus N315
cggaauacagaugau

SEQ ID NO: 2126853 - RNA, 21 nt, Staphylococcus aureus subsp. aureus N315
cgcuuuuuuuuauaaguuaaa

SEQ ID NO: 2126854 - RNA, 18 nt, Staphylococcus aureus subsp. aureus N315
gucuaugucaaauugaac

SEQ ID NO: 2126855 - RNA, 14 nt, Staphylococcus aureus subsp. aureus N315
gucuggcacauuac

SEQ ID NO: 2126856 - RNA, 15 nt, Staphylococcus aureus subsp. aureus N315
gucauaaaauaccag

SEQ ID NO: 2126857 - RNA, 14 nt, Staphylococcus aureus subsp. aureus N315
guacguuugcauau

SEQ ID NO: 2126858 - RNA, 15 nt, Staphylococcus aureus subsp. aureus N315
guaacuaaaaugucu

SEQ ID NO: 2126859 - RNA, 18 nt, Staphylococcus aureus subsp. aureus N315
aagucugcugguaacucu

SEQ ID NO: 2126860 - RNA, 18 nt, Staphylococcus aureus subsp. aureus N315
aagucucuugucauuuca

SEQ ID NO: 2126861 - RNA, 16 nt, Staphylococcus aureus subsp. aureus N315
guauaagaaucagcua

SEQ ID NO: 2126862 - RNA, 16 nt, Staphylococcus aureus subsp. aureus N315
ggaugugacaaauacu

SEQ ID NO: 2126863 - RNA, 13 nt, Staphylococcus aureus subsp. aureus N315
gcuucgucuuuau

SEQ ID NO: 2126864 - RNA, 23 nt, Staphylococcus aureus subsp. aureus N315
gcuuguacgauaacuacacuuaa

SEQ ID NO: 2126865 - RNA, 15 nt, Staphylococcus aureus subsp. aureus N315
gcuuuauuuuaucau

SEQ ID NO: 2126866 - RNA, 17 nt, Staphylococcus aureus subsp. aureus N315
gcuuuuuuuauggugug

SEQ ID NO: 2126867 - RNA, 20 nt, Staphylococcus aureus subsp. aureus N315
gcuuuguuuuucacuguuaa

SEQ ID NO: 2126868 - RNA, 12 nt, Staphylococcus aureus subsp. aureus N315
gcugcaacauuc

SEQ ID NO: 2126869 - RNA, 21 nt, Staphylococcus aureus subsp. aureus N315
gcugaaguuugaacaacaucu

SEQ ID NO: 2126870 - RNA, 17 nt, Staphylococcus aureus subsp. aureus N315
gcuccagucauuuguug

SEQ ID NO: 2126871 - RNA, 20 nt, Staphylococcus aureus subsp. aureus N315
aagcgauuuccaucauuugu

SEQ ID NO: 2126872 - RNA, 14 nt, Staphylococcus aureus subsp. aureus N315
gccuaggaguaucu

SEQ ID NO: 2126873 - RNA, 22 nt, Staphylococcus aureus subsp. aureus N315
gccgucuccauauuuguagccu

SEQ ID NO: 2126874 - RNA, 18 nt, Staphylococcus aureus subsp. aureus N315
gaaauuuuuaauauaccc

SEQ ID NO: 2126875 - RNA, 20 nt, Staphylococcus aureus subsp. aureus N315
gaaaugauaagaaucaucua

SEQ ID NO: 2126876 - RNA, 15 nt, Staphylococcus aureus subsp. aureus N315
gaaacaucuugauau

SEQ ID NO: 2126877 - RNA, 18 nt, Staphylococcus aureus subsp. aureus N315
gaaaaugacgauacguau

SEQ ID NO: 2126878 - RNA, 19 nt, Staphylococcus aureus subsp. aureus N315
gaaaauaagcaucacauau

SEQ ID NO: 2126879 - RNA, 21 nt, Staphylococcus aureus subsp. aureus N315
cuuuuuuuguuuauuuagaau

SEQ ID NO: 2126880 - RNA, 17 nt, Staphylococcus aureus subsp. aureus N315
cuuuuuuguuauugcuu

SEQ ID NO: 2126881 - RNA, 15 nt, Staphylococcus aureus subsp. aureus N315
cuuuuauuuucauaa

SEQ ID NO: 2126882 - RNA, 16 nt, Staphylococcus aureus subsp. aureus N315
cuuuuaugcaugcgca

SEQ ID NO: 2126883 - RNA, 13 nt, Staphylococcus aureus subsp. aureus N315
cuuuuaugcaugc

SEQ ID NO: 2126884 - RNA, 15 nt, Staphylococcus aureus subsp. aureus N315
cuuuuguaauugaaa

SEQ ID NO: 2126885 - RNA, 17 nt, Staphylococcus aureus subsp. aureus N315
cuuuuuauaccaauaau

SEQ ID NO: 2126886 - RNA, 20 nt, Staphylococcus aureus subsp. aureus N315
cuuucgcagcuucuuuaaca

SEQ ID NO: 2126887 - RNA, 21 nt, Staphylococcus aureus subsp. aureus N315
cuuggaaguaucugugaauau

SEQ ID NO: 2126888 - RNA, 13 nt, Staphylococcus aureus subsp. aureus N315
cuucuaaaucaau

SEQ ID NO: 2126889 - RNA, 21 nt, Staphylococcus aureus subsp. aureus N315
cuuuaugcaaaauuaaugaac

SEQ ID NO: 2126890 - RNA, 13 nt, Staphylococcus aureus subsp. aureus N315
cuuuaucaauaau

SEQ ID NO: 2126891 - RNA, 19 nt, Staphylococcus aureus subsp. aureus N315
cuuuaauuuuaccaucaau

SEQ ID NO: 2126892 - RNA, 17 nt, Staphylococcus aureus subsp. aureus N315
cuuguccuaacgcuaau

SEQ ID NO: 2126893 - RNA, 21 nt, Staphylococcus aureus subsp. aureus N315
cuuaaguaagauuuaaacauc

SEQ ID NO: 2126894 - RNA, 15 nt, Staphylococcus aureus subsp. aureus N315
cuuaaucaagcuagc

SEQ ID NO: 2126895 - RNA, 16 nt, Staphylococcus aureus subsp. aureus N315
cuuaaaaacaauauug

SEQ ID NO: 2126896 - RNA, 16 nt, Staphylococcus aureus subsp. aureus N315
cuuaaauagugcuuuu

SEQ ID NO: 2126897 - RNA, 23 nt, Staphylococcus aureus subsp. aureus N315
cuuaucgccuggugcaggcauca

SEQ ID NO: 2126898 - RNA, 19 nt, Staphylococcus aureus subsp. aureus N315
cuguauagcuggcuuuuua

SEQ ID NO: 2126899 - RNA, 22 nt, Staphylococcus aureus subsp. aureus N315
cuguaucaaaaucgguuugauu

SEQ ID NO: 2126900 - RNA, 14 nt, Staphylococcus aureus subsp. aureus N315
cuucaagugccauu

SEQ ID NO: 2126901 - RNA, 23 nt, Staphylococcus aureus subsp. aureus N315
cuucaaguuggugugcaauuaau

SEQ ID NO: 2126902 - RNA, 16 nt, Staphylococcus aureus subsp. aureus N315
cuucaauccaagcaau

SEQ ID NO: 2126903 - RNA, 15 nt, Staphylococcus aureus subsp. aureus N315
cuucaguacgguuau

SEQ ID NO: 2126904 - RNA, 20 nt, Staphylococcus aureus subsp. aureus N315
cuuccaauuuaaaaugauuc

SEQ ID NO: 2126905 - RNA, 20 nt, Staphylococcus aureus subsp. aureus N315
gacauagguauaaucauuua

SEQ ID NO: 2126906 - RNA, 21 nt, Staphylococcus aureus subsp. aureus N315
gacacuauaccauuuuuauag

SEQ ID NO: 2126907 - RNA, 12 nt, Staphylococcus aureus subsp. aureus N315
gaaucacauuaa

SEQ ID NO: 2126908 - RNA, 21 nt, Staphylococcus aureus subsp. aureus N315
gaauaauuggcugaugaacuu

SEQ ID NO: 2126909 - RNA, 20 nt, Staphylococcus aureus subsp. aureus N315
gaauaacguuggaaacuucu

SEQ ID NO: 2126910 - RNA, 13 nt, Staphylococcus aureus subsp. aureus N315
gaauaacacuaga

SEQ ID NO: 2126911 - RNA, 22 nt, Staphylococcus aureus subsp. aureus N315
gaauuuaggaaugaauaaagcu

SEQ ID NO: 2126912 - RNA, 14 nt, Staphylococcus aureus subsp. aureus N315
gacaaguaugucau

SEQ ID NO: 2126913 - RNA, 20 nt, Staphylococcus aureus subsp. aureus N315
aacgauaguaguacacgaau

SEQ ID NO: 2126914 - RNA, 13 nt, Staphylococcus aureus subsp. aureus N315
cuauauaguaaaa

SEQ ID NO: 2126915 - RNA, 23 nt, Staphylococcus aureus subsp. aureus N315
cuauccaaagacauacagucaau

SEQ ID NO: 2126916 - RNA, 15 nt, Staphylococcus aureus subsp. aureus N315
cuaguucagcuucua

SEQ ID NO: 2126917 - RNA, 16 nt, Staphylococcus aureus subsp. aureus N315
cuagauuuuaaacgcu

SEQ ID NO: 2126918 - RNA, 17 nt, Staphylococcus aureus subsp. aureus N315
cuaucuguaccguauuu

SEQ ID NO: 2126919 - RNA, 18 nt, Staphylococcus aureus subsp. aureus N315
cucaaguaacucaaguga

SEQ ID NO: 2126920 - RNA, 19 nt, Staphylococcus aureus subsp. aureus N315
cucacuuggccuaaguuau

SEQ ID NO: 2126921 - RNA, 19 nt, Staphylococcus aureus subsp. aureus N315
cucuauauauccauucaau

SEQ ID NO: 2126922 - RNA, 12 nt, Staphylococcus aureus subsp. aureus N315
cucuuuaaacuc

SEQ ID NO: 2126923 - RNA, 18 nt, Staphylococcus aureus subsp. aureus N315
cugauauugaucugauuu

SEQ ID NO: 2126924 - RNA, 20 nt, Staphylococcus aureus subsp. aureus N315
cugaguauaccaauugcuga

SEQ ID NO: 2126925 - RNA, 12 nt, Staphylococcus aureus subsp. aureus N315
cugcagucgcuu

SEQ ID NO: 2126926 - RNA, 24 nt, Staphylococcus aureus subsp. aureus N315
cugccauucuuuuucucaauguga

SEQ ID NO: 2126927 - RNA, 21 nt, Staphylococcus aureus subsp. aureus N315
cguuauuuucaauauuugaua

SEQ ID NO: 2126928 - RNA, 21 nt, Staphylococcus aureus subsp. aureus N315
cguguuugaauguuuuugaua

SEQ ID NO: 2126929 - RNA, 13 nt, Staphylococcus aureus subsp. aureus N315
cguauauguaauc

SEQ ID NO: 2126930 - RNA, 17 nt, Staphylococcus aureus subsp. aureus N315
cgguuugaaaaauggug

SEQ ID NO: 2126931 - RNA, 17 nt, Staphylococcus aureus subsp. aureus N315
aacugcuuuuuauuaug

SEQ ID NO: 2126932 - RNA, 20 nt, Staphylococcus aureus subsp. aureus N315
gauuuaauaucacgaucuuu

SEQ ID NO: 2126933 - RNA, 22 nt, Staphylococcus aureus subsp. aureus N315
gauuuaacaaccucugauacuu

SEQ ID NO: 2126934 - RNA, 23 nt, Staphylococcus aureus subsp. aureus N315
gcaaacgcacuaucaaugacauc

SEQ ID NO: 2126935 - RNA, 21 nt, Staphylococcus aureus subsp. aureus N315
gcaaauuaucauuaaauugcu

SEQ ID NO: 2126936 - RNA, 15 nt, Staphylococcus aureus subsp. aureus N315
aacuucuuuuuugua

SEQ ID NO: 2126937 - RNA, 14 nt, Staphylococcus aureus subsp. aureus N315
aacuucuaacaccu

SEQ ID NO: 2126938 - RNA, 15 nt, Staphylococcus aureus subsp. aureus N315
gauaacaaaacgauu

SEQ ID NO: 2126939 - RNA, 14 nt, Staphylococcus aureus subsp. aureus N315
gauaccaaacugcc

SEQ ID NO: 2126940 - RNA, 17 nt, Staphylococcus aureus subsp. aureus N315
gauauggcguauucacc

SEQ ID NO: 2126941 - RNA, 16 nt, Staphylococcus aureus subsp. aureus N315
aagaaauauauugucg

SEQ ID NO: 2126942 - RNA, 13 nt, Staphylococcus aureus subsp. aureus N315
gcaggaaugauau

SEQ ID NO: 2126943 - RNA, 19 nt, Staphylococcus aureus subsp. aureus N315
aacuuuaguauauucaaca

SEQ ID NO: 2126944 - RNA, 19 nt, Staphylococcus aureus subsp. aureus N315
aacuuuaauuuuucauuaa

SEQ ID NO: 2126945 - RNA, 19 nt, Staphylococcus aureus subsp. aureus N315
aacuuuaaaaauuaaguaa

SEQ ID NO: 2126946 - RNA, 17 nt, Staphylococcus aureus subsp. aureus N315
aacuuguauuguuugua

SEQ ID NO: 2126947 - RNA, 21 nt, Staphylococcus aureus subsp. aureus N315
aacuuuucaaacaauacaguu

SEQ ID NO: 2126948 - RNA, 13 nt, Staphylococcus aureus subsp. aureus N315
aacuuuucaaaca

SEQ ID NO: 2126949 - RNA, 20 nt, Staphylococcus aureus subsp. aureus N315
aacuuuuauugccauaaagu

SEQ ID NO: 2126950 - RNA, 18 nt, Staphylococcus aureus subsp. aureus N315
gcacuuaauaagucagcu

SEQ ID NO: 2126951 - RNA, 22 nt, Staphylococcus aureus subsp. aureus N315
gcaacauauuuucacaaucaua

SEQ ID NO: 2126952 - RNA, 15 nt, Staphylococcus aureus subsp. aureus N315
aagauguauaugaau

SEQ ID NO: 2126953 - RNA, 16 nt, Staphylococcus aureus subsp. aureus N315
aagauguguugaaacu

SEQ ID NO: 2126954 - RNA, 14 nt, Staphylococcus aureus subsp. aureus N315
aagauuauuauuac

SEQ ID NO: 2126955 - RNA, 17 nt, Staphylococcus aureus subsp. aureus N315
aagauuagaugauauuu

SEQ ID NO: 2126956 - RNA, 19 nt, Staphylococcus aureus subsp. aureus N315
aagauuauuugcgauauca

SEQ ID NO: 2126957 - RNA, 21 nt, Staphylococcus aureus subsp. aureus N315
aagauuauuugcgauaucagc

SEQ ID NO: 2126958 - RNA, 15 nt, Staphylococcus aureus subsp. aureus N315
aagauucaacuuguu

SEQ ID NO: 2126959 - RNA, 17 nt, Staphylococcus aureus subsp. aureus N315
aagcaacauaugauuug

SEQ ID NO: 2126960 - RNA, 14 nt, Staphylococcus aureus subsp. aureus N315
gccaugauacgaug

SEQ ID NO: 2126961 - RNA, 18 nt, Staphylococcus aureus subsp. aureus N315
gcccacaccccaacuugc

SEQ ID NO: 2126962 - RNA, 16 nt, Staphylococcus aureus subsp. aureus N315
acuuaaugcuucaaau

SEQ ID NO: 2126963 - RNA, 18 nt, Staphylococcus aureus subsp. aureus N315
acuguugacauuugacca

SEQ ID NO: 2126964 - RNA, 16 nt, Staphylococcus aureus subsp. aureus N315
acuaugaauagaugau

SEQ ID NO: 2126965 - RNA, 21 nt, Staphylococcus aureus subsp. aureus N315
acugaagacaccuuaucacuu

SEQ ID NO: 2126966 - RNA, 17 nt, Staphylococcus aureus subsp. aureus N315
acugccauauagauauu

SEQ ID NO: 2126967 - RNA, 21 nt, Staphylococcus aureus subsp. aureus N315
agaauucucuauucacgaaau

SEQ ID NO: 2126968 - RNA, 18 nt, Staphylococcus aureus subsp. aureus N315
agaauuucgaaaagaaau

SEQ ID NO: 2126969 - RNA, 21 nt, Staphylococcus aureus subsp. aureus N315
agaaauucgaaaagaaauucu

SEQ ID NO: 2126970 - RNA, 13 nt, Staphylococcus aureus subsp. aureus N315
agaaauacuugaa

SEQ ID NO: 2126971 - RNA, 22 nt, Staphylococcus aureus subsp. aureus N315
agaaauguuaacgauagacauu

SEQ ID NO: 2126972 - RNA, 21 nt, Staphylococcus aureus subsp. aureus N315
acuuuuuauuaguauucaaaa

SEQ ID NO: 2126973 - RNA, 15 nt, Staphylococcus aureus subsp. aureus N315
acuuuuuaacugcca

SEQ ID NO: 2126974 - RNA, 17 nt, Staphylococcus aureus subsp. aureus N315
agauuaaaaaaucauuc

SEQ ID NO: 2126975 - RNA, 18 nt, Staphylococcus aureus subsp. aureus N315
agaucauuaaaaacgauu

SEQ ID NO: 2126976 - RNA, 22 nt, Staphylococcus aureus subsp. aureus N315
agauaggauuugcaccuauacc

SEQ ID NO: 2126977 - RNA, 17 nt, Staphylococcus aureus subsp. aureus N315
agacuuauucaacguau

SEQ ID NO: 2126978 - RNA, 21 nt, Staphylococcus aureus subsp. aureus N315
agaauuuuaauuaauuaucau

SEQ ID NO: 2126979 - RNA, 22 nt, Staphylococcus aureus subsp. aureus N315
acgcugucucauuaauguaagc

SEQ ID NO: 2126980 - RNA, 19 nt, Staphylococcus aureus subsp. aureus N315
acuaaaaguguuaugaauu

SEQ ID NO: 2126981 - RNA, 14 nt, Staphylococcus aureus subsp. aureus N315
acguucauggauuc

SEQ ID NO: 2126982 - RNA, 18 nt, Staphylococcus aureus subsp. aureus N315
acuaaucguuguggcuuu

SEQ ID NO: 2126983 - RNA, 13 nt, Staphylococcus aureus subsp. aureus N315
acuaaaucauuuu

SEQ ID NO: 2126984 - RNA, 21 nt, Staphylococcus aureus subsp. aureus N315
acuaacguaaaggugauauuu

SEQ ID NO: 2126985 - RNA, 15 nt, Staphylococcus aureus subsp. aureus N315
acuacaguguaugau

SEQ ID NO: 2126986 - RNA, 23 nt, Staphylococcus aureus subsp. aureus N315
acguauauacgauugaguugaaa

SEQ ID NO: 2126987 - RNA, 17 nt, Staphylococcus aureus subsp. aureus N315
acggcguauucaauugu

SEQ ID NO: 2126988 - RNA, 17 nt, Staphylococcus aureus subsp. aureus N315
aaaauuauuugauauuu

SEQ ID NO: 2126989 - RNA, 15 nt, Staphylococcus aureus subsp. aureus N315
aaaauucuggauuaa

SEQ ID NO: 2126990 - RNA, 22 nt, Staphylococcus aureus subsp. aureus N315
aaaauauuacuaacaaccguuu

SEQ ID NO: 2126991 - RNA, 20 nt, Staphylococcus aureus subsp. aureus N315
accaugcugcacauuccauc

SEQ ID NO: 2126992 - RNA, 19 nt, Staphylococcus aureus subsp. aureus N315
accucuuuuguuuaguaug

SEQ ID NO: 2126993 - RNA, 21 nt, Staphylococcus aureus subsp. aureus N315
accguuaguacggcugcuuua

SEQ ID NO: 2126994 - RNA, 16 nt, Staphylococcus aureus subsp. aureus N315
accuaaucugcaacga

SEQ ID NO: 2126995 - RNA, 18 nt, Staphylococcus aureus subsp. aureus N315
accuacaaauauguaauc

SEQ ID NO: 2126996 - RNA, 19 nt, Staphylococcus aureus subsp. aureus N315
accuacuuuuucaauaugu

SEQ ID NO: 2126997 - RNA, 21 nt, Staphylococcus aureus subsp. aureus N315
acgaaaaaugccaacuauacc

SEQ ID NO: 2126998 - RNA, 11 nt, Staphylococcus aureus subsp. aureus N315
acgaacugcau

SEQ ID NO: 2126999 - RNA, 14 nt, Staphylococcus aureus subsp. aureus N315
acgaguauuaucac

SEQ ID NO: 2127000 - RNA, 23 nt, Staphylococcus aureus subsp. aureus N315
aaacacacuaaaagcugauguga

SEQ ID NO: 2127001 - RNA, 23 nt, Staphylococcus aureus subsp. aureus N315
aaacaauacguuuucggauugaa

SEQ ID NO: 2127002 - RNA, 13 nt, Staphylococcus aureus subsp. aureus N315
acgauaauuauac

SEQ ID NO: 2127003 - RNA, 20 nt, Staphylococcus aureus subsp. aureus N315
acgauaacagcuacaaauaa

SEQ ID NO: 2127004 - RNA, 13 nt, Staphylococcus aureus subsp. aureus N315
acgcaauaucaua

SEQ ID NO: 2127005 - RNA, 11 nt, Staphylococcus aureus subsp. aureus N315
aagacagaaau

SEQ ID NO: 2127006 - RNA, 13 nt, Staphylococcus aureus subsp. aureus N315
aagaauaaauguu

SEQ ID NO: 2127007 - RNA, 20 nt, Staphylococcus aureus subsp. aureus N315
aagaacgaagaaugauacug

SEQ ID NO: 2127008 - RNA, 22 nt, Staphylococcus aureus subsp. aureus N315
aacugucgcucauccucauuaa

SEQ ID NO: 2127009 - RNA, 16 nt, Staphylococcus aureus subsp. aureus N315
aacuugcgccugcuaa

SEQ ID NO: 2127010 - RNA, 22 nt, Staphylococcus aureus subsp. aureus N315
aacuugagcuauucauagaccu

SEQ ID NO: 2127011 - RNA, 15 nt, Staphylococcus aureus subsp. aureus N315
aacuucuauuaagaa

SEQ ID NO: 2127012 - RNA, 15 nt, Staphylococcus aureus subsp. aureus N315
aacuuccaacauaua

SEQ ID NO: 2127013 - RNA, 15 nt, Staphylococcus aureus subsp. aureus N315
aacugauaauugaug

SEQ ID NO: 2127014 - RNA, 18 nt, Staphylococcus aureus subsp. aureus N315
aacugaccuaacaauuug

SEQ ID NO: 2127015 - RNA, 21 nt, Staphylococcus aureus subsp. aureus N315
aacuaucuacaccauuaucgc

SEQ ID NO: 2127016 - RNA, 22 nt, Staphylococcus aureus subsp. aureus N315
aaccuauuuuuuauaugaugaa

SEQ ID NO: 2127017 - RNA, 18 nt, Staphylococcus aureus subsp. aureus N315
aauauugaagaugcuuua

SEQ ID NO: 2127018 - RNA, 19 nt, Staphylococcus aureus subsp. aureus N315
aauauugaugaauaaauag

SEQ ID NO: 2127019 - RNA, 16 nt, Staphylococcus aureus subsp. aureus N315
aauauuggacuuugcu

SEQ ID NO: 2127020 - RNA, 18 nt, Staphylococcus aureus subsp. aureus N315
aauauuuaaauuuuaagu

SEQ ID NO: 2127021 - RNA, 18 nt, Staphylococcus aureus subsp. aureus N315
aauauuuaccacaaauau

SEQ ID NO: 2127022 - RNA, 22 nt, Staphylococcus aureus subsp. aureus N315
aauauucguagcaugacauuaa

SEQ ID NO: 2127023 - RNA, 15 nt, Staphylococcus aureus subsp. aureus N315
aauaugcccccuaau

SEQ ID NO: 2127024 - RNA, 16 nt, Staphylococcus aureus subsp. aureus N315
aauaugagauuaucug

SEQ ID NO: 2127025 - RNA, 12 nt, Staphylococcus aureus subsp. aureus N315
aauaugauauua

SEQ ID NO: 2127026 - RNA, 17 nt, Staphylococcus aureus subsp. aureus N315
aauaugaguuacauggu

SEQ ID NO: 2127027 - RNA, 18 nt, Staphylococcus aureus subsp. aureus N315
aauaugaguuacaugguu

SEQ ID NO: 2127028 - RNA, 16 nt, Staphylococcus aureus subsp. aureus N315
aaucaaccuuugcuaa

SEQ ID NO: 2127029 - RNA, 14 nt, Staphylococcus aureus subsp. aureus N315
aaucaacccaucau

SEQ ID NO: 2127030 - RNA, 17 nt, Staphylococcus aureus subsp. aureus N315
aaucaauccaucaauac

SEQ ID NO: 2127031 - RNA, 13 nt, Staphylococcus aureus subsp. aureus N315
aauauuuuaucug

SEQ ID NO: 2127032 - RNA, 21 nt, Staphylococcus aureus subsp. aureus N315
aauauaguaauaaaagucgau

SEQ ID NO: 2127033 - RNA, 21 nt, Staphylococcus aureus subsp. aureus N315
aauauaguggugguacuuuuu

SEQ ID NO: 2127034 - RNA, 22 nt, Staphylococcus aureus subsp. aureus N315
aauaucaauuuauuauuaacug

SEQ ID NO: 2127035 - RNA, 20 nt, Staphylococcus aureus subsp. aureus N315
aauaugacgaucuucaugaa

SEQ ID NO: 2127036 - RNA, 14 nt, Staphylococcus aureus subsp. aureus N315
aauaucuuuaauug

SEQ ID NO: 2127037 - RNA, 20 nt, Staphylococcus aureus subsp. aureus N315
aauaucaucaaguuuaucug

SEQ ID NO: 2127038 - RNA, 22 nt, Staphylococcus aureus subsp. aureus N315
aauauagcugugauuugaucaa

SEQ ID NO: 2127039 - RNA, 20 nt, Staphylococcus aureus subsp. aureus N315
aauauaauauacacaaaaag

SEQ ID NO: 2127040 - RNA, 14 nt, Staphylococcus aureus subsp. aureus N315
aauacuuuuuaacu

SEQ ID NO: 2127041 - RNA, 16 nt, Staphylococcus aureus subsp. aureus N315
aauacuaagauuagcu

SEQ ID NO: 2127042 - RNA, 14 nt, Staphylococcus aureus subsp. aureus N315
aauaaaucuaucua

SEQ ID NO: 2127043 - RNA, 14 nt, Staphylococcus aureus subsp. aureus N315
aauaaauacaauag

SEQ ID NO: 2127044 - RNA, 15 nt, Staphylococcus aureus subsp. aureus N315
aaguuguucaauugu

SEQ ID NO: 2127045 - RNA, 12 nt, Staphylococcus aureus subsp. aureus N315
aauaacauguuu

SEQ ID NO: 2127046 - RNA, 23 nt, Staphylococcus aureus subsp. aureus N315
aauaauaucaccuuuuuuaagau

SEQ ID NO: 2127047 - RNA, 17 nt, Staphylococcus aureus subsp. aureus N315
aauaaucauccauauau

SEQ ID NO: 2127048 - RNA, 18 nt, Staphylococcus aureus subsp. aureus N315
aauaauuggaaucaucuu

SEQ ID NO: 2127049 - RNA, 17 nt, Staphylococcus aureus subsp. aureus N315
aauaaugugucaaauag

SEQ ID NO: 2127050 - RNA, 19 nt, Staphylococcus aureus subsp. aureus N315
aaguguugaccauuaucaa

SEQ ID NO: 2127051 - RNA, 18 nt, Staphylococcus aureus subsp. aureus N315
aagugauuugccaaaagu

SEQ ID NO: 2127052 - RNA, 18 nt, Staphylococcus aureus subsp. aureus N315
aagugaguaacauuugcu

SEQ ID NO: 2127053 - RNA, 16 nt, Staphylococcus aureus subsp. aureus N315
aagucuguauauggcg

SEQ ID NO: 2127054 - RNA, 12 nt, Staphylococcus aureus subsp. aureus N315
aagugaaaucau

SEQ ID NO: 2127055 - RNA, 20 nt, Staphylococcus aureus subsp. aureus N315
acacuuggcuuaggaugaaa

SEQ ID NO: 2127056 - RNA, 15 nt, Staphylococcus aureus subsp. aureus N315
acacuugauuaucau

SEQ ID NO: 2127057 - RNA, 23 nt, Staphylococcus aureus subsp. aureus N315
acagagaauuucgaaaagaaauu

SEQ ID NO: 2127058 - RNA, 16 nt, Staphylococcus aureus subsp. aureus N315
aaaauaauaugaauuu

SEQ ID NO: 2127059 - RNA, 16 nt, Staphylococcus aureus subsp. aureus N315
aaaauacuauacugau

SEQ ID NO: 2127060 - RNA, 22 nt, Staphylococcus aureus subsp. aureus N315
aaaagucccgcuuaaaaugauu

SEQ ID NO: 2127061 - RNA, 17 nt, Staphylococcus aureus subsp. aureus N315
aaaaguguuuaaaugcu

SEQ ID NO: 2127062 - RNA, 18 nt, Staphylococcus aureus subsp. aureus N315
aaaaguuauauaaauuug

SEQ ID NO: 2127063 - RNA, 17 nt, Staphylococcus aureus subsp. aureus N315
acaccuucaauaucugu

SEQ ID NO: 2127064 - RNA, 19 nt, Staphylococcus aureus subsp. aureus N315
acaccacuuaggauaaacu

SEQ ID NO: 2127065 - RNA, 15 nt, Staphylococcus aureus subsp. aureus N315
aauuuaaaugcuuaa

SEQ ID NO: 2127066 - RNA, 19 nt, Staphylococcus aureus subsp. aureus N315
aauuguguuucuuucauag

SEQ ID NO: 2127067 - RNA, 19 nt, Staphylococcus aureus subsp. aureus N315
aauuguuagauaaucucau

SEQ ID NO: 2127068 - RNA, 14 nt, Staphylococcus aureus subsp. aureus N315
aauuguauuagcaa

SEQ ID NO: 2127069 - RNA, 19 nt, Staphylococcus aureus subsp. aureus N315
aauugggaaauauuugaaa

SEQ ID NO: 2127070 - RNA, 16 nt, Staphylococcus aureus subsp. aureus N315
aauuggaacacgaaau

SEQ ID NO: 2127071 - RNA, 19 nt, Staphylococcus aureus subsp. aureus N315
aauugcauacguaaauggu

SEQ ID NO: 2127072 - RNA, 20 nt, Staphylococcus aureus subsp. aureus N315
aauugcauacguaaauggua

SEQ ID NO: 2127073 - RNA, 21 nt, Staphylococcus aureus subsp. aureus N315
aauugaucagcauuuaagcua

SEQ ID NO: 2127074 - RNA, 23 nt, Staphylococcus aureus subsp. aureus N315
aauuaauacaucaauaucuucua

SEQ ID NO: 2127075 - RNA, 15 nt, Staphylococcus aureus subsp. aureus N315
aauuaaaucgauuaa

SEQ ID NO: 2127076 - RNA, 20 nt, Staphylococcus aureus subsp. aureus N315
aauuaaacauuuagauuuca

SEQ ID NO: 2127077 - RNA, 14 nt, Staphylococcus aureus subsp. aureus N315
aauuaaacuaauag

SEQ ID NO: 2127078 - RNA, 14 nt, Staphylococcus aureus subsp. aureus N315
aauucauucaauac

SEQ ID NO: 2127079 - RNA, 18 nt, Staphylococcus aureus subsp. aureus N315
aaugacuaaaucgacaua

SEQ ID NO: 2127080 - RNA, 18 nt, Staphylococcus aureus subsp. aureus N315
aaugaagaauacaaauau

SEQ ID NO: 2127081 - RNA, 15 nt, Staphylococcus aureus subsp. aureus N315
aaugaagaauacaaa

SEQ ID NO: 2127082 - RNA, 17 nt, Staphylococcus aureus subsp. aureus N315
aaucaccuuuuuuaacu

SEQ ID NO: 2127083 - RNA, 15 nt, Staphylococcus aureus subsp. aureus N315
aaucuuuuagcuuuu

SEQ ID NO: 2127084 - RNA, 21 nt, Staphylococcus aureus subsp. aureus N315
aaucuuguugaacucugauau

SEQ ID NO: 2127085 - RNA, 19 nt, Staphylococcus aureus subsp. aureus N315
aaugcaugcuucucaauuu

SEQ ID NO: 2127086 - RNA, 17 nt, Staphylococcus aureus subsp. aureus N315
aaugcaauacauuaaua

SEQ ID NO: 2127087 - RNA, 16 nt, Staphylococcus aureus subsp. aureus N315
acaaugaauuucuaau

SEQ ID NO: 2127088 - RNA, 15 nt, Staphylococcus aureus subsp. aureus N315
acaaugauuacuuua

SEQ ID NO: 2127089 - RNA, 16 nt, Staphylococcus aureus subsp. aureus N315
acaauuuucucauuaa

SEQ ID NO: 2127090 - RNA, 19 nt, Staphylococcus aureus subsp. aureus N315
acacaaugcccuuaaagca

SEQ ID NO: 2127091 - RNA, 22 nt, Staphylococcus aureus subsp. aureus N315
acaauugauugcucuaagcauu

SEQ ID NO: 2127092 - RNA, 21 nt, Staphylococcus aureus subsp. aureus N315
acaauaugaauuggauguaau

SEQ ID NO: 2127093 - RNA, 18 nt, Staphylococcus aureus subsp. aureus N315
acaaguuucgcagcuuua

SEQ ID NO: 2127094 - RNA, 14 nt, Staphylococcus aureus subsp. aureus N315
acaauaaagacaua

SEQ ID NO: 2127095 - RNA, 16 nt, Staphylococcus aureus subsp. aureus N315
acaagccaagauaaau

SEQ ID NO: 2127096 - RNA, 16 nt, Staphylococcus aureus subsp. aureus N315
acaaguaaaacgcauu

SEQ ID NO: 2127097 - RNA, 16 nt, Staphylococcus aureus subsp. aureus N315
acaagcuuuuuucaau

SEQ ID NO: 2127098 - RNA, 20 nt, Staphylococcus aureus subsp. aureus N315
acaaauauacuugccuucaa

SEQ ID NO: 2127099 - RNA, 16 nt, Staphylococcus aureus subsp. aureus N315
acaaauaacaaacauu

SEQ ID NO: 2127100 - RNA, 20 nt, Staphylococcus aureus subsp. aureus N315
acaaaggauuauuaacuuua

SEQ ID NO: 2127101 - RNA, 18 nt, Staphylococcus aureus subsp. aureus N315
acaaaaacaucuacauca

SEQ ID NO: 2127102 - RNA, 12 nt, Staphylococcus aureus subsp. aureus N315
aauuucgauuaa

SEQ ID NO: 2127103 - RNA, 16 nt, Staphylococcus aureus subsp. aureus N315
aauuucuuuaaagucu

SEQ ID NO: 2127104 - RNA, 21 nt, Staphylococcus aureus subsp. aureus N315
aauuuuuucaucauucaaacu

SEQ ID NO: 2127105 - RNA, 17 nt, Staphylococcus aureus subsp. aureus N315
acaacucguuuuuccau

SEQ ID NO: 2127106 - RNA, 13 nt, Staphylococcus aureus subsp. aureus N315
aaaucauaacgac

SEQ ID NO: 2127107 - RNA, 20 nt, Staphylococcus aureus subsp. aureus N315
aaauaagugauaaauaaugc

SEQ ID NO: 2127108 - RNA, 21 nt, Staphylococcus aureus subsp. aureus N315
aaauaauaauucauaaaugcu

SEQ ID NO: 2127109 - RNA, 12 nt, Staphylococcus aureus subsp. aureus N315
aaauaaccauuu

SEQ ID NO: 2127110 - RNA, 16 nt, Staphylococcus aureus subsp. aureus N315
aaauaaguaguucagc

SEQ ID NO: 2127111 - RNA, 14 nt, Staphylococcus aureus subsp. aureus N315
aaauaaaccaugcu

SEQ ID NO: 2127112 - RNA, 19 nt, Staphylococcus aureus subsp. aureus N315
aaaucauucauuugcaaag

SEQ ID NO: 2127113 - RNA, 12 nt, Staphylococcus aureus subsp. aureus N315
aaaacaacuugg

SEQ ID NO: 2127114 - RNA, 16 nt, Staphylococcus aureus subsp. aureus N315
aaaugucaguuuugaa

SEQ ID NO: 2127115 - RNA, 22 nt, Staphylococcus aureus subsp. aureus N315
aaauguuauuaaccaucaugac

SEQ ID NO: 2127116 - RNA, 22 nt, Staphylococcus aureus subsp. aureus N315
aaaugauaauuuaauaauguac

SEQ ID NO: 2127117 - RNA, 19 nt, Staphylococcus aureus subsp. aureus N315
aaaugcacgagcaacaucu

SEQ ID NO: 2127118 - RNA, 16 nt, Staphylococcus aureus subsp. aureus N315
aaaucgaauugaugga

SEQ ID NO: 2127119 - RNA, 18 nt, Staphylococcus aureus subsp. aureus N315
aacacauaaauuaagcau

SEQ ID NO: 2127120 - RNA, 22 nt, Staphylococcus aureus subsp. aureus N315
aacaauuuuaaaucuuuuagcu

SEQ ID NO: 2127121 - RNA, 15 nt, Staphylococcus aureus subsp. aureus N315
aacaaaagaaaguua

SEQ ID NO: 2127122 - RNA, 13 nt, Staphylococcus aureus subsp. aureus N315
aacaaauuuaacu

SEQ ID NO: 2127123 - RNA, 16 nt, Staphylococcus aureus subsp. aureus N315
aaauuuaaauauugaa

SEQ ID NO: 2127124 - RNA, 12 nt, Staphylococcus aureus subsp. aureus N315
aaauuuaaaugu

SEQ ID NO: 2127125 - RNA, 16 nt, Staphylococcus aureus subsp. aureus N315
aaaacuaucugauuaa

SEQ ID NO: 2127126 - RNA, 16 nt, Staphylococcus aureus subsp. aureus N315
aaauuaaaaauuucgc

SEQ ID NO: 2127127 - RNA, 13 nt, Staphylococcus aureus subsp. aureus N315
aaaugucauuuga

SEQ ID NO: 2127128 - RNA, 12 nt, Staphylococcus aureus subsp. aureus N315
aaaccuaacaua

SEQ ID NO: 2127129 - RNA, 15 nt, Staphylococcus aureus subsp. aureus N315
aaaccuaaucuacca

SEQ ID NO: 2127130 - RNA, 14 nt, Staphylococcus aureus subsp. aureus N315
aaacaaugauggga

SEQ ID NO: 2127131 - RNA, 14 nt, Staphylococcus aureus subsp. aureus N315
aaacacaguacaaa

SEQ ID NO: 2127132 - RNA, 15 nt, Staphylococcus aureus subsp. aureus N315
aaacaacaucgauuu

SEQ ID NO: 2127133 - RNA, 12 nt, Staphylococcus aureus subsp. aureus N315
aaacaacaucac

SEQ ID NO: 2127134 - RNA, 15 nt, Staphylococcus aureus subsp. aureus N315
aaaauugcuauauua

SEQ ID NO: 2127135 - RNA, 18 nt, Staphylococcus aureus subsp. aureus N315
aaaauuugaauugacuua

SEQ ID NO: 2127136 - RNA, 16 nt, Staphylococcus aureus subsp. aureus N315
aaaauuugugcauuca

SEQ ID NO: 2127137 - RNA, 18 nt, Staphylococcus aureus subsp. aureus N315
aaaauuugugcauucauc

SEQ ID NO: 2127138 - RNA, 13 nt, Staphylococcus aureus subsp. aureus N315
aaacaguguagca

SEQ ID NO: 2127139 - RNA, 15 nt, Staphylococcus aureus subsp. aureus N315
aaacauccaauuaug

SEQ ID NO: 2127140 - RNA, 14 nt, Staphylococcus aureus subsp. aureus N315
aaacauagaugcuu

SEQ ID NO: 2127141 - RNA, 17 nt, Staphylococcus aureus subsp. aureus N315
aaacauuaaucuauaua

SEQ ID NO: 2127142 - RNA, 18 nt, Staphylococcus aureus subsp. aureus N315
aaagggcgaaauggauuc

SEQ ID NO: 2127143 - RNA, 14 nt, Staphylococcus aureus subsp. aureus N315
aaagaacuaacaua

SEQ ID NO: 2127144 - RNA, 13 nt, Staphylococcus aureus subsp. aureus N315
aaaaagaucauua

SEQ ID NO: 2127145 - RNA, 16 nt, Staphylococcus aureus subsp. aureus N315
aaaagauauaaacauu

SEQ ID NO: 2127146 - RNA, 19 nt, Staphylococcus aureus subsp. aureus N315
aaaaauugcaaugcuauca

SEQ ID NO: 2127147 - RNA, 22 nt, Staphylococcus aureus subsp. aureus N315
aaaauuauuuggcucuauauca

SEQ ID NO: 2127148 - RNA, 12 nt, Staphylococcus aureus subsp. aureus N315
aaaaaaugaugc

SEQ ID NO: 2127149 - RNA, 17 nt, Staphylococcus aureus subsp. aureus N315
aaaaugaagaauacaaa

SEQ ID NO: 2127150 - RNA, 13 nt, Staphylococcus aureus subsp. aureus N315
aaaaucugcuuua

SEQ ID NO: 2127151 - RNA, 20 nt, Staphylococcus aureus subsp. aureus N315
aaaaucguuauaaguacaaa

SEQ ID NO: 2127152 - RNA, 20 nt, Staphylococcus aureus subsp. aureus N315
aaaaucucgacacuauacca

SEQ ID NO: 2127153 - RNA, 19 nt, Staphylococcus aureus subsp. aureus N315
aaaaugauagcuaaacauu

SEQ ID NO: 2127154 - RNA, 13 nt, Staphylococcus aureus subsp. aureus N315
aaaagccaccuau

SEQ ID NO: 2127155 - RNA, 15 nt, Staphylococcus aureus subsp. aureus N315
aaaagccaacacauu

SEQ ID NO: 2127156 - RNA, 19 nt, Staphylococcus aureus subsp. aureus N315
aaaagaucgcugccauuaa

SEQ ID NO: 2127157 - RNA, 19 nt, Staphylococcus aureus subsp. aureus N315
aaaaguguugacuuuauca

SEQ ID NO: 2127158 - RNA, 21 nt, Staphylococcus aureus subsp. aureus N315
aaaaucaaauugacgcauuaa

SEQ ID NO: 2127159 - RNA, 17 nt, Staphylococcus aureus subsp. aureus N315
aaaauaacuaagugaau

SEQ ID NO: 2127160 - RNA, 15 nt, Staphylococcus aureus subsp. aureus N315
aaaauaauagauaau

SEQ ID NO: 2127161 - RNA, 19 nt, Staphylococcus aureus subsp. aureus N315
aaaauagaaagaaauuguu

SEQ ID NO: 2127162 - RNA, 11 nt, Staphylococcus aureus subsp. aureus N315
uuuuuuuaaag

SEQ ID NO: 2127163 - RNA, 15 nt, Staphylococcus aureus subsp. aureus N315
uuuuucauauucaca

SEQ ID NO: 2127164 - RNA, 19 nt, Staphylococcus aureus subsp. aureus N315
uuuuucauaauuaauaaca

SEQ ID NO: 2127165 - RNA, 18 nt, Staphylococcus aureus subsp. aureus N315
uuuucgaacuuuuguucu

SEQ ID NO: 2127166 - RNA, 22 nt, Staphylococcus aureus subsp. aureus N315
uuuucagcuaauugucguucuu

SEQ ID NO: 2127167 - RNA, 16 nt, Staphylococcus aureus subsp. aureus N315
uuuucauauacuuaac

SEQ ID NO: 2127168 - RNA, 20 nt, Staphylococcus aureus subsp. aureus N315
uuuaccucuugauaaaauaa

SEQ ID NO: 2127169 - RNA, 22 nt, Staphylococcus aureus subsp. aureus N315
uuuaccuucgcauacuuuuuca

SEQ ID NO: 2127170 - RNA, 13 nt, Staphylococcus aureus subsp. aureus N315
uuuucaaagccac

SEQ ID NO: 2127171 - RNA, 16 nt, Staphylococcus aureus subsp. aureus N315
uuuucaaaacugccaa

SEQ ID NO: 2127172 - RNA, 16 nt, Staphylococcus aureus subsp. aureus N315
uuuucacgaauaucuu

SEQ ID NO: 2127173 - RNA, 14 nt, Staphylococcus aureus subsp. aureus N315
uuuucaaauuucua

SEQ ID NO: 2127174 - RNA, 22 nt, Staphylococcus aureus subsp. aureus N315
uuuucaaauugagcaguauuuu

SEQ ID NO: 2127175 - RNA, 18 nt, Staphylococcus aureus subsp. aureus N315
uuuucaacauaauauuuc

SEQ ID NO: 2127176 - RNA, 18 nt, Staphylococcus aureus subsp. aureus N315
uuuucaacaguuuuaaag

SEQ ID NO: 2127177 - RNA, 15 nt, Staphylococcus aureus subsp. aureus N315
uuuugagcaauaaug

SEQ ID NO: 2127178 - RNA, 21 nt, Staphylococcus aureus subsp. aureus N315
uuuugagcacuuaauaaguca

SEQ ID NO: 2127179 - RNA, 20 nt, Staphylococcus aureus subsp. aureus N315
uuuugacuguuaaacaaggu

SEQ ID NO: 2127180 - RNA, 12 nt, Staphylococcus aureus subsp. aureus N315
uuuugagauauu

SEQ ID NO: 2127181 - RNA, 12 nt, Staphylococcus aureus subsp. aureus N315
uuuucuuuuguu

SEQ ID NO: 2127182 - RNA, 18 nt, Staphylococcus aureus subsp. aureus N315
uuuugaauguuucuccua

SEQ ID NO: 2127183 - RNA, 19 nt, Staphylococcus aureus subsp. aureus N315
uuuugaaucauacgaauuu

SEQ ID NO: 2127184 - RNA, 21 nt, Staphylococcus aureus subsp. aureus N315
uuuugacaguuuuaaaugaaa

SEQ ID NO: 2127185 - RNA, 21 nt, Staphylococcus aureus subsp. aureus N315
uuuugcaucacagauaaugca

SEQ ID NO: 2127186 - RNA, 22 nt, Staphylococcus aureus subsp. aureus N315
uuuugcaucacagauaaugcau

SEQ ID NO: 2127187 - RNA, 14 nt, Staphylococcus aureus subsp. aureus N315
uuuugcaaaacgca

SEQ ID NO: 2127188 - RNA, 14 nt, Staphylococcus aureus subsp. aureus N315
uuuugcacuaaugg

SEQ ID NO: 2127189 - RNA, 17 nt, Staphylococcus aureus subsp. aureus N315
uuuucugccauaaacau

SEQ ID NO: 2127190 - RNA, 18 nt, Staphylococcus aureus subsp. aureus N315
uuuucuugguuugagaau

SEQ ID NO: 2127191 - RNA, 20 nt, Staphylococcus aureus subsp. aureus N315
uuuucuuuaucuauaugcau

SEQ ID NO: 2127192 - RNA, 22 nt, Staphylococcus aureus subsp. aureus N315
uuuucuuuauuuuaaacaugaa

SEQ ID NO: 2127193 - RNA, 20 nt, Staphylococcus aureus subsp. aureus N315
uuuuuaucuguagaaacacu

SEQ ID NO: 2127194 - RNA, 11 nt, Staphylococcus aureus subsp. aureus N315
uuuuuauauua

SEQ ID NO: 2127195 - RNA, 23 nt, Staphylococcus aureus subsp. aureus N315
uuuuuaucgaaagguauaucuuc

SEQ ID NO: 2127196 - RNA, 19 nt, Staphylococcus aureus subsp. aureus N315
uuuuuagguuauauuuaaa

SEQ ID NO: 2127197 - RNA, 22 nt, Staphylococcus aureus subsp. aureus N315
uuuuuaguuagaaaguauuuau

SEQ ID NO: 2127198 - RNA, 18 nt, Staphylococcus aureus subsp. aureus N315
uuuuuauaaguauucaua

SEQ ID NO: 2127199 - RNA, 19 nt, Staphylococcus aureus subsp. aureus N315
uuuuucaauuaaauguuua

SEQ ID NO: 2127200 - RNA, 14 nt, Staphylococcus aureus subsp. aureus N315
uuuuucaauucgcu

SEQ ID NO: 2127201 - RNA, 17 nt, Staphylococcus aureus subsp. aureus N315
uuuuucaaauaauauaa

SEQ ID NO: 2127202 - RNA, 15 nt, Staphylococcus aureus subsp. aureus N315
uuuuuauuauacacu

SEQ ID NO: 2127203 - RNA, 19 nt, Staphylococcus aureus subsp. aureus N315
uuuuuaauuuguauuuaaa

SEQ ID NO: 2127204 - RNA, 17 nt, Staphylococcus aureus subsp. aureus N315
uuuuuaauuuuaucucc

SEQ ID NO: 2127205 - RNA, 15 nt, Staphylococcus aureus subsp. aureus N315
uuuuuaauuuugaca

SEQ ID NO: 2127206 - RNA, 20 nt, Staphylococcus aureus subsp. aureus N315
uuuuuagacauuaaaaaauc

SEQ ID NO: 2127207 - RNA, 18 nt, Staphylococcus aureus subsp. aureus N315
uuuuuagccccagcaaau

SEQ ID NO: 2127208 - RNA, 16 nt, Staphylococcus aureus subsp. aureus N315
uuuuuaacugccauau

SEQ ID NO: 2127209 - RNA, 16 nt, Staphylococcus aureus subsp. aureus N315
uuuuuaauauauuuau

SEQ ID NO: 2127210 - RNA, 12 nt, Staphylococcus aureus subsp. aureus N315
uuuuuaauaauu

SEQ ID NO: 2127211 - RNA, 17 nt, Staphylococcus aureus subsp. aureus N315
uuuuuaaaugauuuaau

SEQ ID NO: 2127212 - RNA, 13 nt, Staphylococcus aureus subsp. aureus N315
uuuuuaaauuuaa

SEQ ID NO: 2127213 - RNA, 14 nt, Staphylococcus aureus subsp. aureus N315
uuuuuaaauuuaau

SEQ ID NO: 2127214 - RNA, 11 nt, Staphylococcus aureus subsp. aureus N315
uuuuuaaauac

SEQ ID NO: 2127215 - RNA, 18 nt, Staphylococcus aureus subsp. aureus N315
uuuugcguuuuuaaauaa

SEQ ID NO: 2127216 - RNA, 16 nt, Staphylococcus aureus subsp. aureus N315
uuuugcgaaaauauca

SEQ ID NO: 2127217 - RNA, 18 nt, Staphylococcus aureus subsp. aureus N315
uuuuggaacauauucaua

SEQ ID NO: 2127218 - RNA, 23 nt, Staphylococcus aureus subsp. aureus N315
uuuuguaauugaaaugauagaug

SEQ ID NO: 2127219 - RNA, 15 nt, Staphylococcus aureus subsp. aureus N315
uuuuguaaacauggu

SEQ ID NO: 2127220 - RNA, 20 nt, Staphylococcus aureus subsp. aureus N315
uuuuggucaaguaaauguuu

SEQ ID NO: 2127221 - RNA, 17 nt, Staphylococcus aureus subsp. aureus N315
uuuuuaaaaaauuuaaa

SEQ ID NO: 2127222 - RNA, 13 nt, Staphylococcus aureus subsp. aureus N315
uuuuguuaaaaaa

SEQ ID NO: 2127223 - RNA, 17 nt, Staphylococcus aureus subsp. aureus N315
uuuuguguucggaauuu

SEQ ID NO: 2127224 - RNA, 16 nt, Staphylococcus aureus subsp. aureus N315
uuuugugauuuuuaau

SEQ ID NO: 2127225 - RNA, 17 nt, Staphylococcus aureus subsp. aureus N315
uuuugugccuuucucua

SEQ ID NO: 2127226 - RNA, 17 nt, Staphylococcus aureus subsp. aureus N315
uuuuguaucucugaaaa

SEQ ID NO: 2127227 - RNA, 18 nt, Staphylococcus aureus subsp. aureus N315
uucguguuccaauuuuau

SEQ ID NO: 2127228 - RNA, 13 nt, Staphylococcus aureus subsp. aureus N315
uucuaaccacuuc

SEQ ID NO: 2127229 - RNA, 21 nt, Staphylococcus aureus subsp. aureus N315
uucuaacgguaaauaaccacu

SEQ ID NO: 2127230 - RNA, 17 nt, Staphylococcus aureus subsp. aureus N315
uucuaaccauucguaau

SEQ ID NO: 2127231 - RNA, 22 nt, Staphylococcus aureus subsp. aureus N315
uucgucuacuauuuuuucuaau

SEQ ID NO: 2127232 - RNA, 23 nt, Staphylococcus aureus subsp. aureus N315
uucguacuaguucgauucaugaa

SEQ ID NO: 2127233 - RNA, 19 nt, Staphylococcus aureus subsp. aureus N315
uucguacaucguugccauu

SEQ ID NO: 2127234 - RNA, 21 nt, Staphylococcus aureus subsp. aureus N315
uucguaauugucuuuauaaaa

SEQ ID NO: 2127235 - RNA, 16 nt, Staphylococcus aureus subsp. aureus N315
uucguaacauuuaaaa

SEQ ID NO: 2127236 - RNA, 19 nt, Staphylococcus aureus subsp. aureus N315
uucguaacauuuaaaaaau

SEQ ID NO: 2127237 - RNA, 22 nt, Staphylococcus aureus subsp. aureus N315
uucguaaaucgugucaaaugcc

SEQ ID NO: 2127238 - RNA, 19 nt, Staphylococcus aureus subsp. aureus N315
uucuaaugcugcuucuuca

SEQ ID NO: 2127239 - RNA, 17 nt, Staphylococcus aureus subsp. aureus N315
uucuaaugcuaauuuaa

SEQ ID NO: 2127240 - RNA, 20 nt, Staphylococcus aureus subsp. aureus N315
uucuaaugcuaauuuaacug

SEQ ID NO: 2127241 - RNA, 20 nt, Staphylococcus aureus subsp. aureus N315
uucuaaucguuaauaaaccu

SEQ ID NO: 2127242 - RNA, 13 nt, Staphylococcus aureus subsp. aureus N315
uucuaaucuaaau

SEQ ID NO: 2127243 - RNA, 15 nt, Staphylococcus aureus subsp. aureus N315
uucuaaguguuuuau

SEQ ID NO: 2127244 - RNA, 13 nt, Staphylococcus aureus subsp. aureus N315
uucuaagucucuu

SEQ ID NO: 2127245 - RNA, 19 nt, Staphylococcus aureus subsp. aureus N315
uucuaacugcaaagccaug

SEQ ID NO: 2127246 - RNA, 12 nt, Staphylococcus aureus subsp. aureus N315
uucuagguaaua

SEQ ID NO: 2127247 - RNA, 14 nt, Staphylococcus aureus subsp. aureus N315
uucuagugaaauac

SEQ ID NO: 2127248 - RNA, 14 nt, Staphylococcus aureus subsp. aureus N315
uucuagauucauau

SEQ ID NO: 2127249 - RNA, 19 nt, Staphylococcus aureus subsp. aureus N315
uucuagauucauauuuaua

SEQ ID NO: 2127250 - RNA, 21 nt, Staphylococcus aureus subsp. aureus N315
uucuccuucaauguucaauuc

SEQ ID NO: 2127251 - RNA, 13 nt, Staphylococcus aureus subsp. aureus N315
uucucauugaaau

SEQ ID NO: 2127252 - RNA, 15 nt, Staphylococcus aureus subsp. aureus N315
uucucauuauaauga

SEQ ID NO: 2127253 - RNA, 20 nt, Staphylococcus aureus subsp. aureus N315
uucuauacuuuuaauuguau

SEQ ID NO: 2127254 - RNA, 17 nt, Staphylococcus aureus subsp. aureus N315
uucucauuaaccuuaca

SEQ ID NO: 2127255 - RNA, 19 nt, Staphylococcus aureus subsp. aureus N315
uucucaucuauuuaauaau

SEQ ID NO: 2127256 - RNA, 20 nt, Staphylococcus aureus subsp. aureus N315
uucuauacauuccaaaguac

SEQ ID NO: 2127257 - RNA, 13 nt, Staphylococcus aureus subsp. aureus N315
uucuauacuuuua

SEQ ID NO: 2127258 - RNA, 16 nt, Staphylococcus aureus subsp. aureus N315
uucuauacauuccaaa

SEQ ID NO: 2127259 - RNA, 23 nt, Staphylococcus aureus subsp. aureus N315
uucuauacaaugaauuucuaauu

SEQ ID NO: 2127260 - RNA, 14 nt, Staphylococcus aureus subsp. aureus N315
uucuauaauuuuaa

SEQ ID NO: 2127261 - RNA, 16 nt, Staphylococcus aureus subsp. aureus N315
uucuguaauaauauca

SEQ ID NO: 2127262 - RNA, 19 nt, Staphylococcus aureus subsp. aureus N315
uucuuagauuuucacuaau

SEQ ID NO: 2127263 - RNA, 23 nt, Staphylococcus aureus subsp. aureus N315
uucuucaccaguuugugguaaug

SEQ ID NO: 2127264 - RNA, 19 nt, Staphylococcus aureus subsp. aureus N315
uucuucaaccauuuguucu

SEQ ID NO: 2127265 - RNA, 18 nt, Staphylococcus aureus subsp. aureus N315
uucuucaaccauuuguuc

SEQ ID NO: 2127266 - RNA, 15 nt, Staphylococcus aureus subsp. aureus N315
uucuucaacaauuuc

SEQ ID NO: 2127267 - RNA, 16 nt, Staphylococcus aureus subsp. aureus N315
uucuucaaaaaauaau

SEQ ID NO: 2127268 - RNA, 23 nt, Staphylococcus aureus subsp. aureus N315
uucuuauuuauucauaacguguu

SEQ ID NO: 2127269 - RNA, 14 nt, Staphylococcus aureus subsp. aureus N315
uucuugaaaaguuu

SEQ ID NO: 2127270 - RNA, 14 nt, Staphylococcus aureus subsp. aureus N315
uucuugauuguaaa

SEQ ID NO: 2127271 - RNA, 12 nt, Staphylococcus aureus subsp. aureus N315
uucuucaucuuu

SEQ ID NO: 2127272 - RNA, 20 nt, Staphylococcus aureus subsp. aureus N315
uucuucacugcuguuuuuau

SEQ ID NO: 2127273 - RNA, 14 nt, Staphylococcus aureus subsp. aureus N315
uucuucacuaaaaa

SEQ ID NO: 2127274 - RNA, 18 nt, Staphylococcus aureus subsp. aureus N315
uucuucacuaaaaauaua

SEQ ID NO: 2127275 - RNA, 20 nt, Staphylococcus aureus subsp. aureus N315
uucugaaacuuuaauacuac

SEQ ID NO: 2127276 - RNA, 21 nt, Staphylococcus aureus subsp. aureus N315
uucugaaaugauacauuauua

SEQ ID NO: 2127277 - RNA, 19 nt, Staphylococcus aureus subsp. aureus N315
uucucuaacuuuaccaaua

SEQ ID NO: 2127278 - RNA, 21 nt, Staphylococcus aureus subsp. aureus N315
uucucgauacaaaggauuauu

SEQ ID NO: 2127279 - RNA, 10 nt, Staphylococcus aureus subsp. aureus N315
uucugcuucu

SEQ ID NO: 2127280 - RNA, 20 nt, Staphylococcus aureus subsp. aureus N315
uucugcuguauggaaaguug

SEQ ID NO: 2127281 - RNA, 15 nt, Staphylococcus aureus subsp. aureus N315
uucugauuauguuca

SEQ ID NO: 2127282 - RNA, 19 nt, Staphylococcus aureus subsp. aureus N315
uugauuuggguaauguuuu

SEQ ID NO: 2127283 - RNA, 19 nt, Staphylococcus aureus subsp. aureus N315
uugcaaugcauauugugcc

SEQ ID NO: 2127284 - RNA, 18 nt, Staphylococcus aureus subsp. aureus N315
uugcaauggcaaccuuuu

SEQ ID NO: 2127285 - RNA, 20 nt, Staphylococcus aureus subsp. aureus N315
uugcaauugcaaugaauaac

SEQ ID NO: 2127286 - RNA, 16 nt, Staphylococcus aureus subsp. aureus N315
uugaucugauuucacu

SEQ ID NO: 2127287 - RNA, 13 nt, Staphylococcus aureus subsp. aureus N315
uugaucuuuuaua

SEQ ID NO: 2127288 - RNA, 20 nt, Staphylococcus aureus subsp. aureus N315
uugauucuucaccaguuugu

SEQ ID NO: 2127289 - RNA, 15 nt, Staphylococcus aureus subsp. aureus N315
uugauucuauuucuu

SEQ ID NO: 2127290 - RNA, 15 nt, Staphylococcus aureus subsp. aureus N315
uugauuuacgugcau

SEQ ID NO: 2127291 - RNA, 15 nt, Staphylococcus aureus subsp. aureus N315
uugauugauaugguu

SEQ ID NO: 2127292 - RNA, 15 nt, Staphylococcus aureus subsp. aureus N315
uugauugcaaaaaaa

SEQ ID NO: 2127293 - RNA, 16 nt, Staphylococcus aureus subsp. aureus N315
uugauugcaaaaaaac

SEQ ID NO: 2127294 - RNA, 14 nt, Staphylococcus aureus subsp. aureus N315
uugagacaacauug

SEQ ID NO: 2127295 - RNA, 19 nt, Staphylococcus aureus subsp. aureus N315
uugaguacuaaucaauacu

SEQ ID NO: 2127296 - RNA, 20 nt, Staphylococcus aureus subsp. aureus N315
uugaguacuaaucaauacua

SEQ ID NO: 2127297 - RNA, 14 nt, Staphylococcus aureus subsp. aureus N315
uugaguauuaaauu

SEQ ID NO: 2127298 - RNA, 13 nt, Staphylococcus aureus subsp. aureus N315
uugaguauuaaau

SEQ ID NO: 2127299 - RNA, 18 nt, Staphylococcus aureus subsp. aureus N315
uugaguugaaaauaaucg

SEQ ID NO: 2127300 - RNA, 21 nt, Staphylococcus aureus subsp. aureus N315
uugaguguguccaucauuugu

SEQ ID NO: 2127301 - RNA, 17 nt, Staphylococcus aureus subsp. aureus N315
uugagucaauucgacuc

SEQ ID NO: 2127302 - RNA, 18 nt, Staphylococcus aureus subsp. aureus N315
uugaucgauuguuuauua

SEQ ID NO: 2127303 - RNA, 16 nt, Staphylococcus aureus subsp. aureus N315
uugauauucuaaaaaa

SEQ ID NO: 2127304 - RNA, 16 nt, Staphylococcus aureus subsp. aureus N315
uugaucaaaaagacag

SEQ ID NO: 2127305 - RNA, 17 nt, Staphylococcus aureus subsp. aureus N315
uugaucaacuauauaua

SEQ ID NO: 2127306 - RNA, 17 nt, Staphylococcus aureus subsp. aureus N315
uugauauuuuucacgua

SEQ ID NO: 2127307 - RNA, 16 nt, Staphylococcus aureus subsp. aureus N315
uugauaaaauaaauaa

SEQ ID NO: 2127308 - RNA, 13 nt, Staphylococcus aureus subsp. aureus N315
uugauaaaauaau

SEQ ID NO: 2127309 - RNA, 13 nt, Staphylococcus aureus subsp. aureus N315
uugauaaaacuaa

SEQ ID NO: 2127310 - RNA, 18 nt, Staphylococcus aureus subsp. aureus N315
uugauaugguuagagaaa

SEQ ID NO: 2127311 - RNA, 21 nt, Staphylococcus aureus subsp. aureus N315
uugauaucgaaacgcuuugca

SEQ ID NO: 2127312 - RNA, 21 nt, Staphylococcus aureus subsp. aureus N315
uucuuuguguuugcuuuuauu

SEQ ID NO: 2127313 - RNA, 20 nt, Staphylococcus aureus subsp. aureus N315
uucuuuuucagcuaauuguc

SEQ ID NO: 2127314 - RNA, 18 nt, Staphylococcus aureus subsp. aureus N315
uucuuuuaaguuaucaaa

SEQ ID NO: 2127315 - RNA, 15 nt, Staphylococcus aureus subsp. aureus N315
uucuuuuucuauaca

SEQ ID NO: 2127316 - RNA, 15 nt, Staphylococcus aureus subsp. aureus N315
uucuuuuucaucuuu

SEQ ID NO: 2127317 - RNA, 22 nt, Staphylococcus aureus subsp. aureus N315
uucuuuuugcguuuuuaaauaa

SEQ ID NO: 2127318 - RNA, 17 nt, Staphylococcus aureus subsp. aureus N315
uucuuuuuuuguuacca

SEQ ID NO: 2127319 - RNA, 18 nt, Staphylococcus aureus subsp. aureus N315
uucuuuuuguuguuuuaa

SEQ ID NO: 2127320 - RNA, 20 nt, Staphylococcus aureus subsp. aureus N315
uugaaaaaccaaguuuugca

SEQ ID NO: 2127321 - RNA, 13 nt, Staphylococcus aureus subsp. aureus N315
uugaaaauuucac

SEQ ID NO: 2127322 - RNA, 17 nt, Staphylococcus aureus subsp. aureus N315
uugaacauauuauaaaa

SEQ ID NO: 2127323 - RNA, 21 nt, Staphylococcus aureus subsp. aureus N315
uugaaccggaaauuaaaucga

SEQ ID NO: 2127324 - RNA, 21 nt, Staphylococcus aureus subsp. aureus N315
uugaaaggaauguuuaaaaaa

SEQ ID NO: 2127325 - RNA, 19 nt, Staphylococcus aureus subsp. aureus N315
uugaaacuaauaauuugua

SEQ ID NO: 2127326 - RNA, 17 nt, Staphylococcus aureus subsp. aureus N315
uugaaacgguaucaaca

SEQ ID NO: 2127327 - RNA, 16 nt, Staphylococcus aureus subsp. aureus N315
uugaauuuuauuaggu

SEQ ID NO: 2127328 - RNA, 13 nt, Staphylococcus aureus subsp. aureus N315
uugaauuuuauua

SEQ ID NO: 2127329 - RNA, 13 nt, Staphylococcus aureus subsp. aureus N315
uugaccuucaguu

SEQ ID NO: 2127330 - RNA, 19 nt, Staphylococcus aureus subsp. aureus N315
uugaacuuuaguauauuca

SEQ ID NO: 2127331 - RNA, 15 nt, Staphylococcus aureus subsp. aureus N315
uugaagaauaaaaaa

SEQ ID NO: 2127332 - RNA, 19 nt, Staphylococcus aureus subsp. aureus N315
uugaagaauaaaaaaguug

SEQ ID NO: 2127333 - RNA, 23 nt, Staphylococcus aureus subsp. aureus N315
uugaagaaggaugaguuuaaaaa

SEQ ID NO: 2127334 - RNA, 11 nt, Staphylococcus aureus subsp. aureus N315
uugaacuuuua

SEQ ID NO: 2127335 - RNA, 21 nt, Staphylococcus aureus subsp. aureus N315
uugaacgauaacaauuuauua

SEQ ID NO: 2127336 - RNA, 23 nt, Staphylococcus aureus subsp. aureus N315
uugaauugacuuacauuuuaaua

SEQ ID NO: 2127337 - RNA, 14 nt, Staphylococcus aureus subsp. aureus N315
uugaauguuucucc

SEQ ID NO: 2127338 - RNA, 22 nt, Staphylococcus aureus subsp. aureus N315
uugaauuaacaauauuaaauuu

SEQ ID NO: 2127339 - RNA, 18 nt, Staphylococcus aureus subsp. aureus N315
uugaagaauguuucauau

SEQ ID NO: 2127340 - RNA, 23 nt, Staphylococcus aureus subsp. aureus N315
uugaaugauauuaacuguaccau

SEQ ID NO: 2127341 - RNA, 12 nt, Staphylococcus aureus subsp. aureus N315
uugaaugaaccu

SEQ ID NO: 2127342 - RNA, 23 nt, Staphylococcus aureus subsp. aureus N315
uugaaugaaguaauauauaaaag

SEQ ID NO: 2127343 - RNA, 20 nt, Staphylococcus aureus subsp. aureus N315
uugaauggcucguuuuuuua

SEQ ID NO: 2127344 - RNA, 19 nt, Staphylococcus aureus subsp. aureus N315
uuguugaauaauuaauguu

SEQ ID NO: 2127345 - RNA, 14 nt, Staphylococcus aureus subsp. aureus N315
uuguugaaauuucu

SEQ ID NO: 2127346 - RNA, 20 nt, Staphylococcus aureus subsp. aureus N315
uuguucuuucuuguucuaaa

SEQ ID NO: 2127347 - RNA, 12 nt, Staphylococcus aureus subsp. aureus N315
uuguucagauuu

SEQ ID NO: 2127348 - RNA, 17 nt, Staphylococcus aureus subsp. aureus N315
uuguucaacuaaauuuu

SEQ ID NO: 2127349 - RNA, 22 nt, Staphylococcus aureus subsp. aureus N315
uuguucaacuaaauuuucuaaa

SEQ ID NO: 2127350 - RNA, 13 nt, Staphylococcus aureus subsp. aureus N315
uuguuucuaaauu

SEQ ID NO: 2127351 - RNA, 12 nt, Staphylococcus aureus subsp. aureus N315
uuguuucaccag

SEQ ID NO: 2127352 - RNA, 18 nt, Staphylococcus aureus subsp. aureus N315
uuguuuaucuguaucaaa

SEQ ID NO: 2127353 - RNA, 14 nt, Staphylococcus aureus subsp. aureus N315
uuguuuaugccaug

SEQ ID NO: 2127354 - RNA, 17 nt, Staphylococcus aureus subsp. aureus N315
uuguuuaugccaugcuc

SEQ ID NO: 2127355 - RNA, 16 nt, Staphylococcus aureus subsp. aureus N315
uugugaauaaaauugu

SEQ ID NO: 2127356 - RNA, 18 nt, Staphylococcus aureus subsp. aureus N315
uugugaaauuagagaacg

SEQ ID NO: 2127357 - RNA, 18 nt, Staphylococcus aureus subsp. aureus N315
uugugaauuuauuuugua

SEQ ID NO: 2127358 - RNA, 20 nt, Staphylococcus aureus subsp. aureus N315
uugugggcguucugcuaauc

SEQ ID NO: 2127359 - RNA, 17 nt, Staphylococcus aureus subsp. aureus N315
uugugguauuaauuaca

SEQ ID NO: 2127360 - RNA, 23 nt, Staphylococcus aureus subsp. aureus N315
uugugguuguuaauguauuaauu

SEQ ID NO: 2127361 - RNA, 19 nt, Staphylococcus aureus subsp. aureus N315
uuguguaucuguaacauaa

SEQ ID NO: 2127362 - RNA, 21 nt, Staphylococcus aureus subsp. aureus N315
uuguguguuuuaaaauuauuu

SEQ ID NO: 2127363 - RNA, 18 nt, Staphylococcus aureus subsp. aureus N315
uuguguauuguuuuacuu

SEQ ID NO: 2127364 - RNA, 17 nt, Staphylococcus aureus subsp. aureus N315
uuguuaguuuucuuaaa

SEQ ID NO: 2127365 - RNA, 19 nt, Staphylococcus aureus subsp. aureus N315
uuguuaucguucaauguua

SEQ ID NO: 2127366 - RNA, 14 nt, Staphylococcus aureus subsp. aureus N315
uuguuauaaaggaa

SEQ ID NO: 2127367 - RNA, 19 nt, Staphylococcus aureus subsp. aureus N315
uuguuauaaguaaauaaua

SEQ ID NO: 2127368 - RNA, 13 nt, Staphylococcus aureus subsp. aureus N315
uugucuuugaaug

SEQ ID NO: 2127369 - RNA, 13 nt, Staphylococcus aureus subsp. aureus N315
uugucuuuuauau

SEQ ID NO: 2127370 - RNA, 15 nt, Staphylococcus aureus subsp. aureus N315
uugucuuuuauauuu

SEQ ID NO: 2127371 - RNA, 17 nt, Staphylococcus aureus subsp. aureus N315
uugucuuuuuuaucaug

SEQ ID NO: 2127372 - RNA, 13 nt, Staphylococcus aureus subsp. aureus N315
uuguauuuuucaa

SEQ ID NO: 2127373 - RNA, 21 nt, Staphylococcus aureus subsp. aureus N315
uugucaaaauugaacuuugua

SEQ ID NO: 2127374 - RNA, 21 nt, Staphylococcus aureus subsp. aureus N315
uuguauuuccuuaauaugcac

SEQ ID NO: 2127375 - RNA, 18 nt, Staphylococcus aureus subsp. aureus N315
uuguauuuaauaaguuaa

SEQ ID NO: 2127376 - RNA, 23 nt, Staphylococcus aureus subsp. aureus N315
uuguccuuuaagaacauaaccua

SEQ ID NO: 2127377 - RNA, 14 nt, Staphylococcus aureus subsp. aureus N315
uuguauuuaaaauc

SEQ ID NO: 2127378 - RNA, 18 nt, Staphylococcus aureus subsp. aureus N315
uuguauuguuuucaucau

SEQ ID NO: 2127379 - RNA, 22 nt, Staphylococcus aureus subsp. aureus N315
uuguaggaagaccacuauuuuu

SEQ ID NO: 2127380 - RNA, 20 nt, Staphylococcus aureus subsp. aureus N315
uuguagccuucaacuaaugu

SEQ ID NO: 2127381 - RNA, 18 nt, Staphylococcus aureus subsp. aureus N315
uuguaacacacuuauaau

SEQ ID NO: 2127382 - RNA, 20 nt, Staphylococcus aureus subsp. aureus N315
uuguaacaagcuuuuuucaa

SEQ ID NO: 2127383 - RNA, 18 nt, Staphylococcus aureus subsp. aureus N315
uuguaaagcaugaauagc

SEQ ID NO: 2127384 - RNA, 20 nt, Staphylococcus aureus subsp. aureus N315
uuguaaauaaaacuaucuac

SEQ ID NO: 2127385 - RNA, 15 nt, Staphylococcus aureus subsp. aureus N315
uuguaaauaaaacua

SEQ ID NO: 2127386 - RNA, 21 nt, Staphylococcus aureus subsp. aureus N315
uuguaaauauuuuuuaaaaug

SEQ ID NO: 2127387 - RNA, 20 nt, Staphylococcus aureus subsp. aureus N315
uuguaaauuuauuuuuaauu

SEQ ID NO: 2127388 - RNA, 17 nt, Staphylococcus aureus subsp. aureus N315
uuuaccaauaucaugca

SEQ ID NO: 2127389 - RNA, 11 nt, Staphylococcus aureus subsp. aureus N315
uuuacauugcc

SEQ ID NO: 2127390 - RNA, 20 nt, Staphylococcus aureus subsp. aureus N315
uuuaccauguuuuacaaguu

SEQ ID NO: 2127391 - RNA, 17 nt, Staphylococcus aureus subsp. aureus N315
uuuaccauugugaauaa

SEQ ID NO: 2127392 - RNA, 22 nt, Staphylococcus aureus subsp. aureus N315
uuuacaauuaauuacuguaaau

SEQ ID NO: 2127393 - RNA, 15 nt, Staphylococcus aureus subsp. aureus N315
uuuaauuuuucuaaa

SEQ ID NO: 2127394 - RNA, 19 nt, Staphylococcus aureus subsp. aureus N315
uuuacaaacuucacaucau

SEQ ID NO: 2127395 - RNA, 16 nt, Staphylococcus aureus subsp. aureus N315
uuuaauguuaaacaau

SEQ ID NO: 2127396 - RNA, 14 nt, Staphylococcus aureus subsp. aureus N315
uuuaauguuugcuu

SEQ ID NO: 2127397 - RNA, 23 nt, Staphylococcus aureus subsp. aureus N315
uuuaauuuugacauaaaaaauaa

SEQ ID NO: 2127398 - RNA, 21 nt, Staphylococcus aureus subsp. aureus N315
uuuaaugggcgauaaaaguug

SEQ ID NO: 2127399 - RNA, 15 nt, Staphylococcus aureus subsp. aureus N315
uuuaauauuuucuua

SEQ ID NO: 2127400 - RNA, 20 nt, Staphylococcus aureus subsp. aureus N315
uuuaaugauuuuucaucaau

SEQ ID NO: 2127401 - RNA, 21 nt, Staphylococcus aureus subsp. aureus N315
uuuaaucguaacauaucagcu

SEQ ID NO: 2127402 - RNA, 21 nt, Staphylococcus aureus subsp. aureus N315
uuuaaucguauuagccaauaa

SEQ ID NO: 2127403 - RNA, 15 nt, Staphylococcus aureus subsp. aureus N315
uuuaagcuuaucaac

SEQ ID NO: 2127404 - RNA, 12 nt, Staphylococcus aureus subsp. aureus N315
uuuaauauauuu

SEQ ID NO: 2127405 - RNA, 13 nt, Staphylococcus aureus subsp. aureus N315
uuuaauauaaauu

SEQ ID NO: 2127406 - RNA, 20 nt, Staphylococcus aureus subsp. aureus N315
uuuaaguaauucauuugcuu

SEQ ID NO: 2127407 - RNA, 23 nt, Staphylococcus aureus subsp. aureus N315
uuuaaacaagcaucaugaaauua

SEQ ID NO: 2127408 - RNA, 24 nt, Staphylococcus aureus subsp. aureus N315
uuuaaaauuugugcauucaucaau

SEQ ID NO: 2127409 - RNA, 13 nt, Staphylococcus aureus subsp. aureus N315
uuuaaaauuauca

SEQ ID NO: 2127410 - RNA, 22 nt, Staphylococcus aureus subsp. aureus N315
uuuaaaauuauuuggcucuaua

SEQ ID NO: 2127411 - RNA, 18 nt, Staphylococcus aureus subsp. aureus N315
uuuaaacauccaauuaug

SEQ ID NO: 2127412 - RNA, 20 nt, Staphylococcus aureus subsp. aureus N315
uuuaaacaucuauaacaaaa

SEQ ID NO: 2127413 - RNA, 19 nt, Staphylococcus aureus subsp. aureus N315
uuuaaacgaucacuuggcu

SEQ ID NO: 2127414 - RNA, 16 nt, Staphylococcus aureus subsp. aureus N315
uuuaaacucguaaauu

SEQ ID NO: 2127415 - RNA, 16 nt, Staphylococcus aureus subsp. aureus N315
uuuaaagaaaaguuua

SEQ ID NO: 2127416 - RNA, 23 nt, Staphylococcus aureus subsp. aureus N315
uuuaaaaaacauaccugcauauu

SEQ ID NO: 2127417 - RNA, 12 nt, Staphylococcus aureus subsp. aureus N315
uuguuuguagaa

SEQ ID NO: 2127418 - RNA, 16 nt, Staphylococcus aureus subsp. aureus N315
uuuaaaaauucauaau

SEQ ID NO: 2127419 - RNA, 22 nt, Staphylococcus aureus subsp. aureus N315
uuuaaaaaugcugguaaauguu

SEQ ID NO: 2127420 - RNA, 12 nt, Staphylococcus aureus subsp. aureus N315
uuuaaaaauaca

SEQ ID NO: 2127421 - RNA, 16 nt, Staphylococcus aureus subsp. aureus N315
uuuaaagcuaaauguu

SEQ ID NO: 2127422 - RNA, 21 nt, Staphylococcus aureus subsp. aureus N315
uuuaaagguauugugauuuca

SEQ ID NO: 2127423 - RNA, 18 nt, Staphylococcus aureus subsp. aureus N315
uuuaaauaaaauuguuga

SEQ ID NO: 2127424 - RNA, 18 nt, Staphylococcus aureus subsp. aureus N315
uuuaaaugucuuucaaau

SEQ ID NO: 2127425 - RNA, 20 nt, Staphylococcus aureus subsp. aureus N315
uuuaaauguauuuuuacuuu

SEQ ID NO: 2127426 - RNA, 15 nt, Staphylococcus aureus subsp. aureus N315
uuuaaauuuucauca

SEQ ID NO: 2127427 - RNA, 14 nt, Staphylococcus aureus subsp. aureus N315
uuuaaauuuauaau

SEQ ID NO: 2127428 - RNA, 20 nt, Staphylococcus aureus subsp. aureus N315
uuuaaauuuucaucauaauc

SEQ ID NO: 2127429 - RNA, 20 nt, Staphylococcus aureus subsp. aureus N315
uuuaaauucuuauaaaauaa

SEQ ID NO: 2127430 - RNA, 14 nt, Staphylococcus aureus subsp. aureus N315
uuuaaauucauuuu

SEQ ID NO: 2127431 - RNA, 18 nt, Staphylococcus aureus subsp. aureus N315
uuuaagaagucgaauuca

SEQ ID NO: 2127432 - RNA, 17 nt, Staphylococcus aureus subsp. aureus N315
uuuaacuucuuuuguuu

SEQ ID NO: 2127433 - RNA, 14 nt, Staphylococcus aureus subsp. aureus N315
uuuaacuuccuaaa

SEQ ID NO: 2127434 - RNA, 14 nt, Staphylococcus aureus subsp. aureus N315
uuuaacaacacuac

SEQ ID NO: 2127435 - RNA, 14 nt, Staphylococcus aureus subsp. aureus N315
uuuaacaaaauaua

SEQ ID NO: 2127436 - RNA, 15 nt, Staphylococcus aureus subsp. aureus N315
uuuaacaaaauauac

SEQ ID NO: 2127437 - RNA, 18 nt, Staphylococcus aureus subsp. aureus N315
uuggcucuauaucaaauu

SEQ ID NO: 2127438 - RNA, 16 nt, Staphylococcus aureus subsp. aureus N315
uuggcuugaaguuguu

SEQ ID NO: 2127439 - RNA, 18 nt, Staphylococcus aureus subsp. aureus N315
uuggcuucgucaucaaca

SEQ ID NO: 2127440 - RNA, 21 nt, Staphylococcus aureus subsp. aureus N315
uuggcuggcccccaacacuga

SEQ ID NO: 2127441 - RNA, 18 nt, Staphylococcus aureus subsp. aureus N315
uugcuucauuauauaauu

SEQ ID NO: 2127442 - RNA, 13 nt, Staphylococcus aureus subsp. aureus N315
uugcuucuguauc

SEQ ID NO: 2127443 - RNA, 13 nt, Staphylococcus aureus subsp. aureus N315
uugcuggauuaca

SEQ ID NO: 2127444 - RNA, 21 nt, Staphylococcus aureus subsp. aureus N315
uugcugcuguacaauuucgcu

SEQ ID NO: 2127445 - RNA, 19 nt, Staphylococcus aureus subsp. aureus N315
uugcuuguacgauaacuac

SEQ ID NO: 2127446 - RNA, 14 nt, Staphylococcus aureus subsp. aureus N315
uuggaaagauggga

SEQ ID NO: 2127447 - RNA, 18 nt, Staphylococcus aureus subsp. aureus N315
uuggaacauauucauaau

SEQ ID NO: 2127448 - RNA, 22 nt, Staphylococcus aureus subsp. aureus N315
uugcuugaaauuauuauuuaaa

SEQ ID NO: 2127449 - RNA, 13 nt, Staphylococcus aureus subsp. aureus N315
uugcuugaaauua

SEQ ID NO: 2127450 - RNA, 17 nt, Staphylococcus aureus subsp. aureus N315
uugcuucuuaucaacaa

SEQ ID NO: 2127451 - RNA, 20 nt, Staphylococcus aureus subsp. aureus N315
uuggauuuuuugguuucuau

SEQ ID NO: 2127452 - RNA, 20 nt, Staphylococcus aureus subsp. aureus N315
uuggauucuuuuguaauaau

SEQ ID NO: 2127453 - RNA, 21 nt, Staphylococcus aureus subsp. aureus N315
uuggauagguaacuaaaaugu

SEQ ID NO: 2127454 - RNA, 14 nt, Staphylococcus aureus subsp. aureus N315
uuggaucuuucaaa

SEQ ID NO: 2127455 - RNA, 17 nt, Staphylococcus aureus subsp. aureus N315
uuggauucaaaugacau

SEQ ID NO: 2127456 - RNA, 23 nt, Staphylococcus aureus subsp. aureus N315
uuggaaucaucuuuuugaaauuu

SEQ ID NO: 2127457 - RNA, 18 nt, Staphylococcus aureus subsp. aureus N315
uuggauaauuucuucuuc

SEQ ID NO: 2127458 - RNA, 14 nt, Staphylococcus aureus subsp. aureus N315
uuggaauagauguu

SEQ ID NO: 2127459 - RNA, 14 nt, Staphylococcus aureus subsp. aureus N315
uuggaaucaucuuu

SEQ ID NO: 2127460 - RNA, 19 nt, Staphylococcus aureus subsp. aureus N315
uugcauacgaauuaaaaua

SEQ ID NO: 2127461 - RNA, 22 nt, Staphylococcus aureus subsp. aureus N315
uugccacuuuguggauucucuu

SEQ ID NO: 2127462 - RNA, 21 nt, Staphylococcus aureus subsp. aureus N315
uugcauaaucaauuucaccuu

SEQ ID NO: 2127463 - RNA, 20 nt, Staphylococcus aureus subsp. aureus N315
uugccucaauaucuuuaauu

SEQ ID NO: 2127464 - RNA, 19 nt, Staphylococcus aureus subsp. aureus N315
uugccauacccauauuaaa

SEQ ID NO: 2127465 - RNA, 20 nt, Staphylococcus aureus subsp. aureus N315
uugcucuaauccaaaauaau

SEQ ID NO: 2127466 - RNA, 21 nt, Staphylococcus aureus subsp. aureus N315
uugcucuaauccaaaauaauc

SEQ ID NO: 2127467 - RNA, 14 nt, Staphylococcus aureus subsp. aureus N315
uugcucuaauccaa

SEQ ID NO: 2127468 - RNA, 18 nt, Staphylococcus aureus subsp. aureus N315
uugcuauauuaguauaau

SEQ ID NO: 2127469 - RNA, 22 nt, Staphylococcus aureus subsp. aureus N315
uuccucuccuucggcucucgcu

SEQ ID NO: 2127470 - RNA, 22 nt, Staphylococcus aureus subsp. aureus N315
uuccucuggaacuuuaauacca

SEQ ID NO: 2127471 - RNA, 20 nt, Staphylococcus aureus subsp. aureus N315
uuccuccuaccgcuaaaauu

SEQ ID NO: 2127472 - RNA, 22 nt, Staphylococcus aureus subsp. aureus N315
uuccuagcuuuuaugucuaguu

SEQ ID NO: 2127473 - RNA, 19 nt, Staphylococcus aureus subsp. aureus N315
uuccucaacgggaacauca

SEQ ID NO: 2127474 - RNA, 18 nt, Staphylococcus aureus subsp. aureus N315
uuccuaauucuugagcaa

SEQ ID NO: 2127475 - RNA, 14 nt, Staphylococcus aureus subsp. aureus N315
uucgaaauagguau

SEQ ID NO: 2127476 - RNA, 23 nt, Staphylococcus aureus subsp. aureus N315
uuccuuuagcaaaaauauuuaaa

SEQ ID NO: 2127477 - RNA, 17 nt, Staphylococcus aureus subsp. aureus N315
uuccugauacaaugauu

SEQ ID NO: 2127478 - RNA, 20 nt, Staphylococcus aureus subsp. aureus N315
uuccugcuacaacuucuucu

SEQ ID NO: 2127479 - RNA, 17 nt, Staphylococcus aureus subsp. aureus N315
uucgaagucauaugcau

SEQ ID NO: 2127480 - RNA, 17 nt, Staphylococcus aureus subsp. aureus N315
uucgaacuuuuguucua

SEQ ID NO: 2127481 - RNA, 12 nt, Staphylococcus aureus subsp. aureus N315
uucgaacuuuug

SEQ ID NO: 2127482 - RNA, 20 nt, Staphylococcus aureus subsp. aureus N315
uucgaacgauauuuuaaaaa

SEQ ID NO: 2127483 - RNA, 18 nt, Staphylococcus aureus subsp. aureus N315
uucgaaaaucucuguauu

SEQ ID NO: 2127484 - RNA, 20 nt, Staphylococcus aureus subsp. aureus N315
uucgacuacaaguuuauaau

SEQ ID NO: 2127485 - RNA, 14 nt, Staphylococcus aureus subsp. aureus N315
uucgauauuuguuu

SEQ ID NO: 2127486 - RNA, 15 nt, Staphylococcus aureus subsp. aureus N315
uucgauaguuuauua

SEQ ID NO: 2127487 - RNA, 19 nt, Staphylococcus aureus subsp. aureus N315
uucgauaauauaacugcau

SEQ ID NO: 2127488 - RNA, 21 nt, Staphylococcus aureus subsp. aureus N315
uucgauuaucuacuauuuguu

SEQ ID NO: 2127489 - RNA, 16 nt, Staphylococcus aureus subsp. aureus N315
uucgauuauucuuaau

SEQ ID NO: 2127490 - RNA, 15 nt, Staphylococcus aureus subsp. aureus N315
uucgauucauaaaau

SEQ ID NO: 2127491 - RNA, 18 nt, Staphylococcus aureus subsp. aureus N315
uucgcuaauguaccaauc

SEQ ID NO: 2127492 - RNA, 20 nt, Staphylococcus aureus subsp. aureus N315
uucgcauacuuuuucagaau

SEQ ID NO: 2127493 - RNA, 23 nt, Staphylococcus aureus subsp. aureus N315
uuccgcacugccuuuuuguaauu

SEQ ID NO: 2127494 - RNA, 17 nt, Staphylococcus aureus subsp. aureus N315
uucccuguuaugaagua

SEQ ID NO: 2127495 - RNA, 15 nt, Staphylococcus aureus subsp. aureus N315
uucccguuaauauca

SEQ ID NO: 2127496 - RNA, 19 nt, Staphylococcus aureus subsp. aureus N315
uucccauuuuuaaaauuau

SEQ ID NO: 2127497 - RNA, 13 nt, Staphylococcus aureus subsp. aureus N315
uuccaugaauaag

SEQ ID NO: 2127498 - RNA, 13 nt, Staphylococcus aureus subsp. aureus N315
uuccauucauaaa

SEQ ID NO: 2127499 - RNA, 21 nt, Staphylococcus aureus subsp. aureus N315
uuccaucauuuguguaaauga

SEQ ID NO: 2127500 - RNA, 13 nt, Staphylococcus aureus subsp. aureus N315
uuccaguaugauu

SEQ ID NO: 2127501 - RNA, 15 nt, Staphylococcus aureus subsp. aureus N315
uuccagacuccuaaa

SEQ ID NO: 2127502 - RNA, 16 nt, Staphylococcus aureus subsp. aureus N315
uuccaacacccauaua

SEQ ID NO: 2127503 - RNA, 17 nt, Staphylococcus aureus subsp. aureus N315
uuccaaauuugaaacaa

SEQ ID NO: 2127504 - RNA, 16 nt, Staphylococcus aureus subsp. aureus N315
uuccaacaacuaagau

SEQ ID NO: 2127505 - RNA, 24 nt, Staphylococcus aureus subsp. aureus N315
uuccaaauugaaauuauccuacug

SEQ ID NO: 2127506 - RNA, 17 nt, Staphylococcus aureus subsp. aureus N315
uuccaauaauaaaccua

SEQ ID NO: 2127507 - RNA, 14 nt, Staphylococcus aureus subsp. aureus N315
uuccaauaauaaau

SEQ ID NO: 2127508 - RNA, 23 nt, Staphylococcus aureus subsp. aureus N315
uuccaauaauaaaccuaaagaua

SEQ ID NO: 2127509 - RNA, 19 nt, Staphylococcus aureus subsp. aureus N315
uuccaauaauaaaccuaaa

SEQ ID NO: 2127510 - RNA, 15 nt, Staphylococcus aureus subsp. aureus N315
uuccaagcaucauug

SEQ ID NO: 2127511 - RNA, 19 nt, Staphylococcus aureus subsp. aureus N315
uuccaagagaauuaauaau

SEQ ID NO: 2127512 - RNA, 21 nt, Staphylococcus aureus subsp. aureus N315
uuccaaacacacuguugaaaa

SEQ ID NO: 2127513 - RNA, 16 nt, Staphylococcus aureus subsp. aureus N315
uuccaaaaauuguaaa

SEQ ID NO: 2127514 - RNA, 13 nt, Staphylococcus aureus subsp. aureus N315
uucauuuuuucaa

SEQ ID NO: 2127515 - RNA, 23 nt, Staphylococcus aureus subsp. aureus N315
uuccacaacaaucacgauuaaug

SEQ ID NO: 2127516 - RNA, 12 nt, Staphylococcus aureus subsp. aureus N315
uuccacuucauc

SEQ ID NO: 2127517 - RNA, 19 nt, Staphylococcus aureus subsp. aureus N315
uucacuguauaaggaugua

SEQ ID NO: 2127518 - RNA, 20 nt, Staphylococcus aureus subsp. aureus N315
uucacguaauugaguuguug

SEQ ID NO: 2127519 - RNA, 16 nt, Staphylococcus aureus subsp. aureus N315
uucacguaaugaauca

SEQ ID NO: 2127520 - RNA, 20 nt, Staphylococcus aureus subsp. aureus N315
uucacuaaauucaauaaucu

SEQ ID NO: 2127521 - RNA, 18 nt, Staphylococcus aureus subsp. aureus N315
uucacuaaauucaauaau

SEQ ID NO: 2127522 - RNA, 20 nt, Staphylococcus aureus subsp. aureus N315
uucacuaaaaauauauuuca

SEQ ID NO: 2127523 - RNA, 13 nt, Staphylococcus aureus subsp. aureus N315
uucacuacuuuuu

SEQ ID NO: 2127524 - RNA, 21 nt, Staphylococcus aureus subsp. aureus N315
uucacgaauaucuuaaagaau

SEQ ID NO: 2127525 - RNA, 14 nt, Staphylococcus aureus subsp. aureus N315
uucaccuaaaaaga

SEQ ID NO: 2127526 - RNA, 13 nt, Staphylococcus aureus subsp. aureus N315
uucacuuuaacuu

SEQ ID NO: 2127527 - RNA, 16 nt, Staphylococcus aureus subsp. aureus N315
uucacuuuuuauauca

SEQ ID NO: 2127528 - RNA, 19 nt, Staphylococcus aureus subsp. aureus N315
uucagaacuaugaauagau

SEQ ID NO: 2127529 - RNA, 15 nt, Staphylococcus aureus subsp. aureus N315
uucagcauuugcugu

SEQ ID NO: 2127530 - RNA, 19 nt, Staphylococcus aureus subsp. aureus N315
uucagcauugggacauaaa

SEQ ID NO: 2127531 - RNA, 16 nt, Staphylococcus aureus subsp. aureus N315
uucagauuuguauuuu

SEQ ID NO: 2127532 - RNA, 23 nt, Staphylococcus aureus subsp. aureus N315
uucagaugaauaauguuuccauu

SEQ ID NO: 2127533 - RNA, 13 nt, Staphylococcus aureus subsp. aureus N315
uucagauagguac

SEQ ID NO: 2127534 - RNA, 14 nt, Staphylococcus aureus subsp. aureus N315
uucaccaacuuuuu

SEQ ID NO: 2127535 - RNA, 20 nt, Staphylococcus aureus subsp. aureus N315
uucaccauuucguguuccaa

SEQ ID NO: 2127536 - RNA, 22 nt, Staphylococcus aureus subsp. aureus N315
uucacaugaauuuuaauauauu

SEQ ID NO: 2127537 - RNA, 17 nt, Staphylococcus aureus subsp. aureus N315
uucacauucuugaauaa

SEQ ID NO: 2127538 - RNA, 13 nt, Staphylococcus aureus subsp. aureus N315
uucacauuuaucc

SEQ ID NO: 2127539 - RNA, 18 nt, Staphylococcus aureus subsp. aureus N315
uucacauuuauccuuuaa

SEQ ID NO: 2127540 - RNA, 18 nt, Staphylococcus aureus subsp. aureus N315
uucacacagcuucauuaa

SEQ ID NO: 2127541 - RNA, 15 nt, Staphylococcus aureus subsp. aureus N315
uucaauucuuacacc

SEQ ID NO: 2127542 - RNA, 23 nt, Staphylococcus aureus subsp. aureus N315
uucaauugacauuaaugauagca

SEQ ID NO: 2127543 - RNA, 14 nt, Staphylococcus aureus subsp. aureus N315
uucaauguuuuaaa

SEQ ID NO: 2127544 - RNA, 21 nt, Staphylococcus aureus subsp. aureus N315
uucaauguuuaauuuucuaaa

SEQ ID NO: 2127545 - RNA, 22 nt, Staphylococcus aureus subsp. aureus N315
uucaauuucauuuuugauaacu

SEQ ID NO: 2127546 - RNA, 18 nt, Staphylococcus aureus subsp. aureus N315
uucaauuuaauagacauu

SEQ ID NO: 2127547 - RNA, 19 nt, Staphylococcus aureus subsp. aureus N315
uucaauugucucaauaaug

SEQ ID NO: 2127548 - RNA, 14 nt, Staphylococcus aureus subsp. aureus N315
uucaauauuaaaau

SEQ ID NO: 2127549 - RNA, 16 nt, Staphylococcus aureus subsp. aureus N315
uucaaucgcauuuugu

SEQ ID NO: 2127550 - RNA, 13 nt, Staphylococcus aureus subsp. aureus N315
uucaaucgucaca

SEQ ID NO: 2127551 - RNA, 19 nt, Staphylococcus aureus subsp. aureus N315
uucaauguaucaccuaauu

SEQ ID NO: 2127552 - RNA, 22 nt, Staphylococcus aureus subsp. aureus N315
uucaaugucugcaucagaccua

SEQ ID NO: 2127553 - RNA, 16 nt, Staphylococcus aureus subsp. aureus N315
uucaaucgucacauca

SEQ ID NO: 2127554 - RNA, 18 nt, Staphylococcus aureus subsp. aureus N315
uucaaugauuuuauaaua

SEQ ID NO: 2127555 - RNA, 15 nt, Staphylococcus aureus subsp. aureus N315
uucaaugauuuuaua

SEQ ID NO: 2127556 - RNA, 21 nt, Staphylococcus aureus subsp. aureus N315
uucaauacgaaguguuauaaa

SEQ ID NO: 2127557 - RNA, 17 nt, Staphylococcus aureus subsp. aureus N315
uucaauaaucuuaggug

SEQ ID NO: 2127558 - RNA, 16 nt, Staphylococcus aureus subsp. aureus N315
uucaauaaucuuaggu

SEQ ID NO: 2127559 - RNA, 14 nt, Staphylococcus aureus subsp. aureus N315
uucaaguuuaaaau

SEQ ID NO: 2127560 - RNA, 15 nt, Staphylococcus aureus subsp. aureus N315
uucaaguguaguaaa

SEQ ID NO: 2127561 - RNA, 18 nt, Staphylococcus aureus subsp. aureus N315
uucaaguguaguaaaaau

SEQ ID NO: 2127562 - RNA, 15 nt, Staphylococcus aureus subsp. aureus N315
uucaaguuuaaaaua

SEQ ID NO: 2127563 - RNA, 19 nt, Staphylococcus aureus subsp. aureus N315
uucaauaaaaaugguauuc

SEQ ID NO: 2127564 - RNA, 21 nt, Staphylococcus aureus subsp. aureus N315
uucaaguauauccgcaucuuu

SEQ ID NO: 2127565 - RNA, 20 nt, Staphylococcus aureus subsp. aureus N315
uucaaguaauggauugauaa

SEQ ID NO: 2127566 - RNA, 14 nt, Staphylococcus aureus subsp. aureus N315
uucaagcuuaauaa

SEQ ID NO: 2127567 - RNA, 14 nt, Staphylococcus aureus subsp. aureus N315
uucaagcguuucuu

SEQ ID NO: 2127568 - RNA, 15 nt, Staphylococcus aureus subsp. aureus N315
uucauguccaucuuu

SEQ ID NO: 2127569 - RNA, 16 nt, Staphylococcus aureus subsp. aureus N315
uucauguaugaaguaa

SEQ ID NO: 2127570 - RNA, 15 nt, Staphylococcus aureus subsp. aureus N315
uucaugauuuacuaa

SEQ ID NO: 2127571 - RNA, 21 nt, Staphylococcus aureus subsp. aureus N315
uucaugcacuuuaacauaacu

SEQ ID NO: 2127572 - RNA, 18 nt, Staphylococcus aureus subsp. aureus N315
uucauuagccaaaucuuu

SEQ ID NO: 2127573 - RNA, 23 nt, Staphylococcus aureus subsp. aureus N315
uucauuacuuggaaauguauaug

SEQ ID NO: 2127574 - RNA, 22 nt, Staphylococcus aureus subsp. aureus N315
uucauuauagucuuaaacauaa

SEQ ID NO: 2127575 - RNA, 21 nt, Staphylococcus aureus subsp. aureus N315
uucauuauagugugucauaau

SEQ ID NO: 2127576 - RNA, 19 nt, Staphylococcus aureus subsp. aureus N315
uucauuaguugcauaauca

SEQ ID NO: 2127577 - RNA, 12 nt, Staphylococcus aureus subsp. aureus N315
uucauuaucauu

SEQ ID NO: 2127578 - RNA, 19 nt, Staphylococcus aureus subsp. aureus N315
uucaugugucauaauccau

SEQ ID NO: 2127579 - RNA, 21 nt, Staphylococcus aureus subsp. aureus N315
uucauguuugauucuaaauaa

SEQ ID NO: 2127580 - RNA, 13 nt, Staphylococcus aureus subsp. aureus N315
uucauuuuaagug

SEQ ID NO: 2127581 - RNA, 15 nt, Staphylococcus aureus subsp. aureus N315
uucauuuguauuaau

SEQ ID NO: 2127582 - RNA, 19 nt, Staphylococcus aureus subsp. aureus N315
uucauuuguauuaauuuga

SEQ ID NO: 2127583 - RNA, 12 nt, Staphylococcus aureus subsp. aureus N315
uucauuuaaaaa

SEQ ID NO: 2127584 - RNA, 16 nt, Staphylococcus aureus subsp. aureus N315
uucauuguuaaacauu

SEQ ID NO: 2127585 - RNA, 12 nt, Staphylococcus aureus subsp. aureus N315
uucauuuaacau

SEQ ID NO: 2127586 - RNA, 17 nt, Staphylococcus aureus subsp. aureus N315
uucauugcguaagguau

SEQ ID NO: 2127587 - RNA, 14 nt, Staphylococcus aureus subsp. aureus N315
uucauuguaaauuu

SEQ ID NO: 2127588 - RNA, 17 nt, Staphylococcus aureus subsp. aureus N315
uucauuguaauaauaau

SEQ ID NO: 2127589 - RNA, 16 nt, Staphylococcus aureus subsp. aureus N315
uucauuauuuaaauaa

SEQ ID NO: 2127590 - RNA, 19 nt, Staphylococcus aureus subsp. aureus N315
uucaucucuuauaaguuca

SEQ ID NO: 2127591 - RNA, 22 nt, Staphylococcus aureus subsp. aureus N315
uucaucugguauuuuaugacgu

SEQ ID NO: 2127592 - RNA, 15 nt, Staphylococcus aureus subsp. aureus N315
uucaucuaaaugaug

SEQ ID NO: 2127593 - RNA, 20 nt, Staphylococcus aureus subsp. aureus N315
uucaucgucucacuuaauaa

SEQ ID NO: 2127594 - RNA, 15 nt, Staphylococcus aureus subsp. aureus N315
uucaucuaaaaugag

SEQ ID NO: 2127595 - RNA, 14 nt, Staphylococcus aureus subsp. aureus N315
uucaucuaaaauga

SEQ ID NO: 2127596 - RNA, 21 nt, Staphylococcus aureus subsp. aureus N315
uucaucguucauauauuuugu

SEQ ID NO: 2127597 - RNA, 16 nt, Staphylococcus aureus subsp. aureus N315
uucaucuucuucaaaa

SEQ ID NO: 2127598 - RNA, 20 nt, Staphylococcus aureus subsp. aureus N315
uucaucuucaaacagacuua

SEQ ID NO: 2127599 - RNA, 12 nt, Staphylococcus aureus subsp. aureus N315
uucaucuugcaa

SEQ ID NO: 2127600 - RNA, 12 nt, Staphylococcus aureus subsp. aureus N315
uucaucuuucaa

SEQ ID NO: 2127601 - RNA, 14 nt, Staphylococcus aureus subsp. aureus N315
uucaugaauaauua

SEQ ID NO: 2127602 - RNA, 23 nt, Staphylococcus aureus subsp. aureus N315
uucaucaguugagugauuuuaau

SEQ ID NO: 2127603 - RNA, 19 nt, Staphylococcus aureus subsp. aureus N315
uucaucauaaucugcugcu

SEQ ID NO: 2127604 - RNA, 19 nt, Staphylococcus aureus subsp. aureus N315
uucaucaguaccaaagaaa

SEQ ID NO: 2127605 - RNA, 19 nt, Staphylococcus aureus subsp. aureus N315
uucauaaaauuuaaaacaa

SEQ ID NO: 2127606 - RNA, 16 nt, Staphylococcus aureus subsp. aureus N315
uucauaaaauuuaaaa

SEQ ID NO: 2127607 - RNA, 14 nt, Staphylococcus aureus subsp. aureus N315
uucauaaugaucaa

SEQ ID NO: 2127608 - RNA, 14 nt, Staphylococcus aureus subsp. aureus N315
uucauaagaaaaau

SEQ ID NO: 2127609 - RNA, 14 nt, Staphylococcus aureus subsp. aureus N315
uucauaaauuguuu

SEQ ID NO: 2127610 - RNA, 17 nt, Staphylococcus aureus subsp. aureus N315
uucaguucaaacagaaa

SEQ ID NO: 2127611 - RNA, 14 nt, Staphylococcus aureus subsp. aureus N315
uucaguuaaaccuu

SEQ ID NO: 2127612 - RNA, 14 nt, Staphylococcus aureus subsp. aureus N315
uucauaucuuucaa

SEQ ID NO: 2127613 - RNA, 14 nt, Staphylococcus aureus subsp. aureus N315
uucauauuaacugu

SEQ ID NO: 2127614 - RNA, 20 nt, Staphylococcus aureus subsp. aureus N315
uucauauauuuuguuaauaa

SEQ ID NO: 2127615 - RNA, 15 nt, Staphylococcus aureus subsp. aureus N315
uucaucaaacaacau

SEQ ID NO: 2127616 - RNA, 19 nt, Staphylococcus aureus subsp. aureus N315
uucaucaaacaacaucacu

SEQ ID NO: 2127617 - RNA, 15 nt, Staphylococcus aureus subsp. aureus N315
uucaucaauaacuau

SEQ ID NO: 2127618 - RNA, 13 nt, Staphylococcus aureus subsp. aureus N315
uucaucaauaagg

SEQ ID NO: 2127619 - RNA, 14 nt, Staphylococcus aureus subsp. aureus N315
uucauaauuuguug

SEQ ID NO: 2127620 - RNA, 13 nt, Staphylococcus aureus subsp. aureus N315
uucauaauuaaca

SEQ ID NO: 2127621 - RNA, 19 nt, Staphylococcus aureus subsp. aureus N315
uucauacgcucaaucgcau

SEQ ID NO: 2127622 - RNA, 18 nt, Staphylococcus aureus subsp. aureus N315
uucauaguguuuguaaug

SEQ ID NO: 2127623 - RNA, 19 nt, Staphylococcus aureus subsp. aureus N315
uucauagaugcauaaaaac

SEQ ID NO: 2127624 - RNA, 18 nt, Staphylococcus aureus subsp. aureus N315
uucauagaugcauaaaaa

SEQ ID NO: 2127625 - RNA, 22 nt, Staphylococcus aureus subsp. aureus N315
uucagcuaauucgucuacauau

SEQ ID NO: 2127626 - RNA, 20 nt, Staphylococcus aureus subsp. aureus N315
uucaggguuuaagauuuuau

SEQ ID NO: 2127627 - RNA, 21 nt, Staphylococcus aureus subsp. aureus N315
uucaguaacguacuguguaau

SEQ ID NO: 2127628 - RNA, 21 nt, Staphylococcus aureus subsp. aureus N315
uucagguuuuaugaauugagu

SEQ ID NO: 2127629 - RNA, 19 nt, Staphylococcus aureus subsp. aureus N315
uucaguaggacauauaaau

SEQ ID NO: 2127630 - RNA, 15 nt, Staphylococcus aureus subsp. aureus N315
uucaguauacucauc

SEQ ID NO: 2127631 - RNA, 22 nt, Staphylococcus aureus subsp. aureus N315
uucaguauagacuauaggucuu

SEQ ID NO: 2127632 - RNA, 21 nt, Staphylococcus aureus subsp. aureus N315
uucaguacgguuauuuaauaa

SEQ ID NO: 2127633 - RNA, 15 nt, Staphylococcus aureus subsp. aureus N315
uggcugcaucaauau

SEQ ID NO: 2127634 - RNA, 17 nt, Staphylococcus aureus subsp. aureus N315
ugggaaauauuugaaaa

SEQ ID NO: 2127635 - RNA, 14 nt, Staphylococcus aureus subsp. aureus N315
uggcuuacugucac

SEQ ID NO: 2127636 - RNA, 21 nt, Staphylococcus aureus subsp. aureus N315
uggcuuagguuuaauuuuaaa

SEQ ID NO: 2127637 - RNA, 17 nt, Staphylococcus aureus subsp. aureus N315
ugggaauuguauuagca

SEQ ID NO: 2127638 - RNA, 12 nt, Staphylococcus aureus subsp. aureus N315
ugggacauuaau

SEQ ID NO: 2127639 - RNA, 14 nt, Staphylococcus aureus subsp. aureus N315
ugggacuuuuuaua

SEQ ID NO: 2127640 - RNA, 23 nt, Staphylococcus aureus subsp. aureus N315
ugggcauuuugacgccagaauaa

SEQ ID NO: 2127641 - RNA, 18 nt, Staphylococcus aureus subsp. aureus N315
uggggaugggccccaaca

SEQ ID NO: 2127642 - RNA, 15 nt, Staphylococcus aureus subsp. aureus N315
uggcucuuuuuauuu

SEQ ID NO: 2127643 - RNA, 14 nt, Staphylococcus aureus subsp. aureus N315
uggcggggccccaa

SEQ ID NO: 2127644 - RNA, 17 nt, Staphylococcus aureus subsp. aureus N315
uggcgguuugaaaauga

SEQ ID NO: 2127645 - RNA, 16 nt, Staphylococcus aureus subsp. aureus N315
ugguuaaaguuaaugc

SEQ ID NO: 2127646 - RNA, 19 nt, Staphylococcus aureus subsp. aureus N315
ugguucugacauuucugac

SEQ ID NO: 2127647 - RNA, 13 nt, Staphylococcus aureus subsp. aureus N315
ugguucuucuuuc

SEQ ID NO: 2127648 - RNA, 14 nt, Staphylococcus aureus subsp. aureus N315
ugguucuuuacuaa

SEQ ID NO: 2127649 - RNA, 15 nt, Staphylococcus aureus subsp. aureus N315
ugguugcuucuuauc

SEQ ID NO: 2127650 - RNA, 19 nt, Staphylococcus aureus subsp. aureus N315
ugguuuaucagcuuuaaua

SEQ ID NO: 2127651 - RNA, 19 nt, Staphylococcus aureus subsp. aureus N315
ugguuuaccuaguuuuacu

SEQ ID NO: 2127652 - RNA, 20 nt, Staphylococcus aureus subsp. aureus N315
ugguuuaaugagcuuuucua

SEQ ID NO: 2127653 - RNA, 15 nt, Staphylococcus aureus subsp. aureus N315
ugguuuaaugagcuu

SEQ ID NO: 2127654 - RNA, 14 nt, Staphylococcus aureus subsp. aureus N315
ugguuguucuuuuu

SEQ ID NO: 2127655 - RNA, 21 nt, Staphylococcus aureus subsp. aureus N315
ugguuucuuaacauaaaauga

SEQ ID NO: 2127656 - RNA, 23 nt, Staphylococcus aureus subsp. aureus N315
ugguuuuauuugauuauucuuca

SEQ ID NO: 2127657 - RNA, 12 nt, Staphylococcus aureus subsp. aureus N315
ugguuuuauuaa

SEQ ID NO: 2127658 - RNA, 20 nt, Staphylococcus aureus subsp. aureus N315
ugguuugugauuuuuugaua

SEQ ID NO: 2127659 - RNA, 17 nt, Staphylococcus aureus subsp. aureus N315
ugguuuggauaaaauga

SEQ ID NO: 2127660 - RNA, 20 nt, Staphylococcus aureus subsp. aureus N315
uguaacaaaauacccugcuu

SEQ ID NO: 2127661 - RNA, 22 nt, Staphylococcus aureus subsp. aureus N315
uguaacauaaagcuguuuauug

SEQ ID NO: 2127662 - RNA, 15 nt, Staphylococcus aureus subsp. aureus N315
uguaacacgcucuuu

SEQ ID NO: 2127663 - RNA, 19 nt, Staphylococcus aureus subsp. aureus N315
uguaagcuaucguaaacaa

SEQ ID NO: 2127664 - RNA, 12 nt, Staphylococcus aureus subsp. aureus N315
ugguuuuuaauu

SEQ ID NO: 2127665 - RNA, 19 nt, Staphylococcus aureus subsp. aureus N315
uguaaauguuaaauucuaa

SEQ ID NO: 2127666 - RNA, 18 nt, Staphylococcus aureus subsp. aureus N315
uguaaaugaauuuugacg

SEQ ID NO: 2127667 - RNA, 13 nt, Staphylococcus aureus subsp. aureus N315
uguaaaugaaaua

SEQ ID NO: 2127668 - RNA, 20 nt, Staphylococcus aureus subsp. aureus N315
uguaagucgcucuagacauu

SEQ ID NO: 2127669 - RNA, 22 nt, Staphylococcus aureus subsp. aureus N315
uguaaguuauuuggauauuuau

SEQ ID NO: 2127670 - RNA, 15 nt, Staphylococcus aureus subsp. aureus N315
uguaauaugaaggcu

SEQ ID NO: 2127671 - RNA, 18 nt, Staphylococcus aureus subsp. aureus N315
uguaaguuugguuucuua

SEQ ID NO: 2127672 - RNA, 13 nt, Staphylococcus aureus subsp. aureus N315
uguaaucaauccu

SEQ ID NO: 2127673 - RNA, 23 nt, Staphylococcus aureus subsp. aureus N315
uguaaucacuaucuguuguuaua

SEQ ID NO: 2127674 - RNA, 19 nt, Staphylococcus aureus subsp. aureus N315
uguaaucucguuuuuacau

SEQ ID NO: 2127675 - RNA, 19 nt, Staphylococcus aureus subsp. aureus N315
uguaauccgcagaccacau

SEQ ID NO: 2127676 - RNA, 18 nt, Staphylococcus aureus subsp. aureus N315
uguaaugcuuaaaaacaa

SEQ ID NO: 2127677 - RNA, 21 nt, Staphylococcus aureus subsp. aureus N315
uguaauguuccccugaaaaga

SEQ ID NO: 2127678 - RNA, 13 nt, Staphylococcus aureus subsp. aureus N315
uguaauuaggauu

SEQ ID NO: 2127679 - RNA, 17 nt, Staphylococcus aureus subsp. aureus N315
uguaauuccucuggaac

SEQ ID NO: 2127680 - RNA, 12 nt, Staphylococcus aureus subsp. aureus N315
ugguaaauuuau

SEQ ID NO: 2127681 - RNA, 23 nt, Staphylococcus aureus subsp. aureus N315
uggggugagggccccaacacaga

SEQ ID NO: 2127682 - RNA, 18 nt, Staphylococcus aureus subsp. aureus N315
ugggggauuuuuuuaugu

SEQ ID NO: 2127683 - RNA, 16 nt, Staphylococcus aureus subsp. aureus N315
ugguagcauuuuagau

SEQ ID NO: 2127684 - RNA, 13 nt, Staphylococcus aureus subsp. aureus N315
ugguagcauuuua

SEQ ID NO: 2127685 - RNA, 16 nt, Staphylococcus aureus subsp. aureus N315
uggucauguguugcaa

SEQ ID NO: 2127686 - RNA, 14 nt, Staphylococcus aureus subsp. aureus N315
ugguauuuuuuaaa

SEQ ID NO: 2127687 - RNA, 18 nt, Staphylococcus aureus subsp. aureus N315
ugguauugauuauucuuu

SEQ ID NO: 2127688 - RNA, 13 nt, Staphylococcus aureus subsp. aureus N315
uggucuuucuuag

SEQ ID NO: 2127689 - RNA, 17 nt, Staphylococcus aureus subsp. aureus N315
uguucgggaauuuuuua

SEQ ID NO: 2127690 - RNA, 18 nt, Staphylococcus aureus subsp. aureus N315
uguucugcuuuuucuuua

SEQ ID NO: 2127691 - RNA, 23 nt, Staphylococcus aureus subsp. aureus N315
uguucauaaucauaauaagauuu

SEQ ID NO: 2127692 - RNA, 20 nt, Staphylococcus aureus subsp. aureus N315
uguucaucugauaauucgaa

SEQ ID NO: 2127693 - RNA, 19 nt, Staphylococcus aureus subsp. aureus N315
uguuccaaucuuuuuaauu

SEQ ID NO: 2127694 - RNA, 16 nt, Staphylococcus aureus subsp. aureus N315
uguucauuggcaauau

SEQ ID NO: 2127695 - RNA, 23 nt, Staphylococcus aureus subsp. aureus N315
uguugauaaugcuacuauuaaau

SEQ ID NO: 2127696 - RNA, 13 nt, Staphylococcus aureus subsp. aureus N315
uguugauaauagc

SEQ ID NO: 2127697 - RNA, 22 nt, Staphylococcus aureus subsp. aureus N315
uguugacauuugaccaaguaug

SEQ ID NO: 2127698 - RNA, 18 nt, Staphylococcus aureus subsp. aureus N315
uguugaacgguagauuua

SEQ ID NO: 2127699 - RNA, 20 nt, Staphylococcus aureus subsp. aureus N315
uguugaaauuaaauucaaau

SEQ ID NO: 2127700 - RNA, 18 nt, Staphylococcus aureus subsp. aureus N315
uguucuuucuuucuuuuc

SEQ ID NO: 2127701 - RNA, 14 nt, Staphylococcus aureus subsp. aureus N315
uguucuuauaaaaa

SEQ ID NO: 2127702 - RNA, 15 nt, Staphylococcus aureus subsp. aureus N315
uguucuuauaaaaaa

SEQ ID NO: 2127703 - RNA, 13 nt, Staphylococcus aureus subsp. aureus N315
uguucaauauuua

SEQ ID NO: 2127704 - RNA, 18 nt, Staphylococcus aureus subsp. aureus N315
uguucaauacuucuuguu

SEQ ID NO: 2127705 - RNA, 16 nt, Staphylococcus aureus subsp. aureus N315
uguucaaugauuuuau

SEQ ID NO: 2127706 - RNA, 19 nt, Staphylococcus aureus subsp. aureus N315
uguucaaugauuuuauaau

SEQ ID NO: 2127707 - RNA, 17 nt, Staphylococcus aureus subsp. aureus N315
uguucaauuguuacuuu

SEQ ID NO: 2127708 - RNA, 18 nt, Staphylococcus aureus subsp. aureus N315
uguucagguucaaaauug

SEQ ID NO: 2127709 - RNA, 16 nt, Staphylococcus aureus subsp. aureus N315
uguucaguuguuuuuu

SEQ ID NO: 2127710 - RNA, 22 nt, Staphylococcus aureus subsp. aureus N315
uguucaacuaaauuuucuaaau

SEQ ID NO: 2127711 - RNA, 16 nt, Staphylococcus aureus subsp. aureus N315
uguuaggggcuuuuau

SEQ ID NO: 2127712 - RNA, 22 nt, Staphylococcus aureus subsp. aureus N315
uguuaggagagauguauaaaac

SEQ ID NO: 2127713 - RNA, 19 nt, Staphylococcus aureus subsp. aureus N315
uguuaggagagauguauaa

SEQ ID NO: 2127714 - RNA, 14 nt, Staphylococcus aureus subsp. aureus N315
uguuagucuuuuua

SEQ ID NO: 2127715 - RNA, 23 nt, Staphylococcus aureus subsp. aureus N315
uguuauaaauagagaacagcagu

SEQ ID NO: 2127716 - RNA, 23 nt, Staphylococcus aureus subsp. aureus N315
uguuaguuuucuuaaaagagcaa

SEQ ID NO: 2127717 - RNA, 20 nt, Staphylococcus aureus subsp. aureus N315
uguuauauuguauuuuauuu

SEQ ID NO: 2127718 - RNA, 22 nt, Staphylococcus aureus subsp. aureus N315
uguguuguuucaggauaaugaa

SEQ ID NO: 2127719 - RNA, 13 nt, Staphylococcus aureus subsp. aureus N315
uguuaauuuaaua

SEQ ID NO: 2127720 - RNA, 13 nt, Staphylococcus aureus subsp. aureus N315
uguguugcaauug

SEQ ID NO: 2127721 - RNA, 16 nt, Staphylococcus aureus subsp. aureus N315
uguguuggggcccaca

SEQ ID NO: 2127722 - RNA, 19 nt, Staphylococcus aureus subsp. aureus N315
uguguuggggcccacaccc

SEQ ID NO: 2127723 - RNA, 20 nt, Staphylococcus aureus subsp. aureus N315
uguguugaaacugaguucaa

SEQ ID NO: 2127724 - RNA, 14 nt, Staphylococcus aureus subsp. aureus N315
uguguuaaaauaua

SEQ ID NO: 2127725 - RNA, 15 nt, Staphylococcus aureus subsp. aureus N315
uguuacacaaauuaa

SEQ ID NO: 2127726 - RNA, 16 nt, Staphylococcus aureus subsp. aureus N315
uguuaauuuuuuauua

SEQ ID NO: 2127727 - RNA, 17 nt, Staphylococcus aureus subsp. aureus N315
uguuacacaaauuaaaa

SEQ ID NO: 2127728 - RNA, 16 nt, Staphylococcus aureus subsp. aureus N315
uguuacacuuuucuua

SEQ ID NO: 2127729 - RNA, 23 nt, Staphylococcus aureus subsp. aureus N315
uguuacuaguuuguaauaauuaa

SEQ ID NO: 2127730 - RNA, 15 nt, Staphylococcus aureus subsp. aureus N315
uguuacuuauauauu

SEQ ID NO: 2127731 - RNA, 16 nt, Staphylococcus aureus subsp. aureus N315
uguuacugcacacaua

SEQ ID NO: 2127732 - RNA, 21 nt, Staphylococcus aureus subsp. aureus N315
ugugcuuuuccauaaauauuu

SEQ ID NO: 2127733 - RNA, 13 nt, Staphylococcus aureus subsp. aureus N315
ugugcuuaagaac

SEQ ID NO: 2127734 - RNA, 15 nt, Staphylococcus aureus subsp. aureus N315
ugugauuuguuacuu

SEQ ID NO: 2127735 - RNA, 15 nt, Staphylococcus aureus subsp. aureus N315
ugugauuuuuugaua

SEQ ID NO: 2127736 - RNA, 19 nt, Staphylococcus aureus subsp. aureus N315
ugugauuuguuacuucuaa

SEQ ID NO: 2127737 - RNA, 15 nt, Staphylococcus aureus subsp. aureus N315
ugugauacuuucuaa

SEQ ID NO: 2127738 - RNA, 14 nt, Staphylococcus aureus subsp. aureus N315
ugugauaauucuuc

SEQ ID NO: 2127739 - RNA, 15 nt, Staphylococcus aureus subsp. aureus N315
ugugauauauaacca

SEQ ID NO: 2127740 - RNA, 17 nt, Staphylococcus aureus subsp. aureus N315
ugugauacuuucuaaga

SEQ ID NO: 2127741 - RNA, 15 nt, Staphylococcus aureus subsp. aureus N315
ugugaauaaaauugu

SEQ ID NO: 2127742 - RNA, 13 nt, Staphylococcus aureus subsp. aureus N315
ugugaaaauacca

SEQ ID NO: 2127743 - RNA, 18 nt, Staphylococcus aureus subsp. aureus N315
ugugaauguuuucuaaau

SEQ ID NO: 2127744 - RNA, 14 nt, Staphylococcus aureus subsp. aureus N315
ugugaauguuuugu

SEQ ID NO: 2127745 - RNA, 17 nt, Staphylococcus aureus subsp. aureus N315
ugucuuuuauuaugaua

SEQ ID NO: 2127746 - RNA, 14 nt, Staphylococcus aureus subsp. aureus N315
ugucuuugaacaua

SEQ ID NO: 2127747 - RNA, 20 nt, Staphylococcus aureus subsp. aureus N315
ugucuuaucaauuagccaau

SEQ ID NO: 2127748 - RNA, 21 nt, Staphylococcus aureus subsp. aureus N315
ugucuuaggcgcuacaauguu

SEQ ID NO: 2127749 - RNA, 13 nt, Staphylococcus aureus subsp. aureus N315
ugucuuacuuuua

SEQ ID NO: 2127750 - RNA, 15 nt, Staphylococcus aureus subsp. aureus N315
ugucuuaauaugcaa

SEQ ID NO: 2127751 - RNA, 14 nt, Staphylococcus aureus subsp. aureus N315
ugucuauuguaaaa

SEQ ID NO: 2127752 - RNA, 19 nt, Staphylococcus aureus subsp. aureus N315
ugucuaguucgauuuuuua

SEQ ID NO: 2127753 - RNA, 21 nt, Staphylococcus aureus subsp. aureus N315
ugucuaguucgauuuuuuaau

SEQ ID NO: 2127754 - RNA, 16 nt, Staphylococcus aureus subsp. aureus N315
ugucuagacuuauuug

SEQ ID NO: 2127755 - RNA, 17 nt, Staphylococcus aureus subsp. aureus N315
ugucuagacuuauuuga

SEQ ID NO: 2127756 - RNA, 23 nt, Staphylococcus aureus subsp. aureus N315
ugucuagacuuauuugaaugcaa

SEQ ID NO: 2127757 - RNA, 21 nt, Staphylococcus aureus subsp. aureus N315
ugucuaaucgacuuuuacaau

SEQ ID NO: 2127758 - RNA, 19 nt, Staphylococcus aureus subsp. aureus N315
ugucguuguacaucauuaa

SEQ ID NO: 2127759 - RNA, 23 nt, Staphylococcus aureus subsp. aureus N315
ugucucaauaauguuacgcugug

SEQ ID NO: 2127760 - RNA, 19 nt, Staphylococcus aureus subsp. aureus N315
ugucucaaauuaaaucacc

SEQ ID NO: 2127761 - RNA, 15 nt, Staphylococcus aureus subsp. aureus N315
ugucgguucaucuaa

SEQ ID NO: 2127762 - RNA, 15 nt, Staphylococcus aureus subsp. aureus N315
ugucgacuuuuagau

SEQ ID NO: 2127763 - RNA, 14 nt, Staphylococcus aureus subsp. aureus N315
uguccgauaucuuu

SEQ ID NO: 2127764 - RNA, 19 nt, Staphylococcus aureus subsp. aureus N315
uguccgacuugauaaaaaa

SEQ ID NO: 2127765 - RNA, 15 nt, Staphylococcus aureus subsp. aureus N315
uguccguuuauagau

SEQ ID NO: 2127766 - RNA, 21 nt, Staphylococcus aureus subsp. aureus N315
uguccuaacgcuaauuuuacu

SEQ ID NO: 2127767 - RNA, 22 nt, Staphylococcus aureus subsp. aureus N315
uguccuaacgcuaauuuuacuc

SEQ ID NO: 2127768 - RNA, 19 nt, Staphylococcus aureus subsp. aureus N315
uguccaucuuuuauuaaag

SEQ ID NO: 2127769 - RNA, 17 nt, Staphylococcus aureus subsp. aureus N315
uguccacuauauccuuu

SEQ ID NO: 2127770 - RNA, 20 nt, Staphylococcus aureus subsp. aureus N315
ugucauguguucaaauaacg

SEQ ID NO: 2127771 - RNA, 18 nt, Staphylococcus aureus subsp. aureus N315
uguccaaauaaauauaaa

SEQ ID NO: 2127772 - RNA, 16 nt, Staphylococcus aureus subsp. aureus N315
ugucauuuucugcuuu

SEQ ID NO: 2127773 - RNA, 17 nt, Staphylococcus aureus subsp. aureus N315
uguccaauaaauugugg

SEQ ID NO: 2127774 - RNA, 20 nt, Staphylococcus aureus subsp. aureus N315
uguaucuuaaauuacuuaau

SEQ ID NO: 2127775 - RNA, 14 nt, Staphylococcus aureus subsp. aureus N315
uguacauaugugua

SEQ ID NO: 2127776 - RNA, 21 nt, Staphylococcus aureus subsp. aureus N315
uguacacuaucguuuuuauua

SEQ ID NO: 2127777 - RNA, 14 nt, Staphylococcus aureus subsp. aureus N315
uguacacuuuugau

SEQ ID NO: 2127778 - RNA, 17 nt, Staphylococcus aureus subsp. aureus N315
uguauuguauuuuaaug

SEQ ID NO: 2127779 - RNA, 17 nt, Staphylococcus aureus subsp. aureus N315
uguauuguuuguuuuua

SEQ ID NO: 2127780 - RNA, 16 nt, Staphylococcus aureus subsp. aureus N315
uguauuguuuguagaa

SEQ ID NO: 2127781 - RNA, 18 nt, Staphylococcus aureus subsp. aureus N315
uguauucuucuaauucug

SEQ ID NO: 2127782 - RNA, 16 nt, Staphylococcus aureus subsp. aureus N315
uguauucuuagauauu

SEQ ID NO: 2127783 - RNA, 17 nt, Staphylococcus aureus subsp. aureus N315
uguauucugaaacuuua

SEQ ID NO: 2127784 - RNA, 19 nt, Staphylococcus aureus subsp. aureus N315
uguauucugaaacuuuaau

SEQ ID NO: 2127785 - RNA, 22 nt, Staphylococcus aureus subsp. aureus N315
uguauggaaaguugguuuuauu

SEQ ID NO: 2127786 - RNA, 19 nt, Staphylococcus aureus subsp. aureus N315
uguaugccgccuaauaaua

SEQ ID NO: 2127787 - RNA, 19 nt, Staphylococcus aureus subsp. aureus N315
uguaugaaaggaguauuuu

SEQ ID NO: 2127788 - RNA, 20 nt, Staphylococcus aureus subsp. aureus N315
uguaugauaaccauuaugau

SEQ ID NO: 2127789 - RNA, 16 nt, Staphylococcus aureus subsp. aureus N315
uguaugaugaacuuaa

SEQ ID NO: 2127790 - RNA, 20 nt, Staphylococcus aureus subsp. aureus N315
uguaugauagaauacuaaaa

SEQ ID NO: 2127791 - RNA, 21 nt, Staphylococcus aureus subsp. aureus N315
uguaugaucaagcugagcuuu

SEQ ID NO: 2127792 - RNA, 11 nt, Staphylococcus aureus subsp. aureus N315
ugucauaccuu

SEQ ID NO: 2127793 - RNA, 21 nt, Staphylococcus aureus subsp. aureus N315
ugucaguuuugaagaauaaaa

SEQ ID NO: 2127794 - RNA, 13 nt, Staphylococcus aureus subsp. aureus N315
ugucauaauccau

SEQ ID NO: 2127795 - RNA, 19 nt, Staphylococcus aureus subsp. aureus N315
ugucauaauccauucuucu

SEQ ID NO: 2127796 - RNA, 24 nt, Staphylococcus aureus subsp. aureus N315
ugucaaaucggcuauacauugaua

SEQ ID NO: 2127797 - RNA, 22 nt, Staphylococcus aureus subsp. aureus N315
ugucaaauacguaucaagaaaa

SEQ ID NO: 2127798 - RNA, 12 nt, Staphylococcus aureus subsp. aureus N315
uguauuuaaaau

SEQ ID NO: 2127799 - RNA, 19 nt, Staphylococcus aureus subsp. aureus N315
uguauuguuuguuuuuaua

SEQ ID NO: 2127800 - RNA, 16 nt, Staphylococcus aureus subsp. aureus N315
ugucaauaaauuguuu

SEQ ID NO: 2127801 - RNA, 14 nt, Staphylococcus aureus subsp. aureus N315
uuauaaaaacuuau

SEQ ID NO: 2127802 - RNA, 16 nt, Staphylococcus aureus subsp. aureus N315
uuagagaagaauucuc

SEQ ID NO: 2127803 - RNA, 23 nt, Staphylococcus aureus subsp. aureus N315
uuauaaagauagaaugaauaauu

SEQ ID NO: 2127804 - RNA, 13 nt, Staphylococcus aureus subsp. aureus N315
uuauaaagcugcg

SEQ ID NO: 2127805 - RNA, 23 nt, Staphylococcus aureus subsp. aureus N315
uuauaaaccuaaugcuuuaauaa

SEQ ID NO: 2127806 - RNA, 16 nt, Staphylococcus aureus subsp. aureus N315
uuauaaacauagguag

SEQ ID NO: 2127807 - RNA, 12 nt, Staphylococcus aureus subsp. aureus N315
uuauaaguacaa

SEQ ID NO: 2127808 - RNA, 14 nt, Staphylococcus aureus subsp. aureus N315
uuauaaguaaauaa

SEQ ID NO: 2127809 - RNA, 20 nt, Staphylococcus aureus subsp. aureus N315
uuauaaauagagaacagcag

SEQ ID NO: 2127810 - RNA, 23 nt, Staphylococcus aureus subsp. aureus N315
uuauaacucuauccaaagacaua

SEQ ID NO: 2127811 - RNA, 19 nt, Staphylococcus aureus subsp. aureus N315
uuauaagaauuuaaaagag

SEQ ID NO: 2127812 - RNA, 13 nt, Staphylococcus aureus subsp. aureus N315
uuauaauuguuca

SEQ ID NO: 2127813 - RNA, 14 nt, Staphylococcus aureus subsp. aureus N315
uuauacacuuuuug

SEQ ID NO: 2127814 - RNA, 19 nt, Staphylococcus aureus subsp. aureus N315
uuauaaguuaaaaauguaa

SEQ ID NO: 2127815 - RNA, 15 nt, Staphylococcus aureus subsp. aureus N315
uuauaaguauauaau

SEQ ID NO: 2127816 - RNA, 21 nt, Staphylococcus aureus subsp. aureus N315
uuauaaguaucgccaucauuc

SEQ ID NO: 2127817 - RNA, 17 nt, Staphylococcus aureus subsp. aureus N315
uuauaauauuaaauugc

SEQ ID NO: 2127818 - RNA, 21 nt, Staphylococcus aureus subsp. aureus N315
uuauaauacguguguuuucuu

SEQ ID NO: 2127819 - RNA, 15 nt, Staphylococcus aureus subsp. aureus N315
uuauacagugaaucu

SEQ ID NO: 2127820 - RNA, 15 nt, Staphylococcus aureus subsp. aureus N315
uuauacauaaauauu

SEQ ID NO: 2127821 - RNA, 13 nt, Staphylococcus aureus subsp. aureus N315
uuauauaauucuu

SEQ ID NO: 2127822 - RNA, 13 nt, Staphylococcus aureus subsp. aureus N315
uuauagccuucau

SEQ ID NO: 2127823 - RNA, 13 nt, Staphylococcus aureus subsp. aureus N315
uuauaucaaaauc

SEQ ID NO: 2127824 - RNA, 14 nt, Staphylococcus aureus subsp. aureus N315
uuauaucaaaaaau

SEQ ID NO: 2127825 - RNA, 23 nt, Staphylococcus aureus subsp. aureus N315
uuauauccaucuccaccauuaau

SEQ ID NO: 2127826 - RNA, 13 nt, Staphylococcus aureus subsp. aureus N315
uuaucaacaacaa

SEQ ID NO: 2127827 - RNA, 17 nt, Staphylococcus aureus subsp. aureus N315
uuaucaacauaaaauuu

SEQ ID NO: 2127828 - RNA, 18 nt, Staphylococcus aureus subsp. aureus N315
uuauauauauuaaaguaa

SEQ ID NO: 2127829 - RNA, 15 nt, Staphylococcus aureus subsp. aureus N315
uuauauauucaauaa

SEQ ID NO: 2127830 - RNA, 14 nt, Staphylococcus aureus subsp. aureus N315
uuauauauauuaaa

SEQ ID NO: 2127831 - RNA, 21 nt, Staphylococcus aureus subsp. aureus N315
uuauauagauugccauucaua

SEQ ID NO: 2127832 - RNA, 19 nt, Staphylococcus aureus subsp. aureus N315
uuaucaagagguaaaucug

SEQ ID NO: 2127833 - RNA, 20 nt, Staphylococcus aureus subsp. aureus N315
uuaucaacgauuuugucuuu

SEQ ID NO: 2127834 - RNA, 22 nt, Staphylococcus aureus subsp. aureus N315
uuaucaauaaaucaguaguuuu

SEQ ID NO: 2127835 - RNA, 20 nt, Staphylococcus aureus subsp. aureus N315
uuaucaauuucuauuucacu

SEQ ID NO: 2127836 - RNA, 18 nt, Staphylococcus aureus subsp. aureus N315
uuaucaucacacucuccc

SEQ ID NO: 2127837 - RNA, 22 nt, Staphylococcus aureus subsp. aureus N315
uuauccaaaccaauuuuaacuu

SEQ ID NO: 2127838 - RNA, 15 nt, Staphylococcus aureus subsp. aureus N315
uuauccaaaacauuu

SEQ ID NO: 2127839 - RNA, 14 nt, Staphylococcus aureus subsp. aureus N315
uuaucaucuauuca

SEQ ID NO: 2127840 - RNA, 12 nt, Staphylococcus aureus subsp. aureus N315
uuaucauuauuc

SEQ ID NO: 2127841 - RNA, 16 nt, Staphylococcus aureus subsp. aureus N315
uuaucauuacagauaa

SEQ ID NO: 2127842 - RNA, 22 nt, Staphylococcus aureus subsp. aureus N315
uuaucauuaaauugcuugaaau

SEQ ID NO: 2127843 - RNA, 19 nt, Staphylococcus aureus subsp. aureus N315
uuaugcauauguaauacaa

SEQ ID NO: 2127844 - RNA, 21 nt, Staphylococcus aureus subsp. aureus N315
uuaugcauauguaauacaaaa

SEQ ID NO: 2127845 - RNA, 18 nt, Staphylococcus aureus subsp. aureus N315
uuaugccauucauuaagc

SEQ ID NO: 2127846 - RNA, 21 nt, Staphylococcus aureus subsp. aureus N315
uuaugcaugcgcaaaagcgca

SEQ ID NO: 2127847 - RNA, 18 nt, Staphylococcus aureus subsp. aureus N315
uuaugcaugcgcaaaagc

SEQ ID NO: 2127848 - RNA, 14 nt, Staphylococcus aureus subsp. aureus N315
uuaugaugucaugu

SEQ ID NO: 2127849 - RNA, 15 nt, Staphylococcus aureus subsp. aureus N315
uuaugauuauauuuu

SEQ ID NO: 2127850 - RNA, 15 nt, Staphylococcus aureus subsp. aureus N315
uuaugcaaaauuaau

SEQ ID NO: 2127851 - RNA, 19 nt, Staphylococcus aureus subsp. aureus N315
uuaugacuuauuuuucauc

SEQ ID NO: 2127852 - RNA, 15 nt, Staphylococcus aureus subsp. aureus N315
uuaugagcuuaauaa

SEQ ID NO: 2127853 - RNA, 17 nt, Staphylococcus aureus subsp. aureus N315
uuaugagcuucuuuaaa

SEQ ID NO: 2127854 - RNA, 20 nt, Staphylococcus aureus subsp. aureus N315
uuaugauacugauauuuaga

SEQ ID NO: 2127855 - RNA, 20 nt, Staphylococcus aureus subsp. aureus N315
uuaugacaaaguucugcaau

SEQ ID NO: 2127856 - RNA, 13 nt, Staphylococcus aureus subsp. aureus N315
uuaucuuuaagua

SEQ ID NO: 2127857 - RNA, 16 nt, Staphylococcus aureus subsp. aureus N315
uuaucuuuaauuuaca

SEQ ID NO: 2127858 - RNA, 15 nt, Staphylococcus aureus subsp. aureus N315
uuaucuuuacgauaa

SEQ ID NO: 2127859 - RNA, 12 nt, Staphylococcus aureus subsp. aureus N315
uuaucuuuauaa

SEQ ID NO: 2127860 - RNA, 15 nt, Staphylococcus aureus subsp. aureus N315
uuaugaaaacauuau

SEQ ID NO: 2127861 - RNA, 13 nt, Staphylococcus aureus subsp. aureus N315
uuaugaaaaguaa

SEQ ID NO: 2127862 - RNA, 16 nt, Staphylococcus aureus subsp. aureus N315
uuauguuuaaacauuu

SEQ ID NO: 2127863 - RNA, 13 nt, Staphylococcus aureus subsp. aureus N315
uuauguuuaauuu

SEQ ID NO: 2127864 - RNA, 17 nt, Staphylococcus aureus subsp. aureus N315
uuauguucgauuauucu

SEQ ID NO: 2127865 - RNA, 19 nt, Staphylococcus aureus subsp. aureus N315
uuauguauuuuuauuuaua

SEQ ID NO: 2127866 - RNA, 20 nt, Staphylococcus aureus subsp. aureus N315
uuauguuauaaauucuaucu

SEQ ID NO: 2127867 - RNA, 22 nt, Staphylococcus aureus subsp. aureus N315
uuauggcgguuugaaaaugacg

SEQ ID NO: 2127868 - RNA, 17 nt, Staphylococcus aureus subsp. aureus N315
uuaugggguguauuuuu

SEQ ID NO: 2127869 - RNA, 13 nt, Staphylococcus aureus subsp. aureus N315
uuaugcuauuuug

SEQ ID NO: 2127870 - RNA, 14 nt, Staphylococcus aureus subsp. aureus N315
uuaugcuuuaaauc

SEQ ID NO: 2127871 - RNA, 16 nt, Staphylococcus aureus subsp. aureus N315
uuaugcuagaaaguaa

SEQ ID NO: 2127872 - RNA, 17 nt, Staphylococcus aureus subsp. aureus N315
uuaucuguaucaaaauc

SEQ ID NO: 2127873 - RNA, 20 nt, Staphylococcus aureus subsp. aureus N315
uuaucuguagauuagcuuaa

SEQ ID NO: 2127874 - RNA, 14 nt, Staphylococcus aureus subsp. aureus N315
uuaucuaacucaua

SEQ ID NO: 2127875 - RNA, 14 nt, Staphylococcus aureus subsp. aureus N315
uuaucuauauauga

SEQ ID NO: 2127876 - RNA, 17 nt, Staphylococcus aureus subsp. aureus N315
uuaucugaccaguauac

SEQ ID NO: 2127877 - RNA, 18 nt, Staphylococcus aureus subsp. aureus N315
uuaucugacauuguugcu

SEQ ID NO: 2127878 - RNA, 15 nt, Staphylococcus aureus subsp. aureus N315
uuaucugcaaaaugc

SEQ ID NO: 2127879 - RNA, 15 nt, Staphylococcus aureus subsp. aureus N315
uuaucugaaaauauc

SEQ ID NO: 2127880 - RNA, 21 nt, Staphylococcus aureus subsp. aureus N315
uuaucuaacaaucguuuuaau

SEQ ID NO: 2127881 - RNA, 20 nt, Staphylococcus aureus subsp. aureus N315
uuaucuaaaucuucaucauc

SEQ ID NO: 2127882 - RNA, 16 nt, Staphylococcus aureus subsp. aureus N315
uuaucgugaagaaaaa

SEQ ID NO: 2127883 - RNA, 17 nt, Staphylococcus aureus subsp. aureus N315
uuaucgugaagaaaaaa

SEQ ID NO: 2127884 - RNA, 16 nt, Staphylococcus aureus subsp. aureus N315
uuaucguaaaaaaacg

SEQ ID NO: 2127885 - RNA, 18 nt, Staphylococcus aureus subsp. aureus N315
uuaucgaucgguauuuuc

SEQ ID NO: 2127886 - RNA, 19 nt, Staphylococcus aureus subsp. aureus N315
uuaucgaucgguauuuuca

SEQ ID NO: 2127887 - RNA, 17 nt, Staphylococcus aureus subsp. aureus N315
uuaucgaucgguauuuu

SEQ ID NO: 2127888 - RNA, 17 nt, Staphylococcus aureus subsp. aureus N315
uuaucgaagaaacauua

SEQ ID NO: 2127889 - RNA, 15 nt, Staphylococcus aureus subsp. aureus N315
uuauccuacugcugu

SEQ ID NO: 2127890 - RNA, 17 nt, Staphylococcus aureus subsp. aureus N315
uuauccuacugcugucu

SEQ ID NO: 2127891 - RNA, 16 nt, Staphylococcus aureus subsp. aureus N315
uucaagagaaccaccu

SEQ ID NO: 2127892 - RNA, 19 nt, Staphylococcus aureus subsp. aureus N315
uucaacuuguuuccuacac

SEQ ID NO: 2127893 - RNA, 18 nt, Staphylococcus aureus subsp. aureus N315
uucaacuuuaaucaaaaa

SEQ ID NO: 2127894 - RNA, 18 nt, Staphylococcus aureus subsp. aureus N315
uucaacuuguuuccuaca

SEQ ID NO: 2127895 - RNA, 11 nt, Staphylococcus aureus subsp. aureus N315
uucaacuuuuc

SEQ ID NO: 2127896 - RNA, 14 nt, Staphylococcus aureus subsp. aureus N315
uucaagaccaaaua

SEQ ID NO: 2127897 - RNA, 14 nt, Staphylococcus aureus subsp. aureus N315
uucaagaccaugca

SEQ ID NO: 2127898 - RNA, 18 nt, Staphylococcus aureus subsp. aureus N315
uucaagaccaugcaaacu

SEQ ID NO: 2127899 - RNA, 11 nt, Staphylococcus aureus subsp. aureus N315
uucaagaacaa

SEQ ID NO: 2127900 - RNA, 13 nt, Staphylococcus aureus subsp. aureus N315
uucaacuacuuca

SEQ ID NO: 2127901 - RNA, 13 nt, Staphylococcus aureus subsp. aureus N315
uucaacuuauaaa

SEQ ID NO: 2127902 - RNA, 16 nt, Staphylococcus aureus subsp. aureus N315
uucaacuuauuauuua

SEQ ID NO: 2127903 - RNA, 22 nt, Staphylococcus aureus subsp. aureus N315
uucaacgcauauucuauuguug

SEQ ID NO: 2127904 - RNA, 15 nt, Staphylococcus aureus subsp. aureus N315
uucaacauuacaugc

SEQ ID NO: 2127905 - RNA, 14 nt, Staphylococcus aureus subsp. aureus N315
uucaaccaauuauu

SEQ ID NO: 2127906 - RNA, 17 nt, Staphylococcus aureus subsp. aureus N315
uucaaccaauuauuaaa

SEQ ID NO: 2127907 - RNA, 18 nt, Staphylococcus aureus subsp. aureus N315
uucaacauaacucaaaua

SEQ ID NO: 2127908 - RNA, 22 nt, Staphylococcus aureus subsp. aureus N315
uucaacaauuucaaugucugca

SEQ ID NO: 2127909 - RNA, 18 nt, Staphylococcus aureus subsp. aureus N315
uucaacaaacauaaauaa

SEQ ID NO: 2127910 - RNA, 21 nt, Staphylococcus aureus subsp. aureus N315
uucaaauaaaucaaacuuuuc

SEQ ID NO: 2127911 - RNA, 16 nt, Staphylococcus aureus subsp. aureus N315
uucaaauaauauaaaa

SEQ ID NO: 2127912 - RNA, 19 nt, Staphylococcus aureus subsp. aureus N315
uucaaauguaguuaagaua

SEQ ID NO: 2127913 - RNA, 19 nt, Staphylococcus aureus subsp. aureus N315
uucaaauguaacauuaaaa

SEQ ID NO: 2127914 - RNA, 17 nt, Staphylococcus aureus subsp. aureus N315
uucaaaauucaauauua

SEQ ID NO: 2127915 - RNA, 19 nt, Staphylococcus aureus subsp. aureus N315
uucaaaauucaauauuaau

SEQ ID NO: 2127916 - RNA, 12 nt, Staphylococcus aureus subsp. aureus N315
uucaaacauauu

SEQ ID NO: 2127917 - RNA, 15 nt, Staphylococcus aureus subsp. aureus N315
uucaaaguagacauu

SEQ ID NO: 2127918 - RNA, 15 nt, Staphylococcus aureus subsp. aureus N315
uucaaagacguacau

SEQ ID NO: 2127919 - RNA, 23 nt, Staphylococcus aureus subsp. aureus N315
uucaaagacacggccugcaaguc

SEQ ID NO: 2127920 - RNA, 23 nt, Staphylococcus aureus subsp. aureus N315
uucaaaagaaauuguguuucuuu

SEQ ID NO: 2127921 - RNA, 19 nt, Staphylococcus aureus subsp. aureus N315
uucaaaacguuuaauugca

SEQ ID NO: 2127922 - RNA, 20 nt, Staphylococcus aureus subsp. aureus N315
uucaaaacguuuaauugcag

SEQ ID NO: 2127923 - RNA, 11 nt, Staphylococcus aureus subsp. aureus N315
uucaaaaauag

SEQ ID NO: 2127924 - RNA, 16 nt, Staphylococcus aureus subsp. aureus N315
uucaaaaaucauacca

SEQ ID NO: 2127925 - RNA, 23 nt, Staphylococcus aureus subsp. aureus N315
uucaaaaaauaauagcaaaauua

SEQ ID NO: 2127926 - RNA, 14 nt, Staphylococcus aureus subsp. aureus N315
uucaaaaaauauuu

SEQ ID NO: 2127927 - RNA, 21 nt, Staphylococcus aureus subsp. aureus N315
uuauuuucuuuggugaaagua

SEQ ID NO: 2127928 - RNA, 16 nt, Staphylococcus aureus subsp. aureus N315
uuauuuuuauucaguu

SEQ ID NO: 2127929 - RNA, 10 nt, Staphylococcus aureus subsp. aureus N315
uuauuuuuua

SEQ ID NO: 2127930 - RNA, 21 nt, Staphylococcus aureus subsp. aureus N315
uuauuuuuuuaaaucuauaua

SEQ ID NO: 2127931 - RNA, 15 nt, Staphylococcus aureus subsp. aureus N315
uuauuccgcaacuug

SEQ ID NO: 2127932 - RNA, 12 nt, Staphylococcus aureus subsp. aureus N315
uuauuauuuauc

SEQ ID NO: 2127933 - RNA, 14 nt, Staphylococcus aureus subsp. aureus N315
uuauugaugaaaac

SEQ ID NO: 2127934 - RNA, 15 nt, Staphylococcus aureus subsp. aureus N315
uuauugagaauauuu

SEQ ID NO: 2127935 - RNA, 21 nt, Staphylococcus aureus subsp. aureus N315
uuauugaaauuuuuaauauac

SEQ ID NO: 2127936 - RNA, 18 nt, Staphylococcus aureus subsp. aureus N315
uuauucuuaauuuaagua

SEQ ID NO: 2127937 - RNA, 14 nt, Staphylococcus aureus subsp. aureus N315
uuauucuucacuuu

SEQ ID NO: 2127938 - RNA, 13 nt, Staphylococcus aureus subsp. aureus N315
uuauucuucccaa

SEQ ID NO: 2127939 - RNA, 15 nt, Staphylococcus aureus subsp. aureus N315
uuauugaaaagauaa

SEQ ID NO: 2127940 - RNA, 14 nt, Staphylococcus aureus subsp. aureus N315
uuauucucuuuauu

SEQ ID NO: 2127941 - RNA, 15 nt, Staphylococcus aureus subsp. aureus N315
uuauucuaauacaaa

SEQ ID NO: 2127942 - RNA, 15 nt, Staphylococcus aureus subsp. aureus N315
uuauucguuaacaau

SEQ ID NO: 2127943 - RNA, 18 nt, Staphylococcus aureus subsp. aureus N315
uuauuaacuuuaauauaa

SEQ ID NO: 2127944 - RNA, 13 nt, Staphylococcus aureus subsp. aureus N315
uuauuaacucaug

SEQ ID NO: 2127945 - RNA, 13 nt, Staphylococcus aureus subsp. aureus N315
uuauuaacugugu

SEQ ID NO: 2127946 - RNA, 13 nt, Staphylococcus aureus subsp. aureus N315
uuauuaaauaaca

SEQ ID NO: 2127947 - RNA, 13 nt, Staphylococcus aureus subsp. aureus N315
uuauuaaaucuuu

SEQ ID NO: 2127948 - RNA, 18 nt, Staphylococcus aureus subsp. aureus N315
uuauuaaaucuuuuacua

SEQ ID NO: 2127949 - RNA, 22 nt, Staphylococcus aureus subsp. aureus N315
uuauuaauuaaaaaauuccuag

SEQ ID NO: 2127950 - RNA, 22 nt, Staphylococcus aureus subsp. aureus N315
uuauuaauucugauuauguuca

SEQ ID NO: 2127951 - RNA, 22 nt, Staphylococcus aureus subsp. aureus N315
uuauuaauggcaacuaagauga

SEQ ID NO: 2127952 - RNA, 14 nt, Staphylococcus aureus subsp. aureus N315
uuauuauaauagcu

SEQ ID NO: 2127953 - RNA, 14 nt, Staphylococcus aureus subsp. aureus N315
uuauuauauaauaa

SEQ ID NO: 2127954 - RNA, 19 nt, Staphylococcus aureus subsp. aureus N315
uuauuaucuuuguaaauuu

SEQ ID NO: 2127955 - RNA, 16 nt, Staphylococcus aureus subsp. aureus N315
uuauuaugaauuauua

SEQ ID NO: 2127956 - RNA, 20 nt, Staphylococcus aureus subsp. aureus N315
uuauuaugaauuauuaauaa

SEQ ID NO: 2127957 - RNA, 13 nt, Staphylococcus aureus subsp. aureus N315
uuauuauguguuu

SEQ ID NO: 2127958 - RNA, 20 nt, Staphylococcus aureus subsp. aureus N315
uuauuauguuauaaauucua

SEQ ID NO: 2127959 - RNA, 12 nt, Staphylococcus aureus subsp. aureus N315
uuauuauuaaau

SEQ ID NO: 2127960 - RNA, 13 nt, Staphylococcus aureus subsp. aureus N315
uuauuauugaaau

SEQ ID NO: 2127961 - RNA, 14 nt, Staphylococcus aureus subsp. aureus N315
uuauuauuaaauua

SEQ ID NO: 2127962 - RNA, 20 nt, Staphylococcus aureus subsp. aureus N315
uuauuauuacaaugaaaaaa

SEQ ID NO: 2127963 - RNA, 17 nt, Staphylococcus aureus subsp. aureus N315
uuauuuauacuaaagca

SEQ ID NO: 2127964 - RNA, 12 nt, Staphylococcus aureus subsp. aureus N315
uuauuuaguaca

SEQ ID NO: 2127965 - RNA, 17 nt, Staphylococcus aureus subsp. aureus N315
uuauuucaauuaucaaa

SEQ ID NO: 2127966 - RNA, 13 nt, Staphylococcus aureus subsp. aureus N315
uuauuuaaaaugc

SEQ ID NO: 2127967 - RNA, 17 nt, Staphylococcus aureus subsp. aureus N315
uuauuguuuuuaaaauc

SEQ ID NO: 2127968 - RNA, 20 nt, Staphylococcus aureus subsp. aureus N315
uuauuuaaucguaacauauc

SEQ ID NO: 2127969 - RNA, 15 nt, Staphylococcus aureus subsp. aureus N315
uuauugcaauaaaau

SEQ ID NO: 2127970 - RNA, 21 nt, Staphylococcus aureus subsp. aureus N315
uuauugccgguuaaauuauuu

SEQ ID NO: 2127971 - RNA, 22 nt, Staphylococcus aureus subsp. aureus N315
uuauugucaucauguucuaaug

SEQ ID NO: 2127972 - RNA, 17 nt, Staphylococcus aureus subsp. aureus N315
uuauuguuccaaucuuu

SEQ ID NO: 2127973 - RNA, 23 nt, Staphylococcus aureus subsp. aureus N315
uuauuuucaauaaauuuuauaua

SEQ ID NO: 2127974 - RNA, 23 nt, Staphylococcus aureus subsp. aureus N315
uuauuuucauauaaauagcuucu

SEQ ID NO: 2127975 - RNA, 17 nt, Staphylococcus aureus subsp. aureus N315
uuauuuucaauaaauuu

SEQ ID NO: 2127976 - RNA, 13 nt, Staphylococcus aureus subsp. aureus N315
uuauuuucaauaa

SEQ ID NO: 2127977 - RNA, 17 nt, Staphylococcus aureus subsp. aureus N315
uuauuuucaauaaauaa

SEQ ID NO: 2127978 - RNA, 13 nt, Staphylococcus aureus subsp. aureus N315
uuauuuuaucauc

SEQ ID NO: 2127979 - RNA, 21 nt, Staphylococcus aureus subsp. aureus N315
uuauuuuaucaucuauucaac

SEQ ID NO: 2127980 - RNA, 18 nt, Staphylococcus aureus subsp. aureus N315
uuauuuguuuaauuaucu

SEQ ID NO: 2127981 - RNA, 20 nt, Staphylococcus aureus subsp. aureus N315
uuauuuggguaacauuagca

SEQ ID NO: 2127982 - RNA, 15 nt, Staphylococcus aureus subsp. aureus N315
uuauuuguaauuuca

SEQ ID NO: 2127983 - RNA, 21 nt, Staphylococcus aureus subsp. aureus N315
uuauuucuauaucuauuuauc

SEQ ID NO: 2127984 - RNA, 19 nt, Staphylococcus aureus subsp. aureus N315
uuauuugauaaauaaaauu

SEQ ID NO: 2127985 - RNA, 22 nt, Staphylococcus aureus subsp. aureus N315
uuauuugaaaugauaagaauca

SEQ ID NO: 2127986 - RNA, 18 nt, Staphylococcus aureus subsp. aureus N315
uuauuugauaaugauagu

SEQ ID NO: 2127987 - RNA, 21 nt, Staphylococcus aureus subsp. aureus N315
uuauuugauaaugauagugua

SEQ ID NO: 2127988 - RNA, 21 nt, Staphylococcus aureus subsp. aureus N315
uuauuuggaugguaaguauaa

SEQ ID NO: 2127989 - RNA, 17 nt, Staphylococcus aureus subsp. aureus N315
uuaacacauucaaauaa

SEQ ID NO: 2127990 - RNA, 21 nt, Staphylococcus aureus subsp. aureus N315
uuaacaccagauaucauaaua

SEQ ID NO: 2127991 - RNA, 18 nt, Staphylococcus aureus subsp. aureus N315
uuaacaauugauugcucu

SEQ ID NO: 2127992 - RNA, 21 nt, Staphylococcus aureus subsp. aureus N315
uuaacaauuuuaucugaaucu

SEQ ID NO: 2127993 - RNA, 20 nt, Staphylococcus aureus subsp. aureus N315
uuaacaaugcgauuaaacuc

SEQ ID NO: 2127994 - RNA, 16 nt, Staphylococcus aureus subsp. aureus N315
uuaacaagauaacuag

SEQ ID NO: 2127995 - RNA, 12 nt, Staphylococcus aureus subsp. aureus N315
uuaacaacauga

SEQ ID NO: 2127996 - RNA, 20 nt, Staphylococcus aureus subsp. aureus N315
uuaacauuuauucuuucucu

SEQ ID NO: 2127997 - RNA, 18 nt, Staphylococcus aureus subsp. aureus N315
uuaacauuugucauaaua

SEQ ID NO: 2127998 - RNA, 14 nt, Staphylococcus aureus subsp. aureus N315
uuaacauaaaauga

SEQ ID NO: 2127999 - RNA, 17 nt, Staphylococcus aureus subsp. aureus N315
uuaacgcaaaaauacuc

SEQ ID NO: 2128000 - RNA, 18 nt, Staphylococcus aureus subsp. aureus N315
uuaacguuauucauuugu

SEQ ID NO: 2128001 - RNA, 15 nt, Staphylococcus aureus subsp. aureus N315
uuaacuaauagacug

SEQ ID NO: 2128002 - RNA, 15 nt, Staphylococcus aureus subsp. aureus N315
uuaacgucauuuuua

SEQ ID NO: 2128003 - RNA, 13 nt, Staphylococcus aureus subsp. aureus N315
uuaacuauaacaa

SEQ ID NO: 2128004 - RNA, 16 nt, Staphylococcus aureus subsp. aureus N315
uuaacuauaaauagaa

SEQ ID NO: 2128005 - RNA, 15 nt, Staphylococcus aureus subsp. aureus N315
uuaacccacauuaaa

SEQ ID NO: 2128006 - RNA, 18 nt, Staphylococcus aureus subsp. aureus N315
uuaacccacauuaaauau

SEQ ID NO: 2128007 - RNA, 20 nt, Staphylococcus aureus subsp. aureus N315
uuaaccaguauaauuuucug

SEQ ID NO: 2128008 - RNA, 15 nt, Staphylococcus aureus subsp. aureus N315
uuaaccauuuaaaaa

SEQ ID NO: 2128009 - RNA, 19 nt, Staphylococcus aureus subsp. aureus N315
uuaaccauacauaugcuau

SEQ ID NO: 2128010 - RNA, 18 nt, Staphylococcus aureus subsp. aureus N315
uuaaccuugauuuaauuu

SEQ ID NO: 2128011 - RNA, 22 nt, Staphylococcus aureus subsp. aureus N315
uuaagccagcagguuucacaaa

SEQ ID NO: 2128012 - RNA, 13 nt, Staphylococcus aureus subsp. aureus N315
uuaagcccuuccc

SEQ ID NO: 2128013 - RNA, 19 nt, Staphylococcus aureus subsp. aureus N315
uuaagccugauguaccacu

SEQ ID NO: 2128014 - RNA, 15 nt, Staphylococcus aureus subsp. aureus N315
uuaagauuuuaacuu

SEQ ID NO: 2128015 - RNA, 20 nt, Staphylococcus aureus subsp. aureus N315
uuaacucaccuuuaucauua

SEQ ID NO: 2128016 - RNA, 14 nt, Staphylococcus aureus subsp. aureus N315
uuaacuuauauacg

SEQ ID NO: 2128017 - RNA, 14 nt, Staphylococcus aureus subsp. aureus N315
uuaacuucauaaua

SEQ ID NO: 2128018 - RNA, 12 nt, Staphylococcus aureus subsp. aureus N315
uuaacuuuaaua

SEQ ID NO: 2128019 - RNA, 16 nt, Staphylococcus aureus subsp. aureus N315
uuaagaaaucaacaac

SEQ ID NO: 2128020 - RNA, 16 nt, Staphylococcus aureus subsp. aureus N315
uuaauaacguacauuu

SEQ ID NO: 2128021 - RNA, 19 nt, Staphylococcus aureus subsp. aureus N315
uuaauaacccauuuucaaa

SEQ ID NO: 2128022 - RNA, 19 nt, Staphylococcus aureus subsp. aureus N315
uuaauaaccuuuaaaacau

SEQ ID NO: 2128023 - RNA, 17 nt, Staphylococcus aureus subsp. aureus N315
uuaauaaccgaaauauu

SEQ ID NO: 2128024 - RNA, 19 nt, Staphylococcus aureus subsp. aureus N315
uuaauaaacgcuucauagu

SEQ ID NO: 2128025 - RNA, 22 nt, Staphylococcus aureus subsp. aureus N315
uuaauaaauugacucaaagaua

SEQ ID NO: 2128026 - RNA, 21 nt, Staphylococcus aureus subsp. aureus N315
uuaauaacauccccaaaaaua

SEQ ID NO: 2128027 - RNA, 14 nt, Staphylococcus aureus subsp. aureus N315
uuaauaacaaaauu

SEQ ID NO: 2128028 - RNA, 22 nt, Staphylococcus aureus subsp. aureus N315
uuaauaaauuguuaucguucaa

SEQ ID NO: 2128029 - RNA, 18 nt, Staphylococcus aureus subsp. aureus N315
uuaauaaaauucuauaau

SEQ ID NO: 2128030 - RNA, 22 nt, Staphylococcus aureus subsp. aureus N315
uuaaguucaucuggugcaauau

SEQ ID NO: 2128031 - RNA, 22 nt, Staphylococcus aureus subsp. aureus N315
uuaagcucauuucaauauuaaa

SEQ ID NO: 2128032 - RNA, 19 nt, Staphylococcus aureus subsp. aureus N315
uuaaguugaaaaccucuuu

SEQ ID NO: 2128033 - RNA, 16 nt, Staphylococcus aureus subsp. aureus N315
uuaaauacgccaaaua

SEQ ID NO: 2128034 - RNA, 17 nt, Staphylococcus aureus subsp. aureus N315
uuaaauacuugcucuaa

SEQ ID NO: 2128035 - RNA, 23 nt, Staphylococcus aureus subsp. aureus N315
uuaaauauaaagacgauuuauua

SEQ ID NO: 2128036 - RNA, 20 nt, Staphylococcus aureus subsp. aureus N315
uuaaauaucaugcaaaacua

SEQ ID NO: 2128037 - RNA, 11 nt, Staphylococcus aureus subsp. aureus N315
uuaaauaucau

SEQ ID NO: 2128038 - RNA, 21 nt, Staphylococcus aureus subsp. aureus N315
uuaaauaugacgcgugaauua

SEQ ID NO: 2128039 - RNA, 21 nt, Staphylococcus aureus subsp. aureus N315
uuaaauauggaugauauucaa

SEQ ID NO: 2128040 - RNA, 17 nt, Staphylococcus aureus subsp. aureus N315
uuaaauauuuaaccuuu

SEQ ID NO: 2128041 - RNA, 21 nt, Staphylococcus aureus subsp. aureus N315
uuaaaugaugcaguaaaacca

SEQ ID NO: 2128042 - RNA, 20 nt, Staphylococcus aureus subsp. aureus N315
uuaaaugauggguauuuugu

SEQ ID NO: 2128043 - RNA, 20 nt, Staphylococcus aureus subsp. aureus N315
uuaaaugauucuuuauaagc

SEQ ID NO: 2128044 - RNA, 14 nt, Staphylococcus aureus subsp. aureus N315
uuaaaugcaauaca

SEQ ID NO: 2128045 - RNA, 21 nt, Staphylococcus aureus subsp. aureus N315
uuaaaugcccaccauguacau

SEQ ID NO: 2128046 - RNA, 15 nt, Staphylococcus aureus subsp. aureus N315
uuaaaucaacaagaa

SEQ ID NO: 2128047 - RNA, 19 nt, Staphylococcus aureus subsp. aureus N315
uuaaaucaacaucaucuuu

SEQ ID NO: 2128048 - RNA, 13 nt, Staphylococcus aureus subsp. aureus N315
uuaaaucacauau

SEQ ID NO: 2128049 - RNA, 19 nt, Staphylococcus aureus subsp. aureus N315
uuaaaucaccaacaacuuu

SEQ ID NO: 2128050 - RNA, 19 nt, Staphylococcus aureus subsp. aureus N315
uuaaauguauuuuuacuuu

SEQ ID NO: 2128051 - RNA, 22 nt, Staphylococcus aureus subsp. aureus N315
uuaaauguacauuguaaauaua

SEQ ID NO: 2128052 - RNA, 22 nt, Staphylococcus aureus subsp. aureus N315
uuaaauuaaagcaaauuauaua

SEQ ID NO: 2128053 - RNA, 13 nt, Staphylococcus aureus subsp. aureus N315
uuaaauucuaaaa

SEQ ID NO: 2128054 - RNA, 14 nt, Staphylococcus aureus subsp. aureus N315
uuaaauuuaaaaga

SEQ ID NO: 2128055 - RNA, 18 nt, Staphylococcus aureus subsp. aureus N315
uuaaauuggaaucccaau

SEQ ID NO: 2128056 - RNA, 14 nt, Staphylococcus aureus subsp. aureus N315
uuaaauucaucuug

SEQ ID NO: 2128057 - RNA, 22 nt, Staphylococcus aureus subsp. aureus N315
uuaaauuccaugucaauuuuuu

SEQ ID NO: 2128058 - RNA, 13 nt, Staphylococcus aureus subsp. aureus N315
uuaaauucauuuu

SEQ ID NO: 2128059 - RNA, 12 nt, Staphylococcus aureus subsp. aureus N315
uuaaauucauuu

SEQ ID NO: 2128060 - RNA, 15 nt, Staphylococcus aureus subsp. aureus N315
uuaaauuauauguuu

SEQ ID NO: 2128061 - RNA, 21 nt, Staphylococcus aureus subsp. aureus N315
uuaaauuauauguuuuuauua

SEQ ID NO: 2128062 - RNA, 21 nt, Staphylococcus aureus subsp. aureus N315
uuaaauuauuuaauuuuucua

SEQ ID NO: 2128063 - RNA, 16 nt, Staphylococcus aureus subsp. aureus N315
uuaaauuauuuaauuu

SEQ ID NO: 2128064 - RNA, 19 nt, Staphylococcus aureus subsp. aureus N315
uuaaauuauuuaauuuuuc

SEQ ID NO: 2128065 - RNA, 16 nt, Staphylococcus aureus subsp. aureus N315
uuaaauuugaaaguaa

SEQ ID NO: 2128066 - RNA, 17 nt, Staphylococcus aureus subsp. aureus N315
uuaacaaaauuaagaag

SEQ ID NO: 2128067 - RNA, 20 nt, Staphylococcus aureus subsp. aureus N315
uuaacaaaauuaagaagaaa

SEQ ID NO: 2128068 - RNA, 20 nt, Staphylococcus aureus subsp. aureus N315
uuaaagacugaaccguauaa

SEQ ID NO: 2128069 - RNA, 20 nt, Staphylococcus aureus subsp. aureus N315
uuaaacgcugauuuuauaaa

SEQ ID NO: 2128070 - RNA, 21 nt, Staphylococcus aureus subsp. aureus N315
uuaaagaaaauuucaguacca

SEQ ID NO: 2128071 - RNA, 21 nt, Staphylococcus aureus subsp. aureus N315
uuaaagaaaauaucugaaaaa

SEQ ID NO: 2128072 - RNA, 14 nt, Staphylococcus aureus subsp. aureus N315
uuaaagaacuauuu

SEQ ID NO: 2128073 - RNA, 20 nt, Staphylococcus aureus subsp. aureus N315
uuaaagaacuauuuuaaauu

SEQ ID NO: 2128074 - RNA, 22 nt, Staphylococcus aureus subsp. aureus N315
uuaaaguagaaccuauauuaag

SEQ ID NO: 2128075 - RNA, 22 nt, Staphylococcus aureus subsp. aureus N315
uuaaaguaaaauauacuugaag

SEQ ID NO: 2128076 - RNA, 16 nt, Staphylococcus aureus subsp. aureus N315
uuaaauaaucaacaaa

SEQ ID NO: 2128077 - RNA, 17 nt, Staphylococcus aureus subsp. aureus N315
uuaaagcuaucuucaga

SEQ ID NO: 2128078 - RNA, 22 nt, Staphylococcus aureus subsp. aureus N315
uuaaagcuaguaaugccauuaa

SEQ ID NO: 2128079 - RNA, 14 nt, Staphylococcus aureus subsp. aureus N315
uuaaaggaaaucaa

SEQ ID NO: 2128080 - RNA, 16 nt, Staphylococcus aureus subsp. aureus N315
uuaaagguuaaauauu

SEQ ID NO: 2128081 - RNA, 20 nt, Staphylococcus aureus subsp. aureus N315
uuaaagguuaaauauuuaau

SEQ ID NO: 2128082 - RNA, 16 nt, Staphylococcus aureus subsp. aureus N315
uuaaaggguguuuaga

SEQ ID NO: 2128083 - RNA, 15 nt, Staphylococcus aureus subsp. aureus N315
uuaaacaagcaucau

SEQ ID NO: 2128084 - RNA, 17 nt, Staphylococcus aureus subsp. aureus N315
uuaaaauuuuaauuaau

SEQ ID NO: 2128085 - RNA, 16 nt, Staphylococcus aureus subsp. aureus N315
uguugcguuaaauaug

SEQ ID NO: 2128086 - RNA, 19 nt, Staphylococcus aureus subsp. aureus N315
uuaaacaugaacaaucaga

SEQ ID NO: 2128087 - RNA, 16 nt, Staphylococcus aureus subsp. aureus N315
uuaaacauuuagauuu

SEQ ID NO: 2128088 - RNA, 15 nt, Staphylococcus aureus subsp. aureus N315
uuaaacaguuuaauu

SEQ ID NO: 2128089 - RNA, 22 nt, Staphylococcus aureus subsp. aureus N315
uuaaacauaacaugaccuaaua

SEQ ID NO: 2128090 - RNA, 16 nt, Staphylococcus aureus subsp. aureus N315
uuaaacaagcaucaug

SEQ ID NO: 2128091 - RNA, 22 nt, Staphylococcus aureus subsp. aureus N315
uuaaacauuuuuagaaucaaaa

SEQ ID NO: 2128092 - RNA, 20 nt, Staphylococcus aureus subsp. aureus N315
uuacggcauaauuuuuuaau

SEQ ID NO: 2128093 - RNA, 18 nt, Staphylococcus aureus subsp. aureus N315
uuacgaucauaaauauuu

SEQ ID NO: 2128094 - RNA, 20 nt, Staphylococcus aureus subsp. aureus N315
uuacccacaucuuuuuaaaa

SEQ ID NO: 2128095 - RNA, 22 nt, Staphylococcus aureus subsp. aureus N315
uuaccaugaugagauaaaauca

SEQ ID NO: 2128096 - RNA, 12 nt, Staphylococcus aureus subsp. aureus N315
uuaccaucuuua

SEQ ID NO: 2128097 - RNA, 14 nt, Staphylococcus aureus subsp. aureus N315
uuaccaucuuuaau

SEQ ID NO: 2128098 - RNA, 20 nt, Staphylococcus aureus subsp. aureus N315
uuagaagaugauuauucucu

SEQ ID NO: 2128099 - RNA, 19 nt, Staphylococcus aureus subsp. aureus N315
uuagaaaaguaaguaaaau

SEQ ID NO: 2128100 - RNA, 19 nt, Staphylococcus aureus subsp. aureus N315
uuagaauuaguacuugaaa

SEQ ID NO: 2128101 - RNA, 13 nt, Staphylococcus aureus subsp. aureus N315
uuacuuaauagua

SEQ ID NO: 2128102 - RNA, 15 nt, Staphylococcus aureus subsp. aureus N315
uuacuuuuaaaacua

SEQ ID NO: 2128103 - RNA, 22 nt, Staphylococcus aureus subsp. aureus N315
uuacuuuuccuugauucuuaua

SEQ ID NO: 2128104 - RNA, 12 nt, Staphylococcus aureus subsp. aureus N315
uuacuuuaacuu

SEQ ID NO: 2128105 - RNA, 19 nt, Staphylococcus aureus subsp. aureus N315
uuacucuacacucaaacaa

SEQ ID NO: 2128106 - RNA, 22 nt, Staphylococcus aureus subsp. aureus N315
uuacugaaacuaaauuaaaagu

SEQ ID NO: 2128107 - RNA, 16 nt, Staphylococcus aureus subsp. aureus N315
uuacugaugaacauac

SEQ ID NO: 2128108 - RNA, 17 nt, Staphylococcus aureus subsp. aureus N315
uuacucaaaccaucuua

SEQ ID NO: 2128109 - RNA, 17 nt, Staphylococcus aureus subsp. aureus N315
uuacucauuuuucuugu

SEQ ID NO: 2128110 - RNA, 23 nt, Staphylococcus aureus subsp. aureus N315
uuacuccaaaguaacaugugcaa

SEQ ID NO: 2128111 - RNA, 18 nt, Staphylococcus aureus subsp. aureus N315
uuacuauggcauuauugc

SEQ ID NO: 2128112 - RNA, 15 nt, Staphylococcus aureus subsp. aureus N315
uuacuauuaaaggaa

SEQ ID NO: 2128113 - RNA, 16 nt, Staphylococcus aureus subsp. aureus N315
uuaauacguuuaauaa

SEQ ID NO: 2128114 - RNA, 15 nt, Staphylococcus aureus subsp. aureus N315
uuaauacgaauuuca

SEQ ID NO: 2128115 - RNA, 22 nt, Staphylococcus aureus subsp. aureus N315
uuaauaccuaucccuguaaaac

SEQ ID NO: 2128116 - RNA, 22 nt, Staphylococcus aureus subsp. aureus N315
uuaauacuaccguuuuuauaua

SEQ ID NO: 2128117 - RNA, 18 nt, Staphylococcus aureus subsp. aureus N315
uuaauagagaaagaauaa

SEQ ID NO: 2128118 - RNA, 17 nt, Staphylococcus aureus subsp. aureus N315
uuaaucuauauaaaaac

SEQ ID NO: 2128119 - RNA, 12 nt, Staphylococcus aureus subsp. aureus N315
uuaaucuauccu

SEQ ID NO: 2128120 - RNA, 22 nt, Staphylococcus aureus subsp. aureus N315
uuaaugacuucuuuauauuuau

SEQ ID NO: 2128121 - RNA, 21 nt, Staphylococcus aureus subsp. aureus N315
uuaaugacuaugcaaaugaaa

SEQ ID NO: 2128122 - RNA, 14 nt, Staphylococcus aureus subsp. aureus N315
uuaaucuuaauauu

SEQ ID NO: 2128123 - RNA, 23 nt, Staphylococcus aureus subsp. aureus N315
uuaaugauugacgauuuaauuaa

SEQ ID NO: 2128124 - RNA, 12 nt, Staphylococcus aureus subsp. aureus N315
uuaauuaucauu

SEQ ID NO: 2128125 - RNA, 14 nt, Staphylococcus aureus subsp. aureus N315
uuaauuaucauaaa

SEQ ID NO: 2128126 - RNA, 21 nt, Staphylococcus aureus subsp. aureus N315
uuaauguauucuucuaauucu

SEQ ID NO: 2128127 - RNA, 17 nt, Staphylococcus aureus subsp. aureus N315
uuaauuacuguaaauau

SEQ ID NO: 2128128 - RNA, 21 nt, Staphylococcus aureus subsp. aureus N315
uuaauuauguauuuuuauuua

SEQ ID NO: 2128129 - RNA, 15 nt, Staphylococcus aureus subsp. aureus N315
uuaauuauuuagauu

SEQ ID NO: 2128130 - RNA, 15 nt, Staphylococcus aureus subsp. aureus N315
uuaauuauuucccug

SEQ ID NO: 2128131 - RNA, 20 nt, Staphylococcus aureus subsp. aureus N315
uuaauuauguauuuuuauuu

SEQ ID NO: 2128132 - RNA, 22 nt, Staphylococcus aureus subsp. aureus N315
uuaauuauugagaauauuuauu

SEQ ID NO: 2128133 - RNA, 16 nt, Staphylococcus aureus subsp. aureus N315
uuaauuauuuuaaaaa

SEQ ID NO: 2128134 - RNA, 20 nt, Staphylococcus aureus subsp. aureus N315
uuaaugccugcccuuuaguc

SEQ ID NO: 2128135 - RNA, 21 nt, Staphylococcus aureus subsp. aureus N315
uuaaugccauuguuauccaaa

SEQ ID NO: 2128136 - RNA, 22 nt, Staphylococcus aureus subsp. aureus N315
uuaaugcuucaaauguaacauu

SEQ ID NO: 2128137 - RNA, 20 nt, Staphylococcus aureus subsp. aureus N315
uuaaugcuucaaauguaaca

SEQ ID NO: 2128138 - RNA, 23 nt, Staphylococcus aureus subsp. aureus N315
uuacacuaaaaccuauuccuaau

SEQ ID NO: 2128139 - RNA, 14 nt, Staphylococcus aureus subsp. aureus N315
uuacaacuuauucu

SEQ ID NO: 2128140 - RNA, 18 nt, Staphylococcus aureus subsp. aureus N315
uuacaacuuuaguuguua

SEQ ID NO: 2128141 - RNA, 13 nt, Staphylococcus aureus subsp. aureus N315
uuacaaauauacu

SEQ ID NO: 2128142 - RNA, 20 nt, Staphylococcus aureus subsp. aureus N315
uuacaaauguauaaauaaua

SEQ ID NO: 2128143 - RNA, 20 nt, Staphylococcus aureus subsp. aureus N315
uuaauuuaacggaaauacaa

SEQ ID NO: 2128144 - RNA, 23 nt, Staphylococcus aureus subsp. aureus N315
uuaauuuaacggaaauacaauga

SEQ ID NO: 2128145 - RNA, 18 nt, Staphylococcus aureus subsp. aureus N315
uuaauuuacaauuaauua

SEQ ID NO: 2128146 - RNA, 15 nt, Staphylococcus aureus subsp. aureus N315
uuaauuguuuaauaa

SEQ ID NO: 2128147 - RNA, 16 nt, Staphylococcus aureus subsp. aureus N315
uuaauuucacuuuaac

SEQ ID NO: 2128148 - RNA, 22 nt, Staphylococcus aureus subsp. aureus N315
uuaauuucacuuuaacuucuuu

SEQ ID NO: 2128149 - RNA, 23 nt, Staphylococcus aureus subsp. aureus N315
uuacaaagugauuuaaaaaauuu

SEQ ID NO: 2128150 - RNA, 13 nt, Staphylococcus aureus subsp. aureus N315
uuaauuucacuuu

SEQ ID NO: 2128151 - RNA, 18 nt, Staphylococcus aureus subsp. aureus N315
uuacauauacgacauuuu

SEQ ID NO: 2128152 - RNA, 13 nt, Staphylococcus aureus subsp. aureus N315
uuacagaugaugc

SEQ ID NO: 2128153 - RNA, 16 nt, Staphylococcus aureus subsp. aureus N315
uuacauuuuaugucca

SEQ ID NO: 2128154 - RNA, 20 nt, Staphylococcus aureus subsp. aureus N315
uuacauuuggcguaaugaua

SEQ ID NO: 2128155 - RNA, 12 nt, Staphylococcus aureus subsp. aureus N315
uuacauuacaua

SEQ ID NO: 2128156 - RNA, 21 nt, Staphylococcus aureus subsp. aureus N315
uuacauucuauacuuuuaauu

SEQ ID NO: 2128157 - RNA, 20 nt, Staphylococcus aureus subsp. aureus N315
uuacauguuacugaugaaca

SEQ ID NO: 2128158 - RNA, 17 nt, Staphylococcus aureus subsp. aureus N315
ugccguuauuuucaaua

SEQ ID NO: 2128159 - RNA, 14 nt, Staphylococcus aureus subsp. aureus N315
ugccgcuucuacaa

SEQ ID NO: 2128160 - RNA, 15 nt, Staphylococcus aureus subsp. aureus N315
ugcccucauaaauca

SEQ ID NO: 2128161 - RNA, 19 nt, Staphylococcus aureus subsp. aureus N315
ugcccucauaaaucaugaa

SEQ ID NO: 2128162 - RNA, 14 nt, Staphylococcus aureus subsp. aureus N315
ugcccgucuggcac

SEQ ID NO: 2128163 - RNA, 16 nt, Staphylococcus aureus subsp. aureus N315
ugcccugcuguuuuau

SEQ ID NO: 2128164 - RNA, 14 nt, Staphylococcus aureus subsp. aureus N315
ugccaucuuuguaa

SEQ ID NO: 2128165 - RNA, 13 nt, Staphylococcus aureus subsp. aureus N315
ugccaugcucuau

SEQ ID NO: 2128166 - RNA, 19 nt, Staphylococcus aureus subsp. aureus N315
ugccaacaaagcuuccaaa

SEQ ID NO: 2128167 - RNA, 22 nt, Staphylococcus aureus subsp. aureus N315
ugcauugauuucagcaccgaca

SEQ ID NO: 2128168 - RNA, 19 nt, Staphylococcus aureus subsp. aureus N315
ugcauuuagaugauucuua

SEQ ID NO: 2128169 - RNA, 16 nt, Staphylococcus aureus subsp. aureus N315
ugccaaaaaguauuca

SEQ ID NO: 2128170 - RNA, 18 nt, Staphylococcus aureus subsp. aureus N315
ugccaaaaugguuaaaau

SEQ ID NO: 2128171 - RNA, 17 nt, Staphylococcus aureus subsp. aureus N315
ugccaaauauaguaauu

SEQ ID NO: 2128172 - RNA, 23 nt, Staphylococcus aureus subsp. aureus N315
ugcauauugugccgcuucuacaa

SEQ ID NO: 2128173 - RNA, 16 nt, Staphylococcus aureus subsp. aureus N315
ugcauauauugaggau

SEQ ID NO: 2128174 - RNA, 13 nt, Staphylococcus aureus subsp. aureus N315
ugcaucacagaua

SEQ ID NO: 2128175 - RNA, 17 nt, Staphylococcus aureus subsp. aureus N315
ugcauagcuaaauaaau

SEQ ID NO: 2128176 - RNA, 15 nt, Staphylococcus aureus subsp. aureus N315
ugcauagcuaaauaa

SEQ ID NO: 2128177 - RNA, 19 nt, Staphylococcus aureus subsp. aureus N315
ugcauacgaauuaaaauaa

SEQ ID NO: 2128178 - RNA, 17 nt, Staphylococcus aureus subsp. aureus N315
ugcauacgaauuaaaau

SEQ ID NO: 2128179 - RNA, 22 nt, Staphylococcus aureus subsp. aureus N315
ugcauaauuaggauuaacauaa

SEQ ID NO: 2128180 - RNA, 14 nt, Staphylococcus aureus subsp. aureus N315
ugcauaaucaauuu

SEQ ID NO: 2128181 - RNA, 16 nt, Staphylococcus aureus subsp. aureus N315
ugcauaagaaauacua

SEQ ID NO: 2128182 - RNA, 22 nt, Staphylococcus aureus subsp. aureus N315
ugcaguuucaaucgcauuuugu

SEQ ID NO: 2128183 - RNA, 18 nt, Staphylococcus aureus subsp. aureus N315
ugcacugcuaauauuaga

SEQ ID NO: 2128184 - RNA, 15 nt, Staphylococcus aureus subsp. aureus N315
ugcaguuaaauuaaa

SEQ ID NO: 2128185 - RNA, 16 nt, Staphylococcus aureus subsp. aureus N315
ugcacugagcaacaaa

SEQ ID NO: 2128186 - RNA, 19 nt, Staphylococcus aureus subsp. aureus N315
ugcaugcgcaaaagcgcag

SEQ ID NO: 2128187 - RNA, 13 nt, Staphylococcus aureus subsp. aureus N315
ugcaugacagcaa

SEQ ID NO: 2128188 - RNA, 16 nt, Staphylococcus aureus subsp. aureus N315
ugcaugacgauaauga

SEQ ID NO: 2128189 - RNA, 17 nt, Staphylococcus aureus subsp. aureus N315
ugcaugacgauaaugaa

SEQ ID NO: 2128190 - RNA, 15 nt, Staphylococcus aureus subsp. aureus N315
ugcauguacaucuuu

SEQ ID NO: 2128191 - RNA, 18 nt, Staphylococcus aureus subsp. aureus N315
ugcauguaaaauuaaaug

SEQ ID NO: 2128192 - RNA, 15 nt, Staphylococcus aureus subsp. aureus N315
ugcauguuuaaauau

SEQ ID NO: 2128193 - RNA, 12 nt, Staphylococcus aureus subsp. aureus N315
ugcauuauuaua

SEQ ID NO: 2128194 - RNA, 20 nt, Staphylococcus aureus subsp. aureus N315
ugcauuacuaucuucaucau

SEQ ID NO: 2128195 - RNA, 23 nt, Staphylococcus aureus subsp. aureus N315
ugcauuacuacuuuauaaauauc

SEQ ID NO: 2128196 - RNA, 12 nt, Staphylococcus aureus subsp. aureus N315
ugcauuaauuuc

SEQ ID NO: 2128197 - RNA, 17 nt, Staphylococcus aureus subsp. aureus N315
ugcauuacuaucuucau

SEQ ID NO: 2128198 - RNA, 17 nt, Staphylococcus aureus subsp. aureus N315
ugcauuaagugcaauaa

SEQ ID NO: 2128199 - RNA, 15 nt, Staphylococcus aureus subsp. aureus N315
ugcaucccgaaaguu

SEQ ID NO: 2128200 - RNA, 17 nt, Staphylococcus aureus subsp. aureus N315
ugcaucaguuaauaauu

SEQ ID NO: 2128201 - RNA, 16 nt, Staphylococcus aureus subsp. aureus N315
ugcggucuaaaugcuc

SEQ ID NO: 2128202 - RNA, 19 nt, Staphylococcus aureus subsp. aureus N315
ugcguaagguauuucauug

SEQ ID NO: 2128203 - RNA, 21 nt, Staphylococcus aureus subsp. aureus N315
ugcguaagguauuucauugau

SEQ ID NO: 2128204 - RNA, 14 nt, Staphylococcus aureus subsp. aureus N315
ugcgccuucuuuuu

SEQ ID NO: 2128205 - RNA, 19 nt, Staphylococcus aureus subsp. aureus N315
ugccuggcaacguucuacu

SEQ ID NO: 2128206 - RNA, 14 nt, Staphylococcus aureus subsp. aureus N315
ugcuuuaacuguac

SEQ ID NO: 2128207 - RNA, 15 nt, Staphylococcus aureus subsp. aureus N315
ugcuuuaaacuuaua

SEQ ID NO: 2128208 - RNA, 18 nt, Staphylococcus aureus subsp. aureus N315
ugcuuuaaacuuauaaau

SEQ ID NO: 2128209 - RNA, 22 nt, Staphylococcus aureus subsp. aureus N315
ugcuuuagagauuguaagaauu

SEQ ID NO: 2128210 - RNA, 13 nt, Staphylococcus aureus subsp. aureus N315
ugcuuuaauauaa

SEQ ID NO: 2128211 - RNA, 20 nt, Staphylococcus aureus subsp. aureus N315
ugcuuuuaauauuauaaacc

SEQ ID NO: 2128212 - RNA, 18 nt, Staphylococcus aureus subsp. aureus N315
ugcuuuuaauauuauaaa

SEQ ID NO: 2128213 - RNA, 17 nt, Staphylococcus aureus subsp. aureus N315
ugcuuuuccauaaauau

SEQ ID NO: 2128214 - RNA, 14 nt, Staphylococcus aureus subsp. aureus N315
ugcuuuuccaguau

SEQ ID NO: 2128215 - RNA, 22 nt, Staphylococcus aureus subsp. aureus N315
ugcuuuuccauaaauauuuaaa

SEQ ID NO: 2128216 - RNA, 14 nt, Staphylococcus aureus subsp. aureus N315
ugcuuuuaaaugua

SEQ ID NO: 2128217 - RNA, 13 nt, Staphylococcus aureus subsp. aureus N315
ugcuuuuaaaugu

SEQ ID NO: 2128218 - RNA, 20 nt, Staphylococcus aureus subsp. aureus N315
ugcuuuuaaauguauuuuua

SEQ ID NO: 2128219 - RNA, 15 nt, Staphylococcus aureus subsp. aureus N315
ugcuuuuaauauuau

SEQ ID NO: 2128220 - RNA, 20 nt, Staphylococcus aureus subsp. aureus N315
ugcuuucacauuguuuacaa

SEQ ID NO: 2128221 - RNA, 17 nt, Staphylococcus aureus subsp. aureus N315
ugcuuuggaguuucuuc

SEQ ID NO: 2128222 - RNA, 23 nt, Staphylococcus aureus subsp. aureus N315
ugcuuuaauuugauuaaauucuu

SEQ ID NO: 2128223 - RNA, 14 nt, Staphylococcus aureus subsp. aureus N315
ugcuuugguggcuu

SEQ ID NO: 2128224 - RNA, 18 nt, Staphylococcus aureus subsp. aureus N315
ugcuuaguacacguguau

SEQ ID NO: 2128225 - RNA, 19 nt, Staphylococcus aureus subsp. aureus N315
ugcuuaguacacguguauu

SEQ ID NO: 2128226 - RNA, 19 nt, Staphylococcus aureus subsp. aureus N315
ugcuucaaaaauuaaucac

SEQ ID NO: 2128227 - RNA, 14 nt, Staphylococcus aureus subsp. aureus N315
ugcuucuuuccucu

SEQ ID NO: 2128228 - RNA, 21 nt, Staphylococcus aureus subsp. aureus N315
ugcuugaaauuauuauuuaaa

SEQ ID NO: 2128229 - RNA, 13 nt, Staphylococcus aureus subsp. aureus N315
ugcuguuacuucu

SEQ ID NO: 2128230 - RNA, 19 nt, Staphylococcus aureus subsp. aureus N315
ugcuguucucuauuuauaa

SEQ ID NO: 2128231 - RNA, 22 nt, Staphylococcus aureus subsp. aureus N315
ugcuguugaagaagguaauaaa

SEQ ID NO: 2128232 - RNA, 19 nt, Staphylococcus aureus subsp. aureus N315
ugcuguauauauauguaaa

SEQ ID NO: 2128233 - RNA, 13 nt, Staphylococcus aureus subsp. aureus N315
ugcugguugcuuc

SEQ ID NO: 2128234 - RNA, 18 nt, Staphylococcus aureus subsp. aureus N315
ugcugguugcuucuuauc

SEQ ID NO: 2128235 - RNA, 19 nt, Staphylococcus aureus subsp. aureus N315
ugcugguugcuucuuauca

SEQ ID NO: 2128236 - RNA, 23 nt, Staphylococcus aureus subsp. aureus N315
ugcugccggugcagauaauugaa

SEQ ID NO: 2128237 - RNA, 19 nt, Staphylococcus aureus subsp. aureus N315
ugcguugguauucaucuuc

SEQ ID NO: 2128238 - RNA, 18 nt, Staphylococcus aureus subsp. aureus N315
ugcucgauauaugucuca

SEQ ID NO: 2128239 - RNA, 14 nt, Staphylococcus aureus subsp. aureus N315
ugcucguauagaaa

SEQ ID NO: 2128240 - RNA, 14 nt, Staphylococcus aureus subsp. aureus N315
ugcugccaaauaua

SEQ ID NO: 2128241 - RNA, 18 nt, Staphylococcus aureus subsp. aureus N315
ugcugccaaaaaguauuc

SEQ ID NO: 2128242 - RNA, 23 nt, Staphylococcus aureus subsp. aureus N315
ugcugauaauuuuucuucuuuuu

SEQ ID NO: 2128243 - RNA, 13 nt, Staphylococcus aureus subsp. aureus N315
ugaauauaaaaaa

SEQ ID NO: 2128244 - RNA, 15 nt, Staphylococcus aureus subsp. aureus N315
ugaauauaaaaaaca

SEQ ID NO: 2128245 - RNA, 15 nt, Staphylococcus aureus subsp. aureus N315
ugaauauuuuucaau

SEQ ID NO: 2128246 - RNA, 23 nt, Staphylococcus aureus subsp. aureus N315
ugaauauuuuucaauuaaauguu

SEQ ID NO: 2128247 - RNA, 21 nt, Staphylococcus aureus subsp. aureus N315
ugaauaaauacaauguuauua

SEQ ID NO: 2128248 - RNA, 13 nt, Staphylococcus aureus subsp. aureus N315
ugaauaaauacaa

SEQ ID NO: 2128249 - RNA, 21 nt, Staphylococcus aureus subsp. aureus N315
ugaauaaauuuuauucuucag

SEQ ID NO: 2128250 - RNA, 13 nt, Staphylococcus aureus subsp. aureus N315
ugaauaacaagaa

SEQ ID NO: 2128251 - RNA, 15 nt, Staphylococcus aureus subsp. aureus N315
ugaauaaauaacuuc

SEQ ID NO: 2128252 - RNA, 21 nt, Staphylococcus aureus subsp. aureus N315
ugaauaaagcuaacauaccua

SEQ ID NO: 2128253 - RNA, 18 nt, Staphylococcus aureus subsp. aureus N315
ugaauaaagcuaacauac

SEQ ID NO: 2128254 - RNA, 20 nt, Staphylococcus aureus subsp. aureus N315
ugaauaaagcuaacauaccu

SEQ ID NO: 2128255 - RNA, 22 nt, Staphylococcus aureus subsp. aureus N315
ugaauaaucauccauauaugcc

SEQ ID NO: 2128256 - RNA, 15 nt, Staphylococcus aureus subsp. aureus N315
ugaaguauggaaguu

SEQ ID NO: 2128257 - RNA, 20 nt, Staphylococcus aureus subsp. aureus N315
ugaaguaugcacaucauuga

SEQ ID NO: 2128258 - RNA, 18 nt, Staphylococcus aureus subsp. aureus N315
ugaagucaauaauuuuau

SEQ ID NO: 2128259 - RNA, 21 nt, Staphylococcus aureus subsp. aureus N315
ugaaguuuuuagcauuaucau

SEQ ID NO: 2128260 - RNA, 14 nt, Staphylococcus aureus subsp. aureus N315
ugaauaaaauugug

SEQ ID NO: 2128261 - RNA, 20 nt, Staphylococcus aureus subsp. aureus N315
ugaaguuugaacaacaucuu

SEQ ID NO: 2128262 - RNA, 13 nt, Staphylococcus aureus subsp. aureus N315
ugaaguuguuucu

SEQ ID NO: 2128263 - RNA, 13 nt, Staphylococcus aureus subsp. aureus N315
ugaauuaauagcu

SEQ ID NO: 2128264 - RNA, 23 nt, Staphylococcus aureus subsp. aureus N315
ugaauguuggaucggcauuguaa

SEQ ID NO: 2128265 - RNA, 12 nt, Staphylococcus aureus subsp. aureus N315
ugaauuaaaaaa

SEQ ID NO: 2128266 - RNA, 17 nt, Staphylococcus aureus subsp. aureus N315
ugaauuaaagcaucgaa

SEQ ID NO: 2128267 - RNA, 18 nt, Staphylococcus aureus subsp. aureus N315
ugacaaucgcuugcuucu

SEQ ID NO: 2128268 - RNA, 16 nt, Staphylococcus aureus subsp. aureus N315
ugaaucagaugauuua

SEQ ID NO: 2128269 - RNA, 20 nt, Staphylococcus aureus subsp. aureus N315
ugaaucgaguuugaaauaau

SEQ ID NO: 2128270 - RNA, 12 nt, Staphylococcus aureus subsp. aureus N315
ugaauggcucgu

SEQ ID NO: 2128271 - RNA, 14 nt, Staphylococcus aureus subsp. aureus N315
ugaauggcaaauau

SEQ ID NO: 2128272 - RNA, 19 nt, Staphylococcus aureus subsp. aureus N315
ugaagaugcuuuaauuaaa

SEQ ID NO: 2128273 - RNA, 20 nt, Staphylococcus aureus subsp. aureus N315
ugaagcgcuuggauuuuuug

SEQ ID NO: 2128274 - RNA, 23 nt, Staphylococcus aureus subsp. aureus N315
ugaagcgcuuggauuuuuugguu

SEQ ID NO: 2128275 - RNA, 17 nt, Staphylococcus aureus subsp. aureus N315
ugaaguaauauauaaaa

SEQ ID NO: 2128276 - RNA, 17 nt, Staphylococcus aureus subsp. aureus N315
ugaagggguuuuuucuu

SEQ ID NO: 2128277 - RNA, 17 nt, Staphylococcus aureus subsp. aureus N315
ugaaggccauuuuuauu

SEQ ID NO: 2128278 - RNA, 18 nt, Staphylococcus aureus subsp. aureus N315
ugaagggagcauuucauu

SEQ ID NO: 2128279 - RNA, 16 nt, Staphylococcus aureus subsp. aureus N315
ugaagggagcauuuca

SEQ ID NO: 2128280 - RNA, 14 nt, Staphylococcus aureus subsp. aureus N315
ugaagggagcauuu

SEQ ID NO: 2128281 - RNA, 23 nt, Staphylococcus aureus subsp. aureus N315
ugaaggcuuugaagggagcauuu

SEQ ID NO: 2128282 - RNA, 19 nt, Staphylococcus aureus subsp. aureus N315
ugaagggagcauuucauua

SEQ ID NO: 2128283 - RNA, 22 nt, Staphylococcus aureus subsp. aureus N315
ugaagcguucgugauagaaguu

SEQ ID NO: 2128284 - RNA, 15 nt, Staphylococcus aureus subsp. aureus N315
ugaagcuaaaugcuc

SEQ ID NO: 2128285 - RNA, 18 nt, Staphylococcus aureus subsp. aureus N315
ugaaggagauauuuucuu

SEQ ID NO: 2128286 - RNA, 23 nt, Staphylococcus aureus subsp. aureus N315
ugaagaaucaggaccaaauagag

SEQ ID NO: 2128287 - RNA, 21 nt, Staphylococcus aureus subsp. aureus N315
ugaagaauguuucauaugcau

SEQ ID NO: 2128288 - RNA, 19 nt, Staphylococcus aureus subsp. aureus N315
ugaagaaggaugaguuuaa

SEQ ID NO: 2128289 - RNA, 15 nt, Staphylococcus aureus subsp. aureus N315
ugaacuucucuuagu

SEQ ID NO: 2128290 - RNA, 12 nt, Staphylococcus aureus subsp. aureus N315
ugaacuucuuuu

SEQ ID NO: 2128291 - RNA, 16 nt, Staphylococcus aureus subsp. aureus N315
ugaagaaaaaaugaua

SEQ ID NO: 2128292 - RNA, 18 nt, Staphylococcus aureus subsp. aureus N315
ugaagaaaaaaugauaua

SEQ ID NO: 2128293 - RNA, 12 nt, Staphylococcus aureus subsp. aureus N315
ugaacguuuauu

SEQ ID NO: 2128294 - RNA, 13 nt, Staphylococcus aureus subsp. aureus N315
ugaacuaaaacga

SEQ ID NO: 2128295 - RNA, 20 nt, Staphylococcus aureus subsp. aureus N315
ugaacuacucccgcaaauau

SEQ ID NO: 2128296 - RNA, 16 nt, Staphylococcus aureus subsp. aureus N315
ugaacuauuaaaacca

SEQ ID NO: 2128297 - RNA, 15 nt, Staphylococcus aureus subsp. aureus N315
ugaacuuauaagucc

SEQ ID NO: 2128298 - RNA, 23 nt, Staphylococcus aureus subsp. aureus N315
ugaacuguuucuguaaaaguaua

SEQ ID NO: 2128299 - RNA, 18 nt, Staphylococcus aureus subsp. aureus N315
ugacgcgugaauuaaaaa

SEQ ID NO: 2128300 - RNA, 21 nt, Staphylococcus aureus subsp. aureus N315
ugacgcgugaauuaaaaaaug

SEQ ID NO: 2128301 - RNA, 13 nt, Staphylococcus aureus subsp. aureus N315
ugaccuuauauuu

SEQ ID NO: 2128302 - RNA, 15 nt, Staphylococcus aureus subsp. aureus N315
ugacauccauacaaa

SEQ ID NO: 2128303 - RNA, 18 nt, Staphylococcus aureus subsp. aureus N315
ugacaauucaucuaaccu

SEQ ID NO: 2128304 - RNA, 16 nt, Staphylococcus aureus subsp. aureus N315
ugacauuuuaaaucua

SEQ ID NO: 2128305 - RNA, 16 nt, Staphylococcus aureus subsp. aureus N315
ugagcaaagcuuuuuu

SEQ ID NO: 2128306 - RNA, 21 nt, Staphylococcus aureus subsp. aureus N315
ugagcaaagcaaauuaguaug

SEQ ID NO: 2128307 - RNA, 22 nt, Staphylococcus aureus subsp. aureus N315
ugagcaacaaaagauguugcuc

SEQ ID NO: 2128308 - RNA, 14 nt, Staphylococcus aureus subsp. aureus N315
ugagcaagucuucu

SEQ ID NO: 2128309 - RNA, 15 nt, Staphylococcus aureus subsp. aureus N315
ugagcacaaacuaaa

SEQ ID NO: 2128310 - RNA, 17 nt, Staphylococcus aureus subsp. aureus N315
ugagacguuuuccauga

SEQ ID NO: 2128311 - RNA, 16 nt, Staphylococcus aureus subsp. aureus N315
ugagauaaaaucauau

SEQ ID NO: 2128312 - RNA, 12 nt, Staphylococcus aureus subsp. aureus N315
ugagauaaaauc

SEQ ID NO: 2128313 - RNA, 16 nt, Staphylococcus aureus subsp. aureus N315
ugagagauuauuuaaa

SEQ ID NO: 2128314 - RNA, 13 nt, Staphylococcus aureus subsp. aureus N315
ugagaauuucuaa

SEQ ID NO: 2128315 - RNA, 15 nt, Staphylococcus aureus subsp. aureus N315
ugagaauuucuaauu

SEQ ID NO: 2128316 - RNA, 23 nt, Staphylococcus aureus subsp. aureus N315
ugagacccaccguuaaaauauau

SEQ ID NO: 2128317 - RNA, 16 nt, Staphylococcus aureus subsp. aureus N315
ugagaaaguaaaaguu

SEQ ID NO: 2128318 - RNA, 14 nt, Staphylococcus aureus subsp. aureus N315
ugagaaaguaaaag

SEQ ID NO: 2128319 - RNA, 16 nt, Staphylococcus aureus subsp. aureus N315
ugacuucuuuauauuu

SEQ ID NO: 2128320 - RNA, 22 nt, Staphylococcus aureus subsp. aureus N315
ugacuacucaauccuaaauuau

SEQ ID NO: 2128321 - RNA, 13 nt, Staphylococcus aureus subsp. aureus N315
ugacuagggguuu

SEQ ID NO: 2128322 - RNA, 19 nt, Staphylococcus aureus subsp. aureus N315
ugacuagggguuuuuaaua

SEQ ID NO: 2128323 - RNA, 16 nt, Staphylococcus aureus subsp. aureus N315
ugacugaauuaauauc

SEQ ID NO: 2128324 - RNA, 21 nt, Staphylococcus aureus subsp. aureus N315
ugacugagaaaaauauuucua

SEQ ID NO: 2128325 - RNA, 12 nt, Staphylococcus aureus subsp. aureus N315
ugacugagaaaa

SEQ ID NO: 2128326 - RNA, 18 nt, Staphylococcus aureus subsp. aureus N315
ugacugaaugagaaugug

SEQ ID NO: 2128327 - RNA, 23 nt, Staphylococcus aureus subsp. aureus N315
ugacuauuucgcuuuuuuuauuu

SEQ ID NO: 2128328 - RNA, 19 nt, Staphylococcus aureus subsp. aureus N315
ugacguucugaucggcuuu

SEQ ID NO: 2128329 - RNA, 18 nt, Staphylococcus aureus subsp. aureus N315
ugacguuuugguuguucu

SEQ ID NO: 2128330 - RNA, 15 nt, Staphylococcus aureus subsp. aureus N315
ugacguaauuaauag

SEQ ID NO: 2128331 - RNA, 17 nt, Staphylococcus aureus subsp. aureus N315
ugcaacaauauaauaua

SEQ ID NO: 2128332 - RNA, 20 nt, Staphylococcus aureus subsp. aureus N315
ugcaaauuaucauuaaauug

SEQ ID NO: 2128333 - RNA, 21 nt, Staphylococcus aureus subsp. aureus N315
ugcaacgcaucacaaaauugu

SEQ ID NO: 2128334 - RNA, 20 nt, Staphylococcus aureus subsp. aureus N315
ugcaacgaugcuacuuaaag

SEQ ID NO: 2128335 - RNA, 14 nt, Staphylococcus aureus subsp. aureus N315
ugcaacauuuugag

SEQ ID NO: 2128336 - RNA, 19 nt, Staphylococcus aureus subsp. aureus N315
ugcaauuaauguaaugaua

SEQ ID NO: 2128337 - RNA, 16 nt, Staphylococcus aureus subsp. aureus N315
ugcaauagcuauaacu

SEQ ID NO: 2128338 - RNA, 23 nt, Staphylococcus aureus subsp. aureus N315
ugcaauaccuccccaacuuaaua

SEQ ID NO: 2128339 - RNA, 15 nt, Staphylococcus aureus subsp. aureus N315
ugcaauacauuaaua

SEQ ID NO: 2128340 - RNA, 16 nt, Staphylococcus aureus subsp. aureus N315
ugcaacuuauaauauu

SEQ ID NO: 2128341 - RNA, 17 nt, Staphylococcus aureus subsp. aureus N315
ugcaacuugaucauuau

SEQ ID NO: 2128342 - RNA, 17 nt, Staphylococcus aureus subsp. aureus N315
ugcaauuucauaguguu

SEQ ID NO: 2128343 - RNA, 18 nt, Staphylococcus aureus subsp. aureus N315
ugcaauugccuuaucagc

SEQ ID NO: 2128344 - RNA, 20 nt, Staphylococcus aureus subsp. aureus N315
ugcaauugccuuaucagcau

SEQ ID NO: 2128345 - RNA, 23 nt, Staphylococcus aureus subsp. aureus N315
ugcacuaauggcacuuaauauaa

SEQ ID NO: 2128346 - RNA, 16 nt, Staphylococcus aureus subsp. aureus N315
ugcaccuauaauagcg

SEQ ID NO: 2128347 - RNA, 22 nt, Staphylococcus aureus subsp. aureus N315
ugauuaaaguguuucaacauau

SEQ ID NO: 2128348 - RNA, 12 nt, Staphylococcus aureus subsp. aureus N315
ugauuaaaagug

SEQ ID NO: 2128349 - RNA, 17 nt, Staphylococcus aureus subsp. aureus N315
ugauuaccuucucuuca

SEQ ID NO: 2128350 - RNA, 23 nt, Staphylococcus aureus subsp. aureus N315
ugauuaguuucugacuuuuaaaa

SEQ ID NO: 2128351 - RNA, 15 nt, Staphylococcus aureus subsp. aureus N315
ugauuauauuuuucu

SEQ ID NO: 2128352 - RNA, 15 nt, Staphylococcus aureus subsp. aureus N315
ugauuauaaauucua

SEQ ID NO: 2128353 - RNA, 17 nt, Staphylococcus aureus subsp. aureus N315
ugauuauaaugauuguc

SEQ ID NO: 2128354 - RNA, 16 nt, Staphylococcus aureus subsp. aureus N315
ugauuaauuaaagauu

SEQ ID NO: 2128355 - RNA, 18 nt, Staphylococcus aureus subsp. aureus N315
ugauuaauuaaagauuaa

SEQ ID NO: 2128356 - RNA, 18 nt, Staphylococcus aureus subsp. aureus N315
ugauuacaacuuauucuu

SEQ ID NO: 2128357 - RNA, 14 nt, Staphylococcus aureus subsp. aureus N315
ugauuacauauacg

SEQ ID NO: 2128358 - RNA, 16 nt, Staphylococcus aureus subsp. aureus N315
ugauuauauuuuucuu

SEQ ID NO: 2128359 - RNA, 18 nt, Staphylococcus aureus subsp. aureus N315
ugauugaacaauaauaug

SEQ ID NO: 2128360 - RNA, 14 nt, Staphylococcus aureus subsp. aureus N315
ugauugauaugguu

SEQ ID NO: 2128361 - RNA, 17 nt, Staphylococcus aureus subsp. aureus N315
ugauugauaugguuaga

SEQ ID NO: 2128362 - RNA, 20 nt, Staphylococcus aureus subsp. aureus N315
ugauugauaugguuagagaa

SEQ ID NO: 2128363 - RNA, 17 nt, Staphylococcus aureus subsp. aureus N315
ugauugcaaaaaaacaa

SEQ ID NO: 2128364 - RNA, 16 nt, Staphylococcus aureus subsp. aureus N315
ugauuuaauuuuuaau

SEQ ID NO: 2128365 - RNA, 17 nt, Staphylococcus aureus subsp. aureus N315
ugauuuaccuuugucuu

SEQ ID NO: 2128366 - RNA, 21 nt, Staphylococcus aureus subsp. aureus N315
ugauuuacgugcauuguaaua

SEQ ID NO: 2128367 - RNA, 19 nt, Staphylococcus aureus subsp. aureus N315
ugauuuagcauacauuaag

SEQ ID NO: 2128368 - RNA, 22 nt, Staphylococcus aureus subsp. aureus N315
ugauuuauaaaaacuuauuugc

SEQ ID NO: 2128369 - RNA, 13 nt, Staphylococcus aureus subsp. aureus N315
ugauuuauaaaaa

SEQ ID NO: 2128370 - RNA, 11 nt, Staphylococcus aureus subsp. aureus N315
ugauuuauuau

SEQ ID NO: 2128371 - RNA, 21 nt, Staphylococcus aureus subsp. aureus N315
ugauuuauucuaaauauauuu

SEQ ID NO: 2128372 - RNA, 20 nt, Staphylococcus aureus subsp. aureus N315
ugauuuucuuucauaaauug

SEQ ID NO: 2128373 - RNA, 18 nt, Staphylococcus aureus subsp. aureus N315
ugauuuugcugccaaaaa

SEQ ID NO: 2128374 - RNA, 17 nt, Staphylococcus aureus subsp. aureus N315
ugauuuuggaacauauu

SEQ ID NO: 2128375 - RNA, 15 nt, Staphylococcus aureus subsp. aureus N315
ugauuuuuaaaaaua

SEQ ID NO: 2128376 - RNA, 12 nt, Staphylococcus aureus subsp. aureus N315
ugauuuuuaaaa

SEQ ID NO: 2128377 - RNA, 19 nt, Staphylococcus aureus subsp. aureus N315
ugcaaauauaucaucucua

SEQ ID NO: 2128378 - RNA, 13 nt, Staphylococcus aureus subsp. aureus N315
ugcaaauacgagu

SEQ ID NO: 2128379 - RNA, 14 nt, Staphylococcus aureus subsp. aureus N315
ugcaaauaaaaaag

SEQ ID NO: 2128380 - RNA, 14 nt, Staphylococcus aureus subsp. aureus N315
ugcaaaugccucuu

SEQ ID NO: 2128381 - RNA, 16 nt, Staphylococcus aureus subsp. aureus N315
ugcaaaucaaauacau

SEQ ID NO: 2128382 - RNA, 16 nt, Staphylococcus aureus subsp. aureus N315
ugcaaaugaaauucuu

SEQ ID NO: 2128383 - RNA, 12 nt, Staphylococcus aureus subsp. aureus N315
ugcaaaaucaac

SEQ ID NO: 2128384 - RNA, 15 nt, Staphylococcus aureus subsp. aureus N315
ugcaaaauguuacac

SEQ ID NO: 2128385 - RNA, 14 nt, Staphylococcus aureus subsp. aureus N315
ugcaaaaugcauua

SEQ ID NO: 2128386 - RNA, 15 nt, Staphylococcus aureus subsp. aureus N315
ugcaaacacaguaca

SEQ ID NO: 2128387 - RNA, 20 nt, Staphylococcus aureus subsp. aureus N315
ugcaaacacaguacaaauaa

SEQ ID NO: 2128388 - RNA, 16 nt, Staphylococcus aureus subsp. aureus N315
ugauuuuuaauaauuu

SEQ ID NO: 2128389 - RNA, 19 nt, Staphylococcus aureus subsp. aureus N315
ugaucuaaaauaucaucaa

SEQ ID NO: 2128390 - RNA, 17 nt, Staphylococcus aureus subsp. aureus N315
ugaugaggcaauauuaa

SEQ ID NO: 2128391 - RNA, 22 nt, Staphylococcus aureus subsp. aureus N315
ugaugagaugaggcgauaaaag

SEQ ID NO: 2128392 - RNA, 15 nt, Staphylococcus aureus subsp. aureus N315
ugauagaugauacau

SEQ ID NO: 2128393 - RNA, 14 nt, Staphylococcus aureus subsp. aureus N315
ugauacucaauaaa

SEQ ID NO: 2128394 - RNA, 17 nt, Staphylococcus aureus subsp. aureus N315
ugauacuucaccaucuu

SEQ ID NO: 2128395 - RNA, 20 nt, Staphylococcus aureus subsp. aureus N315
ugauaguguaugaauggcaa

SEQ ID NO: 2128396 - RNA, 20 nt, Staphylococcus aureus subsp. aureus N315
ugauaguuguaucauuaauu

SEQ ID NO: 2128397 - RNA, 17 nt, Staphylococcus aureus subsp. aureus N315
ugauauaaaaagugaaa

SEQ ID NO: 2128398 - RNA, 23 nt, Staphylococcus aureus subsp. aureus N315
ugauauaaaaagugaaaguauua

SEQ ID NO: 2128399 - RNA, 19 nt, Staphylococcus aureus subsp. aureus N315
ugauauaaaaagugaaagu

SEQ ID NO: 2128400 - RNA, 14 nt, Staphylococcus aureus subsp. aureus N315
ugauagugaauaau

SEQ ID NO: 2128401 - RNA, 15 nt, Staphylococcus aureus subsp. aureus N315
ugauagcuaaugcau

SEQ ID NO: 2128402 - RNA, 17 nt, Staphylococcus aureus subsp. aureus N315
ugauagcuaaugcauua

SEQ ID NO: 2128403 - RNA, 18 nt, Staphylococcus aureus subsp. aureus N315
ugauagcuaaugcauuau

SEQ ID NO: 2128404 - RNA, 14 nt, Staphylococcus aureus subsp. aureus N315
ugauaugugaaaaa

SEQ ID NO: 2128405 - RNA, 16 nt, Staphylococcus aureus subsp. aureus N315
ugauauguuuccucuu

SEQ ID NO: 2128406 - RNA, 15 nt, Staphylococcus aureus subsp. aureus N315
ugaucaaaaagacag

SEQ ID NO: 2128407 - RNA, 14 nt, Staphylococcus aureus subsp. aureus N315
ugaucaaaaauguu

SEQ ID NO: 2128408 - RNA, 19 nt, Staphylococcus aureus subsp. aureus N315
ugauauaaccgcauacaga

SEQ ID NO: 2128409 - RNA, 14 nt, Staphylococcus aureus subsp. aureus N315
ugauaucuugcuug

SEQ ID NO: 2128410 - RNA, 17 nt, Staphylococcus aureus subsp. aureus N315
ugauaugcucucuucaa

SEQ ID NO: 2128411 - RNA, 18 nt, Staphylococcus aureus subsp. aureus N315
ugauaugcucucuucaaa

SEQ ID NO: 2128412 - RNA, 14 nt, Staphylococcus aureus subsp. aureus N315
ugaguuuuuuaaaa

SEQ ID NO: 2128413 - RNA, 24 nt, Staphylococcus aureus subsp. aureus N315
ugauaaaagcccaccuaaaaagua

SEQ ID NO: 2128414 - RNA, 13 nt, Staphylococcus aureus subsp. aureus N315
ugauaaaauaaau

SEQ ID NO: 2128415 - RNA, 21 nt, Staphylococcus aureus subsp. aureus N315
ugauaaaugaauugucuuaau

SEQ ID NO: 2128416 - RNA, 15 nt, Staphylococcus aureus subsp. aureus N315
ugauaaauaaugcau

SEQ ID NO: 2128417 - RNA, 14 nt, Staphylococcus aureus subsp. aureus N315
ugaguuuaaaaaua

SEQ ID NO: 2128418 - RNA, 12 nt, Staphylococcus aureus subsp. aureus N315
ugaguuuaaaaa

SEQ ID NO: 2128419 - RNA, 23 nt, Staphylococcus aureus subsp. aureus N315
ugaguuggcaucagacuaaaaug

SEQ ID NO: 2128420 - RNA, 14 nt, Staphylococcus aureus subsp. aureus N315
ugaguuggcaucag

SEQ ID NO: 2128421 - RNA, 15 nt, Staphylococcus aureus subsp. aureus N315
ugaguucguaaucuu

SEQ ID NO: 2128422 - RNA, 18 nt, Staphylococcus aureus subsp. aureus N315
ugaguguuucauaaucuc

SEQ ID NO: 2128423 - RNA, 21 nt, Staphylococcus aureus subsp. aureus N315
ugagucuuggacauuguaaaa

SEQ ID NO: 2128424 - RNA, 16 nt, Staphylococcus aureus subsp. aureus N315
ugagucaauuucuuua

SEQ ID NO: 2128425 - RNA, 23 nt, Staphylococcus aureus subsp. aureus N315
ugagucaauuucuuuaaagucuu

SEQ ID NO: 2128426 - RNA, 21 nt, Staphylococcus aureus subsp. aureus N315
ugagcaucuugucuaguucga

SEQ ID NO: 2128427 - RNA, 13 nt, Staphylococcus aureus subsp. aureus N315
ugagcaucuuuua

SEQ ID NO: 2128428 - RNA, 17 nt, Staphylococcus aureus subsp. aureus N315
ugauaccuuuaaaucua

SEQ ID NO: 2128429 - RNA, 17 nt, Staphylococcus aureus subsp. aureus N315
ugauacgcuuuuuaaaa

SEQ ID NO: 2128430 - RNA, 22 nt, Staphylococcus aureus subsp. aureus N315
ugauacgccuaaauauuuaccu

SEQ ID NO: 2128431 - RNA, 13 nt, Staphylococcus aureus subsp. aureus N315
ugauacauuauua

SEQ ID NO: 2128432 - RNA, 14 nt, Staphylococcus aureus subsp. aureus N315
ugauacauuauuaa

SEQ ID NO: 2128433 - RNA, 18 nt, Staphylococcus aureus subsp. aureus N315
ugauacauuauuaaauag

SEQ ID NO: 2128434 - RNA, 16 nt, Staphylococcus aureus subsp. aureus N315
ugauaauuaauuaugc

SEQ ID NO: 2128435 - RNA, 22 nt, Staphylococcus aureus subsp. aureus N315
ugauaauucgaaaucaaauauu

SEQ ID NO: 2128436 - RNA, 19 nt, Staphylococcus aureus subsp. aureus N315
ugauaaugucuuacuuguc

SEQ ID NO: 2128437 - RNA, 14 nt, Staphylococcus aureus subsp. aureus N315
ugauaauuuuucuu

SEQ ID NO: 2128438 - RNA, 19 nt, Staphylococcus aureus subsp. aureus N315
ugauacagaaccaacaaua

SEQ ID NO: 2128439 - RNA, 14 nt, Staphylococcus aureus subsp. aureus N315
ugauacauaaaaug

SEQ ID NO: 2128440 - RNA, 20 nt, Staphylococcus aureus subsp. aureus N315
ugauacagaaccaacaauaa

SEQ ID NO: 2128441 - RNA, 21 nt, Staphylococcus aureus subsp. aureus N315
ugauaauccaccaaauacagu

SEQ ID NO: 2128442 - RNA, 15 nt, Staphylococcus aureus subsp. aureus N315
ugauaauccaccaaa

SEQ ID NO: 2128443 - RNA, 18 nt, Staphylococcus aureus subsp. aureus N315
ugauaauagcuugagcau

SEQ ID NO: 2128444 - RNA, 22 nt, Staphylococcus aureus subsp. aureus N315
ugauaauacuguuuaaauaaaa

SEQ ID NO: 2128445 - RNA, 12 nt, Staphylococcus aureus subsp. aureus N315
ugauaaauuaaa

SEQ ID NO: 2128446 - RNA, 15 nt, Staphylococcus aureus subsp. aureus N315
ugauaacuuguaaua

SEQ ID NO: 2128447 - RNA, 20 nt, Staphylococcus aureus subsp. aureus N315
ucgccauuguccaacugcuu

SEQ ID NO: 2128448 - RNA, 19 nt, Staphylococcus aureus subsp. aureus N315
ucgccaucccauucaccaa

SEQ ID NO: 2128449 - RNA, 16 nt, Staphylococcus aureus subsp. aureus N315
ucgcauacuuuuucag

SEQ ID NO: 2128450 - RNA, 18 nt, Staphylococcus aureus subsp. aureus N315
ucgcaucacugcauauaa

SEQ ID NO: 2128451 - RNA, 14 nt, Staphylococcus aureus subsp. aureus N315
ucgccaagccaucu

SEQ ID NO: 2128452 - RNA, 17 nt, Staphylococcus aureus subsp. aureus N315
ucgauuuuggcacauaa

SEQ ID NO: 2128453 - RNA, 15 nt, Staphylococcus aureus subsp. aureus N315
ucgauuuaucauuau

SEQ ID NO: 2128454 - RNA, 16 nt, Staphylococcus aureus subsp. aureus N315
ucgauugcguuuucua

SEQ ID NO: 2128455 - RNA, 16 nt, Staphylococcus aureus subsp. aureus N315
ucgaugacuuugucuu

SEQ ID NO: 2128456 - RNA, 16 nt, Staphylococcus aureus subsp. aureus N315
ucgauugguaaaucua

SEQ ID NO: 2128457 - RNA, 22 nt, Staphylococcus aureus subsp. aureus N315
ucgauuuagaagaacaauaauu

SEQ ID NO: 2128458 - RNA, 21 nt, Staphylococcus aureus subsp. aureus N315
ucgaucgguauuuucauuuua

SEQ ID NO: 2128459 - RNA, 16 nt, Staphylococcus aureus subsp. aureus N315
ucgauaugaccauagu

SEQ ID NO: 2128460 - RNA, 17 nt, Staphylococcus aureus subsp. aureus N315
ucgaucgguauuuucau

SEQ ID NO: 2128461 - RNA, 16 nt, Staphylococcus aureus subsp. aureus N315
ucgaucgguauuuuca

SEQ ID NO: 2128462 - RNA, 14 nt, Staphylococcus aureus subsp. aureus N315
ucgaguaauacuuu

SEQ ID NO: 2128463 - RNA, 14 nt, Staphylococcus aureus subsp. aureus N315
ucgaguuuguuucu

SEQ ID NO: 2128464 - RNA, 12 nt, Staphylococcus aureus subsp. aureus N315
ucgauaaaaugu

SEQ ID NO: 2128465 - RNA, 19 nt, Staphylococcus aureus subsp. aureus N315
ucgagcucuucaaauuuac

SEQ ID NO: 2128466 - RNA, 12 nt, Staphylococcus aureus subsp. aureus N315
uccuuucuuuuu

SEQ ID NO: 2128467 - RNA, 17 nt, Staphylococcus aureus subsp. aureus N315
uccuuuagcaaaaauau

SEQ ID NO: 2128468 - RNA, 21 nt, Staphylococcus aureus subsp. aureus N315
uccuuuauauucuaauauucc

SEQ ID NO: 2128469 - RNA, 14 nt, Staphylococcus aureus subsp. aureus N315
uccuuuaaaucauu

SEQ ID NO: 2128470 - RNA, 19 nt, Staphylococcus aureus subsp. aureus N315
uccuugguuauuaaaauua

SEQ ID NO: 2128471 - RNA, 19 nt, Staphylococcus aureus subsp. aureus N315
ucgaaaauagcuauuaaaa

SEQ ID NO: 2128472 - RNA, 13 nt, Staphylococcus aureus subsp. aureus N315
ucgaaaagaaauu

SEQ ID NO: 2128473 - RNA, 19 nt, Staphylococcus aureus subsp. aureus N315
ucgaaaagaaauucuacag

SEQ ID NO: 2128474 - RNA, 23 nt, Staphylococcus aureus subsp. aureus N315
ucgaaaagaaauucuacagguaa

SEQ ID NO: 2128475 - RNA, 12 nt, Staphylococcus aureus subsp. aureus N315
uccuuuuuuaaa

SEQ ID NO: 2128476 - RNA, 14 nt, Staphylococcus aureus subsp. aureus N315
uccuuuuacuuaau

SEQ ID NO: 2128477 - RNA, 15 nt, Staphylococcus aureus subsp. aureus N315
ucgaaagccaauuaa

SEQ ID NO: 2128478 - RNA, 18 nt, Staphylococcus aureus subsp. aureus N315
ucgaaauauuuauucgcu

SEQ ID NO: 2128479 - RNA, 15 nt, Staphylococcus aureus subsp. aureus N315
ucgaaaucaaauauu

SEQ ID NO: 2128480 - RNA, 23 nt, Staphylococcus aureus subsp. aureus N315
ucgaaaauagcuauuaaaauaga

SEQ ID NO: 2128481 - RNA, 22 nt, Staphylococcus aureus subsp. aureus N315
ucgaaauucucuuuguuggggc

SEQ ID NO: 2128482 - RNA, 12 nt, Staphylococcus aureus subsp. aureus N315
ucgaacagaaaa

SEQ ID NO: 2128483 - RNA, 16 nt, Staphylococcus aureus subsp. aureus N315
ucgaaauuguucuaau

SEQ ID NO: 2128484 - RNA, 15 nt, Staphylococcus aureus subsp. aureus N315
ucgaacagaaaaucg

SEQ ID NO: 2128485 - RNA, 21 nt, Staphylococcus aureus subsp. aureus N315
ucgaacaugaaugauauugau

SEQ ID NO: 2128486 - RNA, 22 nt, Staphylococcus aureus subsp. aureus N315
ucgaacuuuuguucuaaguguu

SEQ ID NO: 2128487 - RNA, 24 nt, Staphylococcus aureus subsp. aureus N315
ucagcgauaggcgcgaaaugaccu

SEQ ID NO: 2128488 - RNA, 20 nt, Staphylococcus aureus subsp. aureus N315
uccugcuacaacuucuucuc

SEQ ID NO: 2128489 - RNA, 20 nt, Staphylococcus aureus subsp. aureus N315
uccuuggaaacgauauagac

SEQ ID NO: 2128490 - RNA, 22 nt, Staphylococcus aureus subsp. aureus N315
uccuugcucaugagcacaaacu

SEQ ID NO: 2128491 - RNA, 15 nt, Staphylococcus aureus subsp. aureus N315
uccuugauucuuaua

SEQ ID NO: 2128492 - RNA, 13 nt, Staphylococcus aureus subsp. aureus N315
uccuuauuuuucg

SEQ ID NO: 2128493 - RNA, 16 nt, Staphylococcus aureus subsp. aureus N315
uccuuaauugcucuuc

SEQ ID NO: 2128494 - RNA, 15 nt, Staphylococcus aureus subsp. aureus N315
ucguuucgucagauu

SEQ ID NO: 2128495 - RNA, 17 nt, Staphylococcus aureus subsp. aureus N315
ucguugucacuauugca

SEQ ID NO: 2128496 - RNA, 19 nt, Staphylococcus aureus subsp. aureus N315
ucguuguacaguaauauuc

SEQ ID NO: 2128497 - RNA, 22 nt, Staphylococcus aureus subsp. aureus N315
ucguuguaaaacuaaguuauuu

SEQ ID NO: 2128498 - RNA, 17 nt, Staphylococcus aureus subsp. aureus N315
ucguuguugaaauuaaa

SEQ ID NO: 2128499 - RNA, 15 nt, Staphylococcus aureus subsp. aureus N315
ucguuguugaaauua

SEQ ID NO: 2128500 - RNA, 15 nt, Staphylococcus aureus subsp. aureus N315
ucguucauauauuuu

SEQ ID NO: 2128501 - RNA, 21 nt, Staphylococcus aureus subsp. aureus N315
ucguucauauauuuuguuaau

SEQ ID NO: 2128502 - RNA, 17 nt, Staphylococcus aureus subsp. aureus N315
ucguucauauauuuugu

SEQ ID NO: 2128503 - RNA, 16 nt, Staphylococcus aureus subsp. aureus N315
ucguucccauucuuug

SEQ ID NO: 2128504 - RNA, 22 nt, Staphylococcus aureus subsp. aureus N315
ucguuaacaaucaguaauaaug

SEQ ID NO: 2128505 - RNA, 16 nt, Staphylococcus aureus subsp. aureus N315
ucguuaaggaaagcuu

SEQ ID NO: 2128506 - RNA, 14 nt, Staphylococcus aureus subsp. aureus N315
ucguuaauuuccaa

SEQ ID NO: 2128507 - RNA, 12 nt, Staphylococcus aureus subsp. aureus N315
ucgugagccccu

SEQ ID NO: 2128508 - RNA, 18 nt, Staphylococcus aureus subsp. aureus N315
ucguuacuaccuauuaau

SEQ ID NO: 2128509 - RNA, 17 nt, Staphylococcus aureus subsp. aureus N315
ucguuagaugaaugccu

SEQ ID NO: 2128510 - RNA, 15 nt, Staphylococcus aureus subsp. aureus N315
ucguucaagaacaau

SEQ ID NO: 2128511 - RNA, 14 nt, Staphylococcus aureus subsp. aureus N315
ucguuauagacuaa

SEQ ID NO: 2128512 - RNA, 14 nt, Staphylococcus aureus subsp. aureus N315
ucuacagguaaugc

SEQ ID NO: 2128513 - RNA, 18 nt, Staphylococcus aureus subsp. aureus N315
ucuacagguaaugcaagu

SEQ ID NO: 2128514 - RNA, 14 nt, Staphylococcus aureus subsp. aureus N315
ucuacaguuuuaug

SEQ ID NO: 2128515 - RNA, 21 nt, Staphylococcus aureus subsp. aureus N315
ucuacauauuggcuugcuuca

SEQ ID NO: 2128516 - RNA, 22 nt, Staphylococcus aureus subsp. aureus N315
ucuacagguaaugcaaguuggc

SEQ ID NO: 2128517 - RNA, 19 nt, Staphylococcus aureus subsp. aureus N315
ucuaauuguuguaauucuu

SEQ ID NO: 2128518 - RNA, 21 nt, Staphylococcus aureus subsp. aureus N315
ucuaauuucuuagauuuuaua

SEQ ID NO: 2128519 - RNA, 15 nt, Staphylococcus aureus subsp. aureus N315
ucuaauuguuguaau

SEQ ID NO: 2128520 - RNA, 21 nt, Staphylococcus aureus subsp. aureus N315
ucuaaguuugcguuuuaauuc

SEQ ID NO: 2128521 - RNA, 23 nt, Staphylococcus aureus subsp. aureus N315
ucuaaguuugcguuuuaauucau

SEQ ID NO: 2128522 - RNA, 22 nt, Staphylococcus aureus subsp. aureus N315
ucuaaguguugaccauuaucaa

SEQ ID NO: 2128523 - RNA, 18 nt, Staphylococcus aureus subsp. aureus N315
ucuaaauuauuuauucau

SEQ ID NO: 2128524 - RNA, 16 nt, Staphylococcus aureus subsp. aureus N315
ucuaaaucuucaucau

SEQ ID NO: 2128525 - RNA, 16 nt, Staphylococcus aureus subsp. aureus N315
ucuaacucauaaucaa

SEQ ID NO: 2128526 - RNA, 21 nt, Staphylococcus aureus subsp. aureus N315
ucuaacuuguuuauucagaua

SEQ ID NO: 2128527 - RNA, 20 nt, Staphylococcus aureus subsp. aureus N315
ucuaaauauaauagaaauaa

SEQ ID NO: 2128528 - RNA, 19 nt, Staphylococcus aureus subsp. aureus N315
ucuaaauaaaauuaaaaca

SEQ ID NO: 2128529 - RNA, 17 nt, Staphylococcus aureus subsp. aureus N315
ucuaaauaguuuuucau

SEQ ID NO: 2128530 - RNA, 16 nt, Staphylococcus aureus subsp. aureus N315
ucuaaagcuuauuaaa

SEQ ID NO: 2128531 - RNA, 18 nt, Staphylococcus aureus subsp. aureus N315
ucuaaauaaaauuaaaac

SEQ ID NO: 2128532 - RNA, 19 nt, Staphylococcus aureus subsp. aureus N315
ucuaaaaagcggacugaaa

SEQ ID NO: 2128533 - RNA, 18 nt, Staphylococcus aureus subsp. aureus N315
ucuaaaaacauaaaaauc

SEQ ID NO: 2128534 - RNA, 14 nt, Staphylococcus aureus subsp. aureus N315
ucguuuuuuuagcu

SEQ ID NO: 2128535 - RNA, 14 nt, Staphylococcus aureus subsp. aureus N315
ucuaaaaacauaaa

SEQ ID NO: 2128536 - RNA, 18 nt, Staphylococcus aureus subsp. aureus N315
ucuaaaaaauuaaaaauu

SEQ ID NO: 2128537 - RNA, 15 nt, Staphylococcus aureus subsp. aureus N315
ucgucgcugauacau

SEQ ID NO: 2128538 - RNA, 15 nt, Staphylococcus aureus subsp. aureus N315
ucguauucuucaaua

SEQ ID NO: 2128539 - RNA, 15 nt, Staphylococcus aureus subsp. aureus N315
ucguauucuuuuaau

SEQ ID NO: 2128540 - RNA, 16 nt, Staphylococcus aureus subsp. aureus N315
ucguauucaaaguuuu

SEQ ID NO: 2128541 - RNA, 14 nt, Staphylococcus aureus subsp. aureus N315
ucguaaugaugaca

SEQ ID NO: 2128542 - RNA, 19 nt, Staphylococcus aureus subsp. aureus N315
ucguaauguguuaauacuu

SEQ ID NO: 2128543 - RNA, 14 nt, Staphylococcus aureus subsp. aureus N315
ucguauaagaauca

SEQ ID NO: 2128544 - RNA, 18 nt, Staphylococcus aureus subsp. aureus N315
ucgguauaucuaaaugau

SEQ ID NO: 2128545 - RNA, 19 nt, Staphylococcus aureus subsp. aureus N315
ucgguauucaauucuguga

SEQ ID NO: 2128546 - RNA, 16 nt, Staphylococcus aureus subsp. aureus N315
ucgguauuuaauguuu

SEQ ID NO: 2128547 - RNA, 18 nt, Staphylococcus aureus subsp. aureus N315
ucgguauuuaauguuuua

SEQ ID NO: 2128548 - RNA, 14 nt, Staphylococcus aureus subsp. aureus N315
ucgguauucaauuc

SEQ ID NO: 2128549 - RNA, 18 nt, Staphylococcus aureus subsp. aureus N315
ucgguauuuuaaauuuau

SEQ ID NO: 2128550 - RNA, 13 nt, Staphylococcus aureus subsp. aureus N315
ucgguauuuuaaa

SEQ ID NO: 2128551 - RNA, 18 nt, Staphylococcus aureus subsp. aureus N315
ucguaaacacuauaaaag

SEQ ID NO: 2128552 - RNA, 16 nt, Staphylococcus aureus subsp. aureus N315
ucguaacauuuaaaaa

SEQ ID NO: 2128553 - RNA, 15 nt, Staphylococcus aureus subsp. aureus N315
ucguaacauuuaaaa

SEQ ID NO: 2128554 - RNA, 22 nt, Staphylococcus aureus subsp. aureus N315
ucguaagcuucuguguuggggc

SEQ ID NO: 2128555 - RNA, 17 nt, Staphylococcus aureus subsp. aureus N315
ucguaacucuuuaauuu

SEQ ID NO: 2128556 - RNA, 14 nt, Staphylococcus aureus subsp. aureus N315
ucggcuuuguaaaa

SEQ ID NO: 2128557 - RNA, 18 nt, Staphylococcus aureus subsp. aureus N315
ucgcuuuuuuuauuuuuc

SEQ ID NO: 2128558 - RNA, 23 nt, Staphylococcus aureus subsp. aureus N315
ucgcuuuuuuuauuuuucuuuuu

SEQ ID NO: 2128559 - RNA, 17 nt, Staphylococcus aureus subsp. aureus N315
ucgcuuguaacaagcuu

SEQ ID NO: 2128560 - RNA, 17 nt, Staphylococcus aureus subsp. aureus N315
ucgcugcuacaccaccu

SEQ ID NO: 2128561 - RNA, 16 nt, Staphylococcus aureus subsp. aureus N315
ucggauuaaaaguauc

SEQ ID NO: 2128562 - RNA, 17 nt, Staphylococcus aureus subsp. aureus N315
ucggauuauauuuagau

SEQ ID NO: 2128563 - RNA, 16 nt, Staphylococcus aureus subsp. aureus N315
ucggauuaucuguaau

SEQ ID NO: 2128564 - RNA, 18 nt, Staphylococcus aureus subsp. aureus N315
ucggaugagaaauguuaa

SEQ ID NO: 2128565 - RNA, 22 nt, Staphylococcus aureus subsp. aureus N315
ucggauugaaccggaaauuaaa

SEQ ID NO: 2128566 - RNA, 16 nt, Staphylococcus aureus subsp. aureus N315
ucuuuugcaagguuuu

SEQ ID NO: 2128567 - RNA, 21 nt, Staphylococcus aureus subsp. aureus N315
ucuuuugcaaaacgcauuuca

SEQ ID NO: 2128568 - RNA, 18 nt, Staphylococcus aureus subsp. aureus N315
ucuuuugaaucuuguuga

SEQ ID NO: 2128569 - RNA, 21 nt, Staphylococcus aureus subsp. aureus N315
ucuuuugagacguuuuccaug

SEQ ID NO: 2128570 - RNA, 15 nt, Staphylococcus aureus subsp. aureus N315
ucuuuuuaucaugau

SEQ ID NO: 2128571 - RNA, 13 nt, Staphylococcus aureus subsp. aureus N315
ucuuuuuauuuau

SEQ ID NO: 2128572 - RNA, 19 nt, Staphylococcus aureus subsp. aureus N315
ucuuuuucagcuaauuguc

SEQ ID NO: 2128573 - RNA, 23 nt, Staphylococcus aureus subsp. aureus N315
ugaaaaaauaacuguaaaacauu

SEQ ID NO: 2128574 - RNA, 13 nt, Staphylococcus aureus subsp. aureus N315
ucuuuuuuuaaug

SEQ ID NO: 2128575 - RNA, 12 nt, Staphylococcus aureus subsp. aureus N315
ucuuuuuuuaau

SEQ ID NO: 2128576 - RNA, 20 nt, Staphylococcus aureus subsp. aureus N315
ucuuuuuguuguuuuaauuu

SEQ ID NO: 2128577 - RNA, 19 nt, Staphylococcus aureus subsp. aureus N315
ucuuuuuguuguuuuaauu

SEQ ID NO: 2128578 - RNA, 15 nt, Staphylococcus aureus subsp. aureus N315
ucuuuuuguccccag

SEQ ID NO: 2128579 - RNA, 21 nt, Staphylococcus aureus subsp. aureus N315
ucuuuuugauaauguucccuu

SEQ ID NO: 2128580 - RNA, 15 nt, Staphylococcus aureus subsp. aureus N315
ucuuuuucuugcaua

SEQ ID NO: 2128581 - RNA, 17 nt, Staphylococcus aureus subsp. aureus N315
ucuuuuucuuucauaau

SEQ ID NO: 2128582 - RNA, 15 nt, Staphylococcus aureus subsp. aureus N315
ucuuuuucuaaauaa

SEQ ID NO: 2128583 - RNA, 23 nt, Staphylococcus aureus subsp. aureus N315
ucuuuuuuuaacuuccuaaaauu

SEQ ID NO: 2128584 - RNA, 12 nt, Staphylococcus aureus subsp. aureus N315
ucuuuuuuaauu

SEQ ID NO: 2128585 - RNA, 19 nt, Staphylococcus aureus subsp. aureus N315
ucuuuuuuauuuaauuauu

SEQ ID NO: 2128586 - RNA, 22 nt, Staphylococcus aureus subsp. aureus N315
ucuuuuauggugggaagguaaa

SEQ ID NO: 2128587 - RNA, 21 nt, Staphylococcus aureus subsp. aureus N315
ucuuuuauacauguacauuau

SEQ ID NO: 2128588 - RNA, 15 nt, Staphylococcus aureus subsp. aureus N315
ucuuuuauacaugua

SEQ ID NO: 2128589 - RNA, 17 nt, Staphylococcus aureus subsp. aureus N315
ucuuuuauauuuuuauc

SEQ ID NO: 2128590 - RNA, 18 nt, Staphylococcus aureus subsp. aureus N315
ucuuuguguuugcuuuuu

SEQ ID NO: 2128591 - RNA, 13 nt, Staphylococcus aureus subsp. aureus N315
ucuuuguauuuau

SEQ ID NO: 2128592 - RNA, 13 nt, Staphylococcus aureus subsp. aureus N315
ucuuuguaaauuu

SEQ ID NO: 2128593 - RNA, 18 nt, Staphylococcus aureus subsp. aureus N315
ucuuuguguuugcuuuua

SEQ ID NO: 2128594 - RNA, 19 nt, Staphylococcus aureus subsp. aureus N315
ucuuugucaucuuuugucu

SEQ ID NO: 2128595 - RNA, 19 nt, Staphylococcus aureus subsp. aureus N315
ucuuuguaaccuaaaaaca

SEQ ID NO: 2128596 - RNA, 18 nt, Staphylococcus aureus subsp. aureus N315
ucuuuuaauagaucuuug

SEQ ID NO: 2128597 - RNA, 22 nt, Staphylococcus aureus subsp. aureus N315
ucuuuguuggggcccacacccc

SEQ ID NO: 2128598 - RNA, 16 nt, Staphylococcus aureus subsp. aureus N315
ucuuuguuuuuaauuu

SEQ ID NO: 2128599 - RNA, 20 nt, Staphylococcus aureus subsp. aureus N315
ucuuuuaaauucuuauaaaa

SEQ ID NO: 2128600 - RNA, 15 nt, Staphylococcus aureus subsp. aureus N315
ucuuuggugaaagua

SEQ ID NO: 2128601 - RNA, 20 nt, Staphylococcus aureus subsp. aureus N315
ucuuucuuuucugaauguau

SEQ ID NO: 2128602 - RNA, 11 nt, Staphylococcus aureus subsp. aureus N315
ucuuucuuuug

SEQ ID NO: 2128603 - RNA, 13 nt, Staphylococcus aureus subsp. aureus N315
ucuuucuuuucug

SEQ ID NO: 2128604 - RNA, 22 nt, Staphylococcus aureus subsp. aureus N315
ucuuucuuuguguuugcuuuuu

SEQ ID NO: 2128605 - RNA, 22 nt, Staphylococcus aureus subsp. aureus N315
ucuuugacauguguuaaaccaa

SEQ ID NO: 2128606 - RNA, 20 nt, Staphylococcus aureus subsp. aureus N315
ucuuugauaacaauuuuaaa

SEQ ID NO: 2128607 - RNA, 16 nt, Staphylococcus aureus subsp. aureus N315
ucuuugauuaaaucuu

SEQ ID NO: 2128608 - RNA, 13 nt, Staphylococcus aureus subsp. aureus N315
ucuuuauauuuau

SEQ ID NO: 2128609 - RNA, 14 nt, Staphylococcus aureus subsp. aureus N315
ucuuuaaugaaagc

SEQ ID NO: 2128610 - RNA, 15 nt, Staphylococcus aureus subsp. aureus N315
ucuuuaaugaaagca

SEQ ID NO: 2128611 - RNA, 18 nt, Staphylococcus aureus subsp. aureus N315
ucuuuaauauaaauuuug

SEQ ID NO: 2128612 - RNA, 17 nt, Staphylococcus aureus subsp. aureus N315
ucuuuaauauaaauuuu

SEQ ID NO: 2128613 - RNA, 19 nt, Staphylococcus aureus subsp. aureus N315
ucuuucauaguuauuaaau

SEQ ID NO: 2128614 - RNA, 14 nt, Staphylococcus aureus subsp. aureus N315
ucuuuaugauaauu

SEQ ID NO: 2128615 - RNA, 16 nt, Staphylococcus aureus subsp. aureus N315
ucuuuaugauaauuaa

SEQ ID NO: 2128616 - RNA, 22 nt, Staphylococcus aureus subsp. aureus N315
ucuuuaugauaauuaauuaaaa

SEQ ID NO: 2128617 - RNA, 13 nt, Staphylococcus aureus subsp. aureus N315
ucuuuauuaauaa

SEQ ID NO: 2128618 - RNA, 19 nt, Staphylococcus aureus subsp. aureus N315
ucuuucagcuaauucgucu

SEQ ID NO: 2128619 - RNA, 14 nt, Staphylococcus aureus subsp. aureus N315
ucuuucgucuugua

SEQ ID NO: 2128620 - RNA, 21 nt, Staphylococcus aureus subsp. aureus N315
ucuuucgucuuguaaacuucu

SEQ ID NO: 2128621 - RNA, 21 nt, Staphylococcus aureus subsp. aureus N315
ucuuucucggcgauaaaaugu

SEQ ID NO: 2128622 - RNA, 15 nt, Staphylococcus aureus subsp. aureus N315
ucuuucucuauuaau

SEQ ID NO: 2128623 - RNA, 16 nt, Staphylococcus aureus subsp. aureus N315
ucuuggacauuguaaa

SEQ ID NO: 2128624 - RNA, 17 nt, Staphylococcus aureus subsp. aureus N315
ucuuggccaauuaacuu

SEQ ID NO: 2128625 - RNA, 23 nt, Staphylococcus aureus subsp. aureus N315
ucuugguauuuuuuaaaugcgua

SEQ ID NO: 2128626 - RNA, 16 nt, Staphylococcus aureus subsp. aureus N315
ucuuguuggauuuuaa

SEQ ID NO: 2128627 - RNA, 15 nt, Staphylococcus aureus subsp. aureus N315
ucuuguguuucagcu

SEQ ID NO: 2128628 - RNA, 13 nt, Staphylococcus aureus subsp. aureus N315
ucuuguucuaaaa

SEQ ID NO: 2128629 - RNA, 19 nt, Staphylococcus aureus subsp. aureus N315
ucuuuaagcccuuccccua

SEQ ID NO: 2128630 - RNA, 19 nt, Staphylococcus aureus subsp. aureus N315
ucuuuaacucuugaaacac

SEQ ID NO: 2128631 - RNA, 17 nt, Staphylococcus aureus subsp. aureus N315
ucuuguuuucauuuaaa

SEQ ID NO: 2128632 - RNA, 16 nt, Staphylococcus aureus subsp. aureus N315
ugaaauauaccaacca

SEQ ID NO: 2128633 - RNA, 16 nt, Staphylococcus aureus subsp. aureus N315
ugaaauaucgagaggg

SEQ ID NO: 2128634 - RNA, 16 nt, Staphylococcus aureus subsp. aureus N315
ugaaauauuuaucuuu

SEQ ID NO: 2128635 - RNA, 15 nt, Staphylococcus aureus subsp. aureus N315
ugaaauauuuaucuu

SEQ ID NO: 2128636 - RNA, 14 nt, Staphylococcus aureus subsp. aureus N315
ugaaauaauauaaa

SEQ ID NO: 2128637 - RNA, 17 nt, Staphylococcus aureus subsp. aureus N315
ugaaaucgauacuaaua

SEQ ID NO: 2128638 - RNA, 14 nt, Staphylococcus aureus subsp. aureus N315
ugaaaucauuuaaa

SEQ ID NO: 2128639 - RNA, 21 nt, Staphylococcus aureus subsp. aureus N315
ugaaaucaguuuuugaauauu

SEQ ID NO: 2128640 - RNA, 20 nt, Staphylococcus aureus subsp. aureus N315
ugaaaucuauugugauauau

SEQ ID NO: 2128641 - RNA, 15 nt, Staphylococcus aureus subsp. aureus N315
ugaaaugagcuuaag

SEQ ID NO: 2128642 - RNA, 22 nt, Staphylococcus aureus subsp. aureus N315
ugaaaugauacauuauuaaaua

SEQ ID NO: 2128643 - RNA, 15 nt, Staphylococcus aureus subsp. aureus N315
ugaaauucuuuugua

SEQ ID NO: 2128644 - RNA, 20 nt, Staphylococcus aureus subsp. aureus N315
ugaaauugacaguuuccaua

SEQ ID NO: 2128645 - RNA, 21 nt, Staphylococcus aureus subsp. aureus N315
ugaaauuauuauuuaaauuuu

SEQ ID NO: 2128646 - RNA, 22 nt, Staphylococcus aureus subsp. aureus N315
ugaaauuauuauuuaaauuuuc

SEQ ID NO: 2128647 - RNA, 21 nt, Staphylococcus aureus subsp. aureus N315
ugaaauuaacgucaacagcau

SEQ ID NO: 2128648 - RNA, 23 nt, Staphylococcus aureus subsp. aureus N315
ugaaauuaacgucaacagcauaa

SEQ ID NO: 2128649 - RNA, 17 nt, Staphylococcus aureus subsp. aureus N315
ugaaauguuuaucaauu

SEQ ID NO: 2128650 - RNA, 16 nt, Staphylococcus aureus subsp. aureus N315
ugaaauuaauuaucuu

SEQ ID NO: 2128651 - RNA, 17 nt, Staphylococcus aureus subsp. aureus N315
ugaaauggaaaguaaua

SEQ ID NO: 2128652 - RNA, 15 nt, Staphylococcus aureus subsp. aureus N315
ugaaauggaaaguaa

SEQ ID NO: 2128653 - RNA, 14 nt, Staphylococcus aureus subsp. aureus N315
ugaaauuuauuaua

SEQ ID NO: 2128654 - RNA, 14 nt, Staphylococcus aureus subsp. aureus N315
ugaaauuucauaaa

SEQ ID NO: 2128655 - RNA, 14 nt, Staphylococcus aureus subsp. aureus N315
ugaaauuuuuaaua

SEQ ID NO: 2128656 - RNA, 20 nt, Staphylococcus aureus subsp. aureus N315
ugaaauuuuuuagugaaaaa

SEQ ID NO: 2128657 - RNA, 19 nt, Staphylococcus aureus subsp. aureus N315
ugaaauuuuuuagugaaaa

SEQ ID NO: 2128658 - RNA, 22 nt, Staphylococcus aureus subsp. aureus N315
ugaacaaaaaauaaaaacuucu

SEQ ID NO: 2128659 - RNA, 23 nt, Staphylococcus aureus subsp. aureus N315
ugaacaaaaaauaaaaacuucua

SEQ ID NO: 2128660 - RNA, 20 nt, Staphylococcus aureus subsp. aureus N315
ugaacauauuauaaaagugu

SEQ ID NO: 2128661 - RNA, 16 nt, Staphylococcus aureus subsp. aureus N315
ugaacauauuauaaaa

SEQ ID NO: 2128662 - RNA, 17 nt, Staphylococcus aureus subsp. aureus N315
ugaacaucauuuaauug

SEQ ID NO: 2128663 - RNA, 18 nt, Staphylococcus aureus subsp. aureus N315
ugaacaucauuuaauuga

SEQ ID NO: 2128664 - RNA, 15 nt, Staphylococcus aureus subsp. aureus N315
ugaacagauucaccu

SEQ ID NO: 2128665 - RNA, 22 nt, Staphylococcus aureus subsp. aureus N315
ugaacagauucaccuaaucuug

SEQ ID NO: 2128666 - RNA, 13 nt, Staphylococcus aureus subsp. aureus N315
ugaacaauaauau

SEQ ID NO: 2128667 - RNA, 13 nt, Staphylococcus aureus subsp. aureus N315
ugaacaauucuuc

SEQ ID NO: 2128668 - RNA, 20 nt, Staphylococcus aureus subsp. aureus N315
ugaaccagcuaaccaaauaa

SEQ ID NO: 2128669 - RNA, 15 nt, Staphylococcus aureus subsp. aureus N315
ugaaccggaaauuaa

SEQ ID NO: 2128670 - RNA, 19 nt, Staphylococcus aureus subsp. aureus N315
ugaaccauuuaacucaccu

SEQ ID NO: 2128671 - RNA, 15 nt, Staphylococcus aureus subsp. aureus N315
ugaaaagauaaacaa

SEQ ID NO: 2128672 - RNA, 16 nt, Staphylococcus aureus subsp. aureus N315
ugaaaaggaaaaacuu

SEQ ID NO: 2128673 - RNA, 16 nt, Staphylococcus aureus subsp. aureus N315
ugaaaaguaaauugag

SEQ ID NO: 2128674 - RNA, 17 nt, Staphylococcus aureus subsp. aureus N315
ugaaaaagauucggaaa

SEQ ID NO: 2128675 - RNA, 20 nt, Staphylococcus aureus subsp. aureus N315
ugaaaaacuucuuaacuuga

SEQ ID NO: 2128676 - RNA, 15 nt, Staphylococcus aureus subsp. aureus N315
ugaaaaaucuucucc

SEQ ID NO: 2128677 - RNA, 19 nt, Staphylococcus aureus subsp. aureus N315
ugaaaauaaucgaacagaa

SEQ ID NO: 2128678 - RNA, 13 nt, Staphylococcus aureus subsp. aureus N315
ugaaaaucuuuaa

SEQ ID NO: 2128679 - RNA, 16 nt, Staphylococcus aureus subsp. aureus N315
ugaaaaucuuuaacuc

SEQ ID NO: 2128680 - RNA, 22 nt, Staphylococcus aureus subsp. aureus N315
ugaaaauaccucuacauuauau

SEQ ID NO: 2128681 - RNA, 14 nt, Staphylococcus aureus subsp. aureus N315
ugaaacaucuugau

SEQ ID NO: 2128682 - RNA, 14 nt, Staphylococcus aureus subsp. aureus N315
ugaaacacaaaaag

SEQ ID NO: 2128683 - RNA, 15 nt, Staphylococcus aureus subsp. aureus N315
ugaaaauuuguauaa

SEQ ID NO: 2128684 - RNA, 14 nt, Staphylococcus aureus subsp. aureus N315
ugaaagauacugcu

SEQ ID NO: 2128685 - RNA, 20 nt, Staphylococcus aureus subsp. aureus N315
ugaaagacugacuaauaaaa

SEQ ID NO: 2128686 - RNA, 14 nt, Staphylococcus aureus subsp. aureus N315
ugaaaguaccuaaa

SEQ ID NO: 2128687 - RNA, 17 nt, Staphylococcus aureus subsp. aureus N315
ugaaaguaccuaaaaua

SEQ ID NO: 2128688 - RNA, 19 nt, Staphylococcus aureus subsp. aureus N315
ugaaaguaccuaaaauaga

SEQ ID NO: 2128689 - RNA, 19 nt, Staphylococcus aureus subsp. aureus N315
ugaaaguuuuugucuuaau

SEQ ID NO: 2128690 - RNA, 20 nt, Staphylococcus aureus subsp. aureus N315
ugaaaguaccuaaaauagaa

SEQ ID NO: 2128691 - RNA, 20 nt, Staphylococcus aureus subsp. aureus N315
ugaaaguauuagauauauuu

SEQ ID NO: 2128692 - RNA, 22 nt, Staphylococcus aureus subsp. aureus N315
ugaaagucguuguugaaauuaa

SEQ ID NO: 2128693 - RNA, 22 nt, Staphylococcus aureus subsp. aureus N315
ugaaaccuuugguucaaucauu

SEQ ID NO: 2128694 - RNA, 13 nt, Staphylococcus aureus subsp. aureus N315
ugaaacuuuaaua

SEQ ID NO: 2128695 - RNA, 19 nt, Staphylococcus aureus subsp. aureus N315
ugaaacuaaauuaaaagug

SEQ ID NO: 2128696 - RNA, 14 nt, Staphylococcus aureus subsp. aureus N315
ugaaacuaaauuaa

SEQ ID NO: 2128697 - RNA, 16 nt, Staphylococcus aureus subsp. aureus N315
ucuucaucuucuucaa

SEQ ID NO: 2128698 - RNA, 23 nt, Staphylococcus aureus subsp. aureus N315
ucuucaucaugacuauuuuccau

SEQ ID NO: 2128699 - RNA, 13 nt, Staphylococcus aureus subsp. aureus N315
ucuucaucaugac

SEQ ID NO: 2128700 - RNA, 17 nt, Staphylococcus aureus subsp. aureus N315
ucuucaucuucuucaaa

SEQ ID NO: 2128701 - RNA, 12 nt, Staphylococcus aureus subsp. aureus N315
ucuucaucuuuu

SEQ ID NO: 2128702 - RNA, 14 nt, Staphylococcus aureus subsp. aureus N315
ucuucaugaacagc

SEQ ID NO: 2128703 - RNA, 12 nt, Staphylococcus aureus subsp. aureus N315
ucuucaucuucu

SEQ ID NO: 2128704 - RNA, 23 nt, Staphylococcus aureus subsp. aureus N315
ucuucaucaauaacuauaaucau

SEQ ID NO: 2128705 - RNA, 17 nt, Staphylococcus aureus subsp. aureus N315
ucuucagaaccuugaau

SEQ ID NO: 2128706 - RNA, 19 nt, Staphylococcus aureus subsp. aureus N315
ucuucacuaaaaauauauu

SEQ ID NO: 2128707 - RNA, 13 nt, Staphylococcus aureus subsp. aureus N315
ucuucaccaucug

SEQ ID NO: 2128708 - RNA, 19 nt, Staphylococcus aureus subsp. aureus N315
ucuuauuuguuuaauuauc

SEQ ID NO: 2128709 - RNA, 18 nt, Staphylococcus aureus subsp. aureus N315
ucuuauuuuguuuuaaaa

SEQ ID NO: 2128710 - RNA, 14 nt, Staphylococcus aureus subsp. aureus N315
ucuucaaaaaauaa

SEQ ID NO: 2128711 - RNA, 22 nt, Staphylococcus aureus subsp. aureus N315
ucuucaacaauuucaaugucug

SEQ ID NO: 2128712 - RNA, 21 nt, Staphylococcus aureus subsp. aureus N315
ucuucaaaguagauauugaau

SEQ ID NO: 2128713 - RNA, 20 nt, Staphylococcus aureus subsp. aureus N315
ucuucaacauaacucaaaua

SEQ ID NO: 2128714 - RNA, 18 nt, Staphylococcus aureus subsp. aureus N315
ucuucaauuucauuuuug

SEQ ID NO: 2128715 - RNA, 9 nt, Staphylococcus aureus subsp. aureus N315
ucuucacca

SEQ ID NO: 2128716 - RNA, 18 nt, Staphylococcus aureus subsp. aureus N315
ucuucaaucuaccaauac

SEQ ID NO: 2128717 - RNA, 22 nt, Staphylococcus aureus subsp. aureus N315
ucuucaauucuuacaccugcaa

SEQ ID NO: 2128718 - RNA, 18 nt, Staphylococcus aureus subsp. aureus N315
ucuuaucauuucaaauaa

SEQ ID NO: 2128719 - RNA, 15 nt, Staphylococcus aureus subsp. aureus N315
ucuuaucauaaucuu

SEQ ID NO: 2128720 - RNA, 16 nt, Staphylococcus aureus subsp. aureus N315
ucuuaucuuuaugaua

SEQ ID NO: 2128721 - RNA, 13 nt, Staphylococcus aureus subsp. aureus N315
ucuuauaaaaauc

SEQ ID NO: 2128722 - RNA, 22 nt, Staphylococcus aureus subsp. aureus N315
ucuuauaaagacaccuucaaua

SEQ ID NO: 2128723 - RNA, 18 nt, Staphylococcus aureus subsp. aureus N315
ucuuagugaaucuucuaa

SEQ ID NO: 2128724 - RNA, 20 nt, Staphylococcus aureus subsp. aureus N315
ucuuagcacuuggauuuuaa

SEQ ID NO: 2128725 - RNA, 13 nt, Staphylococcus aureus subsp. aureus N315
ucuuauaacaaaa

SEQ ID NO: 2128726 - RNA, 19 nt, Staphylococcus aureus subsp. aureus N315
ucuuacugcugcuuuuaau

SEQ ID NO: 2128727 - RNA, 20 nt, Staphylococcus aureus subsp. aureus N315
ucuuagauuuucacuaauau

SEQ ID NO: 2128728 - RNA, 23 nt, Staphylococcus aureus subsp. aureus N315
ucuuacuacuuaauuaauaauuu

SEQ ID NO: 2128729 - RNA, 22 nt, Staphylococcus aureus subsp. aureus N315
ucuuacuacuuaauuaauaauu

SEQ ID NO: 2128730 - RNA, 19 nt, Staphylococcus aureus subsp. aureus N315
ucuguuacagguuuuaaaa

SEQ ID NO: 2128731 - RNA, 23 nt, Staphylococcus aureus subsp. aureus N315
ucuguuacagguuuuaaaauuaa

SEQ ID NO: 2128732 - RNA, 18 nt, Staphylococcus aureus subsp. aureus N315
ucuguuaacugaauuucg

SEQ ID NO: 2128733 - RNA, 22 nt, Staphylococcus aureus subsp. aureus N315
ucuguguuggggcccacacccc

SEQ ID NO: 2128734 - RNA, 16 nt, Staphylococcus aureus subsp. aureus N315
ucugcuaaucuucuca

SEQ ID NO: 2128735 - RNA, 21 nt, Staphylococcus aureus subsp. aureus N315
ucugcuaacucugaucuaaaa

SEQ ID NO: 2128736 - RNA, 17 nt, Staphylococcus aureus subsp. aureus N315
ucugcucuuuuuguaug

SEQ ID NO: 2128737 - RNA, 15 nt, Staphylococcus aureus subsp. aureus N315
ucuggaacuuuaaua

SEQ ID NO: 2128738 - RNA, 16 nt, Staphylococcus aureus subsp. aureus N315
ucuguccgauuuuuaa

SEQ ID NO: 2128739 - RNA, 18 nt, Staphylococcus aureus subsp. aureus N315
ucuguccgauuuuuaaug

SEQ ID NO: 2128740 - RNA, 20 nt, Staphylococcus aureus subsp. aureus N315
ucuguccgauaucuuuuaau

SEQ ID NO: 2128741 - RNA, 17 nt, Staphylococcus aureus subsp. aureus N315
ucugucuaaaaacauaa

SEQ ID NO: 2128742 - RNA, 20 nt, Staphylococcus aureus subsp. aureus N315
ucugucuaaaaacauaaaaa

SEQ ID NO: 2128743 - RNA, 14 nt, Staphylococcus aureus subsp. aureus N315
ucuguguaaauaua

SEQ ID NO: 2128744 - RNA, 18 nt, Staphylococcus aureus subsp. aureus N315
ucugucuaaaaacauaaa

SEQ ID NO: 2128745 - RNA, 15 nt, Staphylococcus aureus subsp. aureus N315
ucuguaccguauuuu

SEQ ID NO: 2128746 - RNA, 13 nt, Staphylococcus aureus subsp. aureus N315
ucuguaauuaauc

SEQ ID NO: 2128747 - RNA, 22 nt, Staphylococcus aureus subsp. aureus N315
ucuguaauaugaaggcuuuuug

SEQ ID NO: 2128748 - RNA, 21 nt, Staphylococcus aureus subsp. aureus N315
ucuguaaauuaucuaaagaaa

SEQ ID NO: 2128749 - RNA, 20 nt, Staphylococcus aureus subsp. aureus N315
ucuggaauaccuaaccauaa

SEQ ID NO: 2128750 - RNA, 18 nt, Staphylococcus aureus subsp. aureus N315
ucucaucuucuaaaucaa

SEQ ID NO: 2128751 - RNA, 14 nt, Staphylococcus aureus subsp. aureus N315
ucucauuauaauga

SEQ ID NO: 2128752 - RNA, 24 nt, Staphylococcus aureus subsp. aureus N315
ucuacauuaaagaaaauaucugaa

SEQ ID NO: 2128753 - RNA, 19 nt, Staphylococcus aureus subsp. aureus N315
ucucaucuacuauuuaauc

SEQ ID NO: 2128754 - RNA, 23 nt, Staphylococcus aureus subsp. aureus N315
ucuccaguuuucaauuuauuaac

SEQ ID NO: 2128755 - RNA, 13 nt, Staphylococcus aureus subsp. aureus N315
ucuccauauuugu

SEQ ID NO: 2128756 - RNA, 13 nt, Staphylococcus aureus subsp. aureus N315
ucucccuuuuauc

SEQ ID NO: 2128757 - RNA, 15 nt, Staphylococcus aureus subsp. aureus N315
ucucccuuuuaucuu

SEQ ID NO: 2128758 - RNA, 22 nt, Staphylococcus aureus subsp. aureus N315
ucucccuuaaauacaauuucuu

SEQ ID NO: 2128759 - RNA, 15 nt, Staphylococcus aureus subsp. aureus N315
ucucgcuuacucauu

SEQ ID NO: 2128760 - RNA, 13 nt, Staphylococcus aureus subsp. aureus N315
ucucguaaauugu

SEQ ID NO: 2128761 - RNA, 16 nt, Staphylococcus aureus subsp. aureus N315
ucucgugaaaauaaua

SEQ ID NO: 2128762 - RNA, 15 nt, Staphylococcus aureus subsp. aureus N315
ucucguguauacaac

SEQ ID NO: 2128763 - RNA, 18 nt, Staphylococcus aureus subsp. aureus N315
ucucguguaaaaugcaau

SEQ ID NO: 2128764 - RNA, 23 nt, Staphylococcus aureus subsp. aureus N315
ucucuaaaaagcggacugaaaga

SEQ ID NO: 2128765 - RNA, 19 nt, Staphylococcus aureus subsp. aureus N315
ucucuaaauaauuucucaa

SEQ ID NO: 2128766 - RNA, 13 nt, Staphylococcus aureus subsp. aureus N315
ucucuaauuucac

SEQ ID NO: 2128767 - RNA, 18 nt, Staphylococcus aureus subsp. aureus N315
ucucuagugcuuugucuu

SEQ ID NO: 2128768 - RNA, 22 nt, Staphylococcus aureus subsp. aureus N315
ucucuaucaguccgcuuuuuca

SEQ ID NO: 2128769 - RNA, 21 nt, Staphylococcus aureus subsp. aureus N315
ucucuaccuugaucuaaaaua

SEQ ID NO: 2128770 - RNA, 14 nt, Staphylococcus aureus subsp. aureus N315
ucucuacuaauauu

SEQ ID NO: 2128771 - RNA, 19 nt, Staphylococcus aureus subsp. aureus N315
ucucuuaaauaugaauaau

SEQ ID NO: 2128772 - RNA, 16 nt, Staphylococcus aureus subsp. aureus N315
ucucuucaaaguagau

SEQ ID NO: 2128773 - RNA, 17 nt, Staphylococcus aureus subsp. aureus N315
ucucugaaaaacuucuu

SEQ ID NO: 2128774 - RNA, 13 nt, Staphylococcus aureus subsp. aureus N315
ucugaaaacaauc

SEQ ID NO: 2128775 - RNA, 16 nt, Staphylococcus aureus subsp. aureus N315
ucucuuuugauaaauu

SEQ ID NO: 2128776 - RNA, 15 nt, Staphylococcus aureus subsp. aureus N315
ucucuuucuuauuca

SEQ ID NO: 2128777 - RNA, 14 nt, Staphylococcus aureus subsp. aureus N315
ucugacuuuuaaaa

SEQ ID NO: 2128778 - RNA, 19 nt, Staphylococcus aureus subsp. aureus N315
ucugagaagaaauauauug

SEQ ID NO: 2128779 - RNA, 15 nt, Staphylococcus aureus subsp. aureus N315
ucugaucgacuaauu

SEQ ID NO: 2128780 - RNA, 23 nt, Staphylococcus aureus subsp. aureus N315
gguguagauaaaucgauaaaaug

SEQ ID NO: 2128781 - RNA, 16 nt, Staphylococcus aureus subsp. aureus N315
gguguggugugaugua

SEQ ID NO: 2128782 - RNA, 14 nt, Staphylococcus aureus subsp. aureus N315
gguggguauauaau

SEQ ID NO: 2128783 - RNA, 15 nt, Staphylococcus aureus subsp. aureus N315
gguuaccaucuuuaa

SEQ ID NO: 2128784 - RNA, 17 nt, Staphylococcus aureus subsp. aureus N315
gguguugaaaaguaauu

SEQ ID NO: 2128785 - RNA, 12 nt, Staphylococcus aureus subsp. aureus N315
gguuauuugaua

SEQ ID NO: 2128786 - RNA, 13 nt, Staphylococcus aureus subsp. aureus N315
gguucaaaauugc

SEQ ID NO: 2128787 - RNA, 14 nt, Staphylococcus aureus subsp. aureus N315
gguuauuaaaauua

SEQ ID NO: 2128788 - RNA, 13 nt, Staphylococcus aureus subsp. aureus N315
gguucgaaucccu

SEQ ID NO: 2128789 - RNA, 21 nt, Staphylococcus aureus subsp. aureus N315
gguuuaaacaguuuaauucgu

SEQ ID NO: 2128790 - RNA, 21 nt, Staphylococcus aureus subsp. aureus N315
gguuuaaucuauauauauaug

SEQ ID NO: 2128791 - RNA, 13 nt, Staphylococcus aureus subsp. aureus N315
guaaaaaugauua

SEQ ID NO: 2128792 - RNA, 18 nt, Staphylococcus aureus subsp. aureus N315
guaaaaacguucaaucgu

SEQ ID NO: 2128793 - RNA, 20 nt, Staphylococcus aureus subsp. aureus N315
guaaaaccaaaucguuucau

SEQ ID NO: 2128794 - RNA, 21 nt, Staphylococcus aureus subsp. aureus N315
guaaaacauucccuuaauaau

SEQ ID NO: 2128795 - RNA, 20 nt, Staphylococcus aureus subsp. aureus N315
guaaaaccuguaucuuaaau

SEQ ID NO: 2128796 - RNA, 21 nt, Staphylococcus aureus subsp. aureus N315
guaaaaccuuacccaaaaaau

SEQ ID NO: 2128797 - RNA, 19 nt, Staphylococcus aureus subsp. aureus N315
gguuuucuuaauuauggua

SEQ ID NO: 2128798 - RNA, 21 nt, Staphylococcus aureus subsp. aureus N315
gguuuaucagcuuuaauaaua

SEQ ID NO: 2128799 - RNA, 23 nt, Staphylococcus aureus subsp. aureus N315
gguuugaguaaauuaauagagaa

SEQ ID NO: 2128800 - RNA, 13 nt, Staphylococcus aureus subsp. aureus N315
ggucugcuguauc

SEQ ID NO: 2128801 - RNA, 20 nt, Staphylococcus aureus subsp. aureus N315
ggugagggccccaacacaga

SEQ ID NO: 2128802 - RNA, 21 nt, Staphylococcus aureus subsp. aureus N315
gguccaaaucgugauaucuug

SEQ ID NO: 2128803 - RNA, 18 nt, Staphylococcus aureus subsp. aureus N315
gguauaucuucauuuaaa

SEQ ID NO: 2128804 - RNA, 18 nt, Staphylococcus aureus subsp. aureus N315
gguauccuucucaucauu

SEQ ID NO: 2128805 - RNA, 15 nt, Staphylococcus aureus subsp. aureus N315
gguauuuaauguuuu

SEQ ID NO: 2128806 - RNA, 21 nt, Staphylococcus aureus subsp. aureus N315
ggucacacccauacucugggc

SEQ ID NO: 2128807 - RNA, 17 nt, Staphylococcus aureus subsp. aureus N315
ggucaacuguaguggaa

SEQ ID NO: 2128808 - RNA, 20 nt, Staphylococcus aureus subsp. aureus N315
gggcuagagcguuuugcuuu

SEQ ID NO: 2128809 - RNA, 23 nt, Staphylococcus aureus subsp. aureus N315
gggucacacccauacucugggca

SEQ ID NO: 2128810 - RNA, 19 nt, Staphylococcus aureus subsp. aureus N315
ggggcuuuuaugcaugcgc

SEQ ID NO: 2128811 - RNA, 14 nt, Staphylococcus aureus subsp. aureus N315
gggacagaaaacaa

SEQ ID NO: 2128812 - RNA, 11 nt, Staphylococcus aureus subsp. aureus N315
gggcccacacc

SEQ ID NO: 2128813 - RNA, 13 nt, Staphylococcus aureus subsp. aureus N315
gggcaaaaaagga

SEQ ID NO: 2128814 - RNA, 18 nt, Staphylococcus aureus subsp. aureus N315
gggauuuuuuuauguuug

SEQ ID NO: 2128815 - RNA, 19 nt, Staphylococcus aureus subsp. aureus N315
gucuaaucgacuuuuacaa

SEQ ID NO: 2128816 - RNA, 16 nt, Staphylococcus aureus subsp. aureus N315
gucuacuauuuuuucu

SEQ ID NO: 2128817 - RNA, 19 nt, Staphylococcus aureus subsp. aureus N315
gucuaucgccuaaaaauaa

SEQ ID NO: 2128818 - RNA, 18 nt, Staphylococcus aureus subsp. aureus N315
gucuagauuuuaaaucaa

SEQ ID NO: 2128819 - RNA, 13 nt, Staphylococcus aureus subsp. aureus N315
gucuaacaguuaa

SEQ ID NO: 2128820 - RNA, 12 nt, Staphylococcus aureus subsp. aureus N315
gucuaaaaaugu

SEQ ID NO: 2128821 - RNA, 22 nt, Staphylococcus aureus subsp. aureus N315
gucguuuagacucaguugugcg

SEQ ID NO: 2128822 - RNA, 21 nt, Staphylococcus aureus subsp. aureus N315
gucuauuguaaaaacguucaa

SEQ ID NO: 2128823 - RNA, 15 nt, Staphylococcus aureus subsp. aureus N315
gucuauuuuauaaaa

SEQ ID NO: 2128824 - RNA, 21 nt, Staphylococcus aureus subsp. aureus N315
gucuaucuccgcuacaauuau

SEQ ID NO: 2128825 - RNA, 10 nt, Staphylococcus aureus subsp. aureus N315
gucuaugaau

SEQ ID NO: 2128826 - RNA, 22 nt, Staphylococcus aureus subsp. aureus N315
gucuaugaauaauguuuucauu

SEQ ID NO: 2128827 - RNA, 15 nt, Staphylococcus aureus subsp. aureus N315
gucuauguacaauaa

SEQ ID NO: 2128828 - RNA, 18 nt, Staphylococcus aureus subsp. aureus N315
gucucacuuaauaaauaa

SEQ ID NO: 2128829 - RNA, 12 nt, Staphylococcus aureus subsp. aureus N315
gucuccauauuu

SEQ ID NO: 2128830 - RNA, 15 nt, Staphylococcus aureus subsp. aureus N315
gucuccaauacuuuu

SEQ ID NO: 2128831 - RNA, 15 nt, Staphylococcus aureus subsp. aureus N315
gucuccgugauaaau

SEQ ID NO: 2128832 - RNA, 15 nt, Staphylococcus aureus subsp. aureus N315
gucguacuuucaaau

SEQ ID NO: 2128833 - RNA, 15 nt, Staphylococcus aureus subsp. aureus N315
gucgguuaauccagc

SEQ ID NO: 2128834 - RNA, 15 nt, Staphylococcus aureus subsp. aureus N315
gucguucaagaacaa

SEQ ID NO: 2128835 - RNA, 14 nt, Staphylococcus aureus subsp. aureus N315
guccggggccccaa

SEQ ID NO: 2128836 - RNA, 15 nt, Staphylococcus aureus subsp. aureus N315
guccgacuugauaaa

SEQ ID NO: 2128837 - RNA, 19 nt, Staphylococcus aureus subsp. aureus N315
guccgacuugauaaaaaau

SEQ ID NO: 2128838 - RNA, 15 nt, Staphylococcus aureus subsp. aureus N315
gucgaauguuucuuc

SEQ ID NO: 2128839 - RNA, 14 nt, Staphylococcus aureus subsp. aureus N315
guccagcuaauaac

SEQ ID NO: 2128840 - RNA, 14 nt, Staphylococcus aureus subsp. aureus N315
gucaucaacacaca

SEQ ID NO: 2128841 - RNA, 23 nt, Staphylococcus aureus subsp. aureus N315
gucaucaaaaguuuguauauucu

SEQ ID NO: 2128842 - RNA, 18 nt, Staphylococcus aureus subsp. aureus N315
gucaucaccuuguuaaaa

SEQ ID NO: 2128843 - RNA, 21 nt, Staphylococcus aureus subsp. aureus N315
gucaugcguuguguaacuuua

SEQ ID NO: 2128844 - RNA, 14 nt, Staphylococcus aureus subsp. aureus N315
guauuuuuaagcug

SEQ ID NO: 2128845 - RNA, 21 nt, Staphylococcus aureus subsp. aureus N315
guauuuuguucaguuaaaucu

SEQ ID NO: 2128846 - RNA, 22 nt, Staphylococcus aureus subsp. aureus N315
guauuuucugcuguauggaaag

SEQ ID NO: 2128847 - RNA, 20 nt, Staphylococcus aureus subsp. aureus N315
guauuuuaaugauuuuucau

SEQ ID NO: 2128848 - RNA, 14 nt, Staphylococcus aureus subsp. aureus N315
guauuuuauuuauu

SEQ ID NO: 2128849 - RNA, 23 nt, Staphylococcus aureus subsp. aureus N315
guauuuuauuuauuuugauuaac

SEQ ID NO: 2128850 - RNA, 18 nt, Staphylococcus aureus subsp. aureus N315
guauuugccuuuugaaua

SEQ ID NO: 2128851 - RNA, 14 nt, Staphylococcus aureus subsp. aureus N315
guauuuaauguuuu

SEQ ID NO: 2128852 - RNA, 18 nt, Staphylococcus aureus subsp. aureus N315
guauuguccauagauaca

SEQ ID NO: 2128853 - RNA, 19 nt, Staphylococcus aureus subsp. aureus N315
guauuguuuguagaaauua

SEQ ID NO: 2128854 - RNA, 18 nt, Staphylococcus aureus subsp. aureus N315
guauuuauacuauaaaua

SEQ ID NO: 2128855 - RNA, 13 nt, Staphylococcus aureus subsp. aureus N315
guauuuacuuuuc

SEQ ID NO: 2128856 - RNA, 19 nt, Staphylococcus aureus subsp. aureus N315
guauugccguuauuuucaa

SEQ ID NO: 2128857 - RNA, 22 nt, Staphylococcus aureus subsp. aureus N315
guauucaaauaaacacaucuau

SEQ ID NO: 2128858 - RNA, 15 nt, Staphylococcus aureus subsp. aureus N315
guauucaaaaaauau

SEQ ID NO: 2128859 - RNA, 16 nt, Staphylococcus aureus subsp. aureus N315
guauuacuugaaaaua

SEQ ID NO: 2128860 - RNA, 16 nt, Staphylococcus aureus subsp. aureus N315
gucaauauuguaggga

SEQ ID NO: 2128861 - RNA, 18 nt, Staphylococcus aureus subsp. aureus N315
gucaaauuggacuuaugg

SEQ ID NO: 2128862 - RNA, 16 nt, Staphylococcus aureus subsp. aureus N315
gucacauuuauaacau

SEQ ID NO: 2128863 - RNA, 22 nt, Staphylococcus aureus subsp. aureus N315
gucacgaucaaauuuaauaaua

SEQ ID NO: 2128864 - RNA, 22 nt, Staphylococcus aureus subsp. aureus N315
guaucucugaaaaacuucuuaa

SEQ ID NO: 2128865 - RNA, 19 nt, Staphylococcus aureus subsp. aureus N315
guaugauagaauacuaaaa

SEQ ID NO: 2128866 - RNA, 15 nt, Staphylococcus aureus subsp. aureus N315
guaucgccaaucuau

SEQ ID NO: 2128867 - RNA, 14 nt, Staphylococcus aureus subsp. aureus N315
guaucgccaucauu

SEQ ID NO: 2128868 - RNA, 20 nt, Staphylococcus aureus subsp. aureus N315
guaucgauaguucuauauaa

SEQ ID NO: 2128869 - RNA, 19 nt, Staphylococcus aureus subsp. aureus N315
guaucgaauuaagaaaagu

SEQ ID NO: 2128870 - RNA, 14 nt, Staphylococcus aureus subsp. aureus N315
guaucuauaaaaag

SEQ ID NO: 2128871 - RNA, 16 nt, Staphylococcus aureus subsp. aureus N315
guaucuauaaaaagaa

SEQ ID NO: 2128872 - RNA, 15 nt, Staphylococcus aureus subsp. aureus N315
guaucguuaccuuuu

SEQ ID NO: 2128873 - RNA, 19 nt, Staphylococcus aureus subsp. aureus N315
guaugcccucauaaaucau

SEQ ID NO: 2128874 - RNA, 20 nt, Staphylococcus aureus subsp. aureus N315
guaugcaucaguuaauaauu

SEQ ID NO: 2128875 - RNA, 13 nt, Staphylococcus aureus subsp. aureus N315
guaugauuaggau

SEQ ID NO: 2128876 - RNA, 22 nt, Staphylococcus aureus subsp. aureus N315
guauuacacgcauuacuuuaga

SEQ ID NO: 2128877 - RNA, 21 nt, Staphylococcus aureus subsp. aureus N315
guauccuguguaaaauaaauc

SEQ ID NO: 2128878 - RNA, 20 nt, Staphylococcus aureus subsp. aureus N315
guauccccauuuauguguug

SEQ ID NO: 2128879 - RNA, 21 nt, Staphylococcus aureus subsp. aureus N315
guaucacuaggauguucauca

SEQ ID NO: 2128880 - RNA, 16 nt, Staphylococcus aureus subsp. aureus N315
guaucaagaaaaaguu

SEQ ID NO: 2128881 - RNA, 22 nt, Staphylococcus aureus subsp. aureus N315
guaucaagaaaaaguuuuucug

SEQ ID NO: 2128882 - RNA, 16 nt, Staphylococcus aureus subsp. aureus N315
guaucaucaaaguuua

SEQ ID NO: 2128883 - RNA, 12 nt, Staphylococcus aureus subsp. aureus N315
guaucauuuaaa

SEQ ID NO: 2128884 - RNA, 15 nt, Staphylococcus aureus subsp. aureus N315
guaucauuuaaaaua

SEQ ID NO: 2128885 - RNA, 14 nt, Staphylococcus aureus subsp. aureus N315
guaucauuucagaa

SEQ ID NO: 2128886 - RNA, 16 nt, Staphylococcus aureus subsp. aureus N315
guaucaacauuaauaa

SEQ ID NO: 2128887 - RNA, 17 nt, Staphylococcus aureus subsp. aureus N315
guaucaacauuaauaaa

SEQ ID NO: 2128888 - RNA, 17 nt, Staphylococcus aureus subsp. aureus N315
guaggaagaccacuauu

SEQ ID NO: 2128889 - RNA, 20 nt, Staphylococcus aureus subsp. aureus N315
guauacuaaacuuuuuucaa

SEQ ID NO: 2128890 - RNA, 16 nt, Staphylococcus aureus subsp. aureus N315
guaggauaauuucaau

SEQ ID NO: 2128891 - RNA, 18 nt, Staphylococcus aureus subsp. aureus N315
guagauuuauuaaauaua

SEQ ID NO: 2128892 - RNA, 18 nt, Staphylococcus aureus subsp. aureus N315
guagauuacuuugcuaaa

SEQ ID NO: 2128893 - RNA, 18 nt, Staphylococcus aureus subsp. aureus N315
guagauucaaauugguuu

SEQ ID NO: 2128894 - RNA, 15 nt, Staphylococcus aureus subsp. aureus N315
guagaaagaugugua

SEQ ID NO: 2128895 - RNA, 17 nt, Staphylococcus aureus subsp. aureus N315
guagaauuucuuuucga

SEQ ID NO: 2128896 - RNA, 21 nt, Staphylococcus aureus subsp. aureus N315
guaccacauacauaucuuuug

SEQ ID NO: 2128897 - RNA, 22 nt, Staphylococcus aureus subsp. aureus N315
guacgcaauuuaauauuauaag

SEQ ID NO: 2128898 - RNA, 23 nt, Staphylococcus aureus subsp. aureus N315
guagaaaauagcuguuugauauu

SEQ ID NO: 2128899 - RNA, 17 nt, Staphylococcus aureus subsp. aureus N315
guacacgaauucauuaa

SEQ ID NO: 2128900 - RNA, 15 nt, Staphylococcus aureus subsp. aureus N315
guacaccuacaaaua

SEQ ID NO: 2128901 - RNA, 17 nt, Staphylococcus aureus subsp. aureus N315
guacacuuuugauuguu

SEQ ID NO: 2128902 - RNA, 17 nt, Staphylococcus aureus subsp. aureus N315
guacauaaaugcuaaaa

SEQ ID NO: 2128903 - RNA, 18 nt, Staphylococcus aureus subsp. aureus N315
guacauaaauagugaaau

SEQ ID NO: 2128904 - RNA, 23 nt, Staphylococcus aureus subsp. aureus N315
guaauuuuuaaaucuacaauauu

SEQ ID NO: 2128905 - RNA, 12 nt, Staphylococcus aureus subsp. aureus N315
guaauuuuaaug

SEQ ID NO: 2128906 - RNA, 17 nt, Staphylococcus aureus subsp. aureus N315
guaauuuaauugguucu

SEQ ID NO: 2128907 - RNA, 13 nt, Staphylococcus aureus subsp. aureus N315
guaauuuaaaaua

SEQ ID NO: 2128908 - RNA, 12 nt, Staphylococcus aureus subsp. aureus N315
guacaaauaaua

SEQ ID NO: 2128909 - RNA, 21 nt, Staphylococcus aureus subsp. aureus N315
guacaauaauaccuucaauug

SEQ ID NO: 2128910 - RNA, 19 nt, Staphylococcus aureus subsp. aureus N315
guacaauuuuuaaaaaccu

SEQ ID NO: 2128911 - RNA, 23 nt, Staphylococcus aureus subsp. aureus N315
guaaucauuauagcagguggcau

SEQ ID NO: 2128912 - RNA, 12 nt, Staphylococcus aureus subsp. aureus N315
guaaucuuuuaa

SEQ ID NO: 2128913 - RNA, 13 nt, Staphylococcus aureus subsp. aureus N315
guaauuaauacau

SEQ ID NO: 2128914 - RNA, 13 nt, Staphylococcus aureus subsp. aureus N315
guaauuaaauacu

SEQ ID NO: 2128915 - RNA, 13 nt, Staphylococcus aureus subsp. aureus N315
guaauuauuuuuc

SEQ ID NO: 2128916 - RNA, 21 nt, Staphylococcus aureus subsp. aureus N315
guaauucaccaucauauucaa

SEQ ID NO: 2128917 - RNA, 15 nt, Staphylococcus aureus subsp. aureus N315
guaauuguaaucuau

SEQ ID NO: 2128918 - RNA, 17 nt, Staphylococcus aureus subsp. aureus N315
guaauuguaaucuauuu

SEQ ID NO: 2128919 - RNA, 16 nt, Staphylococcus aureus subsp. aureus N315
guaauuuaaaauaguu

SEQ ID NO: 2128920 - RNA, 22 nt, Staphylococcus aureus subsp. aureus N315
guaauuguuauaaguaaauaau

SEQ ID NO: 2128921 - RNA, 16 nt, Staphylococcus aureus subsp. aureus N315
guaauaaguaauaauu

SEQ ID NO: 2128922 - RNA, 15 nt, Staphylococcus aureus subsp. aureus N315
guaaaacugcaauaa

SEQ ID NO: 2128923 - RNA, 16 nt, Staphylococcus aureus subsp. aureus N315
guaauaauuuuguuca

SEQ ID NO: 2128924 - RNA, 19 nt, Staphylococcus aureus subsp. aureus N315
guaauaauucagaugaaua

SEQ ID NO: 2128925 - RNA, 15 nt, Staphylococcus aureus subsp. aureus N315
guaauaauaucaccu

SEQ ID NO: 2128926 - RNA, 18 nt, Staphylococcus aureus subsp. aureus N315
guaaucauagcaacaucg

SEQ ID NO: 2128927 - RNA, 21 nt, Staphylococcus aureus subsp. aureus N315
guaauacuauaugaaaagaga

SEQ ID NO: 2128928 - RNA, 19 nt, Staphylococcus aureus subsp. aureus N315
guaauacuauaugaaaaga

SEQ ID NO: 2128929 - RNA, 21 nt, Staphylococcus aureus subsp. aureus N315
guaauagaacgaaauaguuca

SEQ ID NO: 2128930 - RNA, 21 nt, Staphylococcus aureus subsp. aureus N315
guaaucagguuuaaacaguuu

SEQ ID NO: 2128931 - RNA, 15 nt, Staphylococcus aureus subsp. aureus N315
guaaucaauccucua

SEQ ID NO: 2128932 - RNA, 16 nt, Staphylococcus aureus subsp. aureus N315
guggcauuuuaucaug

SEQ ID NO: 2128933 - RNA, 14 nt, Staphylococcus aureus subsp. aureus N315
gugcuuuaaaguug

SEQ ID NO: 2128934 - RNA, 20 nt, Staphylococcus aureus subsp. aureus N315
guggaaaucucggcauuuuu

SEQ ID NO: 2128935 - RNA, 21 nt, Staphylococcus aureus subsp. aureus N315
gugcuuuuccauaaauauuua

SEQ ID NO: 2128936 - RNA, 17 nt, Staphylococcus aureus subsp. aureus N315
guggagaaccuuuaaaa

SEQ ID NO: 2128937 - RNA, 23 nt, Staphylococcus aureus subsp. aureus N315
guuaauccgauuuugauauaaaa

SEQ ID NO: 2128938 - RNA, 14 nt, Staphylococcus aureus subsp. aureus N315
guuaauguaaaguu

SEQ ID NO: 2128939 - RNA, 17 nt, Staphylococcus aureus subsp. aureus N315
guuaaugucuuaaaauu

SEQ ID NO: 2128940 - RNA, 21 nt, Staphylococcus aureus subsp. aureus N315
guuaacauuugucauaauaga

SEQ ID NO: 2128941 - RNA, 13 nt, Staphylococcus aureus subsp. aureus N315
guuaaccauacau

SEQ ID NO: 2128942 - RNA, 18 nt, Staphylococcus aureus subsp. aureus N315
guuaaccauacauaugcu

SEQ ID NO: 2128943 - RNA, 22 nt, Staphylococcus aureus subsp. aureus N315
guuaacaauauucguaaauccu

SEQ ID NO: 2128944 - RNA, 17 nt, Staphylococcus aureus subsp. aureus N315
guuaaaauaaccauuuu

SEQ ID NO: 2128945 - RNA, 16 nt, Staphylococcus aureus subsp. aureus N315
guuaaaaccuuuucaa

SEQ ID NO: 2128946 - RNA, 17 nt, Staphylococcus aureus subsp. aureus N315
guuaaaauaaugucuua

SEQ ID NO: 2128947 - RNA, 19 nt, Staphylococcus aureus subsp. aureus N315
guuaaauauggaugauauu

SEQ ID NO: 2128948 - RNA, 22 nt, Staphylococcus aureus subsp. aureus N315
guuaaauauggaugauauucaa

SEQ ID NO: 2128949 - RNA, 23 nt, Staphylococcus aureus subsp. aureus N315
guuaaaacacccugcuuaucauu

SEQ ID NO: 2128950 - RNA, 15 nt, Staphylococcus aureus subsp. aureus N315
guguuaugaauuaga

SEQ ID NO: 2128951 - RNA, 24 nt, Staphylococcus aureus subsp. aureus N315
guguucaaauaacgcaaugucuug

SEQ ID NO: 2128952 - RNA, 17 nt, Staphylococcus aureus subsp. aureus N315
guguuauauuguauuuu

SEQ ID NO: 2128953 - RNA, 18 nt, Staphylococcus aureus subsp. aureus N315
guguucgggaauuuuuua

SEQ ID NO: 2128954 - RNA, 15 nt, Staphylococcus aureus subsp. aureus N315
guguuuuuauuuuua

SEQ ID NO: 2128955 - RNA, 17 nt, Staphylococcus aureus subsp. aureus N315
guguauucauuuuaaau

SEQ ID NO: 2128956 - RNA, 14 nt, Staphylococcus aureus subsp. aureus N315
gugucaugcugaau

SEQ ID NO: 2128957 - RNA, 14 nt, Staphylococcus aureus subsp. aureus N315
guguaugauagaau

SEQ ID NO: 2128958 - RNA, 22 nt, Staphylococcus aureus subsp. aureus N315
guguaugauagaauacuaaaag

SEQ ID NO: 2128959 - RNA, 22 nt, Staphylococcus aureus subsp. aureus N315
guguauauuauuuugcuuuaau

SEQ ID NO: 2128960 - RNA, 18 nt, Staphylococcus aureus subsp. aureus N315
guguggauuuaauuuuua

SEQ ID NO: 2128961 - RNA, 17 nt, Staphylococcus aureus subsp. aureus N315
guucucguguaaaaugc

SEQ ID NO: 2128962 - RNA, 14 nt, Staphylococcus aureus subsp. aureus N315
guucuccgaucaug

SEQ ID NO: 2128963 - RNA, 15 nt, Staphylococcus aureus subsp. aureus N315
guucucccuuuuauc

SEQ ID NO: 2128964 - RNA, 16 nt, Staphylococcus aureus subsp. aureus N315
guucucccuuuuaucu

SEQ ID NO: 2128965 - RNA, 15 nt, Staphylococcus aureus subsp. aureus N315
guucuauauaauuua

SEQ ID NO: 2128966 - RNA, 22 nt, Staphylococcus aureus subsp. aureus N315
guucucauuauaaugauuuuua

SEQ ID NO: 2128967 - RNA, 13 nt, Staphylococcus aureus subsp. aureus N315
guucuauaauaaa

SEQ ID NO: 2128968 - RNA, 19 nt, Staphylococcus aureus subsp. aureus N315
guucuaguuuuuuuuauau

SEQ ID NO: 2128969 - RNA, 15 nt, Staphylococcus aureus subsp. aureus N315
guucgggaauuuuuu

SEQ ID NO: 2128970 - RNA, 22 nt, Staphylococcus aureus subsp. aureus N315
guuaggggcuuuuaugcaugcg

SEQ ID NO: 2128971 - RNA, 19 nt, Staphylococcus aureus subsp. aureus N315
guuaggcgacuuaacuuaa

SEQ ID NO: 2128972 - RNA, 19 nt, Staphylococcus aureus subsp. aureus N315
guuaccaaaauuugaaaua

SEQ ID NO: 2128973 - RNA, 16 nt, Staphylococcus aureus subsp. aureus N315
guuacauauugcauuu

SEQ ID NO: 2128974 - RNA, 20 nt, Staphylococcus aureus subsp. aureus N315
guuaccaucuuuaauacgaa

SEQ ID NO: 2128975 - RNA, 16 nt, Staphylococcus aureus subsp. aureus N315
guuauaaguacaaaua

SEQ ID NO: 2128976 - RNA, 15 nt, Staphylococcus aureus subsp. aureus N315
guuauauaaauaggc

SEQ ID NO: 2128977 - RNA, 16 nt, Staphylococcus aureus subsp. aureus N315
guuauaaauucuaucu

SEQ ID NO: 2128978 - RNA, 22 nt, Staphylococcus aureus subsp. aureus N315
guuauaaaggaagacauacuca

SEQ ID NO: 2128979 - RNA, 22 nt, Staphylococcus aureus subsp. aureus N315
guuauauuguauuuuauuuauu

SEQ ID NO: 2128980 - RNA, 12 nt, Staphylococcus aureus subsp. aureus N315
guuauauuaaac

SEQ ID NO: 2128981 - RNA, 17 nt, Staphylococcus aureus subsp. aureus N315
guuaugugcuaaucuau

SEQ ID NO: 2128982 - RNA, 21 nt, Staphylococcus aureus subsp. aureus N315
guuauuaaaucuuuuacuaaa

SEQ ID NO: 2128983 - RNA, 16 nt, Staphylococcus aureus subsp. aureus N315
guuauuauaaaauaaa

SEQ ID NO: 2128984 - RNA, 17 nt, Staphylococcus aureus subsp. aureus N315
guuauuguuccaaucuu

SEQ ID NO: 2128985 - RNA, 17 nt, Staphylococcus aureus subsp. aureus N315
guuaugguguguuggug

SEQ ID NO: 2128986 - RNA, 18 nt, Staphylococcus aureus subsp. aureus N315
guuauguaaauaacaguu

SEQ ID NO: 2128987 - RNA, 14 nt, Staphylococcus aureus subsp. aureus N315
guuaugguguguug

SEQ ID NO: 2128988 - RNA, 22 nt, Staphylococcus aureus subsp. aureus N315
guuaucuugcuuauugauauaa

SEQ ID NO: 2128989 - RNA, 14 nt, Staphylococcus aureus subsp. aureus N315
guuaucuaaugauc

SEQ ID NO: 2128990 - RNA, 12 nt, Staphylococcus aureus subsp. aureus N315
guucaaguauau

SEQ ID NO: 2128991 - RNA, 18 nt, Staphylococcus aureus subsp. aureus N315
guucaagcuuuauuuuuu

SEQ ID NO: 2128992 - RNA, 16 nt, Staphylococcus aureus subsp. aureus N315
guucaauauuuaucaa

SEQ ID NO: 2128993 - RNA, 15 nt, Staphylococcus aureus subsp. aureus N315
guuauuuuugcuauu

SEQ ID NO: 2128994 - RNA, 22 nt, Staphylococcus aureus subsp. aureus N315
guuauuuuaauaacgauaagca

SEQ ID NO: 2128995 - RNA, 17 nt, Staphylococcus aureus subsp. aureus N315
guuauuuauaugauuaa

SEQ ID NO: 2128996 - RNA, 16 nt, Staphylococcus aureus subsp. aureus N315
gugauuuuuaauaauu

SEQ ID NO: 2128997 - RNA, 21 nt, Staphylococcus aureus subsp. aureus N315
gugauuucccacgugccucau

SEQ ID NO: 2128998 - RNA, 21 nt, Staphylococcus aureus subsp. aureus N315
gugaccaauagaauucauuaa

SEQ ID NO: 2128999 - RNA, 17 nt, Staphylococcus aureus subsp. aureus N315
gugaccucagguuguua

SEQ ID NO: 2129000 - RNA, 22 nt, Staphylococcus aureus subsp. aureus N315
gugacuuuuauaauucuaaguc

SEQ ID NO: 2129001 - RNA, 20 nt, Staphylococcus aureus subsp. aureus N315
gugaguuuccauauuuuuua

SEQ ID NO: 2129002 - RNA, 15 nt, Staphylococcus aureus subsp. aureus N315
gugauaauuaaaaua

SEQ ID NO: 2129003 - RNA, 19 nt, Staphylococcus aureus subsp. aureus N315
gugauauaugaaauauuua

SEQ ID NO: 2129004 - RNA, 19 nt, Staphylococcus aureus subsp. aureus N315
gugauaucuugcuuggaua

SEQ ID NO: 2129005 - RNA, 15 nt, Staphylococcus aureus subsp. aureus N315
gugagggccccaaca

SEQ ID NO: 2129006 - RNA, 18 nt, Staphylococcus aureus subsp. aureus N315
gugagggacgucaucaug

SEQ ID NO: 2129007 - RNA, 14 nt, Staphylococcus aureus subsp. aureus N315
gugagguaaaacua

SEQ ID NO: 2129008 - RNA, 14 nt, Staphylococcus aureus subsp. aureus N315
gugaggcaccaaug

SEQ ID NO: 2129009 - RNA, 13 nt, Staphylococcus aureus subsp. aureus N315
gugacaaacauuu

SEQ ID NO: 2129010 - RNA, 22 nt, Staphylococcus aureus subsp. aureus N315
gugaauguuuucuaaaucuaac

SEQ ID NO: 2129011 - RNA, 21 nt, Staphylococcus aureus subsp. aureus N315
gugaauucgaugacuuuuuaa

SEQ ID NO: 2129012 - RNA, 22 nt, Staphylococcus aureus subsp. aureus N315
gugaaauugcgugcguuuaaca

SEQ ID NO: 2129013 - RNA, 22 nt, Staphylococcus aureus subsp. aureus N315
gugaaauuagaaaaauaugauu

SEQ ID NO: 2129014 - RNA, 23 nt, Staphylococcus aureus subsp. aureus N315
gugaaaguacuuggaaaauacua

SEQ ID NO: 2129015 - RNA, 21 nt, Staphylococcus aureus subsp. aureus N315
gugaaaguauuagauauauuu

SEQ ID NO: 2129016 - RNA, 14 nt, Staphylococcus aureus subsp. aureus N315
gugaacuauuaaaa

SEQ ID NO: 2129017 - RNA, 14 nt, Staphylococcus aureus subsp. aureus N315
gucuugaguacuaa

SEQ ID NO: 2129018 - RNA, 22 nt, Staphylococcus aureus subsp. aureus N315
gucuugaguacuaaucaauacu

SEQ ID NO: 2129019 - RNA, 15 nt, Staphylococcus aureus subsp. aureus N315
gucuugaguacuaau

SEQ ID NO: 2129020 - RNA, 22 nt, Staphylococcus aureus subsp. aureus N315
gucuugauggugguaccacaua

SEQ ID NO: 2129021 - RNA, 19 nt, Staphylococcus aureus subsp. aureus N315
gucuuguaaacucaugaca

SEQ ID NO: 2129022 - RNA, 14 nt, Staphylococcus aureus subsp. aureus N315
gucuucucuaucag

SEQ ID NO: 2129023 - RNA, 13 nt, Staphylococcus aureus subsp. aureus N315
gucuuucuaaguu

SEQ ID NO: 2129024 - RNA, 21 nt, Staphylococcus aureus subsp. aureus N315
gucuuuaauugucucaucauu

SEQ ID NO: 2129025 - RNA, 12 nt, Staphylococcus aureus subsp. aureus N315
gucuuuuuauuu

SEQ ID NO: 2129026 - RNA, 12 nt, Staphylococcus aureus subsp. aureus N315
gugaaaaguguu

SEQ ID NO: 2129027 - RNA, 11 nt, Staphylococcus aureus subsp. aureus N315
gugaaaagugu

SEQ ID NO: 2129028 - RNA, 22 nt, Staphylococcus aureus subsp. aureus N315
gucuuaacaaauuaaaaaggua

SEQ ID NO: 2129029 - RNA, 15 nt, Staphylococcus aureus subsp. aureus N315
gucuggcacauuacu

SEQ ID NO: 2129030 - RNA, 19 nt, Staphylococcus aureus subsp. aureus N315
gucugaugucgaaaauagc

SEQ ID NO: 2129031 - RNA, 19 nt, Staphylococcus aureus subsp. aureus N315
uaaaucuguuuaaauuuaa

SEQ ID NO: 2129032 - RNA, 21 nt, Staphylococcus aureus subsp. aureus N315
uaaaucuguuuaaauuuaaaa

SEQ ID NO: 2129033 - RNA, 20 nt, Staphylococcus aureus subsp. aureus N315
uaaaucuguacuucuaauuu

SEQ ID NO: 2129034 - RNA, 13 nt, Staphylococcus aureus subsp. aureus N315
uaaaucuucauca

SEQ ID NO: 2129035 - RNA, 18 nt, Staphylococcus aureus subsp. aureus N315
uaaaucuccauuaaucau

SEQ ID NO: 2129036 - RNA, 19 nt, Staphylococcus aureus subsp. aureus N315
uaaaucuccauuaaucauu

SEQ ID NO: 2129037 - RNA, 14 nt, Staphylococcus aureus subsp. aureus N315
uaaaucaccaacaa

SEQ ID NO: 2129038 - RNA, 20 nt, Staphylococcus aureus subsp. aureus N315
uaaaucacgauuuucaagua

SEQ ID NO: 2129039 - RNA, 22 nt, Staphylococcus aureus subsp. aureus N315
uaaaucacugcuuucaaguaau

SEQ ID NO: 2129040 - RNA, 18 nt, Staphylococcus aureus subsp. aureus N315
uaaaucacugcuuucaag

SEQ ID NO: 2129041 - RNA, 14 nt, Staphylococcus aureus subsp. aureus N315
uaaaucaagaaaug

SEQ ID NO: 2129042 - RNA, 17 nt, Staphylococcus aureus subsp. aureus N315
uaaaucaagaaauguua

SEQ ID NO: 2129043 - RNA, 21 nt, Staphylococcus aureus subsp. aureus N315
uaaaucaaagaugacuuggcc

SEQ ID NO: 2129044 - RNA, 14 nt, Staphylococcus aureus subsp. aureus N315
uaaaucaaagcuau

SEQ ID NO: 2129045 - RNA, 15 nt, Staphylococcus aureus subsp. aureus N315
uaaauauuuuuaauu

SEQ ID NO: 2129046 - RNA, 16 nt, Staphylococcus aureus subsp. aureus N315
uaaauauuuuuaauua

SEQ ID NO: 2129047 - RNA, 16 nt, Staphylococcus aureus subsp. aureus N315
uaaauaucaugcaaaa

SEQ ID NO: 2129048 - RNA, 20 nt, Staphylococcus aureus subsp. aureus N315
uaaauaucuuaguauguuca

SEQ ID NO: 2129049 - RNA, 21 nt, Staphylococcus aureus subsp. aureus N315
uaaauaugacgcgugaauuaa

SEQ ID NO: 2129050 - RNA, 13 nt, Staphylococcus aureus subsp. aureus N315
uaaauaugaaucu

SEQ ID NO: 2129051 - RNA, 16 nt, Staphylococcus aureus subsp. aureus N315
uaaaugacuucacauu

SEQ ID NO: 2129052 - RNA, 18 nt, Staphylococcus aureus subsp. aureus N315
uaaaugaccuuuacgcca

SEQ ID NO: 2129053 - RNA, 15 nt, Staphylococcus aureus subsp. aureus N315
uaaaugacauuuaau

SEQ ID NO: 2129054 - RNA, 21 nt, Staphylococcus aureus subsp. aureus N315
uaaaugaaaguaccuaaaaua

SEQ ID NO: 2129055 - RNA, 20 nt, Staphylococcus aureus subsp. aureus N315
uaaaucuuuuacuaaaugaa

SEQ ID NO: 2129056 - RNA, 16 nt, Staphylococcus aureus subsp. aureus N315
uaaaugaauuauuuaa

SEQ ID NO: 2129057 - RNA, 22 nt, Staphylococcus aureus subsp. aureus N315
uaaaugaaaguaccuaaaauag

SEQ ID NO: 2129058 - RNA, 18 nt, Staphylococcus aureus subsp. aureus N315
uaaauggugucgauacuc

SEQ ID NO: 2129059 - RNA, 18 nt, Staphylococcus aureus subsp. aureus N315
uaaauguuuuauguauuu

SEQ ID NO: 2129060 - RNA, 22 nt, Staphylococcus aureus subsp. aureus N315
uaaauguuuuauguauuuauuu

SEQ ID NO: 2129061 - RNA, 15 nt, Staphylococcus aureus subsp. aureus N315
uaaaugcuaaaagua

SEQ ID NO: 2129062 - RNA, 22 nt, Staphylococcus aureus subsp. aureus N315
uaaaugcuuaauuuguuuuaaa

SEQ ID NO: 2129063 - RNA, 23 nt, Staphylococcus aureus subsp. aureus N315
uaaauaauguugucacuuggauu

SEQ ID NO: 2129064 - RNA, 19 nt, Staphylococcus aureus subsp. aureus N315
uaaauaaucgaagauagag

SEQ ID NO: 2129065 - RNA, 14 nt, Staphylococcus aureus subsp. aureus N315
uaaauaauuucuca

SEQ ID NO: 2129066 - RNA, 17 nt, Staphylococcus aureus subsp. aureus N315
uaaauacaaaaauauag

SEQ ID NO: 2129067 - RNA, 20 nt, Staphylococcus aureus subsp. aureus N315
uaaauacaaagccuuaauau

SEQ ID NO: 2129068 - RNA, 19 nt, Staphylococcus aureus subsp. aureus N315
uaaauacaauuucuucauu

SEQ ID NO: 2129069 - RNA, 17 nt, Staphylococcus aureus subsp. aureus N315
uaaauacaauuucuuca

SEQ ID NO: 2129070 - RNA, 16 nt, Staphylococcus aureus subsp. aureus N315
uaaauacaauguuauu

SEQ ID NO: 2129071 - RNA, 11 nt, Staphylococcus aureus subsp. aureus N315
uaaauacaaua

SEQ ID NO: 2129072 - RNA, 15 nt, Staphylococcus aureus subsp. aureus N315
uaaauagcaaagucu

SEQ ID NO: 2129073 - RNA, 17 nt, Staphylococcus aureus subsp. aureus N315
uaaauauaguaauaaaa

SEQ ID NO: 2129074 - RNA, 15 nt, Staphylococcus aureus subsp. aureus N315
uaaauauaguaauaa

SEQ ID NO: 2129075 - RNA, 21 nt, Staphylococcus aureus subsp. aureus N315
uaaauaucauaccguacaaag

SEQ ID NO: 2129076 - RNA, 16 nt, Staphylococcus aureus subsp. aureus N315
uaaauaucauaaaugc

SEQ ID NO: 2129077 - RNA, 19 nt, Staphylococcus aureus subsp. aureus N315
uaaauagcuucuuaaauca

SEQ ID NO: 2129078 - RNA, 18 nt, Staphylococcus aureus subsp. aureus N315
uaaauagcuucuuaaauc

SEQ ID NO: 2129079 - RNA, 11 nt, Staphylococcus aureus subsp. aureus N315
uaaauaaacaa

SEQ ID NO: 2129080 - RNA, 14 nt, Staphylococcus aureus subsp. aureus N315
uaaauaaaauuguu

SEQ ID NO: 2129081 - RNA, 14 nt, Staphylococcus aureus subsp. aureus N315
uaaauaaaaugcau

SEQ ID NO: 2129082 - RNA, 15 nt, Staphylococcus aureus subsp. aureus N315
uaaauaaacaacugc

SEQ ID NO: 2129083 - RNA, 16 nt, Staphylococcus aureus subsp. aureus N315
uaaauaaacucaccaa

SEQ ID NO: 2129084 - RNA, 23 nt, Staphylococcus aureus subsp. aureus N315
uaaauaaacucaccaaguucacu

SEQ ID NO: 2129085 - RNA, 19 nt, Staphylococcus aureus subsp. aureus N315
uaaauaaaaauacauaauu

SEQ ID NO: 2129086 - RNA, 21 nt, Staphylococcus aureus subsp. aureus N315
uaaaguuuugaaccuaaauuc

SEQ ID NO: 2129087 - RNA, 14 nt, Staphylococcus aureus subsp. aureus N315
uaaauaaaaauuau

SEQ ID NO: 2129088 - RNA, 15 nt, Staphylococcus aureus subsp. aureus N315
uaaauaaaacuaucu

SEQ ID NO: 2129089 - RNA, 23 nt, Staphylococcus aureus subsp. aureus N315
uaaauaaaaguuaccuacuacau

SEQ ID NO: 2129090 - RNA, 15 nt, Staphylococcus aureus subsp. aureus N315
uaaauaaaaguucaa

SEQ ID NO: 2129091 - RNA, 15 nt, Staphylococcus aureus subsp. aureus N315
uaaaguaaauaacac

SEQ ID NO: 2129092 - RNA, 23 nt, Staphylococcus aureus subsp. aureus N315
uaaaguugacaauacaaaucgau

SEQ ID NO: 2129093 - RNA, 15 nt, Staphylococcus aureus subsp. aureus N315
uaaaguuuauuuaug

SEQ ID NO: 2129094 - RNA, 23 nt, Staphylococcus aureus subsp. aureus N315
uaaaguuuauuuauguucgauua

SEQ ID NO: 2129095 - RNA, 19 nt, Staphylococcus aureus subsp. aureus N315
uaaagaaugauuuauaaaa

SEQ ID NO: 2129096 - RNA, 21 nt, Staphylococcus aureus subsp. aureus N315
uaaagaaugauuuauaaaaaa

SEQ ID NO: 2129097 - RNA, 16 nt, Staphylococcus aureus subsp. aureus N315
uaaacuucuauuaaua

SEQ ID NO: 2129098 - RNA, 18 nt, Staphylococcus aureus subsp. aureus N315
uaaacuuuggcaaaguca

SEQ ID NO: 2129099 - RNA, 23 nt, Staphylococcus aureus subsp. aureus N315
uaaagaaguauguuuuauacauu

SEQ ID NO: 2129100 - RNA, 15 nt, Staphylococcus aureus subsp. aureus N315
uaaagcgauaauaga

SEQ ID NO: 2129101 - RNA, 19 nt, Staphylococcus aureus subsp. aureus N315
uaaaggguguuuagauagc

SEQ ID NO: 2129102 - RNA, 21 nt, Staphylococcus aureus subsp. aureus N315
uaaagcguucucuaauuucac

SEQ ID NO: 2129103 - RNA, 20 nt, Staphylococcus aureus subsp. aureus N315
uaaagagcaauuaaagucaa

SEQ ID NO: 2129104 - RNA, 19 nt, Staphylococcus aureus subsp. aureus N315
uaaagccaccuaaaucucc

SEQ ID NO: 2129105 - RNA, 18 nt, Staphylococcus aureus subsp. aureus N315
uaaaccaacuuucucaag

SEQ ID NO: 2129106 - RNA, 15 nt, Staphylococcus aureus subsp. aureus N315
uaaaccaaugauugu

SEQ ID NO: 2129107 - RNA, 17 nt, Staphylococcus aureus subsp. aureus N315
uaaaccggcacuuauuu

SEQ ID NO: 2129108 - RNA, 18 nt, Staphylococcus aureus subsp. aureus N315
uaaaccagcuaaaccauc

SEQ ID NO: 2129109 - RNA, 16 nt, Staphylococcus aureus subsp. aureus N315
uaaaccuaaugcuuua

SEQ ID NO: 2129110 - RNA, 20 nt, Staphylococcus aureus subsp. aureus N315
uaaaccguauagucauuaca

SEQ ID NO: 2129111 - RNA, 12 nt, Staphylococcus aureus subsp. aureus N315
uaaaaugaaaua

SEQ ID NO: 2129112 - RNA, 16 nt, Staphylococcus aureus subsp. aureus N315
uaaaaugaaugaagac

SEQ ID NO: 2129113 - RNA, 20 nt, Staphylococcus aureus subsp. aureus N315
uaaaauccaagugcuaagag

SEQ ID NO: 2129114 - RNA, 19 nt, Staphylococcus aureus subsp. aureus N315
uaaacauuuuugaauuuaa

SEQ ID NO: 2129115 - RNA, 13 nt, Staphylococcus aureus subsp. aureus N315
uaaacauuuagau

SEQ ID NO: 2129116 - RNA, 14 nt, Staphylococcus aureus subsp. aureus N315
uaaacauuuagauu

SEQ ID NO: 2129117 - RNA, 20 nt, Staphylococcus aureus subsp. aureus N315
uaaaaugauagcuaaacauu

SEQ ID NO: 2129118 - RNA, 15 nt, Staphylococcus aureus subsp. aureus N315
uaaaaugauaucuau

SEQ ID NO: 2129119 - RNA, 20 nt, Staphylococcus aureus subsp. aureus N315
uaaaaugauaucugacauuu

SEQ ID NO: 2129120 - RNA, 14 nt, Staphylococcus aureus subsp. aureus N315
uaaacauugcuuaa

SEQ ID NO: 2129121 - RNA, 17 nt, Staphylococcus aureus subsp. aureus N315
uaaaccuuuuuuaaguu

SEQ ID NO: 2129122 - RNA, 16 nt, Staphylococcus aureus subsp. aureus N315
uaaacgaucacuuggc

SEQ ID NO: 2129123 - RNA, 22 nt, Staphylococcus aureus subsp. aureus N315
uaaaccuacuaauauauuaauu

SEQ ID NO: 2129124 - RNA, 14 nt, Staphylococcus aureus subsp. aureus N315
uaaaccucaacauu

SEQ ID NO: 2129125 - RNA, 19 nt, Staphylococcus aureus subsp. aureus N315
uaaaccucaacauuaaaau

SEQ ID NO: 2129126 - RNA, 11 nt, Staphylococcus aureus subsp. aureus N315
uaaaccuguua

SEQ ID NO: 2129127 - RNA, 18 nt, Staphylococcus aureus subsp. aureus N315
uaaaccucuaaauaaaau

SEQ ID NO: 2129128 - RNA, 22 nt, Staphylococcus aureus subsp. aureus N315
uaaaccucuaaauaaaauuaaa

SEQ ID NO: 2129129 - RNA, 14 nt, Staphylococcus aureus subsp. aureus N315
uaaacuaauccuca

SEQ ID NO: 2129130 - RNA, 17 nt, Staphylococcus aureus subsp. aureus N315
uaaacguacauuuuuau

SEQ ID NO: 2129131 - RNA, 21 nt, Staphylococcus aureus subsp. aureus N315
uaaacgcaauacgaauaucug

SEQ ID NO: 2129132 - RNA, 23 nt, Staphylococcus aureus subsp. aureus N315
uaaauuuugcgaaaauaucauuu

SEQ ID NO: 2129133 - RNA, 13 nt, Staphylococcus aureus subsp. aureus N315
uaacaaaaucuca

SEQ ID NO: 2129134 - RNA, 21 nt, Staphylococcus aureus subsp. aureus N315
uaacaaaauuaagaagaaaua

SEQ ID NO: 2129135 - RNA, 20 nt, Staphylococcus aureus subsp. aureus N315
uaacaaaauuaagaagaaau

SEQ ID NO: 2129136 - RNA, 16 nt, Staphylococcus aureus subsp. aureus N315
uaacaaaauuaagaag

SEQ ID NO: 2129137 - RNA, 12 nt, Staphylococcus aureus subsp. aureus N315
uaaauuuucauc

SEQ ID NO: 2129138 - RNA, 14 nt, Staphylococcus aureus subsp. aureus N315
uaaauuuucaucau

SEQ ID NO: 2129139 - RNA, 20 nt, Staphylococcus aureus subsp. aureus N315
uaaauuuucuguuuaauuaa

SEQ ID NO: 2129140 - RNA, 21 nt, Staphylococcus aureus subsp. aureus N315
uaaauuuucuguuuaauuaaa

SEQ ID NO: 2129141 - RNA, 20 nt, Staphylococcus aureus subsp. aureus N315
uaaauuuuaucuaaacauuu

SEQ ID NO: 2129142 - RNA, 16 nt, Staphylococcus aureus subsp. aureus N315
uaaauuuauuuuuaau

SEQ ID NO: 2129143 - RNA, 17 nt, Staphylococcus aureus subsp. aureus N315
uaaauuuauuuuuaauu

SEQ ID NO: 2129144 - RNA, 14 nt, Staphylococcus aureus subsp. aureus N315
uaaauuuaguaucu

SEQ ID NO: 2129145 - RNA, 17 nt, Staphylococcus aureus subsp. aureus N315
uaaauuucugaacauaa

SEQ ID NO: 2129146 - RNA, 22 nt, Staphylococcus aureus subsp. aureus N315
uaaauuucgauuaauugaaugc

SEQ ID NO: 2129147 - RNA, 22 nt, Staphylococcus aureus subsp. aureus N315
uaaauuucuucauaguucaaau

SEQ ID NO: 2129148 - RNA, 17 nt, Staphylococcus aureus subsp. aureus N315
uaaauuugaaaguaaau

SEQ ID NO: 2129149 - RNA, 15 nt, Staphylococcus aureus subsp. aureus N315
uaacaauuuuaucug

SEQ ID NO: 2129150 - RNA, 16 nt, Staphylococcus aureus subsp. aureus N315
uaacaauuuauuaaaa

SEQ ID NO: 2129151 - RNA, 17 nt, Staphylococcus aureus subsp. aureus N315
uaacaauuuauuaaaac

SEQ ID NO: 2129152 - RNA, 22 nt, Staphylococcus aureus subsp. aureus N315
uaacaauuuauuaaaacgaagu

SEQ ID NO: 2129153 - RNA, 13 nt, Staphylococcus aureus subsp. aureus N315
uaacaauuuuaaa

SEQ ID NO: 2129154 - RNA, 19 nt, Staphylococcus aureus subsp. aureus N315
uaacaccaauuaaaucgau

SEQ ID NO: 2129155 - RNA, 18 nt, Staphylococcus aureus subsp. aureus N315
uaacacauucaaauaaau

SEQ ID NO: 2129156 - RNA, 13 nt, Staphylococcus aureus subsp. aureus N315
uaacaaugcgauu

SEQ ID NO: 2129157 - RNA, 15 nt, Staphylococcus aureus subsp. aureus N315
uaacaauuuauuaaa

SEQ ID NO: 2129158 - RNA, 13 nt, Staphylococcus aureus subsp. aureus N315
uaacaaacauuaa

SEQ ID NO: 2129159 - RNA, 19 nt, Staphylococcus aureus subsp. aureus N315
uaaauucccauguauucuu

SEQ ID NO: 2129160 - RNA, 22 nt, Staphylococcus aureus subsp. aureus N315
uaaauucccauguauucuuaga

SEQ ID NO: 2129161 - RNA, 13 nt, Staphylococcus aureus subsp. aureus N315
uaaauucaucuua

SEQ ID NO: 2129162 - RNA, 22 nt, Staphylococcus aureus subsp. aureus N315
uaaauuccaagagaauuaauaa

SEQ ID NO: 2129163 - RNA, 16 nt, Staphylococcus aureus subsp. aureus N315
uaaauucaauaaucuu

SEQ ID NO: 2129164 - RNA, 21 nt, Staphylococcus aureus subsp. aureus N315
uaaauuacuugcacaccagug

SEQ ID NO: 2129165 - RNA, 15 nt, Staphylococcus aureus subsp. aureus N315
uaaauuauaaauagu

SEQ ID NO: 2129166 - RNA, 14 nt, Staphylococcus aureus subsp. aureus N315
uaaauuauauguuu

SEQ ID NO: 2129167 - RNA, 13 nt, Staphylococcus aureus subsp. aureus N315
uaaauuaauauga

SEQ ID NO: 2129168 - RNA, 14 nt, Staphylococcus aureus subsp. aureus N315
uaaauuaaaucgau

SEQ ID NO: 2129169 - RNA, 13 nt, Staphylococcus aureus subsp. aureus N315
uaaauuaaaugca

SEQ ID NO: 2129170 - RNA, 20 nt, Staphylococcus aureus subsp. aureus N315
uaaauucuuuucaagaaauu

SEQ ID NO: 2129171 - RNA, 13 nt, Staphylococcus aureus subsp. aureus N315
uaaauugagaagu

SEQ ID NO: 2129172 - RNA, 21 nt, Staphylococcus aureus subsp. aureus N315
uaaauugagcaacucaggaau

SEQ ID NO: 2129173 - RNA, 20 nt, Staphylococcus aureus subsp. aureus N315
uaaauugcuugaaauuauua

SEQ ID NO: 2129174 - RNA, 18 nt, Staphylococcus aureus subsp. aureus N315
uaaauugcuugaaauuau

SEQ ID NO: 2129175 - RNA, 19 nt, Staphylococcus aureus subsp. aureus N315
uaaauuguuuacuauacuu

SEQ ID NO: 2129176 - RNA, 15 nt, Staphylococcus aureus subsp. aureus N315
uaaauuguguuucuu

SEQ ID NO: 2129177 - RNA, 20 nt, Staphylococcus aureus subsp. aureus N315
uaaauuguguuucuuucaua

SEQ ID NO: 2129178 - RNA, 16 nt, Staphylococcus aureus subsp. aureus N315
uaaauuuaaaauaaua

SEQ ID NO: 2129179 - RNA, 17 nt, Staphylococcus aureus subsp. aureus N315
uaaauuuaaaauaauag

SEQ ID NO: 2129180 - RNA, 13 nt, Staphylococcus aureus subsp. aureus N315
uaaauuuaaaugu

SEQ ID NO: 2129181 - RNA, 14 nt, Staphylococcus aureus subsp. aureus N315
uaaccgaaauauug

SEQ ID NO: 2129182 - RNA, 15 nt, Staphylococcus aureus subsp. aureus N315
uaaccgaaauauugu

SEQ ID NO: 2129183 - RNA, 14 nt, Staphylococcus aureus subsp. aureus N315
uaaccgaugugauu

SEQ ID NO: 2129184 - RNA, 19 nt, Staphylococcus aureus subsp. aureus N315
uaaccgcuucuuuuaaguu

SEQ ID NO: 2129185 - RNA, 18 nt, Staphylococcus aureus subsp. aureus N315
uaaccuaaguuaauuuau

SEQ ID NO: 2129186 - RNA, 22 nt, Staphylococcus aureus subsp. aureus N315
uaacgaaaaagaugguuuuguu

SEQ ID NO: 2129187 - RNA, 15 nt, Staphylococcus aureus subsp. aureus N315
uaaccuuuucaucag

SEQ ID NO: 2129188 - RNA, 20 nt, Staphylococcus aureus subsp. aureus N315
uaacgagugcuuucaccuuu

SEQ ID NO: 2129189 - RNA, 22 nt, Staphylococcus aureus subsp. aureus N315
uaacgauaagcacgauaaaaau

SEQ ID NO: 2129190 - RNA, 23 nt, Staphylococcus aureus subsp. aureus N315
uaacauguauuuaguaucaugau

SEQ ID NO: 2129191 - RNA, 21 nt, Staphylococcus aureus subsp. aureus N315
uaacauguauuuaguaucaug

SEQ ID NO: 2129192 - RNA, 21 nt, Staphylococcus aureus subsp. aureus N315
uaacaucuucauguaugaagu

SEQ ID NO: 2129193 - RNA, 19 nt, Staphylococcus aureus subsp. aureus N315
uaacaugaccuaauauauu

SEQ ID NO: 2129194 - RNA, 22 nt, Staphylococcus aureus subsp. aureus N315
uaacauuucugaugcuagcuuu

SEQ ID NO: 2129195 - RNA, 15 nt, Staphylococcus aureus subsp. aureus N315
uaacauuuaaaaaau

SEQ ID NO: 2129196 - RNA, 19 nt, Staphylococcus aureus subsp. aureus N315
uaacauuuauucuuucucu

SEQ ID NO: 2129197 - RNA, 16 nt, Staphylococcus aureus subsp. aureus N315
uaacauucuucaaaaa

SEQ ID NO: 2129198 - RNA, 13 nt, Staphylococcus aureus subsp. aureus N315
uaacauuagcaug

SEQ ID NO: 2129199 - RNA, 13 nt, Staphylococcus aureus subsp. aureus N315
uaacauuauuaaa

SEQ ID NO: 2129200 - RNA, 20 nt, Staphylococcus aureus subsp. aureus N315
uaacauuuguccgauuuauu

SEQ ID NO: 2129201 - RNA, 15 nt, Staphylococcus aureus subsp. aureus N315
uaacauuuucuuauu

SEQ ID NO: 2129202 - RNA, 16 nt, Staphylococcus aureus subsp. aureus N315
uaaccaucauaaaugu

SEQ ID NO: 2129203 - RNA, 12 nt, Staphylococcus aureus subsp. aureus N315
uaaccauaguaa

SEQ ID NO: 2129204 - RNA, 14 nt, Staphylococcus aureus subsp. aureus N315
uaaccauuaugauu

SEQ ID NO: 2129205 - RNA, 13 nt, Staphylococcus aureus subsp. aureus N315
uaaccauuaugau

SEQ ID NO: 2129206 - RNA, 21 nt, Staphylococcus aureus subsp. aureus N315
uaacccuaaagcuaaugcaag

SEQ ID NO: 2129207 - RNA, 18 nt, Staphylococcus aureus subsp. aureus N315
uaacccuaaaaugaauag

SEQ ID NO: 2129208 - RNA, 20 nt, Staphylococcus aureus subsp. aureus N315
uaacccuaaagcuaaugcaa

SEQ ID NO: 2129209 - RNA, 21 nt, Staphylococcus aureus subsp. aureus N315
guuuuuagguuauauuuaaau

SEQ ID NO: 2129210 - RNA, 19 nt, Staphylococcus aureus subsp. aureus N315
guuuuuacuguaaucaauc

SEQ ID NO: 2129211 - RNA, 14 nt, Staphylococcus aureus subsp. aureus N315
guuuuuaaauaauc

SEQ ID NO: 2129212 - RNA, 14 nt, Staphylococcus aureus subsp. aureus N315
guuuugaaccuaaa

SEQ ID NO: 2129213 - RNA, 20 nt, Staphylococcus aureus subsp. aureus N315
guuuugagagauuauuuaaa

SEQ ID NO: 2129214 - RNA, 19 nt, Staphylococcus aureus subsp. aureus N315
guuuugcaacauuuugagu

SEQ ID NO: 2129215 - RNA, 19 nt, Staphylococcus aureus subsp. aureus N315
guuuugauugcaaaaaaac

SEQ ID NO: 2129216 - RNA, 15 nt, Staphylococcus aureus subsp. aureus N315
guuuucuuaaaagag

SEQ ID NO: 2129217 - RNA, 15 nt, Staphylococcus aureus subsp. aureus N315
guuuugguucugaca

SEQ ID NO: 2129218 - RNA, 14 nt, Staphylococcus aureus subsp. aureus N315
guuuuguagauaua

SEQ ID NO: 2129219 - RNA, 14 nt, Staphylococcus aureus subsp. aureus N315
uaaaaaacaauagg

SEQ ID NO: 2129220 - RNA, 21 nt, Staphylococcus aureus subsp. aureus N315
uaaaaaacagcaguaagauau

SEQ ID NO: 2129221 - RNA, 15 nt, Staphylococcus aureus subsp. aureus N315
uaaaaaaauuaaaau

SEQ ID NO: 2129222 - RNA, 16 nt, Staphylococcus aureus subsp. aureus N315
uaaaaaaccugaaaca

SEQ ID NO: 2129223 - RNA, 17 nt, Staphylococcus aureus subsp. aureus N315
uaaaaaacgauaguagu

SEQ ID NO: 2129224 - RNA, 15 nt, Staphylococcus aureus subsp. aureus N315
uaaaaaaauuaacua

SEQ ID NO: 2129225 - RNA, 16 nt, Staphylococcus aureus subsp. aureus N315
uaaaaaacgguacaga

SEQ ID NO: 2129226 - RNA, 23 nt, Staphylococcus aureus subsp. aureus N315
uaaaaaauccggaacauuaaaag

SEQ ID NO: 2129227 - RNA, 20 nt, Staphylococcus aureus subsp. aureus N315
uaaaaaaucaguuuuuaaau

SEQ ID NO: 2129228 - RNA, 22 nt, Staphylococcus aureus subsp. aureus N315
uaaaaaaugcacugagcaacaa

SEQ ID NO: 2129229 - RNA, 18 nt, Staphylococcus aureus subsp. aureus N315
uaaaaaaugcgcuuccaa

SEQ ID NO: 2129230 - RNA, 13 nt, Staphylococcus aureus subsp. aureus N315
uaaaaaaguuauc

SEQ ID NO: 2129231 - RNA, 18 nt, Staphylococcus aureus subsp. aureus N315
uaaaaaaguugauuaaaa

SEQ ID NO: 2129232 - RNA, 20 nt, Staphylococcus aureus subsp. aureus N315
uaaaaaaaucccucaauccg

SEQ ID NO: 2129233 - RNA, 23 nt, Staphylococcus aureus subsp. aureus N315
uaaaaaaacgucuuuccauuuau

SEQ ID NO: 2129234 - RNA, 21 nt, Staphylococcus aureus subsp. aureus N315
guuuuuuagauuugaaauuua

SEQ ID NO: 2129235 - RNA, 22 nt, Staphylococcus aureus subsp. aureus N315
guuuuuuuagcuauagaaauga

SEQ ID NO: 2129236 - RNA, 12 nt, Staphylococcus aureus subsp. aureus N315
guuuuuuuaaau

SEQ ID NO: 2129237 - RNA, 18 nt, Staphylococcus aureus subsp. aureus N315
guuuuuugauuaguaaau

SEQ ID NO: 2129238 - RNA, 21 nt, Staphylococcus aureus subsp. aureus N315
guuuuuugauuaguaaauaua

SEQ ID NO: 2129239 - RNA, 14 nt, Staphylococcus aureus subsp. aureus N315
uaaaagcaaaggcg

SEQ ID NO: 2129240 - RNA, 21 nt, Staphylococcus aureus subsp. aureus N315
uaaaaggugugggcuuuauua

SEQ ID NO: 2129241 - RNA, 16 nt, Staphylococcus aureus subsp. aureus N315
uaaaaggggaaaucau

SEQ ID NO: 2129242 - RNA, 23 nt, Staphylococcus aureus subsp. aureus N315
uaaaagccucuaaugauuaaaaa

SEQ ID NO: 2129243 - RNA, 15 nt, Staphylococcus aureus subsp. aureus N315
uaaaaguuguauucu

SEQ ID NO: 2129244 - RNA, 12 nt, Staphylococcus aureus subsp. aureus N315
uaaaauaaaaaa

SEQ ID NO: 2129245 - RNA, 18 nt, Staphylococcus aureus subsp. aureus N315
uaaaaguuucccaagcau

SEQ ID NO: 2129246 - RNA, 22 nt, Staphylococcus aureus subsp. aureus N315
uaaaaguuguaauuuaaaauag

SEQ ID NO: 2129247 - RNA, 23 nt, Staphylococcus aureus subsp. aureus N315
uaaaaguuguaauuuaaaauagu

SEQ ID NO: 2129248 - RNA, 17 nt, Staphylococcus aureus subsp. aureus N315
uaaaaguuguaauuuaa

SEQ ID NO: 2129249 - RNA, 19 nt, Staphylococcus aureus subsp. aureus N315
uaaaaucauaugucuuaac

SEQ ID NO: 2129250 - RNA, 15 nt, Staphylococcus aureus subsp. aureus N315
uaaaaucaacaccaa

SEQ ID NO: 2129251 - RNA, 15 nt, Staphylococcus aureus subsp. aureus N315
uaaaauaguucuuua

SEQ ID NO: 2129252 - RNA, 21 nt, Staphylococcus aureus subsp. aureus N315
uaaaauacgguacagauagga

SEQ ID NO: 2129253 - RNA, 15 nt, Staphylococcus aureus subsp. aureus N315
uaaaauagaaaaauu

SEQ ID NO: 2129254 - RNA, 19 nt, Staphylococcus aureus subsp. aureus N315
uaaaauagaaaaauuucaa

SEQ ID NO: 2129255 - RNA, 17 nt, Staphylococcus aureus subsp. aureus N315
uaaaauagaguagacgu

SEQ ID NO: 2129256 - RNA, 15 nt, Staphylococcus aureus subsp. aureus N315
uaaaauagcugcaau

SEQ ID NO: 2129257 - RNA, 16 nt, Staphylococcus aureus subsp. aureus N315
uaaaauaaaaaaugca

SEQ ID NO: 2129258 - RNA, 18 nt, Staphylococcus aureus subsp. aureus N315
uaaaauaaaaaaugcacu

SEQ ID NO: 2129259 - RNA, 17 nt, Staphylococcus aureus subsp. aureus N315
uaaaauaaaaaaaugau

SEQ ID NO: 2129260 - RNA, 18 nt, Staphylococcus aureus subsp. aureus N315
uaaaauaaaccacgcaca

SEQ ID NO: 2129261 - RNA, 22 nt, Staphylococcus aureus subsp. aureus N315
uaaaauacauuucuauacuauu

SEQ ID NO: 2129262 - RNA, 13 nt, Staphylococcus aureus subsp. aureus N315
uaaaauaaaucau

SEQ ID NO: 2129263 - RNA, 12 nt, Staphylococcus aureus subsp. aureus N315
uaaaauaaaucu

SEQ ID NO: 2129264 - RNA, 19 nt, Staphylococcus aureus subsp. aureus N315
uaaaaaucauaaauaacac

SEQ ID NO: 2129265 - RNA, 19 nt, Staphylococcus aureus subsp. aureus N315
uaaaaauccacacauuaag

SEQ ID NO: 2129266 - RNA, 16 nt, Staphylococcus aureus subsp. aureus N315
uaaaaaucucaaaauu

SEQ ID NO: 2129267 - RNA, 15 nt, Staphylococcus aureus subsp. aureus N315
uaaaaaucucaaaau

SEQ ID NO: 2129268 - RNA, 19 nt, Staphylococcus aureus subsp. aureus N315
uaaaacaaugauuaaaauu

SEQ ID NO: 2129269 - RNA, 14 nt, Staphylococcus aureus subsp. aureus N315
uaaaacagcaaaua

SEQ ID NO: 2129270 - RNA, 18 nt, Staphylococcus aureus subsp. aureus N315
uaaaacagcaaauaaaau

SEQ ID NO: 2129271 - RNA, 21 nt, Staphylococcus aureus subsp. aureus N315
uaaaacagcaaauaaaaucau

SEQ ID NO: 2129272 - RNA, 13 nt, Staphylococcus aureus subsp. aureus N315
uaaaaauauauuu

SEQ ID NO: 2129273 - RNA, 18 nt, Staphylococcus aureus subsp. aureus N315
uaaaaaauuuaaauaaua

SEQ ID NO: 2129274 - RNA, 13 nt, Staphylococcus aureus subsp. aureus N315
uaaaaaauuuaau

SEQ ID NO: 2129275 - RNA, 14 nt, Staphylococcus aureus subsp. aureus N315
uaaaaaauuuaaug

SEQ ID NO: 2129276 - RNA, 19 nt, Staphylococcus aureus subsp. aureus N315
uaaaaacaauauugacuuu

SEQ ID NO: 2129277 - RNA, 21 nt, Staphylococcus aureus subsp. aureus N315
uaaaaaauuccuagcuuuuau

SEQ ID NO: 2129278 - RNA, 13 nt, Staphylococcus aureus subsp. aureus N315
uaaaaaauuuaaa

SEQ ID NO: 2129279 - RNA, 16 nt, Staphylococcus aureus subsp. aureus N315
uaaaaaauuauuaaaa

SEQ ID NO: 2129280 - RNA, 16 nt, Staphylococcus aureus subsp. aureus N315
uaaaacgauaagaauu

SEQ ID NO: 2129281 - RNA, 15 nt, Staphylococcus aureus subsp. aureus N315
uaaaacgauaauaau

SEQ ID NO: 2129282 - RNA, 16 nt, Staphylococcus aureus subsp. aureus N315
uaaaacgauaauaaua

SEQ ID NO: 2129283 - RNA, 13 nt, Staphylococcus aureus subsp. aureus N315
uaaaacuuacauu

SEQ ID NO: 2129284 - RNA, 20 nt, Staphylococcus aureus subsp. aureus N315
uaaaacuuauaacugauaau

SEQ ID NO: 2129285 - RNA, 13 nt, Staphylococcus aureus subsp. aureus N315
uaaaagaaaaauu

SEQ ID NO: 2129286 - RNA, 21 nt, Staphylococcus aureus subsp. aureus N315
uaaaacuuguuguuauuuauu

SEQ ID NO: 2129287 - RNA, 20 nt, Staphylococcus aureus subsp. aureus N315
uaaaacuuguuguuauuuau

SEQ ID NO: 2129288 - RNA, 19 nt, Staphylococcus aureus subsp. aureus N315
uaaaaccgguacuuucauu

SEQ ID NO: 2129289 - RNA, 21 nt, Staphylococcus aureus subsp. aureus N315
uaaaacauucccuuaauaaua

SEQ ID NO: 2129290 - RNA, 22 nt, Staphylococcus aureus subsp. aureus N315
uaaaacauucccuuaauaauaa

SEQ ID NO: 2129291 - RNA, 14 nt, Staphylococcus aureus subsp. aureus N315
uaaaacaucauuca

SEQ ID NO: 2129292 - RNA, 20 nt, Staphylococcus aureus subsp. aureus N315
uaaaacaguaaguaauaaaa

SEQ ID NO: 2129293 - RNA, 22 nt, Staphylococcus aureus subsp. aureus N315
uaaaacaguaaguaauaaaaua

SEQ ID NO: 2129294 - RNA, 18 nt, Staphylococcus aureus subsp. aureus N315
uaaaaccuuacccaaaaa

SEQ ID NO: 2129295 - RNA, 14 nt, Staphylococcus aureus subsp. aureus N315
uaaaaccuucaauc

SEQ ID NO: 2129296 - RNA, 20 nt, Staphylococcus aureus subsp. aureus N315
uaaaacgacucauuauaaau

SEQ ID NO: 2129297 - RNA, 23 nt, Staphylococcus aureus subsp. aureus N315
guuuuauauuuauuuuauaauaa

SEQ ID NO: 2129298 - RNA, 15 nt, Staphylococcus aureus subsp. aureus N315
guuuuauagcauuuc

SEQ ID NO: 2129299 - RNA, 22 nt, Staphylococcus aureus subsp. aureus N315
guuuuauuaauucugauuaugu

SEQ ID NO: 2129300 - RNA, 18 nt, Staphylococcus aureus subsp. aureus N315
guuuuauucgauaauaua

SEQ ID NO: 2129301 - RNA, 17 nt, Staphylococcus aureus subsp. aureus N315
guuuuaucuacaguuuu

SEQ ID NO: 2129302 - RNA, 20 nt, Staphylococcus aureus subsp. aureus N315
guuuuaauuucacuuuaacu

SEQ ID NO: 2129303 - RNA, 12 nt, Staphylococcus aureus subsp. aureus N315
guuuuaaaagua

SEQ ID NO: 2129304 - RNA, 17 nt, Staphylococcus aureus subsp. aureus N315
guuuuaaauugaaaugu

SEQ ID NO: 2129305 - RNA, 18 nt, Staphylococcus aureus subsp. aureus N315
guuuuaaacuuauuaauu

SEQ ID NO: 2129306 - RNA, 23 nt, Staphylococcus aureus subsp. aureus N315
guuuuacaugauuaaugaugcga

SEQ ID NO: 2129307 - RNA, 22 nt, Staphylococcus aureus subsp. aureus N315
guuuuacuacugucucaucuuc

SEQ ID NO: 2129308 - RNA, 22 nt, Staphylococcus aureus subsp. aureus N315
guuuucacuucgccaagccauc

SEQ ID NO: 2129309 - RNA, 20 nt, Staphylococcus aureus subsp. aureus N315
guuuuauuuuuaucaucaug

SEQ ID NO: 2129310 - RNA, 15 nt, Staphylococcus aureus subsp. aureus N315
guuuucaguaacuga

SEQ ID NO: 2129311 - RNA, 16 nt, Staphylococcus aureus subsp. aureus N315
guuuucauuuuuucaa

SEQ ID NO: 2129312 - RNA, 16 nt, Staphylococcus aureus subsp. aureus N315
guuuucuaauuguuuu

SEQ ID NO: 2129313 - RNA, 15 nt, Staphylococcus aureus subsp. aureus N315
guuuuccaugaguuu

SEQ ID NO: 2129314 - RNA, 14 nt, Staphylococcus aureus subsp. aureus N315
guuuguuuucuuuc

SEQ ID NO: 2129315 - RNA, 17 nt, Staphylococcus aureus subsp. aureus N315
guuuguuuauugagaau

SEQ ID NO: 2129316 - RNA, 17 nt, Staphylococcus aureus subsp. aureus N315
guuuggcauaauaauau

SEQ ID NO: 2129317 - RNA, 15 nt, Staphylococcus aureus subsp. aureus N315
guuuggauaaaauga

SEQ ID NO: 2129318 - RNA, 15 nt, Staphylococcus aureus subsp. aureus N315
guuugcaacauauuu

SEQ ID NO: 2129319 - RNA, 17 nt, Staphylococcus aureus subsp. aureus N315
guuucuguuucaucacc

SEQ ID NO: 2129320 - RNA, 13 nt, Staphylococcus aureus subsp. aureus N315
guugucuuuacau

SEQ ID NO: 2129321 - RNA, 21 nt, Staphylococcus aureus subsp. aureus N315
guucuucaucuuuuauggugg

SEQ ID NO: 2129322 - RNA, 15 nt, Staphylococcus aureus subsp. aureus N315
guuuaauaaugguuc

SEQ ID NO: 2129323 - RNA, 16 nt, Staphylococcus aureus subsp. aureus N315
guuuaauaaugguucu

SEQ ID NO: 2129324 - RNA, 14 nt, Staphylococcus aureus subsp. aureus N315
guuuaauuaaaaua

SEQ ID NO: 2129325 - RNA, 17 nt, Staphylococcus aureus subsp. aureus N315
guuuacuauuaaaggaa

SEQ ID NO: 2129326 - RNA, 15 nt, Staphylococcus aureus subsp. aureus N315
guugugauauauagu

SEQ ID NO: 2129327 - RNA, 17 nt, Staphylococcus aureus subsp. aureus N315
guuuaagauuuuaucuu

SEQ ID NO: 2129328 - RNA, 23 nt, Staphylococcus aureus subsp. aureus N315
guuuagaaaaguaaguaaaauaa

SEQ ID NO: 2129329 - RNA, 15 nt, Staphylococcus aureus subsp. aureus N315
guuuauuuagaauaa

SEQ ID NO: 2129330 - RNA, 20 nt, Staphylococcus aureus subsp. aureus N315
guuucaaacgugauuuuauc

SEQ ID NO: 2129331 - RNA, 19 nt, Staphylococcus aureus subsp. aureus N315
guuucacaaauucuuuuac

SEQ ID NO: 2129332 - RNA, 15 nt, Staphylococcus aureus subsp. aureus N315
guuucacaaauucuu

SEQ ID NO: 2129333 - RNA, 15 nt, Staphylococcus aureus subsp. aureus N315
guuucaagugcuugg

SEQ ID NO: 2129334 - RNA, 21 nt, Staphylococcus aureus subsp. aureus N315
guuucuaaauucuuuuuguuc

SEQ ID NO: 2129335 - RNA, 19 nt, Staphylococcus aureus subsp. aureus N315
guuucauaugcaucaacag

SEQ ID NO: 2129336 - RNA, 21 nt, Staphylococcus aureus subsp. aureus N315
guuucaugcacuuuaacauaa

SEQ ID NO: 2129337 - RNA, 14 nt, Staphylococcus aureus subsp. aureus N315
ucaaaaaauuaauc

SEQ ID NO: 2129338 - RNA, 16 nt, Staphylococcus aureus subsp. aureus N315
ucaaaaacaguuacaa

SEQ ID NO: 2129339 - RNA, 14 nt, Staphylococcus aureus subsp. aureus N315
ucaaaaagacagca

SEQ ID NO: 2129340 - RNA, 23 nt, Staphylococcus aureus subsp. aureus N315
ucaaaaauagcguaauuauuaua

SEQ ID NO: 2129341 - RNA, 22 nt, Staphylococcus aureus subsp. aureus N315
ucaaaaauaauuaugaaaagua

SEQ ID NO: 2129342 - RNA, 13 nt, Staphylococcus aureus subsp. aureus N315
uauuuuuuuaaau

SEQ ID NO: 2129343 - RNA, 21 nt, Staphylococcus aureus subsp. aureus N315
uauuuuuuggagcguaaaguu

SEQ ID NO: 2129344 - RNA, 13 nt, Staphylococcus aureus subsp. aureus N315
ucaaaaauuaauc

SEQ ID NO: 2129345 - RNA, 18 nt, Staphylococcus aureus subsp. aureus N315
ucaaaaccgcuauaaaau

SEQ ID NO: 2129346 - RNA, 15 nt, Staphylococcus aureus subsp. aureus N315
ucaaaacaauuuaaa

SEQ ID NO: 2129347 - RNA, 18 nt, Staphylococcus aureus subsp. aureus N315
ucaaaacguuuaauugca

SEQ ID NO: 2129348 - RNA, 16 nt, Staphylococcus aureus subsp. aureus N315
ucaaaacguuuaauug

SEQ ID NO: 2129349 - RNA, 17 nt, Staphylococcus aureus subsp. aureus N315
uauuuuuauauaaaauu

SEQ ID NO: 2129350 - RNA, 15 nt, Staphylococcus aureus subsp. aureus N315
uauuuuuaucaucau

SEQ ID NO: 2129351 - RNA, 13 nt, Staphylococcus aureus subsp. aureus N315
uauuuuucaucau

SEQ ID NO: 2129352 - RNA, 14 nt, Staphylococcus aureus subsp. aureus N315
uauuuuuacauauu

SEQ ID NO: 2129353 - RNA, 16 nt, Staphylococcus aureus subsp. aureus N315
uauuuuuaagcugcuc

SEQ ID NO: 2129354 - RNA, 19 nt, Staphylococcus aureus subsp. aureus N315
uauuuuuaaaugauucuuu

SEQ ID NO: 2129355 - RNA, 19 nt, Staphylococcus aureus subsp. aureus N315
uauuuuguuuuaaaaaaca

SEQ ID NO: 2129356 - RNA, 14 nt, Staphylococcus aureus subsp. aureus N315
uauuuuguauuuuu

SEQ ID NO: 2129357 - RNA, 17 nt, Staphylococcus aureus subsp. aureus N315
uauuuuguccagacaac

SEQ ID NO: 2129358 - RNA, 15 nt, Staphylococcus aureus subsp. aureus N315
uauuuuguuaauaag

SEQ ID NO: 2129359 - RNA, 23 nt, Staphylococcus aureus subsp. aureus N315
uauuuuuuauguuuuaauuucuu

SEQ ID NO: 2129360 - RNA, 21 nt, Staphylococcus aureus subsp. aureus N315
uauuuuuugagcacuuaauaa

SEQ ID NO: 2129361 - RNA, 17 nt, Staphylococcus aureus subsp. aureus N315
uauuuuuuauguuuuaa

SEQ ID NO: 2129362 - RNA, 23 nt, Staphylococcus aureus subsp. aureus N315
uauuuuugauagugguagccaau

SEQ ID NO: 2129363 - RNA, 13 nt, Staphylococcus aureus subsp. aureus N315
uauuuuuuaauaa

SEQ ID NO: 2129364 - RNA, 14 nt, Staphylococcus aureus subsp. aureus N315
uauuuuuuaaaugc

SEQ ID NO: 2129365 - RNA, 11 nt, Staphylococcus aureus subsp. aureus N315
uauuuuucuuu

SEQ ID NO: 2129366 - RNA, 17 nt, Staphylococcus aureus subsp. aureus N315
uauuuucugcuguaugg

SEQ ID NO: 2129367 - RNA, 21 nt, Staphylococcus aureus subsp. aureus N315
uauuuucuuguguauuuuuau

SEQ ID NO: 2129368 - RNA, 20 nt, Staphylococcus aureus subsp. aureus N315
uauuuucuuuuucuaaauaa

SEQ ID NO: 2129369 - RNA, 13 nt, Staphylococcus aureus subsp. aureus N315
uauuuucuugugu

SEQ ID NO: 2129370 - RNA, 20 nt, Staphylococcus aureus subsp. aureus N315
uauuuucuucucaacaaauc

SEQ ID NO: 2129371 - RNA, 21 nt, Staphylococcus aureus subsp. aureus N315
uauuuucuuuuucuaaauaaa

SEQ ID NO: 2129372 - RNA, 13 nt, Staphylococcus aureus subsp. aureus N315
uauuuucuuuuuc

SEQ ID NO: 2129373 - RNA, 12 nt, Staphylococcus aureus subsp. aureus N315
uauuuuguaguu

SEQ ID NO: 2129374 - RNA, 22 nt, Staphylococcus aureus subsp. aureus N315
uauuuuggacugguacuacuau

SEQ ID NO: 2129375 - RNA, 20 nt, Staphylococcus aureus subsp. aureus N315
uauuuugcaauugcaaugaa

SEQ ID NO: 2129376 - RNA, 13 nt, Staphylococcus aureus subsp. aureus N315
uauuuugcaauaa

SEQ ID NO: 2129377 - RNA, 17 nt, Staphylococcus aureus subsp. aureus N315
uauuuugcgcuucuagu

SEQ ID NO: 2129378 - RNA, 15 nt, Staphylococcus aureus subsp. aureus N315
uauuuucauuuuagu

SEQ ID NO: 2129379 - RNA, 18 nt, Staphylococcus aureus subsp. aureus N315
uauuuucaauauuugaua

SEQ ID NO: 2129380 - RNA, 21 nt, Staphylococcus aureus subsp. aureus N315
uauuuucaauaaauuuuauau

SEQ ID NO: 2129381 - RNA, 16 nt, Staphylococcus aureus subsp. aureus N315
uauuuucaguuaaaau

SEQ ID NO: 2129382 - RNA, 16 nt, Staphylococcus aureus subsp. aureus N315
uauuuuauuuaaaaau

SEQ ID NO: 2129383 - RNA, 13 nt, Staphylococcus aureus subsp. aureus N315
uauuuuauuuaaa

SEQ ID NO: 2129384 - RNA, 22 nt, Staphylococcus aureus subsp. aureus N315
uauuuuauuuaaaaauagccuu

SEQ ID NO: 2129385 - RNA, 22 nt, Staphylococcus aureus subsp. aureus N315
ucaaaaugccggucaaagcgaa

SEQ ID NO: 2129386 - RNA, 18 nt, Staphylococcus aureus subsp. aureus N315
ucaaaauguuuaacaaua

SEQ ID NO: 2129387 - RNA, 13 nt, Staphylococcus aureus subsp. aureus N315
ucaaaauaguaaa

SEQ ID NO: 2129388 - RNA, 23 nt, Staphylococcus aureus subsp. aureus N315
ucaaacaaaucuuuuaaauuuag

SEQ ID NO: 2129389 - RNA, 22 nt, Staphylococcus aureus subsp. aureus N315
ucaaaauucaauauuaaucaua

SEQ ID NO: 2129390 - RNA, 14 nt, Staphylococcus aureus subsp. aureus N315
ucaaaauuaugacu

SEQ ID NO: 2129391 - RNA, 23 nt, Staphylococcus aureus subsp. aureus N315
ucaaaauuaugacuaacauuggu

SEQ ID NO: 2129392 - RNA, 20 nt, Staphylococcus aureus subsp. aureus N315
ucaaaauuaaagcuuaauua

SEQ ID NO: 2129393 - RNA, 21 nt, Staphylococcus aureus subsp. aureus N315
ucaaaauuucgauuuucacca

SEQ ID NO: 2129394 - RNA, 14 nt, Staphylococcus aureus subsp. aureus N315
ucaaacagacuuaa

SEQ ID NO: 2129395 - RNA, 14 nt, Staphylococcus aureus subsp. aureus N315
ucaaacauauucau

SEQ ID NO: 2129396 - RNA, 19 nt, Staphylococcus aureus subsp. aureus N315
ucaaaccaccaaaaaucau

SEQ ID NO: 2129397 - RNA, 21 nt, Staphylococcus aureus subsp. aureus N315
ucaaaccaucuuaucuuuaug

SEQ ID NO: 2129398 - RNA, 22 nt, Staphylococcus aureus subsp. aureus N315
ucaaagccugucggaauugguu

SEQ ID NO: 2129399 - RNA, 12 nt, Staphylococcus aureus subsp. aureus N315
ucaaagaaaaag

SEQ ID NO: 2129400 - RNA, 14 nt, Staphylococcus aureus subsp. aureus N315
ucaaacuuaaaacu

SEQ ID NO: 2129401 - RNA, 13 nt, Staphylococcus aureus subsp. aureus N315
ucaaacugauuuc

SEQ ID NO: 2129402 - RNA, 16 nt, Staphylococcus aureus subsp. aureus N315
ucaaacuuaaaacuau

SEQ ID NO: 2129403 - RNA, 15 nt, Staphylococcus aureus subsp. aureus N315
ucaaacuuaaaacua

SEQ ID NO: 2129404 - RNA, 21 nt, Staphylococcus aureus subsp. aureus N315
ucaaacuuaaaacuauaaccu

SEQ ID NO: 2129405 - RNA, 20 nt, Staphylococcus aureus subsp. aureus N315
ucaaacuuggcaaugaaauu

SEQ ID NO: 2129406 - RNA, 21 nt, Staphylococcus aureus subsp. aureus N315
ucaaaguuuucaggaauuguu

SEQ ID NO: 2129407 - RNA, 14 nt, Staphylococcus aureus subsp. aureus N315
ucaaaguuuucauu

SEQ ID NO: 2129408 - RNA, 19 nt, Staphylococcus aureus subsp. aureus N315
ucaaaguuuucauuuaaca

SEQ ID NO: 2129409 - RNA, 21 nt, Staphylococcus aureus subsp. aureus N315
ucaaaguuuucauuuaacaug

SEQ ID NO: 2129410 - RNA, 13 nt, Staphylococcus aureus subsp. aureus N315
ucaaaguuuaauu

SEQ ID NO: 2129411 - RNA, 22 nt, Staphylococcus aureus subsp. aureus N315
ucaaauaaaugacauuuaauac

SEQ ID NO: 2129412 - RNA, 21 nt, Staphylococcus aureus subsp. aureus N315
ucaaauaaaugacauuuaaua

SEQ ID NO: 2129413 - RNA, 17 nt, Staphylococcus aureus subsp. aureus N315
ucaaauaacugaguuaa

SEQ ID NO: 2129414 - RNA, 21 nt, Staphylococcus aureus subsp. aureus N315
ucaaauacauuucaaaaaaag

SEQ ID NO: 2129415 - RNA, 16 nt, Staphylococcus aureus subsp. aureus N315
ucaaauaauauaaaac

SEQ ID NO: 2129416 - RNA, 18 nt, Staphylococcus aureus subsp. aureus N315
ucaaauaaugugaaaaau

SEQ ID NO: 2129417 - RNA, 21 nt, Staphylococcus aureus subsp. aureus N315
ucaaauaaugugaaaaaucuu

SEQ ID NO: 2129418 - RNA, 14 nt, Staphylococcus aureus subsp. aureus N315
ucaaauaauauaaa

SEQ ID NO: 2129419 - RNA, 20 nt, Staphylococcus aureus subsp. aureus N315
ucaaauagacaccaaaaaac

SEQ ID NO: 2129420 - RNA, 22 nt, Staphylococcus aureus subsp. aureus N315
ucaaauagacaccaaaaaacag

SEQ ID NO: 2129421 - RNA, 21 nt, Staphylococcus aureus subsp. aureus N315
ucaaagcuauauaugaauuga

SEQ ID NO: 2129422 - RNA, 12 nt, Staphylococcus aureus subsp. aureus N315
ucaaaguagaca

SEQ ID NO: 2129423 - RNA, 17 nt, Staphylococcus aureus subsp. aureus N315
ucaaaguagacauugaa

SEQ ID NO: 2129424 - RNA, 19 nt, Staphylococcus aureus subsp. aureus N315
ucaaaguagacauugaaua

SEQ ID NO: 2129425 - RNA, 19 nt, Staphylococcus aureus subsp. aureus N315
ucaaagucauuuagauagc

SEQ ID NO: 2129426 - RNA, 21 nt, Staphylococcus aureus subsp. aureus N315
ucaaaguauauacuaaucuuc

SEQ ID NO: 2129427 - RNA, 22 nt, Staphylococcus aureus subsp. aureus N315
ucaaaguagacauugaauaaau

SEQ ID NO: 2129428 - RNA, 16 nt, Staphylococcus aureus subsp. aureus N315
ucaacaucaugaacuu

SEQ ID NO: 2129429 - RNA, 21 nt, Staphylococcus aureus subsp. aureus N315
ucaacaucaucuuuaauuuuc

SEQ ID NO: 2129430 - RNA, 13 nt, Staphylococcus aureus subsp. aureus N315
ucaacaucaucuu

SEQ ID NO: 2129431 - RNA, 20 nt, Staphylococcus aureus subsp. aureus N315
ucaacauguuccgcuacaaa

SEQ ID NO: 2129432 - RNA, 22 nt, Staphylococcus aureus subsp. aureus N315
ucaacauguuccgcuacaaaac

SEQ ID NO: 2129433 - RNA, 21 nt, Staphylococcus aureus subsp. aureus N315
ucaacauguucguuauagacu

SEQ ID NO: 2129434 - RNA, 15 nt, Staphylococcus aureus subsp. aureus N315
ucaacauuaaaaugu

SEQ ID NO: 2129435 - RNA, 16 nt, Staphylococcus aureus subsp. aureus N315
ucaacauuaauaaaua

SEQ ID NO: 2129436 - RNA, 20 nt, Staphylococcus aureus subsp. aureus N315
ucaacacuuucuacucugau

SEQ ID NO: 2129437 - RNA, 15 nt, Staphylococcus aureus subsp. aureus N315
ucaacacuuucuacu

SEQ ID NO: 2129438 - RNA, 23 nt, Staphylococcus aureus subsp. aureus N315
ucaacaccaacaccuaauauuuu

SEQ ID NO: 2129439 - RNA, 15 nt, Staphylococcus aureus subsp. aureus N315
ucaacaauuucaaug

SEQ ID NO: 2129440 - RNA, 18 nt, Staphylococcus aureus subsp. aureus N315
ucaacagggguaaaacuu

SEQ ID NO: 2129441 - RNA, 14 nt, Staphylococcus aureus subsp. aureus N315
ucaacagcaaaaaa

SEQ ID NO: 2129442 - RNA, 16 nt, Staphylococcus aureus subsp. aureus N315
ucaacagcaaaaaaua

SEQ ID NO: 2129443 - RNA, 18 nt, Staphylococcus aureus subsp. aureus N315
ucaacaacugcgacaugu

SEQ ID NO: 2129444 - RNA, 18 nt, Staphylococcus aureus subsp. aureus N315
ucaacaaauuuaacuuuc

SEQ ID NO: 2129445 - RNA, 11 nt, Staphylococcus aureus subsp. aureus N315
ucaacaaacau

SEQ ID NO: 2129446 - RNA, 19 nt, Staphylococcus aureus subsp. aureus N315
ucaaauucucaauuaauuu

SEQ ID NO: 2129447 - RNA, 19 nt, Staphylococcus aureus subsp. aureus N315
ucaaauugagcaguauuuu

SEQ ID NO: 2129448 - RNA, 19 nt, Staphylococcus aureus subsp. aureus N315
ucaaauuggacuuaugggu

SEQ ID NO: 2129449 - RNA, 14 nt, Staphylococcus aureus subsp. aureus N315
ucaaauugguuuuc

SEQ ID NO: 2129450 - RNA, 12 nt, Staphylococcus aureus subsp. aureus N315
ucaaauuuaaua

SEQ ID NO: 2129451 - RNA, 24 nt, Staphylococcus aureus subsp. aureus N315
ucaaauauaucaacguuaauauaa

SEQ ID NO: 2129452 - RNA, 19 nt, Staphylococcus aureus subsp. aureus N315
ucaaauauacuuuuaccau

SEQ ID NO: 2129453 - RNA, 17 nt, Staphylococcus aureus subsp. aureus N315
ucaaauaggcauaauga

SEQ ID NO: 2129454 - RNA, 17 nt, Staphylococcus aureus subsp. aureus N315
ucaaaucauaaguuaaa

SEQ ID NO: 2129455 - RNA, 17 nt, Staphylococcus aureus subsp. aureus N315
ucaaauguaacauuaaa

SEQ ID NO: 2129456 - RNA, 21 nt, Staphylococcus aureus subsp. aureus N315
ucaaaugcuuaauaaaaucaa

SEQ ID NO: 2129457 - RNA, 20 nt, Staphylococcus aureus subsp. aureus N315
ucaaauuaauuaaaccaaua

SEQ ID NO: 2129458 - RNA, 15 nt, Staphylococcus aureus subsp. aureus N315
ucaaauuaaaucacc

SEQ ID NO: 2129459 - RNA, 23 nt, Staphylococcus aureus subsp. aureus N315
ucaaaugccgcuucuaauuuuuc

SEQ ID NO: 2129460 - RNA, 20 nt, Staphylococcus aureus subsp. aureus N315
ucaaaugacauuuuaaaucu

SEQ ID NO: 2129461 - RNA, 21 nt, Staphylococcus aureus subsp. aureus N315
ucaaaugacauuuuaaaucua

SEQ ID NO: 2129462 - RNA, 17 nt, Staphylococcus aureus subsp. aureus N315
ucaacugcuucacgauu

SEQ ID NO: 2129463 - RNA, 21 nt, Staphylococcus aureus subsp. aureus N315
ucaacugaaauuuuuccgauu

SEQ ID NO: 2129464 - RNA, 22 nt, Staphylococcus aureus subsp. aureus N315
ucaacuauauauaguugaucaa

SEQ ID NO: 2129465 - RNA, 16 nt, Staphylococcus aureus subsp. aureus N315
ucaacgggaacaucau

SEQ ID NO: 2129466 - RNA, 15 nt, Staphylococcus aureus subsp. aureus N315
ucaacgucaucugcu

SEQ ID NO: 2129467 - RNA, 21 nt, Staphylococcus aureus subsp. aureus N315
ucaacgucaucugcuuguaau

SEQ ID NO: 2129468 - RNA, 19 nt, Staphylococcus aureus subsp. aureus N315
ucaacuaaucguguauuau

SEQ ID NO: 2129469 - RNA, 14 nt, Staphylococcus aureus subsp. aureus N315
ucaacuaauuuaaa

SEQ ID NO: 2129470 - RNA, 22 nt, Staphylococcus aureus subsp. aureus N315
ucaaccuuugcuaaaucaagac

SEQ ID NO: 2129471 - RNA, 17 nt, Staphylococcus aureus subsp. aureus N315
ucaaccuguucuuuauu

SEQ ID NO: 2129472 - RNA, 21 nt, Staphylococcus aureus subsp. aureus N315
ucaaccuguucuuuauuuaaa

SEQ ID NO: 2129473 - RNA, 15 nt, Staphylococcus aureus subsp. aureus N315
ucaacgccauauuua

SEQ ID NO: 2129474 - RNA, 23 nt, Staphylococcus aureus subsp. aureus N315
ucaagauguuugcaacauauuuu

SEQ ID NO: 2129475 - RNA, 19 nt, Staphylococcus aureus subsp. aureus N315
ucaagauauccauuaugau

SEQ ID NO: 2129476 - RNA, 14 nt, Staphylococcus aureus subsp. aureus N315
ucaacuuauaaaau

SEQ ID NO: 2129477 - RNA, 23 nt, Staphylococcus aureus subsp. aureus N315
ucaacuuauaaaaugaaauauuu

SEQ ID NO: 2129478 - RNA, 22 nt, Staphylococcus aureus subsp. aureus N315
ucaacuucgauaugauuaaagc

SEQ ID NO: 2129479 - RNA, 15 nt, Staphylococcus aureus subsp. aureus N315
ucaacuuuaguuguu

SEQ ID NO: 2129480 - RNA, 22 nt, Staphylococcus aureus subsp. aureus N315
ucaacuuuaguuguuaggggcu

SEQ ID NO: 2129481 - RNA, 18 nt, Staphylococcus aureus subsp. aureus N315
ucaacuuuuuaauaauac

SEQ ID NO: 2129482 - RNA, 18 nt, Staphylococcus aureus subsp. aureus N315
ucaacuuuucaaagccac

SEQ ID NO: 2129483 - RNA, 14 nt, Staphylococcus aureus subsp. aureus N315
ucaacuuuuuuaac

SEQ ID NO: 2129484 - RNA, 19 nt, Staphylococcus aureus subsp. aureus N315
ucaagaaaaaguuuuucug

SEQ ID NO: 2129485 - RNA, 19 nt, Staphylococcus aureus subsp. aureus N315
ucaagaaauucgcaagccu

SEQ ID NO: 2129486 - RNA, 10 nt, Staphylococcus aureus subsp. aureus N315
ucaagaacaa

SEQ ID NO: 2129487 - RNA, 19 nt, Staphylococcus aureus subsp. aureus N315
ucaagaaugugaacaucua

SEQ ID NO: 2129488 - RNA, 15 nt, Staphylococcus aureus subsp. aureus N315
uauugagaauauuaa

SEQ ID NO: 2129489 - RNA, 14 nt, Staphylococcus aureus subsp. aureus N315
uauugagaauauuu

SEQ ID NO: 2129490 - RNA, 14 nt, Staphylococcus aureus subsp. aureus N315
uauugagacaacau

SEQ ID NO: 2129491 - RNA, 17 nt, Staphylococcus aureus subsp. aureus N315
uauugagauagaaauua

SEQ ID NO: 2129492 - RNA, 23 nt, Staphylococcus aureus subsp. aureus N315
uauugaucugauuucacuucuaa

SEQ ID NO: 2129493 - RNA, 19 nt, Staphylococcus aureus subsp. aureus N315
uauugauauucuaaaaaau

SEQ ID NO: 2129494 - RNA, 22 nt, Staphylococcus aureus subsp. aureus N315
uauugauucuagugaaauaccu

SEQ ID NO: 2129495 - RNA, 21 nt, Staphylococcus aureus subsp. aureus N315
uauugauuguaccaguaacaa

SEQ ID NO: 2129496 - RNA, 13 nt, Staphylococcus aureus subsp. aureus N315
uauugauuauucu

SEQ ID NO: 2129497 - RNA, 21 nt, Staphylococcus aureus subsp. aureus N315
uauugaugaauaaauagauaa

SEQ ID NO: 2129498 - RNA, 23 nt, Staphylococcus aureus subsp. aureus N315
uauugcaaaaauaauaugaauuu

SEQ ID NO: 2129499 - RNA, 21 nt, Staphylococcus aureus subsp. aureus N315
uauugauuugauucauuacau

SEQ ID NO: 2129500 - RNA, 18 nt, Staphylococcus aureus subsp. aureus N315
uauugcauguuuaaauau

SEQ ID NO: 2129501 - RNA, 16 nt, Staphylococcus aureus subsp. aureus N315
uauuggucauuacuaa

SEQ ID NO: 2129502 - RNA, 19 nt, Staphylococcus aureus subsp. aureus N315
uauugguaaauuuaucauu

SEQ ID NO: 2129503 - RNA, 17 nt, Staphylococcus aureus subsp. aureus N315
uauuggaauacucuuca

SEQ ID NO: 2129504 - RNA, 14 nt, Staphylococcus aureus subsp. aureus N315
uauuuaaaaauagc

SEQ ID NO: 2129505 - RNA, 15 nt, Staphylococcus aureus subsp. aureus N315
uauuuaaaaauagcc

SEQ ID NO: 2129506 - RNA, 19 nt, Staphylococcus aureus subsp. aureus N315
uauuguuuucaucaugcau

SEQ ID NO: 2129507 - RNA, 13 nt, Staphylococcus aureus subsp. aureus N315
uauuuaaaagaca

SEQ ID NO: 2129508 - RNA, 23 nt, Staphylococcus aureus subsp. aureus N315
uauuguuccagacuccuaaauua

SEQ ID NO: 2129509 - RNA, 21 nt, Staphylococcus aureus subsp. aureus N315
uauuuaaacuaguaauagaau

SEQ ID NO: 2129510 - RNA, 21 nt, Staphylococcus aureus subsp. aureus N315
uauuuaacaucaauuacucuu

SEQ ID NO: 2129511 - RNA, 16 nt, Staphylococcus aureus subsp. aureus N315
uauuuaaauuuuaagu

SEQ ID NO: 2129512 - RNA, 22 nt, Staphylococcus aureus subsp. aureus N315
uauuguuaaacuagaaaacaua

SEQ ID NO: 2129513 - RNA, 23 nt, Staphylococcus aureus subsp. aureus N315
uauuguuaaacuagaaaacauaa

SEQ ID NO: 2129514 - RNA, 18 nt, Staphylococcus aureus subsp. aureus N315
uauuguauuuuauuuauu

SEQ ID NO: 2129515 - RNA, 13 nt, Staphylococcus aureus subsp. aureus N315
uauugucaucaug

SEQ ID NO: 2129516 - RNA, 15 nt, Staphylococcus aureus subsp. aureus N315
uauugucaucauguu

SEQ ID NO: 2129517 - RNA, 14 nt, Staphylococcus aureus subsp. aureus N315
uauuguauuuuaau

SEQ ID NO: 2129518 - RNA, 17 nt, Staphylococcus aureus subsp. aureus N315
uauuguaagcugacuuu

SEQ ID NO: 2129519 - RNA, 19 nt, Staphylococcus aureus subsp. aureus N315
uauugucgacuuuuagauu

SEQ ID NO: 2129520 - RNA, 16 nt, Staphylococcus aureus subsp. aureus N315
uauugugccgcuucua

SEQ ID NO: 2129521 - RNA, 13 nt, Staphylococcus aureus subsp. aureus N315
uauuuacccaaca

SEQ ID NO: 2129522 - RNA, 20 nt, Staphylococcus aureus subsp. aureus N315
uauuuaccacaaauaucaau

SEQ ID NO: 2129523 - RNA, 16 nt, Staphylococcus aureus subsp. aureus N315
uauuuaauuuugauau

SEQ ID NO: 2129524 - RNA, 15 nt, Staphylococcus aureus subsp. aureus N315
uauuuaauuuuucua

SEQ ID NO: 2129525 - RNA, 22 nt, Staphylococcus aureus subsp. aureus N315
uauuuacaauguuaucuugcuu

SEQ ID NO: 2129526 - RNA, 16 nt, Staphylococcus aureus subsp. aureus N315
uauuuaccuucuucua

SEQ ID NO: 2129527 - RNA, 15 nt, Staphylococcus aureus subsp. aureus N315
uauuuagauaaaaau

SEQ ID NO: 2129528 - RNA, 16 nt, Staphylococcus aureus subsp. aureus N315
uauuuagaauauuaac

SEQ ID NO: 2129529 - RNA, 16 nt, Staphylococcus aureus subsp. aureus N315
uauuuagaauucuaaa

SEQ ID NO: 2129530 - RNA, 16 nt, Staphylococcus aureus subsp. aureus N315
uauuuagaauaaacuu

SEQ ID NO: 2129531 - RNA, 15 nt, Staphylococcus aureus subsp. aureus N315
uauuuagauugguca

SEQ ID NO: 2129532 - RNA, 16 nt, Staphylococcus aureus subsp. aureus N315
uauuuagauuuauaac

SEQ ID NO: 2129533 - RNA, 14 nt, Staphylococcus aureus subsp. aureus N315
uauuuauaaaauaa

SEQ ID NO: 2129534 - RNA, 22 nt, Staphylococcus aureus subsp. aureus N315
uauuucugaaaugauacauuau

SEQ ID NO: 2129535 - RNA, 22 nt, Staphylococcus aureus subsp. aureus N315
uauuucugacaacuuaauagaa

SEQ ID NO: 2129536 - RNA, 16 nt, Staphylococcus aureus subsp. aureus N315
uauuucuuaccauuua

SEQ ID NO: 2129537 - RNA, 21 nt, Staphylococcus aureus subsp. aureus N315
uauuugacacauuauugaaau

SEQ ID NO: 2129538 - RNA, 22 nt, Staphylococcus aureus subsp. aureus N315
uauuugaaagacauuuaaauau

SEQ ID NO: 2129539 - RNA, 23 nt, Staphylococcus aureus subsp. aureus N315
uauuugaaagacauuuaaauaua

SEQ ID NO: 2129540 - RNA, 17 nt, Staphylococcus aureus subsp. aureus N315
uauuugaaagguaagua

SEQ ID NO: 2129541 - RNA, 14 nt, Staphylococcus aureus subsp. aureus N315
uauuugaaaauauu

SEQ ID NO: 2129542 - RNA, 17 nt, Staphylococcus aureus subsp. aureus N315
uauuugauuauucuuca

SEQ ID NO: 2129543 - RNA, 15 nt, Staphylococcus aureus subsp. aureus N315
uauuugauauuucau

SEQ ID NO: 2129544 - RNA, 13 nt, Staphylococcus aureus subsp. aureus N315
uauuugauacaac

SEQ ID NO: 2129545 - RNA, 14 nt, Staphylococcus aureus subsp. aureus N315
uauuugauucuuca

SEQ ID NO: 2129546 - RNA, 14 nt, Staphylococcus aureus subsp. aureus N315
uauuugauucuauu

SEQ ID NO: 2129547 - RNA, 20 nt, Staphylococcus aureus subsp. aureus N315
uauuugauucuauuucuuca

SEQ ID NO: 2129548 - RNA, 14 nt, Staphylococcus aureus subsp. aureus N315
uauuugcccgacuu

SEQ ID NO: 2129549 - RNA, 21 nt, Staphylococcus aureus subsp. aureus N315
uauuuggaugguaaguauaau

SEQ ID NO: 2129550 - RNA, 22 nt, Staphylococcus aureus subsp. aureus N315
uauuugcuagucauaauuuaaa

SEQ ID NO: 2129551 - RNA, 22 nt, Staphylococcus aureus subsp. aureus N315
uauuuuaaugggcgauaaaagu

SEQ ID NO: 2129552 - RNA, 18 nt, Staphylococcus aureus subsp. aureus N315
uauuuuaauauugaaaug

SEQ ID NO: 2129553 - RNA, 15 nt, Staphylococcus aureus subsp. aureus N315
uauuuuaauagcauu

SEQ ID NO: 2129554 - RNA, 13 nt, Staphylococcus aureus subsp. aureus N315
uauuuuauaaaau

SEQ ID NO: 2129555 - RNA, 14 nt, Staphylococcus aureus subsp. aureus N315
uauuuuauaaaaua

SEQ ID NO: 2129556 - RNA, 16 nt, Staphylococcus aureus subsp. aureus N315
uauuuuauaaaauaua

SEQ ID NO: 2129557 - RNA, 14 nt, Staphylococcus aureus subsp. aureus N315
uauuuuauaagaau

SEQ ID NO: 2129558 - RNA, 12 nt, Staphylococcus aureus subsp. aureus N315
uauuuuaugauu

SEQ ID NO: 2129559 - RNA, 20 nt, Staphylococcus aureus subsp. aureus N315
uauuuuaugacguaauuaau

SEQ ID NO: 2129560 - RNA, 13 nt, Staphylococcus aureus subsp. aureus N315
uauuuuauacaua

SEQ ID NO: 2129561 - RNA, 23 nt, Staphylococcus aureus subsp. aureus N315
uauuuuaucaagagguaaaucug

SEQ ID NO: 2129562 - RNA, 13 nt, Staphylococcus aureus subsp. aureus N315
uauuuuaucucuu

SEQ ID NO: 2129563 - RNA, 15 nt, Staphylococcus aureus subsp. aureus N315
uauuuguauaugcaa

SEQ ID NO: 2129564 - RNA, 15 nt, Staphylococcus aureus subsp. aureus N315
uauuuguaauuucag

SEQ ID NO: 2129565 - RNA, 16 nt, Staphylococcus aureus subsp. aureus N315
uauuuggauauuuauu

SEQ ID NO: 2129566 - RNA, 12 nt, Staphylococcus aureus subsp. aureus N315
uauuuuaaaaau

SEQ ID NO: 2129567 - RNA, 12 nt, Staphylococcus aureus subsp. aureus N315
uauuuuaaacau

SEQ ID NO: 2129568 - RNA, 21 nt, Staphylococcus aureus subsp. aureus N315
uauuuuaaaccguuauauauu

SEQ ID NO: 2129569 - RNA, 10 nt, Staphylococcus aureus subsp. aureus N315
uauuuuaaac

SEQ ID NO: 2129570 - RNA, 19 nt, Staphylococcus aureus subsp. aureus N315
uauuuuaaauuuauaauac

SEQ ID NO: 2129571 - RNA, 15 nt, Staphylococcus aureus subsp. aureus N315
uauuuccaaauugaa

SEQ ID NO: 2129572 - RNA, 14 nt, Staphylococcus aureus subsp. aureus N315
uauuucauauaugu

SEQ ID NO: 2129573 - RNA, 20 nt, Staphylococcus aureus subsp. aureus N315
uauuucgguauuuuaaauuu

SEQ ID NO: 2129574 - RNA, 20 nt, Staphylococcus aureus subsp. aureus N315
uauuucgguuagucuuaauc

SEQ ID NO: 2129575 - RNA, 21 nt, Staphylococcus aureus subsp. aureus N315
uauuucuaaauuauuuauuca

SEQ ID NO: 2129576 - RNA, 17 nt, Staphylococcus aureus subsp. aureus N315
uauuucuauuccuucua

SEQ ID NO: 2129577 - RNA, 13 nt, Staphylococcus aureus subsp. aureus N315
uauuuauuuuaau

SEQ ID NO: 2129578 - RNA, 18 nt, Staphylococcus aureus subsp. aureus N315
uauuuauuuuaauagugu

SEQ ID NO: 2129579 - RNA, 15 nt, Staphylococcus aureus subsp. aureus N315
uauuuauuuuauaau

SEQ ID NO: 2129580 - RNA, 13 nt, Staphylococcus aureus subsp. aureus N315
uauuuauuuugau

SEQ ID NO: 2129581 - RNA, 20 nt, Staphylococcus aureus subsp. aureus N315
uauuucacacagcuucauua

SEQ ID NO: 2129582 - RNA, 15 nt, Staphylococcus aureus subsp. aureus N315
uauuucaauuaucaa

SEQ ID NO: 2129583 - RNA, 21 nt, Staphylococcus aureus subsp. aureus N315
uauuucaacaaacauaaauaa

SEQ ID NO: 2129584 - RNA, 19 nt, Staphylococcus aureus subsp. aureus N315
uauuucaacuuuuuaauaa

SEQ ID NO: 2129585 - RNA, 13 nt, Staphylococcus aureus subsp. aureus N315
uauuucaaaugua

SEQ ID NO: 2129586 - RNA, 15 nt, Staphylococcus aureus subsp. aureus N315
uauuucaacaaacau

SEQ ID NO: 2129587 - RNA, 17 nt, Staphylococcus aureus subsp. aureus N315
uauuucaacaaacauaa

SEQ ID NO: 2129588 - RNA, 17 nt, Staphylococcus aureus subsp. aureus N315
uauuuauacuaaagcac

SEQ ID NO: 2129589 - RNA, 18 nt, Staphylococcus aureus subsp. aureus N315
uauuuauaacuuuaaaaa

SEQ ID NO: 2129590 - RNA, 18 nt, Staphylococcus aureus subsp. aureus N315
uauuuauaagaggagaaa

SEQ ID NO: 2129591 - RNA, 19 nt, Staphylococcus aureus subsp. aureus N315
uauuuauacuauaaauaca

SEQ ID NO: 2129592 - RNA, 11 nt, Staphylococcus aureus subsp. aureus N315
uauuuauucag

SEQ ID NO: 2129593 - RNA, 18 nt, Staphylococcus aureus subsp. aureus N315
uauuuauugagauagaaa

SEQ ID NO: 2129594 - RNA, 19 nt, Staphylococcus aureus subsp. aureus N315
uauuuauugagauagaaau

SEQ ID NO: 2129595 - RNA, 10 nt, Staphylococcus aureus subsp. aureus N315
uauuuauuca

SEQ ID NO: 2129596 - RNA, 15 nt, Staphylococcus aureus subsp. aureus N315
uauuuauguuuucua

SEQ ID NO: 2129597 - RNA, 18 nt, Staphylococcus aureus subsp. aureus N315
uauuuaucucuuucuuca

SEQ ID NO: 2129598 - RNA, 14 nt, Staphylococcus aureus subsp. aureus N315
uauuuaucuuuaga

SEQ ID NO: 2129599 - RNA, 12 nt, Staphylococcus aureus subsp. aureus N315
uauuauaaaaua

SEQ ID NO: 2129600 - RNA, 15 nt, Staphylococcus aureus subsp. aureus N315
uauuauaaaauaaau

SEQ ID NO: 2129601 - RNA, 11 nt, Staphylococcus aureus subsp. aureus N315
uauuauagaac

SEQ ID NO: 2129602 - RNA, 15 nt, Staphylococcus aureus subsp. aureus N315
uauuauaguuuagau

SEQ ID NO: 2129603 - RNA, 17 nt, Staphylococcus aureus subsp. aureus N315
uauuauauaauaagaga

SEQ ID NO: 2129604 - RNA, 19 nt, Staphylococcus aureus subsp. aureus N315
uauuauaauuguucauugg

SEQ ID NO: 2129605 - RNA, 14 nt, Staphylococcus aureus subsp. aureus N315
uauuauaauuuugu

SEQ ID NO: 2129606 - RNA, 16 nt, Staphylococcus aureus subsp. aureus N315
uauuauaaauauuuuu

SEQ ID NO: 2129607 - RNA, 18 nt, Staphylococcus aureus subsp. aureus N315
uauuagccaauaaaaugu

SEQ ID NO: 2129608 - RNA, 14 nt, Staphylococcus aureus subsp. aureus N315
uauuacuuuaauuu

SEQ ID NO: 2129609 - RNA, 20 nt, Staphylococcus aureus subsp. aureus N315
uauuacuuauuucuuuucau

SEQ ID NO: 2129610 - RNA, 15 nt, Staphylococcus aureus subsp. aureus N315
uauuacuuauuucuu

SEQ ID NO: 2129611 - RNA, 16 nt, Staphylococcus aureus subsp. aureus N315
uauuacuuauuucuuu

SEQ ID NO: 2129612 - RNA, 22 nt, Staphylococcus aureus subsp. aureus N315
uauuauugaaaucgauacuaau

SEQ ID NO: 2129613 - RNA, 16 nt, Staphylococcus aureus subsp. aureus N315
uauuauugucaucaug

SEQ ID NO: 2129614 - RNA, 15 nt, Staphylococcus aureus subsp. aureus N315
uauuauguuauaaau

SEQ ID NO: 2129615 - RNA, 23 nt, Staphylococcus aureus subsp. aureus N315
uauuauguuauaaauucuaucua

SEQ ID NO: 2129616 - RNA, 14 nt, Staphylococcus aureus subsp. aureus N315
uauuauguuauaaa

SEQ ID NO: 2129617 - RNA, 16 nt, Staphylococcus aureus subsp. aureus N315
uauuaugaauuauuaa

SEQ ID NO: 2129618 - RNA, 21 nt, Staphylococcus aureus subsp. aureus N315
uauuaucuuuaauuuacaauu

SEQ ID NO: 2129619 - RNA, 15 nt, Staphylococcus aureus subsp. aureus N315
uauuauccucaaaua

SEQ ID NO: 2129620 - RNA, 15 nt, Staphylococcus aureus subsp. aureus N315
uauuaucuauccauu

SEQ ID NO: 2129621 - RNA, 14 nt, Staphylococcus aureus subsp. aureus N315
uauuauauauauuc

SEQ ID NO: 2129622 - RNA, 14 nt, Staphylococcus aureus subsp. aureus N315
uauuaaauuucuga

SEQ ID NO: 2129623 - RNA, 13 nt, Staphylococcus aureus subsp. aureus N315
uauuaaauuaugg

SEQ ID NO: 2129624 - RNA, 21 nt, Staphylococcus aureus subsp. aureus N315
uauuaaaauacgguacagaua

SEQ ID NO: 2129625 - RNA, 16 nt, Staphylococcus aureus subsp. aureus N315
uauuaaguauaucuuu

SEQ ID NO: 2129626 - RNA, 24 nt, Staphylococcus aureus subsp. aureus N315
uauuaaggggguaauacuauauga

SEQ ID NO: 2129627 - RNA, 22 nt, Staphylococcus aureus subsp. aureus N315
uauuaaggggguaauacuauau

SEQ ID NO: 2129628 - RNA, 16 nt, Staphylococcus aureus subsp. aureus N315
uauuaagacugauuaa

SEQ ID NO: 2129629 - RNA, 22 nt, Staphylococcus aureus subsp. aureus N315
uauuaagcuauacucauuuucu

SEQ ID NO: 2129630 - RNA, 21 nt, Staphylococcus aureus subsp. aureus N315
uauuaccauaacuuuauauau

SEQ ID NO: 2129631 - RNA, 17 nt, Staphylococcus aureus subsp. aureus N315
uauuacuaaccuauuaa

SEQ ID NO: 2129632 - RNA, 19 nt, Staphylococcus aureus subsp. aureus N315
uauuacuauaaaaaacagc

SEQ ID NO: 2129633 - RNA, 15 nt, Staphylococcus aureus subsp. aureus N315
uauuacaaugaaaaa

SEQ ID NO: 2129634 - RNA, 17 nt, Staphylococcus aureus subsp. aureus N315
uauuaauuugauaaaug

SEQ ID NO: 2129635 - RNA, 18 nt, Staphylococcus aureus subsp. aureus N315
uauuaauuuuucaaaugu

SEQ ID NO: 2129636 - RNA, 16 nt, Staphylococcus aureus subsp. aureus N315
uauuaauuuuacguuu

SEQ ID NO: 2129637 - RNA, 12 nt, Staphylococcus aureus subsp. aureus N315
uauuaauuuaau

SEQ ID NO: 2129638 - RNA, 13 nt, Staphylococcus aureus subsp. aureus N315
uauuaaugaauau

SEQ ID NO: 2129639 - RNA, 14 nt, Staphylococcus aureus subsp. aureus N315
uauuaauuuacuca

SEQ ID NO: 2129640 - RNA, 16 nt, Staphylococcus aureus subsp. aureus N315
uauucuaaauauauuu

SEQ ID NO: 2129641 - RNA, 19 nt, Staphylococcus aureus subsp. aureus N315
uauucuaaauauauuuuau

SEQ ID NO: 2129642 - RNA, 16 nt, Staphylococcus aureus subsp. aureus N315
uauucuauuuuucaau

SEQ ID NO: 2129643 - RNA, 21 nt, Staphylococcus aureus subsp. aureus N315
uauucuauuuuucaauucgcu

SEQ ID NO: 2129644 - RNA, 12 nt, Staphylococcus aureus subsp. aureus N315
uauucggcaaaa

SEQ ID NO: 2129645 - RNA, 16 nt, Staphylococcus aureus subsp. aureus N315
uauucuaaaaaauuaa

SEQ ID NO: 2129646 - RNA, 22 nt, Staphylococcus aureus subsp. aureus N315
uauucuaaaaaauuaaaaauuu

SEQ ID NO: 2129647 - RNA, 20 nt, Staphylococcus aureus subsp. aureus N315
uauucuaaaaaauuaaaaau

SEQ ID NO: 2129648 - RNA, 14 nt, Staphylococcus aureus subsp. aureus N315
uauucgcaccacug

SEQ ID NO: 2129649 - RNA, 18 nt, Staphylococcus aureus subsp. aureus N315
uauugaaaguguaugcau

SEQ ID NO: 2129650 - RNA, 19 nt, Staphylococcus aureus subsp. aureus N315
uauugaaaguguaugcaug

SEQ ID NO: 2129651 - RNA, 15 nt, Staphylococcus aureus subsp. aureus N315
uauugaaaagauaaa

SEQ ID NO: 2129652 - RNA, 12 nt, Staphylococcus aureus subsp. aureus N315
uauugaaacuaa

SEQ ID NO: 2129653 - RNA, 15 nt, Staphylococcus aureus subsp. aureus N315
uauucuuucucuauu

SEQ ID NO: 2129654 - RNA, 12 nt, Staphylococcus aureus subsp. aureus N315
uauucuuugauu

SEQ ID NO: 2129655 - RNA, 18 nt, Staphylococcus aureus subsp. aureus N315
uauucuuuuaauagaucu

SEQ ID NO: 2129656 - RNA, 16 nt, Staphylococcus aureus subsp. aureus N315
uauugaaaugagcuua

SEQ ID NO: 2129657 - RNA, 20 nt, Staphylococcus aureus subsp. aureus N315
uauugaacaauuuuugggaa

SEQ ID NO: 2129658 - RNA, 14 nt, Staphylococcus aureus subsp. aureus N315
uauugaacuucuaa

SEQ ID NO: 2129659 - RNA, 15 nt, Staphylococcus aureus subsp. aureus N315
uauugaaugaauuca

SEQ ID NO: 2129660 - RNA, 22 nt, Staphylococcus aureus subsp. aureus N315
uauugaauggaguauaucagcu

SEQ ID NO: 2129661 - RNA, 18 nt, Staphylococcus aureus subsp. aureus N315
uauugaccaccuguaucu

SEQ ID NO: 2129662 - RNA, 18 nt, Staphylococcus aureus subsp. aureus N315
uauucugagauugagaau

SEQ ID NO: 2129663 - RNA, 17 nt, Staphylococcus aureus subsp. aureus N315
uauucuuaaaagacauc

SEQ ID NO: 2129664 - RNA, 11 nt, Staphylococcus aureus subsp. aureus N315
uauucuuccca

SEQ ID NO: 2129665 - RNA, 14 nt, Staphylococcus aureus subsp. aureus N315
uauucuuuauauuu

SEQ ID NO: 2129666 - RNA, 16 nt, Staphylococcus aureus subsp. aureus N315
uauucaaaguuuucau

SEQ ID NO: 2129667 - RNA, 12 nt, Staphylococcus aureus subsp. aureus N315
uauucaaaauaa

SEQ ID NO: 2129668 - RNA, 20 nt, Staphylococcus aureus subsp. aureus N315
uauuauuuuguauuuuucaa

SEQ ID NO: 2129669 - RNA, 18 nt, Staphylococcus aureus subsp. aureus N315
uauuauuuugcuuuaauu

SEQ ID NO: 2129670 - RNA, 16 nt, Staphylococcus aureus subsp. aureus N315
uauuauugugaaaucu

SEQ ID NO: 2129671 - RNA, 21 nt, Staphylococcus aureus subsp. aureus N315
uauucaacagggguaaaacuu

SEQ ID NO: 2129672 - RNA, 15 nt, Staphylococcus aureus subsp. aureus N315
uauucaauaauucau

SEQ ID NO: 2129673 - RNA, 14 nt, Staphylococcus aureus subsp. aureus N315
uauucaauaauuau

SEQ ID NO: 2129674 - RNA, 14 nt, Staphylococcus aureus subsp. aureus N315
uauucaauucugug

SEQ ID NO: 2129675 - RNA, 10 nt, Staphylococcus aureus subsp. aureus N315
uauucaauug

SEQ ID NO: 2129676 - RNA, 19 nt, Staphylococcus aureus subsp. aureus N315
uauucaaugauuaguaaug

SEQ ID NO: 2129677 - RNA, 21 nt, Staphylococcus aureus subsp. aureus N315
uauuccgaacauguuucuaga

SEQ ID NO: 2129678 - RNA, 17 nt, Staphylococcus aureus subsp. aureus N315
uauuccuaauaaauauc

SEQ ID NO: 2129679 - RNA, 14 nt, Staphylococcus aureus subsp. aureus N315
uauucgauaauaua

SEQ ID NO: 2129680 - RNA, 20 nt, Staphylococcus aureus subsp. aureus N315
uauucgauacauaaaacauc

SEQ ID NO: 2129681 - RNA, 16 nt, Staphylococcus aureus subsp. aureus N315
ucacaaucauagauau

SEQ ID NO: 2129682 - RNA, 22 nt, Staphylococcus aureus subsp. aureus N315
ucacaauacgaaaucaaaaaua

SEQ ID NO: 2129683 - RNA, 13 nt, Staphylococcus aureus subsp. aureus N315
ucacaaugaccau

SEQ ID NO: 2129684 - RNA, 18 nt, Staphylococcus aureus subsp. aureus N315
ucacaaauuugaauauac

SEQ ID NO: 2129685 - RNA, 15 nt, Staphylococcus aureus subsp. aureus N315
ucacaacacauaaau

SEQ ID NO: 2129686 - RNA, 22 nt, Staphylococcus aureus subsp. aureus N315
ucacaaauucuuuuacagcaag

SEQ ID NO: 2129687 - RNA, 20 nt, Staphylococcus aureus subsp. aureus N315
ucacaacugcauauaaaguc

SEQ ID NO: 2129688 - RNA, 16 nt, Staphylococcus aureus subsp. aureus N315
ucacaacugcauauaa

SEQ ID NO: 2129689 - RNA, 23 nt, Staphylococcus aureus subsp. aureus N315
ucacacgacauguagguaauugc

SEQ ID NO: 2129690 - RNA, 13 nt, Staphylococcus aureus subsp. aureus N315
ucacauacauuuu

SEQ ID NO: 2129691 - RNA, 20 nt, Staphylococcus aureus subsp. aureus N315
ucacauacauuuugaaacau

SEQ ID NO: 2129692 - RNA, 16 nt, Staphylococcus aureus subsp. aureus N315
ucacauauaaauauuu

SEQ ID NO: 2129693 - RNA, 15 nt, Staphylococcus aureus subsp. aureus N315
ucacauagaguaauu

SEQ ID NO: 2129694 - RNA, 18 nt, Staphylococcus aureus subsp. aureus N315
ucacauaugacuuuauuu

SEQ ID NO: 2129695 - RNA, 22 nt, Staphylococcus aureus subsp. aureus N315
ucacaguaucuucaguuauuug

SEQ ID NO: 2129696 - RNA, 13 nt, Staphylococcus aureus subsp. aureus N315
ucacauaaaauac

SEQ ID NO: 2129697 - RNA, 17 nt, Staphylococcus aureus subsp. aureus N315
ucacauaaaauacauuu

SEQ ID NO: 2129698 - RNA, 22 nt, Staphylococcus aureus subsp. aureus N315
ucacaugaauuuuaauauauuu

SEQ ID NO: 2129699 - RNA, 18 nt, Staphylococcus aureus subsp. aureus N315
ucacaugaauuuuaauau

SEQ ID NO: 2129700 - RNA, 22 nt, Staphylococcus aureus subsp. aureus N315
ucacauguaccacauuuuccuu

SEQ ID NO: 2129701 - RNA, 16 nt, Staphylococcus aureus subsp. aureus N315
ucacaugugaaauaau

SEQ ID NO: 2129702 - RNA, 15 nt, Staphylococcus aureus subsp. aureus N315
ucacauuaaguuaaa

SEQ ID NO: 2129703 - RNA, 15 nt, Staphylococcus aureus subsp. aureus N315
ucacaugugaaauaa

SEQ ID NO: 2129704 - RNA, 18 nt, Staphylococcus aureus subsp. aureus N315
ucacauucuugaauaaau

SEQ ID NO: 2129705 - RNA, 13 nt, Staphylococcus aureus subsp. aureus N315
ucacauuuauaac

SEQ ID NO: 2129706 - RNA, 20 nt, Staphylococcus aureus subsp. aureus N315
ucaccaacaacuuuguuuuc

SEQ ID NO: 2129707 - RNA, 15 nt, Staphylococcus aureus subsp. aureus N315
ucaccaauuagguuu

SEQ ID NO: 2129708 - RNA, 18 nt, Staphylococcus aureus subsp. aureus N315
ucaccaauccgauucacu

SEQ ID NO: 2129709 - RNA, 17 nt, Staphylococcus aureus subsp. aureus N315
ucaccagauuuuaagug

SEQ ID NO: 2129710 - RNA, 16 nt, Staphylococcus aureus subsp. aureus N315
ucaccauuuacuucau

SEQ ID NO: 2129711 - RNA, 13 nt, Staphylococcus aureus subsp. aureus N315
ucaccaucuuuaa

SEQ ID NO: 2129712 - RNA, 17 nt, Staphylococcus aureus subsp. aureus N315
ucaccaucauauucaac

SEQ ID NO: 2129713 - RNA, 19 nt, Staphylococcus aureus subsp. aureus N315
ucaccauacuaaaacauga

SEQ ID NO: 2129714 - RNA, 18 nt, Staphylococcus aureus subsp. aureus N315
ucaccauauuuaacauuu

SEQ ID NO: 2129715 - RNA, 20 nt, Staphylococcus aureus subsp. aureus N315
ucaccguaaucuuuuaacuu

SEQ ID NO: 2129716 - RNA, 20 nt, Staphylococcus aureus subsp. aureus N315
ucaccuaaaugauuaauaac

SEQ ID NO: 2129717 - RNA, 14 nt, Staphylococcus aureus subsp. aureus N315
ucaccguaaucuuu

SEQ ID NO: 2129718 - RNA, 14 nt, Staphylococcus aureus subsp. aureus N315
ucaccgcuuucaau

SEQ ID NO: 2129719 - RNA, 15 nt, Staphylococcus aureus subsp. aureus N315
ucaauuagaaaauau

SEQ ID NO: 2129720 - RNA, 22 nt, Staphylococcus aureus subsp. aureus N315
ucaauuacucuuuuucuuucau

SEQ ID NO: 2129721 - RNA, 14 nt, Staphylococcus aureus subsp. aureus N315
ucaauuauugaaaa

SEQ ID NO: 2129722 - RNA, 14 nt, Staphylococcus aureus subsp. aureus N315
ucaauuaauuuaaa

SEQ ID NO: 2129723 - RNA, 19 nt, Staphylococcus aureus subsp. aureus N315
ucaauuaauuuaaaugcuu

SEQ ID NO: 2129724 - RNA, 14 nt, Staphylococcus aureus subsp. aureus N315
ucaauguuuaauuu

SEQ ID NO: 2129725 - RNA, 19 nt, Staphylococcus aureus subsp. aureus N315
ucaauuaaacuuaagaaua

SEQ ID NO: 2129726 - RNA, 12 nt, Staphylococcus aureus subsp. aureus N315
ucaauucucuaa

SEQ ID NO: 2129727 - RNA, 17 nt, Staphylococcus aureus subsp. aureus N315
ucaauugaaucuuuguu

SEQ ID NO: 2129728 - RNA, 20 nt, Staphylococcus aureus subsp. aureus N315
ucaauuuaaauaaguuacuc

SEQ ID NO: 2129729 - RNA, 23 nt, Staphylococcus aureus subsp. aureus N315
ucaauuguugcaaaauacgauuu

SEQ ID NO: 2129730 - RNA, 14 nt, Staphylococcus aureus subsp. aureus N315
ucaauuucuguaau

SEQ ID NO: 2129731 - RNA, 16 nt, Staphylococcus aureus subsp. aureus N315
ucaauuucauuugaaa

SEQ ID NO: 2129732 - RNA, 14 nt, Staphylococcus aureus subsp. aureus N315
ucaauuucauuuuu

SEQ ID NO: 2129733 - RNA, 22 nt, Staphylococcus aureus subsp. aureus N315
ucaauuucaccuuguaaauuga

SEQ ID NO: 2129734 - RNA, 22 nt, Staphylococcus aureus subsp. aureus N315
ucaauuuaguauaaauaaaaau

SEQ ID NO: 2129735 - RNA, 18 nt, Staphylococcus aureus subsp. aureus N315
ucaauuuggaaauaucuu

SEQ ID NO: 2129736 - RNA, 19 nt, Staphylococcus aureus subsp. aureus N315
ucaauuuggaaauaucuua

SEQ ID NO: 2129737 - RNA, 21 nt, Staphylococcus aureus subsp. aureus N315
ucaauuuuuucaugauuuacu

SEQ ID NO: 2129738 - RNA, 22 nt, Staphylococcus aureus subsp. aureus N315
ucacaaaauuaggcauucaucu

SEQ ID NO: 2129739 - RNA, 16 nt, Staphylococcus aureus subsp. aureus N315
ucaauuuuuacuaaau

SEQ ID NO: 2129740 - RNA, 13 nt, Staphylococcus aureus subsp. aureus N315
ucacaaagaaauu

SEQ ID NO: 2129741 - RNA, 18 nt, Staphylococcus aureus subsp. aureus N315
ucacaaauucaacuuuuc

SEQ ID NO: 2129742 - RNA, 16 nt, Staphylococcus aureus subsp. aureus N315
ucaauccuaaauuaua

SEQ ID NO: 2129743 - RNA, 13 nt, Staphylococcus aureus subsp. aureus N315
ucaauccuuuguu

SEQ ID NO: 2129744 - RNA, 21 nt, Staphylococcus aureus subsp. aureus N315
ucaauccaauuaaauauuuaa

SEQ ID NO: 2129745 - RNA, 22 nt, Staphylococcus aureus subsp. aureus N315
ucaauccaucaauaccauaauu

SEQ ID NO: 2129746 - RNA, 15 nt, Staphylococcus aureus subsp. aureus N315
ucaaucguuaauuuc

SEQ ID NO: 2129747 - RNA, 14 nt, Staphylococcus aureus subsp. aureus N315
ucaaugauuuuaua

SEQ ID NO: 2129748 - RNA, 21 nt, Staphylococcus aureus subsp. aureus N315
ucaaugauuuuauaauauuau

SEQ ID NO: 2129749 - RNA, 20 nt, Staphylococcus aureus subsp. aureus N315
ucaaugauuuuauaauauua

SEQ ID NO: 2129750 - RNA, 23 nt, Staphylococcus aureus subsp. aureus N315
ucaaugacugagaaaaauauuuc

SEQ ID NO: 2129751 - RNA, 12 nt, Staphylococcus aureus subsp. aureus N315
ucaaugacuaag

SEQ ID NO: 2129752 - RNA, 15 nt, Staphylococcus aureus subsp. aureus N315
ucaauguuauuaaac

SEQ ID NO: 2129753 - RNA, 17 nt, Staphylococcus aureus subsp. aureus N315
ucaauguuauuaaacgc

SEQ ID NO: 2129754 - RNA, 16 nt, Staphylococcus aureus subsp. aureus N315
ucaaugugagauauaa

SEQ ID NO: 2129755 - RNA, 17 nt, Staphylococcus aureus subsp. aureus N315
ucaauguaagcaacaua

SEQ ID NO: 2129756 - RNA, 17 nt, Staphylococcus aureus subsp. aureus N315
ucaauguauauuuaaca

SEQ ID NO: 2129757 - RNA, 12 nt, Staphylococcus aureus subsp. aureus N315
ucaauaaaaaug

SEQ ID NO: 2129758 - RNA, 14 nt, Staphylococcus aureus subsp. aureus N315
ucaaguuuuaagug

SEQ ID NO: 2129759 - RNA, 12 nt, Staphylococcus aureus subsp. aureus N315
ucaauaaauugu

SEQ ID NO: 2129760 - RNA, 13 nt, Staphylococcus aureus subsp. aureus N315
ucaauaaauauug

SEQ ID NO: 2129761 - RNA, 18 nt, Staphylococcus aureus subsp. aureus N315
ucaagucugcauuaauuu

SEQ ID NO: 2129762 - RNA, 20 nt, Staphylococcus aureus subsp. aureus N315
ucaaguauauccgcaucuuu

SEQ ID NO: 2129763 - RNA, 13 nt, Staphylococcus aureus subsp. aureus N315
ucaaguuuaaaau

SEQ ID NO: 2129764 - RNA, 22 nt, Staphylococcus aureus subsp. aureus N315
ucaaguuuacgaucauaaauau

SEQ ID NO: 2129765 - RNA, 20 nt, Staphylococcus aureus subsp. aureus N315
ucaaguuggugugcaauuaa

SEQ ID NO: 2129766 - RNA, 11 nt, Staphylococcus aureus subsp. aureus N315
ucaagugcuug

SEQ ID NO: 2129767 - RNA, 15 nt, Staphylococcus aureus subsp. aureus N315
ucaaguguauuaaag

SEQ ID NO: 2129768 - RNA, 17 nt, Staphylococcus aureus subsp. aureus N315
ucaagguauacacaaau

SEQ ID NO: 2129769 - RNA, 23 nt, Staphylococcus aureus subsp. aureus N315
ucaagcgcaugcuugaacuuuua

SEQ ID NO: 2129770 - RNA, 16 nt, Staphylococcus aureus subsp. aureus N315
ucaagcuagcaucaug

SEQ ID NO: 2129771 - RNA, 14 nt, Staphylococcus aureus subsp. aureus N315
ucaagcuuaauaag

SEQ ID NO: 2129772 - RNA, 14 nt, Staphylococcus aureus subsp. aureus N315
ucaaggaaaucaua

SEQ ID NO: 2129773 - RNA, 19 nt, Staphylococcus aureus subsp. aureus N315
ucaaggaaaucauauauuu

SEQ ID NO: 2129774 - RNA, 19 nt, Staphylococcus aureus subsp. aureus N315
ucaagcugagcuuuaauuu

SEQ ID NO: 2129775 - RNA, 14 nt, Staphylococcus aureus subsp. aureus N315
ucaauaauuucuug

SEQ ID NO: 2129776 - RNA, 13 nt, Staphylococcus aureus subsp. aureus N315
ucaauaauugauu

SEQ ID NO: 2129777 - RNA, 13 nt, Staphylococcus aureus subsp. aureus N315
ucaauaauuauua

SEQ ID NO: 2129778 - RNA, 14 nt, Staphylococcus aureus subsp. aureus N315
ucaauaguuucaau

SEQ ID NO: 2129779 - RNA, 14 nt, Staphylococcus aureus subsp. aureus N315
ucaauauaacauug

SEQ ID NO: 2129780 - RNA, 15 nt, Staphylococcus aureus subsp. aureus N315
ucaauagaugaaaau

SEQ ID NO: 2129781 - RNA, 23 nt, Staphylococcus aureus subsp. aureus N315
ucaauaucuguagcgauaccuuu

SEQ ID NO: 2129782 - RNA, 15 nt, Staphylococcus aureus subsp. aureus N315
ucaauaucuuuaauu

SEQ ID NO: 2129783 - RNA, 16 nt, Staphylococcus aureus subsp. aureus N315
ucaauaucacuaucag

SEQ ID NO: 2129784 - RNA, 12 nt, Staphylococcus aureus subsp. aureus N315
ucaauauuaaaa

SEQ ID NO: 2129785 - RNA, 22 nt, Staphylococcus aureus subsp. aureus N315
ucaauauuacuuuaucucauug

SEQ ID NO: 2129786 - RNA, 14 nt, Staphylococcus aureus subsp. aureus N315
ucaauauucuuauc

SEQ ID NO: 2129787 - RNA, 13 nt, Staphylococcus aureus subsp. aureus N315
ucacuguuuuauu

SEQ ID NO: 2129788 - RNA, 17 nt, Staphylococcus aureus subsp. aureus N315
ucacuguuaaagauguc

SEQ ID NO: 2129789 - RNA, 23 nt, Staphylococcus aureus subsp. aureus N315
ucacuguauggucuggaauaaau

SEQ ID NO: 2129790 - RNA, 21 nt, Staphylococcus aureus subsp. aureus N315
ucacuguauggucuggaauaa

SEQ ID NO: 2129791 - RNA, 15 nt, Staphylococcus aureus subsp. aureus N315
ucacuguagauucaa

SEQ ID NO: 2129792 - RNA, 16 nt, Staphylococcus aureus subsp. aureus N315
ucacuguagauucaaa

SEQ ID NO: 2129793 - RNA, 22 nt, Staphylococcus aureus subsp. aureus N315
ucacugcaaacacaguacaaau

SEQ ID NO: 2129794 - RNA, 23 nt, Staphylococcus aureus subsp. aureus N315
ucacugaaugcuaauacuaauca

SEQ ID NO: 2129795 - RNA, 13 nt, Staphylococcus aureus subsp. aureus N315
ucacugaaaauuu

SEQ ID NO: 2129796 - RNA, 17 nt, Staphylococcus aureus subsp. aureus N315
ucacugcacuuaugaua

SEQ ID NO: 2129797 - RNA, 17 nt, Staphylococcus aureus subsp. aureus N315
ucacugcuuucaaguaa

SEQ ID NO: 2129798 - RNA, 22 nt, Staphylococcus aureus subsp. aureus N315
ucacugcuguuuuuauuauaau

SEQ ID NO: 2129799 - RNA, 16 nt, Staphylococcus aureus subsp. aureus N315
ucacuuauuauuuugu

SEQ ID NO: 2129800 - RNA, 16 nt, Staphylococcus aureus subsp. aureus N315
ucacuguuuuauuaug

SEQ ID NO: 2129801 - RNA, 20 nt, Staphylococcus aureus subsp. aureus N315
ucacuuggauucaaaugaca

SEQ ID NO: 2129802 - RNA, 18 nt, Staphylococcus aureus subsp. aureus N315
ucacuuuaacuucuuuug

SEQ ID NO: 2129803 - RNA, 19 nt, Staphylococcus aureus subsp. aureus N315
ucacucuguaauaaagaau

SEQ ID NO: 2129804 - RNA, 22 nt, Staphylococcus aureus subsp. aureus N315
ucacucuuacucauuuuucuug

SEQ ID NO: 2129805 - RNA, 23 nt, Staphylococcus aureus subsp. aureus N315
ucacuccucuauuuuaugauuug

SEQ ID NO: 2129806 - RNA, 18 nt, Staphylococcus aureus subsp. aureus N315
ucacuagauaguuuauac

SEQ ID NO: 2129807 - RNA, 23 nt, Staphylococcus aureus subsp. aureus N315
ucacuauagccaaaggcaaaaug

SEQ ID NO: 2129808 - RNA, 13 nt, Staphylococcus aureus subsp. aureus N315
ucacuaucagcuu

SEQ ID NO: 2129809 - RNA, 23 nt, Staphylococcus aureus subsp. aureus N315
ucacgugcuucguuuuuaguguu

SEQ ID NO: 2129810 - RNA, 18 nt, Staphylococcus aureus subsp. aureus N315
ucacguugugcaauaccu

SEQ ID NO: 2129811 - RNA, 13 nt, Staphylococcus aureus subsp. aureus N315
ucacuaacucaau

SEQ ID NO: 2129812 - RNA, 17 nt, Staphylococcus aureus subsp. aureus N315
ucacuaacucaauauga

SEQ ID NO: 2129813 - RNA, 20 nt, Staphylococcus aureus subsp. aureus N315
ucacuaaaaauauauuucaa

SEQ ID NO: 2129814 - RNA, 15 nt, Staphylococcus aureus subsp. aureus N315
ucacgauaauguaua

SEQ ID NO: 2129815 - RNA, 21 nt, Staphylococcus aureus subsp. aureus N315
ucacgauauguugugcugcca

SEQ ID NO: 2129816 - RNA, 14 nt, Staphylococcus aureus subsp. aureus N315
ucacgaucaaauuu

SEQ ID NO: 2129817 - RNA, 16 nt, Staphylococcus aureus subsp. aureus N315
ucaccuuuuuuaacuu

SEQ ID NO: 2129818 - RNA, 21 nt, Staphylococcus aureus subsp. aureus N315
ucaccuuugaauauaguccuu

SEQ ID NO: 2129819 - RNA, 15 nt, Staphylococcus aureus subsp. aureus N315
ucaccuacaacacca

SEQ ID NO: 2129820 - RNA, 22 nt, Staphylococcus aureus subsp. aureus N315
ucaccugcagcauccuuaccuu

SEQ ID NO: 2129821 - RNA, 24 nt, Staphylococcus aureus subsp. aureus N315
ucaccuguagacaauuguaguaau

SEQ ID NO: 2129822 - RNA, 13 nt, Staphylococcus aureus subsp. aureus N315
ucaccuucccagu

SEQ ID NO: 2129823 - RNA, 14 nt, Staphylococcus aureus subsp. aureus N315
ucaccuucccaguc

SEQ ID NO: 2129824 - RNA, 16 nt, Staphylococcus aureus subsp. aureus N315
ucacgauuuuuaaaau

SEQ ID NO: 2129825 - RNA, 17 nt, Staphylococcus aureus subsp. aureus N315
ucacgauuaauaaaauu

SEQ ID NO: 2129826 - RNA, 14 nt, Staphylococcus aureus subsp. aureus N315
ucacgauuaauaaa

SEQ ID NO: 2129827 - RNA, 19 nt, Staphylococcus aureus subsp. aureus N315
ucacgauuuuuaaaaugcu

SEQ ID NO: 2129828 - RNA, 13 nt, Staphylococcus aureus subsp. aureus N315
ucacgccauaauc

SEQ ID NO: 2129829 - RNA, 16 nt, Staphylococcus aureus subsp. aureus N315
ucacgcuuauucgaac

SEQ ID NO: 2129830 - RNA, 19 nt, Staphylococcus aureus subsp. aureus N315
ucagaaguuguuuagaaaa

SEQ ID NO: 2129831 - RNA, 20 nt, Staphylococcus aureus subsp. aureus N315
ucagaaguuguuuagaaaag

SEQ ID NO: 2129832 - RNA, 14 nt, Staphylococcus aureus subsp. aureus N315
ucagaaauuuaaua

SEQ ID NO: 2129833 - RNA, 19 nt, Staphylococcus aureus subsp. aureus N315
ucagaaugaacuucucuua

SEQ ID NO: 2129834 - RNA, 17 nt, Staphylococcus aureus subsp. aureus N315
ucagaaugaacuucucu

SEQ ID NO: 2129835 - RNA, 15 nt, Staphylococcus aureus subsp. aureus N315
ucagaugauuuaauu

SEQ ID NO: 2129836 - RNA, 21 nt, Staphylococcus aureus subsp. aureus N315
ucagaugauuuaauucugguu

SEQ ID NO: 2129837 - RNA, 14 nt, Staphylococcus aureus subsp. aureus N315
ucagaguagaaagu

SEQ ID NO: 2129838 - RNA, 12 nt, Staphylococcus aureus subsp. aureus N315
ucagaguagaaa

SEQ ID NO: 2129839 - RNA, 14 nt, Staphylococcus aureus subsp. aureus N315
ucagccacugucau

SEQ ID NO: 2129840 - RNA, 20 nt, Staphylococcus aureus subsp. aureus N315
ucagcauugggacauaaaau

SEQ ID NO: 2129841 - RNA, 19 nt, Staphylococcus aureus subsp. aureus N315
ucagcauuaaucguauuuu

SEQ ID NO: 2129842 - RNA, 20 nt, Staphylococcus aureus subsp. aureus N315
ucagcaccgacaauuauaau

SEQ ID NO: 2129843 - RNA, 23 nt, Staphylococcus aureus subsp. aureus N315
uagaugcuggcuuaguaguugua

SEQ ID NO: 2129844 - RNA, 20 nt, Staphylococcus aureus subsp. aureus N315
uagauguguugugauuauaa

SEQ ID NO: 2129845 - RNA, 14 nt, Staphylococcus aureus subsp. aureus N315
uagaugauauuuaa

SEQ ID NO: 2129846 - RNA, 19 nt, Staphylococcus aureus subsp. aureus N315
uagaugcauaaaaaaagaa

SEQ ID NO: 2129847 - RNA, 15 nt, Staphylococcus aureus subsp. aureus N315
uagaugcauaaaaaa

SEQ ID NO: 2129848 - RNA, 23 nt, Staphylococcus aureus subsp. aureus N315
uagaugauuagugucacaaagaa

SEQ ID NO: 2129849 - RNA, 21 nt, Staphylococcus aureus subsp. aureus N315
uagaugaaugccuaauuuugu

SEQ ID NO: 2129850 - RNA, 18 nt, Staphylococcus aureus subsp. aureus N315
uagaugaaugccuaauuu

SEQ ID NO: 2129851 - RNA, 11 nt, Staphylococcus aureus subsp. aureus N315
uagaugaaaug

SEQ ID NO: 2129852 - RNA, 18 nt, Staphylococcus aureus subsp. aureus N315
uagaaaaggcucauuugu

SEQ ID NO: 2129853 - RNA, 22 nt, Staphylococcus aureus subsp. aureus N315
uagaaaauaugacgaucuucau

SEQ ID NO: 2129854 - RNA, 19 nt, Staphylococcus aureus subsp. aureus N315
uagaaaaguaaguaaaaua

SEQ ID NO: 2129855 - RNA, 15 nt, Staphylococcus aureus subsp. aureus N315
uagaaaaauuucaaa

SEQ ID NO: 2129856 - RNA, 13 nt, Staphylococcus aureus subsp. aureus N315
uagauugaaaaaa

SEQ ID NO: 2129857 - RNA, 20 nt, Staphylococcus aureus subsp. aureus N315
uagauucugauacagaacca

SEQ ID NO: 2129858 - RNA, 16 nt, Staphylococcus aureus subsp. aureus N315
uagauugauuguauuu

SEQ ID NO: 2129859 - RNA, 18 nt, Staphylococcus aureus subsp. aureus N315
uagauugacuaaguuugu

SEQ ID NO: 2129860 - RNA, 18 nt, Staphylococcus aureus subsp. aureus N315
uagauuguauuuaauaag

SEQ ID NO: 2129861 - RNA, 15 nt, Staphylococcus aureus subsp. aureus N315
uagauuaucuuucaa

SEQ ID NO: 2129862 - RNA, 17 nt, Staphylococcus aureus subsp. aureus N315
uagauuuaggagagcca

SEQ ID NO: 2129863 - RNA, 13 nt, Staphylococcus aureus subsp. aureus N315
uagauuuaaaaug

SEQ ID NO: 2129864 - RNA, 14 nt, Staphylococcus aureus subsp. aureus N315
uagauuuacgguua

SEQ ID NO: 2129865 - RNA, 14 nt, Staphylococcus aureus subsp. aureus N315
uagauuuauaacga

SEQ ID NO: 2129866 - RNA, 19 nt, Staphylococcus aureus subsp. aureus N315
uagauuuaucaccuuuagg

SEQ ID NO: 2129867 - RNA, 14 nt, Staphylococcus aureus subsp. aureus N315
uagauuuguguguc

SEQ ID NO: 2129868 - RNA, 14 nt, Staphylococcus aureus subsp. aureus N315
uagauuuuauauaa

SEQ ID NO: 2129869 - RNA, 17 nt, Staphylococcus aureus subsp. aureus N315
uagauuuuauauaaaaa

SEQ ID NO: 2129870 - RNA, 18 nt, Staphylococcus aureus subsp. aureus N315
uagauuuuaugcuuuacu

SEQ ID NO: 2129871 - RNA, 19 nt, Staphylococcus aureus subsp. aureus N315
uagauuuuguauuagcauc

SEQ ID NO: 2129872 - RNA, 17 nt, Staphylococcus aureus subsp. aureus N315
uagccccaguauagaag

SEQ ID NO: 2129873 - RNA, 15 nt, Staphylococcus aureus subsp. aureus N315
uagcauugccccauc

SEQ ID NO: 2129874 - RNA, 19 nt, Staphylococcus aureus subsp. aureus N315
uagcauuccuaauuauauu

SEQ ID NO: 2129875 - RNA, 19 nt, Staphylococcus aureus subsp. aureus N315
uagcauuacgccaccaguu

SEQ ID NO: 2129876 - RNA, 14 nt, Staphylococcus aureus subsp. aureus N315
uagcauuauuugcu

SEQ ID NO: 2129877 - RNA, 15 nt, Staphylococcus aureus subsp. aureus N315
uagcauuauuugcug

SEQ ID NO: 2129878 - RNA, 18 nt, Staphylococcus aureus subsp. aureus N315
uagcaugauaaaguaugu

SEQ ID NO: 2129879 - RNA, 17 nt, Staphylococcus aureus subsp. aureus N315
uagcauguuuugagcaa

SEQ ID NO: 2129880 - RNA, 21 nt, Staphylococcus aureus subsp. aureus N315
uagcaaaauuauguaaaaaau

SEQ ID NO: 2129881 - RNA, 16 nt, Staphylococcus aureus subsp. aureus N315
uagcaaaauuauguaa

SEQ ID NO: 2129882 - RNA, 17 nt, Staphylococcus aureus subsp. aureus N315
uagcaaauauuauuaaa

SEQ ID NO: 2129883 - RNA, 15 nt, Staphylococcus aureus subsp. aureus N315
uagcaaauauuucug

SEQ ID NO: 2129884 - RNA, 17 nt, Staphylococcus aureus subsp. aureus N315
uagcaaauauuucuggc

SEQ ID NO: 2129885 - RNA, 16 nt, Staphylococcus aureus subsp. aureus N315
uagcaacugaucauuu

SEQ ID NO: 2129886 - RNA, 19 nt, Staphylococcus aureus subsp. aureus N315
uagcaagaauagauugauu

SEQ ID NO: 2129887 - RNA, 21 nt, Staphylococcus aureus subsp. aureus N315
uaggacauauaaauguugacu

SEQ ID NO: 2129888 - RNA, 16 nt, Staphylococcus aureus subsp. aureus N315
uaggacuaucuauaau

SEQ ID NO: 2129889 - RNA, 18 nt, Staphylococcus aureus subsp. aureus N315
uagcuauauuuuuguauu

SEQ ID NO: 2129890 - RNA, 13 nt, Staphylococcus aureus subsp. aureus N315
uagcuauuaaaau

SEQ ID NO: 2129891 - RNA, 21 nt, Staphylococcus aureus subsp. aureus N315
uagcuuagucaauguauauuu

SEQ ID NO: 2129892 - RNA, 20 nt, Staphylococcus aureus subsp. aureus N315
uaggagagauguauaaaacu

SEQ ID NO: 2129893 - RNA, 18 nt, Staphylococcus aureus subsp. aureus N315
uaggauuuccggaacaau

SEQ ID NO: 2129894 - RNA, 22 nt, Staphylococcus aureus subsp. aureus N315
uagcgcucuggauuuuucuuau

SEQ ID NO: 2129895 - RNA, 17 nt, Staphylococcus aureus subsp. aureus N315
uagcuacaauuaaagug

SEQ ID NO: 2129896 - RNA, 15 nt, Staphylococcus aureus subsp. aureus N315
uagcguaauuauuau

SEQ ID NO: 2129897 - RNA, 14 nt, Staphylococcus aureus subsp. aureus N315
uaguacacguguau

SEQ ID NO: 2129898 - RNA, 17 nt, Staphylococcus aureus subsp. aureus N315
uaguaauuuuuaaaucu

SEQ ID NO: 2129899 - RNA, 23 nt, Staphylococcus aureus subsp. aureus N315
uaguaauucuucaucuucuucaa

SEQ ID NO: 2129900 - RNA, 20 nt, Staphylococcus aureus subsp. aureus N315
uaguaauaacaucuaaauuu

SEQ ID NO: 2129901 - RNA, 19 nt, Staphylococcus aureus subsp. aureus N315
uaguaauaacaucuaaauu

SEQ ID NO: 2129902 - RNA, 18 nt, Staphylococcus aureus subsp. aureus N315
uaguaacucaacauuuuu

SEQ ID NO: 2129903 - RNA, 22 nt, Staphylococcus aureus subsp. aureus N315
uaguaaugaugugaauuggauu

SEQ ID NO: 2129904 - RNA, 15 nt, Staphylococcus aureus subsp. aureus N315
uaguaaacuaauccu

SEQ ID NO: 2129905 - RNA, 15 nt, Staphylococcus aureus subsp. aureus N315
uaguaaaaccuguau

SEQ ID NO: 2129906 - RNA, 22 nt, Staphylococcus aureus subsp. aureus N315
uaguaaaaccuguaucuuaaau

SEQ ID NO: 2129907 - RNA, 12 nt, Staphylococcus aureus subsp. aureus N315
uagguuagaauu

SEQ ID NO: 2129908 - RNA, 16 nt, Staphylococcus aureus subsp. aureus N315
uagguugauuucugcu

SEQ ID NO: 2129909 - RNA, 16 nt, Staphylococcus aureus subsp. aureus N315
uagguuuaauuuuaaa

SEQ ID NO: 2129910 - RNA, 17 nt, Staphylococcus aureus subsp. aureus N315
uagguuuaauuuuaaau

SEQ ID NO: 2129911 - RNA, 23 nt, Staphylococcus aureus subsp. aureus N315
uaguccggggccccaacaaagaa

SEQ ID NO: 2129912 - RNA, 16 nt, Staphylococcus aureus subsp. aureus N315
uaguccggggccccaa

SEQ ID NO: 2129913 - RNA, 14 nt, Staphylococcus aureus subsp. aureus N315
uagucauaauuuaa

SEQ ID NO: 2129914 - RNA, 16 nt, Staphylococcus aureus subsp. aureus N315
uagucauaauuuaaaa

SEQ ID NO: 2129915 - RNA, 12 nt, Staphylococcus aureus subsp. aureus N315
uagucauguuug

SEQ ID NO: 2129916 - RNA, 15 nt, Staphylococcus aureus subsp. aureus N315
uagucauuacauuuu

SEQ ID NO: 2129917 - RNA, 15 nt, Staphylococcus aureus subsp. aureus N315
uaguauuauagccua

SEQ ID NO: 2129918 - RNA, 19 nt, Staphylococcus aureus subsp. aureus N315
uaguauucaaaaaauauuu

SEQ ID NO: 2129919 - RNA, 22 nt, Staphylococcus aureus subsp. aureus N315
uaguauuucaucauuaguuuuu

SEQ ID NO: 2129920 - RNA, 17 nt, Staphylococcus aureus subsp. aureus N315
uagucaauuaaugauaa

SEQ ID NO: 2129921 - RNA, 15 nt, Staphylococcus aureus subsp. aureus N315
uaguagcuugaauag

SEQ ID NO: 2129922 - RNA, 19 nt, Staphylococcus aureus subsp. aureus N315
uaguaguuuauaucaaaaa

SEQ ID NO: 2129923 - RNA, 16 nt, Staphylococcus aureus subsp. aureus N315
uaguagauuuauuaaa

SEQ ID NO: 2129924 - RNA, 16 nt, Staphylococcus aureus subsp. aureus N315
uaguacucaauguuag

SEQ ID NO: 2129925 - RNA, 18 nt, Staphylococcus aureus subsp. aureus N315
uaguacggcugcuuuaac

SEQ ID NO: 2129926 - RNA, 22 nt, Staphylococcus aureus subsp. aureus N315
uaguacuuugauaucuacagag

SEQ ID NO: 2129927 - RNA, 20 nt, Staphylococcus aureus subsp. aureus N315
uaguagauuuauuaaauaua

SEQ ID NO: 2129928 - RNA, 14 nt, Staphylococcus aureus subsp. aureus N315
uauaaguuaaaauu

SEQ ID NO: 2129929 - RNA, 14 nt, Staphylococcus aureus subsp. aureus N315
uauaaguuaaaaau

SEQ ID NO: 2129930 - RNA, 20 nt, Staphylococcus aureus subsp. aureus N315
uauaagugauuucuucauua

SEQ ID NO: 2129931 - RNA, 19 nt, Staphylococcus aureus subsp. aureus N315
uauaaguuugguucaguag

SEQ ID NO: 2129932 - RNA, 18 nt, Staphylococcus aureus subsp. aureus N315
uauaaguugcauauaaaa

SEQ ID NO: 2129933 - RNA, 22 nt, Staphylococcus aureus subsp. aureus N315
uauaagggguauauuaaaaauu

SEQ ID NO: 2129934 - RNA, 20 nt, Staphylococcus aureus subsp. aureus N315
uauaagggguauauuaaaaa

SEQ ID NO: 2129935 - RNA, 23 nt, Staphylococcus aureus subsp. aureus N315
uauaaguagugauuuuuuacauu

SEQ ID NO: 2129936 - RNA, 23 nt, Staphylococcus aureus subsp. aureus N315
uauaaguaucgccaucauucacc

SEQ ID NO: 2129937 - RNA, 12 nt, Staphylococcus aureus subsp. aureus N315
uauaaguacaaa

SEQ ID NO: 2129938 - RNA, 14 nt, Staphylococcus aureus subsp. aureus N315
uauaaguacaaaua

SEQ ID NO: 2129939 - RNA, 13 nt, Staphylococcus aureus subsp. aureus N315
uauaaguaaauaa

SEQ ID NO: 2129940 - RNA, 18 nt, Staphylococcus aureus subsp. aureus N315
uauaaguauuuuaggguu

SEQ ID NO: 2129941 - RNA, 15 nt, Staphylococcus aureus subsp. aureus N315
uauaaguacaaauaa

SEQ ID NO: 2129942 - RNA, 15 nt, Staphylococcus aureus subsp. aureus N315
uauaagccuuuucaa

SEQ ID NO: 2129943 - RNA, 16 nt, Staphylococcus aureus subsp. aureus N315
uauaagauucauauuu

SEQ ID NO: 2129944 - RNA, 22 nt, Staphylococcus aureus subsp. aureus N315
uauaagcuuuuucuuucucuaa

SEQ ID NO: 2129945 - RNA, 20 nt, Staphylococcus aureus subsp. aureus N315
uauaagccuuuucaaacaua

SEQ ID NO: 2129946 - RNA, 16 nt, Staphylococcus aureus subsp. aureus N315
uauaacuuuaaaaauu

SEQ ID NO: 2129947 - RNA, 18 nt, Staphylococcus aureus subsp. aureus N315
uauaacuuuaaaaauuaa

SEQ ID NO: 2129948 - RNA, 13 nt, Staphylococcus aureus subsp. aureus N315
uauaacuuuaaaa

SEQ ID NO: 2129949 - RNA, 20 nt, Staphylococcus aureus subsp. aureus N315
uauaagaauuguugaucaug

SEQ ID NO: 2129950 - RNA, 22 nt, Staphylococcus aureus subsp. aureus N315
uauaagaauuguugaucaugag

SEQ ID NO: 2129951 - RNA, 21 nt, Staphylococcus aureus subsp. aureus N315
uauaaccgugaugaugugcaa

SEQ ID NO: 2129952 - RNA, 24 nt, Staphylococcus aureus subsp. aureus N315
uauaaccuuguucuuuacuccaaa

SEQ ID NO: 2129953 - RNA, 15 nt, Staphylococcus aureus subsp. aureus N315
uauaaccuauuaaau

SEQ ID NO: 2129954 - RNA, 13 nt, Staphylococcus aureus subsp. aureus N315
uauaaccauaaug

SEQ ID NO: 2129955 - RNA, 21 nt, Staphylococcus aureus subsp. aureus N315
uauaacccuaauguguggauu

SEQ ID NO: 2129956 - RNA, 23 nt, Staphylococcus aureus subsp. aureus N315
uauaacccucguaggcauaggcu

SEQ ID NO: 2129957 - RNA, 15 nt, Staphylococcus aureus subsp. aureus N315
uauaacgcuuuaaua

SEQ ID NO: 2129958 - RNA, 18 nt, Staphylococcus aureus subsp. aureus N315
uauaacgcuuuaauauaa

SEQ ID NO: 2129959 - RNA, 18 nt, Staphylococcus aureus subsp. aureus N315
uauaacugauaauacugu

SEQ ID NO: 2129960 - RNA, 20 nt, Staphylococcus aureus subsp. aureus N315
uauaacugcauguacaucuu

SEQ ID NO: 2129961 - RNA, 12 nt, Staphylococcus aureus subsp. aureus N315
uauaacauuaaa

SEQ ID NO: 2129962 - RNA, 16 nt, Staphylococcus aureus subsp. aureus N315
uauaacauucuucaaa

SEQ ID NO: 2129963 - RNA, 20 nt, Staphylococcus aureus subsp. aureus N315
uauaacauucuucaaaaaau

SEQ ID NO: 2129964 - RNA, 21 nt, Staphylococcus aureus subsp. aureus N315
uauaacauucuucaaaaaaua

SEQ ID NO: 2129965 - RNA, 16 nt, Staphylococcus aureus subsp. aureus N315
uauaacaccaauuaaa

SEQ ID NO: 2129966 - RNA, 18 nt, Staphylococcus aureus subsp. aureus N315
uauaacaauaguuuucuu

SEQ ID NO: 2129967 - RNA, 18 nt, Staphylococcus aureus subsp. aureus N315
uauaacacgauaauuaua

SEQ ID NO: 2129968 - RNA, 20 nt, Staphylococcus aureus subsp. aureus N315
uauaacaacuacuuaaauua

SEQ ID NO: 2129969 - RNA, 18 nt, Staphylococcus aureus subsp. aureus N315
uauaaaguugacaauaca

SEQ ID NO: 2129970 - RNA, 15 nt, Staphylococcus aureus subsp. aureus N315
uauaaauuuugaauu

SEQ ID NO: 2129971 - RNA, 18 nt, Staphylococcus aureus subsp. aureus N315
uauaaaggaauagcuaca

SEQ ID NO: 2129972 - RNA, 23 nt, Staphylococcus aureus subsp. aureus N315
uauaaagcuagggugaauuagua

SEQ ID NO: 2129973 - RNA, 18 nt, Staphylococcus aureus subsp. aureus N315
uauaaagacgauuuauua

SEQ ID NO: 2129974 - RNA, 10 nt, Staphylococcus aureus subsp. aureus N315
uauaaagaau

SEQ ID NO: 2129975 - RNA, 20 nt, Staphylococcus aureus subsp. aureus N315
uauaaagaaugauuuauaaa

SEQ ID NO: 2129976 - RNA, 23 nt, Staphylococcus aureus subsp. aureus N315
uauaaagaaugauuuauaaaaaa

SEQ ID NO: 2129977 - RNA, 21 nt, Staphylococcus aureus subsp. aureus N315
uauaaagaaauaauuuaaagg

SEQ ID NO: 2129978 - RNA, 13 nt, Staphylococcus aureus subsp. aureus N315
uauaaagaaauaa

SEQ ID NO: 2129979 - RNA, 21 nt, Staphylococcus aureus subsp. aureus N315
uauaaaauaugagauuaucug

SEQ ID NO: 2129980 - RNA, 21 nt, Staphylococcus aureus subsp. aureus N315
uauaaacgucacuuuauuaaa

SEQ ID NO: 2129981 - RNA, 20 nt, Staphylococcus aureus subsp. aureus N315
uauaaaaagaucauuaaaaa

SEQ ID NO: 2129982 - RNA, 17 nt, Staphylococcus aureus subsp. aureus N315
uauaaaacgauaagaau

SEQ ID NO: 2129983 - RNA, 22 nt, Staphylococcus aureus subsp. aureus N315
uauaaaacagaauuucaucaaa

SEQ ID NO: 2129984 - RNA, 22 nt, Staphylococcus aureus subsp. aureus N315
uauaaaaagugaagauauuuau

SEQ ID NO: 2129985 - RNA, 20 nt, Staphylococcus aureus subsp. aureus N315
uauaaaacgauaagaauuaa

SEQ ID NO: 2129986 - RNA, 14 nt, Staphylococcus aureus subsp. aureus N315
uauaaaauaaaaug

SEQ ID NO: 2129987 - RNA, 16 nt, Staphylococcus aureus subsp. aureus N315
uaguuguccauuuuau

SEQ ID NO: 2129988 - RNA, 14 nt, Staphylococcus aureus subsp. aureus N315
uaguuuagguugau

SEQ ID NO: 2129989 - RNA, 13 nt, Staphylococcus aureus subsp. aureus N315
uaguuuauaaauu

SEQ ID NO: 2129990 - RNA, 22 nt, Staphylococcus aureus subsp. aureus N315
uagugcucuugcaauagcaaca

SEQ ID NO: 2129991 - RNA, 13 nt, Staphylococcus aureus subsp. aureus N315
uagugcucuugca

SEQ ID NO: 2129992 - RNA, 17 nt, Staphylococcus aureus subsp. aureus N315
uagugcaaguaauuuaa

SEQ ID NO: 2129993 - RNA, 21 nt, Staphylococcus aureus subsp. aureus N315
uaguugccccuagcaaaaaua

SEQ ID NO: 2129994 - RNA, 17 nt, Staphylococcus aureus subsp. aureus N315
uaguucuguugauauuu

SEQ ID NO: 2129995 - RNA, 18 nt, Staphylococcus aureus subsp. aureus N315
uaguucuggcaaagaauc

SEQ ID NO: 2129996 - RNA, 19 nt, Staphylococcus aureus subsp. aureus N315
uaguucuggcaaagaaucc

SEQ ID NO: 2129997 - RNA, 21 nt, Staphylococcus aureus subsp. aureus N315
uaucgcuuuugaaguuggucc

SEQ ID NO: 2129998 - RNA, 19 nt, Staphylococcus aureus subsp. aureus N315
uaucgccuaaaaauaaaau

SEQ ID NO: 2129999 - RNA, 18 nt, Staphylococcus aureus subsp. aureus N315
uaucgccuggugcaggca

SEQ ID NO: 2130000 - RNA, 17 nt, Staphylococcus aureus subsp. aureus N315
uauccucgguauuuaau

SEQ ID NO: 2130001 - RNA, 14 nt, Staphylococcus aureus subsp. aureus N315
uauccugauuuaau

SEQ ID NO: 2130002 - RNA, 17 nt, Staphylococcus aureus subsp. aureus N315
uaucgugaagaaaaaau

SEQ ID NO: 2130003 - RNA, 16 nt, Staphylococcus aureus subsp. aureus N315
uaucguaaacaacauc

SEQ ID NO: 2130004 - RNA, 23 nt, Staphylococcus aureus subsp. aureus N315
uaucuccgcuacaauuauaugua

SEQ ID NO: 2130005 - RNA, 18 nt, Staphylococcus aureus subsp. aureus N315
uaucuccgcuacaauuau

SEQ ID NO: 2130006 - RNA, 17 nt, Staphylococcus aureus subsp. aureus N315
uaucauuuaaaauauuu

SEQ ID NO: 2130007 - RNA, 18 nt, Staphylococcus aureus subsp. aureus N315
uaucauuguucauacgcu

SEQ ID NO: 2130008 - RNA, 23 nt, Staphylococcus aureus subsp. aureus N315
uaucauuuggcguucaacauuac

SEQ ID NO: 2130009 - RNA, 13 nt, Staphylococcus aureus subsp. aureus N315
uauccaaagacau

SEQ ID NO: 2130010 - RNA, 19 nt, Staphylococcus aureus subsp. aureus N315
uauccaaggauguuauaaa

SEQ ID NO: 2130011 - RNA, 20 nt, Staphylococcus aureus subsp. aureus N315
uauccauucaauguuuaauu

SEQ ID NO: 2130012 - RNA, 19 nt, Staphylococcus aureus subsp. aureus N315
uauccuaagcauaauucaa

SEQ ID NO: 2130013 - RNA, 17 nt, Staphylococcus aureus subsp. aureus N315
uauaugauguucaauau

SEQ ID NO: 2130014 - RNA, 18 nt, Staphylococcus aureus subsp. aureus N315
uauaugauuaauuagccu

SEQ ID NO: 2130015 - RNA, 15 nt, Staphylococcus aureus subsp. aureus N315
uauauggcaucauca

SEQ ID NO: 2130016 - RNA, 17 nt, Staphylococcus aureus subsp. aureus N315
uauauuuauuuuugaua

SEQ ID NO: 2130017 - RNA, 16 nt, Staphylococcus aureus subsp. aureus N315
uauauuuauuuuugau

SEQ ID NO: 2130018 - RNA, 23 nt, Staphylococcus aureus subsp. aureus N315
uauauguaggggagucuuauuuu

SEQ ID NO: 2130019 - RNA, 21 nt, Staphylococcus aureus subsp. aureus N315
uauaugucucucuuucuuauu

SEQ ID NO: 2130020 - RNA, 18 nt, Staphylococcus aureus subsp. aureus N315
uauauuuuauuuaaaaau

SEQ ID NO: 2130021 - RNA, 22 nt, Staphylococcus aureus subsp. aureus N315
uauauuucgguauuuuaaauuu

SEQ ID NO: 2130022 - RNA, 15 nt, Staphylococcus aureus subsp. aureus N315
uauauuuuaugucaa

SEQ ID NO: 2130023 - RNA, 19 nt, Staphylococcus aureus subsp. aureus N315
uauauuuuauuagaauauu

SEQ ID NO: 2130024 - RNA, 14 nt, Staphylococcus aureus subsp. aureus N315
uauauuuuuauuaa

SEQ ID NO: 2130025 - RNA, 16 nt, Staphylococcus aureus subsp. aureus N315
uauauuuuuguauuua

SEQ ID NO: 2130026 - RNA, 18 nt, Staphylococcus aureus subsp. aureus N315
uauauuuuuagcuuuauu

SEQ ID NO: 2130027 - RNA, 22 nt, Staphylococcus aureus subsp. aureus N315
uauauuuuuagcuuuauuauuu

SEQ ID NO: 2130028 - RNA, 16 nt, Staphylococcus aureus subsp. aureus N315
uaucaacauaauauuu

SEQ ID NO: 2130029 - RNA, 18 nt, Staphylococcus aureus subsp. aureus N315
uaucaacauaaaauuuaa

SEQ ID NO: 2130030 - RNA, 20 nt, Staphylococcus aureus subsp. aureus N315
uaucaacauuaauaaauaau

SEQ ID NO: 2130031 - RNA, 15 nt, Staphylococcus aureus subsp. aureus N315
uaucaacauauuuau

SEQ ID NO: 2130032 - RNA, 15 nt, Staphylococcus aureus subsp. aureus N315
uaucaacauuaauaa

SEQ ID NO: 2130033 - RNA, 19 nt, Staphylococcus aureus subsp. aureus N315
uaucaagaacuuuaaaaau

SEQ ID NO: 2130034 - RNA, 13 nt, Staphylococcus aureus subsp. aureus N315
uaucaagaaaaag

SEQ ID NO: 2130035 - RNA, 16 nt, Staphylococcus aureus subsp. aureus N315
uaucaagaaaaaguuu

SEQ ID NO: 2130036 - RNA, 15 nt, Staphylococcus aureus subsp. aureus N315
uaucacuaucagcuu

SEQ ID NO: 2130037 - RNA, 21 nt, Staphylococcus aureus subsp. aureus N315
uaucaagaaaaaguuuuucug

SEQ ID NO: 2130038 - RNA, 17 nt, Staphylococcus aureus subsp. aureus N315
uaucacgagcuuuuaaa

SEQ ID NO: 2130039 - RNA, 15 nt, Staphylococcus aureus subsp. aureus N315
uaucaccuaauugaa

SEQ ID NO: 2130040 - RNA, 17 nt, Staphylococcus aureus subsp. aureus N315
uaucacuuuucaugaug

SEQ ID NO: 2130041 - RNA, 13 nt, Staphylococcus aureus subsp. aureus N315
uaucacuuauuau

SEQ ID NO: 2130042 - RNA, 23 nt, Staphylococcus aureus subsp. aureus N315
uauauaaaguugacaauacaaau

SEQ ID NO: 2130043 - RNA, 20 nt, Staphylococcus aureus subsp. aureus N315
uauauaacaaguacaauaau

SEQ ID NO: 2130044 - RNA, 14 nt, Staphylococcus aureus subsp. aureus N315
uauauaacacaaua

SEQ ID NO: 2130045 - RNA, 18 nt, Staphylococcus aureus subsp. aureus N315
uauauaauuuauaaaaag

SEQ ID NO: 2130046 - RNA, 13 nt, Staphylococcus aureus subsp. aureus N315
uauauaauugauu

SEQ ID NO: 2130047 - RNA, 14 nt, Staphylococcus aureus subsp. aureus N315
uauauaauuuaaag

SEQ ID NO: 2130048 - RNA, 23 nt, Staphylococcus aureus subsp. aureus N315
uauauaaugguucuauaauaaau

SEQ ID NO: 2130049 - RNA, 16 nt, Staphylococcus aureus subsp. aureus N315
uauaguuggcaauccu

SEQ ID NO: 2130050 - RNA, 14 nt, Staphylococcus aureus subsp. aureus N315
uauauaaaaacugu

SEQ ID NO: 2130051 - RNA, 21 nt, Staphylococcus aureus subsp. aureus N315
uauauaaaguugacaauacaa

SEQ ID NO: 2130052 - RNA, 22 nt, Staphylococcus aureus subsp. aureus N315
uauauaaagaaauaauuuaaag

SEQ ID NO: 2130053 - RNA, 15 nt, Staphylococcus aureus subsp. aureus N315
uauauaaacaaaaau

SEQ ID NO: 2130054 - RNA, 20 nt, Staphylococcus aureus subsp. aureus N315
uauauaaaauuucauauugu

SEQ ID NO: 2130055 - RNA, 19 nt, Staphylococcus aureus subsp. aureus N315
uauaucaaauacauuucaa

SEQ ID NO: 2130056 - RNA, 14 nt, Staphylococcus aureus subsp. aureus N315
uauauauuuugcaa

SEQ ID NO: 2130057 - RNA, 20 nt, Staphylococcus aureus subsp. aureus N315
uauauauucguuacaaauga

SEQ ID NO: 2130058 - RNA, 21 nt, Staphylococcus aureus subsp. aureus N315
uauauauuccacgcucacauu

SEQ ID NO: 2130059 - RNA, 14 nt, Staphylococcus aureus subsp. aureus N315
uauauauucaauaa

SEQ ID NO: 2130060 - RNA, 15 nt, Staphylococcus aureus subsp. aureus N315
uauauauuaaaacaa

SEQ ID NO: 2130061 - RNA, 20 nt, Staphylococcus aureus subsp. aureus N315
uauauacaaugacagcagac

SEQ ID NO: 2130062 - RNA, 16 nt, Staphylococcus aureus subsp. aureus N315
uauauccaguaaaguu

SEQ ID NO: 2130063 - RNA, 15 nt, Staphylococcus aureus subsp. aureus N315
uauaucaacguuaau

SEQ ID NO: 2130064 - RNA, 23 nt, Staphylococcus aureus subsp. aureus N315
uauaucacaacacauaaauuaag

SEQ ID NO: 2130065 - RNA, 14 nt, Staphylococcus aureus subsp. aureus N315
uauagugguaaaaa

SEQ ID NO: 2130066 - RNA, 15 nt, Staphylococcus aureus subsp. aureus N315
uauagucuuaaacau

SEQ ID NO: 2130067 - RNA, 16 nt, Staphylococcus aureus subsp. aureus N315
uauagucuuaaacaua

SEQ ID NO: 2130068 - RNA, 20 nt, Staphylococcus aureus subsp. aureus N315
uauaguugagcguuuaauua

SEQ ID NO: 2130069 - RNA, 19 nt, Staphylococcus aureus subsp. aureus N315
uauaguguuuuauucgaua

SEQ ID NO: 2130070 - RNA, 13 nt, Staphylococcus aureus subsp. aureus N315
uauagucauucau

SEQ ID NO: 2130071 - RNA, 23 nt, Staphylococcus aureus subsp. aureus N315
uauaguccuucccacuuaucauc

SEQ ID NO: 2130072 - RNA, 18 nt, Staphylococcus aureus subsp. aureus N315
uauaguaauagcuauauu

SEQ ID NO: 2130073 - RNA, 16 nt, Staphylococcus aureus subsp. aureus N315
uauaguaauuguuaua

SEQ ID NO: 2130074 - RNA, 23 nt, Staphylococcus aureus subsp. aureus N315
uauaguaggguauugaaauaaua

SEQ ID NO: 2130075 - RNA, 21 nt, Staphylococcus aureus subsp. aureus N315
uauaaugauugucuuauaaga

SEQ ID NO: 2130076 - RNA, 21 nt, Staphylococcus aureus subsp. aureus N315
uauaauggacgguauuuucaa

SEQ ID NO: 2130077 - RNA, 17 nt, Staphylococcus aureus subsp. aureus N315
uauaaugccaaauauag

SEQ ID NO: 2130078 - RNA, 15 nt, Staphylococcus aureus subsp. aureus N315
uauagguuuauaaaa

SEQ ID NO: 2130079 - RNA, 16 nt, Staphylococcus aureus subsp. aureus N315
uauaguaaaauaaaua

SEQ ID NO: 2130080 - RNA, 14 nt, Staphylococcus aureus subsp. aureus N315
uauaguaagaaaag

SEQ ID NO: 2130081 - RNA, 18 nt, Staphylococcus aureus subsp. aureus N315
uauaaucuaucuugugcu

SEQ ID NO: 2130082 - RNA, 14 nt, Staphylococcus aureus subsp. aureus N315
uauaaucuaucuug

SEQ ID NO: 2130083 - RNA, 18 nt, Staphylococcus aureus subsp. aureus N315
uaugccaaauaacguuaa

SEQ ID NO: 2130084 - RNA, 15 nt, Staphylococcus aureus subsp. aureus N315
uaugccauucauuaa

SEQ ID NO: 2130085 - RNA, 22 nt, Staphylococcus aureus subsp. aureus N315
uaugccgauugcucuaauccaa

SEQ ID NO: 2130086 - RNA, 14 nt, Staphylococcus aureus subsp. aureus N315
uauggaaauggugg

SEQ ID NO: 2130087 - RNA, 22 nt, Staphylococcus aureus subsp. aureus N315
uaugcuuuacuugcuuuuucaa

SEQ ID NO: 2130088 - RNA, 22 nt, Staphylococcus aureus subsp. aureus N315
uaugcuguuggcaaaacaauau

SEQ ID NO: 2130089 - RNA, 21 nt, Staphylococcus aureus subsp. aureus N315
uaugcuguguaucaucauaau

SEQ ID NO: 2130090 - RNA, 21 nt, Staphylococcus aureus subsp. aureus N315
uaugcuguuggcaaaacaaua

SEQ ID NO: 2130091 - RNA, 17 nt, Staphylococcus aureus subsp. aureus N315
uaugcuguguaucauca

SEQ ID NO: 2130092 - RNA, 19 nt, Staphylococcus aureus subsp. aureus N315
uaugcugcaagucucauau

SEQ ID NO: 2130093 - RNA, 21 nt, Staphylococcus aureus subsp. aureus N315
uaugcucuacaaaguuauaau

SEQ ID NO: 2130094 - RNA, 16 nt, Staphylococcus aureus subsp. aureus N315
uauggauaaaauuuaa

SEQ ID NO: 2130095 - RNA, 13 nt, Staphylococcus aureus subsp. aureus N315
uauggagcggaag

SEQ ID NO: 2130096 - RNA, 21 nt, Staphylococcus aureus subsp. aureus N315
uauggcgcaauuuuuaacaaa

SEQ ID NO: 2130097 - RNA, 14 nt, Staphylococcus aureus subsp. aureus N315
uauggcgguuugaa

SEQ ID NO: 2130098 - RNA, 17 nt, Staphylococcus aureus subsp. aureus N315
uauguucagaaauuuaa

SEQ ID NO: 2130099 - RNA, 16 nt, Staphylococcus aureus subsp. aureus N315
uauguuauguaaauaa

SEQ ID NO: 2130100 - RNA, 20 nt, Staphylococcus aureus subsp. aureus N315
uauguuaaugucuuaaaauu

SEQ ID NO: 2130101 - RNA, 15 nt, Staphylococcus aureus subsp. aureus N315
uauguuauaaauucu

SEQ ID NO: 2130102 - RNA, 20 nt, Staphylococcus aureus subsp. aureus N315
uauguguugugauauauagu

SEQ ID NO: 2130103 - RNA, 15 nt, Staphylococcus aureus subsp. aureus N315
uauguguuucuagcu

SEQ ID NO: 2130104 - RNA, 20 nt, Staphylococcus aureus subsp. aureus N315
uaugucuuaacaacaugauu

SEQ ID NO: 2130105 - RNA, 16 nt, Staphylococcus aureus subsp. aureus N315
uauguggauacaaacc

SEQ ID NO: 2130106 - RNA, 17 nt, Staphylococcus aureus subsp. aureus N315
uauuaaaauaaaccacg

SEQ ID NO: 2130107 - RNA, 13 nt, Staphylococcus aureus subsp. aureus N315
uauuaaaaauccu

SEQ ID NO: 2130108 - RNA, 15 nt, Staphylococcus aureus subsp. aureus N315
uauguuuuauaauaa

SEQ ID NO: 2130109 - RNA, 13 nt, Staphylococcus aureus subsp. aureus N315
uauguuuuaucaa

SEQ ID NO: 2130110 - RNA, 15 nt, Staphylococcus aureus subsp. aureus N315
uauguuuuauuuucu

SEQ ID NO: 2130111 - RNA, 20 nt, Staphylococcus aureus subsp. aureus N315
uauguuuuaucaauauuagu

SEQ ID NO: 2130112 - RNA, 21 nt, Staphylococcus aureus subsp. aureus N315
uauguugucauaccaaauaaa

SEQ ID NO: 2130113 - RNA, 20 nt, Staphylococcus aureus subsp. aureus N315
uauguugugcugccaaauau

SEQ ID NO: 2130114 - RNA, 22 nt, Staphylococcus aureus subsp. aureus N315
uaugguauuuacccaacauauc

SEQ ID NO: 2130115 - RNA, 13 nt, Staphylococcus aureus subsp. aureus N315
uaugguuagagaa

SEQ ID NO: 2130116 - RNA, 15 nt, Staphylococcus aureus subsp. aureus N315
uaugguuagagaaaa

SEQ ID NO: 2130117 - RNA, 16 nt, Staphylococcus aureus subsp. aureus N315
uaugguguggugugau

SEQ ID NO: 2130118 - RNA, 21 nt, Staphylococcus aureus subsp. aureus N315
uaugguuuaccuaguuuuacu

SEQ ID NO: 2130119 - RNA, 12 nt, Staphylococcus aureus subsp. aureus N315
uauguaaaaaau

SEQ ID NO: 2130120 - RNA, 19 nt, Staphylococcus aureus subsp. aureus N315
uaugguuuaccuaguuuua

SEQ ID NO: 2130121 - RNA, 16 nt, Staphylococcus aureus subsp. aureus N315
uaugguuguuuuccaa

SEQ ID NO: 2130122 - RNA, 13 nt, Staphylococcus aureus subsp. aureus N315
uauguaaauaaca

SEQ ID NO: 2130123 - RNA, 15 nt, Staphylococcus aureus subsp. aureus N315
uauguagaauuucuu

SEQ ID NO: 2130124 - RNA, 14 nt, Staphylococcus aureus subsp. aureus N315
uauguagauuuuaa

SEQ ID NO: 2130125 - RNA, 15 nt, Staphylococcus aureus subsp. aureus N315
uauguagauuuuaau

SEQ ID NO: 2130126 - RNA, 17 nt, Staphylococcus aureus subsp. aureus N315
uaugucauauacuauau

SEQ ID NO: 2130127 - RNA, 18 nt, Staphylococcus aureus subsp. aureus N315
uaugucaucuucaauucu

SEQ ID NO: 2130128 - RNA, 21 nt, Staphylococcus aureus subsp. aureus N315
uaugaaguaagcagagccaua

SEQ ID NO: 2130129 - RNA, 16 nt, Staphylococcus aureus subsp. aureus N315
uaugaaucgauauaau

SEQ ID NO: 2130130 - RNA, 22 nt, Staphylococcus aureus subsp. aureus N315
uaugaauggcaaucuauauaaa

SEQ ID NO: 2130131 - RNA, 23 nt, Staphylococcus aureus subsp. aureus N315
uaugaauggcaaucuauauaaau

SEQ ID NO: 2130132 - RNA, 17 nt, Staphylococcus aureus subsp. aureus N315
uaugaauuauuaauaag

SEQ ID NO: 2130133 - RNA, 23 nt, Staphylococcus aureus subsp. aureus N315
uaugaaaagagaaacaaaacaaa

SEQ ID NO: 2130134 - RNA, 14 nt, Staphylococcus aureus subsp. aureus N315
uaucuuuugcuucg

SEQ ID NO: 2130135 - RNA, 14 nt, Staphylococcus aureus subsp. aureus N315
uaugaaauuuuuua

SEQ ID NO: 2130136 - RNA, 10 nt, Staphylococcus aureus subsp. aureus N315
uaucuuuaua

SEQ ID NO: 2130137 - RNA, 22 nt, Staphylococcus aureus subsp. aureus N315
uaucuuuacgauaaacuaaaaa

SEQ ID NO: 2130138 - RNA, 19 nt, Staphylococcus aureus subsp. aureus N315
uaucuugucauuugaacau

SEQ ID NO: 2130139 - RNA, 11 nt, Staphylococcus aureus subsp. aureus N315
uaucuuuaauu

SEQ ID NO: 2130140 - RNA, 14 nt, Staphylococcus aureus subsp. aureus N315
uaucuugauuuaaa

SEQ ID NO: 2130141 - RNA, 12 nt, Staphylococcus aureus subsp. aureus N315
uaucuucuucua

SEQ ID NO: 2130142 - RNA, 12 nt, Staphylococcus aureus subsp. aureus N315
uaugacaacaua

SEQ ID NO: 2130143 - RNA, 15 nt, Staphylococcus aureus subsp. aureus N315
uaugaauuuuauaaa

SEQ ID NO: 2130144 - RNA, 22 nt, Staphylococcus aureus subsp. aureus N315
uaugaauuuagcaucaaaaaua

SEQ ID NO: 2130145 - RNA, 21 nt, Staphylococcus aureus subsp. aureus N315
uaugaauugaguauuaaauuu

SEQ ID NO: 2130146 - RNA, 20 nt, Staphylococcus aureus subsp. aureus N315
uaugaauugaguauuaaauu

SEQ ID NO: 2130147 - RNA, 19 nt, Staphylococcus aureus subsp. aureus N315
uaugaauugaguauuaaau

SEQ ID NO: 2130148 - RNA, 22 nt, Staphylococcus aureus subsp. aureus N315
uaugacuaacgaaaaagauggu

SEQ ID NO: 2130149 - RNA, 21 nt, Staphylococcus aureus subsp. aureus N315
uaugacgcgugaauuaaaaaa

SEQ ID NO: 2130150 - RNA, 14 nt, Staphylococcus aureus subsp. aureus N315
uaugaccuuuaugu

SEQ ID NO: 2130151 - RNA, 22 nt, Staphylococcus aureus subsp. aureus N315
uaugauagaauacuaaaagugu

SEQ ID NO: 2130152 - RNA, 23 nt, Staphylococcus aureus subsp. aureus N315
uaugauagaauacuaaaaguguu

SEQ ID NO: 2130153 - RNA, 15 nt, Staphylococcus aureus subsp. aureus N315
uaugauaauaagaau

SEQ ID NO: 2130154 - RNA, 16 nt, Staphylococcus aureus subsp. aureus N315
uaugauaauuaauuaa

SEQ ID NO: 2130155 - RNA, 19 nt, Staphylococcus aureus subsp. aureus N315
uaugauaauuaauuaaaau

SEQ ID NO: 2130156 - RNA, 20 nt, Staphylococcus aureus subsp. aureus N315
uaugauaauuaauuaaaauu

SEQ ID NO: 2130157 - RNA, 21 nt, Staphylococcus aureus subsp. aureus N315
uaugauacgcuuuuuaaaaaa

SEQ ID NO: 2130158 - RNA, 18 nt, Staphylococcus aureus subsp. aureus N315
uaugauagaauacuaaaa

SEQ ID NO: 2130159 - RNA, 23 nt, Staphylococcus aureus subsp. aureus N315
uaugauacugauauuuagaauaa

SEQ ID NO: 2130160 - RNA, 21 nt, Staphylococcus aureus subsp. aureus N315
uaugacuuauuuuucaucauu

SEQ ID NO: 2130161 - RNA, 16 nt, Staphylococcus aureus subsp. aureus N315
uaugcaaaauuaauga

SEQ ID NO: 2130162 - RNA, 19 nt, Staphylococcus aureus subsp. aureus N315
uaugcaugccagaugcaau

SEQ ID NO: 2130163 - RNA, 23 nt, Staphylococcus aureus subsp. aureus N315
uaugcauccuaaaaaggcaagca

SEQ ID NO: 2130164 - RNA, 22 nt, Staphylococcus aureus subsp. aureus N315
uaugauuuucuuuaauaacuaa

SEQ ID NO: 2130165 - RNA, 16 nt, Staphylococcus aureus subsp. aureus N315
uaugcacaucauugau

SEQ ID NO: 2130166 - RNA, 17 nt, Staphylococcus aureus subsp. aureus N315
uaugauuuaaaauauaa

SEQ ID NO: 2130167 - RNA, 12 nt, Staphylococcus aureus subsp. aureus N315
uaugauuuaaaa

SEQ ID NO: 2130168 - RNA, 18 nt, Staphylococcus aureus subsp. aureus N315
uaugauuugauuugggua

SEQ ID NO: 2130169 - RNA, 16 nt, Staphylococcus aureus subsp. aureus N315
uaugauguuaaaaaau

SEQ ID NO: 2130170 - RNA, 19 nt, Staphylococcus aureus subsp. aureus N315
uaugauuaauaaaguaauc

SEQ ID NO: 2130171 - RNA, 20 nt, Staphylococcus aureus subsp. aureus N315
uaugauuaggauuagcguua

SEQ ID NO: 2130172 - RNA, 14 nt, Staphylococcus aureus subsp. aureus N315
uaugaugcuucuaa

SEQ ID NO: 2130173 - RNA, 19 nt, Staphylococcus aureus subsp. aureus N315
uaugauauauguaacauaa

SEQ ID NO: 2130174 - RNA, 21 nt, Staphylococcus aureus subsp. aureus N315
uaugaugaauuguuguacaug

SEQ ID NO: 2130175 - RNA, 16 nt, Staphylococcus aureus subsp. aureus N315
uacugguuaguaaaau

SEQ ID NO: 2130176 - RNA, 16 nt, Staphylococcus aureus subsp. aureus N315
uacugcuuuuuuaaau

SEQ ID NO: 2130177 - RNA, 15 nt, Staphylococcus aureus subsp. aureus N315
uacugugaaaauacc

SEQ ID NO: 2130178 - RNA, 13 nt, Staphylococcus aureus subsp. aureus N315
uacuguuugcuuu

SEQ ID NO: 2130179 - RNA, 16 nt, Staphylococcus aureus subsp. aureus N315
uacuguuuaaauaaaa

SEQ ID NO: 2130180 - RNA, 17 nt, Staphylococcus aureus subsp. aureus N315
uacuguaguacuauagu

SEQ ID NO: 2130181 - RNA, 21 nt, Staphylococcus aureus subsp. aureus N315
uacuguaguacuauagucauu

SEQ ID NO: 2130182 - RNA, 13 nt, Staphylococcus aureus subsp. aureus N315
uacuguaaucaau

SEQ ID NO: 2130183 - RNA, 14 nt, Staphylococcus aureus subsp. aureus N315
uacuguaaaauucu

SEQ ID NO: 2130184 - RNA, 13 nt, Staphylococcus aureus subsp. aureus N315
uacuguauuuuaa

SEQ ID NO: 2130185 - RNA, 19 nt, Staphylococcus aureus subsp. aureus N315
uacuuaguaaggaauauuu

SEQ ID NO: 2130186 - RNA, 18 nt, Staphylococcus aureus subsp. aureus N315
uacuuacgccaaucacaa

SEQ ID NO: 2130187 - RNA, 14 nt, Staphylococcus aureus subsp. aureus N315
uacuuacugaaacu

SEQ ID NO: 2130188 - RNA, 15 nt, Staphylococcus aureus subsp. aureus N315
uacuuaauuaauaau

SEQ ID NO: 2130189 - RNA, 21 nt, Staphylococcus aureus subsp. aureus N315
uacuuaauuuaaaucuguacu

SEQ ID NO: 2130190 - RNA, 12 nt, Staphylococcus aureus subsp. aureus N315
uacuuaauauag

SEQ ID NO: 2130191 - RNA, 14 nt, Staphylococcus aureus subsp. aureus N315
uacuuaauuuaaau

SEQ ID NO: 2130192 - RNA, 19 nt, Staphylococcus aureus subsp. aureus N315
uacuuauuucuuuucauua

SEQ ID NO: 2130193 - RNA, 18 nt, Staphylococcus aureus subsp. aureus N315
uacuuauuucuuuucauu

SEQ ID NO: 2130194 - RNA, 18 nt, Staphylococcus aureus subsp. aureus N315
uacuuauuucaaaaauag

SEQ ID NO: 2130195 - RNA, 20 nt, Staphylococcus aureus subsp. aureus N315
uacuucaguuugguuugcuu

SEQ ID NO: 2130196 - RNA, 16 nt, Staphylococcus aureus subsp. aureus N315
uacuuccaauacuguu

SEQ ID NO: 2130197 - RNA, 22 nt, Staphylococcus aureus subsp. aureus N315
uacuucguauugaauggcuucg

SEQ ID NO: 2130198 - RNA, 17 nt, Staphylococcus aureus subsp. aureus N315
uacuuucacauuuucaa

SEQ ID NO: 2130199 - RNA, 17 nt, Staphylococcus aureus subsp. aureus N315
uacuuucaccauuuacu

SEQ ID NO: 2130200 - RNA, 18 nt, Staphylococcus aureus subsp. aureus N315
uacuuucgaguaauacuu

SEQ ID NO: 2130201 - RNA, 15 nt, Staphylococcus aureus subsp. aureus N315
uacuuucuaagauac

SEQ ID NO: 2130202 - RNA, 15 nt, Staphylococcus aureus subsp. aureus N315
uacuuuuauaaucuu

SEQ ID NO: 2130203 - RNA, 22 nt, Staphylococcus aureus subsp. aureus N315
uacuuuggcagacguaucauca

SEQ ID NO: 2130204 - RNA, 18 nt, Staphylococcus aureus subsp. aureus N315
uacuuuucugucuguaaa

SEQ ID NO: 2130205 - RNA, 21 nt, Staphylococcus aureus subsp. aureus N315
uacuuuuccuugauucuuaua

SEQ ID NO: 2130206 - RNA, 12 nt, Staphylococcus aureus subsp. aureus N315
uacuuuucuaaa

SEQ ID NO: 2130207 - RNA, 15 nt, Staphylococcus aureus subsp. aureus N315
uacuuuuccuugauu

SEQ ID NO: 2130208 - RNA, 19 nt, Staphylococcus aureus subsp. aureus N315
uacuuuucucgauuaauuu

SEQ ID NO: 2130209 - RNA, 16 nt, Staphylococcus aureus subsp. aureus N315
uacuucuuuaaucgcu

SEQ ID NO: 2130210 - RNA, 15 nt, Staphylococcus aureus subsp. aureus N315
uacuucuaauuugca

SEQ ID NO: 2130211 - RNA, 21 nt, Staphylococcus aureus subsp. aureus N315
uacuucucaauuuaguauaaa

SEQ ID NO: 2130212 - RNA, 23 nt, Staphylococcus aureus subsp. aureus N315
uacuuggaaaauacuauacugau

SEQ ID NO: 2130213 - RNA, 16 nt, Staphylococcus aureus subsp. aureus N315
uacuugcacaccagug

SEQ ID NO: 2130214 - RNA, 16 nt, Staphylococcus aureus subsp. aureus N315
uacuucuuuggucuaa

SEQ ID NO: 2130215 - RNA, 19 nt, Staphylococcus aureus subsp. aureus N315
uacuugaauaccuuuuauu

SEQ ID NO: 2130216 - RNA, 23 nt, Staphylococcus aureus subsp. aureus N315
uacuuuagaaagugauucccaaa

SEQ ID NO: 2130217 - RNA, 19 nt, Staphylococcus aureus subsp. aureus N315
uacuuuauuugauaauauu

SEQ ID NO: 2130218 - RNA, 16 nt, Staphylococcus aureus subsp. aureus N315
uacuuucaaacaaauc

SEQ ID NO: 2130219 - RNA, 19 nt, Staphylococcus aureus subsp. aureus N315
uacuuucaaauaaugugaa

SEQ ID NO: 2130220 - RNA, 16 nt, Staphylococcus aureus subsp. aureus N315
uacuugucguauucuu

SEQ ID NO: 2130221 - RNA, 18 nt, Staphylococcus aureus subsp. aureus N315
uacuugucguauucuuca

SEQ ID NO: 2130222 - RNA, 15 nt, Staphylococcus aureus subsp. aureus N315
uacuuuaaaauugua

SEQ ID NO: 2130223 - RNA, 17 nt, Staphylococcus aureus subsp. aureus N315
uacuuguaauuaauaca

SEQ ID NO: 2130224 - RNA, 18 nt, Staphylococcus aureus subsp. aureus N315
uacuuguaauuaauacau

SEQ ID NO: 2130225 - RNA, 23 nt, Staphylococcus aureus subsp. aureus N315
uacucuuuuucuuucauaauuaa

SEQ ID NO: 2130226 - RNA, 14 nt, Staphylococcus aureus subsp. aureus N315
uacucuaacuuacc

SEQ ID NO: 2130227 - RNA, 14 nt, Staphylococcus aureus subsp. aureus N315
uacucuagcggaac

SEQ ID NO: 2130228 - RNA, 19 nt, Staphylococcus aureus subsp. aureus N315
uacucugaaaagccuacuu

SEQ ID NO: 2130229 - RNA, 19 nt, Staphylococcus aureus subsp. aureus N315
uacucugggcauuuugacg

SEQ ID NO: 2130230 - RNA, 17 nt, Staphylococcus aureus subsp. aureus N315
uacucugauuacauaua

SEQ ID NO: 2130231 - RNA, 22 nt, Staphylococcus aureus subsp. aureus N315
uacugcaauuauuuuucaaaua

SEQ ID NO: 2130232 - RNA, 23 nt, Staphylococcus aureus subsp. aureus N315
uacugcaccgauaucauauaaug

SEQ ID NO: 2130233 - RNA, 19 nt, Staphylococcus aureus subsp. aureus N315
uacugaugaacauaccugc

SEQ ID NO: 2130234 - RNA, 15 nt, Staphylococcus aureus subsp. aureus N315
uacugcugcuuuuaa

SEQ ID NO: 2130235 - RNA, 18 nt, Staphylococcus aureus subsp. aureus N315
uacugcuucaaucgucac

SEQ ID NO: 2130236 - RNA, 15 nt, Staphylococcus aureus subsp. aureus N315
uacugcugucuuuuu

SEQ ID NO: 2130237 - RNA, 17 nt, Staphylococcus aureus subsp. aureus N315
uacucauauugaauacu

SEQ ID NO: 2130238 - RNA, 18 nt, Staphylococcus aureus subsp. aureus N315
uacucauuuagcucuacu

SEQ ID NO: 2130239 - RNA, 14 nt, Staphylococcus aureus subsp. aureus N315
uacuccaaaguaac

SEQ ID NO: 2130240 - RNA, 21 nt, Staphylococcus aureus subsp. aureus N315
uacucuaaaaaaggaagaaca

SEQ ID NO: 2130241 - RNA, 11 nt, Staphylococcus aureus subsp. aureus N315
uacuaaaacau

SEQ ID NO: 2130242 - RNA, 21 nt, Staphylococcus aureus subsp. aureus N315
uacuaaaaguguuaugaauua

SEQ ID NO: 2130243 - RNA, 12 nt, Staphylococcus aureus subsp. aureus N315
uacuaaaacaug

SEQ ID NO: 2130244 - RNA, 20 nt, Staphylococcus aureus subsp. aureus N315
uacuaaaaucacuugguaaa

SEQ ID NO: 2130245 - RNA, 14 nt, Staphylococcus aureus subsp. aureus N315
uacguuuauaucuu

SEQ ID NO: 2130246 - RNA, 23 nt, Staphylococcus aureus subsp. aureus N315
uacuauuuuugacuguuaaacaa

SEQ ID NO: 2130247 - RNA, 15 nt, Staphylococcus aureus subsp. aureus N315
uacucaaaccaucuu

SEQ ID NO: 2130248 - RNA, 17 nt, Staphylococcus aureus subsp. aureus N315
uacuauuaguaugcaua

SEQ ID NO: 2130249 - RNA, 20 nt, Staphylococcus aureus subsp. aureus N315
uacuauuccguuucauugau

SEQ ID NO: 2130250 - RNA, 19 nt, Staphylococcus aureus subsp. aureus N315
uacuauuaaaggaaaucaa

SEQ ID NO: 2130251 - RNA, 23 nt, Staphylococcus aureus subsp. aureus N315
uacuauuaaaggaaaucaaucca

SEQ ID NO: 2130252 - RNA, 16 nt, Staphylococcus aureus subsp. aureus N315
uacuauuaaauaaucg

SEQ ID NO: 2130253 - RNA, 20 nt, Staphylococcus aureus subsp. aureus N315
uacucacugcacuuaugaua

SEQ ID NO: 2130254 - RNA, 13 nt, Staphylococcus aureus subsp. aureus N315
uacucacaaaaaa

SEQ ID NO: 2130255 - RNA, 20 nt, Staphylococcus aureus subsp. aureus N315
uaccccuguugaauauacua

SEQ ID NO: 2130256 - RNA, 20 nt, Staphylococcus aureus subsp. aureus N315
uacccacaucuuuuuaaaag

SEQ ID NO: 2130257 - RNA, 15 nt, Staphylococcus aureus subsp. aureus N315
uacccuauuuuacaa

SEQ ID NO: 2130258 - RNA, 22 nt, Staphylococcus aureus subsp. aureus N315
uacccuugcaaauauaucaucu

SEQ ID NO: 2130259 - RNA, 20 nt, Staphylococcus aureus subsp. aureus N315
uacauaauuuaucaauuucu

SEQ ID NO: 2130260 - RNA, 14 nt, Staphylococcus aureus subsp. aureus N315
uacauaauaaaaag

SEQ ID NO: 2130261 - RNA, 21 nt, Staphylococcus aureus subsp. aureus N315
uacauaacccuaaaaugaaua

SEQ ID NO: 2130262 - RNA, 12 nt, Staphylococcus aureus subsp. aureus N315
uacauaaauacc

SEQ ID NO: 2130263 - RNA, 15 nt, Staphylococcus aureus subsp. aureus N315
uacauaaaucuaaua

SEQ ID NO: 2130264 - RNA, 22 nt, Staphylococcus aureus subsp. aureus N315
uacauaaaugcuaaaaguauaa

SEQ ID NO: 2130265 - RNA, 18 nt, Staphylococcus aureus subsp. aureus N315
uacauaacccuaaaauga

SEQ ID NO: 2130266 - RNA, 22 nt, Staphylococcus aureus subsp. aureus N315
uacauaauuuaucugcaaaaug

SEQ ID NO: 2130267 - RNA, 15 nt, Staphylococcus aureus subsp. aureus N315
uacauaauuugaauu

SEQ ID NO: 2130268 - RNA, 21 nt, Staphylococcus aureus subsp. aureus N315
uacauaccacacuuuaaacaa

SEQ ID NO: 2130269 - RNA, 22 nt, Staphylococcus aureus subsp. aureus N315
uacauaccacacuuuaaacaag

SEQ ID NO: 2130270 - RNA, 21 nt, Staphylococcus aureus subsp. aureus N315
uacauacggcaaauucaacuu

SEQ ID NO: 2130271 - RNA, 15 nt, Staphylococcus aureus subsp. aureus N315
uaccacuugaauacu

SEQ ID NO: 2130272 - RNA, 20 nt, Staphylococcus aureus subsp. aureus N315
uaccacgaacaagucuugca

SEQ ID NO: 2130273 - RNA, 17 nt, Staphylococcus aureus subsp. aureus N315
uacguaucaagaaaaag

SEQ ID NO: 2130274 - RNA, 19 nt, Staphylococcus aureus subsp. aureus N315
uacgcauuuuaaauaaaau

SEQ ID NO: 2130275 - RNA, 21 nt, Staphylococcus aureus subsp. aureus N315
uacgcauuuuaaauaaaaugc

SEQ ID NO: 2130276 - RNA, 21 nt, Staphylococcus aureus subsp. aureus N315
uacgcuaaacaaugaugggaa

SEQ ID NO: 2130277 - RNA, 20 nt, Staphylococcus aureus subsp. aureus N315
uacgaugaugauuuauaaaa

SEQ ID NO: 2130278 - RNA, 22 nt, Staphylococcus aureus subsp. aureus N315
uaccuucuucuacccauaauuu

SEQ ID NO: 2130279 - RNA, 20 nt, Staphylococcus aureus subsp. aureus N315
uaccuugauucauuucgauu

SEQ ID NO: 2130280 - RNA, 18 nt, Staphylococcus aureus subsp. aureus N315
uaccguauuuuaauauug

SEQ ID NO: 2130281 - RNA, 19 nt, Staphylococcus aureus subsp. aureus N315
uaccuaaagcuaauacacc

SEQ ID NO: 2130282 - RNA, 17 nt, Staphylococcus aureus subsp. aureus N315
uaccuaaccauaacaau

SEQ ID NO: 2130283 - RNA, 21 nt, Staphylococcus aureus subsp. aureus N315
uaccuacagaauggauaccua

SEQ ID NO: 2130284 - RNA, 20 nt, Staphylococcus aureus subsp. aureus N315
uaccuaguaacucaacauuu

SEQ ID NO: 2130285 - RNA, 22 nt, Staphylococcus aureus subsp. aureus N315
uaccuuugucuuuuuuaucaug

SEQ ID NO: 2130286 - RNA, 19 nt, Staphylococcus aureus subsp. aureus N315
uacgaaaguagaauuauuu

SEQ ID NO: 2130287 - RNA, 13 nt, Staphylococcus aureus subsp. aureus N315
uacgaaaugcaau

SEQ ID NO: 2130288 - RNA, 18 nt, Staphylococcus aureus subsp. aureus N315
uacgaaaguagaauuauu

SEQ ID NO: 2130289 - RNA, 16 nt, Staphylococcus aureus subsp. aureus N315
uaccuuuaauaauauu

SEQ ID NO: 2130290 - RNA, 15 nt, Staphylococcus aureus subsp. aureus N315
uaccuuuaauaucua

SEQ ID NO: 2130291 - RNA, 15 nt, Staphylococcus aureus subsp. aureus N315
uaccuuuacuuucau

SEQ ID NO: 2130292 - RNA, 16 nt, Staphylococcus aureus subsp. aureus N315
uaccuuuacuuucauu

SEQ ID NO: 2130293 - RNA, 14 nt, Staphylococcus aureus subsp. aureus N315
uaccuuuauuauuu

SEQ ID NO: 2130294 - RNA, 18 nt, Staphylococcus aureus subsp. aureus N315
uaccuuucaaauauaucu

SEQ ID NO: 2130295 - RNA, 12 nt, Staphylococcus aureus subsp. aureus N315
uaccuuuccauu

SEQ ID NO: 2130296 - RNA, 15 nt, Staphylococcus aureus subsp. aureus N315
uaccuuugucuuuuu

SEQ ID NO: 2130297 - RNA, 19 nt, Staphylococcus aureus subsp. aureus N315
uacgaucaaaaucaugcuc

SEQ ID NO: 2130298 - RNA, 16 nt, Staphylococcus aureus subsp. aureus N315
uacgauauagugcuug

SEQ ID NO: 2130299 - RNA, 23 nt, Staphylococcus aureus subsp. aureus N315
uacgaaguuuaaaugugcaauua

SEQ ID NO: 2130300 - RNA, 22 nt, Staphylococcus aureus subsp. aureus N315
uacgaaucacaguuauauauuc

SEQ ID NO: 2130301 - RNA, 17 nt, Staphylococcus aureus subsp. aureus N315
uaauuuuaaaaauaaaa

SEQ ID NO: 2130302 - RNA, 16 nt, Staphylococcus aureus subsp. aureus N315
uaauuuuacucuguau

SEQ ID NO: 2130303 - RNA, 17 nt, Staphylococcus aureus subsp. aureus N315
uaauuuguccauccauu

SEQ ID NO: 2130304 - RNA, 15 nt, Staphylococcus aureus subsp. aureus N315
uaauuuuaaaaauaa

SEQ ID NO: 2130305 - RNA, 17 nt, Staphylococcus aureus subsp. aureus N315
uaauuuguuaguuuaag

SEQ ID NO: 2130306 - RNA, 21 nt, Staphylococcus aureus subsp. aureus N315
uaauuuucacuuucaaugaca

SEQ ID NO: 2130307 - RNA, 22 nt, Staphylococcus aureus subsp. aureus N315
uaauuuuccuagcguuguagga

SEQ ID NO: 2130308 - RNA, 24 nt, Staphylococcus aureus subsp. aureus N315
uaauuuuuaacagcgugaauauaa

SEQ ID NO: 2130309 - RNA, 15 nt, Staphylococcus aureus subsp. aureus N315
uaauuuuuaacagcg

SEQ ID NO: 2130310 - RNA, 13 nt, Staphylococcus aureus subsp. aureus N315
uaauuuuuaaauc

SEQ ID NO: 2130311 - RNA, 13 nt, Staphylococcus aureus subsp. aureus N315
uaauuuucuaaau

SEQ ID NO: 2130312 - RNA, 16 nt, Staphylococcus aureus subsp. aureus N315
uaauuuucuaaauaua

SEQ ID NO: 2130313 - RNA, 23 nt, Staphylococcus aureus subsp. aureus N315
uaauuuucuugccaucaauuucu

SEQ ID NO: 2130314 - RNA, 19 nt, Staphylococcus aureus subsp. aureus N315
uaauuuugugaauuuauuu

SEQ ID NO: 2130315 - RNA, 16 nt, Staphylococcus aureus subsp. aureus N315
uaauuuugacauaaaa

SEQ ID NO: 2130316 - RNA, 14 nt, Staphylococcus aureus subsp. aureus N315
uaauuuucuuuuuu

SEQ ID NO: 2130317 - RNA, 13 nt, Staphylococcus aureus subsp. aureus N315
uaauuuuguaauu

SEQ ID NO: 2130318 - RNA, 13 nt, Staphylococcus aureus subsp. aureus N315
uaauuuuuugaca

SEQ ID NO: 2130319 - RNA, 15 nt, Staphylococcus aureus subsp. aureus N315
uaauuuuucuucuuu

SEQ ID NO: 2130320 - RNA, 17 nt, Staphylococcus aureus subsp. aureus N315
uaauuuuucuaaaugau

SEQ ID NO: 2130321 - RNA, 22 nt, Staphylococcus aureus subsp. aureus N315
uaauuuuuuuccuuucuuuuuc

SEQ ID NO: 2130322 - RNA, 15 nt, Staphylococcus aureus subsp. aureus N315
uaauuuuuugugccu

SEQ ID NO: 2130323 - RNA, 13 nt, Staphylococcus aureus subsp. aureus N315
uaauuuuuuuagc

SEQ ID NO: 2130324 - RNA, 15 nt, Staphylococcus aureus subsp. aureus N315
uacaaaauugucuca

SEQ ID NO: 2130325 - RNA, 13 nt, Staphylococcus aureus subsp. aureus N315
uacaaaacauauu

SEQ ID NO: 2130326 - RNA, 12 nt, Staphylococcus aureus subsp. aureus N315
uacaaaacaaau

SEQ ID NO: 2130327 - RNA, 15 nt, Staphylococcus aureus subsp. aureus N315
uacaaaacaaaucca

SEQ ID NO: 2130328 - RNA, 16 nt, Staphylococcus aureus subsp. aureus N315
uaauuuccaauaucuu

SEQ ID NO: 2130329 - RNA, 14 nt, Staphylococcus aureus subsp. aureus N315
uaauuuccuaaaaa

SEQ ID NO: 2130330 - RNA, 22 nt, Staphylococcus aureus subsp. aureus N315
uaauuuccuaaaaacugugauu

SEQ ID NO: 2130331 - RNA, 17 nt, Staphylococcus aureus subsp. aureus N315
uaauuucaguucuuaga

SEQ ID NO: 2130332 - RNA, 19 nt, Staphylococcus aureus subsp. aureus N315
uaauuucaguucuuagauu

SEQ ID NO: 2130333 - RNA, 12 nt, Staphylococcus aureus subsp. aureus N315
uaauuucaauuu

SEQ ID NO: 2130334 - RNA, 15 nt, Staphylococcus aureus subsp. aureus N315
uaauuugauaaaugc

SEQ ID NO: 2130335 - RNA, 17 nt, Staphylococcus aureus subsp. aureus N315
uaauuucuaugaaaaaa

SEQ ID NO: 2130336 - RNA, 10 nt, Staphylococcus aureus subsp. aureus N315
uaauuucuau

SEQ ID NO: 2130337 - RNA, 18 nt, Staphylococcus aureus subsp. aureus N315
uaauuucugguaaaaaaa

SEQ ID NO: 2130338 - RNA, 11 nt, Staphylococcus aureus subsp. aureus N315
uaauuugauua

SEQ ID NO: 2130339 - RNA, 23 nt, Staphylococcus aureus subsp. aureus N315
uaauuugauguucuugaaaacaa

SEQ ID NO: 2130340 - RNA, 19 nt, Staphylococcus aureus subsp. aureus N315
uaauucguaauuuaugauu

SEQ ID NO: 2130341 - RNA, 22 nt, Staphylococcus aureus subsp. aureus N315
uaauucgccaucuuuuuuagcu

SEQ ID NO: 2130342 - RNA, 21 nt, Staphylococcus aureus subsp. aureus N315
uaauucuaagucucuugucau

SEQ ID NO: 2130343 - RNA, 17 nt, Staphylococcus aureus subsp. aureus N315
uaauucuauuuuugauu

SEQ ID NO: 2130344 - RNA, 18 nt, Staphylococcus aureus subsp. aureus N315
uaauucguugauuuagca

SEQ ID NO: 2130345 - RNA, 20 nt, Staphylococcus aureus subsp. aureus N315
uaauuuaaagcaucauauac

SEQ ID NO: 2130346 - RNA, 14 nt, Staphylococcus aureus subsp. aureus N315
uaauuuaaaauagu

SEQ ID NO: 2130347 - RNA, 11 nt, Staphylococcus aureus subsp. aureus N315
uaauuuaaaga

SEQ ID NO: 2130348 - RNA, 19 nt, Staphylococcus aureus subsp. aureus N315
uaauuuaucaauuucuauu

SEQ ID NO: 2130349 - RNA, 16 nt, Staphylococcus aureus subsp. aureus N315
uaauuuauugauaagc

SEQ ID NO: 2130350 - RNA, 17 nt, Staphylococcus aureus subsp. aureus N315
uaauuuauaaacaauua

SEQ ID NO: 2130351 - RNA, 15 nt, Staphylococcus aureus subsp. aureus N315
uaauuuauaaacaua

SEQ ID NO: 2130352 - RNA, 16 nt, Staphylococcus aureus subsp. aureus N315
uaauuuaguacucaau

SEQ ID NO: 2130353 - RNA, 17 nt, Staphylococcus aureus subsp. aureus N315
uacaguaauauucaacu

SEQ ID NO: 2130354 - RNA, 12 nt, Staphylococcus aureus subsp. aureus N315
uacaguaauauu

SEQ ID NO: 2130355 - RNA, 21 nt, Staphylococcus aureus subsp. aureus N315
uacagguuuaauaaauuuaac

SEQ ID NO: 2130356 - RNA, 15 nt, Staphylococcus aureus subsp. aureus N315
uacagguuuaauaaa

SEQ ID NO: 2130357 - RNA, 18 nt, Staphylococcus aureus subsp. aureus N315
uacagguuuuaaaauuaa

SEQ ID NO: 2130358 - RNA, 23 nt, Staphylococcus aureus subsp. aureus N315
uacaguucuauagguuuauaaaa

SEQ ID NO: 2130359 - RNA, 15 nt, Staphylococcus aureus subsp. aureus N315
uacagcguauuuuaa

SEQ ID NO: 2130360 - RNA, 22 nt, Staphylococcus aureus subsp. aureus N315
uacagcgugauucaucuauuau

SEQ ID NO: 2130361 - RNA, 20 nt, Staphylococcus aureus subsp. aureus N315
uacagcgugauucaucuauu

SEQ ID NO: 2130362 - RNA, 16 nt, Staphylococcus aureus subsp. aureus N315
uacagguuuaaacauc

SEQ ID NO: 2130363 - RNA, 14 nt, Staphylococcus aureus subsp. aureus N315
uacacuagucuuuu

SEQ ID NO: 2130364 - RNA, 15 nt, Staphylococcus aureus subsp. aureus N315
uacacugcacaucau

SEQ ID NO: 2130365 - RNA, 18 nt, Staphylococcus aureus subsp. aureus N315
uacacugcacaucauaau

SEQ ID NO: 2130366 - RNA, 17 nt, Staphylococcus aureus subsp. aureus N315
uacacgaguauuaucac

SEQ ID NO: 2130367 - RNA, 20 nt, Staphylococcus aureus subsp. aureus N315
uacacgaguauuaucacaua

SEQ ID NO: 2130368 - RNA, 16 nt, Staphylococcus aureus subsp. aureus N315
uacacuuaauauauuc

SEQ ID NO: 2130369 - RNA, 16 nt, Staphylococcus aureus subsp. aureus N315
uacacuuacaaauauu

SEQ ID NO: 2130370 - RNA, 17 nt, Staphylococcus aureus subsp. aureus N315
uacacuguuuuauaaau

SEQ ID NO: 2130371 - RNA, 15 nt, Staphylococcus aureus subsp. aureus N315
uacagcacugaaauc

SEQ ID NO: 2130372 - RNA, 15 nt, Staphylococcus aureus subsp. aureus N315
uacacuugauaaaac

SEQ ID NO: 2130373 - RNA, 13 nt, Staphylococcus aureus subsp. aureus N315
uacagcauauaau

SEQ ID NO: 2130374 - RNA, 14 nt, Staphylococcus aureus subsp. aureus N315
uacagcaucaccua

SEQ ID NO: 2130375 - RNA, 15 nt, Staphylococcus aureus subsp. aureus N315
uacaccacuuaggau

SEQ ID NO: 2130376 - RNA, 19 nt, Staphylococcus aureus subsp. aureus N315
uacaauucauaagaaaaau

SEQ ID NO: 2130377 - RNA, 15 nt, Staphylococcus aureus subsp. aureus N315
uacaauuuccuaccc

SEQ ID NO: 2130378 - RNA, 17 nt, Staphylococcus aureus subsp. aureus N315
uacaauuaaagugaaua

SEQ ID NO: 2130379 - RNA, 18 nt, Staphylococcus aureus subsp. aureus N315
uacaaguuuauaaucuuu

SEQ ID NO: 2130380 - RNA, 16 nt, Staphylococcus aureus subsp. aureus N315
uacaauuauauguagg

SEQ ID NO: 2130381 - RNA, 16 nt, Staphylococcus aureus subsp. aureus N315
uacaauuauaaaugau

SEQ ID NO: 2130382 - RNA, 23 nt, Staphylococcus aureus subsp. aureus N315
uacaagucuaguucgaacacaca

SEQ ID NO: 2130383 - RNA, 14 nt, Staphylococcus aureus subsp. aureus N315
uacaagucuuauuu

SEQ ID NO: 2130384 - RNA, 18 nt, Staphylococcus aureus subsp. aureus N315
uacaacucguuuuuccau

SEQ ID NO: 2130385 - RNA, 17 nt, Staphylococcus aureus subsp. aureus N315
uacaacucguuuuucca

SEQ ID NO: 2130386 - RNA, 17 nt, Staphylococcus aureus subsp. aureus N315
uacaaacuucacaucau

SEQ ID NO: 2130387 - RNA, 23 nt, Staphylococcus aureus subsp. aureus N315
uacaacugaaucuccuugcucau

SEQ ID NO: 2130388 - RNA, 19 nt, Staphylococcus aureus subsp. aureus N315
uacaacucguuuuuccaug

SEQ ID NO: 2130389 - RNA, 23 nt, Staphylococcus aureus subsp. aureus N315
uaauccgagucauacucaucaga

SEQ ID NO: 2130390 - RNA, 21 nt, Staphylococcus aureus subsp. aureus N315
uaaucccuucaaaauuuugac

SEQ ID NO: 2130391 - RNA, 17 nt, Staphylococcus aureus subsp. aureus N315
uaaucauguaaugcuua

SEQ ID NO: 2130392 - RNA, 21 nt, Staphylococcus aureus subsp. aureus N315
uaaucauguaaugcuuaaaaa

SEQ ID NO: 2130393 - RNA, 16 nt, Staphylococcus aureus subsp. aureus N315
uaaucauguaaugcuu

SEQ ID NO: 2130394 - RNA, 21 nt, Staphylococcus aureus subsp. aureus N315
uaaucauuuaucuagacucaa

SEQ ID NO: 2130395 - RNA, 16 nt, Staphylococcus aureus subsp. aureus N315
uaauccuucuccaaaa

SEQ ID NO: 2130396 - RNA, 15 nt, Staphylococcus aureus subsp. aureus N315
uaaucagaaaagcag

SEQ ID NO: 2130397 - RNA, 17 nt, Staphylococcus aureus subsp. aureus N315
uaaucacauuaauugga

SEQ ID NO: 2130398 - RNA, 16 nt, Staphylococcus aureus subsp. aureus N315
uaaucaccuuauugau

SEQ ID NO: 2130399 - RNA, 14 nt, Staphylococcus aureus subsp. aureus N315
uaauauucaacuug

SEQ ID NO: 2130400 - RNA, 13 nt, Staphylococcus aureus subsp. aureus N315
uaauauugaauau

SEQ ID NO: 2130401 - RNA, 17 nt, Staphylococcus aureus subsp. aureus N315
uaauauugacauuuaca

SEQ ID NO: 2130402 - RNA, 21 nt, Staphylococcus aureus subsp. aureus N315
uaauaucuuacuacuuaauua

SEQ ID NO: 2130403 - RNA, 17 nt, Staphylococcus aureus subsp. aureus N315
uaauaugaaggcuuuuu

SEQ ID NO: 2130404 - RNA, 17 nt, Staphylococcus aureus subsp. aureus N315
uaauauuggacuuugcu

SEQ ID NO: 2130405 - RNA, 13 nt, Staphylococcus aureus subsp. aureus N315
uaaucacauuaau

SEQ ID NO: 2130406 - RNA, 14 nt, Staphylococcus aureus subsp. aureus N315
uaaucacauuaauu

SEQ ID NO: 2130407 - RNA, 15 nt, Staphylococcus aureus subsp. aureus N315
uaacguucuguuuug

SEQ ID NO: 2130408 - RNA, 20 nt, Staphylococcus aureus subsp. aureus N315
uaacgucaacagcauaaaua

SEQ ID NO: 2130409 - RNA, 22 nt, Staphylococcus aureus subsp. aureus N315
uaacggaaauacaaugaauugu

SEQ ID NO: 2130410 - RNA, 19 nt, Staphylococcus aureus subsp. aureus N315
uaauauaaaaacaaaagaa

SEQ ID NO: 2130411 - RNA, 20 nt, Staphylococcus aureus subsp. aureus N315
uaauauaaaaacaaaagaaa

SEQ ID NO: 2130412 - RNA, 12 nt, Staphylococcus aureus subsp. aureus N315
uaauauaaaaac

SEQ ID NO: 2130413 - RNA, 16 nt, Staphylococcus aureus subsp. aureus N315
uaauaguaaugaugug

SEQ ID NO: 2130414 - RNA, 17 nt, Staphylococcus aureus subsp. aureus N315
uaauaguguuauauugu

SEQ ID NO: 2130415 - RNA, 21 nt, Staphylococcus aureus subsp. aureus N315
uaauaggauaugcuaaacacu

SEQ ID NO: 2130416 - RNA, 21 nt, Staphylococcus aureus subsp. aureus N315
uaauagguuauuugauaauga

SEQ ID NO: 2130417 - RNA, 15 nt, Staphylococcus aureus subsp. aureus N315
uaauagcgucaaguu

SEQ ID NO: 2130418 - RNA, 14 nt, Staphylococcus aureus subsp. aureus N315
uaauagcuauauuu

SEQ ID NO: 2130419 - RNA, 16 nt, Staphylococcus aureus subsp. aureus N315
uaacguugcagagaau

SEQ ID NO: 2130420 - RNA, 20 nt, Staphylococcus aureus subsp. aureus N315
uaacguugcagagaauauag

SEQ ID NO: 2130421 - RNA, 17 nt, Staphylococcus aureus subsp. aureus N315
uaauagcuuguacacau

SEQ ID NO: 2130422 - RNA, 19 nt, Staphylococcus aureus subsp. aureus N315
uaauaucuuacuacuuaau

SEQ ID NO: 2130423 - RNA, 16 nt, Staphylococcus aureus subsp. aureus N315
uaauaucaauaaugcu

SEQ ID NO: 2130424 - RNA, 21 nt, Staphylococcus aureus subsp. aureus N315
uaauaucauauucaaaauaac

SEQ ID NO: 2130425 - RNA, 17 nt, Staphylococcus aureus subsp. aureus N315
uaauaucauauucaaaa

SEQ ID NO: 2130426 - RNA, 17 nt, Staphylococcus aureus subsp. aureus N315
uaauauauccugccaau

SEQ ID NO: 2130427 - RNA, 13 nt, Staphylococcus aureus subsp. aureus N315
uaauauaauuaaa

SEQ ID NO: 2130428 - RNA, 15 nt, Staphylococcus aureus subsp. aureus N315
uaauauaauuauuaa

SEQ ID NO: 2130429 - RNA, 17 nt, Staphylococcus aureus subsp. aureus N315
uaauauaauuaaacauu

SEQ ID NO: 2130430 - RNA, 15 nt, Staphylococcus aureus subsp. aureus N315
uaauauaaguauaau

SEQ ID NO: 2130431 - RNA, 17 nt, Staphylococcus aureus subsp. aureus N315
uaauauaacuucuauua

SEQ ID NO: 2130432 - RNA, 20 nt, Staphylococcus aureus subsp. aureus N315
uaauuauuuuaaaaaaugau

SEQ ID NO: 2130433 - RNA, 22 nt, Staphylococcus aureus subsp. aureus N315
uaauucaacuuaaauggaugau

SEQ ID NO: 2130434 - RNA, 14 nt, Staphylococcus aureus subsp. aureus N315
uaauucaaugcuau

SEQ ID NO: 2130435 - RNA, 13 nt, Staphylococcus aureus subsp. aureus N315
uaauuauuaauaa

SEQ ID NO: 2130436 - RNA, 20 nt, Staphylococcus aureus subsp. aureus N315
uaauuauugagaauauuuau

SEQ ID NO: 2130437 - RNA, 13 nt, Staphylococcus aureus subsp. aureus N315
uaauuauguauuu

SEQ ID NO: 2130438 - RNA, 21 nt, Staphylococcus aureus subsp. aureus N315
uaauuaucauaugugauuuaa

SEQ ID NO: 2130439 - RNA, 23 nt, Staphylococcus aureus subsp. aureus N315
uaauuacaggaauugcuuuaaac

SEQ ID NO: 2130440 - RNA, 20 nt, Staphylococcus aureus subsp. aureus N315
uaauuacagguuuaaacauc

SEQ ID NO: 2130441 - RNA, 16 nt, Staphylococcus aureus subsp. aureus N315
uaauuaccuuuccauu

SEQ ID NO: 2130442 - RNA, 16 nt, Staphylococcus aureus subsp. aureus N315
uaauuaauuuguccau

SEQ ID NO: 2130443 - RNA, 16 nt, Staphylococcus aureus subsp. aureus N315
uaauuaauuuuguaau

SEQ ID NO: 2130444 - RNA, 13 nt, Staphylococcus aureus subsp. aureus N315
uaauuaaaacaug

SEQ ID NO: 2130445 - RNA, 16 nt, Staphylococcus aureus subsp. aureus N315
uaauuaaaauacaaau

SEQ ID NO: 2130446 - RNA, 14 nt, Staphylococcus aureus subsp. aureus N315
uaauuaaaauacaa

SEQ ID NO: 2130447 - RNA, 22 nt, Staphylococcus aureus subsp. aureus N315
uaauuaaaauaagauauauaau

SEQ ID NO: 2130448 - RNA, 13 nt, Staphylococcus aureus subsp. aureus N315
uaauuaaaauaca

SEQ ID NO: 2130449 - RNA, 12 nt, Staphylococcus aureus subsp. aureus N315
uaauuaaaauaa

SEQ ID NO: 2130450 - RNA, 17 nt, Staphylococcus aureus subsp. aureus N315
uaauguuuucauuggau

SEQ ID NO: 2130451 - RNA, 14 nt, Staphylococcus aureus subsp. aureus N315
uaauuaaugccauu

SEQ ID NO: 2130452 - RNA, 23 nt, Staphylococcus aureus subsp. aureus N315
uaauuaauuacuuucauuguaaa

SEQ ID NO: 2130453 - RNA, 15 nt, Staphylococcus aureus subsp. aureus N315
uaauuaauaagcauu

SEQ ID NO: 2130454 - RNA, 13 nt, Staphylococcus aureus subsp. aureus N315
uaauuaauaauuu

SEQ ID NO: 2130455 - RNA, 16 nt, Staphylococcus aureus subsp. aureus N315
uaauuaaaauucucuu

SEQ ID NO: 2130456 - RNA, 20 nt, Staphylococcus aureus subsp. aureus N315
uaauggcuaauacaaaacaa

SEQ ID NO: 2130457 - RNA, 22 nt, Staphylococcus aureus subsp. aureus N315
uaauggcgggcccccaacacaa

SEQ ID NO: 2130458 - RNA, 16 nt, Staphylococcus aureus subsp. aureus N315
uaaugguauugauuau

SEQ ID NO: 2130459 - RNA, 13 nt, Staphylococcus aureus subsp. aureus N315
uaauguuuccauu

SEQ ID NO: 2130460 - RNA, 15 nt, Staphylococcus aureus subsp. aureus N315
uaaugccaaauauag

SEQ ID NO: 2130461 - RNA, 20 nt, Staphylococcus aureus subsp. aureus N315
uaaugaugacaucaauaucu

SEQ ID NO: 2130462 - RNA, 16 nt, Staphylococcus aureus subsp. aureus N315
uaaugauucuacagca

SEQ ID NO: 2130463 - RNA, 22 nt, Staphylococcus aureus subsp. aureus N315
uaaugauugacgauuuaauuaa

SEQ ID NO: 2130464 - RNA, 22 nt, Staphylococcus aureus subsp. aureus N315
uaaugauuuuuauuauugucau

SEQ ID NO: 2130465 - RNA, 13 nt, Staphylococcus aureus subsp. aureus N315
uaaugauuuugcu

SEQ ID NO: 2130466 - RNA, 16 nt, Staphylococcus aureus subsp. aureus N315
uaaugagaguaauguu

SEQ ID NO: 2130467 - RNA, 16 nt, Staphylococcus aureus subsp. aureus N315
uaaugacugacacuuu

SEQ ID NO: 2130468 - RNA, 15 nt, Staphylococcus aureus subsp. aureus N315
uaaugaucaaguagu

SEQ ID NO: 2130469 - RNA, 13 nt, Staphylococcus aureus subsp. aureus N315
uaaugaucaucua

SEQ ID NO: 2130470 - RNA, 20 nt, Staphylococcus aureus subsp. aureus N315
uaaugauacaaacccauaua

SEQ ID NO: 2130471 - RNA, 19 nt, Staphylococcus aureus subsp. aureus N315
uaaugauaguacauuuauu

SEQ ID NO: 2130472 - RNA, 15 nt, Staphylococcus aureus subsp. aureus N315
uaaugauagcaauga

SEQ ID NO: 2130473 - RNA, 18 nt, Staphylococcus aureus subsp. aureus N315
uaaugauaauccaccaaa

SEQ ID NO: 2130474 - RNA, 17 nt, Staphylococcus aureus subsp. aureus N315
uaaugaguaguuucucu

SEQ ID NO: 2130475 - RNA, 13 nt, Staphylococcus aureus subsp. aureus N315
uaaugaacaaggg

SEQ ID NO: 2130476 - RNA, 13 nt, Staphylococcus aureus subsp. aureus N315
uaaugaauaguaa

SEQ ID NO: 2130477 - RNA, 17 nt, Staphylococcus aureus subsp. aureus N315
uaaugaauaauuaaaaa

SEQ ID NO: 2130478 - RNA, 19 nt, Staphylococcus aureus subsp. aureus N315
uaaugaagguaagugcuca

SEQ ID NO: 2130479 - RNA, 21 nt, Staphylococcus aureus subsp. aureus N315
uaaucuuuuuuacuaaaauca

SEQ ID NO: 2130480 - RNA, 15 nt, Staphylococcus aureus subsp. aureus N315
uaaucgaacagaaaa

SEQ ID NO: 2130481 - RNA, 15 nt, Staphylococcus aureus subsp. aureus N315
ggcacauaaaucaau

SEQ ID NO: 2130482 - RNA, 20 nt, Staphylococcus aureus subsp. aureus N315
ggcacauucccguuaauauc

SEQ ID NO: 2130483 - RNA, 16 nt, Staphylococcus aureus subsp. aureus N315
ggcauaaccuguaauu

SEQ ID NO: 2130484 - RNA, 15 nt, Staphylococcus aureus subsp. aureus N315
ggcaggaaugauaua

SEQ ID NO: 2130485 - RNA, 13 nt, Staphylococcus aureus subsp. aureus N315
ggcccccaacacu

SEQ ID NO: 2130486 - RNA, 18 nt, Staphylococcus aureus subsp. aureus N315
ggccccgacuauuuuuga

SEQ ID NO: 2130487 - RNA, 13 nt, Staphylococcus aureus subsp. aureus N315
ggauaucuuuguu

SEQ ID NO: 2130488 - RNA, 14 nt, Staphylococcus aureus subsp. aureus N315
ggauaauuuuauug

SEQ ID NO: 2130489 - RNA, 20 nt, Staphylococcus aureus subsp. aureus N315
ggauaauuuuuaacagcgug

SEQ ID NO: 2130490 - RNA, 19 nt, Staphylococcus aureus subsp. aureus N315
ggaucauuauuuagaauuc

SEQ ID NO: 2130491 - RNA, 17 nt, Staphylococcus aureus subsp. aureus N315
ggagcacuaucuuuugc

SEQ ID NO: 2130492 - RNA, 19 nt, Staphylococcus aureus subsp. aureus N315
ggagccccuuacaacuuua

SEQ ID NO: 2130493 - RNA, 18 nt, Staphylococcus aureus subsp. aureus N315
ggacuaacgucauuauau

SEQ ID NO: 2130494 - RNA, 19 nt, Staphylococcus aureus subsp. aureus N315
ggacauagguauaaucauu

SEQ ID NO: 2130495 - RNA, 23 nt, Staphylococcus aureus subsp. aureus N315
ggaauguuccuccaccaccugca

SEQ ID NO: 2130496 - RNA, 21 nt, Staphylococcus aureus subsp. aureus N315
ggaauuguuaauuucaacauu

SEQ ID NO: 2130497 - RNA, 21 nt, Staphylococcus aureus subsp. aureus N315
ggaauugguuuuuagugaaaa

SEQ ID NO: 2130498 - RNA, 18 nt, Staphylococcus aureus subsp. aureus N315
ggaauccaauuucucuau

SEQ ID NO: 2130499 - RNA, 20 nt, Staphylococcus aureus subsp. aureus N315
ggaauauuucccuaugaaau

SEQ ID NO: 2130500 - RNA, 12 nt, Staphylococcus aureus subsp. aureus N315
ggaagaacagca

SEQ ID NO: 2130501 - RNA, 17 nt, Staphylococcus aureus subsp. aureus N315
ggaagauaggauuuaca

SEQ ID NO: 2130502 - RNA, 15 nt, Staphylococcus aureus subsp. aureus N315
ggaagaccauuuuau

SEQ ID NO: 2130503 - RNA, 18 nt, Staphylococcus aureus subsp. aureus N315
ggaagaccacuauuuuua

SEQ ID NO: 2130504 - RNA, 14 nt, Staphylococcus aureus subsp. aureus N315
ggaagcgucuuuuu

SEQ ID NO: 2130505 - RNA, 22 nt, Staphylococcus aureus subsp. aureus N315
ggaaauuuauuauaaaauagaa

SEQ ID NO: 2130506 - RNA, 16 nt, Staphylococcus aureus subsp. aureus N315
ggaaaucaguaauauc

SEQ ID NO: 2130507 - RNA, 17 nt, Staphylococcus aureus subsp. aureus N315
ggaaaguaauaaguaau

SEQ ID NO: 2130508 - RNA, 21 nt, Staphylococcus aureus subsp. aureus N315
gcuuuuuuaaauuuaauuucg

SEQ ID NO: 2130509 - RNA, 12 nt, Staphylococcus aureus subsp. aureus N315
gcuuuuuguuuu

SEQ ID NO: 2130510 - RNA, 14 nt, Staphylococcus aureus subsp. aureus N315
gcuuuuuucaauuc

SEQ ID NO: 2130511 - RNA, 15 nt, Staphylococcus aureus subsp. aureus N315
ggaaaauacuauacu

SEQ ID NO: 2130512 - RNA, 23 nt, Staphylococcus aureus subsp. aureus N315
ggaaaauacuauacugaugaaaa

SEQ ID NO: 2130513 - RNA, 19 nt, Staphylococcus aureus subsp. aureus N315
ggaaaauaaaaaccagcua

SEQ ID NO: 2130514 - RNA, 22 nt, Staphylococcus aureus subsp. aureus N315
ggaaaauuauuugauauuucau

SEQ ID NO: 2130515 - RNA, 13 nt, Staphylococcus aureus subsp. aureus N315
ggaaagaugggau

SEQ ID NO: 2130516 - RNA, 19 nt, Staphylococcus aureus subsp. aureus N315
gcuuugaagggagcauuuc

SEQ ID NO: 2130517 - RNA, 20 nt, Staphylococcus aureus subsp. aureus N315
gcuuucuuuuucaucuuuca

SEQ ID NO: 2130518 - RNA, 18 nt, Staphylococcus aureus subsp. aureus N315
gcuuuaucaacaaauuuu

SEQ ID NO: 2130519 - RNA, 23 nt, Staphylococcus aureus subsp. aureus N315
gcuuugucacgauagauuuauca

SEQ ID NO: 2130520 - RNA, 17 nt, Staphylococcus aureus subsp. aureus N315
gcuuuggauuucuuuuu

SEQ ID NO: 2130521 - RNA, 14 nt, Staphylococcus aureus subsp. aureus N315
gcuuuguuuuucac

SEQ ID NO: 2130522 - RNA, 18 nt, Staphylococcus aureus subsp. aureus N315
gcuuuuccauaaauauuu

SEQ ID NO: 2130523 - RNA, 14 nt, Staphylococcus aureus subsp. aureus N315
gcuuuuaugcaugc

SEQ ID NO: 2130524 - RNA, 13 nt, Staphylococcus aureus subsp. aureus N315
gcuuuuaugcaug

SEQ ID NO: 2130525 - RNA, 13 nt, Staphylococcus aureus subsp. aureus N315
gcuuuuuaaaaaa

SEQ ID NO: 2130526 - RNA, 14 nt, Staphylococcus aureus subsp. aureus N315
gcuuuuucuuucuc

SEQ ID NO: 2130527 - RNA, 16 nt, Staphylococcus aureus subsp. aureus N315
gcuuuuucuuucucua

SEQ ID NO: 2130528 - RNA, 18 nt, Staphylococcus aureus subsp. aureus N315
gcuuuuucaaauaauaua

SEQ ID NO: 2130529 - RNA, 15 nt, Staphylococcus aureus subsp. aureus N315
gcuuuuucaaauaau

SEQ ID NO: 2130530 - RNA, 15 nt, Staphylococcus aureus subsp. aureus N315
gcuuuuuauuuuguu

SEQ ID NO: 2130531 - RNA, 20 nt, Staphylococcus aureus subsp. aureus N315
gcuuuuuauuuuguuuaucu

SEQ ID NO: 2130532 - RNA, 23 nt, Staphylococcus aureus subsp. aureus N315
gcuuuuuauuuuguuuaucugua

SEQ ID NO: 2130533 - RNA, 13 nt, Staphylococcus aureus subsp. aureus N315
gcuuuaauuuuuu

SEQ ID NO: 2130534 - RNA, 20 nt, Staphylococcus aureus subsp. aureus N315
gcuuuaguaguguauucauu

SEQ ID NO: 2130535 - RNA, 16 nt, Staphylococcus aureus subsp. aureus N315
gcuuuagcucuuuuuu

SEQ ID NO: 2130536 - RNA, 13 nt, Staphylococcus aureus subsp. aureus N315
gcuuuaauauaau

SEQ ID NO: 2130537 - RNA, 14 nt, Staphylococcus aureus subsp. aureus N315
gcuuguaaaauuuu

SEQ ID NO: 2130538 - RNA, 15 nt, Staphylococcus aureus subsp. aureus N315
gcuugugugaaauua

SEQ ID NO: 2130539 - RNA, 17 nt, Staphylococcus aureus subsp. aureus N315
gcuugugugaaauuaga

SEQ ID NO: 2130540 - RNA, 13 nt, Staphylococcus aureus subsp. aureus N315
gcuuguucaacua

SEQ ID NO: 2130541 - RNA, 21 nt, Staphylococcus aureus subsp. aureus N315
gcuuguaacaagcuuuucauu

SEQ ID NO: 2130542 - RNA, 14 nt, Staphylococcus aureus subsp. aureus N315
gcuuggacauauac

SEQ ID NO: 2130543 - RNA, 23 nt, Staphylococcus aureus subsp. aureus N315
gcuugagcaucuuuuacugcuuc

SEQ ID NO: 2130544 - RNA, 21 nt, Staphylococcus aureus subsp. aureus N315
gcuugcauccaugcugguuuu

SEQ ID NO: 2130545 - RNA, 19 nt, Staphylococcus aureus subsp. aureus N315
gcuucgucacguaaaauau

SEQ ID NO: 2130546 - RNA, 20 nt, Staphylococcus aureus subsp. aureus N315
gcuuccucucguaaauuguu

SEQ ID NO: 2130547 - RNA, 16 nt, Staphylococcus aureus subsp. aureus N315
gcuugaaguuguuucu

SEQ ID NO: 2130548 - RNA, 22 nt, Staphylococcus aureus subsp. aureus N315
gcuucuguguuggggcccacac

SEQ ID NO: 2130549 - RNA, 17 nt, Staphylococcus aureus subsp. aureus N315
gcuuauuuuuguauucu

SEQ ID NO: 2130550 - RNA, 21 nt, Staphylococcus aureus subsp. aureus N315
gcuuauugaaaagauaaacaa

SEQ ID NO: 2130551 - RNA, 15 nt, Staphylococcus aureus subsp. aureus N315
gcuucaaauguaaca

SEQ ID NO: 2130552 - RNA, 21 nt, Staphylococcus aureus subsp. aureus N315
gcuuccaauuuaaaaugauuc

SEQ ID NO: 2130553 - RNA, 21 nt, Staphylococcus aureus subsp. aureus N315
gcuucauuauauaauucuuca

SEQ ID NO: 2130554 - RNA, 22 nt, Staphylococcus aureus subsp. aureus N315
gcuucauauuuagguaauacau

SEQ ID NO: 2130555 - RNA, 15 nt, Staphylococcus aureus subsp. aureus N315
gcuuaacuuccuuuu

SEQ ID NO: 2130556 - RNA, 22 nt, Staphylococcus aureus subsp. aureus N315
gcuuaaguaagauuuaaacauc

SEQ ID NO: 2130557 - RNA, 19 nt, Staphylococcus aureus subsp. aureus N315
gcuuaauaagcugaaauaa

SEQ ID NO: 2130558 - RNA, 14 nt, Staphylococcus aureus subsp. aureus N315
gcuuaauucuucau

SEQ ID NO: 2130559 - RNA, 13 nt, Staphylococcus aureus subsp. aureus N315
gcuuaauuuaugu

SEQ ID NO: 2130560 - RNA, 18 nt, Staphylococcus aureus subsp. aureus N315
gcuuaauuggcaccucua

SEQ ID NO: 2130561 - RNA, 17 nt, Staphylococcus aureus subsp. aureus N315
gcuuauugaaaagauaa

SEQ ID NO: 2130562 - RNA, 16 nt, Staphylococcus aureus subsp. aureus N315
gcuuaucuguaaauaa

SEQ ID NO: 2130563 - RNA, 12 nt, Staphylococcus aureus subsp. aureus N315
gcuuaucauuac

SEQ ID NO: 2130564 - RNA, 17 nt, Staphylococcus aureus subsp. aureus N315
gcuuaucaacagcuuca

SEQ ID NO: 2130565 - RNA, 13 nt, Staphylococcus aureus subsp. aureus N315
gcuuagauaaauu

SEQ ID NO: 2130566 - RNA, 22 nt, Staphylococcus aureus subsp. aureus N315
gcuuagcaguucuauugucagc

SEQ ID NO: 2130567 - RNA, 18 nt, Staphylococcus aureus subsp. aureus N315
gcuguguaucaucauaau

SEQ ID NO: 2130568 - RNA, 21 nt, Staphylococcus aureus subsp. aureus N315
gcuguguacguuucaauguau

SEQ ID NO: 2130569 - RNA, 17 nt, Staphylococcus aureus subsp. aureus N315
gcuguuacacuuuucuu

SEQ ID NO: 2130570 - RNA, 23 nt, Staphylococcus aureus subsp. aureus N315
gcuguuuuuauuauaauagagaa

SEQ ID NO: 2130571 - RNA, 13 nt, Staphylococcus aureus subsp. aureus N315
gcuguuugauauu

SEQ ID NO: 2130572 - RNA, 19 nt, Staphylococcus aureus subsp. aureus N315
gcugguaauauuuuuguug

SEQ ID NO: 2130573 - RNA, 21 nt, Staphylococcus aureus subsp. aureus N315
gcugcaagucucauaucuauu

SEQ ID NO: 2130574 - RNA, 22 nt, Staphylococcus aureus subsp. aureus N315
gcugcacauuccaucuuaaaac

SEQ ID NO: 2130575 - RNA, 15 nt, Staphylococcus aureus subsp. aureus N315
gcugccaaauauaau

SEQ ID NO: 2130576 - RNA, 16 nt, Staphylococcus aureus subsp. aureus N315
gcugccaaauauaauu

SEQ ID NO: 2130577 - RNA, 21 nt, Staphylococcus aureus subsp. aureus N315
gcuggacaaucuuaucauaau

SEQ ID NO: 2130578 - RNA, 17 nt, Staphylococcus aureus subsp. aureus N315
gcugcuguacaauuucg

SEQ ID NO: 2130579 - RNA, 23 nt, Staphylococcus aureus subsp. aureus N315
gcugcuauccuugcuaucaaacu

SEQ ID NO: 2130580 - RNA, 13 nt, Staphylococcus aureus subsp. aureus N315
gcgauaaaguaug

SEQ ID NO: 2130581 - RNA, 19 nt, Staphylococcus aureus subsp. aureus N315
gcgaaccgaagcgcaguga

SEQ ID NO: 2130582 - RNA, 20 nt, Staphylococcus aureus subsp. aureus N315
gcggaauacagaugaugcuu

SEQ ID NO: 2130583 - RNA, 21 nt, Staphylococcus aureus subsp. aureus N315
gcgcuuuuuaauuuguauuua

SEQ ID NO: 2130584 - RNA, 17 nt, Staphylococcus aureus subsp. aureus N315
gcgcuuuuuuuuauaag

SEQ ID NO: 2130585 - RNA, 13 nt, Staphylococcus aureus subsp. aureus N315
gcggaaauaugau

SEQ ID NO: 2130586 - RNA, 17 nt, Staphylococcus aureus subsp. aureus N315
gcgcuucuaacucaccu

SEQ ID NO: 2130587 - RNA, 23 nt, Staphylococcus aureus subsp. aureus N315
gcgcucuggauuuuucuuauaaa

SEQ ID NO: 2130588 - RNA, 11 nt, Staphylococcus aureus subsp. aureus N315
gcguauuuuuu

SEQ ID NO: 2130589 - RNA, 18 nt, Staphylococcus aureus subsp. aureus N315
gcgucauuuguucaucug

SEQ ID NO: 2130590 - RNA, 20 nt, Staphylococcus aureus subsp. aureus N315
gcgucauuuguucaucugau

SEQ ID NO: 2130591 - RNA, 15 nt, Staphylococcus aureus subsp. aureus N315
gcguugguauucauc

SEQ ID NO: 2130592 - RNA, 15 nt, Staphylococcus aureus subsp. aureus N315
gcguuaaauauggau

SEQ ID NO: 2130593 - RNA, 22 nt, Staphylococcus aureus subsp. aureus N315
gcucuggauuuuucuuauaaaa

SEQ ID NO: 2130594 - RNA, 20 nt, Staphylococcus aureus subsp. aureus N315
gcucuuaauguacuuuucug

SEQ ID NO: 2130595 - RNA, 20 nt, Staphylococcus aureus subsp. aureus N315
gcugaaucgaguuugaaaua

SEQ ID NO: 2130596 - RNA, 21 nt, Staphylococcus aureus subsp. aureus N315
gcugaaauuuuuuagugaaaa

SEQ ID NO: 2130597 - RNA, 15 nt, Staphylococcus aureus subsp. aureus N315
gcugauaauuuuucu

SEQ ID NO: 2130598 - RNA, 16 nt, Staphylococcus aureus subsp. aureus N315
gcugauacauaaaaug

SEQ ID NO: 2130599 - RNA, 22 nt, Staphylococcus aureus subsp. aureus N315
gcuauuacuauaaaaaacagca

SEQ ID NO: 2130600 - RNA, 22 nt, Staphylococcus aureus subsp. aureus N315
gcuauuucaacaaacauaaaua

SEQ ID NO: 2130601 - RNA, 20 nt, Staphylococcus aureus subsp. aureus N315
gcuauuucaacaaacauaaa

SEQ ID NO: 2130602 - RNA, 14 nt, Staphylococcus aureus subsp. aureus N315
gcuauuugauacaa

SEQ ID NO: 2130603 - RNA, 15 nt, Staphylococcus aureus subsp. aureus N315
gcucaacuauauaua

SEQ ID NO: 2130604 - RNA, 18 nt, Staphylococcus aureus subsp. aureus N315
gcuauaaucuaucuugug

SEQ ID NO: 2130605 - RNA, 24 nt, Staphylococcus aureus subsp. aureus N315
gcuaguugaaccguaacuauauga

SEQ ID NO: 2130606 - RNA, 11 nt, Staphylococcus aureus subsp. aureus N315
gcuauaaaagu

SEQ ID NO: 2130607 - RNA, 20 nt, Staphylococcus aureus subsp. aureus N315
gcuauaaaauuuugaagaag

SEQ ID NO: 2130608 - RNA, 23 nt, Staphylococcus aureus subsp. aureus N315
gccauuuuuauuuaacacuucag

SEQ ID NO: 2130609 - RNA, 14 nt, Staphylococcus aureus subsp. aureus N315
gcccacaccccaac

SEQ ID NO: 2130610 - RNA, 15 nt, Staphylococcus aureus subsp. aureus N315
gcccagaauguguug

SEQ ID NO: 2130611 - RNA, 16 nt, Staphylococcus aureus subsp. aureus N315
gccaucaauuucugua

SEQ ID NO: 2130612 - RNA, 21 nt, Staphylococcus aureus subsp. aureus N315
gccaucaauauugauaucgaa

SEQ ID NO: 2130613 - RNA, 15 nt, Staphylococcus aureus subsp. aureus N315
gccauuaaaauuacg

SEQ ID NO: 2130614 - RNA, 15 nt, Staphylococcus aureus subsp. aureus N315
gccaucuuaccuuua

SEQ ID NO: 2130615 - RNA, 11 nt, Staphylococcus aureus subsp. aureus N315
gccaucuuuuu

SEQ ID NO: 2130616 - RNA, 22 nt, Staphylococcus aureus subsp. aureus N315
gccaucuuuuuuagcugaacca

SEQ ID NO: 2130617 - RNA, 17 nt, Staphylococcus aureus subsp. aureus N315
gccaugaaaaggaaaaa

SEQ ID NO: 2130618 - RNA, 22 nt, Staphylococcus aureus subsp. aureus N315
gccacugucauguguucaaaua

SEQ ID NO: 2130619 - RNA, 21 nt, Staphylococcus aureus subsp. aureus N315
gccaaucuauugcaauauagu

SEQ ID NO: 2130620 - RNA, 14 nt, Staphylococcus aureus subsp. aureus N315
gccaauaaaauguc

SEQ ID NO: 2130621 - RNA, 16 nt, Staphylococcus aureus subsp. aureus N315
gccaacaaagcuucca

SEQ ID NO: 2130622 - RNA, 20 nt, Staphylococcus aureus subsp. aureus N315
gccaacaucuucaacauaac

SEQ ID NO: 2130623 - RNA, 13 nt, Staphylococcus aureus subsp. aureus N315
gccaacaguaauu

SEQ ID NO: 2130624 - RNA, 15 nt, Staphylococcus aureus subsp. aureus N315
gcauuuuaaauaaaa

SEQ ID NO: 2130625 - RNA, 13 nt, Staphylococcus aureus subsp. aureus N315
gcauuuuguuuca

SEQ ID NO: 2130626 - RNA, 14 nt, Staphylococcus aureus subsp. aureus N315
gcauuuuucaauua

SEQ ID NO: 2130627 - RNA, 21 nt, Staphylococcus aureus subsp. aureus N315
gccaaacaaccugugauaaaa

SEQ ID NO: 2130628 - RNA, 20 nt, Staphylococcus aureus subsp. aureus N315
gccaaauaucaguaauaaua

SEQ ID NO: 2130629 - RNA, 17 nt, Staphylococcus aureus subsp. aureus N315
gccaaauaucaguaaua

SEQ ID NO: 2130630 - RNA, 22 nt, Staphylococcus aureus subsp. aureus N315
gcauuuaaauauaaaccagcug

SEQ ID NO: 2130631 - RNA, 15 nt, Staphylococcus aureus subsp. aureus N315
gcauucuuccaacac

SEQ ID NO: 2130632 - RNA, 21 nt, Staphylococcus aureus subsp. aureus N315
gcauuauagaugacuguagaa

SEQ ID NO: 2130633 - RNA, 14 nt, Staphylococcus aureus subsp. aureus N315
gcauuauuauaaua

SEQ ID NO: 2130634 - RNA, 23 nt, Staphylococcus aureus subsp. aureus N315
gcauuauuaaggggguaauacua

SEQ ID NO: 2130635 - RNA, 20 nt, Staphylococcus aureus subsp. aureus N315
gcauuauuauuucauuagaa

SEQ ID NO: 2130636 - RNA, 15 nt, Staphylococcus aureus subsp. aureus N315
gcauguaaaauuaaa

SEQ ID NO: 2130637 - RNA, 18 nt, Staphylococcus aureus subsp. aureus N315
gcauuacuaucuucauca

SEQ ID NO: 2130638 - RNA, 13 nt, Staphylococcus aureus subsp. aureus N315
gcauuaauuucau

SEQ ID NO: 2130639 - RNA, 18 nt, Staphylococcus aureus subsp. aureus N315
gcauuaagaugauugucu

SEQ ID NO: 2130640 - RNA, 19 nt, Staphylococcus aureus subsp. aureus N315
gcaugaaucgcauuuaaau

SEQ ID NO: 2130641 - RNA, 17 nt, Staphylococcus aureus subsp. aureus N315
gcaugacagcaaauuuu

SEQ ID NO: 2130642 - RNA, 14 nt, Staphylococcus aureus subsp. aureus N315
gcaugacagcaaau

SEQ ID NO: 2130643 - RNA, 14 nt, Staphylococcus aureus subsp. aureus N315
gcaugacuguaagu

SEQ ID NO: 2130644 - RNA, 19 nt, Staphylococcus aureus subsp. aureus N315
gcaucuucaauauuuaaau

SEQ ID NO: 2130645 - RNA, 17 nt, Staphylococcus aureus subsp. aureus N315
gcaugacuguaaguaug

SEQ ID NO: 2130646 - RNA, 19 nt, Staphylococcus aureus subsp. aureus N315
gcaugcgcaaaagcgcagg

SEQ ID NO: 2130647 - RNA, 18 nt, Staphylococcus aureus subsp. aureus N315
gcaucuccaaaggccaug

SEQ ID NO: 2130648 - RNA, 14 nt, Staphylococcus aureus subsp. aureus N315
gccguuauuuucaa

SEQ ID NO: 2130649 - RNA, 21 nt, Staphylococcus aureus subsp. aureus N315
gccgagauuauuauguggaaa

SEQ ID NO: 2130650 - RNA, 21 nt, Staphylococcus aureus subsp. aureus N315
gcccuagguuuauauaucaca

SEQ ID NO: 2130651 - RNA, 19 nt, Staphylococcus aureus subsp. aureus N315
gcacuaugcauaauaccaa

SEQ ID NO: 2130652 - RNA, 13 nt, Staphylococcus aureus subsp. aureus N315
gcacuaucuuuug

SEQ ID NO: 2130653 - RNA, 21 nt, Staphylococcus aureus subsp. aureus N315
gcaccgauuuggucagcgaca

SEQ ID NO: 2130654 - RNA, 21 nt, Staphylococcus aureus subsp. aureus N315
gcaccgucaaacuuaaaacua

SEQ ID NO: 2130655 - RNA, 13 nt, Staphylococcus aureus subsp. aureus N315
gcaaugaaauuac

SEQ ID NO: 2130656 - RNA, 14 nt, Staphylococcus aureus subsp. aureus N315
gcaauagcaccaua

SEQ ID NO: 2130657 - RNA, 16 nt, Staphylococcus aureus subsp. aureus N315
gcaauagcaacacguu

SEQ ID NO: 2130658 - RNA, 16 nt, Staphylococcus aureus subsp. aureus N315
gcaauaggaugaaacu

SEQ ID NO: 2130659 - RNA, 17 nt, Staphylococcus aureus subsp. aureus N315
gcaaauuggaaaaauaa

SEQ ID NO: 2130660 - RNA, 13 nt, Staphylococcus aureus subsp. aureus N315
gcaacuuauaaua

SEQ ID NO: 2130661 - RNA, 16 nt, Staphylococcus aureus subsp. aureus N315
gcaacaaaagauguug

SEQ ID NO: 2130662 - RNA, 14 nt, Staphylococcus aureus subsp. aureus N315
gcaagccaucaaua

SEQ ID NO: 2130663 - RNA, 18 nt, Staphylococcus aureus subsp. aureus N315
gcacauuuuuaguuagaa

SEQ ID NO: 2130664 - RNA, 13 nt, Staphylococcus aureus subsp. aureus N315
gcacauaaaucaa

SEQ ID NO: 2130665 - RNA, 15 nt, Staphylococcus aureus subsp. aureus N315
gcaauguaaugguua

SEQ ID NO: 2130666 - RNA, 20 nt, Staphylococcus aureus subsp. aureus N315
gcaauuaaccuugauuuaau

SEQ ID NO: 2130667 - RNA, 14 nt, Staphylococcus aureus subsp. aureus N315
gcaauuaaaaguac

SEQ ID NO: 2130668 - RNA, 14 nt, Staphylococcus aureus subsp. aureus N315
gcaauuaaagucaa

SEQ ID NO: 2130669 - RNA, 22 nt, Staphylococcus aureus subsp. aureus N315
gcaauuaaaacuauaauaaaga

SEQ ID NO: 2130670 - RNA, 16 nt, Staphylococcus aureus subsp. aureus N315
gcaauuauuuuucaaa

SEQ ID NO: 2130671 - RNA, 13 nt, Staphylococcus aureus subsp. aureus N315
gcaauuucauagu

SEQ ID NO: 2130672 - RNA, 19 nt, Staphylococcus aureus subsp. aureus N315
gcaauuuuucacuuauaac

SEQ ID NO: 2130673 - RNA, 19 nt, Staphylococcus aureus subsp. aureus N315
gcacaacugcauaaaagcc

SEQ ID NO: 2130674 - RNA, 16 nt, Staphylococcus aureus subsp. aureus N315
gcacaaaaaaaucucc

SEQ ID NO: 2130675 - RNA, 22 nt, Staphylococcus aureus subsp. aureus N315
gcacaauauuuaccacaaauau

SEQ ID NO: 2130676 - RNA, 14 nt, Staphylococcus aureus subsp. aureus N315
gcauauucacgaua

SEQ ID NO: 2130677 - RNA, 23 nt, Staphylococcus aureus subsp. aureus N315
gcauauucgcuuaaaaacgcuuu

SEQ ID NO: 2130678 - RNA, 16 nt, Staphylococcus aureus subsp. aureus N315
gcauauguaauacaaa

SEQ ID NO: 2130679 - RNA, 13 nt, Staphylococcus aureus subsp. aureus N315
gcaucaaaaauga

SEQ ID NO: 2130680 - RNA, 22 nt, Staphylococcus aureus subsp. aureus N315
gcaguaguugacugaacgaaaa

SEQ ID NO: 2130681 - RNA, 15 nt, Staphylococcus aureus subsp. aureus N315
gcaguauauaucaaa

SEQ ID NO: 2130682 - RNA, 19 nt, Staphylococcus aureus subsp. aureus N315
gcaguauauaucaaauaca

SEQ ID NO: 2130683 - RNA, 19 nt, Staphylococcus aureus subsp. aureus N315
gcauaauuaggauuaacau

SEQ ID NO: 2130684 - RNA, 18 nt, Staphylococcus aureus subsp. aureus N315
gcauaucgauaaauguau

SEQ ID NO: 2130685 - RNA, 15 nt, Staphylococcus aureus subsp. aureus N315
gcauaaaagccucua

SEQ ID NO: 2130686 - RNA, 13 nt, Staphylococcus aureus subsp. aureus N315
gcagcuuuauaau

SEQ ID NO: 2130687 - RNA, 21 nt, Staphylococcus aureus subsp. aureus N315
gcagcuugaucuaaaugaucu

SEQ ID NO: 2130688 - RNA, 13 nt, Staphylococcus aureus subsp. aureus N315
gcagcuucuuuaa

SEQ ID NO: 2130689 - RNA, 19 nt, Staphylococcus aureus subsp. aureus N315
gcaggcgaaccgaagcgca

SEQ ID NO: 2130690 - RNA, 13 nt, Staphylococcus aureus subsp. aureus N315
gcagcaucauaau

SEQ ID NO: 2130691 - RNA, 15 nt, Staphylococcus aureus subsp. aureus N315
gcagauugauauaaa

SEQ ID NO: 2130692 - RNA, 19 nt, Staphylococcus aureus subsp. aureus N315
gcagauguugguucaucaa

SEQ ID NO: 2130693 - RNA, 23 nt, Staphylococcus aureus subsp. aureus N315
gcacuuauuuggaugguaaguau

SEQ ID NO: 2130694 - RNA, 14 nt, Staphylococcus aureus subsp. aureus N315
gcagcgaucuuuuu

SEQ ID NO: 2130695 - RNA, 20 nt, Staphylococcus aureus subsp. aureus N315
gcaaaggcgcaccaugugcc

SEQ ID NO: 2130696 - RNA, 19 nt, Staphylococcus aureus subsp. aureus N315
gcaaagucauuaaauguac

SEQ ID NO: 2130697 - RNA, 15 nt, Staphylococcus aureus subsp. aureus N315
gcaaauaaaaaaguu

SEQ ID NO: 2130698 - RNA, 17 nt, Staphylococcus aureus subsp. aureus N315
gcaaauuaucauuaaau

SEQ ID NO: 2130699 - RNA, 13 nt, Staphylococcus aureus subsp. aureus N315
gcaaauuaucauu

SEQ ID NO: 2130700 - RNA, 14 nt, Staphylococcus aureus subsp. aureus N315
gcaaauuaucauua

SEQ ID NO: 2130701 - RNA, 13 nt, Staphylococcus aureus subsp. aureus N315
gcaaauauaucau

SEQ ID NO: 2130702 - RNA, 11 nt, Staphylococcus aureus subsp. aureus N315
gcaaauacuuc

SEQ ID NO: 2130703 - RNA, 13 nt, Staphylococcus aureus subsp. aureus N315
gcaaauauuucug

SEQ ID NO: 2130704 - RNA, 13 nt, Staphylococcus aureus subsp. aureus N315
gcaaaucaaacaa

SEQ ID NO: 2130705 - RNA, 19 nt, Staphylococcus aureus subsp. aureus N315
gcaaauauuauuaaaucaa

SEQ ID NO: 2130706 - RNA, 13 nt, Staphylococcus aureus subsp. aureus N315
gcaaagacucaau

SEQ ID NO: 2130707 - RNA, 18 nt, Staphylococcus aureus subsp. aureus N315
gcaaagacucaauuucau

SEQ ID NO: 2130708 - RNA, 16 nt, Staphylococcus aureus subsp. aureus N315
gcaaacuugauucaau

SEQ ID NO: 2130709 - RNA, 18 nt, Staphylococcus aureus subsp. aureus N315
gcaaacggcccaacugga

SEQ ID NO: 2130710 - RNA, 17 nt, Staphylococcus aureus subsp. aureus N315
gcaaacgcacuaucaau

SEQ ID NO: 2130711 - RNA, 18 nt, Staphylococcus aureus subsp. aureus N315
gcaaaauuauguaaaaaa

SEQ ID NO: 2130712 - RNA, 15 nt, Staphylococcus aureus subsp. aureus N315
gcaaacacaguacaa

SEQ ID NO: 2130713 - RNA, 19 nt, Staphylococcus aureus subsp. aureus N315
gcaaaauacgauuuguuca

SEQ ID NO: 2130714 - RNA, 16 nt, Staphylococcus aureus subsp. aureus N315
gauuuuucauauuuuu

SEQ ID NO: 2130715 - RNA, 15 nt, Staphylococcus aureus subsp. aureus N315
gauuuuauaaaguuu

SEQ ID NO: 2130716 - RNA, 18 nt, Staphylococcus aureus subsp. aureus N315
gcaaaaauauuuaaacua

SEQ ID NO: 2130717 - RNA, 13 nt, Staphylococcus aureus subsp. aureus N315
gcaaaaauacuuu

SEQ ID NO: 2130718 - RNA, 18 nt, Staphylococcus aureus subsp. aureus N315
gcaaaaauaauaugaauu

SEQ ID NO: 2130719 - RNA, 15 nt, Staphylococcus aureus subsp. aureus N315
gauuucacuucuaaa

SEQ ID NO: 2130720 - RNA, 22 nt, Staphylococcus aureus subsp. aureus N315
gauuucacuugaccacuuuugu

SEQ ID NO: 2130721 - RNA, 23 nt, Staphylococcus aureus subsp. aureus N315
gauuuuaaucuauccuucaaaag

SEQ ID NO: 2130722 - RNA, 14 nt, Staphylococcus aureus subsp. aureus N315
gauuuuacuugaau

SEQ ID NO: 2130723 - RNA, 23 nt, Staphylococcus aureus subsp. aureus N315
gauuugccaaaaguuauauaaau

SEQ ID NO: 2130724 - RNA, 21 nt, Staphylococcus aureus subsp. aureus N315
gauugacuaaguuuguuuucu

SEQ ID NO: 2130725 - RNA, 23 nt, Staphylococcus aureus subsp. aureus N315
gauuguuucaccagcuuguaaau

SEQ ID NO: 2130726 - RNA, 21 nt, Staphylococcus aureus subsp. aureus N315
gauuguuuauucgguccuuug

SEQ ID NO: 2130727 - RNA, 21 nt, Staphylococcus aureus subsp. aureus N315
gauuuaaaauauaaauuucuu

SEQ ID NO: 2130728 - RNA, 15 nt, Staphylococcus aureus subsp. aureus N315
gauuuauuaacucau

SEQ ID NO: 2130729 - RNA, 15 nt, Staphylococcus aureus subsp. aureus N315
gauuuauuaaauaua

SEQ ID NO: 2130730 - RNA, 21 nt, Staphylococcus aureus subsp. aureus N315
gauuauguucagaacuacaau

SEQ ID NO: 2130731 - RNA, 20 nt, Staphylococcus aureus subsp. aureus N315
gauuauuaugccuuugauuu

SEQ ID NO: 2130732 - RNA, 22 nt, Staphylococcus aureus subsp. aureus N315
gauuauucuucauuuauaacau

SEQ ID NO: 2130733 - RNA, 22 nt, Staphylococcus aureus subsp. aureus N315
gauuauuuaaaacuuguaaauu

SEQ ID NO: 2130734 - RNA, 18 nt, Staphylococcus aureus subsp. aureus N315
gauuauugguugaaauua

SEQ ID NO: 2130735 - RNA, 18 nt, Staphylococcus aureus subsp. aureus N315
gauuauuuagauaaaaau

SEQ ID NO: 2130736 - RNA, 20 nt, Staphylococcus aureus subsp. aureus N315
gauuauuuagauaaaaauua

SEQ ID NO: 2130737 - RNA, 17 nt, Staphylococcus aureus subsp. aureus N315
gauuauguaauucuagc

SEQ ID NO: 2130738 - RNA, 15 nt, Staphylococcus aureus subsp. aureus N315
gauuaucuaacucau

SEQ ID NO: 2130739 - RNA, 20 nt, Staphylococcus aureus subsp. aureus N315
gauuaucuacuauuuguuuu

SEQ ID NO: 2130740 - RNA, 22 nt, Staphylococcus aureus subsp. aureus N315
gauuaucugacauuguugcuaa

SEQ ID NO: 2130741 - RNA, 22 nt, Staphylococcus aureus subsp. aureus N315
gauuaucuguaauuaauccauc

SEQ ID NO: 2130742 - RNA, 18 nt, Staphylococcus aureus subsp. aureus N315
gauuauauuuuucuucag

SEQ ID NO: 2130743 - RNA, 15 nt, Staphylococcus aureus subsp. aureus N315
gauuauauuuuucuu

SEQ ID NO: 2130744 - RNA, 17 nt, Staphylococcus aureus subsp. aureus N315
gauuaaaagcaucuuua

SEQ ID NO: 2130745 - RNA, 17 nt, Staphylococcus aureus subsp. aureus N315
gauuaaaaaaucauuca

SEQ ID NO: 2130746 - RNA, 20 nt, Staphylococcus aureus subsp. aureus N315
gauuaaaguguuucaacaua

SEQ ID NO: 2130747 - RNA, 18 nt, Staphylococcus aureus subsp. aureus N315
gaugucaugucuagauuu

SEQ ID NO: 2130748 - RNA, 15 nt, Staphylococcus aureus subsp. aureus N315
gaugucgaaaaguau

SEQ ID NO: 2130749 - RNA, 13 nt, Staphylococcus aureus subsp. aureus N315
gauggucuuuuaa

SEQ ID NO: 2130750 - RNA, 13 nt, Staphylococcus aureus subsp. aureus N315
gaugguuuuguuu

SEQ ID NO: 2130751 - RNA, 16 nt, Staphylococcus aureus subsp. aureus N315
gaugcuaaaaauauug

SEQ ID NO: 2130752 - RNA, 23 nt, Staphylococcus aureus subsp. aureus N315
gaugcuaaaaauauugaauaauc

SEQ ID NO: 2130753 - RNA, 19 nt, Staphylococcus aureus subsp. aureus N315
gaugcuucucacaacugca

SEQ ID NO: 2130754 - RNA, 19 nt, Staphylococcus aureus subsp. aureus N315
gaugcuucgcaucacugca

SEQ ID NO: 2130755 - RNA, 14 nt, Staphylococcus aureus subsp. aureus N315
gaugacuguagaaa

SEQ ID NO: 2130756 - RNA, 13 nt, Staphylococcus aureus subsp. aureus N315
gaugagaaauguu

SEQ ID NO: 2130757 - RNA, 18 nt, Staphylococcus aureus subsp. aureus N315
gaugaauuuuuauuuuua

SEQ ID NO: 2130758 - RNA, 22 nt, Staphylococcus aureus subsp. aureus N315
gaugaauggauuuucuucacca

SEQ ID NO: 2130759 - RNA, 19 nt, Staphylococcus aureus subsp. aureus N315
gaucgcccauacuaaauaa

SEQ ID NO: 2130760 - RNA, 14 nt, Staphylococcus aureus subsp. aureus N315
gaucgauacuuuuu

SEQ ID NO: 2130761 - RNA, 16 nt, Staphylococcus aureus subsp. aureus N315
gauauugcaucauuca

SEQ ID NO: 2130762 - RNA, 20 nt, Staphylococcus aureus subsp. aureus N315
gauauuaauugaaaaaccaa

SEQ ID NO: 2130763 - RNA, 22 nt, Staphylococcus aureus subsp. aureus N315
gauauuaauugaaaaaccaagu

SEQ ID NO: 2130764 - RNA, 13 nt, Staphylococcus aureus subsp. aureus N315
gauauguuuauau

SEQ ID NO: 2130765 - RNA, 13 nt, Staphylococcus aureus subsp. aureus N315
gauauuacauaua

SEQ ID NO: 2130766 - RNA, 17 nt, Staphylococcus aureus subsp. aureus N315
gauauuaggcuuaaaua

SEQ ID NO: 2130767 - RNA, 21 nt, Staphylococcus aureus subsp. aureus N315
gauaugaauaaccaucuucuu

SEQ ID NO: 2130768 - RNA, 19 nt, Staphylococcus aureus subsp. aureus N315
gauaugcucucuucaaagu

SEQ ID NO: 2130769 - RNA, 15 nt, Staphylococcus aureus subsp. aureus N315
gauauggaucauaau

SEQ ID NO: 2130770 - RNA, 19 nt, Staphylococcus aureus subsp. aureus N315
gauaucuuaaucuaaaaau

SEQ ID NO: 2130771 - RNA, 17 nt, Staphylococcus aureus subsp. aureus N315
gauaucuggauuaacug

SEQ ID NO: 2130772 - RNA, 21 nt, Staphylococcus aureus subsp. aureus N315
gauaucuuaaucuaaaaauag

SEQ ID NO: 2130773 - RNA, 19 nt, Staphylococcus aureus subsp. aureus N315
gauaucuuuuaauucuuaa

SEQ ID NO: 2130774 - RNA, 21 nt, Staphylococcus aureus subsp. aureus N315
gauaucuuuuccaaaacaaaa

SEQ ID NO: 2130775 - RNA, 21 nt, Staphylococcus aureus subsp. aureus N315
gauagcaccguaacauaugua

SEQ ID NO: 2130776 - RNA, 19 nt, Staphylococcus aureus subsp. aureus N315
gauaucagcuaaguuaaau

SEQ ID NO: 2130777 - RNA, 17 nt, Staphylococcus aureus subsp. aureus N315
gaucauuaguguagaaa

SEQ ID NO: 2130778 - RNA, 14 nt, Staphylococcus aureus subsp. aureus N315
gaucauuauuuaga

SEQ ID NO: 2130779 - RNA, 17 nt, Staphylococcus aureus subsp. aureus N315
gaucauuauuuagaauu

SEQ ID NO: 2130780 - RNA, 19 nt, Staphylococcus aureus subsp. aureus N315
gauccaaaguacucaagua

SEQ ID NO: 2130781 - RNA, 17 nt, Staphylococcus aureus subsp. aureus N315
gauccaaaguacucaag

SEQ ID NO: 2130782 - RNA, 19 nt, Staphylococcus aureus subsp. aureus N315
gaucauuugacauaaucca

SEQ ID NO: 2130783 - RNA, 22 nt, Staphylococcus aureus subsp. aureus N315
gauauuuagaauaagaaauaaa

SEQ ID NO: 2130784 - RNA, 14 nt, Staphylococcus aureus subsp. aureus N315
gaucaacaaugcca

SEQ ID NO: 2130785 - RNA, 15 nt, Staphylococcus aureus subsp. aureus N315
gaucaacuauauaua

SEQ ID NO: 2130786 - RNA, 17 nt, Staphylococcus aureus subsp. aureus N315
gaucaacugaaauuuuu

SEQ ID NO: 2130787 - RNA, 17 nt, Staphylococcus aureus subsp. aureus N315
gauaacgagugaaaaua

SEQ ID NO: 2130788 - RNA, 20 nt, Staphylococcus aureus subsp. aureus N315
gauaaauaaacucaccaagu

SEQ ID NO: 2130789 - RNA, 18 nt, Staphylococcus aureus subsp. aureus N315
gauaauagcuugagcauc

SEQ ID NO: 2130790 - RNA, 20 nt, Staphylococcus aureus subsp. aureus N315
gauaauacuguuuaaauaaa

SEQ ID NO: 2130791 - RNA, 17 nt, Staphylococcus aureus subsp. aureus N315
gauaauacuguuuaaau

SEQ ID NO: 2130792 - RNA, 18 nt, Staphylococcus aureus subsp. aureus N315
gauaauccaccaaauaca

SEQ ID NO: 2130793 - RNA, 17 nt, Staphylococcus aureus subsp. aureus N315
gauaaucacaauacgaa

SEQ ID NO: 2130794 - RNA, 20 nt, Staphylococcus aureus subsp. aureus N315
gauaauuauacguuacuaaa

SEQ ID NO: 2130795 - RNA, 16 nt, Staphylococcus aureus subsp. aureus N315
gauaauucgaaaucaa

SEQ ID NO: 2130796 - RNA, 19 nt, Staphylococcus aureus subsp. aureus N315
gauaauuuucaauuagaaa

SEQ ID NO: 2130797 - RNA, 13 nt, Staphylococcus aureus subsp. aureus N315
gauaauuucuucu

SEQ ID NO: 2130798 - RNA, 18 nt, Staphylococcus aureus subsp. aureus N315
gauacaaaggauuauuaa

SEQ ID NO: 2130799 - RNA, 13 nt, Staphylococcus aureus subsp. aureus N315
gauacaaaccuaa

SEQ ID NO: 2130800 - RNA, 23 nt, Staphylococcus aureus subsp. aureus N315
gauaauuaaaauaagauauauaa

SEQ ID NO: 2130801 - RNA, 22 nt, Staphylococcus aureus subsp. aureus N315
gauaauguacauguauaaaaga

SEQ ID NO: 2130802 - RNA, 22 nt, Staphylococcus aureus subsp. aureus N315
gauaauguaauuguuuuuucuu

SEQ ID NO: 2130803 - RNA, 21 nt, Staphylococcus aureus subsp. aureus N315
gauaaugauaguguaugaaug

SEQ ID NO: 2130804 - RNA, 22 nt, Staphylococcus aureus subsp. aureus N315
gauaaucucauucuuuaauaua

SEQ ID NO: 2130805 - RNA, 14 nt, Staphylococcus aureus subsp. aureus N315
gauacauaaaucua

SEQ ID NO: 2130806 - RNA, 13 nt, Staphylococcus aureus subsp. aureus N315
gauacagaaccaa

SEQ ID NO: 2130807 - RNA, 15 nt, Staphylococcus aureus subsp. aureus N315
gauacauucuauuaa

SEQ ID NO: 2130808 - RNA, 22 nt, Staphylococcus aureus subsp. aureus N315
gauagaugcuggcuuaguaguu

SEQ ID NO: 2130809 - RNA, 18 nt, Staphylococcus aureus subsp. aureus N315
gauacugauauuuagaau

SEQ ID NO: 2130810 - RNA, 15 nt, Staphylococcus aureus subsp. aureus N315
gauacugccauaugu

SEQ ID NO: 2130811 - RNA, 23 nt, Staphylococcus aureus subsp. aureus N315
gauacugaaauuucauaaaguuu

SEQ ID NO: 2130812 - RNA, 20 nt, Staphylococcus aureus subsp. aureus N315
gauaaaaguuguauucugaa

SEQ ID NO: 2130813 - RNA, 15 nt, Staphylococcus aureus subsp. aureus N315
gauaaaaguuguauu

SEQ ID NO: 2130814 - RNA, 21 nt, Staphylococcus aureus subsp. aureus N315
gauaaacaagccaagauaaau

SEQ ID NO: 2130815 - RNA, 19 nt, Staphylococcus aureus subsp. aureus N315
gauaaaaauuuaugucuua

SEQ ID NO: 2130816 - RNA, 19 nt, Staphylococcus aureus subsp. aureus N315
gauaaaaccaccuaccauu

SEQ ID NO: 2130817 - RNA, 21 nt, Staphylococcus aureus subsp. aureus N315
gauaaaaaauaaagucauaug

SEQ ID NO: 2130818 - RNA, 20 nt, Staphylococcus aureus subsp. aureus N315
gaguucuuuuugaugaucau

SEQ ID NO: 2130819 - RNA, 13 nt, Staphylococcus aureus subsp. aureus N315
gaguuaaacgaaa

SEQ ID NO: 2130820 - RNA, 15 nt, Staphylococcus aureus subsp. aureus N315
gaauuucgaaaagaa

SEQ ID NO: 2130821 - RNA, 17 nt, Staphylococcus aureus subsp. aureus N315
gaauuucgaaaagaaau

SEQ ID NO: 2130822 - RNA, 18 nt, Staphylococcus aureus subsp. aureus N315
gaauuucgaaaagaaauu

SEQ ID NO: 2130823 - RNA, 13 nt, Staphylococcus aureus subsp. aureus N315
gaguauaucagcu

SEQ ID NO: 2130824 - RNA, 11 nt, Staphylococcus aureus subsp. aureus N315
gaguauauucg

SEQ ID NO: 2130825 - RNA, 16 nt, Staphylococcus aureus subsp. aureus N315
gaauuugcacaaagau

SEQ ID NO: 2130826 - RNA, 20 nt, Staphylococcus aureus subsp. aureus N315
gagucaaagucauuuagaua

SEQ ID NO: 2130827 - RNA, 13 nt, Staphylococcus aureus subsp. aureus N315
cuuuuauauuuuu

SEQ ID NO: 2130828 - RNA, 12 nt, Staphylococcus aureus subsp. aureus N315
cuuuuauagaaa

SEQ ID NO: 2130829 - RNA, 13 nt, Staphylococcus aureus subsp. aureus N315
cuuuuauuauuuu

SEQ ID NO: 2130830 - RNA, 10 nt, Staphylococcus aureus subsp. aureus N315
cuuuuaugca

SEQ ID NO: 2130831 - RNA, 14 nt, Staphylococcus aureus subsp. aureus N315
cuuuuaugcaugcg

SEQ ID NO: 2130832 - RNA, 18 nt, Staphylococcus aureus subsp. aureus N315
cuuuuacaaacuucacau

SEQ ID NO: 2130833 - RNA, 17 nt, Staphylococcus aureus subsp. aureus N315
cuuuuacgccuucuuua

SEQ ID NO: 2130834 - RNA, 20 nt, Staphylococcus aureus subsp. aureus N315
cuuuuaccucugauaaauga

SEQ ID NO: 2130835 - RNA, 21 nt, Staphylococcus aureus subsp. aureus N315
cuuuuacuuucucaucuauuu

SEQ ID NO: 2130836 - RNA, 12 nt, Staphylococcus aureus subsp. aureus N315
cuuuuagauuau

SEQ ID NO: 2130837 - RNA, 18 nt, Staphylococcus aureus subsp. aureus N315
cuuuucaucguucauaua

SEQ ID NO: 2130838 - RNA, 19 nt, Staphylococcus aureus subsp. aureus N315
cuuuucauuaucauuaagu

SEQ ID NO: 2130839 - RNA, 12 nt, Staphylococcus aureus subsp. aureus N315
cuuuuauuuuca

SEQ ID NO: 2130840 - RNA, 12 nt, Staphylococcus aureus subsp. aureus N315
cuuuucaaaaua

SEQ ID NO: 2130841 - RNA, 17 nt, Staphylococcus aureus subsp. aureus N315
cuuuuauuuaucuuuua

SEQ ID NO: 2130842 - RNA, 18 nt, Staphylococcus aureus subsp. aureus N315
cuuuucaaacauauucau

SEQ ID NO: 2130843 - RNA, 17 nt, Staphylococcus aureus subsp. aureus N315
cuuuucaaacauauuca

SEQ ID NO: 2130844 - RNA, 21 nt, Staphylococcus aureus subsp. aureus N315
cuuuuccauaaauauuuaaaa

SEQ ID NO: 2130845 - RNA, 19 nt, Staphylococcus aureus subsp. aureus N315
cuuuguuguaagguggacu

SEQ ID NO: 2130846 - RNA, 22 nt, Staphylococcus aureus subsp. aureus N315
cuuuguuggggcccacacccca

SEQ ID NO: 2130847 - RNA, 21 nt, Staphylococcus aureus subsp. aureus N315
cuuuguuggggcccacacccc

SEQ ID NO: 2130848 - RNA, 20 nt, Staphylococcus aureus subsp. aureus N315
cuuuguuggggcccacaccc

SEQ ID NO: 2130849 - RNA, 15 nt, Staphylococcus aureus subsp. aureus N315
cuuuguuggggccca

SEQ ID NO: 2130850 - RNA, 14 nt, Staphylococcus aureus subsp. aureus N315
cuuuguuggggccc

SEQ ID NO: 2130851 - RNA, 18 nt, Staphylococcus aureus subsp. aureus N315
cuuuuaaaccguguucuu

SEQ ID NO: 2130852 - RNA, 14 nt, Staphylococcus aureus subsp. aureus N315
cuuuguuuucagua

SEQ ID NO: 2130853 - RNA, 12 nt, Staphylococcus aureus subsp. aureus N315
cuuuuaaaaaac

SEQ ID NO: 2130854 - RNA, 17 nt, Staphylococcus aureus subsp. aureus N315
cuuuuaaaccguguucu

SEQ ID NO: 2130855 - RNA, 16 nt, Staphylococcus aureus subsp. aureus N315
cuuuuaauucuuaauc

SEQ ID NO: 2130856 - RNA, 21 nt, Staphylococcus aureus subsp. aureus N315
cuuuuaauauuugauaacaaa

SEQ ID NO: 2130857 - RNA, 16 nt, Staphylococcus aureus subsp. aureus N315
cuuuuaauaucuucua

SEQ ID NO: 2130858 - RNA, 18 nt, Staphylococcus aureus subsp. aureus N315
cuuuuaauuguauuuucu

SEQ ID NO: 2130859 - RNA, 15 nt, Staphylococcus aureus subsp. aureus N315
cuuuuacaaacuuca

SEQ ID NO: 2130860 - RNA, 17 nt, Staphylococcus aureus subsp. aureus N315
cuuuuacaaacuucaca

SEQ ID NO: 2130861 - RNA, 23 nt, Staphylococcus aureus subsp. aureus N315
cuuuuacaaacuucacaucaugu

SEQ ID NO: 2130862 - RNA, 13 nt, Staphylococcus aureus subsp. aureus N315
cuuuuaaauuaaa

SEQ ID NO: 2130863 - RNA, 12 nt, Staphylococcus aureus subsp. aureus N315
cuuuuaaacgau

SEQ ID NO: 2130864 - RNA, 22 nt, Staphylococcus aureus subsp. aureus N315
cuuuuaacccacauuaaauauu

SEQ ID NO: 2130865 - RNA, 14 nt, Staphylococcus aureus subsp. aureus N315
cuuuguguuugcuu

SEQ ID NO: 2130866 - RNA, 16 nt, Staphylococcus aureus subsp. aureus N315
cuuuguguuugcuuuu

SEQ ID NO: 2130867 - RNA, 17 nt, Staphylococcus aureus subsp. aureus N315
cuuuguggauucucuuu

SEQ ID NO: 2130868 - RNA, 21 nt, Staphylococcus aureus subsp. aureus N315
cuuugucauuuugauuaagug

SEQ ID NO: 2130869 - RNA, 11 nt, Staphylococcus aureus subsp. aureus N315
cuuucuuuucu

SEQ ID NO: 2130870 - RNA, 16 nt, Staphylococcus aureus subsp. aureus N315
cuuucuuuuucaucuu

SEQ ID NO: 2130871 - RNA, 20 nt, Staphylococcus aureus subsp. aureus N315
cuuuucgcaaaucccuucuc

SEQ ID NO: 2130872 - RNA, 16 nt, Staphylococcus aureus subsp. aureus N315
cuuuuccuugauucuu

SEQ ID NO: 2130873 - RNA, 19 nt, Staphylococcus aureus subsp. aureus N315
cuuuugauagcuaaugcau

SEQ ID NO: 2130874 - RNA, 19 nt, Staphylococcus aureus subsp. aureus N315
cuuuugauccaaaguacuc

SEQ ID NO: 2130875 - RNA, 21 nt, Staphylococcus aureus subsp. aureus N315
cuuuugagacguuuuccauga

SEQ ID NO: 2130876 - RNA, 14 nt, Staphylococcus aureus subsp. aureus N315
cuuuuguuaaaaaa

SEQ ID NO: 2130877 - RNA, 16 nt, Staphylococcus aureus subsp. aureus N315
cuuuugcuguaucuuc

SEQ ID NO: 2130878 - RNA, 13 nt, Staphylococcus aureus subsp. aureus N315
cuuuuguaaaaaa

SEQ ID NO: 2130879 - RNA, 13 nt, Staphylococcus aureus subsp. aureus N315
cuuuuggucuguu

SEQ ID NO: 2130880 - RNA, 22 nt, Staphylococcus aureus subsp. aureus N315
cuuuugggaagcgucuuuuuug

SEQ ID NO: 2130881 - RNA, 12 nt, Staphylococcus aureus subsp. aureus N315
cuuuuuaggaug

SEQ ID NO: 2130882 - RNA, 17 nt, Staphylococcus aureus subsp. aureus N315
cuuuuuauuauacuuua

SEQ ID NO: 2130883 - RNA, 19 nt, Staphylococcus aureus subsp. aureus N315
cuuuuuaucaacaaauuua

SEQ ID NO: 2130884 - RNA, 21 nt, Staphylococcus aureus subsp. aureus N315
cuuuuucaaauaauauaaaac

SEQ ID NO: 2130885 - RNA, 23 nt, Staphylococcus aureus subsp. aureus N315
cuuuuuauuuauaacuuuaaaaa

SEQ ID NO: 2130886 - RNA, 14 nt, Staphylococcus aureus subsp. aureus N315
cuuuuuauuuuuug

SEQ ID NO: 2130887 - RNA, 17 nt, Staphylococcus aureus subsp. aureus N315
cuuuuuauuuuaauauu

SEQ ID NO: 2130888 - RNA, 21 nt, Staphylococcus aureus subsp. aureus N315
cuuuuuauuuuaauauuuucu

SEQ ID NO: 2130889 - RNA, 14 nt, Staphylococcus aureus subsp. aureus N315
cuuuuuauuuuguu

SEQ ID NO: 2130890 - RNA, 12 nt, Staphylococcus aureus subsp. aureus N315
cuuuuuaaagua

SEQ ID NO: 2130891 - RNA, 16 nt, Staphylococcus aureus subsp. aureus N315
cuuuuuaaaaucguua

SEQ ID NO: 2130892 - RNA, 12 nt, Staphylococcus aureus subsp. aureus N315
cuuuuuaaaaua

SEQ ID NO: 2130893 - RNA, 12 nt, Staphylococcus aureus subsp. aureus N315
cuuuuuaaaaaa

SEQ ID NO: 2130894 - RNA, 20 nt, Staphylococcus aureus subsp. aureus N315
cuuuuuacuauguaacuuua

SEQ ID NO: 2130895 - RNA, 23 nt, Staphylococcus aureus subsp. aureus N315
cuuuuuaacuauguuacuuauau

SEQ ID NO: 2130896 - RNA, 14 nt, Staphylococcus aureus subsp. aureus N315
cuuuuuaaaugauu

SEQ ID NO: 2130897 - RNA, 17 nt, Staphylococcus aureus subsp. aureus N315
cuuuuuacauuuucaaa

SEQ ID NO: 2130898 - RNA, 17 nt, Staphylococcus aureus subsp. aureus N315
cuuuuucuauacaauga

SEQ ID NO: 2130899 - RNA, 19 nt, Staphylococcus aureus subsp. aureus N315
cuuuuugacauauuuuuua

SEQ ID NO: 2130900 - RNA, 12 nt, Staphylococcus aureus subsp. aureus N315
cuuuuucuuuca

SEQ ID NO: 2130901 - RNA, 22 nt, Staphylococcus aureus subsp. aureus N315
cuuuuugccuggcaacguucua

SEQ ID NO: 2130902 - RNA, 22 nt, Staphylococcus aureus subsp. aureus N315
cuuuuugaaauuucgacaucua

SEQ ID NO: 2130903 - RNA, 21 nt, Staphylococcus aureus subsp. aureus N315
cuuuuucauagaacaaaaugu

SEQ ID NO: 2130904 - RNA, 13 nt, Staphylococcus aureus subsp. aureus N315
cuuuuucaucuuu

SEQ ID NO: 2130905 - RNA, 16 nt, Staphylococcus aureus subsp. aureus N315
cuuuuucuaaauaaac

SEQ ID NO: 2130906 - RNA, 17 nt, Staphylococcus aureus subsp. aureus N315
cuuuuucuaccaauaau

SEQ ID NO: 2130907 - RNA, 15 nt, Staphylococcus aureus subsp. aureus N315
cuuuuucuaaauaaa

SEQ ID NO: 2130908 - RNA, 16 nt, Staphylococcus aureus subsp. aureus N315
gaaaagaaauucuaca

SEQ ID NO: 2130909 - RNA, 19 nt, Staphylococcus aureus subsp. aureus N315
gaaaagaaauucuacaggu

SEQ ID NO: 2130910 - RNA, 16 nt, Staphylococcus aureus subsp. aureus N315
gaaaacuauuuuaaaa

SEQ ID NO: 2130911 - RNA, 17 nt, Staphylococcus aureus subsp. aureus N315
gaaaauaaaacaaauua

SEQ ID NO: 2130912 - RNA, 18 nt, Staphylococcus aureus subsp. aureus N315
gaaaauaagcuuguaaca

SEQ ID NO: 2130913 - RNA, 23 nt, Staphylococcus aureus subsp. aureus N315
gaaaauaagcuuguaacaagcau

SEQ ID NO: 2130914 - RNA, 10 nt, Staphylococcus aureus subsp. aureus N315
gaaaauaaua

SEQ ID NO: 2130915 - RNA, 20 nt, Staphylococcus aureus subsp. aureus N315
gaaaauaaucgaacagaaaa

SEQ ID NO: 2130916 - RNA, 21 nt, Staphylococcus aureus subsp. aureus N315
gaaaauaaucgaacagaaaau

SEQ ID NO: 2130917 - RNA, 16 nt, Staphylococcus aureus subsp. aureus N315
gaaaauaagcuuguaa

SEQ ID NO: 2130918 - RNA, 22 nt, Staphylococcus aureus subsp. aureus N315
gaaaauagcuauuaaaauagag

SEQ ID NO: 2130919 - RNA, 20 nt, Staphylococcus aureus subsp. aureus N315
gaaaauagcuguuugauauu

SEQ ID NO: 2130920 - RNA, 18 nt, Staphylococcus aureus subsp. aureus N315
gaaaauagccauauucau

SEQ ID NO: 2130921 - RNA, 15 nt, Staphylococcus aureus subsp. aureus N315
gaaaauagaaagaaa

SEQ ID NO: 2130922 - RNA, 17 nt, Staphylococcus aureus subsp. aureus N315
gaaaauacuauacugau

SEQ ID NO: 2130923 - RNA, 14 nt, Staphylococcus aureus subsp. aureus N315
gaaaaguauaugaa

SEQ ID NO: 2130924 - RNA, 18 nt, Staphylococcus aureus subsp. aureus N315
gaaaagugcgauuaucag

SEQ ID NO: 2130925 - RNA, 12 nt, Staphylococcus aureus subsp. aureus N315
gaaaauaucauu

SEQ ID NO: 2130926 - RNA, 16 nt, Staphylococcus aureus subsp. aureus N315
gaaaauaucuuacugc

SEQ ID NO: 2130927 - RNA, 20 nt, Staphylococcus aureus subsp. aureus N315
gaaaauauaguggugguacu

SEQ ID NO: 2130928 - RNA, 15 nt, Staphylococcus aureus subsp. aureus N315
gaaaauaugauaacu

SEQ ID NO: 2130929 - RNA, 22 nt, Staphylococcus aureus subsp. aureus N315
gaaaaugacgauacguauauag

SEQ ID NO: 2130930 - RNA, 18 nt, Staphylococcus aureus subsp. aureus N315
gaaaaucucuguauugag

SEQ ID NO: 2130931 - RNA, 18 nt, Staphylococcus aureus subsp. aureus N315
gaaaauugaguauauuca

SEQ ID NO: 2130932 - RNA, 18 nt, Staphylococcus aureus subsp. aureus N315
gaaaauucgcuuguaaca

SEQ ID NO: 2130933 - RNA, 22 nt, Staphylococcus aureus subsp. aureus N315
gaaaauuucucacugcuguucu

SEQ ID NO: 2130934 - RNA, 21 nt, Staphylococcus aureus subsp. aureus N315
gaaaauuauuugauauuucau

SEQ ID NO: 2130935 - RNA, 19 nt, Staphylococcus aureus subsp. aureus N315
gaaacaaaacaaaaaauau

SEQ ID NO: 2130936 - RNA, 15 nt, Staphylococcus aureus subsp. aureus N315
gaaacacacuaaaag

SEQ ID NO: 2130937 - RNA, 21 nt, Staphylococcus aureus subsp. aureus N315
gaaacaagaaguuuccaacgu

SEQ ID NO: 2130938 - RNA, 22 nt, Staphylococcus aureus subsp. aureus N315
gaaacaauucauuaauaggauu

SEQ ID NO: 2130939 - RNA, 20 nt, Staphylococcus aureus subsp. aureus N315
gaaaaagugauaauuaaaau

SEQ ID NO: 2130940 - RNA, 20 nt, Staphylococcus aureus subsp. aureus N315
gaaaaagauucggaaaauau

SEQ ID NO: 2130941 - RNA, 17 nt, Staphylococcus aureus subsp. aureus N315
gaaaaagcuaauucuua

SEQ ID NO: 2130942 - RNA, 21 nt, Staphylococcus aureus subsp. aureus N315
gaaaaacuucuuaacuugaaa

SEQ ID NO: 2130943 - RNA, 18 nt, Staphylococcus aureus subsp. aureus N315
gaaaaagaugaaaaaguc

SEQ ID NO: 2130944 - RNA, 16 nt, Staphylococcus aureus subsp. aureus N315
gaaaaauuucaaaaau

SEQ ID NO: 2130945 - RNA, 19 nt, Staphylococcus aureus subsp. aureus N315
gaaaaauguguuaaaauau

SEQ ID NO: 2130946 - RNA, 18 nt, Staphylococcus aureus subsp. aureus N315
gaaaaauuucaaaaauag

SEQ ID NO: 2130947 - RNA, 12 nt, Staphylococcus aureus subsp. aureus N315
gaaaaaccaagu

SEQ ID NO: 2130948 - RNA, 22 nt, Staphylococcus aureus subsp. aureus N315
gaaaaaauuaauaauuuuccau

SEQ ID NO: 2130949 - RNA, 13 nt, Staphylococcus aureus subsp. aureus N315
cuuuuuuuuauaa

SEQ ID NO: 2130950 - RNA, 13 nt, Staphylococcus aureus subsp. aureus N315
cuuuuuugugauu

SEQ ID NO: 2130951 - RNA, 16 nt, Staphylococcus aureus subsp. aureus N315
cuuuuuuuaaaucuuc

SEQ ID NO: 2130952 - RNA, 17 nt, Staphylococcus aureus subsp. aureus N315
cuuuuuuuauaaguauu

SEQ ID NO: 2130953 - RNA, 23 nt, Staphylococcus aureus subsp. aureus N315
cuuuuuuuaaaucuucuauuuuc

SEQ ID NO: 2130954 - RNA, 20 nt, Staphylococcus aureus subsp. aureus N315
cuuuuuucucuucuugaggu

SEQ ID NO: 2130955 - RNA, 20 nt, Staphylococcus aureus subsp. aureus N315
cuuuuuuauuuuauaagaau

SEQ ID NO: 2130956 - RNA, 20 nt, Staphylococcus aureus subsp. aureus N315
cuuuuugucucucaacauuu

SEQ ID NO: 2130957 - RNA, 21 nt, Staphylococcus aureus subsp. aureus N315
cuuuuugcguuuuuaaauaau

SEQ ID NO: 2130958 - RNA, 16 nt, Staphylococcus aureus subsp. aureus N315
cuuuuuuaagaucaau

SEQ ID NO: 2130959 - RNA, 19 nt, Staphylococcus aureus subsp. aureus N315
cuuuuuuaccagcaugaau

SEQ ID NO: 2130960 - RNA, 14 nt, Staphylococcus aureus subsp. aureus N315
cuuuuuuaaauuua

SEQ ID NO: 2130961 - RNA, 12 nt, Staphylococcus aureus subsp. aureus N315
cuuuuuuaaguu

SEQ ID NO: 2130962 - RNA, 17 nt, Staphylococcus aureus subsp. aureus N315
cuuuuuuaagcuuauca

SEQ ID NO: 2130963 - RNA, 14 nt, Staphylococcus aureus subsp. aureus N315
gaaacauuaaaaua

SEQ ID NO: 2130964 - RNA, 21 nt, Staphylococcus aureus subsp. aureus N315
gaaagacguuuuuuuauaaau

SEQ ID NO: 2130965 - RNA, 14 nt, Staphylococcus aureus subsp. aureus N315
gaaacuuaaauauu

SEQ ID NO: 2130966 - RNA, 14 nt, Staphylococcus aureus subsp. aureus N315
gaaacuuuaauacu

SEQ ID NO: 2130967 - RNA, 19 nt, Staphylococcus aureus subsp. aureus N315
gaaacgucuuaauucuucu

SEQ ID NO: 2130968 - RNA, 21 nt, Staphylococcus aureus subsp. aureus N315
gaaagcuaauaucaauaaugc

SEQ ID NO: 2130969 - RNA, 22 nt, Staphylococcus aureus subsp. aureus N315
gaaagaugggauuucacuugac

SEQ ID NO: 2130970 - RNA, 22 nt, Staphylococcus aureus subsp. aureus N315
gaaaggcuagcuaaaauuugcu

SEQ ID NO: 2130971 - RNA, 20 nt, Staphylococcus aureus subsp. aureus N315
gaaaguauuagauauauuug

SEQ ID NO: 2130972 - RNA, 18 nt, Staphylococcus aureus subsp. aureus N315
gaaaguaccuaaaauaga

SEQ ID NO: 2130973 - RNA, 22 nt, Staphylococcus aureus subsp. aureus N315
gaaaguaccuaaaauagaaaaa

SEQ ID NO: 2130974 - RNA, 20 nt, Staphylococcus aureus subsp. aureus N315
gaaaguaucuaugaaauuuu

SEQ ID NO: 2130975 - RNA, 20 nt, Staphylococcus aureus subsp. aureus N315
gaaaguaauaaguaauaauu

SEQ ID NO: 2130976 - RNA, 17 nt, Staphylococcus aureus subsp. aureus N315
gaaauacuugaauuuaa

SEQ ID NO: 2130977 - RNA, 15 nt, Staphylococcus aureus subsp. aureus N315
gaaauaucaagaugu

SEQ ID NO: 2130978 - RNA, 17 nt, Staphylococcus aureus subsp. aureus N315
gaaauauuguaaucacu

SEQ ID NO: 2130979 - RNA, 19 nt, Staphylococcus aureus subsp. aureus N315
gaaauauuugaaaauuuca

SEQ ID NO: 2130980 - RNA, 14 nt, Staphylococcus aureus subsp. aureus N315
gaaauaaaaaauaa

SEQ ID NO: 2130981 - RNA, 16 nt, Staphylococcus aureus subsp. aureus N315
gaaauaaaaaaacacc

SEQ ID NO: 2130982 - RNA, 21 nt, Staphylococcus aureus subsp. aureus N315
gaaauaaucuaguaucuauca

SEQ ID NO: 2130983 - RNA, 19 nt, Staphylococcus aureus subsp. aureus N315
gaaaguugcuuagcuucuc

SEQ ID NO: 2130984 - RNA, 15 nt, Staphylococcus aureus subsp. aureus N315
gaaaguguaugcaug

SEQ ID NO: 2130985 - RNA, 23 nt, Staphylococcus aureus subsp. aureus N315
gaaagucuuuaacccaaauugau

SEQ ID NO: 2130986 - RNA, 16 nt, Staphylococcus aureus subsp. aureus N315
gaaagugauucccaaa

SEQ ID NO: 2130987 - RNA, 13 nt, Staphylococcus aureus subsp. aureus N315
gaacaucaucuau

SEQ ID NO: 2130988 - RNA, 18 nt, Staphylococcus aureus subsp. aureus N315
gaacauauucauaauauc

SEQ ID NO: 2130989 - RNA, 22 nt, Staphylococcus aureus subsp. aureus N315
gaacauaccugcauauguguuu

SEQ ID NO: 2130990 - RNA, 19 nt, Staphylococcus aureus subsp. aureus N315
gaacaucuaguuauuucau

SEQ ID NO: 2130991 - RNA, 15 nt, Staphylococcus aureus subsp. aureus N315
gaacaucugaaaaaa

SEQ ID NO: 2130992 - RNA, 23 nt, Staphylococcus aureus subsp. aureus N315
gaaccaauccaauauacaaugcu

SEQ ID NO: 2130993 - RNA, 16 nt, Staphylococcus aureus subsp. aureus N315
gaacaugaaugauauu

SEQ ID NO: 2130994 - RNA, 17 nt, Staphylococcus aureus subsp. aureus N315
gaacauaaauaaacuuu

SEQ ID NO: 2130995 - RNA, 13 nt, Staphylococcus aureus subsp. aureus N315
gaacauaaauaaa

SEQ ID NO: 2130996 - RNA, 17 nt, Staphylococcus aureus subsp. aureus N315
gaacaguuagugcuugu

SEQ ID NO: 2130997 - RNA, 19 nt, Staphylococcus aureus subsp. aureus N315
gaacaauaccgccuacugu

SEQ ID NO: 2130998 - RNA, 23 nt, Staphylococcus aureus subsp. aureus N315
gaacaaucaauacagagucuaca

SEQ ID NO: 2130999 - RNA, 19 nt, Staphylococcus aureus subsp. aureus N315
gaacagcaucuuguucuuc

SEQ ID NO: 2131000 - RNA, 16 nt, Staphylococcus aureus subsp. aureus N315
gaacagcacauuuuua

SEQ ID NO: 2131001 - RNA, 18 nt, Staphylococcus aureus subsp. aureus N315
gaaauuguguuucuuuua

SEQ ID NO: 2131002 - RNA, 21 nt, Staphylococcus aureus subsp. aureus N315
gaaauuguguugaaucaacag

SEQ ID NO: 2131003 - RNA, 22 nt, Staphylococcus aureus subsp. aureus N315
gaaauuuuuuagugaaaaaguu

SEQ ID NO: 2131004 - RNA, 16 nt, Staphylococcus aureus subsp. aureus N315
gaacaacauuaggaug

SEQ ID NO: 2131005 - RNA, 20 nt, Staphylococcus aureus subsp. aureus N315
gaacaacauugagauuaucu

SEQ ID NO: 2131006 - RNA, 21 nt, Staphylococcus aureus subsp. aureus N315
gaaauucucuuuguuggggcc

SEQ ID NO: 2131007 - RNA, 20 nt, Staphylococcus aureus subsp. aureus N315
gaaauucucaguguuggggg

SEQ ID NO: 2131008 - RNA, 15 nt, Staphylococcus aureus subsp. aureus N315
gaaauucuacaggua

SEQ ID NO: 2131009 - RNA, 16 nt, Staphylococcus aureus subsp. aureus N315
gaaauucuacagguaa

SEQ ID NO: 2131010 - RNA, 21 nt, Staphylococcus aureus subsp. aureus N315
gaaauucuacagguaaugcaa

SEQ ID NO: 2131011 - RNA, 21 nt, Staphylococcus aureus subsp. aureus N315
gaaauucuacaggcaaugcaa

SEQ ID NO: 2131012 - RNA, 16 nt, Staphylococcus aureus subsp. aureus N315
gaaauucuacaggcaa

SEQ ID NO: 2131013 - RNA, 21 nt, Staphylococcus aureus subsp. aureus N315
gaaauucuacaaacaaugcaa

SEQ ID NO: 2131014 - RNA, 16 nt, Staphylococcus aureus subsp. aureus N315
gaaauuaaaucgacaa

SEQ ID NO: 2131015 - RNA, 14 nt, Staphylococcus aureus subsp. aureus N315
gaaauuaaaucgac

SEQ ID NO: 2131016 - RNA, 16 nt, Staphylococcus aureus subsp. aureus N315
gaaauguuuuggaaaa

SEQ ID NO: 2131017 - RNA, 11 nt, Staphylococcus aureus subsp. aureus N315
gaaauuagaaa

SEQ ID NO: 2131018 - RNA, 14 nt, Staphylococcus aureus subsp. aureus N315
gaaauuagauuuua

SEQ ID NO: 2131019 - RNA, 17 nt, Staphylococcus aureus subsp. aureus N315
gaaauuaggaauccaau

SEQ ID NO: 2131020 - RNA, 13 nt, Staphylococcus aureus subsp. aureus N315
gaaaugcaaugag

SEQ ID NO: 2131021 - RNA, 15 nt, Staphylococcus aureus subsp. aureus N315
gaaaugauaauuuaa

SEQ ID NO: 2131022 - RNA, 21 nt, Staphylococcus aureus subsp. aureus N315
gaaaugauacauuauuaaaua

SEQ ID NO: 2131023 - RNA, 19 nt, Staphylococcus aureus subsp. aureus N315
gaaauguauaugagguuca

SEQ ID NO: 2131024 - RNA, 21 nt, Staphylococcus aureus subsp. aureus N315
gaaauguaugauauaaaccau

SEQ ID NO: 2131025 - RNA, 11 nt, Staphylococcus aureus subsp. aureus N315
gaaauguagau

SEQ ID NO: 2131026 - RNA, 17 nt, Staphylococcus aureus subsp. aureus N315
gaaauguagauuacuuu

SEQ ID NO: 2131027 - RNA, 14 nt, Staphylococcus aureus subsp. aureus N315
gaaaucauauauuu

SEQ ID NO: 2131028 - RNA, 17 nt, Staphylococcus aureus subsp. aureus N315
gaaaucauauauuucua

SEQ ID NO: 2131029 - RNA, 19 nt, Staphylococcus aureus subsp. aureus N315
gaaauccgcauaaauuaga

SEQ ID NO: 2131030 - RNA, 20 nt, Staphylococcus aureus subsp. aureus N315
gaaauccgcauaaauuagau

SEQ ID NO: 2131031 - RNA, 17 nt, Staphylococcus aureus subsp. aureus N315
gaaaucaaaaauaauua

SEQ ID NO: 2131032 - RNA, 21 nt, Staphylococcus aureus subsp. aureus N315
gaaaucaaaaauaauuaugaa

SEQ ID NO: 2131033 - RNA, 16 nt, Staphylococcus aureus subsp. aureus N315
gaaauccguuaaaauu

SEQ ID NO: 2131034 - RNA, 19 nt, Staphylococcus aureus subsp. aureus N315
gaacuucuuuuuuguaucu

SEQ ID NO: 2131035 - RNA, 15 nt, Staphylococcus aureus subsp. aureus N315
gaacuuuaauaccag

SEQ ID NO: 2131036 - RNA, 16 nt, Staphylococcus aureus subsp. aureus N315
gaacuuuucaaacaau

SEQ ID NO: 2131037 - RNA, 16 nt, Staphylococcus aureus subsp. aureus N315
gaagaaacuuaaucaa

SEQ ID NO: 2131038 - RNA, 18 nt, Staphylococcus aureus subsp. aureus N315
gaagaccacuauuuuuaa

SEQ ID NO: 2131039 - RNA, 22 nt, Staphylococcus aureus subsp. aureus N315
gaagaauccuaugccaaauaac

SEQ ID NO: 2131040 - RNA, 15 nt, Staphylococcus aureus subsp. aureus N315
gaagaauacaaauau

SEQ ID NO: 2131041 - RNA, 21 nt, Staphylococcus aureus subsp. aureus N315
gaagaaucaggaccaaauaga

SEQ ID NO: 2131042 - RNA, 14 nt, Staphylococcus aureus subsp. aureus N315
gaagaauacaaaua

SEQ ID NO: 2131043 - RNA, 15 nt, Staphylococcus aureus subsp. aureus N315
gaagagaugaaagau

SEQ ID NO: 2131044 - RNA, 23 nt, Staphylococcus aureus subsp. aureus N315
gaagauauuuauaagaggagaaa

SEQ ID NO: 2131045 - RNA, 15 nt, Staphylococcus aureus subsp. aureus N315
gaagcacagaaaauu

SEQ ID NO: 2131046 - RNA, 14 nt, Staphylococcus aureus subsp. aureus N315
gaagcacagaaaau

SEQ ID NO: 2131047 - RNA, 22 nt, Staphylococcus aureus subsp. aureus N315
gaagcgcuuggauuuuuugguu

SEQ ID NO: 2131048 - RNA, 20 nt, Staphylococcus aureus subsp. aureus N315
gaagcuaaaugcucaagcca

SEQ ID NO: 2131049 - RNA, 19 nt, Staphylococcus aureus subsp. aureus N315
gaaggaauguauucuaaga

SEQ ID NO: 2131050 - RNA, 17 nt, Staphylococcus aureus subsp. aureus N315
gaaggagauauuuucuu

SEQ ID NO: 2131051 - RNA, 18 nt, Staphylococcus aureus subsp. aureus N315
gaaggaaaauaaaaacca

SEQ ID NO: 2131052 - RNA, 22 nt, Staphylococcus aureus subsp. aureus N315
gaacucuuuuaacccacauuaa

SEQ ID NO: 2131053 - RNA, 16 nt, Staphylococcus aureus subsp. aureus N315
gaacuuaaugcuucaa

SEQ ID NO: 2131054 - RNA, 21 nt, Staphylococcus aureus subsp. aureus N315
gaacuuacaagucuaguucga

SEQ ID NO: 2131055 - RNA, 23 nt, Staphylococcus aureus subsp. aureus N315
gaacuuauaaguccgauuugaua

SEQ ID NO: 2131056 - RNA, 17 nt, Staphylococcus aureus subsp. aureus N315
gaacuuagaaaugcaau

SEQ ID NO: 2131057 - RNA, 20 nt, Staphylococcus aureus subsp. aureus N315
gaacugccaauauaacauuu

SEQ ID NO: 2131058 - RNA, 19 nt, Staphylococcus aureus subsp. aureus N315
gaacuacgcauuuuaaaua

SEQ ID NO: 2131059 - RNA, 17 nt, Staphylococcus aureus subsp. aureus N315
gaacuagacaagaugcu

SEQ ID NO: 2131060 - RNA, 17 nt, Staphylococcus aureus subsp. aureus N315
gaacuauuaaaaccaaa

SEQ ID NO: 2131061 - RNA, 19 nt, Staphylococcus aureus subsp. aureus N315
gaacuaguacgaaaugcaa

SEQ ID NO: 2131062 - RNA, 19 nt, Staphylococcus aureus subsp. aureus N315
gaacguguuugaauggcaa

SEQ ID NO: 2131063 - RNA, 18 nt, Staphylococcus aureus subsp. aureus N315
gaacguaaguuuaguuca

SEQ ID NO: 2131064 - RNA, 16 nt, Staphylococcus aureus subsp. aureus N315
gaaccugcugaaguuu

SEQ ID NO: 2131065 - RNA, 13 nt, Staphylococcus aureus subsp. aureus N315
gaaccuauuuuuu

SEQ ID NO: 2131066 - RNA, 21 nt, Staphylococcus aureus subsp. aureus N315
gaaccuauuuuuuauaugaug

SEQ ID NO: 2131067 - RNA, 20 nt, Staphylococcus aureus subsp. aureus N315
gaacgauauuuuaaaaagua

SEQ ID NO: 2131068 - RNA, 21 nt, Staphylococcus aureus subsp. aureus N315
gaacgauauuuuaaaaaguaa

SEQ ID NO: 2131069 - RNA, 17 nt, Staphylococcus aureus subsp. aureus N315
gaaccauacucuaacuu

SEQ ID NO: 2131070 - RNA, 18 nt, Staphylococcus aureus subsp. aureus N315
gaauuaucuauauaugaa

SEQ ID NO: 2131071 - RNA, 20 nt, Staphylococcus aureus subsp. aureus N315
gaauuaucuauauaugaaga

SEQ ID NO: 2131072 - RNA, 16 nt, Staphylococcus aureus subsp. aureus N315
gaauuaguacuugaaa

SEQ ID NO: 2131073 - RNA, 17 nt, Staphylococcus aureus subsp. aureus N315
gaauuauuuaaaaugcu

SEQ ID NO: 2131074 - RNA, 17 nt, Staphylococcus aureus subsp. aureus N315
gaauuauucaaguaaua

SEQ ID NO: 2131075 - RNA, 20 nt, Staphylococcus aureus subsp. aureus N315
gaauuaguaaacuaauccuc

SEQ ID NO: 2131076 - RNA, 17 nt, Staphylococcus aureus subsp. aureus N315
gaauuagauuuacgguu

SEQ ID NO: 2131077 - RNA, 23 nt, Staphylococcus aureus subsp. aureus N315
gaauuaauaauuuuuuuccuuuc

SEQ ID NO: 2131078 - RNA, 15 nt, Staphylococcus aureus subsp. aureus N315
gaauuaacaacaaau

SEQ ID NO: 2131079 - RNA, 11 nt, Staphylococcus aureus subsp. aureus N315
gaauucaacgu

SEQ ID NO: 2131080 - RNA, 16 nt, Staphylococcus aureus subsp. aureus N315
gaauucaaccaauuau

SEQ ID NO: 2131081 - RNA, 18 nt, Staphylococcus aureus subsp. aureus N315
gaauuauucaaguaauau

SEQ ID NO: 2131082 - RNA, 18 nt, Staphylococcus aureus subsp. aureus N315
gaauucauucaauacgaa

SEQ ID NO: 2131083 - RNA, 16 nt, Staphylococcus aureus subsp. aureus N315
gaauuguauuagcaau

SEQ ID NO: 2131084 - RNA, 18 nt, Staphylococcus aureus subsp. aureus N315
gaauugcuuuaaacuuau

SEQ ID NO: 2131085 - RNA, 19 nt, Staphylococcus aureus subsp. aureus N315
gaauuuacuccuuacaaua

SEQ ID NO: 2131086 - RNA, 20 nt, Staphylococcus aureus subsp. aureus N315
gaauuuacuccuuacaauaa

SEQ ID NO: 2131087 - RNA, 21 nt, Staphylococcus aureus subsp. aureus N315
gaauuuaggaaugaauaaagc

SEQ ID NO: 2131088 - RNA, 23 nt, Staphylococcus aureus subsp. aureus N315
gaauuuacuccuuacaauaaaga

SEQ ID NO: 2131089 - RNA, 23 nt, Staphylococcus aureus subsp. aureus N315
gaauuuagaugcauaaaaaaaga

SEQ ID NO: 2131090 - RNA, 18 nt, Staphylococcus aureus subsp. aureus N315
gaauuuagcaucaaaaau

SEQ ID NO: 2131091 - RNA, 11 nt, Staphylococcus aureus subsp. aureus N315
gaauugaguau

SEQ ID NO: 2131092 - RNA, 16 nt, Staphylococcus aureus subsp. aureus N315
gaauugaguauuaaau

SEQ ID NO: 2131093 - RNA, 19 nt, Staphylococcus aureus subsp. aureus N315
gaauugccagaauucccaa

SEQ ID NO: 2131094 - RNA, 21 nt, Staphylococcus aureus subsp. aureus N315
gaaugcgauuuccuuuagcaa

SEQ ID NO: 2131095 - RNA, 13 nt, Staphylococcus aureus subsp. aureus N315
gaaugccuaauuu

SEQ ID NO: 2131096 - RNA, 21 nt, Staphylococcus aureus subsp. aureus N315
gaaugcaaaucaaauacauca

SEQ ID NO: 2131097 - RNA, 22 nt, Staphylococcus aureus subsp. aureus N315
gaauuaacuagugccucuuuua

SEQ ID NO: 2131098 - RNA, 17 nt, Staphylococcus aureus subsp. aureus N315
gaauuaagaaaaguuac

SEQ ID NO: 2131099 - RNA, 19 nt, Staphylococcus aureus subsp. aureus N315
gaauuaacaacaaauauaa

SEQ ID NO: 2131100 - RNA, 17 nt, Staphylococcus aureus subsp. aureus N315
gaauuaaaauaacucgc

SEQ ID NO: 2131101 - RNA, 15 nt, Staphylococcus aureus subsp. aureus N315
gaaugugaugauuaa

SEQ ID NO: 2131102 - RNA, 13 nt, Staphylococcus aureus subsp. aureus N315
gaauguuccuugu

SEQ ID NO: 2131103 - RNA, 18 nt, Staphylococcus aureus subsp. aureus N315
gaauguauucuaagaguu

SEQ ID NO: 2131104 - RNA, 13 nt, Staphylococcus aureus subsp. aureus N315
gaauguacaauuu

SEQ ID NO: 2131105 - RNA, 13 nt, Staphylococcus aureus subsp. aureus N315
gaaugguauaauu

SEQ ID NO: 2131106 - RNA, 23 nt, Staphylococcus aureus subsp. aureus N315
gaaugaugguguguacugauucc

SEQ ID NO: 2131107 - RNA, 17 nt, Staphylococcus aureus subsp. aureus N315
gaaugaugaguauacuu

SEQ ID NO: 2131108 - RNA, 19 nt, Staphylococcus aureus subsp. aureus N315
gaaugagugucaugcuuaa

SEQ ID NO: 2131109 - RNA, 14 nt, Staphylococcus aureus subsp. aureus N315
gaaugauagauuua

SEQ ID NO: 2131110 - RNA, 14 nt, Staphylococcus aureus subsp. aureus N315
gaaugaauaauucc

SEQ ID NO: 2131111 - RNA, 13 nt, Staphylococcus aureus subsp. aureus N315
gaaugaaccuuua

SEQ ID NO: 2131112 - RNA, 17 nt, Staphylococcus aureus subsp. aureus N315
gaaucuuauuuuguuuu

SEQ ID NO: 2131113 - RNA, 22 nt, Staphylococcus aureus subsp. aureus N315
gaaucuuauuuuguuuuaaaaa

SEQ ID NO: 2131114 - RNA, 15 nt, Staphylococcus aureus subsp. aureus N315
gaaucuaaacuauaa

SEQ ID NO: 2131115 - RNA, 13 nt, Staphylococcus aureus subsp. aureus N315
gaaucucauugau

SEQ ID NO: 2131116 - RNA, 18 nt, Staphylococcus aureus subsp. aureus N315
gaaucaauugcauacgua

SEQ ID NO: 2131117 - RNA, 20 nt, Staphylococcus aureus subsp. aureus N315
gaaucacaguuauauauucc

SEQ ID NO: 2131118 - RNA, 21 nt, Staphylococcus aureus subsp. aureus N315
gaaucagaugauuuaauucug

SEQ ID NO: 2131119 - RNA, 15 nt, Staphylococcus aureus subsp. aureus N315
gaaucgauauaauga

SEQ ID NO: 2131120 - RNA, 13 nt, Staphylococcus aureus subsp. aureus N315
gaauccuucauca

SEQ ID NO: 2131121 - RNA, 12 nt, Staphylococcus aureus subsp. aureus N315
gaaguuguuucu

SEQ ID NO: 2131122 - RNA, 13 nt, Staphylococcus aureus subsp. aureus N315
gaauaaaauauau

SEQ ID NO: 2131123 - RNA, 23 nt, Staphylococcus aureus subsp. aureus N315
gaaguuuuuagcauuaucaucac

SEQ ID NO: 2131124 - RNA, 16 nt, Staphylococcus aureus subsp. aureus N315
gaagggaguauuuuuu

SEQ ID NO: 2131125 - RNA, 13 nt, Staphylococcus aureus subsp. aureus N315
gaauaauauauuu

SEQ ID NO: 2131126 - RNA, 15 nt, Staphylococcus aureus subsp. aureus N315
gaauaaauagauaau

SEQ ID NO: 2131127 - RNA, 14 nt, Staphylococcus aureus subsp. aureus N315
gaauaaaucgggca

SEQ ID NO: 2131128 - RNA, 15 nt, Staphylococcus aureus subsp. aureus N315
gaauacuaaaagugu

SEQ ID NO: 2131129 - RNA, 18 nt, Staphylococcus aureus subsp. aureus N315
gaauaauugcuaaaauau

SEQ ID NO: 2131130 - RNA, 17 nt, Staphylococcus aureus subsp. aureus N315
gaauaauuuuaaaaaua

SEQ ID NO: 2131131 - RNA, 13 nt, Staphylococcus aureus subsp. aureus N315
gaauaauuaaaaa

SEQ ID NO: 2131132 - RNA, 15 nt, Staphylococcus aureus subsp. aureus N315
gaauacaaauauuaa

SEQ ID NO: 2131133 - RNA, 18 nt, Staphylococcus aureus subsp. aureus N315
gaauacagaugaugcuuc

SEQ ID NO: 2131134 - RNA, 23 nt, Staphylococcus aureus subsp. aureus N315
gaauauagauuuuguauuagcau

SEQ ID NO: 2131135 - RNA, 19 nt, Staphylococcus aureus subsp. aureus N315
gaauauuaagauguauaug

SEQ ID NO: 2131136 - RNA, 22 nt, Staphylococcus aureus subsp. aureus N315
gaauauuaacaccagauaucau

SEQ ID NO: 2131137 - RNA, 23 nt, Staphylococcus aureus subsp. aureus N315
gaauauuucccuaugaaauaacu

SEQ ID NO: 2131138 - RNA, 16 nt, Staphylococcus aureus subsp. aureus N315
gaauacuuuuuaacug

SEQ ID NO: 2131139 - RNA, 20 nt, Staphylococcus aureus subsp. aureus N315
gaauauacuaaaguucaaca

SEQ ID NO: 2131140 - RNA, 13 nt, Staphylococcus aureus subsp. aureus N315
gaauauaacgaau

SEQ ID NO: 2131141 - RNA, 18 nt, Staphylococcus aureus subsp. aureus N315
cuuaaaauaugauuuaaa

SEQ ID NO: 2131142 - RNA, 21 nt, Staphylococcus aureus subsp. aureus N315
cuuaaaauaugauuuaaaaua

SEQ ID NO: 2131143 - RNA, 17 nt, Staphylococcus aureus subsp. aureus N315
cuuaaaaugauuguuuu

SEQ ID NO: 2131144 - RNA, 14 nt, Staphylococcus aureus subsp. aureus N315
cuuaaaauuuaaau

SEQ ID NO: 2131145 - RNA, 16 nt, Staphylococcus aureus subsp. aureus N315
cuuaaaauugaauauc

SEQ ID NO: 2131146 - RNA, 15 nt, Staphylococcus aureus subsp. aureus N315
cuuaaaauuuaaaua

SEQ ID NO: 2131147 - RNA, 18 nt, Staphylococcus aureus subsp. aureus N315
cuuaaaauuuaaauauug

SEQ ID NO: 2131148 - RNA, 21 nt, Staphylococcus aureus subsp. aureus N315
cuuaaaauuuaaauauugaag

SEQ ID NO: 2131149 - RNA, 13 nt, Staphylococcus aureus subsp. aureus N315
cuuaaacaaauaa

SEQ ID NO: 2131150 - RNA, 19 nt, Staphylococcus aureus subsp. aureus N315
cuuaaaaacgcuuuuaaac

SEQ ID NO: 2131151 - RNA, 20 nt, Staphylococcus aureus subsp. aureus N315
cuuaaaagacauccacagaa

SEQ ID NO: 2131152 - RNA, 22 nt, Staphylococcus aureus subsp. aureus N315
cuuaaaagacauccacagaauu

SEQ ID NO: 2131153 - RNA, 12 nt, Staphylococcus aureus subsp. aureus N315
cuuaaaaacaau

SEQ ID NO: 2131154 - RNA, 13 nt, Staphylococcus aureus subsp. aureus N315
cuguuucaucacc

SEQ ID NO: 2131155 - RNA, 16 nt, Staphylococcus aureus subsp. aureus N315
cuguuuauauaaguga

SEQ ID NO: 2131156 - RNA, 19 nt, Staphylococcus aureus subsp. aureus N315
cuguuugagauauauuaau

SEQ ID NO: 2131157 - RNA, 21 nt, Staphylococcus aureus subsp. aureus N315
cuguucuuucgucuuguaaac

SEQ ID NO: 2131158 - RNA, 21 nt, Staphylococcus aureus subsp. aureus N315
cuguuggaauaccuuuuucua

SEQ ID NO: 2131159 - RNA, 21 nt, Staphylococcus aureus subsp. aureus N315
cuguugguuugaucauuugac

SEQ ID NO: 2131160 - RNA, 16 nt, Staphylococcus aureus subsp. aureus N315
cuuacagacaaacauu

SEQ ID NO: 2131161 - RNA, 17 nt, Staphylococcus aureus subsp. aureus N315
cuuacagacaaacauua

SEQ ID NO: 2131162 - RNA, 23 nt, Staphylococcus aureus subsp. aureus N315
cuuacaauagugugcaaguuggc

SEQ ID NO: 2131163 - RNA, 23 nt, Staphylococcus aureus subsp. aureus N315
cuuaauuuaaaucuguacuucua

SEQ ID NO: 2131164 - RNA, 18 nt, Staphylococcus aureus subsp. aureus N315
cuuacuacgcauuauuaa

SEQ ID NO: 2131165 - RNA, 19 nt, Staphylococcus aureus subsp. aureus N315
cuuacuacgcauuauuaag

SEQ ID NO: 2131166 - RNA, 21 nt, Staphylococcus aureus subsp. aureus N315
cuuaaagauuuacccauuaca

SEQ ID NO: 2131167 - RNA, 16 nt, Staphylococcus aureus subsp. aureus N315
cuuaaagaauuaagua

SEQ ID NO: 2131168 - RNA, 15 nt, Staphylococcus aureus subsp. aureus N315
cuuaaauauaaugau

SEQ ID NO: 2131169 - RNA, 22 nt, Staphylococcus aureus subsp. aureus N315
cuuaaauacaauuucuucauuu

SEQ ID NO: 2131170 - RNA, 14 nt, Staphylococcus aureus subsp. aureus N315
cuuaauagaaagag

SEQ ID NO: 2131171 - RNA, 14 nt, Staphylococcus aureus subsp. aureus N315
cuuaauaguaacau

SEQ ID NO: 2131172 - RNA, 22 nt, Staphylococcus aureus subsp. aureus N315
cuuaaucagcuauaaaaguacu

SEQ ID NO: 2131173 - RNA, 18 nt, Staphylococcus aureus subsp. aureus N315
cuuaauauugaauauaaa

SEQ ID NO: 2131174 - RNA, 22 nt, Staphylococcus aureus subsp. aureus N315
cuuaauauugaauauaaaaaac

SEQ ID NO: 2131175 - RNA, 13 nt, Staphylococcus aureus subsp. aureus N315
cuuaauuuaaauc

SEQ ID NO: 2131176 - RNA, 19 nt, Staphylococcus aureus subsp. aureus N315
cuuaauuaauaauuuaacu

SEQ ID NO: 2131177 - RNA, 14 nt, Staphylococcus aureus subsp. aureus N315
cuuaauuaauaauu

SEQ ID NO: 2131178 - RNA, 12 nt, Staphylococcus aureus subsp. aureus N315
cuuaucagugua

SEQ ID NO: 2131179 - RNA, 14 nt, Staphylococcus aureus subsp. aureus N315
cuuaucaucacacu

SEQ ID NO: 2131180 - RNA, 14 nt, Staphylococcus aureus subsp. aureus N315
cuuaucaacaacaa

SEQ ID NO: 2131181 - RNA, 16 nt, Staphylococcus aureus subsp. aureus N315
cuuaucaacagcuuca

SEQ ID NO: 2131182 - RNA, 22 nt, Staphylococcus aureus subsp. aureus N315
cuuaucaaaaccgcuauaaaau

SEQ ID NO: 2131183 - RNA, 22 nt, Staphylococcus aureus subsp. aureus N315
cuuauauuuuauuuaaaaauag

SEQ ID NO: 2131184 - RNA, 16 nt, Staphylococcus aureus subsp. aureus N315
cuuauacguuacggcu

SEQ ID NO: 2131185 - RNA, 16 nt, Staphylococcus aureus subsp. aureus N315
cuuauauauucaauaa

SEQ ID NO: 2131186 - RNA, 14 nt, Staphylococcus aureus subsp. aureus N315
cuuauaauauuaaa

SEQ ID NO: 2131187 - RNA, 21 nt, Staphylococcus aureus subsp. aureus N315
cuuauaaguucaaccauauga

SEQ ID NO: 2131188 - RNA, 22 nt, Staphylococcus aureus subsp. aureus N315
cuuagcacuuggauuuuaauua

SEQ ID NO: 2131189 - RNA, 14 nt, Staphylococcus aureus subsp. aureus N315
cuuacucauuuuuc

SEQ ID NO: 2131190 - RNA, 16 nt, Staphylococcus aureus subsp. aureus N315
cuuacuacuuaauuaa

SEQ ID NO: 2131191 - RNA, 16 nt, Staphylococcus aureus subsp. aureus N315
cuuacugcaauuauuu

SEQ ID NO: 2131192 - RNA, 16 nt, Staphylococcus aureus subsp. aureus N315
cuuacugaaacuaaau

SEQ ID NO: 2131193 - RNA, 23 nt, Staphylococcus aureus subsp. aureus N315
cuuacugaaacuaaauuaaaagu

SEQ ID NO: 2131194 - RNA, 19 nt, Staphylococcus aureus subsp. aureus N315
cuuagauaaauuaauauga

SEQ ID NO: 2131195 - RNA, 14 nt, Staphylococcus aureus subsp. aureus N315
cuuagauaaauuaa

SEQ ID NO: 2131196 - RNA, 17 nt, Staphylococcus aureus subsp. aureus N315
cuuagcaaacaauuuug

SEQ ID NO: 2131197 - RNA, 22 nt, Staphylococcus aureus subsp. aureus N315
cuuauuauuuuguauuuuucaa

SEQ ID NO: 2131198 - RNA, 12 nt, Staphylococcus aureus subsp. aureus N315
cuuauuauuuau

SEQ ID NO: 2131199 - RNA, 20 nt, Staphylococcus aureus subsp. aureus N315
cuuauuauuuuguauuuuuc

SEQ ID NO: 2131200 - RNA, 14 nt, Staphylococcus aureus subsp. aureus N315
cuucacauuuaucc

SEQ ID NO: 2131201 - RNA, 20 nt, Staphylococcus aureus subsp. aureus N315
cuuauguggaggacacauuu

SEQ ID NO: 2131202 - RNA, 11 nt, Staphylococcus aureus subsp. aureus N315
cuuauuaacuu

SEQ ID NO: 2131203 - RNA, 16 nt, Staphylococcus aureus subsp. aureus N315
cuuaugucauauacua

SEQ ID NO: 2131204 - RNA, 20 nt, Staphylococcus aureus subsp. aureus N315
cuuaucugaagcuaaaugcu

SEQ ID NO: 2131205 - RNA, 17 nt, Staphylococcus aureus subsp. aureus N315
cuucacuaaaaauauau

SEQ ID NO: 2131206 - RNA, 16 nt, Staphylococcus aureus subsp. aureus N315
cuucaucaauaacuau

SEQ ID NO: 2131207 - RNA, 21 nt, Staphylococcus aureus subsp. aureus N315
cuucauagucacuuuuaacga

SEQ ID NO: 2131208 - RNA, 20 nt, Staphylococcus aureus subsp. aureus N315
cuucauaaucguauucauau

SEQ ID NO: 2131209 - RNA, 17 nt, Staphylococcus aureus subsp. aureus N315
cuucauauccuucauua

SEQ ID NO: 2131210 - RNA, 21 nt, Staphylococcus aureus subsp. aureus N315
cuucaguuaaaucuuuaacuu

SEQ ID NO: 2131211 - RNA, 16 nt, Staphylococcus aureus subsp. aureus N315
cuucaguuaaaucuuu

SEQ ID NO: 2131212 - RNA, 22 nt, Staphylococcus aureus subsp. aureus N315
cuucagcuaaaaguuucccaag

SEQ ID NO: 2131213 - RNA, 19 nt, Staphylococcus aureus subsp. aureus N315
cuuccucucguaaauuguu

SEQ ID NO: 2131214 - RNA, 21 nt, Staphylococcus aureus subsp. aureus N315
cuucgccaagccaucuuucuu

SEQ ID NO: 2131215 - RNA, 18 nt, Staphylococcus aureus subsp. aureus N315
cuucgccaagccaucuuu

SEQ ID NO: 2131216 - RNA, 22 nt, Staphylococcus aureus subsp. aureus N315
cuucauuugcgauuucuucugc

SEQ ID NO: 2131217 - RNA, 23 nt, Staphylococcus aureus subsp. aureus N315
cuucauuauauaauucuucaaau

SEQ ID NO: 2131218 - RNA, 20 nt, Staphylococcus aureus subsp. aureus N315
cuucauuaucaauagaugaa

SEQ ID NO: 2131219 - RNA, 16 nt, Staphylococcus aureus subsp. aureus N315
cuuccaucacaucaua

SEQ ID NO: 2131220 - RNA, 15 nt, Staphylococcus aureus subsp. aureus N315
cuuucauaaauuguu

SEQ ID NO: 2131221 - RNA, 20 nt, Staphylococcus aureus subsp. aureus N315
cuuucauaaauuguuuuaca

SEQ ID NO: 2131222 - RNA, 17 nt, Staphylococcus aureus subsp. aureus N315
cuuucauacauaacaca

SEQ ID NO: 2131223 - RNA, 20 nt, Staphylococcus aureus subsp. aureus N315
cuuucauaguuauuaaaucu

SEQ ID NO: 2131224 - RNA, 12 nt, Staphylococcus aureus subsp. aureus N315
cuuucuauuaau

SEQ ID NO: 2131225 - RNA, 18 nt, Staphylococcus aureus subsp. aureus N315
cuuucucaucuauuuaau

SEQ ID NO: 2131226 - RNA, 13 nt, Staphylococcus aureus subsp. aureus N315
cuuucgauaaacu

SEQ ID NO: 2131227 - RNA, 19 nt, Staphylococcus aureus subsp. aureus N315
cuuuaucaacauaaaauuu

SEQ ID NO: 2131228 - RNA, 14 nt, Staphylococcus aureus subsp. aureus N315
cuuuauaugagaaa

SEQ ID NO: 2131229 - RNA, 14 nt, Staphylococcus aureus subsp. aureus N315
cuuuauauauaaag

SEQ ID NO: 2131230 - RNA, 14 nt, Staphylococcus aureus subsp. aureus N315
cuuuacgauaaaua

SEQ ID NO: 2131231 - RNA, 15 nt, Staphylococcus aureus subsp. aureus N315
cuuuaccaauaucau

SEQ ID NO: 2131232 - RNA, 12 nt, Staphylococcus aureus subsp. aureus N315
cuuuaauaucua

SEQ ID NO: 2131233 - RNA, 18 nt, Staphylococcus aureus subsp. aureus N315
cuuuaaucauagcauuaa

SEQ ID NO: 2131234 - RNA, 16 nt, Staphylococcus aureus subsp. aureus N315
cuuuauuauuuaaucu

SEQ ID NO: 2131235 - RNA, 20 nt, Staphylococcus aureus subsp. aureus N315
cuuuauggguauccuucuca

SEQ ID NO: 2131236 - RNA, 14 nt, Staphylococcus aureus subsp. aureus N315
cuuuauuaaaaauc

SEQ ID NO: 2131237 - RNA, 21 nt, Staphylococcus aureus subsp. aureus N315
cuuuaugugcaucauuuauau

SEQ ID NO: 2131238 - RNA, 21 nt, Staphylococcus aureus subsp. aureus N315
cuuucaggcuuuguuuuucac

SEQ ID NO: 2131239 - RNA, 19 nt, Staphylococcus aureus subsp. aureus N315
cuuguacacauccucauaa

SEQ ID NO: 2131240 - RNA, 21 nt, Staphylococcus aureus subsp. aureus N315
cuugucaguuuuuuuauaagc

SEQ ID NO: 2131241 - RNA, 16 nt, Staphylococcus aureus subsp. aureus N315
cuuguacgauaacuac

SEQ ID NO: 2131242 - RNA, 16 nt, Staphylococcus aureus subsp. aureus N315
cuuguaaacuucuuuu

SEQ ID NO: 2131243 - RNA, 22 nt, Staphylococcus aureus subsp. aureus N315
cuuguaacaagcuuuucauuuu

SEQ ID NO: 2131244 - RNA, 21 nt, Staphylococcus aureus subsp. aureus N315
cuuguaacaagcauuuuucaa

SEQ ID NO: 2131245 - RNA, 14 nt, Staphylococcus aureus subsp. aureus N315
cuuggacauuguaa

SEQ ID NO: 2131246 - RNA, 17 nt, Staphylococcus aureus subsp. aureus N315
cuuguccucuaaaacau

SEQ ID NO: 2131247 - RNA, 19 nt, Staphylococcus aureus subsp. aureus N315
cuugugauaauucuucaac

SEQ ID NO: 2131248 - RNA, 13 nt, Staphylococcus aureus subsp. aureus N315
cuuguuaaaauaa

SEQ ID NO: 2131249 - RNA, 13 nt, Staphylococcus aureus subsp. aureus N315
cuuguucuaauug

SEQ ID NO: 2131250 - RNA, 22 nt, Staphylococcus aureus subsp. aureus N315
cuuguucgauaaucguuaaaac

SEQ ID NO: 2131251 - RNA, 15 nt, Staphylococcus aureus subsp. aureus N315
cuuguucuaaaauaa

SEQ ID NO: 2131252 - RNA, 12 nt, Staphylococcus aureus subsp. aureus N315
cuuguuuuaaau

SEQ ID NO: 2131253 - RNA, 11 nt, Staphylococcus aureus subsp. aureus N315
cuuuaaacucg

SEQ ID NO: 2131254 - RNA, 20 nt, Staphylococcus aureus subsp. aureus N315
cuuuaaacucguaaauuuua

SEQ ID NO: 2131255 - RNA, 14 nt, Staphylococcus aureus subsp. aureus N315
cuuuaaaauucucu

SEQ ID NO: 2131256 - RNA, 19 nt, Staphylococcus aureus subsp. aureus N315
cuuuaaaacaucauucaca

SEQ ID NO: 2131257 - RNA, 22 nt, Staphylococcus aureus subsp. aureus N315
cuuuaaaacaucauucacaagu

SEQ ID NO: 2131258 - RNA, 17 nt, Staphylococcus aureus subsp. aureus N315
cuuuaaaaauuaaguaa

SEQ ID NO: 2131259 - RNA, 16 nt, Staphylococcus aureus subsp. aureus N315
cuuuaaaucuacuuug

SEQ ID NO: 2131260 - RNA, 21 nt, Staphylococcus aureus subsp. aureus N315
cuuuaaaucuuguucuaauug

SEQ ID NO: 2131261 - RNA, 11 nt, Staphylococcus aureus subsp. aureus N315
cuuuaaaucuu

SEQ ID NO: 2131262 - RNA, 21 nt, Staphylococcus aureus subsp. aureus N315
cuuuaauacuaccguuuuuau

SEQ ID NO: 2131263 - RNA, 22 nt, Staphylococcus aureus subsp. aureus N315
cuuuaauaaccuuuaaaacauc

SEQ ID NO: 2131264 - RNA, 14 nt, Staphylococcus aureus subsp. aureus N315
cuugccuucaaauu

SEQ ID NO: 2131265 - RNA, 14 nt, Staphylococcus aureus subsp. aureus N315
cuugccuggcaacg

SEQ ID NO: 2131266 - RNA, 14 nt, Staphylococcus aureus subsp. aureus N315
cuugagcaucacuc

SEQ ID NO: 2131267 - RNA, 14 nt, Staphylococcus aureus subsp. aureus N315
cuugagcaucuuuu

SEQ ID NO: 2131268 - RNA, 16 nt, Staphylococcus aureus subsp. aureus N315
cuugaaccccauucac

SEQ ID NO: 2131269 - RNA, 15 nt, Staphylococcus aureus subsp. aureus N315
cuugagcuauucaua

SEQ ID NO: 2131270 - RNA, 19 nt, Staphylococcus aureus subsp. aureus N315
cuugagcuguuacacuuuu

SEQ ID NO: 2131271 - RNA, 17 nt, Staphylococcus aureus subsp. aureus N315
cuucuuuuuuguaucuc

SEQ ID NO: 2131272 - RNA, 16 nt, Staphylococcus aureus subsp. aureus N315
cuucuuuuuuuaacuu

SEQ ID NO: 2131273 - RNA, 17 nt, Staphylococcus aureus subsp. aureus N315
cuucuuuuuuaucuaca

SEQ ID NO: 2131274 - RNA, 12 nt, Staphylococcus aureus subsp. aureus N315
cuugauucuuau

SEQ ID NO: 2131275 - RNA, 15 nt, Staphylococcus aureus subsp. aureus N315
cuugauuguaaauaa

SEQ ID NO: 2131276 - RNA, 19 nt, Staphylococcus aureus subsp. aureus N315
cuugauuuaaaccaucaau

SEQ ID NO: 2131277 - RNA, 13 nt, Staphylococcus aureus subsp. aureus N315
cuugauaaaaaau

SEQ ID NO: 2131278 - RNA, 15 nt, Staphylococcus aureus subsp. aureus N315
cuugauaaaauaaau

SEQ ID NO: 2131279 - RNA, 18 nt, Staphylococcus aureus subsp. aureus N315
cuucucccuuaaauacaa

SEQ ID NO: 2131280 - RNA, 23 nt, Staphylococcus aureus subsp. aureus N315
cuucuggauagguaucacuagga

SEQ ID NO: 2131281 - RNA, 20 nt, Staphylococcus aureus subsp. aureus N315
cuucuggauagguaucacua

SEQ ID NO: 2131282 - RNA, 21 nt, Staphylococcus aureus subsp. aureus N315
cuucuggagccccuuguucuc

SEQ ID NO: 2131283 - RNA, 17 nt, Staphylococcus aureus subsp. aureus N315
cuucugcuacuuguugu

SEQ ID NO: 2131284 - RNA, 15 nt, Staphylococcus aureus subsp. aureus N315
cuucuuguuucaaac

SEQ ID NO: 2131285 - RNA, 20 nt, Staphylococcus aureus subsp. aureus N315
cuucuuaacuugaaauguug

SEQ ID NO: 2131286 - RNA, 21 nt, Staphylococcus aureus subsp. aureus N315
cuucuuaaaauaugauuuaaa

SEQ ID NO: 2131287 - RNA, 22 nt, Staphylococcus aureus subsp. aureus N315
cuucuucaggaauaucuuucaa

SEQ ID NO: 2131288 - RNA, 21 nt, Staphylococcus aureus subsp. aureus N315
cuggaaaugauaauuuaauaa

SEQ ID NO: 2131289 - RNA, 14 nt, Staphylococcus aureus subsp. aureus N315
cugcuucugcugua

SEQ ID NO: 2131290 - RNA, 19 nt, Staphylococcus aureus subsp. aureus N315
cugcuuuuaauaucuucua

SEQ ID NO: 2131291 - RNA, 14 nt, Staphylococcus aureus subsp. aureus N315
cugcuuuaacugua

SEQ ID NO: 2131292 - RNA, 21 nt, Staphylococcus aureus subsp. aureus N315
cugcuuuauuuuaucaucuau

SEQ ID NO: 2131293 - RNA, 12 nt, Staphylococcus aureus subsp. aureus N315
cugucccaagcu

SEQ ID NO: 2131294 - RNA, 15 nt, Staphylococcus aureus subsp. aureus N315
cugucgcucauccuc

SEQ ID NO: 2131295 - RNA, 14 nt, Staphylococcus aureus subsp. aureus N315
cuguauuuaauaaa

SEQ ID NO: 2131296 - RNA, 12 nt, Staphylococcus aureus subsp. aureus N315
cuguauuuacua

SEQ ID NO: 2131297 - RNA, 20 nt, Staphylococcus aureus subsp. aureus N315
cuguaaaaccauagauaauu

SEQ ID NO: 2131298 - RNA, 13 nt, Staphylococcus aureus subsp. aureus N315
cuguaaaauucua

SEQ ID NO: 2131299 - RNA, 13 nt, Staphylococcus aureus subsp. aureus N315
cuguaaaacauuc

SEQ ID NO: 2131300 - RNA, 17 nt, Staphylococcus aureus subsp. aureus N315
cuguaaaucaucauaac

SEQ ID NO: 2131301 - RNA, 17 nt, Staphylococcus aureus subsp. aureus N315
cuguaaauuaucuaaag

SEQ ID NO: 2131302 - RNA, 15 nt, Staphylococcus aureus subsp. aureus N315
cuguaaccaaaagaa

SEQ ID NO: 2131303 - RNA, 21 nt, Staphylococcus aureus subsp. aureus N315
cuguaacauaaacaauaacug

SEQ ID NO: 2131304 - RNA, 21 nt, Staphylococcus aureus subsp. aureus N315
cuguaccaucacuaaaguaaa

SEQ ID NO: 2131305 - RNA, 22 nt, Staphylococcus aureus subsp. aureus N315
cuggugcaggcaucauaucaua

SEQ ID NO: 2131306 - RNA, 15 nt, Staphylococcus aureus subsp. aureus N315
cuggggaagaccauu

SEQ ID NO: 2131307 - RNA, 19 nt, Staphylococcus aureus subsp. aureus N315
cuggguuaccaaguaauga

SEQ ID NO: 2131308 - RNA, 14 nt, Staphylococcus aureus subsp. aureus N315
cugcuaauuuuuuc

SEQ ID NO: 2131309 - RNA, 15 nt, Staphylococcus aureus subsp. aureus N315
cugccauauagauau

SEQ ID NO: 2131310 - RNA, 15 nt, Staphylococcus aureus subsp. aureus N315
cugaucuaaaaccau

SEQ ID NO: 2131311 - RNA, 15 nt, Staphylococcus aureus subsp. aureus N315
cugaucguaacauua

SEQ ID NO: 2131312 - RNA, 23 nt, Staphylococcus aureus subsp. aureus N315
cugauugcugcuguacaauuucg

SEQ ID NO: 2131313 - RNA, 19 nt, Staphylococcus aureus subsp. aureus N315
cugauugggcugauaauaa

SEQ ID NO: 2131314 - RNA, 15 nt, Staphylococcus aureus subsp. aureus N315
cugauguguuauguu

SEQ ID NO: 2131315 - RNA, 21 nt, Staphylococcus aureus subsp. aureus N315
cugauguguuauguuagauga

SEQ ID NO: 2131316 - RNA, 22 nt, Staphylococcus aureus subsp. aureus N315
cugcaagucguucucuuaaaua

SEQ ID NO: 2131317 - RNA, 23 nt, Staphylococcus aureus subsp. aureus N315
cugcaagucguucucuuaaauau

SEQ ID NO: 2131318 - RNA, 21 nt, Staphylococcus aureus subsp. aureus N315
cugcaaacacaguacaaauaa

SEQ ID NO: 2131319 - RNA, 19 nt, Staphylococcus aureus subsp. aureus N315
cugcaaacacaguacaaau

SEQ ID NO: 2131320 - RNA, 16 nt, Staphylococcus aureus subsp. aureus N315
cugcaaacacaguaca

SEQ ID NO: 2131321 - RNA, 22 nt, Staphylococcus aureus subsp. aureus N315
cugcaaaauguuacacaaauua

SEQ ID NO: 2131322 - RNA, 21 nt, Staphylococcus aureus subsp. aureus N315
cugcaaacuugauucaauaua

SEQ ID NO: 2131323 - RNA, 22 nt, Staphylococcus aureus subsp. aureus N315
cugcagaguaaccuuucgcagc

SEQ ID NO: 2131324 - RNA, 16 nt, Staphylococcus aureus subsp. aureus N315
cugcacuuaugauacu

SEQ ID NO: 2131325 - RNA, 17 nt, Staphylococcus aureus subsp. aureus N315
cucuaucaguccgcuuu

SEQ ID NO: 2131326 - RNA, 19 nt, Staphylococcus aureus subsp. aureus N315
cucuaucaaauuaccauuc

SEQ ID NO: 2131327 - RNA, 15 nt, Staphylococcus aureus subsp. aureus N315
cucuauuuuaugauu

SEQ ID NO: 2131328 - RNA, 16 nt, Staphylococcus aureus subsp. aureus N315
cucuauuaauuuacuc

SEQ ID NO: 2131329 - RNA, 17 nt, Staphylococcus aureus subsp. aureus N315
cugauacagaaccaaca

SEQ ID NO: 2131330 - RNA, 22 nt, Staphylococcus aureus subsp. aureus N315
cugauacagaaccaacaauaaa

SEQ ID NO: 2131331 - RNA, 22 nt, Staphylococcus aureus subsp. aureus N315
cugauaauuuuucuucuuuuuu

SEQ ID NO: 2131332 - RNA, 22 nt, Staphylococcus aureus subsp. aureus N315
cugauaauacuguuuaaauaaa

SEQ ID NO: 2131333 - RNA, 15 nt, Staphylococcus aureus subsp. aureus N315
cugauaauucgaaau

SEQ ID NO: 2131334 - RNA, 18 nt, Staphylococcus aureus subsp. aureus N315
cugauaauacuguuuaaa

SEQ ID NO: 2131335 - RNA, 14 nt, Staphylococcus aureus subsp. aureus N315
cugauaaaugaauu

SEQ ID NO: 2131336 - RNA, 17 nt, Staphylococcus aureus subsp. aureus N315
cuaggauuaaaagcauc

SEQ ID NO: 2131337 - RNA, 18 nt, Staphylococcus aureus subsp. aureus N315
cuagcggaacguaaguuu

SEQ ID NO: 2131338 - RNA, 18 nt, Staphylococcus aureus subsp. aureus N315
cuaggaauauaaaacugu

SEQ ID NO: 2131339 - RNA, 16 nt, Staphylococcus aureus subsp. aureus N315
cuauaacaaaaucuca

SEQ ID NO: 2131340 - RNA, 17 nt, Staphylococcus aureus subsp. aureus N315
cuauaacaaaaucucaa

SEQ ID NO: 2131341 - RNA, 16 nt, Staphylococcus aureus subsp. aureus N315
cuauaaauacaaauau

SEQ ID NO: 2131342 - RNA, 16 nt, Staphylococcus aureus subsp. aureus N315
cuauaaccuauuaaau

SEQ ID NO: 2131343 - RNA, 16 nt, Staphylococcus aureus subsp. aureus N315
cuauaacaccaauuaa

SEQ ID NO: 2131344 - RNA, 19 nt, Staphylococcus aureus subsp. aureus N315
cuauaaaaauuuauucaaa

SEQ ID NO: 2131345 - RNA, 23 nt, Staphylococcus aureus subsp. aureus N315
cuauaaaaguacuuuaaaauugu

SEQ ID NO: 2131346 - RNA, 14 nt, Staphylococcus aureus subsp. aureus N315
cuauaaaauucacc

SEQ ID NO: 2131347 - RNA, 15 nt, Staphylococcus aureus subsp. aureus N315
cuauaaaauuuugaa

SEQ ID NO: 2131348 - RNA, 11 nt, Staphylococcus aureus subsp. aureus N315
cuauaaacaua

SEQ ID NO: 2131349 - RNA, 11 nt, Staphylococcus aureus subsp. aureus N315
cuauagaaaaa

SEQ ID NO: 2131350 - RNA, 18 nt, Staphylococcus aureus subsp. aureus N315
cuauacuccaguuuauaa

SEQ ID NO: 2131351 - RNA, 14 nt, Staphylococcus aureus subsp. aureus N315
cuauagaaaaagua

SEQ ID NO: 2131352 - RNA, 13 nt, Staphylococcus aureus subsp. aureus N315
cuauauaaaaacu

SEQ ID NO: 2131353 - RNA, 22 nt, Staphylococcus aureus subsp. aureus N315
cuauacaauuauggauaaaauu

SEQ ID NO: 2131354 - RNA, 17 nt, Staphylococcus aureus subsp. aureus N315
cuauaccauuccaaaaa

SEQ ID NO: 2131355 - RNA, 21 nt, Staphylococcus aureus subsp. aureus N315
cuauaccauuccaaaaauugu

SEQ ID NO: 2131356 - RNA, 13 nt, Staphylococcus aureus subsp. aureus N315
cuauaccauuuuu

SEQ ID NO: 2131357 - RNA, 18 nt, Staphylococcus aureus subsp. aureus N315
cuauaacucuaaauauaa

SEQ ID NO: 2131358 - RNA, 19 nt, Staphylococcus aureus subsp. aureus N315
cuauaacucuaaauauaau

SEQ ID NO: 2131359 - RNA, 19 nt, Staphylococcus aureus subsp. aureus N315
cuauacaaucauaaagugc

SEQ ID NO: 2131360 - RNA, 16 nt, Staphylococcus aureus subsp. aureus N315
cuauacaaucauuuau

SEQ ID NO: 2131361 - RNA, 17 nt, Staphylococcus aureus subsp. aureus N315
cuauacaaucauuuaug

SEQ ID NO: 2131362 - RNA, 14 nt, Staphylococcus aureus subsp. aureus N315
cuaucuucagauuc

SEQ ID NO: 2131363 - RNA, 21 nt, Staphylococcus aureus subsp. aureus N315
cuaugauauauguaacauaaa

SEQ ID NO: 2131364 - RNA, 23 nt, Staphylococcus aureus subsp. aureus N315
cuaugaaauuggaauagauguug

SEQ ID NO: 2131365 - RNA, 16 nt, Staphylococcus aureus subsp. aureus N315
cuaucgccuaaaaaua

SEQ ID NO: 2131366 - RNA, 17 nt, Staphylococcus aureus subsp. aureus N315
cuaucgccuaaaaauaa

SEQ ID NO: 2131367 - RNA, 15 nt, Staphylococcus aureus subsp. aureus N315
cuaucgauacuaaac

SEQ ID NO: 2131368 - RNA, 24 nt, Staphylococcus aureus subsp. aureus N315
cuaucuccgcuacaauuauaugua

SEQ ID NO: 2131369 - RNA, 14 nt, Staphylococcus aureus subsp. aureus N315
cuaucucuuuaguu

SEQ ID NO: 2131370 - RNA, 14 nt, Staphylococcus aureus subsp. aureus N315
cuauauaaaguuga

SEQ ID NO: 2131371 - RNA, 13 nt, Staphylococcus aureus subsp. aureus N315
cuauauaauuuau

SEQ ID NO: 2131372 - RNA, 14 nt, Staphylococcus aureus subsp. aureus N315
cuauauaauuuauu

SEQ ID NO: 2131373 - RNA, 19 nt, Staphylococcus aureus subsp. aureus N315
cuauauaugaauugaguau

SEQ ID NO: 2131374 - RNA, 11 nt, Staphylococcus aureus subsp. aureus N315
cuauaugcaua

SEQ ID NO: 2131375 - RNA, 18 nt, Staphylococcus aureus subsp. aureus N315
cuagaaagaccauuguau

SEQ ID NO: 2131376 - RNA, 21 nt, Staphylococcus aureus subsp. aureus N315
cuagaaaguaaugcuguacua

SEQ ID NO: 2131377 - RNA, 19 nt, Staphylococcus aureus subsp. aureus N315
cuagagcguuuugcuuuag

SEQ ID NO: 2131378 - RNA, 19 nt, Staphylococcus aureus subsp. aureus N315
cuacuaaaaaugcuuuaac

SEQ ID NO: 2131379 - RNA, 18 nt, Staphylococcus aureus subsp. aureus N315
cuagauaccaaacugccu

SEQ ID NO: 2131380 - RNA, 19 nt, Staphylococcus aureus subsp. aureus N315
cuagcaagaauagauugau

SEQ ID NO: 2131381 - RNA, 17 nt, Staphylococcus aureus subsp. aureus N315
cuagcauaucuuuauca

SEQ ID NO: 2131382 - RNA, 14 nt, Staphylococcus aureus subsp. aureus N315
cuagccugaaauag

SEQ ID NO: 2131383 - RNA, 18 nt, Staphylococcus aureus subsp. aureus N315
cuagccguuauuuuuuug

SEQ ID NO: 2131384 - RNA, 20 nt, Staphylococcus aureus subsp. aureus N315
cuaauagcauuuguaaacag

SEQ ID NO: 2131385 - RNA, 15 nt, Staphylococcus aureus subsp. aureus N315
cuaauagcauuugua

SEQ ID NO: 2131386 - RNA, 15 nt, Staphylococcus aureus subsp. aureus N315
cuaauaggaucaccu

SEQ ID NO: 2131387 - RNA, 22 nt, Staphylococcus aureus subsp. aureus N315
cuaauacuuucacuuuuuauau

SEQ ID NO: 2131388 - RNA, 22 nt, Staphylococcus aureus subsp. aureus N315
cuaauacacuugauaaaacuaa

SEQ ID NO: 2131389 - RNA, 16 nt, Staphylococcus aureus subsp. aureus N315
cuaauacaaaacaaau

SEQ ID NO: 2131390 - RNA, 23 nt, Staphylococcus aureus subsp. aureus N315
cuacgauuuucaagaccaaauau

SEQ ID NO: 2131391 - RNA, 20 nt, Staphylococcus aureus subsp. aureus N315
cucagguauaggugcaguua

SEQ ID NO: 2131392 - RNA, 20 nt, Staphylococcus aureus subsp. aureus N315
cucauccgccaauuaaaauu

SEQ ID NO: 2131393 - RNA, 20 nt, Staphylococcus aureus subsp. aureus N315
cucaucgaguuuguuucuaa

SEQ ID NO: 2131394 - RNA, 17 nt, Staphylococcus aureus subsp. aureus N315
cucaucuacuauuuaau

SEQ ID NO: 2131395 - RNA, 12 nt, Staphylococcus aureus subsp. aureus N315
cucaucuaauuu

SEQ ID NO: 2131396 - RNA, 21 nt, Staphylococcus aureus subsp. aureus N315
cucaucuguccgauaucuuuu

SEQ ID NO: 2131397 - RNA, 15 nt, Staphylococcus aureus subsp. aureus N315
cucagccucuuuuua

SEQ ID NO: 2131398 - RNA, 13 nt, Staphylococcus aureus subsp. aureus N315
cucacaugugaaa

SEQ ID NO: 2131399 - RNA, 15 nt, Staphylococcus aureus subsp. aureus N315
cucaaugaauuuacu

SEQ ID NO: 2131400 - RNA, 24 nt, Staphylococcus aureus subsp. aureus N315
cucaauuucauuugaaauaguuaa

SEQ ID NO: 2131401 - RNA, 16 nt, Staphylococcus aureus subsp. aureus N315
cucaagugauuuccca

SEQ ID NO: 2131402 - RNA, 12 nt, Staphylococcus aureus subsp. aureus N315
cucaacauuuug

SEQ ID NO: 2131403 - RNA, 12 nt, Staphylococcus aureus subsp. aureus N315
cucaacauuuuu

SEQ ID NO: 2131404 - RNA, 13 nt, Staphylococcus aureus subsp. aureus N315
cucaacauuuuuu

SEQ ID NO: 2131405 - RNA, 14 nt, Staphylococcus aureus subsp. aureus N315
cucaacauuuuuuc

SEQ ID NO: 2131406 - RNA, 17 nt, Staphylococcus aureus subsp. aureus N315
cucaacauuaaaaugug

SEQ ID NO: 2131407 - RNA, 20 nt, Staphylococcus aureus subsp. aureus N315
cucaaggaaaucauauauuu

SEQ ID NO: 2131408 - RNA, 20 nt, Staphylococcus aureus subsp. aureus N315
cuauuaauaucauaguuguc

SEQ ID NO: 2131409 - RNA, 20 nt, Staphylococcus aureus subsp. aureus N315
cuauuaacugaccuaacaau

SEQ ID NO: 2131410 - RNA, 14 nt, Staphylococcus aureus subsp. aureus N315
cuauuaauuuacuc

SEQ ID NO: 2131411 - RNA, 17 nt, Staphylococcus aureus subsp. aureus N315
cuauuaauuacgucaua

SEQ ID NO: 2131412 - RNA, 14 nt, Staphylococcus aureus subsp. aureus N315
cuauuuauugagau

SEQ ID NO: 2131413 - RNA, 21 nt, Staphylococcus aureus subsp. aureus N315
cuauuucaacaaacauaaaua

SEQ ID NO: 2131414 - RNA, 19 nt, Staphylococcus aureus subsp. aureus N315
cucaaacguucaucuaauu

SEQ ID NO: 2131415 - RNA, 18 nt, Staphylococcus aureus subsp. aureus N315
cucaaagguuuacuauua

SEQ ID NO: 2131416 - RNA, 19 nt, Staphylococcus aureus subsp. aureus N315
cucaaagguuuacuauuaa

SEQ ID NO: 2131417 - RNA, 18 nt, Staphylococcus aureus subsp. aureus N315
cucaaagaaacuauagau

SEQ ID NO: 2131418 - RNA, 16 nt, Staphylococcus aureus subsp. aureus N315
cuauuuuauacauaaa

SEQ ID NO: 2131419 - RNA, 17 nt, Staphylococcus aureus subsp. aureus N315
cuauuuuugauuuaaua

SEQ ID NO: 2131420 - RNA, 19 nt, Staphylococcus aureus subsp. aureus N315
cuauuuuuuauguuuuaau

SEQ ID NO: 2131421 - RNA, 11 nt, Staphylococcus aureus subsp. aureus N315
cuauuuuuaau

SEQ ID NO: 2131422 - RNA, 18 nt, Staphylococcus aureus subsp. aureus N315
cuauuuuucgauuuugag

SEQ ID NO: 2131423 - RNA, 18 nt, Staphylococcus aureus subsp. aureus N315
cucgauuuuuuuauauuu

SEQ ID NO: 2131424 - RNA, 15 nt, Staphylococcus aureus subsp. aureus N315
cucgauauaugucuc

SEQ ID NO: 2131425 - RNA, 17 nt, Staphylococcus aureus subsp. aureus N315
cucuaaaagccaucuua

SEQ ID NO: 2131426 - RNA, 15 nt, Staphylococcus aureus subsp. aureus N315
cucguuuuuccaugu

SEQ ID NO: 2131427 - RNA, 15 nt, Staphylococcus aureus subsp. aureus N315
cucuaaauaauuucu

SEQ ID NO: 2131428 - RNA, 16 nt, Staphylococcus aureus subsp. aureus N315
cucuaaauaaaauuaa

SEQ ID NO: 2131429 - RNA, 17 nt, Staphylococcus aureus subsp. aureus N315
cucuaccaguucaacau

SEQ ID NO: 2131430 - RNA, 12 nt, Staphylococcus aureus subsp. aureus N315
cucgguuuuuuc

SEQ ID NO: 2131431 - RNA, 23 nt, Staphylococcus aureus subsp. aureus N315
cucgguuuuuucgguuuauuuaa

SEQ ID NO: 2131432 - RNA, 12 nt, Staphylococcus aureus subsp. aureus N315
cucguaauaaug

SEQ ID NO: 2131433 - RNA, 14 nt, Staphylococcus aureus subsp. aureus N315
cucgugaaaagcag

SEQ ID NO: 2131434 - RNA, 20 nt, Staphylococcus aureus subsp. aureus N315
cuccuaccgcuaaaauucuu

SEQ ID NO: 2131435 - RNA, 23 nt, Staphylococcus aureus subsp. aureus N315
cuccuaaagcugcaauuaugcca

SEQ ID NO: 2131436 - RNA, 18 nt, Staphylococcus aureus subsp. aureus N315
cuccucaaaagcuguagu

SEQ ID NO: 2131437 - RNA, 21 nt, Staphylococcus aureus subsp. aureus N315
cucauuuguauagauuguauu

SEQ ID NO: 2131438 - RNA, 16 nt, Staphylococcus aureus subsp. aureus N315
cucauuucaauauuaa

SEQ ID NO: 2131439 - RNA, 22 nt, Staphylococcus aureus subsp. aureus N315
cucauuuuuuuaauuauuuccc

SEQ ID NO: 2131440 - RNA, 23 nt, Staphylococcus aureus subsp. aureus N315
cucauuuuuuuaauuauuucccu

SEQ ID NO: 2131441 - RNA, 14 nt, Staphylococcus aureus subsp. aureus N315
cucauuuuuuuaau

SEQ ID NO: 2131442 - RNA, 20 nt, Staphylococcus aureus subsp. aureus N315
cuccaaaaauaauuaaaucc

SEQ ID NO: 2131443 - RNA, 17 nt, Staphylococcus aureus subsp. aureus N315
cgugguaugauuuuuga

SEQ ID NO: 2131444 - RNA, 20 nt, Staphylococcus aureus subsp. aureus N315
cgugcuuuuaaauguauuuu

SEQ ID NO: 2131445 - RNA, 14 nt, Staphylococcus aureus subsp. aureus N315
cguguaaaaaugau

SEQ ID NO: 2131446 - RNA, 23 nt, Staphylococcus aureus subsp. aureus N315
cguguaaaaaugauuauucuuuu

SEQ ID NO: 2131447 - RNA, 13 nt, Staphylococcus aureus subsp. aureus N315
cgugguucccaau

SEQ ID NO: 2131448 - RNA, 20 nt, Staphylococcus aureus subsp. aureus N315
cguguauacaacauguguau

SEQ ID NO: 2131449 - RNA, 20 nt, Staphylococcus aureus subsp. aureus N315
cguuaauaaaccuacaauau

SEQ ID NO: 2131450 - RNA, 17 nt, Staphylococcus aureus subsp. aureus N315
cguguguuuucuuuuca

SEQ ID NO: 2131451 - RNA, 13 nt, Staphylococcus aureus subsp. aureus N315
cguguucuaaaag

SEQ ID NO: 2131452 - RNA, 17 nt, Staphylococcus aureus subsp. aureus N315
cguucaauguuauuaaa

SEQ ID NO: 2131453 - RNA, 22 nt, Staphylococcus aureus subsp. aureus N315
cguuacuuuggucaacuuuuuc

SEQ ID NO: 2131454 - RNA, 22 nt, Staphylococcus aureus subsp. aureus N315
cguuaguauaaacguccaaaca

SEQ ID NO: 2131455 - RNA, 22 nt, Staphylococcus aureus subsp. aureus N315
cguuaguacggcugcuuuaacu

SEQ ID NO: 2131456 - RNA, 20 nt, Staphylococcus aureus subsp. aureus N315
cguuagugauaccuuuaauu

SEQ ID NO: 2131457 - RNA, 12 nt, Staphylococcus aureus subsp. aureus N315
cguuauuuuuug

SEQ ID NO: 2131458 - RNA, 12 nt, Staphylococcus aureus subsp. aureus N315
cguuuaauaaug

SEQ ID NO: 2131459 - RNA, 18 nt, Staphylococcus aureus subsp. aureus N315
cguugguugugauuuguu

SEQ ID NO: 2131460 - RNA, 23 nt, Staphylococcus aureus subsp. aureus N315
cguuguaggaagaccacuauuuu

SEQ ID NO: 2131461 - RNA, 17 nt, Staphylococcus aureus subsp. aureus N315
cguugguauucaucuuc

SEQ ID NO: 2131462 - RNA, 21 nt, Staphylococcus aureus subsp. aureus N315
cguucuugguauuuuuuaaau

SEQ ID NO: 2131463 - RNA, 10 nt, Staphylococcus aureus subsp. aureus N315
cguucugcua

SEQ ID NO: 2131464 - RNA, 14 nt, Staphylococcus aureus subsp. aureus N315
cguucuguuuugcg

SEQ ID NO: 2131465 - RNA, 13 nt, Staphylococcus aureus subsp. aureus N315
cguuuuuuuaaau

SEQ ID NO: 2131466 - RNA, 21 nt, Staphylococcus aureus subsp. aureus N315
cguuuuaauucaucaauaagg

SEQ ID NO: 2131467 - RNA, 15 nt, Staphylococcus aureus subsp. aureus N315
cuaaaaaaauuaaaa

SEQ ID NO: 2131468 - RNA, 16 nt, Staphylococcus aureus subsp. aureus N315
cguuuguacuucacua

SEQ ID NO: 2131469 - RNA, 12 nt, Staphylococcus aureus subsp. aureus N315
cguuuguguguu

SEQ ID NO: 2131470 - RNA, 18 nt, Staphylococcus aureus subsp. aureus N315
cuaaaccgauuaauauaa

SEQ ID NO: 2131471 - RNA, 15 nt, Staphylococcus aureus subsp. aureus N315
cuaaaccucaacauu

SEQ ID NO: 2131472 - RNA, 15 nt, Staphylococcus aureus subsp. aureus N315
cuaaaacuuuuucaa

SEQ ID NO: 2131473 - RNA, 23 nt, Staphylococcus aureus subsp. aureus N315
cuaaaaaugucguauauguaauc

SEQ ID NO: 2131474 - RNA, 17 nt, Staphylococcus aureus subsp. aureus N315
cuaaaacaucacuugcu

SEQ ID NO: 2131475 - RNA, 20 nt, Staphylococcus aureus subsp. aureus N315
cuaaaaccuauuccuaauaa

SEQ ID NO: 2131476 - RNA, 17 nt, Staphylococcus aureus subsp. aureus N315
cuaaaacggaaauaacc

SEQ ID NO: 2131477 - RNA, 13 nt, Staphylococcus aureus subsp. aureus N315
cuaaaaacuguga

SEQ ID NO: 2131478 - RNA, 13 nt, Staphylococcus aureus subsp. aureus N315
cuaaaaacauaaa

SEQ ID NO: 2131479 - RNA, 14 nt, Staphylococcus aureus subsp. aureus N315
cuaacauaacugua

SEQ ID NO: 2131480 - RNA, 18 nt, Staphylococcus aureus subsp. aureus N315
cuaacauaauuuuuauuu

SEQ ID NO: 2131481 - RNA, 15 nt, Staphylococcus aureus subsp. aureus N315
cuaacaguuaauaug

SEQ ID NO: 2131482 - RNA, 23 nt, Staphylococcus aureus subsp. aureus N315
cuaacauugguaccuuuuuauua

SEQ ID NO: 2131483 - RNA, 18 nt, Staphylococcus aureus subsp. aureus N315
cuaacagcuuaauuuuau

SEQ ID NO: 2131484 - RNA, 18 nt, Staphylococcus aureus subsp. aureus N315
cuaaauuuucuaaaugug

SEQ ID NO: 2131485 - RNA, 13 nt, Staphylococcus aureus subsp. aureus N315
cuaaauuuauaua

SEQ ID NO: 2131486 - RNA, 11 nt, Staphylococcus aureus subsp. aureus N315
cuaaauugucg

SEQ ID NO: 2131487 - RNA, 14 nt, Staphylococcus aureus subsp. aureus N315
cuaaauucuuuuug

SEQ ID NO: 2131488 - RNA, 15 nt, Staphylococcus aureus subsp. aureus N315
cuaaauuuacgaaag

SEQ ID NO: 2131489 - RNA, 14 nt, Staphylococcus aureus subsp. aureus N315
cuaaauuuacgaaa

SEQ ID NO: 2131490 - RNA, 16 nt, Staphylococcus aureus subsp. aureus N315
cuaaauuauuguuuau

SEQ ID NO: 2131491 - RNA, 19 nt, Staphylococcus aureus subsp. aureus N315
cuaaauucaauaaucuuag

SEQ ID NO: 2131492 - RNA, 10 nt, Staphylococcus aureus subsp. aureus N315
cuaaaugauu

SEQ ID NO: 2131493 - RNA, 23 nt, Staphylococcus aureus subsp. aureus N315
cuaaaugauuuauucuaaauaua

SEQ ID NO: 2131494 - RNA, 17 nt, Staphylococcus aureus subsp. aureus N315
cuaaacgauaaauuaac

SEQ ID NO: 2131495 - RNA, 18 nt, Staphylococcus aureus subsp. aureus N315
cuaaaccuuuuuuaaguu

SEQ ID NO: 2131496 - RNA, 20 nt, Staphylococcus aureus subsp. aureus N315
cuaaagaaugacguuaucau

SEQ ID NO: 2131497 - RNA, 12 nt, Staphylococcus aureus subsp. aureus N315
cuaagcagucug

SEQ ID NO: 2131498 - RNA, 17 nt, Staphylococcus aureus subsp. aureus N315
cuaagcaucguaaaaaa

SEQ ID NO: 2131499 - RNA, 22 nt, Staphylococcus aureus subsp. aureus N315
cuaacuuuaugggguguauuuu

SEQ ID NO: 2131500 - RNA, 16 nt, Staphylococcus aureus subsp. aureus N315
cuaagugaauuaucua

SEQ ID NO: 2131501 - RNA, 22 nt, Staphylococcus aureus subsp. aureus N315
cuaagugaacuauuaaaaccaa

SEQ ID NO: 2131502 - RNA, 13 nt, Staphylococcus aureus subsp. aureus N315
cuaaguguuuuau

SEQ ID NO: 2131503 - RNA, 14 nt, Staphylococcus aureus subsp. aureus N315
cuaaguuaaaaccu

SEQ ID NO: 2131504 - RNA, 20 nt, Staphylococcus aureus subsp. aureus N315
cuaagcugauuaaaauguua

SEQ ID NO: 2131505 - RNA, 16 nt, Staphylococcus aureus subsp. aureus N315
cuaacuuguuuauuca

SEQ ID NO: 2131506 - RNA, 19 nt, Staphylococcus aureus subsp. aureus N315
cuaacggcguuuguuucuu

SEQ ID NO: 2131507 - RNA, 18 nt, Staphylococcus aureus subsp. aureus N315
cuaacgguauaucaucca

SEQ ID NO: 2131508 - RNA, 14 nt, Staphylococcus aureus subsp. aureus N315
cuaaccuauuaaaa

SEQ ID NO: 2131509 - RNA, 16 nt, Staphylococcus aureus subsp. aureus N315
cuaaccacuucuucac

SEQ ID NO: 2131510 - RNA, 19 nt, Staphylococcus aureus subsp. aureus N315
cuaaccaucauaaauguua

SEQ ID NO: 2131511 - RNA, 17 nt, Staphylococcus aureus subsp. aureus N315
cgucuuaauucuucugu

SEQ ID NO: 2131512 - RNA, 12 nt, Staphylococcus aureus subsp. aureus N315
cgucuuguaaac

SEQ ID NO: 2131513 - RNA, 19 nt, Staphylococcus aureus subsp. aureus N315
cgucuuuugcaaauuggaa

SEQ ID NO: 2131514 - RNA, 20 nt, Staphylococcus aureus subsp. aureus N315
cgucuuuugcaaauuggaaa

SEQ ID NO: 2131515 - RNA, 14 nt, Staphylococcus aureus subsp. aureus N315
cgucuacuauuuuu

SEQ ID NO: 2131516 - RNA, 22 nt, Staphylococcus aureus subsp. aureus N315
cgugauuacauucuauacuuuu

SEQ ID NO: 2131517 - RNA, 18 nt, Staphylococcus aureus subsp. aureus N315
cgugauggcuacuuuuuc

SEQ ID NO: 2131518 - RNA, 19 nt, Staphylococcus aureus subsp. aureus N315
cgugaggcugggacauaaa

SEQ ID NO: 2131519 - RNA, 15 nt, Staphylococcus aureus subsp. aureus N315
cgugaagaaaaaaug

SEQ ID NO: 2131520 - RNA, 16 nt, Staphylococcus aureus subsp. aureus N315
cgugcauuuagaugau

SEQ ID NO: 2131521 - RNA, 14 nt, Staphylococcus aureus subsp. aureus N315
cgcuccuacuuuuc

SEQ ID NO: 2131522 - RNA, 16 nt, Staphylococcus aureus subsp. aureus N315
cgcucuggauuuuucu

SEQ ID NO: 2131523 - RNA, 19 nt, Staphylococcus aureus subsp. aureus N315
cgcuaauuuuacucuguau

SEQ ID NO: 2131524 - RNA, 20 nt, Staphylococcus aureus subsp. aureus N315
cgcuaauguaccaaucaaug

SEQ ID NO: 2131525 - RNA, 22 nt, Staphylococcus aureus subsp. aureus N315
cgcgcuuauugaaaagauaaac

SEQ ID NO: 2131526 - RNA, 15 nt, Staphylococcus aureus subsp. aureus N315
cgcuuggauuuuuug

SEQ ID NO: 2131527 - RNA, 21 nt, Staphylococcus aureus subsp. aureus N315
cgcuucauugaugaugugcua

SEQ ID NO: 2131528 - RNA, 21 nt, Staphylococcus aureus subsp. aureus N315
cggaagauaggauuugcaccu

SEQ ID NO: 2131529 - RNA, 12 nt, Staphylococcus aureus subsp. aureus N315
cggaauaaaaua

SEQ ID NO: 2131530 - RNA, 14 nt, Staphylococcus aureus subsp. aureus N315
cggaauaaaauaaa

SEQ ID NO: 2131531 - RNA, 15 nt, Staphylococcus aureus subsp. aureus N315
cggaauaacuuuuua

SEQ ID NO: 2131532 - RNA, 13 nt, Staphylococcus aureus subsp. aureus N315
cggacugaaagaa

SEQ ID NO: 2131533 - RNA, 19 nt, Staphylococcus aureus subsp. aureus N315
cggacaaguugcacauuau

SEQ ID NO: 2131534 - RNA, 22 nt, Staphylococcus aureus subsp. aureus N315
cggaucauuauuuagaauucua

SEQ ID NO: 2131535 - RNA, 14 nt, Staphylococcus aureus subsp. aureus N315
cgguucaucuaaaa

SEQ ID NO: 2131536 - RNA, 15 nt, Staphylococcus aureus subsp. aureus N315
cguaaugauauuacc

SEQ ID NO: 2131537 - RNA, 16 nt, Staphylococcus aureus subsp. aureus N315
cguaacaucacauaaa

SEQ ID NO: 2131538 - RNA, 19 nt, Staphylococcus aureus subsp. aureus N315
cguaacucuuuaauuuuac

SEQ ID NO: 2131539 - RNA, 20 nt, Staphylococcus aureus subsp. aureus N315
cguaagcaguuaauaagaaa

SEQ ID NO: 2131540 - RNA, 19 nt, Staphylococcus aureus subsp. aureus N315
cggggccccaacaaagaag

SEQ ID NO: 2131541 - RNA, 17 nt, Staphylococcus aureus subsp. aureus N315
cggggccccaacacaga

SEQ ID NO: 2131542 - RNA, 17 nt, Staphylococcus aureus subsp. aureus N315
cggggaauuuuuaugca

SEQ ID NO: 2131543 - RNA, 20 nt, Staphylococcus aureus subsp. aureus N315
cgggggauuauuuauauuuu

SEQ ID NO: 2131544 - RNA, 18 nt, Staphylococcus aureus subsp. aureus N315
cgguaggaccucuuauuu

SEQ ID NO: 2131545 - RNA, 22 nt, Staphylococcus aureus subsp. aureus N315
cgguacagauaggaaacuuaaa

SEQ ID NO: 2131546 - RNA, 21 nt, Staphylococcus aureus subsp. aureus N315
cggucaaagcgaauagaaggu

SEQ ID NO: 2131547 - RNA, 15 nt, Staphylococcus aureus subsp. aureus N315
cgguauuuucauuuu

SEQ ID NO: 2131548 - RNA, 19 nt, Staphylococcus aureus subsp. aureus N315
cgguauuuuaaauuuauaa

SEQ ID NO: 2131549 - RNA, 15 nt, Staphylococcus aureus subsp. aureus N315
cgguauuuaauguuu

SEQ ID NO: 2131550 - RNA, 15 nt, Staphylococcus aureus subsp. aureus N315
cgggaacaucauaau

SEQ ID NO: 2131551 - RNA, 13 nt, Staphylococcus aureus subsp. aureus N315
cggcccauaauag

SEQ ID NO: 2131552 - RNA, 13 nt, Staphylococcus aureus subsp. aureus N315
ccggaaauuaaau

SEQ ID NO: 2131553 - RNA, 14 nt, Staphylococcus aureus subsp. aureus N315
ccgccuaauaauaa

SEQ ID NO: 2131554 - RNA, 14 nt, Staphylococcus aureus subsp. aureus N315
cccuggaaaaugau

SEQ ID NO: 2131555 - RNA, 16 nt, Staphylococcus aureus subsp. aureus N315
ccccuuacaacuuuag

SEQ ID NO: 2131556 - RNA, 13 nt, Staphylococcus aureus subsp. aureus N315
cccuguaaaacca

SEQ ID NO: 2131557 - RNA, 21 nt, Staphylococcus aureus subsp. aureus N315
ccgaaaauugcuaaaaaaauu

SEQ ID NO: 2131558 - RNA, 18 nt, Staphylococcus aureus subsp. aureus N315
ccgaaaauugcuaaaaaa

SEQ ID NO: 2131559 - RNA, 24 nt, Staphylococcus aureus subsp. aureus N315
ccgaaaaaaccgagaaucuccauu

SEQ ID NO: 2131560 - RNA, 19 nt, Staphylococcus aureus subsp. aureus N315
cccuuuuugucucucaaca

SEQ ID NO: 2131561 - RNA, 22 nt, Staphylococcus aureus subsp. aureus N315
ccgaacaucugaaaaaauuaau

SEQ ID NO: 2131562 - RNA, 18 nt, Staphylococcus aureus subsp. aureus N315
ccgcacuucuauauuaau

SEQ ID NO: 2131563 - RNA, 15 nt, Staphylococcus aureus subsp. aureus N315
ccgcacuucuauauu

SEQ ID NO: 2131564 - RNA, 18 nt, Staphylococcus aureus subsp. aureus N315
ccgauuuugauauaaaaa

SEQ ID NO: 2131565 - RNA, 16 nt, Staphylococcus aureus subsp. aureus N315
ccgauuuugauauaaa

SEQ ID NO: 2131566 - RNA, 13 nt, Staphylococcus aureus subsp. aureus N315
ccgauuguuucac

SEQ ID NO: 2131567 - RNA, 20 nt, Staphylococcus aureus subsp. aureus N315
ccgacuugauaaaaaaugaa

SEQ ID NO: 2131568 - RNA, 21 nt, Staphylococcus aureus subsp. aureus N315
ccgacuuuugauuuugaauaa

SEQ ID NO: 2131569 - RNA, 14 nt, Staphylococcus aureus subsp. aureus N315
ccgacuauuuuuga

SEQ ID NO: 2131570 - RNA, 14 nt, Staphylococcus aureus subsp. aureus N315
ccgaauaauuuuga

SEQ ID NO: 2131571 - RNA, 16 nt, Staphylococcus aureus subsp. aureus N315
ccgaggcuaauuuuaa

SEQ ID NO: 2131572 - RNA, 23 nt, Staphylococcus aureus subsp. aureus N315
ccuguauagcgguguuuugagag

SEQ ID NO: 2131573 - RNA, 15 nt, Staphylococcus aureus subsp. aureus N315
ccuguacauccacuu

SEQ ID NO: 2131574 - RNA, 19 nt, Staphylococcus aureus subsp. aureus N315
ccucuuguaccgucuuauc

SEQ ID NO: 2131575 - RNA, 21 nt, Staphylococcus aureus subsp. aureus N315
ccugaaauuaacgucaacagc

SEQ ID NO: 2131576 - RNA, 15 nt, Staphylococcus aureus subsp. aureus N315
ccucugauaaaugaa

SEQ ID NO: 2131577 - RNA, 17 nt, Staphylococcus aureus subsp. aureus N315
ccucguuccgggaagga

SEQ ID NO: 2131578 - RNA, 16 nt, Staphylococcus aureus subsp. aureus N315
ccucgguauucaauuc

SEQ ID NO: 2131579 - RNA, 12 nt, Staphylococcus aureus subsp. aureus N315
ccuccaaagcua

SEQ ID NO: 2131580 - RNA, 17 nt, Staphylococcus aureus subsp. aureus N315
ccucauuccaggaagga

SEQ ID NO: 2131581 - RNA, 21 nt, Staphylococcus aureus subsp. aureus N315
ccuaccgcuaaaauucuuuca

SEQ ID NO: 2131582 - RNA, 11 nt, Staphylococcus aureus subsp. aureus N315
ccucauucaca

SEQ ID NO: 2131583 - RNA, 13 nt, Staphylococcus aureus subsp. aureus N315
ccguuauuuuuuu

SEQ ID NO: 2131584 - RNA, 18 nt, Staphylococcus aureus subsp. aureus N315
ccgugaggaauaugaauu

SEQ ID NO: 2131585 - RNA, 13 nt, Staphylococcus aureus subsp. aureus N315
ccuaacuuuuauu

SEQ ID NO: 2131586 - RNA, 18 nt, Staphylococcus aureus subsp. aureus N315
ccuaauaauaaaauagcu

SEQ ID NO: 2131587 - RNA, 22 nt, Staphylococcus aureus subsp. aureus N315
ccuaaucugcaacgauuuuaaa

SEQ ID NO: 2131588 - RNA, 20 nt, Staphylococcus aureus subsp. aureus N315
ccuaauacacuugauaaaac

SEQ ID NO: 2131589 - RNA, 21 nt, Staphylococcus aureus subsp. aureus N315
ccuaauacacuugauaaaacu

SEQ ID NO: 2131590 - RNA, 19 nt, Staphylococcus aureus subsp. aureus N315
ccuaaccuguuugagauau

SEQ ID NO: 2131591 - RNA, 12 nt, Staphylococcus aureus subsp. aureus N315
ccuaaccuguuu

SEQ ID NO: 2131592 - RNA, 23 nt, Staphylococcus aureus subsp. aureus N315
ccuaauucgccaucuuuuuuagc

SEQ ID NO: 2131593 - RNA, 19 nt, Staphylococcus aureus subsp. aureus N315
cgaggaaauccuuaaaugg

SEQ ID NO: 2131594 - RNA, 20 nt, Staphylococcus aureus subsp. aureus N315
cgagcuaauaugucuagacu

SEQ ID NO: 2131595 - RNA, 20 nt, Staphylococcus aureus subsp. aureus N315
cgaguguuuuaaucuuauuc

SEQ ID NO: 2131596 - RNA, 13 nt, Staphylococcus aureus subsp. aureus N315
cgauaauaacuag

SEQ ID NO: 2131597 - RNA, 14 nt, Staphylococcus aureus subsp. aureus N315
cgauaauagauacc

SEQ ID NO: 2131598 - RNA, 13 nt, Staphylococcus aureus subsp. aureus N315
cgauagauaucau

SEQ ID NO: 2131599 - RNA, 21 nt, Staphylococcus aureus subsp. aureus N315
cgauagauuuaucaccuuuag

SEQ ID NO: 2131600 - RNA, 17 nt, Staphylococcus aureus subsp. aureus N315
cgauaccaaauauauuu

SEQ ID NO: 2131601 - RNA, 20 nt, Staphylococcus aureus subsp. aureus N315
cgauauuaugucgagguguu

SEQ ID NO: 2131602 - RNA, 14 nt, Staphylococcus aureus subsp. aureus N315
cgacuuaacuuaag

SEQ ID NO: 2131603 - RNA, 18 nt, Staphylococcus aureus subsp. aureus N315
cgagaaauuagaaccauc

SEQ ID NO: 2131604 - RNA, 17 nt, Staphylococcus aureus subsp. aureus N315
cgagccauuauuauuuu

SEQ ID NO: 2131605 - RNA, 11 nt, Staphylococcus aureus subsp. aureus N315
cgcauacuuuu

SEQ ID NO: 2131606 - RNA, 18 nt, Staphylococcus aureus subsp. aureus N315
cgcauacuuuuucagaau

SEQ ID NO: 2131607 - RNA, 13 nt, Staphylococcus aureus subsp. aureus N315
cgcaucauguaua

SEQ ID NO: 2131608 - RNA, 20 nt, Staphylococcus aureus subsp. aureus N315
cgcaucuuuugguuuaucug

SEQ ID NO: 2131609 - RNA, 18 nt, Staphylococcus aureus subsp. aureus N315
cgcaucuccaaaggccau

SEQ ID NO: 2131610 - RNA, 22 nt, Staphylococcus aureus subsp. aureus N315
cgccaauacagaacuuuaauaa

SEQ ID NO: 2131611 - RNA, 12 nt, Staphylococcus aureus subsp. aureus N315
cgcaauuuuuaa

SEQ ID NO: 2131612 - RNA, 13 nt, Staphylococcus aureus subsp. aureus N315
cgcaauuaaaagu

SEQ ID NO: 2131613 - RNA, 22 nt, Staphylococcus aureus subsp. aureus N315
cgcaaugauaucuuuuccaaaa

SEQ ID NO: 2131614 - RNA, 14 nt, Staphylococcus aureus subsp. aureus N315
cgcaaugaaaacag

SEQ ID NO: 2131615 - RNA, 21 nt, Staphylococcus aureus subsp. aureus N315
cgcaaucauuagcgaaaaccu

SEQ ID NO: 2131616 - RNA, 22 nt, Staphylococcus aureus subsp. aureus N315
cgauuucuuuaugauaauaaga

SEQ ID NO: 2131617 - RNA, 13 nt, Staphylococcus aureus subsp. aureus N315
cgauuuucaagua

SEQ ID NO: 2131618 - RNA, 15 nt, Staphylococcus aureus subsp. aureus N315
cgauuuguucaauga

SEQ ID NO: 2131619 - RNA, 16 nt, Staphylococcus aureus subsp. aureus N315
cgauuuauuauuacca

SEQ ID NO: 2131620 - RNA, 12 nt, Staphylococcus aureus subsp. aureus N315
cgauugcaauug

SEQ ID NO: 2131621 - RNA, 18 nt, Staphylococcus aureus subsp. aureus N315
cgaaauggugaacuaaau

SEQ ID NO: 2131622 - RNA, 15 nt, Staphylococcus aureus subsp. aureus N315
cgaaaugaaugagug

SEQ ID NO: 2131623 - RNA, 13 nt, Staphylococcus aureus subsp. aureus N315
cgaacaaaugaaa

SEQ ID NO: 2131624 - RNA, 15 nt, Staphylococcus aureus subsp. aureus N315
cgaaaguaucuauga

SEQ ID NO: 2131625 - RNA, 17 nt, Staphylococcus aureus subsp. aureus N315
cgaaaguagaauuauuu

SEQ ID NO: 2131626 - RNA, 17 nt, Staphylococcus aureus subsp. aureus N315
cgaaagaugauauauuc

SEQ ID NO: 2131627 - RNA, 14 nt, Staphylococcus aureus subsp. aureus N315
cgaacauaaauaaa

SEQ ID NO: 2131628 - RNA, 16 nt, Staphylococcus aureus subsp. aureus N315
cgaacaucugaaaaaa

SEQ ID NO: 2131629 - RNA, 18 nt, Staphylococcus aureus subsp. aureus N315
cgaacgauagauucugau

SEQ ID NO: 2131630 - RNA, 17 nt, Staphylococcus aureus subsp. aureus N315
ccuuuuuauuuuuugga

SEQ ID NO: 2131631 - RNA, 13 nt, Staphylococcus aureus subsp. aureus N315
ccuuuuuguaauu

SEQ ID NO: 2131632 - RNA, 17 nt, Staphylococcus aureus subsp. aureus N315
ccuuuuuguaauuguaa

SEQ ID NO: 2131633 - RNA, 22 nt, Staphylococcus aureus subsp. aureus N315
cgaaaauagcuauuaaaauaga

SEQ ID NO: 2131634 - RNA, 18 nt, Staphylococcus aureus subsp. aureus N315
cgaaaauugcuaaaaaaa

SEQ ID NO: 2131635 - RNA, 20 nt, Staphylococcus aureus subsp. aureus N315
cgaaaauugcuaaaaaaauu

SEQ ID NO: 2131636 - RNA, 23 nt, Staphylococcus aureus subsp. aureus N315
cgaaaauucgcuuguaacaagcu

SEQ ID NO: 2131637 - RNA, 21 nt, Staphylococcus aureus subsp. aureus N315
cgaaaaaugccaacuauaccu

SEQ ID NO: 2131638 - RNA, 10 nt, Staphylococcus aureus subsp. aureus N315
cgaaaagaaa

SEQ ID NO: 2131639 - RNA, 23 nt, Staphylococcus aureus subsp. aureus N315
cgaaaagaaauucuacagguaau

SEQ ID NO: 2131640 - RNA, 17 nt, Staphylococcus aureus subsp. aureus N315
ccuuugcuuaaaccuua

SEQ ID NO: 2131641 - RNA, 18 nt, Staphylococcus aureus subsp. aureus N315
ccuuuuaauuuaguuaua

SEQ ID NO: 2131642 - RNA, 11 nt, Staphylococcus aureus subsp. aureus N315
ccuuuucaaau

SEQ ID NO: 2131643 - RNA, 13 nt, Staphylococcus aureus subsp. aureus N315
ccuuuuaucuuua

SEQ ID NO: 2131644 - RNA, 19 nt, Staphylococcus aureus subsp. aureus N315
ccuuuaugugcaucauuua

SEQ ID NO: 2131645 - RNA, 18 nt, Staphylococcus aureus subsp. aureus N315
ccuuuauauuuaguuagc

SEQ ID NO: 2131646 - RNA, 15 nt, Staphylococcus aureus subsp. aureus N315
ccuuuagucauguuu

SEQ ID NO: 2131647 - RNA, 17 nt, Staphylococcus aureus subsp. aureus N315
ccuuuagccaaugcuuc

SEQ ID NO: 2131648 - RNA, 20 nt, Staphylococcus aureus subsp. aureus N315
ccuuuccauucguauaagaa

SEQ ID NO: 2131649 - RNA, 19 nt, Staphylococcus aureus subsp. aureus N315
ccuuucgauaaacuacaca

SEQ ID NO: 2131650 - RNA, 15 nt, Staphylococcus aureus subsp. aureus N315
ccuuguaaauuuaaa

SEQ ID NO: 2131651 - RNA, 19 nt, Staphylococcus aureus subsp. aureus N315
ccuuuacaacauacaugcc

SEQ ID NO: 2131652 - RNA, 13 nt, Staphylococcus aureus subsp. aureus N315
ccuuuaauaauau

SEQ ID NO: 2131653 - RNA, 19 nt, Staphylococcus aureus subsp. aureus N315
ccuuuaauuguuaaaucac

SEQ ID NO: 2131654 - RNA, 20 nt, Staphylococcus aureus subsp. aureus N315
ccuuuacgccauucaucauc

SEQ ID NO: 2131655 - RNA, 13 nt, Staphylococcus aureus subsp. aureus N315
ccuuuaaaucauu

SEQ ID NO: 2131656 - RNA, 20 nt, Staphylococcus aureus subsp. aureus N315
ccuuuaaaucuacuuuguuc

SEQ ID NO: 2131657 - RNA, 12 nt, Staphylococcus aureus subsp. aureus N315
ccuuuaaaacau

SEQ ID NO: 2131658 - RNA, 22 nt, Staphylococcus aureus subsp. aureus N315
ccuuuaaauuuaccauaaccuu

SEQ ID NO: 2131659 - RNA, 22 nt, Staphylococcus aureus subsp. aureus N315
ccuuuaagaagucgaauucacc

SEQ ID NO: 2131660 - RNA, 18 nt, Staphylococcus aureus subsp. aureus N315
ccuuguuggcuuuuuuaa

SEQ ID NO: 2131661 - RNA, 20 nt, Staphylococcus aureus subsp. aureus N315
ccuuguucuccgaucaugcc

SEQ ID NO: 2131662 - RNA, 15 nt, Staphylococcus aureus subsp. aureus N315
ccuugcuaucaaacu

SEQ ID NO: 2131663 - RNA, 18 nt, Staphylococcus aureus subsp. aureus N315
ccuugauuuaauuuuuaa

SEQ ID NO: 2131664 - RNA, 17 nt, Staphylococcus aureus subsp. aureus N315
ccuucgcauacuuuuuc

SEQ ID NO: 2131665 - RNA, 15 nt, Staphylococcus aureus subsp. aureus N315
ccuuccaauaauaaa

SEQ ID NO: 2131666 - RNA, 17 nt, Staphylococcus aureus subsp. aureus N315
ccuucuugagcaucacu

SEQ ID NO: 2131667 - RNA, 15 nt, Staphylococcus aureus subsp. aureus N315
ccuucuuucgcuuca

SEQ ID NO: 2131668 - RNA, 15 nt, Staphylococcus aureus subsp. aureus N315
ccuucuuuauaacuu

SEQ ID NO: 2131669 - RNA, 17 nt, Staphylococcus aureus subsp. aureus N315
ccuucuuugaaaucaau

SEQ ID NO: 2131670 - RNA, 18 nt, Staphylococcus aureus subsp. aureus N315
ccuucuuugaaaucaaug

SEQ ID NO: 2131671 - RNA, 16 nt, Staphylococcus aureus subsp. aureus N315
ccuugaaugauauuaa

SEQ ID NO: 2131672 - RNA, 15 nt, Staphylococcus aureus subsp. aureus N315
ccuucucaucauuuu

SEQ ID NO: 2131673 - RNA, 21 nt, Staphylococcus aureus subsp. aureus N315
ccuucuguacguuuuaaauaa

SEQ ID NO: 2131674 - RNA, 12 nt, Staphylococcus aureus subsp. aureus N315
cgaaguuuaaau

SEQ ID NO: 2131675 - RNA, 15 nt, Staphylococcus aureus subsp. aureus N315
cgaacuuuuguucua

SEQ ID NO: 2131676 - RNA, 16 nt, Staphylococcus aureus subsp. aureus N315
cgaagaaacauuauau

SEQ ID NO: 2131677 - RNA, 18 nt, Staphylococcus aureus subsp. aureus N315
cgacaaaacuuguaauca

SEQ ID NO: 2131678 - RNA, 15 nt, Staphylococcus aureus subsp. aureus N315
cgaauuucauaguua

SEQ ID NO: 2131679 - RNA, 16 nt, Staphylococcus aureus subsp. aureus N315
cgacaccaacauauuu

SEQ ID NO: 2131680 - RNA, 22 nt, Staphylococcus aureus subsp. aureus N315
cgacaauuauaauaaaacuugu

SEQ ID NO: 2131681 - RNA, 19 nt, Staphylococcus aureus subsp. aureus N315
cgacacguguaaaaaugau

SEQ ID NO: 2131682 - RNA, 17 nt, Staphylococcus aureus subsp. aureus N315
cgacacgaacaacauua

SEQ ID NO: 2131683 - RNA, 17 nt, Staphylococcus aureus subsp. aureus N315
cgaauaucuuaaagaau

SEQ ID NO: 2131684 - RNA, 17 nt, Staphylococcus aureus subsp. aureus N315
cgaauucuccguuaauu

SEQ ID NO: 2131685 - RNA, 15 nt, Staphylococcus aureus subsp. aureus N315
cgaauuaaaauaacu

SEQ ID NO: 2131686 - RNA, 22 nt, Staphylococcus aureus subsp. aureus N315
cgaauguauugcuauaagaacu

SEQ ID NO: 2131687 - RNA, 20 nt, Staphylococcus aureus subsp. aureus N315
cgacaucuagaugaaauugu

SEQ ID NO: 2131688 - RNA, 15 nt, Staphylococcus aureus subsp. aureus N315
cgacaggggcuuaac

SEQ ID NO: 2131689 - RNA, 15 nt, Staphylococcus aureus subsp. aureus N315
cccaagcccugacaa

SEQ ID NO: 2131690 - RNA, 19 nt, Staphylococcus aureus subsp. aureus N315
cccaagcccugacaauuca

SEQ ID NO: 2131691 - RNA, 13 nt, Staphylococcus aureus subsp. aureus N315
ccauugucaugcc

SEQ ID NO: 2131692 - RNA, 18 nt, Staphylococcus aureus subsp. aureus N315
cccaagaugguauugcuu

SEQ ID NO: 2131693 - RNA, 19 nt, Staphylococcus aureus subsp. aureus N315
cccaaugcuugaauuuuau

SEQ ID NO: 2131694 - RNA, 16 nt, Staphylococcus aureus subsp. aureus N315
cccacaucuuuuuaaa

SEQ ID NO: 2131695 - RNA, 17 nt, Staphylococcus aureus subsp. aureus N315
cccagaugaauuuuuau

SEQ ID NO: 2131696 - RNA, 19 nt, Staphylococcus aureus subsp. aureus N315
ccaugugccuuugcuuuuu

SEQ ID NO: 2131697 - RNA, 12 nt, Staphylococcus aureus subsp. aureus N315
ccauucauuaag

SEQ ID NO: 2131698 - RNA, 19 nt, Staphylococcus aureus subsp. aureus N315
ccauucaucgucucacuua

SEQ ID NO: 2131699 - RNA, 12 nt, Staphylococcus aureus subsp. aureus N315
ccauucguaaua

SEQ ID NO: 2131700 - RNA, 20 nt, Staphylococcus aureus subsp. aureus N315
ccauuggauucuuuuguaau

SEQ ID NO: 2131701 - RNA, 14 nt, Staphylococcus aureus subsp. aureus N315
ccauucugcagcga

SEQ ID NO: 2131702 - RNA, 14 nt, Staphylococcus aureus subsp. aureus N315
ccauuaauuacaua

SEQ ID NO: 2131703 - RNA, 19 nt, Staphylococcus aureus subsp. aureus N315
ccauuaaaucaacaagaac

SEQ ID NO: 2131704 - RNA, 16 nt, Staphylococcus aureus subsp. aureus N315
ccauucaauguuuaau

SEQ ID NO: 2131705 - RNA, 24 nt, Staphylococcus aureus subsp. aureus N315
ccauucaccaauauuaaugaauau

SEQ ID NO: 2131706 - RNA, 21 nt, Staphylococcus aureus subsp. aureus N315
cccaucuuuuagguaauaauu

SEQ ID NO: 2131707 - RNA, 11 nt, Staphylococcus aureus subsp. aureus N315
cccccaacaca

SEQ ID NO: 2131708 - RNA, 14 nt, Staphylococcus aureus subsp. aureus N315
ccccuagcaaaaau

SEQ ID NO: 2131709 - RNA, 17 nt, Staphylococcus aureus subsp. aureus N315
ccaugcaaacucauuua

SEQ ID NO: 2131710 - RNA, 21 nt, Staphylococcus aureus subsp. aureus N315
ccaugcaaacucauuuauaaa

SEQ ID NO: 2131711 - RNA, 17 nt, Staphylococcus aureus subsp. aureus N315
ccaugauuagcgcacca

SEQ ID NO: 2131712 - RNA, 19 nt, Staphylococcus aureus subsp. aureus N315
ccaugcccgauaaaaccac

SEQ ID NO: 2131713 - RNA, 16 nt, Staphylococcus aureus subsp. aureus N315
ccaugagaaaccgcuu

SEQ ID NO: 2131714 - RNA, 18 nt, Staphylococcus aureus subsp. aureus N315
ccaugaaaaggaaaaacu

SEQ ID NO: 2131715 - RNA, 19 nt, Staphylococcus aureus subsp. aureus N315
ccaucugugucagcauuca

SEQ ID NO: 2131716 - RNA, 15 nt, Staphylococcus aureus subsp. aureus N315
ccaucauuuguguuu

SEQ ID NO: 2131717 - RNA, 20 nt, Staphylococcus aureus subsp. aureus N315
ccaucucgugaaaauaauac

SEQ ID NO: 2131718 - RNA, 23 nt, Staphylococcus aureus subsp. aureus N315
ccaucgcuuuuuccauuuuuuug

SEQ ID NO: 2131719 - RNA, 22 nt, Staphylococcus aureus subsp. aureus N315
ccauacuucuauuuuauaauaa

SEQ ID NO: 2131720 - RNA, 24 nt, Staphylococcus aureus subsp. aureus N315
ccauacuucuauuuuauaauaaau

SEQ ID NO: 2131721 - RNA, 14 nt, Staphylococcus aureus subsp. aureus N315
ccauacuucuauuu

SEQ ID NO: 2131722 - RNA, 16 nt, Staphylococcus aureus subsp. aureus N315
ccauacccauauuaaa

SEQ ID NO: 2131723 - RNA, 23 nt, Staphylococcus aureus subsp. aureus N315
ccauauaaagcugcgauauaacu

SEQ ID NO: 2131724 - RNA, 17 nt, Staphylococcus aureus subsp. aureus N315
ccauaguaauaaaauga

SEQ ID NO: 2131725 - RNA, 17 nt, Staphylococcus aureus subsp. aureus N315
ccauauagauauuagcu

SEQ ID NO: 2131726 - RNA, 15 nt, Staphylococcus aureus subsp. aureus N315
ccaguuuucaauuua

SEQ ID NO: 2131727 - RNA, 20 nt, Staphylococcus aureus subsp. aureus N315
ccagcuugaccgccuaugau

SEQ ID NO: 2131728 - RNA, 19 nt, Staphylococcus aureus subsp. aureus N315
ccacuuuuguuaaaaaaug

SEQ ID NO: 2131729 - RNA, 15 nt, Staphylococcus aureus subsp. aureus N315
ccagaugaauuuuua

SEQ ID NO: 2131730 - RNA, 18 nt, Staphylococcus aureus subsp. aureus N315
ccacggcauuuaagccug

SEQ ID NO: 2131731 - RNA, 21 nt, Staphylococcus aureus subsp. aureus N315
ccaccguuaaaauauaugaau

SEQ ID NO: 2131732 - RNA, 20 nt, Staphylococcus aureus subsp. aureus N315
ccaccacauuugguggagaa

SEQ ID NO: 2131733 - RNA, 16 nt, Staphylococcus aureus subsp. aureus N315
ccaccagucguaauga

SEQ ID NO: 2131734 - RNA, 17 nt, Staphylococcus aureus subsp. aureus N315
ccaauuugauuaguaau

SEQ ID NO: 2131735 - RNA, 14 nt, Staphylococcus aureus subsp. aureus N315
ccacaaauaucaau

SEQ ID NO: 2131736 - RNA, 16 nt, Staphylococcus aureus subsp. aureus N315
ccaauugauuuugcug

SEQ ID NO: 2131737 - RNA, 17 nt, Staphylococcus aureus subsp. aureus N315
ccaauuccaauaaacaa

SEQ ID NO: 2131738 - RNA, 21 nt, Staphylococcus aureus subsp. aureus N315
ccaauuaucaacauaauauuu

SEQ ID NO: 2131739 - RNA, 21 nt, Staphylococcus aureus subsp. aureus N315
ccaauuaauuguaaagcauga

SEQ ID NO: 2131740 - RNA, 18 nt, Staphylococcus aureus subsp. aureus N315
ccaaugcugaauaaauaa

SEQ ID NO: 2131741 - RNA, 16 nt, Staphylococcus aureus subsp. aureus N315
ccaauguauaaaaccu

SEQ ID NO: 2131742 - RNA, 20 nt, Staphylococcus aureus subsp. aureus N315
ccaauacuuuuuauauaauu

SEQ ID NO: 2131743 - RNA, 21 nt, Staphylococcus aureus subsp. aureus N315
ccaauaccgaauaauuuugau

SEQ ID NO: 2131744 - RNA, 16 nt, Staphylococcus aureus subsp. aureus N315
ccaauaucauauuuga

SEQ ID NO: 2131745 - RNA, 21 nt, Staphylococcus aureus subsp. aureus N315
ccaauauauucaccuacaaca

SEQ ID NO: 2131746 - RNA, 14 nt, Staphylococcus aureus subsp. aureus N315
ccaauaucauauuu

SEQ ID NO: 2131747 - RNA, 20 nt, Staphylococcus aureus subsp. aureus N315
ccaauacagaacuuuaauaa

SEQ ID NO: 2131748 - RNA, 23 nt, Staphylococcus aureus subsp. aureus N315
ccaauaaaaugucagcaacuucu

SEQ ID NO: 2131749 - RNA, 14 nt, Staphylococcus aureus subsp. aureus N315
ccaauaaaauguca

SEQ ID NO: 2131750 - RNA, 10 nt, Staphylococcus aureus subsp. aureus N315
ccaaugaauc

SEQ ID NO: 2131751 - RNA, 16 nt, Staphylococcus aureus subsp. aureus N315
ccaagauuaugacaac

SEQ ID NO: 2131752 - RNA, 19 nt, Staphylococcus aureus subsp. aureus N315
ccaagauaaaucaucauuc

SEQ ID NO: 2131753 - RNA, 17 nt, Staphylococcus aureus subsp. aureus N315
ccaagaacguguuugaa

SEQ ID NO: 2131754 - RNA, 21 nt, Staphylococcus aureus subsp. aureus N315
ccaagaagacauuggauuacu

SEQ ID NO: 2131755 - RNA, 19 nt, Staphylococcus aureus subsp. aureus N315
ccaaguacgcaauuuaaua

SEQ ID NO: 2131756 - RNA, 18 nt, Staphylococcus aureus subsp. aureus N315
ccaaguccaauuccaaua

SEQ ID NO: 2131757 - RNA, 17 nt, Staphylococcus aureus subsp. aureus N315
ccaauaaaacuaugugu

SEQ ID NO: 2131758 - RNA, 22 nt, Staphylococcus aureus subsp. aureus N315
ccaaggauguuauaaaaugaau

SEQ ID NO: 2131759 - RNA, 21 nt, Staphylococcus aureus subsp. aureus N315
ccaacauauaaaaaauuauua

SEQ ID NO: 2131760 - RNA, 18 nt, Staphylococcus aureus subsp. aureus N315
ccaacauaucacgagcuu

SEQ ID NO: 2131761 - RNA, 23 nt, Staphylococcus aureus subsp. aureus N315
ccaacauauuuuaacuaugaaug

SEQ ID NO: 2131762 - RNA, 15 nt, Staphylococcus aureus subsp. aureus N315
ccaacaucuucaaca

SEQ ID NO: 2131763 - RNA, 18 nt, Staphylococcus aureus subsp. aureus N315
ccaacacccauauaauuu

SEQ ID NO: 2131764 - RNA, 20 nt, Staphylococcus aureus subsp. aureus N315
ccaacaagguucuaaaucuu

SEQ ID NO: 2131765 - RNA, 22 nt, Staphylococcus aureus subsp. aureus N315
ccaacacagagaauuucgaaaa

SEQ ID NO: 2131766 - RNA, 22 nt, Staphylococcus aureus subsp. aureus N315
ccaacacaaagaauuucgaaaa

SEQ ID NO: 2131767 - RNA, 22 nt, Staphylococcus aureus subsp. aureus N315
ccaaauuuaggcaugucaaauc

SEQ ID NO: 2131768 - RNA, 18 nt, Staphylococcus aureus subsp. aureus N315
ccaaauuggccauuggau

SEQ ID NO: 2131769 - RNA, 14 nt, Staphylococcus aureus subsp. aureus N315
ccaacaaaaagaau

SEQ ID NO: 2131770 - RNA, 13 nt, Staphylococcus aureus subsp. aureus N315
ccaacuuuuuuaa

SEQ ID NO: 2131771 - RNA, 20 nt, Staphylococcus aureus subsp. aureus N315
ccaacugucgguucaucuaa

SEQ ID NO: 2131772 - RNA, 21 nt, Staphylococcus aureus subsp. aureus N315
ccaaauaacguuaauauaauu

SEQ ID NO: 2131773 - RNA, 15 nt, Staphylococcus aureus subsp. aureus N315
ccaaauaaauuaaau

SEQ ID NO: 2131774 - RNA, 22 nt, Staphylococcus aureus subsp. aureus N315
ccaaaguaccaucucuauuuuu

SEQ ID NO: 2131775 - RNA, 17 nt, Staphylococcus aureus subsp. aureus N315
ccaaauauuuuaucugu

SEQ ID NO: 2131776 - RNA, 16 nt, Staphylococcus aureus subsp. aureus N315
ccaaauccaucuaauu

SEQ ID NO: 2131777 - RNA, 20 nt, Staphylococcus aureus subsp. aureus N315
ccaaauauaguaauuguuau

SEQ ID NO: 2131778 - RNA, 18 nt, Staphylococcus aureus subsp. aureus N315
ccaaauauaauuucaauu

SEQ ID NO: 2131779 - RNA, 17 nt, Staphylococcus aureus subsp. aureus N315
ccaaaucggaauaaaau

SEQ ID NO: 2131780 - RNA, 19 nt, Staphylococcus aureus subsp. aureus N315
ccaaaucggaauaaaauaa

SEQ ID NO: 2131781 - RNA, 16 nt, Staphylococcus aureus subsp. aureus N315
ccaaagcugaauuuua

SEQ ID NO: 2131782 - RNA, 20 nt, Staphylococcus aureus subsp. aureus N315
ccaaagaaaucaccagauuu

SEQ ID NO: 2131783 - RNA, 12 nt, Staphylococcus aureus subsp. aureus N315
ccaaaaaguauu

SEQ ID NO: 2131784 - RNA, 20 nt, Staphylococcus aureus subsp. aureus N315
cauuucuauacaaucauuua

SEQ ID NO: 2131785 - RNA, 22 nt, Staphylococcus aureus subsp. aureus N315
ccaaaaaucauccauaaaaaua

SEQ ID NO: 2131786 - RNA, 15 nt, Staphylococcus aureus subsp. aureus N315
ccaaaaauuguucaa

SEQ ID NO: 2131787 - RNA, 17 nt, Staphylococcus aureus subsp. aureus N315
ccaaaaguuauauaaau

SEQ ID NO: 2131788 - RNA, 21 nt, Staphylococcus aureus subsp. aureus N315
ccaaaaguuauauaaauuugu

SEQ ID NO: 2131789 - RNA, 17 nt, Staphylococcus aureus subsp. aureus N315
ccaaaagaaauuuaaua

SEQ ID NO: 2131790 - RNA, 22 nt, Staphylococcus aureus subsp. aureus N315
ccaaacaaccugugauaaaaau

SEQ ID NO: 2131791 - RNA, 13 nt, Staphylococcus aureus subsp. aureus N315
caggugauugacg

SEQ ID NO: 2131792 - RNA, 19 nt, Staphylococcus aureus subsp. aureus N315
caggugacuuuccuaauuc

SEQ ID NO: 2131793 - RNA, 20 nt, Staphylococcus aureus subsp. aureus N315
caggugacuuuccuaauucu

SEQ ID NO: 2131794 - RNA, 21 nt, Staphylococcus aureus subsp. aureus N315
caggucgcccuugccugugcu

SEQ ID NO: 2131795 - RNA, 18 nt, Staphylococcus aureus subsp. aureus N315
cagguaaugcaaguuggg

SEQ ID NO: 2131796 - RNA, 22 nt, Staphylococcus aureus subsp. aureus N315
caguaaucaugcauucuaugau

SEQ ID NO: 2131797 - RNA, 15 nt, Staphylococcus aureus subsp. aureus N315
caguaaucaaaguau

SEQ ID NO: 2131798 - RNA, 14 nt, Staphylococcus aureus subsp. aureus N315
caguacgaacaacu

SEQ ID NO: 2131799 - RNA, 16 nt, Staphylococcus aureus subsp. aureus N315
caguaggacauauaaa

SEQ ID NO: 2131800 - RNA, 17 nt, Staphylococcus aureus subsp. aureus N315
caguccauuauugggcu

SEQ ID NO: 2131801 - RNA, 17 nt, Staphylococcus aureus subsp. aureus N315
cagucauuugauuuaaa

SEQ ID NO: 2131802 - RNA, 14 nt, Staphylococcus aureus subsp. aureus N315
caguauuuacuuuu

SEQ ID NO: 2131803 - RNA, 18 nt, Staphylococcus aureus subsp. aureus N315
caguauguggauacaaac

SEQ ID NO: 2131804 - RNA, 14 nt, Staphylococcus aureus subsp. aureus N315
caguuuuaaagacu

SEQ ID NO: 2131805 - RNA, 15 nt, Staphylococcus aureus subsp. aureus N315
caguuuuaaaugaaa

SEQ ID NO: 2131806 - RNA, 18 nt, Staphylococcus aureus subsp. aureus N315
caguuuuauuaucuuugu

SEQ ID NO: 2131807 - RNA, 18 nt, Staphylococcus aureus subsp. aureus N315
caguuuuacuauaaugau

SEQ ID NO: 2131808 - RNA, 17 nt, Staphylococcus aureus subsp. aureus N315
caguuuccauaaauaaa

SEQ ID NO: 2131809 - RNA, 15 nt, Staphylococcus aureus subsp. aureus N315
caguuuauugaggau

SEQ ID NO: 2131810 - RNA, 14 nt, Staphylococcus aureus subsp. aureus N315
cauaaaauuucugc

SEQ ID NO: 2131811 - RNA, 16 nt, Staphylococcus aureus subsp. aureus N315
cauaaaauuucugcuu

SEQ ID NO: 2131812 - RNA, 11 nt, Staphylococcus aureus subsp. aureus N315
cauaaaaugag

SEQ ID NO: 2131813 - RNA, 19 nt, Staphylococcus aureus subsp. aureus N315
cauaaaacuuacauuacau

SEQ ID NO: 2131814 - RNA, 23 nt, Staphylococcus aureus subsp. aureus N315
cauaaaacuuacauuacauauau

SEQ ID NO: 2131815 - RNA, 20 nt, Staphylococcus aureus subsp. aureus N315
cauaaaagacagaaauuacu

SEQ ID NO: 2131816 - RNA, 21 nt, Staphylococcus aureus subsp. aureus N315
cauaaaauacgcaaaccaauc

SEQ ID NO: 2131817 - RNA, 19 nt, Staphylococcus aureus subsp. aureus N315
caguuuugaagaauaaaaa

SEQ ID NO: 2131818 - RNA, 12 nt, Staphylococcus aureus subsp. aureus N315
caguuuuuauau

SEQ ID NO: 2131819 - RNA, 15 nt, Staphylococcus aureus subsp. aureus N315
cauaaaaaaagaacu

SEQ ID NO: 2131820 - RNA, 19 nt, Staphylococcus aureus subsp. aureus N315
cauaauccauucuucuugu

SEQ ID NO: 2131821 - RNA, 21 nt, Staphylococcus aureus subsp. aureus N315
cauaauaucuuacuacuuaau

SEQ ID NO: 2131822 - RNA, 19 nt, Staphylococcus aureus subsp. aureus N315
cauaauauuucuuaccauu

SEQ ID NO: 2131823 - RNA, 17 nt, Staphylococcus aureus subsp. aureus N315
cauaaucaacauguguc

SEQ ID NO: 2131824 - RNA, 15 nt, Staphylococcus aureus subsp. aureus N315
cauaaucaagucugc

SEQ ID NO: 2131825 - RNA, 16 nt, Staphylococcus aureus subsp. aureus N315
cauaaucaagucugca

SEQ ID NO: 2131826 - RNA, 13 nt, Staphylococcus aureus subsp. aureus N315
cauaauaaaaagg

SEQ ID NO: 2131827 - RNA, 16 nt, Staphylococcus aureus subsp. aureus N315
cauaagucacauuuau

SEQ ID NO: 2131828 - RNA, 18 nt, Staphylococcus aureus subsp. aureus N315
cauaacuuuauauauaaa

SEQ ID NO: 2131829 - RNA, 22 nt, Staphylococcus aureus subsp. aureus N315
cauaacuguaguuucuuaauua

SEQ ID NO: 2131830 - RNA, 16 nt, Staphylococcus aureus subsp. aureus N315
cauaagaaaauacuaa

SEQ ID NO: 2131831 - RNA, 19 nt, Staphylococcus aureus subsp. aureus N315
cauaaagugcguuuuucga

SEQ ID NO: 2131832 - RNA, 16 nt, Staphylococcus aureus subsp. aureus N315
cauaaauacaaaaaua

SEQ ID NO: 2131833 - RNA, 20 nt, Staphylococcus aureus subsp. aureus N315
cauaaauacaaaaauauagc

SEQ ID NO: 2131834 - RNA, 16 nt, Staphylococcus aureus subsp. aureus N315
cauaaaguuuauuuau

SEQ ID NO: 2131835 - RNA, 16 nt, Staphylococcus aureus subsp. aureus N315
cauaagccauaugcuu

SEQ ID NO: 2131836 - RNA, 22 nt, Staphylococcus aureus subsp. aureus N315
cauaagguacauaaauagugaa

SEQ ID NO: 2131837 - RNA, 17 nt, Staphylococcus aureus subsp. aureus N315
cauaaggucuuggacua

SEQ ID NO: 2131838 - RNA, 22 nt, Staphylococcus aureus subsp. aureus N315
cauaaggucuuggacuaauaau

SEQ ID NO: 2131839 - RNA, 23 nt, Staphylococcus aureus subsp. aureus N315
cagugcuauguauuuuucuuaau

SEQ ID NO: 2131840 - RNA, 15 nt, Staphylococcus aureus subsp. aureus N315
cagugccuugcugga

SEQ ID NO: 2131841 - RNA, 17 nt, Staphylococcus aureus subsp. aureus N315
caguuaugccugaagcg

SEQ ID NO: 2131842 - RNA, 19 nt, Staphylococcus aureus subsp. aureus N315
cagcuucuaaguaauauaa

SEQ ID NO: 2131843 - RNA, 17 nt, Staphylococcus aureus subsp. aureus N315
cagcuacaaauaaugag

SEQ ID NO: 2131844 - RNA, 16 nt, Staphylococcus aureus subsp. aureus N315
cagcuacaaauaauga

SEQ ID NO: 2131845 - RNA, 13 nt, Staphylococcus aureus subsp. aureus N315
cagcuaaauauuu

SEQ ID NO: 2131846 - RNA, 15 nt, Staphylococcus aureus subsp. aureus N315
cagcuaaaaaguaua

SEQ ID NO: 2131847 - RNA, 21 nt, Staphylococcus aureus subsp. aureus N315
cagcuaaaaaguauacuaaac

SEQ ID NO: 2131848 - RNA, 12 nt, Staphylococcus aureus subsp. aureus N315
cagcuaacaaaa

SEQ ID NO: 2131849 - RNA, 21 nt, Staphylococcus aureus subsp. aureus N315
cagcuaaugucaugaaaauaa

SEQ ID NO: 2131850 - RNA, 19 nt, Staphylococcus aureus subsp. aureus N315
cagcuaaugucaugaaaau

SEQ ID NO: 2131851 - RNA, 18 nt, Staphylococcus aureus subsp. aureus N315
caggcaaugcgaguuggg

SEQ ID NO: 2131852 - RNA, 17 nt, Staphylococcus aureus subsp. aureus N315
caggcaacaacuuuuca

SEQ ID NO: 2131853 - RNA, 15 nt, Staphylococcus aureus subsp. aureus N315
cauguaacaaaauac

SEQ ID NO: 2131854 - RNA, 21 nt, Staphylococcus aureus subsp. aureus N315
cauguaaugcuuaaaaacaau

SEQ ID NO: 2131855 - RNA, 16 nt, Staphylococcus aureus subsp. aureus N315
cauguaaugcuuaaaa

SEQ ID NO: 2131856 - RNA, 17 nt, Staphylococcus aureus subsp. aureus N315
cauguaaugcuuaaaaa

SEQ ID NO: 2131857 - RNA, 15 nt, Staphylococcus aureus subsp. aureus N315
cauguacaguuacuu

SEQ ID NO: 2131858 - RNA, 19 nt, Staphylococcus aureus subsp. aureus N315
cauguacauugguuuuuac

SEQ ID NO: 2131859 - RNA, 18 nt, Staphylococcus aureus subsp. aureus N315
cauguaccacauuuuccu

SEQ ID NO: 2131860 - RNA, 21 nt, Staphylococcus aureus subsp. aureus N315
cauguacguuuuuuuaaauac

SEQ ID NO: 2131861 - RNA, 19 nt, Staphylococcus aureus subsp. aureus N315
cauguaaaauuaaaugcuc

SEQ ID NO: 2131862 - RNA, 19 nt, Staphylococcus aureus subsp. aureus N315
cauguauaaaagauauaaa

SEQ ID NO: 2131863 - RNA, 20 nt, Staphylococcus aureus subsp. aureus N315
cauguauucuuagauauuau

SEQ ID NO: 2131864 - RNA, 19 nt, Staphylococcus aureus subsp. aureus N315
cauguauauggcaucauca

SEQ ID NO: 2131865 - RNA, 23 nt, Staphylococcus aureus subsp. aureus N315
cauguggcuggacaaucuuauca

SEQ ID NO: 2131866 - RNA, 17 nt, Staphylococcus aureus subsp. aureus N315
caugcuuaauuuaugug

SEQ ID NO: 2131867 - RNA, 19 nt, Staphylococcus aureus subsp. aureus N315
caugauacugaaauuucau

SEQ ID NO: 2131868 - RNA, 21 nt, Staphylococcus aureus subsp. aureus N315
caugagauuauuuuuuuaaau

SEQ ID NO: 2131869 - RNA, 20 nt, Staphylococcus aureus subsp. aureus N315
caugaugauaaauugaguuu

SEQ ID NO: 2131870 - RNA, 14 nt, Staphylococcus aureus subsp. aureus N315
caugauucaugaua

SEQ ID NO: 2131871 - RNA, 18 nt, Staphylococcus aureus subsp. aureus N315
caugaauuuuaauauauu

SEQ ID NO: 2131872 - RNA, 23 nt, Staphylococcus aureus subsp. aureus N315
caugaauuuuaauauauuuggag

SEQ ID NO: 2131873 - RNA, 15 nt, Staphylococcus aureus subsp. aureus N315
caugacagcaucauc

SEQ ID NO: 2131874 - RNA, 23 nt, Staphylococcus aureus subsp. aureus N315
caugacgaacgauagauucugau

SEQ ID NO: 2131875 - RNA, 17 nt, Staphylococcus aureus subsp. aureus N315
caugacucacuaaucuc

SEQ ID NO: 2131876 - RNA, 18 nt, Staphylococcus aureus subsp. aureus N315
caugaaucgcauuuaaau

SEQ ID NO: 2131877 - RNA, 21 nt, Staphylococcus aureus subsp. aureus N315
caugaaucgcauuuaaauaua

SEQ ID NO: 2131878 - RNA, 21 nt, Staphylococcus aureus subsp. aureus N315
caucucugcuuuaauauaauu

SEQ ID NO: 2131879 - RNA, 14 nt, Staphylococcus aureus subsp. aureus N315
cauuucauguguca

SEQ ID NO: 2131880 - RNA, 17 nt, Staphylococcus aureus subsp. aureus N315
cauuucaugugucacaa

SEQ ID NO: 2131881 - RNA, 20 nt, Staphylococcus aureus subsp. aureus N315
cauuucaugugucacaauga

SEQ ID NO: 2131882 - RNA, 16 nt, Staphylococcus aureus subsp. aureus N315
cauuucagaaauacau

SEQ ID NO: 2131883 - RNA, 16 nt, Staphylococcus aureus subsp. aureus N315
cauuuccuaugugcug

SEQ ID NO: 2131884 - RNA, 16 nt, Staphylococcus aureus subsp. aureus N315
cauuucaauauuaaaa

SEQ ID NO: 2131885 - RNA, 15 nt, Staphylococcus aureus subsp. aureus N315
cauuuaguuaaauac

SEQ ID NO: 2131886 - RNA, 15 nt, Staphylococcus aureus subsp. aureus N315
cauuuaucuaacaau

SEQ ID NO: 2131887 - RNA, 14 nt, Staphylococcus aureus subsp. aureus N315
cauuuauguagauu

SEQ ID NO: 2131888 - RNA, 22 nt, Staphylococcus aureus subsp. aureus N315
cauuuauuuucaauaaauaaac

SEQ ID NO: 2131889 - RNA, 23 nt, Staphylococcus aureus subsp. aureus N315
cauuuauuuucuuuggugaaagu

SEQ ID NO: 2131890 - RNA, 18 nt, Staphylococcus aureus subsp. aureus N315
cauuuauaaacauugucc

SEQ ID NO: 2131891 - RNA, 22 nt, Staphylococcus aureus subsp. aureus N315
cauugucaugccuucauuagcc

SEQ ID NO: 2131892 - RNA, 14 nt, Staphylococcus aureus subsp. aureus N315
cauuguaauaccaa

SEQ ID NO: 2131893 - RNA, 23 nt, Staphylococcus aureus subsp. aureus N315
cauugcuagugcucuugcaauag

SEQ ID NO: 2131894 - RNA, 17 nt, Staphylococcus aureus subsp. aureus N315
cauugguaccuuuuuau

SEQ ID NO: 2131895 - RNA, 22 nt, Staphylococcus aureus subsp. aureus N315
cauucuuccaacacccauauaa

SEQ ID NO: 2131896 - RNA, 20 nt, Staphylococcus aureus subsp. aureus N315
cauucuuuaauauaaauuuu

SEQ ID NO: 2131897 - RNA, 16 nt, Staphylococcus aureus subsp. aureus N315
cauucuucaaaaaaua

SEQ ID NO: 2131898 - RNA, 21 nt, Staphylococcus aureus subsp. aureus N315
cauuacuguaaaauucuauaa

SEQ ID NO: 2131899 - RNA, 14 nt, Staphylococcus aureus subsp. aureus N315
cauuacuacuuuau

SEQ ID NO: 2131900 - RNA, 18 nt, Staphylococcus aureus subsp. aureus N315
cauuacuaauugaucagc

SEQ ID NO: 2131901 - RNA, 19 nt, Staphylococcus aureus subsp. aureus N315
cauuacuaucuucaucaua

SEQ ID NO: 2131902 - RNA, 17 nt, Staphylococcus aureus subsp. aureus N315
cauuaguuuuuaaaauu

SEQ ID NO: 2131903 - RNA, 15 nt, Staphylococcus aureus subsp. aureus N315
cauuaguugcauaau

SEQ ID NO: 2131904 - RNA, 22 nt, Staphylococcus aureus subsp. aureus N315
cauuaguugcauaaucaauuuc

SEQ ID NO: 2131905 - RNA, 22 nt, Staphylococcus aureus subsp. aureus N315
cauguuccccauuaauuaacaa

SEQ ID NO: 2131906 - RNA, 22 nt, Staphylococcus aureus subsp. aureus N315
cauuacguaacaucacauaaaa

SEQ ID NO: 2131907 - RNA, 20 nt, Staphylococcus aureus subsp. aureus N315
cauuauaugguucguccauu

SEQ ID NO: 2131908 - RNA, 17 nt, Staphylococcus aureus subsp. aureus N315
cauuauuuauauuuaga

SEQ ID NO: 2131909 - RNA, 15 nt, Staphylococcus aureus subsp. aureus N315
cauuauuuagaauuc

SEQ ID NO: 2131910 - RNA, 24 nt, Staphylococcus aureus subsp. aureus N315
cauucaauguuuaauuuucuaaau

SEQ ID NO: 2131911 - RNA, 15 nt, Staphylococcus aureus subsp. aureus N315
cauucaccuaaaaag

SEQ ID NO: 2131912 - RNA, 20 nt, Staphylococcus aureus subsp. aureus N315
cauucaccuaaaaagaaaau

SEQ ID NO: 2131913 - RNA, 18 nt, Staphylococcus aureus subsp. aureus N315
cauuauuugauaaauaaa

SEQ ID NO: 2131914 - RNA, 20 nt, Staphylococcus aureus subsp. aureus N315
cauuauuugcugcuaauuga

SEQ ID NO: 2131915 - RNA, 12 nt, Staphylococcus aureus subsp. aureus N315
cauucaaauaaa

SEQ ID NO: 2131916 - RNA, 20 nt, Staphylococcus aureus subsp. aureus N315
cauucauuaagcuuuguuug

SEQ ID NO: 2131917 - RNA, 21 nt, Staphylococcus aureus subsp. aureus N315
cauucauuuaguuaaauacaa

SEQ ID NO: 2131918 - RNA, 18 nt, Staphylococcus aureus subsp. aureus N315
cauucauauggaauacua

SEQ ID NO: 2131919 - RNA, 13 nt, Staphylococcus aureus subsp. aureus N315
cauuccaaaaauu

SEQ ID NO: 2131920 - RNA, 22 nt, Staphylococcus aureus subsp. aureus N315
cauuccaaaguaccaucucuau

SEQ ID NO: 2131921 - RNA, 15 nt, Staphylococcus aureus subsp. aureus N315
cauucauaaaugacu

SEQ ID NO: 2131922 - RNA, 21 nt, Staphylococcus aureus subsp. aureus N315
cauucauaccgaagaaacuaa

SEQ ID NO: 2131923 - RNA, 14 nt, Staphylococcus aureus subsp. aureus N315
cauucacuacuuuu

SEQ ID NO: 2131924 - RNA, 23 nt, Staphylococcus aureus subsp. aureus N315
cauucgaugcuaaaaauauugaa

SEQ ID NO: 2131925 - RNA, 16 nt, Staphylococcus aureus subsp. aureus N315
cauagcauuaagauga

SEQ ID NO: 2131926 - RNA, 13 nt, Staphylococcus aureus subsp. aureus N315
cauagagcauuug

SEQ ID NO: 2131927 - RNA, 18 nt, Staphylococcus aureus subsp. aureus N315
cauagaugacgaucuaua

SEQ ID NO: 2131928 - RNA, 18 nt, Staphylococcus aureus subsp. aureus N315
cauagaugcauaaaaacc

SEQ ID NO: 2131929 - RNA, 17 nt, Staphylococcus aureus subsp. aureus N315
cauagaugcauaaaaac

SEQ ID NO: 2131930 - RNA, 15 nt, Staphylococcus aureus subsp. aureus N315
cauaauuaaauaacu

SEQ ID NO: 2131931 - RNA, 19 nt, Staphylococcus aureus subsp. aureus N315
cauaauuaccuuuccauuc

SEQ ID NO: 2131932 - RNA, 11 nt, Staphylococcus aureus subsp. aureus N315
cauaaugguuc

SEQ ID NO: 2131933 - RNA, 14 nt, Staphylococcus aureus subsp. aureus N315
cauaauuaauaaca

SEQ ID NO: 2131934 - RNA, 13 nt, Staphylococcus aureus subsp. aureus N315
cauacaaauuuuu

SEQ ID NO: 2131935 - RNA, 18 nt, Staphylococcus aureus subsp. aureus N315
cauacaaauuuuuuuuau

SEQ ID NO: 2131936 - RNA, 15 nt, Staphylococcus aureus subsp. aureus N315
cauaauuuguugaua

SEQ ID NO: 2131937 - RNA, 15 nt, Staphylococcus aureus subsp. aureus N315
cauaauuuaaaagau

SEQ ID NO: 2131938 - RNA, 14 nt, Staphylococcus aureus subsp. aureus N315
cauaauucuagaga

SEQ ID NO: 2131939 - RNA, 12 nt, Staphylococcus aureus subsp. aureus N315
cauagaaauuuu

SEQ ID NO: 2131940 - RNA, 15 nt, Staphylococcus aureus subsp. aureus N315
cauaggcuugccaau

SEQ ID NO: 2131941 - RNA, 19 nt, Staphylococcus aureus subsp. aureus N315
cauaggcuugccaauguga

SEQ ID NO: 2131942 - RNA, 13 nt, Staphylococcus aureus subsp. aureus N315
cauagguaaccuu

SEQ ID NO: 2131943 - RNA, 16 nt, Staphylococcus aureus subsp. aureus N315
cauagcucuucuuuuu

SEQ ID NO: 2131944 - RNA, 18 nt, Staphylococcus aureus subsp. aureus N315
cauagcucuucuuuuucu

SEQ ID NO: 2131945 - RNA, 16 nt, Staphylococcus aureus subsp. aureus N315
cauagcuaaauaaauu

SEQ ID NO: 2131946 - RNA, 23 nt, Staphylococcus aureus subsp. aureus N315
cauaggcgcuguuccaaauucau

SEQ ID NO: 2131947 - RNA, 15 nt, Staphylococcus aureus subsp. aureus N315
cauaggcgcuuuuuu

SEQ ID NO: 2131948 - RNA, 17 nt, Staphylococcus aureus subsp. aureus N315
cauauacgacauuuuua

SEQ ID NO: 2131949 - RNA, 19 nt, Staphylococcus aureus subsp. aureus N315
cauauacgacauuuuuaga

SEQ ID NO: 2131950 - RNA, 16 nt, Staphylococcus aureus subsp. aureus N315
cauauacgacauuuuu

SEQ ID NO: 2131951 - RNA, 14 nt, Staphylococcus aureus subsp. aureus N315
cauauaaacaacug

SEQ ID NO: 2131952 - RNA, 16 nt, Staphylococcus aureus subsp. aureus N315
cauagugguguuuaua

SEQ ID NO: 2131953 - RNA, 13 nt, Staphylococcus aureus subsp. aureus N315
cauauuuauauuu

SEQ ID NO: 2131954 - RNA, 17 nt, Staphylococcus aureus subsp. aureus N315
cauauuuauauuuacac

SEQ ID NO: 2131955 - RNA, 23 nt, Staphylococcus aureus subsp. aureus N315
cauauuuaucgcgauuauuacca

SEQ ID NO: 2131956 - RNA, 17 nt, Staphylococcus aureus subsp. aureus N315
cauauugugccgcuucu

SEQ ID NO: 2131957 - RNA, 15 nt, Staphylococcus aureus subsp. aureus N315
cauauucaguauaug

SEQ ID NO: 2131958 - RNA, 14 nt, Staphylococcus aureus subsp. aureus N315
cauaucaugaaugu

SEQ ID NO: 2131959 - RNA, 16 nt, Staphylococcus aureus subsp. aureus N315
cauauuucuaaauuau

SEQ ID NO: 2131960 - RNA, 22 nt, Staphylococcus aureus subsp. aureus N315
caucaaugagcaagucuucuaa

SEQ ID NO: 2131961 - RNA, 14 nt, Staphylococcus aureus subsp. aureus N315
caucaauaucaaau

SEQ ID NO: 2131962 - RNA, 15 nt, Staphylococcus aureus subsp. aureus N315
caucacauaaaauac

SEQ ID NO: 2131963 - RNA, 12 nt, Staphylococcus aureus subsp. aureus N315
caucaauuucua

SEQ ID NO: 2131964 - RNA, 20 nt, Staphylococcus aureus subsp. aureus N315
caucacuugcuguugcaaua

SEQ ID NO: 2131965 - RNA, 13 nt, Staphylococcus aureus subsp. aureus N315
caucacuuuuuaa

SEQ ID NO: 2131966 - RNA, 23 nt, Staphylococcus aureus subsp. aureus N315
caucacucuuacucauuuuucuu

SEQ ID NO: 2131967 - RNA, 14 nt, Staphylococcus aureus subsp. aureus N315
caucacugcauaua

SEQ ID NO: 2131968 - RNA, 19 nt, Staphylococcus aureus subsp. aureus N315
caucacuguagauucaaau

SEQ ID NO: 2131969 - RNA, 19 nt, Staphylococcus aureus subsp. aureus N315
caucuaaaugcacgagcaa

SEQ ID NO: 2131970 - RNA, 13 nt, Staphylococcus aureus subsp. aureus N315
caucuaaaaugag

SEQ ID NO: 2131971 - RNA, 14 nt, Staphylococcus aureus subsp. aureus N315
caucuauuucuugu

SEQ ID NO: 2131972 - RNA, 14 nt, Staphylococcus aureus subsp. aureus N315
caucuaauuuuccu

SEQ ID NO: 2131973 - RNA, 21 nt, Staphylococcus aureus subsp. aureus N315
caucuacaauauucaauaauu

SEQ ID NO: 2131974 - RNA, 17 nt, Staphylococcus aureus subsp. aureus N315
caucucagcaauacuaa

SEQ ID NO: 2131975 - RNA, 21 nt, Staphylococcus aureus subsp. aureus N315
caucgucaucacuuuuuaaac

SEQ ID NO: 2131976 - RNA, 23 nt, Staphylococcus aureus subsp. aureus N315
caucguaaaaaacaaaaaaaccg

SEQ ID NO: 2131977 - RNA, 19 nt, Staphylococcus aureus subsp. aureus N315
caucgcaaauacauaauca

SEQ ID NO: 2131978 - RNA, 20 nt, Staphylococcus aureus subsp. aureus N315
caucgauuuaucauuauuug

SEQ ID NO: 2131979 - RNA, 20 nt, Staphylococcus aureus subsp. aureus N315
caucccauucaccaauauua

SEQ ID NO: 2131980 - RNA, 14 nt, Staphylococcus aureus subsp. aureus N315
caucauguuuaucu

SEQ ID NO: 2131981 - RNA, 16 nt, Staphylococcus aureus subsp. aureus N315
caucauguuuaucuac

SEQ ID NO: 2131982 - RNA, 16 nt, Staphylococcus aureus subsp. aureus N315
caucauucaaacuccu

SEQ ID NO: 2131983 - RNA, 19 nt, Staphylococcus aureus subsp. aureus N315
caucauuaguuuuuaaaau

SEQ ID NO: 2131984 - RNA, 21 nt, Staphylococcus aureus subsp. aureus N315
cauccaauuauguuuaucuac

SEQ ID NO: 2131985 - RNA, 16 nt, Staphylococcus aureus subsp. aureus N315
cauccacaaucacagu

SEQ ID NO: 2131986 - RNA, 17 nt, Staphylococcus aureus subsp. aureus N315
cauccaggcaacaacuu

SEQ ID NO: 2131987 - RNA, 15 nt, Staphylococcus aureus subsp. aureus N315
caaaaucuuuacuug

SEQ ID NO: 2131988 - RNA, 17 nt, Staphylococcus aureus subsp. aureus N315
caaaaucucaacagcaa

SEQ ID NO: 2131989 - RNA, 18 nt, Staphylococcus aureus subsp. aureus N315
caaaaucucaacagcaaa

SEQ ID NO: 2131990 - RNA, 23 nt, Staphylococcus aureus subsp. aureus N315
caaaaugccaagaagacauugga

SEQ ID NO: 2131991 - RNA, 22 nt, Staphylococcus aureus subsp. aureus N315
caaacaaccugugauaaaaauc

SEQ ID NO: 2131992 - RNA, 12 nt, Staphylococcus aureus subsp. aureus N315
caaacaauacau

SEQ ID NO: 2131993 - RNA, 20 nt, Staphylococcus aureus subsp. aureus N315
caaacaauuuuguacauuuc

SEQ ID NO: 2131994 - RNA, 21 nt, Staphylococcus aureus subsp. aureus N315
caaacaauuuuguacauuucu

SEQ ID NO: 2131995 - RNA, 12 nt, Staphylococcus aureus subsp. aureus N315
caaacaauacag

SEQ ID NO: 2131996 - RNA, 17 nt, Staphylococcus aureus subsp. aureus N315
caaaauuugaaauauac

SEQ ID NO: 2131997 - RNA, 17 nt, Staphylococcus aureus subsp. aureus N315
caaaauugaacuuugua

SEQ ID NO: 2131998 - RNA, 17 nt, Staphylococcus aureus subsp. aureus N315
caaaauuauguaaaaaa

SEQ ID NO: 2131999 - RNA, 18 nt, Staphylococcus aureus subsp. aureus N315
caaaauaauagcaguuuc

SEQ ID NO: 2132000 - RNA, 24 nt, Staphylococcus aureus subsp. aureus N315
caaaauacucaacacgauagucau

SEQ ID NO: 2132001 - RNA, 14 nt, Staphylococcus aureus subsp. aureus N315
caaaauauaaaauc

SEQ ID NO: 2132002 - RNA, 16 nt, Staphylococcus aureus subsp. aureus N315
caaaauauaaaauccu

SEQ ID NO: 2132003 - RNA, 21 nt, Staphylococcus aureus subsp. aureus N315
caaaaguaugauuuguuugau

SEQ ID NO: 2132004 - RNA, 14 nt, Staphylococcus aureus subsp. aureus N315
caaaaguaugauuu

SEQ ID NO: 2132005 - RNA, 19 nt, Staphylococcus aureus subsp. aureus N315
caaaaguuauauaaauuug

SEQ ID NO: 2132006 - RNA, 20 nt, Staphylococcus aureus subsp. aureus N315
caaaaguuauauaaauuugu

SEQ ID NO: 2132007 - RNA, 16 nt, Staphylococcus aureus subsp. aureus N315
auuuuucaauuaaaug

SEQ ID NO: 2132008 - RNA, 13 nt, Staphylococcus aureus subsp. aureus N315
auuuuuauuuaua

SEQ ID NO: 2132009 - RNA, 22 nt, Staphylococcus aureus subsp. aureus N315
auuuuuauagugucgagauuuu

SEQ ID NO: 2132010 - RNA, 13 nt, Staphylococcus aureus subsp. aureus N315
auuuuuauauaaa

SEQ ID NO: 2132011 - RNA, 20 nt, Staphylococcus aureus subsp. aureus N315
auuuuuaucccacuccuuau

SEQ ID NO: 2132012 - RNA, 13 nt, Staphylococcus aureus subsp. aureus N315
caaaccuuuauau

SEQ ID NO: 2132013 - RNA, 19 nt, Staphylococcus aureus subsp. aureus N315
caaacucauuuauaaacau

SEQ ID NO: 2132014 - RNA, 13 nt, Staphylococcus aureus subsp. aureus N315
caaacuauuaaug

SEQ ID NO: 2132015 - RNA, 21 nt, Staphylococcus aureus subsp. aureus N315
caaacauuaaucuauauaaaa

SEQ ID NO: 2132016 - RNA, 23 nt, Staphylococcus aureus subsp. aureus N315
caaacauuucgguaugauauuuc

SEQ ID NO: 2132017 - RNA, 13 nt, Staphylococcus aureus subsp. aureus N315
caaaccaccaaaa

SEQ ID NO: 2132018 - RNA, 14 nt, Staphylococcus aureus subsp. aureus N315
caaaccaccaaaaa

SEQ ID NO: 2132019 - RNA, 18 nt, Staphylococcus aureus subsp. aureus N315
caaaccauaaguaaaacu

SEQ ID NO: 2132020 - RNA, 24 nt, Staphylococcus aureus subsp. aureus N315
caaacacaguacaaauaacaaaca

SEQ ID NO: 2132021 - RNA, 20 nt, Staphylococcus aureus subsp. aureus N315
caaacauagauacaaaguac

SEQ ID NO: 2132022 - RNA, 16 nt, Staphylococcus aureus subsp. aureus N315
caaagcuugauuuaac

SEQ ID NO: 2132023 - RNA, 19 nt, Staphylococcus aureus subsp. aureus N315
caaagcuaaguuugaagga

SEQ ID NO: 2132024 - RNA, 16 nt, Staphylococcus aureus subsp. aureus N315
caaagauauguuuaua

SEQ ID NO: 2132025 - RNA, 22 nt, Staphylococcus aureus subsp. aureus N315
caaagcgauaaaguaugaguga

SEQ ID NO: 2132026 - RNA, 17 nt, Staphylococcus aureus subsp. aureus N315
caaagaggcuuuaaaau

SEQ ID NO: 2132027 - RNA, 16 nt, Staphylococcus aureus subsp. aureus N315
caaagacucaauuuca

SEQ ID NO: 2132028 - RNA, 17 nt, Staphylococcus aureus subsp. aureus N315
caaacuuggcaaugaaa

SEQ ID NO: 2132029 - RNA, 14 nt, Staphylococcus aureus subsp. aureus N315
caaaucaaauacau

SEQ ID NO: 2132030 - RNA, 18 nt, Staphylococcus aureus subsp. aureus N315
caaauauuauuaaaucaa

SEQ ID NO: 2132031 - RNA, 14 nt, Staphylococcus aureus subsp. aureus N315
caaauauuucuaaa

SEQ ID NO: 2132032 - RNA, 15 nt, Staphylococcus aureus subsp. aureus N315
caaauagacaccaaa

SEQ ID NO: 2132033 - RNA, 18 nt, Staphylococcus aureus subsp. aureus N315
caaauagacaccaaaaaa

SEQ ID NO: 2132034 - RNA, 20 nt, Staphylococcus aureus subsp. aureus N315
caaauauaucuagccugaaa

SEQ ID NO: 2132035 - RNA, 13 nt, Staphylococcus aureus subsp. aureus N315
caaauaugagugg

SEQ ID NO: 2132036 - RNA, 18 nt, Staphylococcus aureus subsp. aureus N315
caaauaucaguaauaaua

SEQ ID NO: 2132037 - RNA, 14 nt, Staphylococcus aureus subsp. aureus N315
caaauaaauauaaa

SEQ ID NO: 2132038 - RNA, 14 nt, Staphylococcus aureus subsp. aureus N315
caaauaaaucaaac

SEQ ID NO: 2132039 - RNA, 18 nt, Staphylococcus aureus subsp. aureus N315
caaauaaaucaaacuuuu

SEQ ID NO: 2132040 - RNA, 19 nt, Staphylococcus aureus subsp. aureus N315
caaauaaaugacauuuaau

SEQ ID NO: 2132041 - RNA, 15 nt, Staphylococcus aureus subsp. aureus N315
caaauaacguuaaua

SEQ ID NO: 2132042 - RNA, 15 nt, Staphylococcus aureus subsp. aureus N315
caaauaacaaacauu

SEQ ID NO: 2132043 - RNA, 12 nt, Staphylococcus aureus subsp. aureus N315
caaauaaauguc

SEQ ID NO: 2132044 - RNA, 20 nt, Staphylococcus aureus subsp. aureus N315
caaauaaauguccgacuuga

SEQ ID NO: 2132045 - RNA, 17 nt, Staphylococcus aureus subsp. aureus N315
caaauaaauuaaauuuu

SEQ ID NO: 2132046 - RNA, 13 nt, Staphylococcus aureus subsp. aureus N315
caacaaaagaugu

SEQ ID NO: 2132047 - RNA, 13 nt, Staphylococcus aureus subsp. aureus N315
caacaaaaagaau

SEQ ID NO: 2132048 - RNA, 15 nt, Staphylococcus aureus subsp. aureus N315
caaauuuuuuguaaa

SEQ ID NO: 2132049 - RNA, 12 nt, Staphylococcus aureus subsp. aureus N315
caacaaacauaa

SEQ ID NO: 2132050 - RNA, 19 nt, Staphylococcus aureus subsp. aureus N315
caacaaagugcaauuauuu

SEQ ID NO: 2132051 - RNA, 13 nt, Staphylococcus aureus subsp. aureus N315
caaauucauuugu

SEQ ID NO: 2132052 - RNA, 15 nt, Staphylococcus aureus subsp. aureus N315
caaauucauuuguau

SEQ ID NO: 2132053 - RNA, 19 nt, Staphylococcus aureus subsp. aureus N315
caaauucgacucaaacaau

SEQ ID NO: 2132054 - RNA, 15 nt, Staphylococcus aureus subsp. aureus N315
caaaugaaauucuuu

SEQ ID NO: 2132055 - RNA, 22 nt, Staphylococcus aureus subsp. aureus N315
caaaugaaaaaguaaaaucuuu

SEQ ID NO: 2132056 - RNA, 20 nt, Staphylococcus aureus subsp. aureus N315
caaaugaaaaaguaaaaucu

SEQ ID NO: 2132057 - RNA, 14 nt, Staphylococcus aureus subsp. aureus N315
caaaucuuuuaaau

SEQ ID NO: 2132058 - RNA, 16 nt, Staphylococcus aureus subsp. aureus N315
caaauucaacuuuaau

SEQ ID NO: 2132059 - RNA, 10 nt, Staphylococcus aureus subsp. aureus N315
caaaugcuua

SEQ ID NO: 2132060 - RNA, 15 nt, Staphylococcus aureus subsp. aureus N315
caacacccauauaau

SEQ ID NO: 2132061 - RNA, 15 nt, Staphylococcus aureus subsp. aureus N315
caacaauaaaucuuu

SEQ ID NO: 2132062 - RNA, 15 nt, Staphylococcus aureus subsp. aureus N315
caacaccuaauauuu

SEQ ID NO: 2132063 - RNA, 19 nt, Staphylococcus aureus subsp. aureus N315
caacaacuaagauauauug

SEQ ID NO: 2132064 - RNA, 16 nt, Staphylococcus aureus subsp. aureus N315
caacaacuuuucauau

SEQ ID NO: 2132065 - RNA, 11 nt, Staphylococcus aureus subsp. aureus N315
caacaguaauu

SEQ ID NO: 2132066 - RNA, 14 nt, Staphylococcus aureus subsp. aureus N315
caacaguuuuaaag

SEQ ID NO: 2132067 - RNA, 14 nt, Staphylococcus aureus subsp. aureus N315
caacagcaaaaaau

SEQ ID NO: 2132068 - RNA, 22 nt, Staphylococcus aureus subsp. aureus N315
caaggauguuauaaaaugaaua

SEQ ID NO: 2132069 - RNA, 13 nt, Staphylococcus aureus subsp. aureus N315
caaggauugaaaa

SEQ ID NO: 2132070 - RNA, 16 nt, Staphylococcus aureus subsp. aureus N315
caaggauugaaaaaag

SEQ ID NO: 2132071 - RNA, 18 nt, Staphylococcus aureus subsp. aureus N315
caagcuuuucauuuuuau

SEQ ID NO: 2132072 - RNA, 18 nt, Staphylococcus aureus subsp. aureus N315
caaggauguuauaaaaug

SEQ ID NO: 2132073 - RNA, 22 nt, Staphylococcus aureus subsp. aureus N315
caagcuuaauaagcugaaauaa

SEQ ID NO: 2132074 - RNA, 18 nt, Staphylococcus aureus subsp. aureus N315
caagauuaugacaacaua

SEQ ID NO: 2132075 - RNA, 13 nt, Staphylococcus aureus subsp. aureus N315
caagcaaucuuag

SEQ ID NO: 2132076 - RNA, 21 nt, Staphylococcus aureus subsp. aureus N315
caagguuuucgccaauaaaac

SEQ ID NO: 2132077 - RNA, 13 nt, Staphylococcus aureus subsp. aureus N315
caaguaaauguuu

SEQ ID NO: 2132078 - RNA, 15 nt, Staphylococcus aureus subsp. aureus N315
caagugguaaaaaug

SEQ ID NO: 2132079 - RNA, 20 nt, Staphylococcus aureus subsp. aureus N315
caagugcuugguuaaaguua

SEQ ID NO: 2132080 - RNA, 18 nt, Staphylococcus aureus subsp. aureus N315
caaguguaucgcccauac

SEQ ID NO: 2132081 - RNA, 17 nt, Staphylococcus aureus subsp. aureus N315
caaguguaguaaaaauc

SEQ ID NO: 2132082 - RNA, 22 nt, Staphylococcus aureus subsp. aureus N315
caagucguucucuuaaauauga

SEQ ID NO: 2132083 - RNA, 20 nt, Staphylococcus aureus subsp. aureus N315
caagucguucucuuaaauau

SEQ ID NO: 2132084 - RNA, 14 nt, Staphylococcus aureus subsp. aureus N315
caagugcagauguu

SEQ ID NO: 2132085 - RNA, 20 nt, Staphylococcus aureus subsp. aureus N315
caaguucaccguaaucuuuu

SEQ ID NO: 2132086 - RNA, 23 nt, Staphylococcus aureus subsp. aureus N315
caaguuggcuggcccccaacacu

SEQ ID NO: 2132087 - RNA, 22 nt, Staphylococcus aureus subsp. aureus N315
caaguuggggaaggacaggaau

SEQ ID NO: 2132088 - RNA, 22 nt, Staphylococcus aureus subsp. aureus N315
caaguuggggaugggccccaac

SEQ ID NO: 2132089 - RNA, 13 nt, Staphylococcus aureus subsp. aureus N315
caaguuuaaaaua

SEQ ID NO: 2132090 - RNA, 23 nt, Staphylococcus aureus subsp. aureus N315
caaguuggcggggccccaacaca

SEQ ID NO: 2132091 - RNA, 16 nt, Staphylococcus aureus subsp. aureus N315
caaguuggcggggccc

SEQ ID NO: 2132092 - RNA, 19 nt, Staphylococcus aureus subsp. aureus N315
caaguugcugaauaaaaua

SEQ ID NO: 2132093 - RNA, 17 nt, Staphylococcus aureus subsp. aureus N315
caauaaccccugucacu

SEQ ID NO: 2132094 - RNA, 17 nt, Staphylococcus aureus subsp. aureus N315
caauaagcgcaauuaaa

SEQ ID NO: 2132095 - RNA, 19 nt, Staphylococcus aureus subsp. aureus N315
caauaauccgagucauacu

SEQ ID NO: 2132096 - RNA, 16 nt, Staphylococcus aureus subsp. aureus N315
caauaaugugucaaau

SEQ ID NO: 2132097 - RNA, 11 nt, Staphylococcus aureus subsp. aureus N315
caauaauguua

SEQ ID NO: 2132098 - RNA, 17 nt, Staphylococcus aureus subsp. aureus N315
caauaccauaauuaaau

SEQ ID NO: 2132099 - RNA, 17 nt, Staphylococcus aureus subsp. aureus N315
caauacauuaauauaaa

SEQ ID NO: 2132100 - RNA, 20 nt, Staphylococcus aureus subsp. aureus N315
caauaccgaauaauuuugau

SEQ ID NO: 2132101 - RNA, 12 nt, Staphylococcus aureus subsp. aureus N315
caauauacuuuu

SEQ ID NO: 2132102 - RNA, 16 nt, Staphylococcus aureus subsp. aureus N315
caauauacaaugcuga

SEQ ID NO: 2132103 - RNA, 14 nt, Staphylococcus aureus subsp. aureus N315
caauauacuuuuua

SEQ ID NO: 2132104 - RNA, 15 nt, Staphylococcus aureus subsp. aureus N315
caauauauucaccua

SEQ ID NO: 2132105 - RNA, 14 nt, Staphylococcus aureus subsp. aureus N315
caauagaugaaaau

SEQ ID NO: 2132106 - RNA, 16 nt, Staphylococcus aureus subsp. aureus N315
caauagcaauugaaua

SEQ ID NO: 2132107 - RNA, 21 nt, Staphylococcus aureus subsp. aureus N315
caauacgaaaucaaaaauaau

SEQ ID NO: 2132108 - RNA, 18 nt, Staphylococcus aureus subsp. aureus N315
caauaccuguccaaauaa

SEQ ID NO: 2132109 - RNA, 20 nt, Staphylococcus aureus subsp. aureus N315
caauaccuguccaaauaaau

SEQ ID NO: 2132110 - RNA, 19 nt, Staphylococcus aureus subsp. aureus N315
caaucaacuuagaauuuac

SEQ ID NO: 2132111 - RNA, 13 nt, Staphylococcus aureus subsp. aureus N315
caauauuaaaauu

SEQ ID NO: 2132112 - RNA, 21 nt, Staphylococcus aureus subsp. aureus N315
caauauguggcgcucuuauaa

SEQ ID NO: 2132113 - RNA, 14 nt, Staphylococcus aureus subsp. aureus N315
caaucacagcaaua

SEQ ID NO: 2132114 - RNA, 17 nt, Staphylococcus aureus subsp. aureus N315
caagaaguaauguuaaa

SEQ ID NO: 2132115 - RNA, 20 nt, Staphylococcus aureus subsp. aureus N315
caagaaacaauucauuaaua

SEQ ID NO: 2132116 - RNA, 19 nt, Staphylococcus aureus subsp. aureus N315
caagaaacaauucauuaau

SEQ ID NO: 2132117 - RNA, 14 nt, Staphylococcus aureus subsp. aureus N315
caacucuaacagcu

SEQ ID NO: 2132118 - RNA, 17 nt, Staphylococcus aureus subsp. aureus N315
caacuugugguuggaag

SEQ ID NO: 2132119 - RNA, 19 nt, Staphylococcus aureus subsp. aureus N315
caacuugaucauuauaaaa

SEQ ID NO: 2132120 - RNA, 16 nt, Staphylococcus aureus subsp. aureus N315
caacuuuuuaauaaua

SEQ ID NO: 2132121 - RNA, 22 nt, Staphylococcus aureus subsp. aureus N315
caacuuuuuaauaauacuucua

SEQ ID NO: 2132122 - RNA, 23 nt, Staphylococcus aureus subsp. aureus N315
caacuuuuuuaacagcugcaguc

SEQ ID NO: 2132123 - RNA, 14 nt, Staphylococcus aureus subsp. aureus N315
caacuuuaguuguu

SEQ ID NO: 2132124 - RNA, 17 nt, Staphylococcus aureus subsp. aureus N315
caacuuuacgauaaaua

SEQ ID NO: 2132125 - RNA, 22 nt, Staphylococcus aureus subsp. aureus N315
caacuugugguuggaagucugc

SEQ ID NO: 2132126 - RNA, 21 nt, Staphylococcus aureus subsp. aureus N315
caacuuuaauuuuucauuaau

SEQ ID NO: 2132127 - RNA, 21 nt, Staphylococcus aureus subsp. aureus N315
caagagguaaaucuguuuaaa

SEQ ID NO: 2132128 - RNA, 14 nt, Staphylococcus aureus subsp. aureus N315
caagauaaaucauc

SEQ ID NO: 2132129 - RNA, 13 nt, Staphylococcus aureus subsp. aureus N315
caagauaaaucau

SEQ ID NO: 2132130 - RNA, 15 nt, Staphylococcus aureus subsp. aureus N315
caagagguuuuauuu

SEQ ID NO: 2132131 - RNA, 23 nt, Staphylococcus aureus subsp. aureus N315
caagaauuauggcagauccauaa

SEQ ID NO: 2132132 - RNA, 18 nt, Staphylococcus aureus subsp. aureus N315
caagaccaugcaaacuca

SEQ ID NO: 2132133 - RNA, 14 nt, Staphylococcus aureus subsp. aureus N315
caagagauaagaaa

SEQ ID NO: 2132134 - RNA, 16 nt, Staphylococcus aureus subsp. aureus N315
caagagauaagaaaau

SEQ ID NO: 2132135 - RNA, 22 nt, Staphylococcus aureus subsp. aureus N315
caagacucccuuuuuaaaauac

SEQ ID NO: 2132136 - RNA, 17 nt, Staphylococcus aureus subsp. aureus N315
caacgagucauaaauau

SEQ ID NO: 2132137 - RNA, 22 nt, Staphylococcus aureus subsp. aureus N315
caacaucgauuuaucauuauuu

SEQ ID NO: 2132138 - RNA, 15 nt, Staphylococcus aureus subsp. aureus N315
caacauauaaaucau

SEQ ID NO: 2132139 - RNA, 13 nt, Staphylococcus aureus subsp. aureus N315
caacauauuuuca

SEQ ID NO: 2132140 - RNA, 17 nt, Staphylococcus aureus subsp. aureus N315
caacauauuauauauau

SEQ ID NO: 2132141 - RNA, 17 nt, Staphylococcus aureus subsp. aureus N315
caaccugugauaaaaau

SEQ ID NO: 2132142 - RNA, 22 nt, Staphylococcus aureus subsp. aureus N315
caaccuguucuuuauuuaaagg

SEQ ID NO: 2132143 - RNA, 17 nt, Staphylococcus aureus subsp. aureus N315
caaccuuugcuaaauca

SEQ ID NO: 2132144 - RNA, 19 nt, Staphylococcus aureus subsp. aureus N315
caacuauauauaguugauc

SEQ ID NO: 2132145 - RNA, 22 nt, Staphylococcus aureus subsp. aureus N315
caacuaaaggucccauuaaaau

SEQ ID NO: 2132146 - RNA, 21 nt, Staphylococcus aureus subsp. aureus N315
auuuuaccuguuucuuuacuu

SEQ ID NO: 2132147 - RNA, 21 nt, Staphylococcus aureus subsp. aureus N315
auuuuaccuucgcauacuuuu

SEQ ID NO: 2132148 - RNA, 16 nt, Staphylococcus aureus subsp. aureus N315
auuuuagcaaaagcuu

SEQ ID NO: 2132149 - RNA, 18 nt, Staphylococcus aureus subsp. aureus N315
auuuuauacauaaauauu

SEQ ID NO: 2132150 - RNA, 14 nt, Staphylococcus aureus subsp. aureus N315
auuuuauauaaaaa

SEQ ID NO: 2132151 - RNA, 13 nt, Staphylococcus aureus subsp. aureus N315
auuuuauaagaau

SEQ ID NO: 2132152 - RNA, 15 nt, Staphylococcus aureus subsp. aureus N315
auuuuauaaaucaua

SEQ ID NO: 2132153 - RNA, 17 nt, Staphylococcus aureus subsp. aureus N315
auuuuauaaaauauauu

SEQ ID NO: 2132154 - RNA, 18 nt, Staphylococcus aureus subsp. aureus N315
auuuuauaaaauauauuu

SEQ ID NO: 2132155 - RNA, 19 nt, Staphylococcus aureus subsp. aureus N315
auuuuauaaaauauauuua

SEQ ID NO: 2132156 - RNA, 14 nt, Staphylococcus aureus subsp. aureus N315
auuuuauaaaguuu

SEQ ID NO: 2132157 - RNA, 23 nt, Staphylococcus aureus subsp. aureus N315
auuuuaucuaaagcuauaaaaaa

SEQ ID NO: 2132158 - RNA, 14 nt, Staphylococcus aureus subsp. aureus N315
auuuuaucaucuau

SEQ ID NO: 2132159 - RNA, 12 nt, Staphylococcus aureus subsp. aureus N315
auuuuauauauc

SEQ ID NO: 2132160 - RNA, 12 nt, Staphylococcus aureus subsp. aureus N315
auuuuauauuuu

SEQ ID NO: 2132161 - RNA, 23 nt, Staphylococcus aureus subsp. aureus N315
auuuuauccaaaccaauuuuaac

SEQ ID NO: 2132162 - RNA, 14 nt, Staphylococcus aureus subsp. aureus N315
auuuuaucaaauuc

SEQ ID NO: 2132163 - RNA, 15 nt, Staphylococcus aureus subsp. aureus N315
auuuuaucaaauuca

SEQ ID NO: 2132164 - RNA, 11 nt, Staphylococcus aureus subsp. aureus N315
auuuucauuuu

SEQ ID NO: 2132165 - RNA, 13 nt, Staphylococcus aureus subsp. aureus N315
auuuucauuuuag

SEQ ID NO: 2132166 - RNA, 19 nt, Staphylococcus aureus subsp. aureus N315
auuuucauuguauguugaa

SEQ ID NO: 2132167 - RNA, 18 nt, Staphylococcus aureus subsp. aureus N315
auuuucaaguuuaaaaua

SEQ ID NO: 2132168 - RNA, 23 nt, Staphylococcus aureus subsp. aureus N315
auuuucaagaccaaauauuuuau

SEQ ID NO: 2132169 - RNA, 11 nt, Staphylococcus aureus subsp. aureus N315
auuuucaaaac

SEQ ID NO: 2132170 - RNA, 15 nt, Staphylococcus aureus subsp. aureus N315
auuuucaaaacugcc

SEQ ID NO: 2132171 - RNA, 15 nt, Staphylococcus aureus subsp. aureus N315
auuuuaucugaaaau

SEQ ID NO: 2132172 - RNA, 22 nt, Staphylococcus aureus subsp. aureus N315
auuuugcgaaaauaucauuucu

SEQ ID NO: 2132173 - RNA, 20 nt, Staphylococcus aureus subsp. aureus N315
auuuugacguuuuagacaua

SEQ ID NO: 2132174 - RNA, 20 nt, Staphylococcus aureus subsp. aureus N315
auuuugacgccagaauaaau

SEQ ID NO: 2132175 - RNA, 21 nt, Staphylococcus aureus subsp. aureus N315
auuuugacgccagaauaaauc

SEQ ID NO: 2132176 - RNA, 11 nt, Staphylococcus aureus subsp. aureus N315
auuuugaagaa

SEQ ID NO: 2132177 - RNA, 15 nt, Staphylococcus aureus subsp. aureus N315
auuuugaagaagugc

SEQ ID NO: 2132178 - RNA, 21 nt, Staphylococcus aureus subsp. aureus N315
auuuucuuuuuuuauggauuu

SEQ ID NO: 2132179 - RNA, 20 nt, Staphylococcus aureus subsp. aureus N315
auuuucuugccaucaauuuc

SEQ ID NO: 2132180 - RNA, 17 nt, Staphylococcus aureus subsp. aureus N315
auuuucuuuaauaacua

SEQ ID NO: 2132181 - RNA, 17 nt, Staphylococcus aureus subsp. aureus N315
auuuugcuuuauuuucu

SEQ ID NO: 2132182 - RNA, 15 nt, Staphylococcus aureus subsp. aureus N315
auuuuggaacauauu

SEQ ID NO: 2132183 - RNA, 17 nt, Staphylococcus aureus subsp. aureus N315
auuuuggauaggauauu

SEQ ID NO: 2132184 - RNA, 13 nt, Staphylococcus aureus subsp. aureus N315
auuuuggauuuuu

SEQ ID NO: 2132185 - RNA, 18 nt, Staphylococcus aureus subsp. aureus N315
auuuuuaguuagaaagua

SEQ ID NO: 2132186 - RNA, 17 nt, Staphylococcus aureus subsp. aureus N315
auuuuuagacauuaaaa

SEQ ID NO: 2132187 - RNA, 12 nt, Staphylococcus aureus subsp. aureus N315
auuuuuaauaua

SEQ ID NO: 2132188 - RNA, 15 nt, Staphylococcus aureus subsp. aureus N315
auuuuuaauuauuuu

SEQ ID NO: 2132189 - RNA, 15 nt, Staphylococcus aureus subsp. aureus N315
auuugcaaaaucaac

SEQ ID NO: 2132190 - RNA, 21 nt, Staphylococcus aureus subsp. aureus N315
auuugcaaaaucaacccauca

SEQ ID NO: 2132191 - RNA, 21 nt, Staphylococcus aureus subsp. aureus N315
auuugauuuggguaauguuuu

SEQ ID NO: 2132192 - RNA, 19 nt, Staphylococcus aureus subsp. aureus N315
auuugcacaaagauauguu

SEQ ID NO: 2132193 - RNA, 18 nt, Staphylococcus aureus subsp. aureus N315
auuugcaccuauaccucg

SEQ ID NO: 2132194 - RNA, 17 nt, Staphylococcus aureus subsp. aureus N315
auuugcaccuauaccuc

SEQ ID NO: 2132195 - RNA, 21 nt, Staphylococcus aureus subsp. aureus N315
auuugaggauacauaaaucua

SEQ ID NO: 2132196 - RNA, 19 nt, Staphylococcus aureus subsp. aureus N315
auuugacauaauccagcca

SEQ ID NO: 2132197 - RNA, 21 nt, Staphylococcus aureus subsp. aureus N315
auuugacauaauccagccaca

SEQ ID NO: 2132198 - RNA, 23 nt, Staphylococcus aureus subsp. aureus N315
auuugcugcuaauugauauggau

SEQ ID NO: 2132199 - RNA, 23 nt, Staphylococcus aureus subsp. aureus N315
auuugccauauacacacuaagga

SEQ ID NO: 2132200 - RNA, 14 nt, Staphylococcus aureus subsp. aureus N315
auuuguaauacaag

SEQ ID NO: 2132201 - RNA, 20 nt, Staphylococcus aureus subsp. aureus N315
auuuguaaucccauuuuaaa

SEQ ID NO: 2132202 - RNA, 15 nt, Staphylococcus aureus subsp. aureus N315
auuuggaaguuuuca

SEQ ID NO: 2132203 - RNA, 16 nt, Staphylococcus aureus subsp. aureus N315
auuugguuaauacguu

SEQ ID NO: 2132204 - RNA, 19 nt, Staphylococcus aureus subsp. aureus N315
auuuguaaagacaccauca

SEQ ID NO: 2132205 - RNA, 23 nt, Staphylococcus aureus subsp. aureus N315
auuuguaaauauuuuuuaaaaug

SEQ ID NO: 2132206 - RNA, 17 nt, Staphylococcus aureus subsp. aureus N315
auuuguaacuauugaaa

SEQ ID NO: 2132207 - RNA, 20 nt, Staphylococcus aureus subsp. aureus N315
auuuguaacuauugaaaaua

SEQ ID NO: 2132208 - RNA, 16 nt, Staphylococcus aureus subsp. aureus N315
auuuuaaaagauaaau

SEQ ID NO: 2132209 - RNA, 16 nt, Staphylococcus aureus subsp. aureus N315
auuuuaaaaauaaaaa

SEQ ID NO: 2132210 - RNA, 19 nt, Staphylococcus aureus subsp. aureus N315
auuuuaaaaauucauaauc

SEQ ID NO: 2132211 - RNA, 21 nt, Staphylococcus aureus subsp. aureus N315
auuuuaaucuauccuucaaaa

SEQ ID NO: 2132212 - RNA, 13 nt, Staphylococcus aureus subsp. aureus N315
auuuuaauuuuca

SEQ ID NO: 2132213 - RNA, 21 nt, Staphylococcus aureus subsp. aureus N315
auuucuuuucauuaucauuaa

SEQ ID NO: 2132214 - RNA, 19 nt, Staphylococcus aureus subsp. aureus N315
auuucuuuuuaaaaucguu

SEQ ID NO: 2132215 - RNA, 15 nt, Staphylococcus aureus subsp. aureus N315
auuucuuuuuaaaau

SEQ ID NO: 2132216 - RNA, 13 nt, Staphylococcus aureus subsp. aureus N315
auuucuuuucauu

SEQ ID NO: 2132217 - RNA, 18 nt, Staphylococcus aureus subsp. aureus N315
auuucuguaccaaauuug

SEQ ID NO: 2132218 - RNA, 14 nt, Staphylococcus aureus subsp. aureus N315
auuucuguaccaaa

SEQ ID NO: 2132219 - RNA, 14 nt, Staphylococcus aureus subsp. aureus N315
auuucuacucgaaa

SEQ ID NO: 2132220 - RNA, 21 nt, Staphylococcus aureus subsp. aureus N315
auuucgguauuuuaaauuuau

SEQ ID NO: 2132221 - RNA, 18 nt, Staphylococcus aureus subsp. aureus N315
auuucgguauuuuaaauu

SEQ ID NO: 2132222 - RNA, 16 nt, Staphylococcus aureus subsp. aureus N315
auuucugacaacuuaa

SEQ ID NO: 2132223 - RNA, 21 nt, Staphylococcus aureus subsp. aureus N315
auuucugaaaugauacauuau

SEQ ID NO: 2132224 - RNA, 14 nt, Staphylococcus aureus subsp. aureus N315
auuucuaucaaaua

SEQ ID NO: 2132225 - RNA, 15 nt, Staphylococcus aureus subsp. aureus N315
auuucuaucaaauaa

SEQ ID NO: 2132226 - RNA, 16 nt, Staphylococcus aureus subsp. aureus N315
auuucuaucaaauaau

SEQ ID NO: 2132227 - RNA, 18 nt, Staphylococcus aureus subsp. aureus N315
auuucuauacaaucauuu

SEQ ID NO: 2132228 - RNA, 15 nt, Staphylococcus aureus subsp. aureus N315
auuucuauaucuauu

SEQ ID NO: 2132229 - RNA, 20 nt, Staphylococcus aureus subsp. aureus N315
auuucuauaucuauuuauca

SEQ ID NO: 2132230 - RNA, 14 nt, Staphylococcus aureus subsp. aureus N315
auuuaauaaaccag

SEQ ID NO: 2132231 - RNA, 13 nt, Staphylococcus aureus subsp. aureus N315
auuuaauaacgaa

SEQ ID NO: 2132232 - RNA, 20 nt, Staphylococcus aureus subsp. aureus N315
auuuaauaacguacauuuau

SEQ ID NO: 2132233 - RNA, 21 nt, Staphylococcus aureus subsp. aureus N315
auuuaauaaaaaccaauauuu

SEQ ID NO: 2132234 - RNA, 21 nt, Staphylococcus aureus subsp. aureus N315
auuuaauguuuuagugacaaa

SEQ ID NO: 2132235 - RNA, 13 nt, Staphylococcus aureus subsp. aureus N315
auuuaauuuuucu

SEQ ID NO: 2132236 - RNA, 14 nt, Staphylococcus aureus subsp. aureus N315
auuuaauugaaaua

SEQ ID NO: 2132237 - RNA, 16 nt, Staphylococcus aureus subsp. aureus N315
auuuaauuacagguuu

SEQ ID NO: 2132238 - RNA, 18 nt, Staphylococcus aureus subsp. aureus N315
auuuaauuacagguuuaa

SEQ ID NO: 2132239 - RNA, 21 nt, Staphylococcus aureus subsp. aureus N315
auuuaauuacagguuuaaaca

SEQ ID NO: 2132240 - RNA, 20 nt, Staphylococcus aureus subsp. aureus N315
auuuaaacauccaauuaugu

SEQ ID NO: 2132241 - RNA, 16 nt, Staphylococcus aureus subsp. aureus N315
auuuaaacauccaauu

SEQ ID NO: 2132242 - RNA, 19 nt, Staphylococcus aureus subsp. aureus N315
auuuaaaaugcuuguucaa

SEQ ID NO: 2132243 - RNA, 13 nt, Staphylococcus aureus subsp. aureus N315
auuuaaaaugauu

SEQ ID NO: 2132244 - RNA, 12 nt, Staphylococcus aureus subsp. aureus N315
auuuaaaauaua

SEQ ID NO: 2132245 - RNA, 14 nt, Staphylococcus aureus subsp. aureus N315
auuuaaaauauaaa

SEQ ID NO: 2132246 - RNA, 19 nt, Staphylococcus aureus subsp. aureus N315
auuuaaaauauuauuuuua

SEQ ID NO: 2132247 - RNA, 17 nt, Staphylococcus aureus subsp. aureus N315
auuuaaaauauuauuuu

SEQ ID NO: 2132248 - RNA, 21 nt, Staphylococcus aureus subsp. aureus N315
auuuaaaauaguucuuuaaau

SEQ ID NO: 2132249 - RNA, 16 nt, Staphylococcus aureus subsp. aureus N315
auuuaagaaacgucuu

SEQ ID NO: 2132250 - RNA, 18 nt, Staphylococcus aureus subsp. aureus N315
auuuaagggucacaccca

SEQ ID NO: 2132251 - RNA, 22 nt, Staphylococcus aureus subsp. aureus N315
auuuaagggucacacccauacu

SEQ ID NO: 2132252 - RNA, 23 nt, Staphylococcus aureus subsp. aureus N315
auuuaagggucacacccauacuc

SEQ ID NO: 2132253 - RNA, 14 nt, Staphylococcus aureus subsp. aureus N315
auuuaagauuuaau

SEQ ID NO: 2132254 - RNA, 20 nt, Staphylococcus aureus subsp. aureus N315
auugguaaauuuaucauuuu

SEQ ID NO: 2132255 - RNA, 14 nt, Staphylococcus aureus subsp. aureus N315
auuuaaaaaucaaa

SEQ ID NO: 2132256 - RNA, 18 nt, Staphylococcus aureus subsp. aureus N315
auuuaaaaauugaaggaa

SEQ ID NO: 2132257 - RNA, 22 nt, Staphylococcus aureus subsp. aureus N315
auuuaaaacaaugauuaaaauu

SEQ ID NO: 2132258 - RNA, 19 nt, Staphylococcus aureus subsp. aureus N315
auuuaaaauaauagauaau

SEQ ID NO: 2132259 - RNA, 12 nt, Staphylococcus aureus subsp. aureus N315
auuuaaaagaaa

SEQ ID NO: 2132260 - RNA, 12 nt, Staphylococcus aureus subsp. aureus N315
auuuaaaagaga

SEQ ID NO: 2132261 - RNA, 19 nt, Staphylococcus aureus subsp. aureus N315
auuguuuuggcuuugagug

SEQ ID NO: 2132262 - RNA, 13 nt, Staphylococcus aureus subsp. aureus N315
auuguuuuuaaaa

SEQ ID NO: 2132263 - RNA, 19 nt, Staphylococcus aureus subsp. aureus N315
auuguuuugagauauuugu

SEQ ID NO: 2132264 - RNA, 19 nt, Staphylococcus aureus subsp. aureus N315
auuuauauagucuaugaau

SEQ ID NO: 2132265 - RNA, 21 nt, Staphylococcus aureus subsp. aureus N315
auuuauaugauguucaauauu

SEQ ID NO: 2132266 - RNA, 17 nt, Staphylococcus aureus subsp. aureus N315
auuuauauuaaauacua

SEQ ID NO: 2132267 - RNA, 19 nt, Staphylococcus aureus subsp. aureus N315
auuuagguaauacaucauc

SEQ ID NO: 2132268 - RNA, 19 nt, Staphylococcus aureus subsp. aureus N315
auuuauauuuacacagaau

SEQ ID NO: 2132269 - RNA, 14 nt, Staphylococcus aureus subsp. aureus N315
auuuaucaauaaau

SEQ ID NO: 2132270 - RNA, 18 nt, Staphylococcus aureus subsp. aureus N315
auuuaucaauuucuauuu

SEQ ID NO: 2132271 - RNA, 22 nt, Staphylococcus aureus subsp. aureus N315
auuuacuugauuagauuugugu

SEQ ID NO: 2132272 - RNA, 21 nt, Staphylococcus aureus subsp. aureus N315
auuuacuucuucuucagacca

SEQ ID NO: 2132273 - RNA, 16 nt, Staphylococcus aureus subsp. aureus N315
auuuagauuuauaacg

SEQ ID NO: 2132274 - RNA, 17 nt, Staphylococcus aureus subsp. aureus N315
auuuagauuuauaacga

SEQ ID NO: 2132275 - RNA, 15 nt, Staphylococcus aureus subsp. aureus N315
auuuagauucuuuuc

SEQ ID NO: 2132276 - RNA, 18 nt, Staphylococcus aureus subsp. aureus N315
auuuagaaacuuccaaca

SEQ ID NO: 2132277 - RNA, 18 nt, Staphylococcus aureus subsp. aureus N315
auuuaggcaugucaaauc

SEQ ID NO: 2132278 - RNA, 18 nt, Staphylococcus aureus subsp. aureus N315
auuuagcaaauauuucug

SEQ ID NO: 2132279 - RNA, 20 nt, Staphylococcus aureus subsp. aureus N315
auuuacggcauaauuuuuua

SEQ ID NO: 2132280 - RNA, 21 nt, Staphylococcus aureus subsp. aureus N315
auuuaccuuugucuuuuuuau

SEQ ID NO: 2132281 - RNA, 20 nt, Staphylococcus aureus subsp. aureus N315
auuuaccucuugauaaaaua

SEQ ID NO: 2132282 - RNA, 22 nt, Staphylococcus aureus subsp. aureus N315
auuuaccucuugauaaaauaaa

SEQ ID NO: 2132283 - RNA, 19 nt, Staphylococcus aureus subsp. aureus N315
auuuaccaguuugaucaua

SEQ ID NO: 2132284 - RNA, 17 nt, Staphylococcus aureus subsp. aureus N315
auuuacaccuauaccuc

SEQ ID NO: 2132285 - RNA, 17 nt, Staphylococcus aureus subsp. aureus N315
auuuacauccaacuaaa

SEQ ID NO: 2132286 - RNA, 21 nt, Staphylococcus aureus subsp. aureus N315
auuuacauccaacuaaaugua

SEQ ID NO: 2132287 - RNA, 21 nt, Staphylococcus aureus subsp. aureus N315
auuuacacagaaugauauaac

SEQ ID NO: 2132288 - RNA, 20 nt, Staphylococcus aureus subsp. aureus N315
auuuacaaauguauaaauaa

SEQ ID NO: 2132289 - RNA, 19 nt, Staphylococcus aureus subsp. aureus N315
auuuacaaauguauaaaua

SEQ ID NO: 2132290 - RNA, 23 nt, Staphylococcus aureus subsp. aureus N315
auuuacaauuaauuacuguaaau

SEQ ID NO: 2132291 - RNA, 18 nt, Staphylococcus aureus subsp. aureus N315
auuuccuaaaaacuguga

SEQ ID NO: 2132292 - RNA, 18 nt, Staphylococcus aureus subsp. aureus N315
auuuccuuuagcaaaaau

SEQ ID NO: 2132293 - RNA, 16 nt, Staphylococcus aureus subsp. aureus N315
auuucgcuuuuuuuau

SEQ ID NO: 2132294 - RNA, 22 nt, Staphylococcus aureus subsp. aureus N315
auuucgcuuuuuuuauuuuucu

SEQ ID NO: 2132295 - RNA, 18 nt, Staphylococcus aureus subsp. aureus N315
auuucgccucaucuaauu

SEQ ID NO: 2132296 - RNA, 13 nt, Staphylococcus aureus subsp. aureus N315
auuucgauuuuca

SEQ ID NO: 2132297 - RNA, 18 nt, Staphylococcus aureus subsp. aureus N315
auuucgagauucaauauu

SEQ ID NO: 2132298 - RNA, 17 nt, Staphylococcus aureus subsp. aureus N315
auuucgaaaagaaauuc

SEQ ID NO: 2132299 - RNA, 14 nt, Staphylococcus aureus subsp. aureus N315
auuucgaaaagaaa

SEQ ID NO: 2132300 - RNA, 20 nt, Staphylococcus aureus subsp. aureus N315
auuucgacaucuagaugaaa

SEQ ID NO: 2132301 - RNA, 17 nt, Staphylococcus aureus subsp. aureus N315
auuucccauuuaucuaa

SEQ ID NO: 2132302 - RNA, 13 nt, Staphylococcus aureus subsp. aureus N315
auuucaucaauaa

SEQ ID NO: 2132303 - RNA, 16 nt, Staphylococcus aureus subsp. aureus N315
auuucauauuguuuag

SEQ ID NO: 2132304 - RNA, 21 nt, Staphylococcus aureus subsp. aureus N315
auuucauuugaaauaguuaaa

SEQ ID NO: 2132305 - RNA, 13 nt, Staphylococcus aureus subsp. aureus N315
auuucauuuaugc

SEQ ID NO: 2132306 - RNA, 19 nt, Staphylococcus aureus subsp. aureus N315
auuucaguaccauguuuuu

SEQ ID NO: 2132307 - RNA, 16 nt, Staphylococcus aureus subsp. aureus N315
auuucacuuuaacuuc

SEQ ID NO: 2132308 - RNA, 14 nt, Staphylococcus aureus subsp. aureus N315
auuucacuuuaacu

SEQ ID NO: 2132309 - RNA, 13 nt, Staphylococcus aureus subsp. aureus N315
auuucacuuuaac

SEQ ID NO: 2132310 - RNA, 14 nt, Staphylococcus aureus subsp. aureus N315
auuucagaaauaca

SEQ ID NO: 2132311 - RNA, 20 nt, Staphylococcus aureus subsp. aureus N315
auuucaggcguuaauacaua

SEQ ID NO: 2132312 - RNA, 18 nt, Staphylococcus aureus subsp. aureus N315
auuucacgcugaaauuuu

SEQ ID NO: 2132313 - RNA, 21 nt, Staphylococcus aureus subsp. aureus N315
auuuauguguugugauauaua

SEQ ID NO: 2132314 - RNA, 17 nt, Staphylococcus aureus subsp. aureus N315
auuuauguguuggcuuu

SEQ ID NO: 2132315 - RNA, 15 nt, Staphylococcus aureus subsp. aureus N315
auuuauguuuucuag

SEQ ID NO: 2132316 - RNA, 16 nt, Staphylococcus aureus subsp. aureus N315
auuuauguagauuuua

SEQ ID NO: 2132317 - RNA, 17 nt, Staphylococcus aureus subsp. aureus N315
auuuauguagauuuuaa

SEQ ID NO: 2132318 - RNA, 17 nt, Staphylococcus aureus subsp. aureus N315
auuucaauuuggaaaua

SEQ ID NO: 2132319 - RNA, 23 nt, Staphylococcus aureus subsp. aureus N315
auuucaauuuggaaauaucuuac

SEQ ID NO: 2132320 - RNA, 21 nt, Staphylococcus aureus subsp. aureus N315
auuuaucuugauuuuauaaau

SEQ ID NO: 2132321 - RNA, 15 nt, Staphylococcus aureus subsp. aureus N315
auucccguuaauauc

SEQ ID NO: 2132322 - RNA, 17 nt, Staphylococcus aureus subsp. aureus N315
auucccguuaauaucau

SEQ ID NO: 2132323 - RNA, 18 nt, Staphylococcus aureus subsp. aureus N315
auucgaugacuuuuuaau

SEQ ID NO: 2132324 - RNA, 22 nt, Staphylococcus aureus subsp. aureus N315
auucgaucguaguuguccauuu

SEQ ID NO: 2132325 - RNA, 20 nt, Staphylococcus aureus subsp. aureus N315
auucgaacuaucaauauaau

SEQ ID NO: 2132326 - RNA, 15 nt, Staphylococcus aureus subsp. aureus N315
auucgaaagccaauu

SEQ ID NO: 2132327 - RNA, 18 nt, Staphylococcus aureus subsp. aureus N315
auucgaacuaucaauaua

SEQ ID NO: 2132328 - RNA, 13 nt, Staphylococcus aureus subsp. aureus N315
auucgaaaagaaa

SEQ ID NO: 2132329 - RNA, 22 nt, Staphylococcus aureus subsp. aureus N315
auucgaaaagaaauucuacagg

SEQ ID NO: 2132330 - RNA, 22 nt, Staphylococcus aureus subsp. aureus N315
auuccuuggugucgaaauuguu

SEQ ID NO: 2132331 - RNA, 15 nt, Staphylococcus aureus subsp. aureus N315
auucgccuaaauggu

SEQ ID NO: 2132332 - RNA, 22 nt, Staphylococcus aureus subsp. aureus N315
auucgcuaauguaccaaucaau

SEQ ID NO: 2132333 - RNA, 22 nt, Staphylococcus aureus subsp. aureus N315
auucgcgucauuuguucaucug

SEQ ID NO: 2132334 - RNA, 17 nt, Staphylococcus aureus subsp. aureus N315
auucgcuuguaacaagc

SEQ ID NO: 2132335 - RNA, 14 nt, Staphylococcus aureus subsp. aureus N315
auucaucuucaaac

SEQ ID NO: 2132336 - RNA, 23 nt, Staphylococcus aureus subsp. aureus N315
auucaucuugcaaguauuuucuu

SEQ ID NO: 2132337 - RNA, 14 nt, Staphylococcus aureus subsp. aureus N315
auucaucuuaucaa

SEQ ID NO: 2132338 - RNA, 23 nt, Staphylococcus aureus subsp. aureus N315
auucaucuaaccuuuucaucagu

SEQ ID NO: 2132339 - RNA, 19 nt, Staphylococcus aureus subsp. aureus N315
auucaucgucucacuuaau

SEQ ID NO: 2132340 - RNA, 21 nt, Staphylococcus aureus subsp. aureus N315
auucaugcccgagacuauauu

SEQ ID NO: 2132341 - RNA, 16 nt, Staphylococcus aureus subsp. aureus N315
auucauguaaauaguu

SEQ ID NO: 2132342 - RNA, 13 nt, Staphylococcus aureus subsp. aureus N315
auucauuaagcuu

SEQ ID NO: 2132343 - RNA, 16 nt, Staphylococcus aureus subsp. aureus N315
auucauauucaaauuu

SEQ ID NO: 2132344 - RNA, 14 nt, Staphylococcus aureus subsp. aureus N315
auucauaucuuuca

SEQ ID NO: 2132345 - RNA, 17 nt, Staphylococcus aureus subsp. aureus N315
auucauauauacugccc

SEQ ID NO: 2132346 - RNA, 14 nt, Staphylococcus aureus subsp. aureus N315
auucauauuuauau

SEQ ID NO: 2132347 - RNA, 17 nt, Staphylococcus aureus subsp. aureus N315
auucauaagaaaaaugu

SEQ ID NO: 2132348 - RNA, 20 nt, Staphylococcus aureus subsp. aureus N315
auucauaaaugacugaauua

SEQ ID NO: 2132349 - RNA, 21 nt, Staphylococcus aureus subsp. aureus N315
auucauacacugcacaucaua

SEQ ID NO: 2132350 - RNA, 22 nt, Staphylococcus aureus subsp. aureus N315
auucauaauuuguugauaguaa

SEQ ID NO: 2132351 - RNA, 19 nt, Staphylococcus aureus subsp. aureus N315
auguugacucguuauucaa

SEQ ID NO: 2132352 - RNA, 22 nt, Staphylococcus aureus subsp. aureus N315
auguugacauaccacuaaguga

SEQ ID NO: 2132353 - RNA, 20 nt, Staphylococcus aureus subsp. aureus N315
auguucuuauaaaaaacaau

SEQ ID NO: 2132354 - RNA, 21 nt, Staphylococcus aureus subsp. aureus N315
auucagucaguaaaaauacau

SEQ ID NO: 2132355 - RNA, 15 nt, Staphylococcus aureus subsp. aureus N315
auucaguauauguau

SEQ ID NO: 2132356 - RNA, 18 nt, Staphylococcus aureus subsp. aureus N315
auucagucaguaaaaaua

SEQ ID NO: 2132357 - RNA, 14 nt, Staphylococcus aureus subsp. aureus N315
auguugauaaaaag

SEQ ID NO: 2132358 - RNA, 16 nt, Staphylococcus aureus subsp. aureus N315
auuccacuacaaucau

SEQ ID NO: 2132359 - RNA, 24 nt, Staphylococcus aureus subsp. aureus N315
auuccaucacgauauguugugcug

SEQ ID NO: 2132360 - RNA, 15 nt, Staphylococcus aureus subsp. aureus N315
auuccaucuuaaaac

SEQ ID NO: 2132361 - RNA, 17 nt, Staphylococcus aureus subsp. aureus N315
auuccaucuuaaaacaa

SEQ ID NO: 2132362 - RNA, 21 nt, Staphylococcus aureus subsp. aureus N315
auucauuccuaagaauguaau

SEQ ID NO: 2132363 - RNA, 13 nt, Staphylococcus aureus subsp. aureus N315
auucauuuaaaaa

SEQ ID NO: 2132364 - RNA, 15 nt, Staphylococcus aureus subsp. aureus N315
auucauuaauaggau

SEQ ID NO: 2132365 - RNA, 14 nt, Staphylococcus aureus subsp. aureus N315
auucauuacauguu

SEQ ID NO: 2132366 - RNA, 20 nt, Staphylococcus aureus subsp. aureus N315
auucauuucgauuaauuuaa

SEQ ID NO: 2132367 - RNA, 16 nt, Staphylococcus aureus subsp. aureus N315
auucauuuaaaaauca

SEQ ID NO: 2132368 - RNA, 20 nt, Staphylococcus aureus subsp. aureus N315
auucauuuuaaauuuaacua

SEQ ID NO: 2132369 - RNA, 22 nt, Staphylococcus aureus subsp. aureus N315
auucauuuucuuuuucuugaag

SEQ ID NO: 2132370 - RNA, 19 nt, Staphylococcus aureus subsp. aureus N315
auuccaaucuauuuuaaac

SEQ ID NO: 2132371 - RNA, 16 nt, Staphylococcus aureus subsp. aureus N315
auugauucuagugaaa

SEQ ID NO: 2132372 - RNA, 17 nt, Staphylococcus aureus subsp. aureus N315
auugauucuacagcauc

SEQ ID NO: 2132373 - RNA, 19 nt, Staphylococcus aureus subsp. aureus N315
auugauucuagugaaauac

SEQ ID NO: 2132374 - RNA, 15 nt, Staphylococcus aureus subsp. aureus N315
auugauuaucauaug

SEQ ID NO: 2132375 - RNA, 18 nt, Staphylococcus aureus subsp. aureus N315
auugaugucacauaugac

SEQ ID NO: 2132376 - RNA, 20 nt, Staphylococcus aureus subsp. aureus N315
auugaugucaauuucacgcu

SEQ ID NO: 2132377 - RNA, 15 nt, Staphylococcus aureus subsp. aureus N315
auugaugaauaaaua

SEQ ID NO: 2132378 - RNA, 14 nt, Staphylococcus aureus subsp. aureus N315
auugaauugaaaaa

SEQ ID NO: 2132379 - RNA, 21 nt, Staphylococcus aureus subsp. aureus N315
auugaauuguagauccaauuc

SEQ ID NO: 2132380 - RNA, 15 nt, Staphylococcus aureus subsp. aureus N315
auugaguuuuuuaaa

SEQ ID NO: 2132381 - RNA, 21 nt, Staphylococcus aureus subsp. aureus N315
auugaccaacguucgauaacg

SEQ ID NO: 2132382 - RNA, 15 nt, Staphylococcus aureus subsp. aureus N315
auugauaaauuuuua

SEQ ID NO: 2132383 - RNA, 16 nt, Staphylococcus aureus subsp. aureus N315
auugauauucuaaaaa

SEQ ID NO: 2132384 - RNA, 17 nt, Staphylococcus aureus subsp. aureus N315
auugauagauagaaauu

SEQ ID NO: 2132385 - RNA, 23 nt, Staphylococcus aureus subsp. aureus N315
auugauagcaccguaacauaugu

SEQ ID NO: 2132386 - RNA, 15 nt, Staphylococcus aureus subsp. aureus N315
auugaugaaaacaaa

SEQ ID NO: 2132387 - RNA, 23 nt, Staphylococcus aureus subsp. aureus N315
auugcugcuguacaauuucgcuu

SEQ ID NO: 2132388 - RNA, 20 nt, Staphylococcus aureus subsp. aureus N315
auugcugggcuaccgauugu

SEQ ID NO: 2132389 - RNA, 18 nt, Staphylococcus aureus subsp. aureus N315
auuggaaucccaaugcuu

SEQ ID NO: 2132390 - RNA, 19 nt, Staphylococcus aureus subsp. aureus N315
auuggaaucaucuuuuuga

SEQ ID NO: 2132391 - RNA, 21 nt, Staphylococcus aureus subsp. aureus N315
auugccaguaucucuuuucua

SEQ ID NO: 2132392 - RNA, 19 nt, Staphylococcus aureus subsp. aureus N315
auucuaccaguugauuuaa

SEQ ID NO: 2132393 - RNA, 17 nt, Staphylococcus aureus subsp. aureus N315
auucuacagguaaugca

SEQ ID NO: 2132394 - RNA, 19 nt, Staphylococcus aureus subsp. aureus N315
auucuagauucauauuuau

SEQ ID NO: 2132395 - RNA, 15 nt, Staphylococcus aureus subsp. aureus N315
auucucagucucuuu

SEQ ID NO: 2132396 - RNA, 20 nt, Staphylococcus aureus subsp. aureus N315
auucucagucucuuugaagg

SEQ ID NO: 2132397 - RNA, 19 nt, Staphylococcus aureus subsp. aureus N315
auucuagcaucgauguuau

SEQ ID NO: 2132398 - RNA, 22 nt, Staphylococcus aureus subsp. aureus N315
auucucuuuauugggagcaauc

SEQ ID NO: 2132399 - RNA, 12 nt, Staphylococcus aureus subsp. aureus N315
auucucuuuuaa

SEQ ID NO: 2132400 - RNA, 20 nt, Staphylococcus aureus subsp. aureus N315
auucucuuaucuugauuuaa

SEQ ID NO: 2132401 - RNA, 21 nt, Staphylococcus aureus subsp. aureus N315
auucucuuaucuugauuuaaa

SEQ ID NO: 2132402 - RNA, 16 nt, Staphylococcus aureus subsp. aureus N315
auucugaaacuuuaau

SEQ ID NO: 2132403 - RNA, 20 nt, Staphylococcus aureus subsp. aureus N315
auucuccaguggaaaugaua

SEQ ID NO: 2132404 - RNA, 17 nt, Staphylococcus aureus subsp. aureus N315
auucguuugaauuauuu

SEQ ID NO: 2132405 - RNA, 15 nt, Staphylococcus aureus subsp. aureus N315
auucuaaaagaauua

SEQ ID NO: 2132406 - RNA, 18 nt, Staphylococcus aureus subsp. aureus N315
auucuaaaaaauuaaaaa

SEQ ID NO: 2132407 - RNA, 14 nt, Staphylococcus aureus subsp. aureus N315
auucuaaaacggaa

SEQ ID NO: 2132408 - RNA, 14 nt, Staphylococcus aureus subsp. aureus N315
auucuaacugcaaa

SEQ ID NO: 2132409 - RNA, 14 nt, Staphylococcus aureus subsp. aureus N315
auucuaaguuaaaa

SEQ ID NO: 2132410 - RNA, 17 nt, Staphylococcus aureus subsp. aureus N315
auucuaaguuaaaaccu

SEQ ID NO: 2132411 - RNA, 14 nt, Staphylococcus aureus subsp. aureus N315
auucuacagguaau

SEQ ID NO: 2132412 - RNA, 12 nt, Staphylococcus aureus subsp. aureus N315
auucuacaggca

SEQ ID NO: 2132413 - RNA, 23 nt, Staphylococcus aureus subsp. aureus N315
auucguugauuuagcauacauua

SEQ ID NO: 2132414 - RNA, 17 nt, Staphylococcus aureus subsp. aureus N315
auucgugauuacauucu

SEQ ID NO: 2132415 - RNA, 14 nt, Staphylococcus aureus subsp. aureus N315
auucuuuucaagaa

SEQ ID NO: 2132416 - RNA, 19 nt, Staphylococcus aureus subsp. aureus N315
auucuuuguauuuauacua

SEQ ID NO: 2132417 - RNA, 21 nt, Staphylococcus aureus subsp. aureus N315
auucuuuuaauagaucuuugu

SEQ ID NO: 2132418 - RNA, 17 nt, Staphylococcus aureus subsp. aureus N315
auucuuuuguaauaauu

SEQ ID NO: 2132419 - RNA, 21 nt, Staphylococcus aureus subsp. aureus N315
auugaaauuauccuacugcug

SEQ ID NO: 2132420 - RNA, 13 nt, Staphylococcus aureus subsp. aureus N315
auugaaauuuuua

SEQ ID NO: 2132421 - RNA, 21 nt, Staphylococcus aureus subsp. aureus N315
auucuuuauaagcuuuuucuu

SEQ ID NO: 2132422 - RNA, 16 nt, Staphylococcus aureus subsp. aureus N315
auucuuggcguauuuu

SEQ ID NO: 2132423 - RNA, 22 nt, Staphylococcus aureus subsp. aureus N315
auucuugagcaaugucuuuaau

SEQ ID NO: 2132424 - RNA, 15 nt, Staphylococcus aureus subsp. aureus N315
auucuuuaauauaaa

SEQ ID NO: 2132425 - RNA, 19 nt, Staphylococcus aureus subsp. aureus N315
auucugcagcgacaucuuu

SEQ ID NO: 2132426 - RNA, 14 nt, Staphylococcus aureus subsp. aureus N315
auucugauacagaa

SEQ ID NO: 2132427 - RNA, 18 nt, Staphylococcus aureus subsp. aureus N315
auucuugaauaaauuuua

SEQ ID NO: 2132428 - RNA, 15 nt, Staphylococcus aureus subsp. aureus N315
auucuugaaaaguuu

SEQ ID NO: 2132429 - RNA, 14 nt, Staphylococcus aureus subsp. aureus N315
auucuugaauaaau

SEQ ID NO: 2132430 - RNA, 12 nt, Staphylococcus aureus subsp. aureus N315
auucuucauuua

SEQ ID NO: 2132431 - RNA, 17 nt, Staphylococcus aureus subsp. aureus N315
auucuucauuuauaaca

SEQ ID NO: 2132432 - RNA, 17 nt, Staphylococcus aureus subsp. aureus N315
auucuucaguuuguugg

SEQ ID NO: 2132433 - RNA, 20 nt, Staphylococcus aureus subsp. aureus N315
auucuucaucaugacuauuu

SEQ ID NO: 2132434 - RNA, 21 nt, Staphylococcus aureus subsp. aureus N315
auucuucccaaaaauuguuca

SEQ ID NO: 2132435 - RNA, 14 nt, Staphylococcus aureus subsp. aureus N315
cacugaaaucuaga

SEQ ID NO: 2132436 - RNA, 19 nt, Staphylococcus aureus subsp. aureus N315
cacucuuacucauuuuucu

SEQ ID NO: 2132437 - RNA, 20 nt, Staphylococcus aureus subsp. aureus N315
cacucuuacucauuuuucuu

SEQ ID NO: 2132438 - RNA, 15 nt, Staphylococcus aureus subsp. aureus N315
cacuccuuaaacaaa

SEQ ID NO: 2132439 - RNA, 14 nt, Staphylococcus aureus subsp. aureus N315
cacuccucuauuuu

SEQ ID NO: 2132440 - RNA, 19 nt, Staphylococcus aureus subsp. aureus N315
cacucauaaccgcuucuuu

SEQ ID NO: 2132441 - RNA, 12 nt, Staphylococcus aureus subsp. aureus N315
cacucauaaccg

SEQ ID NO: 2132442 - RNA, 19 nt, Staphylococcus aureus subsp. aureus N315
cacucauaaucaagucugc

SEQ ID NO: 2132443 - RNA, 20 nt, Staphylococcus aureus subsp. aureus N315
cacucauaaucaagucugca

SEQ ID NO: 2132444 - RNA, 13 nt, Staphylococcus aureus subsp. aureus N315
cacuauuuuuaaa

SEQ ID NO: 2132445 - RNA, 14 nt, Staphylococcus aureus subsp. aureus N315
cacuauuuuuaaau

SEQ ID NO: 2132446 - RNA, 15 nt, Staphylococcus aureus subsp. aureus N315
cacucacuucaacgu

SEQ ID NO: 2132447 - RNA, 17 nt, Staphylococcus aureus subsp. aureus N315
cacucaauucucuaacu

SEQ ID NO: 2132448 - RNA, 24 nt, Staphylococcus aureus subsp. aureus N315
cacuacgcugaugaaugauugcau

SEQ ID NO: 2132449 - RNA, 15 nt, Staphylococcus aureus subsp. aureus N315
cacuaggaucuuuuc

SEQ ID NO: 2132450 - RNA, 18 nt, Staphylococcus aureus subsp. aureus N315
cacuagauaguuuauacu

SEQ ID NO: 2132451 - RNA, 11 nt, Staphylococcus aureus subsp. aureus N315
cacuaucuuuu

SEQ ID NO: 2132452 - RNA, 16 nt, Staphylococcus aureus subsp. aureus N315
cacuauauccuuuuug

SEQ ID NO: 2132453 - RNA, 15 nt, Staphylococcus aureus subsp. aureus N315
cacuauaaaauucac

SEQ ID NO: 2132454 - RNA, 22 nt, Staphylococcus aureus subsp. aureus N315
cacuacaguguaugaugaacuu

SEQ ID NO: 2132455 - RNA, 16 nt, Staphylococcus aureus subsp. aureus N315
cacuaaaaauauauuu

SEQ ID NO: 2132456 - RNA, 15 nt, Staphylococcus aureus subsp. aureus N315
cacuaacucaauaug

SEQ ID NO: 2132457 - RNA, 23 nt, Staphylococcus aureus subsp. aureus N315
cacgugcuucguuuuuaguguua

SEQ ID NO: 2132458 - RNA, 23 nt, Staphylococcus aureus subsp. aureus N315
cacguugugcaauaccuguucca

SEQ ID NO: 2132459 - RNA, 19 nt, Staphylococcus aureus subsp. aureus N315
cacguucuugguauuuuuu

SEQ ID NO: 2132460 - RNA, 20 nt, Staphylococcus aureus subsp. aureus N315
cacguucuugguauuuuuua

SEQ ID NO: 2132461 - RNA, 23 nt, Staphylococcus aureus subsp. aureus N315
cacgauuacgcucauaugucugu

SEQ ID NO: 2132462 - RNA, 14 nt, Staphylococcus aureus subsp. aureus N315
cacgcaauaucaua

SEQ ID NO: 2132463 - RNA, 18 nt, Staphylococcus aureus subsp. aureus N315
cacgauaucuagcugcuu

SEQ ID NO: 2132464 - RNA, 20 nt, Staphylococcus aureus subsp. aureus N315
cacgauaaaaauaaaaaacg

SEQ ID NO: 2132465 - RNA, 16 nt, Staphylococcus aureus subsp. aureus N315
cacgcauuacuuuaga

SEQ ID NO: 2132466 - RNA, 23 nt, Staphylococcus aureus subsp. aureus N315
cacgcuaacauucagugcaauga

SEQ ID NO: 2132467 - RNA, 13 nt, Staphylococcus aureus subsp. aureus N315
cacgcguucaaau

SEQ ID NO: 2132468 - RNA, 17 nt, Staphylococcus aureus subsp. aureus N315
cacccugcuuaucauua

SEQ ID NO: 2132469 - RNA, 21 nt, Staphylococcus aureus subsp. aureus N315
caccuggucguacuuucaaau

SEQ ID NO: 2132470 - RNA, 17 nt, Staphylococcus aureus subsp. aureus N315
caccuuaccuacuuuuu

SEQ ID NO: 2132471 - RNA, 21 nt, Staphylococcus aureus subsp. aureus N315
caccuguuacuugagaaccau

SEQ ID NO: 2132472 - RNA, 21 nt, Staphylococcus aureus subsp. aureus N315
caccuuauugaugaaaacaaa

SEQ ID NO: 2132473 - RNA, 23 nt, Staphylococcus aureus subsp. aureus N315
caccuuaucacuuggaauaauac

SEQ ID NO: 2132474 - RNA, 16 nt, Staphylococcus aureus subsp. aureus N315
caccuuuacaacauac

SEQ ID NO: 2132475 - RNA, 16 nt, Staphylococcus aureus subsp. aureus N315
caccuuuaucuguaac

SEQ ID NO: 2132476 - RNA, 15 nt, Staphylococcus aureus subsp. aureus N315
cacgaacaacauuag

SEQ ID NO: 2132477 - RNA, 17 nt, Staphylococcus aureus subsp. aureus N315
cacgaacaagucuugca

SEQ ID NO: 2132478 - RNA, 22 nt, Staphylococcus aureus subsp. aureus N315
cacgaaauggugaacuaaauug

SEQ ID NO: 2132479 - RNA, 17 nt, Staphylococcus aureus subsp. aureus N315
cacgagcugcuucaacu

SEQ ID NO: 2132480 - RNA, 13 nt, Staphylococcus aureus subsp. aureus N315
cacgauaaaaaua

SEQ ID NO: 2132481 - RNA, 11 nt, Staphylococcus aureus subsp. aureus N315
cacgagaaaug

SEQ ID NO: 2132482 - RNA, 18 nt, Staphylococcus aureus subsp. aureus N315
cacgagcaacaucuuuug

SEQ ID NO: 2132483 - RNA, 14 nt, Staphylococcus aureus subsp. aureus N315
cacgagcugcuuca

SEQ ID NO: 2132484 - RNA, 17 nt, Staphylococcus aureus subsp. aureus N315
caccucuaaguucaccu

SEQ ID NO: 2132485 - RNA, 18 nt, Staphylococcus aureus subsp. aureus N315
caccucuaaguucaccua

SEQ ID NO: 2132486 - RNA, 12 nt, Staphylococcus aureus subsp. aureus N315
caccugcaauuu

SEQ ID NO: 2132487 - RNA, 15 nt, Staphylococcus aureus subsp. aureus N315
caccugcagcauccu

SEQ ID NO: 2132488 - RNA, 13 nt, Staphylococcus aureus subsp. aureus N315
caccuaaaugauu

SEQ ID NO: 2132489 - RNA, 18 nt, Staphylococcus aureus subsp. aureus N315
caccuaaaaagaaaauua

SEQ ID NO: 2132490 - RNA, 13 nt, Staphylococcus aureus subsp. aureus N315
caccuacaaauau

SEQ ID NO: 2132491 - RNA, 13 nt, Staphylococcus aureus subsp. aureus N315
caccuaauaccau

SEQ ID NO: 2132492 - RNA, 19 nt, Staphylococcus aureus subsp. aureus N315
caccuacaaauauuucuaa

SEQ ID NO: 2132493 - RNA, 14 nt, Staphylococcus aureus subsp. aureus N315
caccuauuaggauc

SEQ ID NO: 2132494 - RNA, 16 nt, Staphylococcus aureus subsp. aureus N315
caccuauauuuuuagc

SEQ ID NO: 2132495 - RNA, 18 nt, Staphylococcus aureus subsp. aureus N315
caccguaaucuuuuaacu

SEQ ID NO: 2132496 - RNA, 12 nt, Staphylococcus aureus subsp. aureus N315
caccaguuucaa

SEQ ID NO: 2132497 - RNA, 18 nt, Staphylococcus aureus subsp. aureus N315
caccauauuuaacauuuu

SEQ ID NO: 2132498 - RNA, 19 nt, Staphylococcus aureus subsp. aureus N315
caccauuuacuucauaagu

SEQ ID NO: 2132499 - RNA, 15 nt, Staphylococcus aureus subsp. aureus N315
caccaucccauuaaa

SEQ ID NO: 2132500 - RNA, 21 nt, Staphylococcus aureus subsp. aureus N315
caccaaugauagugaauaaug

SEQ ID NO: 2132501 - RNA, 16 nt, Staphylococcus aureus subsp. aureus N315
caccagaacaauucaa

SEQ ID NO: 2132502 - RNA, 18 nt, Staphylococcus aureus subsp. aureus N315
caccagauaucauaauau

SEQ ID NO: 2132503 - RNA, 23 nt, Staphylococcus aureus subsp. aureus N315
caccaacaauagguacaacuaaa

SEQ ID NO: 2132504 - RNA, 18 nt, Staphylococcus aureus subsp. aureus N315
cacauuuacuuaagaacu

SEQ ID NO: 2132505 - RNA, 16 nt, Staphylococcus aureus subsp. aureus N315
cacauuacuguaaaau

SEQ ID NO: 2132506 - RNA, 23 nt, Staphylococcus aureus subsp. aureus N315
cacauuccaucuuaaaacaacuu

SEQ ID NO: 2132507 - RNA, 14 nt, Staphylococcus aureus subsp. aureus N315
cacauauguccaua

SEQ ID NO: 2132508 - RNA, 16 nt, Staphylococcus aureus subsp. aureus N315
cacauccccuuugaua

SEQ ID NO: 2132509 - RNA, 13 nt, Staphylococcus aureus subsp. aureus N315
cacaucuaugugg

SEQ ID NO: 2132510 - RNA, 13 nt, Staphylococcus aureus subsp. aureus N315
cacaugaauuuua

SEQ ID NO: 2132511 - RNA, 14 nt, Staphylococcus aureus subsp. aureus N315
cacauuaacaaggc

SEQ ID NO: 2132512 - RNA, 12 nt, Staphylococcus aureus subsp. aureus N315
cacaugugaaau

SEQ ID NO: 2132513 - RNA, 21 nt, Staphylococcus aureus subsp. aureus N315
cacauguacguuuuuuuaaau

SEQ ID NO: 2132514 - RNA, 23 nt, Staphylococcus aureus subsp. aureus N315
cacauguacguuuuuuuaaauac

SEQ ID NO: 2132515 - RNA, 21 nt, Staphylococcus aureus subsp. aureus N315
cacagagaaauucgaaaagaa

SEQ ID NO: 2132516 - RNA, 19 nt, Staphylococcus aureus subsp. aureus N315
cacaguggauuacagauga

SEQ ID NO: 2132517 - RNA, 12 nt, Staphylococcus aureus subsp. aureus N315
cacauaaaucaa

SEQ ID NO: 2132518 - RNA, 13 nt, Staphylococcus aureus subsp. aureus N315
cacauacauuuug

SEQ ID NO: 2132519 - RNA, 15 nt, Staphylococcus aureus subsp. aureus N315
cacauagaguaauuu

SEQ ID NO: 2132520 - RNA, 13 nt, Staphylococcus aureus subsp. aureus N315
cacacaugauaau

SEQ ID NO: 2132521 - RNA, 21 nt, Staphylococcus aureus subsp. aureus N315
cacacagguaaauuuaaaaua

SEQ ID NO: 2132522 - RNA, 18 nt, Staphylococcus aureus subsp. aureus N315
cacacacaguuuauaaua

SEQ ID NO: 2132523 - RNA, 20 nt, Staphylococcus aureus subsp. aureus N315
cacaaugcccuuaaagcaca

SEQ ID NO: 2132524 - RNA, 17 nt, Staphylococcus aureus subsp. aureus N315
cacaaugauugaauauu

SEQ ID NO: 2132525 - RNA, 17 nt, Staphylococcus aureus subsp. aureus N315
cacaauaauccaagaua

SEQ ID NO: 2132526 - RNA, 21 nt, Staphylococcus aureus subsp. aureus N315
cacaauauuuaccacaaauau

SEQ ID NO: 2132527 - RNA, 14 nt, Staphylococcus aureus subsp. aureus N315
cacacuuuaaacaa

SEQ ID NO: 2132528 - RNA, 15 nt, Staphylococcus aureus subsp. aureus N315
cacacuuuaaacaag

SEQ ID NO: 2132529 - RNA, 11 nt, Staphylococcus aureus subsp. aureus N315
cacaccccaac

SEQ ID NO: 2132530 - RNA, 23 nt, Staphylococcus aureus subsp. aureus N315
cacaacauguuuggaugaacaaa

SEQ ID NO: 2132531 - RNA, 16 nt, Staphylococcus aureus subsp. aureus N315
cacaaccagucagaaa

SEQ ID NO: 2132532 - RNA, 21 nt, Staphylococcus aureus subsp. aureus N315
cacaacaaucacgauuaaugu

SEQ ID NO: 2132533 - RNA, 17 nt, Staphylococcus aureus subsp. aureus N315
cacaacacauaaauuaa

SEQ ID NO: 2132534 - RNA, 12 nt, Staphylococcus aureus subsp. aureus N315
cacaaaugaaug

SEQ ID NO: 2132535 - RNA, 19 nt, Staphylococcus aureus subsp. aureus N315
cacaaagauauguuuauau

SEQ ID NO: 2132536 - RNA, 12 nt, Staphylococcus aureus subsp. aureus N315
caauuucucuau

SEQ ID NO: 2132537 - RNA, 15 nt, Staphylococcus aureus subsp. aureus N315
caauuuggaaauauc

SEQ ID NO: 2132538 - RNA, 18 nt, Staphylococcus aureus subsp. aureus N315
caauuuggucauauaaac

SEQ ID NO: 2132539 - RNA, 22 nt, Staphylococcus aureus subsp. aureus N315
caauuucuaggccacuaagacc

SEQ ID NO: 2132540 - RNA, 13 nt, Staphylococcus aureus subsp. aureus N315
caauuucuguaau

SEQ ID NO: 2132541 - RNA, 22 nt, Staphylococcus aureus subsp. aureus N315
caauuuauuauuaacuguaccu

SEQ ID NO: 2132542 - RNA, 17 nt, Staphylococcus aureus subsp. aureus N315
caauuuauuauuaacug

SEQ ID NO: 2132543 - RNA, 23 nt, Staphylococcus aureus subsp. aureus N315
caauuucacgcugaaauuuuuua

SEQ ID NO: 2132544 - RNA, 14 nt, Staphylococcus aureus subsp. aureus N315
caauuuuuaacaaa

SEQ ID NO: 2132545 - RNA, 15 nt, Staphylococcus aureus subsp. aureus N315
caauuuuuucaucuu

SEQ ID NO: 2132546 - RNA, 14 nt, Staphylococcus aureus subsp. aureus N315
cacaaaaaugaaga

SEQ ID NO: 2132547 - RNA, 23 nt, Staphylococcus aureus subsp. aureus N315
caauuuuaccuucgcauacuuuu

SEQ ID NO: 2132548 - RNA, 15 nt, Staphylococcus aureus subsp. aureus N315
caauuuuuaaaaacc

SEQ ID NO: 2132549 - RNA, 17 nt, Staphylococcus aureus subsp. aureus N315
caauuuuaaaucuuuua

SEQ ID NO: 2132550 - RNA, 19 nt, Staphylococcus aureus subsp. aureus N315
caauuuggucauauaaaca

SEQ ID NO: 2132551 - RNA, 22 nt, Staphylococcus aureus subsp. aureus N315
caauuuguccuucgcuaugacc

SEQ ID NO: 2132552 - RNA, 15 nt, Staphylococcus aureus subsp. aureus N315
caauuaaagugaaua

SEQ ID NO: 2132553 - RNA, 15 nt, Staphylococcus aureus subsp. aureus N315
caauuaaaacuauaa

SEQ ID NO: 2132554 - RNA, 22 nt, Staphylococcus aureus subsp. aureus N315
caauuaaucggaucauuauuua

SEQ ID NO: 2132555 - RNA, 20 nt, Staphylococcus aureus subsp. aureus N315
caauuaaucggaucauuauu

SEQ ID NO: 2132556 - RNA, 23 nt, Staphylococcus aureus subsp. aureus N315
caauuaauuuagucauuacaaau

SEQ ID NO: 2132557 - RNA, 17 nt, Staphylococcus aureus subsp. aureus N315
caauuaaugauaaaccg

SEQ ID NO: 2132558 - RNA, 17 nt, Staphylococcus aureus subsp. aureus N315
caaucaguaauaaugua

SEQ ID NO: 2132559 - RNA, 19 nt, Staphylococcus aureus subsp. aureus N315
caauuagaaaauuucucac

SEQ ID NO: 2132560 - RNA, 13 nt, Staphylococcus aureus subsp. aureus N315
caauuagaaaaua

SEQ ID NO: 2132561 - RNA, 17 nt, Staphylococcus aureus subsp. aureus N315
caauuaucaacauaaua

SEQ ID NO: 2132562 - RNA, 12 nt, Staphylococcus aureus subsp. aureus N315
caauuaguucug

SEQ ID NO: 2132563 - RNA, 17 nt, Staphylococcus aureus subsp. aureus N315
caauuauaaaugauuaa

SEQ ID NO: 2132564 - RNA, 20 nt, Staphylococcus aureus subsp. aureus N315
caauuacucuuuuucuuuca

SEQ ID NO: 2132565 - RNA, 15 nt, Staphylococcus aureus subsp. aureus N315
caauuacucuuuuuc

SEQ ID NO: 2132566 - RNA, 12 nt, Staphylococcus aureus subsp. aureus N315
caauucaaugua

SEQ ID NO: 2132567 - RNA, 19 nt, Staphylococcus aureus subsp. aureus N315
caauuauugaaaacaaaaa

SEQ ID NO: 2132568 - RNA, 18 nt, Staphylococcus aureus subsp. aureus N315
caauuaucaacauaauau

SEQ ID NO: 2132569 - RNA, 13 nt, Staphylococcus aureus subsp. aureus N315
caauugcuuuacc

SEQ ID NO: 2132570 - RNA, 15 nt, Staphylococcus aureus subsp. aureus N315
caauuuaauagacau

SEQ ID NO: 2132571 - RNA, 18 nt, Staphylococcus aureus subsp. aureus N315
caauuuaauagacauuaa

SEQ ID NO: 2132572 - RNA, 13 nt, Staphylococcus aureus subsp. aureus N315
caauuuaaauaag

SEQ ID NO: 2132573 - RNA, 12 nt, Staphylococcus aureus subsp. aureus N315
caauuuaaauaa

SEQ ID NO: 2132574 - RNA, 22 nt, Staphylococcus aureus subsp. aureus N315
caauugaagugaaauugcgugc

SEQ ID NO: 2132575 - RNA, 15 nt, Staphylococcus aureus subsp. aureus N315
caauugaagugaaau

SEQ ID NO: 2132576 - RNA, 18 nt, Staphylococcus aureus subsp. aureus N315
caauugcauacguaaaug

SEQ ID NO: 2132577 - RNA, 15 nt, Staphylococcus aureus subsp. aureus N315
caauugcaaugaaua

SEQ ID NO: 2132578 - RNA, 13 nt, Staphylococcus aureus subsp. aureus N315
caauugcauacgu

SEQ ID NO: 2132579 - RNA, 21 nt, Staphylococcus aureus subsp. aureus N315
caauucgcucacaugugaaau

SEQ ID NO: 2132580 - RNA, 17 nt, Staphylococcus aureus subsp. aureus N315
caauucggauuauauuu

SEQ ID NO: 2132581 - RNA, 22 nt, Staphylococcus aureus subsp. aureus N315
caauucucuuaucuugauuuaa

SEQ ID NO: 2132582 - RNA, 22 nt, Staphylococcus aureus subsp. aureus N315
caauucauuaauaggauuauua

SEQ ID NO: 2132583 - RNA, 21 nt, Staphylococcus aureus subsp. aureus N315
auccuguguaaaauaaaucau

SEQ ID NO: 2132584 - RNA, 11 nt, Staphylococcus aureus subsp. aureus N315
auccuuaaaug

SEQ ID NO: 2132585 - RNA, 20 nt, Staphylococcus aureus subsp. aureus N315
auccuucaaagauuuuaccu

SEQ ID NO: 2132586 - RNA, 15 nt, Staphylococcus aureus subsp. aureus N315
auccuuuaaaucauu

SEQ ID NO: 2132587 - RNA, 18 nt, Staphylococcus aureus subsp. aureus N315
aucgaauugguaaaaauc

SEQ ID NO: 2132588 - RNA, 20 nt, Staphylococcus aureus subsp. aureus N315
aucgaauaacuguuuaucau

SEQ ID NO: 2132589 - RNA, 23 nt, Staphylococcus aureus subsp. aureus N315
aucgcauuuuguuucaacauuuc

SEQ ID NO: 2132590 - RNA, 18 nt, Staphylococcus aureus subsp. aureus N315
aucgauuaguuuuugguu

SEQ ID NO: 2132591 - RNA, 15 nt, Staphylococcus aureus subsp. aureus N315
aucgccaaucuauug

SEQ ID NO: 2132592 - RNA, 15 nt, Staphylococcus aureus subsp. aureus N315
aucgccaucccauuc

SEQ ID NO: 2132593 - RNA, 14 nt, Staphylococcus aureus subsp. aureus N315
aucgcuugcuucuu

SEQ ID NO: 2132594 - RNA, 16 nt, Staphylococcus aureus subsp. aureus N315
aucgcuugcuucuuuc

SEQ ID NO: 2132595 - RNA, 18 nt, Staphylococcus aureus subsp. aureus N315
aucgucaucacuuuuuaa

SEQ ID NO: 2132596 - RNA, 17 nt, Staphylococcus aureus subsp. aureus N315
aucguuguaccacccca

SEQ ID NO: 2132597 - RNA, 18 nt, Staphylococcus aureus subsp. aureus N315
aucgugaagaaaaaauga

SEQ ID NO: 2132598 - RNA, 19 nt, Staphylococcus aureus subsp. aureus N315
aucgugaagaaaaaaugau

SEQ ID NO: 2132599 - RNA, 19 nt, Staphylococcus aureus subsp. aureus N315
aucuaaccuuuucaucagu

SEQ ID NO: 2132600 - RNA, 22 nt, Staphylococcus aureus subsp. aureus N315
aucuaacaaucguuuuaaugcc

SEQ ID NO: 2132601 - RNA, 16 nt, Staphylococcus aureus subsp. aureus N315
aucguauucuuuuaau

SEQ ID NO: 2132602 - RNA, 18 nt, Staphylococcus aureus subsp. aureus N315
aucguaacauaucagcuu

SEQ ID NO: 2132603 - RNA, 22 nt, Staphylococcus aureus subsp. aureus N315
aucguauagauuaaaaaaucau

SEQ ID NO: 2132604 - RNA, 14 nt, Staphylococcus aureus subsp. aureus N315
aucguaaaaaacaa

SEQ ID NO: 2132605 - RNA, 13 nt, Staphylococcus aureus subsp. aureus N315
aucguaaacauaa

SEQ ID NO: 2132606 - RNA, 24 nt, Staphylococcus aureus subsp. aureus N315
auccugauuuaauguuaaacaaua

SEQ ID NO: 2132607 - RNA, 21 nt, Staphylococcus aureus subsp. aureus N315
auccucgguauuuaauguuuu

SEQ ID NO: 2132608 - RNA, 19 nt, Staphylococcus aureus subsp. aureus N315
auccugcuuauuaauuguu

SEQ ID NO: 2132609 - RNA, 16 nt, Staphylococcus aureus subsp. aureus N315
auccuggaauauuaac

SEQ ID NO: 2132610 - RNA, 14 nt, Staphylococcus aureus subsp. aureus N315
auccuggaauauua

SEQ ID NO: 2132611 - RNA, 16 nt, Staphylococcus aureus subsp. aureus N315
auccugccaauauauu

SEQ ID NO: 2132612 - RNA, 15 nt, Staphylococcus aureus subsp. aureus N315
auccugccaauauau

SEQ ID NO: 2132613 - RNA, 19 nt, Staphylococcus aureus subsp. aureus N315
auccugccaauauauucac

SEQ ID NO: 2132614 - RNA, 18 nt, Staphylococcus aureus subsp. aureus N315
auccuaaaaagcucaauc

SEQ ID NO: 2132615 - RNA, 17 nt, Staphylococcus aureus subsp. aureus N315
auccuaagcauaauuca

SEQ ID NO: 2132616 - RNA, 17 nt, Staphylococcus aureus subsp. aureus N315
auccuaauuuuucucca

SEQ ID NO: 2132617 - RNA, 14 nt, Staphylococcus aureus subsp. aureus N315
auccuaauuuuucu

SEQ ID NO: 2132618 - RNA, 22 nt, Staphylococcus aureus subsp. aureus N315
auccuacgacacguguaaaaau

SEQ ID NO: 2132619 - RNA, 21 nt, Staphylococcus aureus subsp. aureus N315
auccuauggcgcaauuuuuaa

SEQ ID NO: 2132620 - RNA, 20 nt, Staphylococcus aureus subsp. aureus N315
auccuauggcgcaauuuuua

SEQ ID NO: 2132621 - RNA, 17 nt, Staphylococcus aureus subsp. aureus N315
auccuaugccaaauaac

SEQ ID NO: 2132622 - RNA, 16 nt, Staphylococcus aureus subsp. aureus N315
auccucaguuauacca

SEQ ID NO: 2132623 - RNA, 13 nt, Staphylococcus aureus subsp. aureus N315
auccucauaauua

SEQ ID NO: 2132624 - RNA, 16 nt, Staphylococcus aureus subsp. aureus N315
auccucauaauuauca

SEQ ID NO: 2132625 - RNA, 17 nt, Staphylococcus aureus subsp. aureus N315
auccgccaauuaaaauu

SEQ ID NO: 2132626 - RNA, 15 nt, Staphylococcus aureus subsp. aureus N315
aucccuguaaaacca

SEQ ID NO: 2132627 - RNA, 16 nt, Staphylococcus aureus subsp. aureus N315
aucccuguaaaaccau

SEQ ID NO: 2132628 - RNA, 17 nt, Staphylococcus aureus subsp. aureus N315
auccccgagcaauucuu

SEQ ID NO: 2132629 - RNA, 14 nt, Staphylococcus aureus subsp. aureus N315
aucccauuuuaaag

SEQ ID NO: 2132630 - RNA, 15 nt, Staphylococcus aureus subsp. aureus N315
aucccauucaccaau

SEQ ID NO: 2132631 - RNA, 19 nt, Staphylococcus aureus subsp. aureus N315
aucccauucaccaauauua

SEQ ID NO: 2132632 - RNA, 13 nt, Staphylococcus aureus subsp. aureus N315
auccauaaaaaua

SEQ ID NO: 2132633 - RNA, 15 nt, Staphylococcus aureus subsp. aureus N315
auccauaaaaauacg

SEQ ID NO: 2132634 - RNA, 15 nt, Staphylococcus aureus subsp. aureus N315
aucccauuaaaccac

SEQ ID NO: 2132635 - RNA, 13 nt, Staphylococcus aureus subsp. aureus N315
auccauucaaugu

SEQ ID NO: 2132636 - RNA, 16 nt, Staphylococcus aureus subsp. aureus N315
auccaugcugguuuug

SEQ ID NO: 2132637 - RNA, 15 nt, Staphylococcus aureus subsp. aureus N315
auccaucaauaccau

SEQ ID NO: 2132638 - RNA, 13 nt, Staphylococcus aureus subsp. aureus N315
auccaauguauaa

SEQ ID NO: 2132639 - RNA, 16 nt, Staphylococcus aureus subsp. aureus N315
auccaccaaauacagu

SEQ ID NO: 2132640 - RNA, 14 nt, Staphylococcus aureus subsp. aureus N315
auccaaaacauuuu

SEQ ID NO: 2132641 - RNA, 18 nt, Staphylococcus aureus subsp. aureus N315
auccaaaauccugaaauu

SEQ ID NO: 2132642 - RNA, 15 nt, Staphylococcus aureus subsp. aureus N315
aucauuuucaauacu

SEQ ID NO: 2132643 - RNA, 20 nt, Staphylococcus aureus subsp. aureus N315
aucauuuugccucguccauu

SEQ ID NO: 2132644 - RNA, 22 nt, Staphylococcus aureus subsp. aureus N315
aucauuuucaacauaauauuuc

SEQ ID NO: 2132645 - RNA, 22 nt, Staphylococcus aureus subsp. aureus N315
aucauuugugcguuucaaugag

SEQ ID NO: 2132646 - RNA, 16 nt, Staphylococcus aureus subsp. aureus N315
aucauuuguguauaaa

SEQ ID NO: 2132647 - RNA, 12 nt, Staphylococcus aureus subsp. aureus N315
aucauuuguguu

SEQ ID NO: 2132648 - RNA, 11 nt, Staphylococcus aureus subsp. aureus N315
auccaaaccaa

SEQ ID NO: 2132649 - RNA, 16 nt, Staphylococcus aureus subsp. aureus N315
auccaaagacauacag

SEQ ID NO: 2132650 - RNA, 23 nt, Staphylococcus aureus subsp. aureus N315
auccaaggauguuauaaaaugaa

SEQ ID NO: 2132651 - RNA, 14 nt, Staphylococcus aureus subsp. aureus N315
auccaacuaaaugu

SEQ ID NO: 2132652 - RNA, 19 nt, Staphylococcus aureus subsp. aureus N315
aucauuuaaaauauuuuuu

SEQ ID NO: 2132653 - RNA, 23 nt, Staphylococcus aureus subsp. aureus N315
aucauuguguccauaaauauuaa

SEQ ID NO: 2132654 - RNA, 20 nt, Staphylococcus aureus subsp. aureus N315
aucauuguggcuuuuuuuau

SEQ ID NO: 2132655 - RNA, 23 nt, Staphylococcus aureus subsp. aureus N315
aucauuuaaauuaguuauacuaa

SEQ ID NO: 2132656 - RNA, 19 nt, Staphylococcus aureus subsp. aureus N315
aucauuuaaauuaguuaua

SEQ ID NO: 2132657 - RNA, 15 nt, Staphylococcus aureus subsp. aureus N315
aucauuucaaauaag

SEQ ID NO: 2132658 - RNA, 16 nt, Staphylococcus aureus subsp. aureus N315
aucauuucaaauaaga

SEQ ID NO: 2132659 - RNA, 19 nt, Staphylococcus aureus subsp. aureus N315
aucauuuauguagauuuua

SEQ ID NO: 2132660 - RNA, 18 nt, Staphylococcus aureus subsp. aureus N315
aucauuugacauaaucca

SEQ ID NO: 2132661 - RNA, 20 nt, Staphylococcus aureus subsp. aureus N315
aucauucuguguaaauauaa

SEQ ID NO: 2132662 - RNA, 19 nt, Staphylococcus aureus subsp. aureus N315
aucauucuguguaaauaua

SEQ ID NO: 2132663 - RNA, 21 nt, Staphylococcus aureus subsp. aureus N315
aucauucuguguaaauauaaa

SEQ ID NO: 2132664 - RNA, 17 nt, Staphylococcus aureus subsp. aureus N315
aucauucuuuauagaaa

SEQ ID NO: 2132665 - RNA, 23 nt, Staphylococcus aureus subsp. aureus N315
aucaugugucuuccaaucaacuu

SEQ ID NO: 2132666 - RNA, 20 nt, Staphylococcus aureus subsp. aureus N315
aucauguucuuauaaaaaac

SEQ ID NO: 2132667 - RNA, 20 nt, Staphylococcus aureus subsp. aureus N315
aucauuaauuggauuuuuac

SEQ ID NO: 2132668 - RNA, 23 nt, Staphylococcus aureus subsp. aureus N315
aucauucaaguguaguaaaaauc

SEQ ID NO: 2132669 - RNA, 24 nt, Staphylococcus aureus subsp. aureus N315
aucauucaaguguaguaaaaauca

SEQ ID NO: 2132670 - RNA, 18 nt, Staphylococcus aureus subsp. aureus N315
aucauucaccuaaaaaga

SEQ ID NO: 2132671 - RNA, 13 nt, Staphylococcus aureus subsp. aureus N315
aucauucaccuug

SEQ ID NO: 2132672 - RNA, 19 nt, Staphylococcus aureus subsp. aureus N315
aucauuauucgcaucucca

SEQ ID NO: 2132673 - RNA, 14 nt, Staphylococcus aureus subsp. aureus N315
aucauuagauaaua

SEQ ID NO: 2132674 - RNA, 14 nt, Staphylococcus aureus subsp. aureus N315
aucauuauaaaaug

SEQ ID NO: 2132675 - RNA, 13 nt, Staphylococcus aureus subsp. aureus N315
aucauuauaaaau

SEQ ID NO: 2132676 - RNA, 19 nt, Staphylococcus aureus subsp. aureus N315
aucauuaguguagaaaaua

SEQ ID NO: 2132677 - RNA, 20 nt, Staphylococcus aureus subsp. aureus N315
aucauuaguguagaaaauag

SEQ ID NO: 2132678 - RNA, 22 nt, Staphylococcus aureus subsp. aureus N315
aucauuaguuuuuaaaauuauc

SEQ ID NO: 2132679 - RNA, 20 nt, Staphylococcus aureus subsp. aureus N315
aucauuaguuuuuaaaauua

SEQ ID NO: 2132680 - RNA, 16 nt, Staphylococcus aureus subsp. aureus N315
aucaugacauaaaacu

SEQ ID NO: 2132681 - RNA, 16 nt, Staphylococcus aureus subsp. aureus N315
aucaugaaguugguuu

SEQ ID NO: 2132682 - RNA, 14 nt, Staphylococcus aureus subsp. aureus N315
aucaugaaauaaaa

SEQ ID NO: 2132683 - RNA, 16 nt, Staphylococcus aureus subsp. aureus N315
aucaugaaauaaaaaa

SEQ ID NO: 2132684 - RNA, 20 nt, Staphylococcus aureus subsp. aureus N315
aucaucuuuuugaaauuucg

SEQ ID NO: 2132685 - RNA, 15 nt, Staphylococcus aureus subsp. aureus N315
aucaugcaaaacuaa

SEQ ID NO: 2132686 - RNA, 14 nt, Staphylococcus aureus subsp. aureus N315
aucaugcacaauau

SEQ ID NO: 2132687 - RNA, 21 nt, Staphylococcus aureus subsp. aureus N315
aucauggucaacuuuuuuaac

SEQ ID NO: 2132688 - RNA, 19 nt, Staphylococcus aureus subsp. aureus N315
aucaugccuucaugaauaa

SEQ ID NO: 2132689 - RNA, 13 nt, Staphylococcus aureus subsp. aureus N315
aucaugccuucau

SEQ ID NO: 2132690 - RNA, 18 nt, Staphylococcus aureus subsp. aureus N315
aucaugcuuuuaauauua

SEQ ID NO: 2132691 - RNA, 17 nt, Staphylococcus aureus subsp. aureus N315
aucaugcucguuuuuau

SEQ ID NO: 2132692 - RNA, 15 nt, Staphylococcus aureus subsp. aureus N315
aucauccauaaaaau

SEQ ID NO: 2132693 - RNA, 17 nt, Staphylococcus aureus subsp. aureus N315
aucaucacacucucccc

SEQ ID NO: 2132694 - RNA, 16 nt, Staphylococcus aureus subsp. aureus N315
aucaucuauauuuaau

SEQ ID NO: 2132695 - RNA, 19 nt, Staphylococcus aureus subsp. aureus N315
aucaucguauuucauauau

SEQ ID NO: 2132696 - RNA, 23 nt, Staphylococcus aureus subsp. aureus N315
aucaucuccuugguuauuaaaau

SEQ ID NO: 2132697 - RNA, 21 nt, Staphylococcus aureus subsp. aureus N315
aucaucucugcuuuaauauaa

SEQ ID NO: 2132698 - RNA, 18 nt, Staphylococcus aureus subsp. aureus N315
aucaucucugcuuuaaua

SEQ ID NO: 2132699 - RNA, 17 nt, Staphylococcus aureus subsp. aureus N315
aucaucgcaaauacaua

SEQ ID NO: 2132700 - RNA, 19 nt, Staphylococcus aureus subsp. aureus N315
aucaucgccaucccauuca

SEQ ID NO: 2132701 - RNA, 20 nt, Staphylococcus aureus subsp. aureus N315
aucaucgccaucccauucac

SEQ ID NO: 2132702 - RNA, 15 nt, Staphylococcus aureus subsp. aureus N315
aucauaugucuuaac

SEQ ID NO: 2132703 - RNA, 12 nt, Staphylococcus aureus subsp. aureus N315
aucauauauuuc

SEQ ID NO: 2132704 - RNA, 12 nt, Staphylococcus aureus subsp. aureus N315
aucauaucauac

SEQ ID NO: 2132705 - RNA, 16 nt, Staphylococcus aureus subsp. aureus N315
aucauagcauuaagau

SEQ ID NO: 2132706 - RNA, 23 nt, Staphylococcus aureus subsp. aureus N315
aucauauaaugguugaauaacac

SEQ ID NO: 2132707 - RNA, 17 nt, Staphylococcus aureus subsp. aureus N315
aucauauaaaucaaaua

SEQ ID NO: 2132708 - RNA, 16 nt, Staphylococcus aureus subsp. aureus N315
aucauacgagaaauua

SEQ ID NO: 2132709 - RNA, 15 nt, Staphylococcus aureus subsp. aureus N315
aucauacuucaauaa

SEQ ID NO: 2132710 - RNA, 19 nt, Staphylococcus aureus subsp. aureus N315
aucauaccagcaaguguau

SEQ ID NO: 2132711 - RNA, 16 nt, Staphylococcus aureus subsp. aureus N315
aucauaaucugcugcu

SEQ ID NO: 2132712 - RNA, 13 nt, Staphylococcus aureus subsp. aureus N315
aucauacgagaaa

SEQ ID NO: 2132713 - RNA, 17 nt, Staphylococcus aureus subsp. aureus N315
aucauaaucauaaaaau

SEQ ID NO: 2132714 - RNA, 16 nt, Staphylococcus aureus subsp. aureus N315
aucaguugagucaauu

SEQ ID NO: 2132715 - RNA, 18 nt, Staphylococcus aureus subsp. aureus N315
aucaguugagugauuuua

SEQ ID NO: 2132716 - RNA, 14 nt, Staphylococcus aureus subsp. aureus N315
aucaguuuuugaau

SEQ ID NO: 2132717 - RNA, 19 nt, Staphylococcus aureus subsp. aureus N315
aucaguuuuugaauauuug

SEQ ID NO: 2132718 - RNA, 13 nt, Staphylococcus aureus subsp. aureus N315
aucaguuuuuaaa

SEQ ID NO: 2132719 - RNA, 21 nt, Staphylococcus aureus subsp. aureus N315
aucaguuucaucaaguauaaa

SEQ ID NO: 2132720 - RNA, 13 nt, Staphylococcus aureus subsp. aureus N315
aucauaaagauaa

SEQ ID NO: 2132721 - RNA, 13 nt, Staphylococcus aureus subsp. aureus N315
aucagucauucac

SEQ ID NO: 2132722 - RNA, 18 nt, Staphylococcus aureus subsp. aureus N315
aucaguccgcuuuuucau

SEQ ID NO: 2132723 - RNA, 17 nt, Staphylococcus aureus subsp. aureus N315
aucaguccgcuuuuuca

SEQ ID NO: 2132724 - RNA, 19 nt, Staphylococcus aureus subsp. aureus N315
aucagugugauuuuggaac

SEQ ID NO: 2132725 - RNA, 12 nt, Staphylococcus aureus subsp. aureus N315
aucaguuauuuu

SEQ ID NO: 2132726 - RNA, 21 nt, Staphylococcus aureus subsp. aureus N315
aucaguuacugcgcuuuuaau

SEQ ID NO: 2132727 - RNA, 20 nt, Staphylococcus aureus subsp. aureus N315
aucaguauaaucagcaaugu

SEQ ID NO: 2132728 - RNA, 13 nt, Staphylococcus aureus subsp. aureus N315
aucaguaauaaua

SEQ ID NO: 2132729 - RNA, 23 nt, Staphylococcus aureus subsp. aureus N315
aucaaucgcuuuagcaauugaau

SEQ ID NO: 2132730 - RNA, 22 nt, Staphylococcus aureus subsp. aureus N315
aucaaucgcuuuagcaauugaa

SEQ ID NO: 2132731 - RNA, 17 nt, Staphylococcus aureus subsp. aureus N315
aucaauccaucaauacc

SEQ ID NO: 2132732 - RNA, 15 nt, Staphylococcus aureus subsp. aureus N315
aucaggaccaaauag

SEQ ID NO: 2132733 - RNA, 17 nt, Staphylococcus aureus subsp. aureus N315
augcgcuuguaacaagc

SEQ ID NO: 2132734 - RNA, 16 nt, Staphylococcus aureus subsp. aureus N315
augcaugcgcaaaagc

SEQ ID NO: 2132735 - RNA, 17 nt, Staphylococcus aureus subsp. aureus N315
augcaugcgcaaaagcg

SEQ ID NO: 2132736 - RNA, 24 nt, Staphylococcus aureus subsp. aureus N315
augcaugcgcaaaagcgcaggcga

SEQ ID NO: 2132737 - RNA, 13 nt, Staphylococcus aureus subsp. aureus N315
augcauucaauau

SEQ ID NO: 2132738 - RNA, 23 nt, Staphylococcus aureus subsp. aureus N315
augccaaauaacguuaauauaau

SEQ ID NO: 2132739 - RNA, 12 nt, Staphylococcus aureus subsp. aureus N315
augccaaauaac

SEQ ID NO: 2132740 - RNA, 15 nt, Staphylococcus aureus subsp. aureus N315
augcucguauagaaa

SEQ ID NO: 2132741 - RNA, 20 nt, Staphylococcus aureus subsp. aureus N315
augcucuauauauccauuca

SEQ ID NO: 2132742 - RNA, 19 nt, Staphylococcus aureus subsp. aureus N315
augcucucuucaaaguaga

SEQ ID NO: 2132743 - RNA, 21 nt, Staphylococcus aureus subsp. aureus N315
augcucuauauauccauucaa

SEQ ID NO: 2132744 - RNA, 21 nt, Staphylococcus aureus subsp. aureus N315
augcucccuucaaaguuuuca

SEQ ID NO: 2132745 - RNA, 18 nt, Staphylococcus aureus subsp. aureus N315
augcuagaaaguaaugcu

SEQ ID NO: 2132746 - RNA, 20 nt, Staphylococcus aureus subsp. aureus N315
augcucacuuuuuaaaguaa

SEQ ID NO: 2132747 - RNA, 14 nt, Staphylococcus aureus subsp. aureus N315
augcuuaucuguaa

SEQ ID NO: 2132748 - RNA, 14 nt, Staphylococcus aureus subsp. aureus N315
augcuucaaaaauu

SEQ ID NO: 2132749 - RNA, 15 nt, Staphylococcus aureus subsp. aureus N315
augcuuaaaaacaau

SEQ ID NO: 2132750 - RNA, 13 nt, Staphylococcus aureus subsp. aureus N315
augcuguacuaua

SEQ ID NO: 2132751 - RNA, 17 nt, Staphylococcus aureus subsp. aureus N315
augcuuuaauuaaaguu

SEQ ID NO: 2132752 - RNA, 14 nt, Staphylococcus aureus subsp. aureus N315
augcuuuaaaucga

SEQ ID NO: 2132753 - RNA, 17 nt, Staphylococcus aureus subsp. aureus N315
augcuuggacauauacu

SEQ ID NO: 2132754 - RNA, 16 nt, Staphylococcus aureus subsp. aureus N315
augcuucugguucuuc

SEQ ID NO: 2132755 - RNA, 19 nt, Staphylococcus aureus subsp. aureus N315
augcuucgcacaacugcau

SEQ ID NO: 2132756 - RNA, 22 nt, Staphylococcus aureus subsp. aureus N315
augcuuccuuuuuguuauaucu

SEQ ID NO: 2132757 - RNA, 17 nt, Staphylococcus aureus subsp. aureus N315
augcugaauaaauaacu

SEQ ID NO: 2132758 - RNA, 16 nt, Staphylococcus aureus subsp. aureus N315
augcucuuuagguaaa

SEQ ID NO: 2132759 - RNA, 17 nt, Staphylococcus aureus subsp. aureus N315
augcugcacauuccauc

SEQ ID NO: 2132760 - RNA, 21 nt, Staphylococcus aureus subsp. aureus N315
augcugcuucuucagguguuu

SEQ ID NO: 2132761 - RNA, 21 nt, Staphylococcus aureus subsp. aureus N315
auggaaguuguugcuuuggua

SEQ ID NO: 2132762 - RNA, 16 nt, Staphylococcus aureus subsp. aureus N315
auggaaaaguuuuuua

SEQ ID NO: 2132763 - RNA, 23 nt, Staphylococcus aureus subsp. aureus N315
augcuuuuuuuacaauaugauua

SEQ ID NO: 2132764 - RNA, 20 nt, Staphylococcus aureus subsp. aureus N315
augcuuuuuuuacaauauga

SEQ ID NO: 2132765 - RNA, 22 nt, Staphylococcus aureus subsp. aureus N315
auggauuacagcguacuaaaga

SEQ ID NO: 2132766 - RNA, 21 nt, Staphylococcus aureus subsp. aureus N315
auggaucauaaucauaaaaau

SEQ ID NO: 2132767 - RNA, 13 nt, Staphylococcus aureus subsp. aureus N315
auggauauucaau

SEQ ID NO: 2132768 - RNA, 16 nt, Staphylococcus aureus subsp. aureus N315
auggauacuuaaagau

SEQ ID NO: 2132769 - RNA, 16 nt, Staphylococcus aureus subsp. aureus N315
auggagcggaagauag

SEQ ID NO: 2132770 - RNA, 22 nt, Staphylococcus aureus subsp. aureus N315
auggacuaagauauaaggaaaa

SEQ ID NO: 2132771 - RNA, 13 nt, Staphylococcus aureus subsp. aureus N315
auggagcaugauu

SEQ ID NO: 2132772 - RNA, 16 nt, Staphylococcus aureus subsp. aureus N315
auggacaguuuuuaua

SEQ ID NO: 2132773 - RNA, 14 nt, Staphylococcus aureus subsp. aureus N315
augucuaaaaaugu

SEQ ID NO: 2132774 - RNA, 22 nt, Staphylococcus aureus subsp. aureus N315
augucuuaggcgcuacaauguu

SEQ ID NO: 2132775 - RNA, 13 nt, Staphylococcus aureus subsp. aureus N315
augucuuaaaauu

SEQ ID NO: 2132776 - RNA, 23 nt, Staphylococcus aureus subsp. aureus N315
augucuuaaaauugaauaucacu

SEQ ID NO: 2132777 - RNA, 15 nt, Staphylococcus aureus subsp. aureus N315
augugcuaccuacuu

SEQ ID NO: 2132778 - RNA, 15 nt, Staphylococcus aureus subsp. aureus N315
augugccuuugcuuu

SEQ ID NO: 2132779 - RNA, 17 nt, Staphylococcus aureus subsp. aureus N315
auguguaugauagaaua

SEQ ID NO: 2132780 - RNA, 14 nt, Staphylococcus aureus subsp. aureus N315
auguuacugaugaa

SEQ ID NO: 2132781 - RNA, 13 nt, Staphylococcus aureus subsp. aureus N315
auguuacugauga

SEQ ID NO: 2132782 - RNA, 20 nt, Staphylococcus aureus subsp. aureus N315
auguuaucgauauagcauaa

SEQ ID NO: 2132783 - RNA, 21 nt, Staphylococcus aureus subsp. aureus N315
auguuauauuaaacuuauaac

SEQ ID NO: 2132784 - RNA, 18 nt, Staphylococcus aureus subsp. aureus N315
auguuagugacaagguau

SEQ ID NO: 2132785 - RNA, 15 nt, Staphylococcus aureus subsp. aureus N315
auguuauaaaaugaa

SEQ ID NO: 2132786 - RNA, 24 nt, Staphylococcus aureus subsp. aureus N315
auguguuaaucaacguauauaagu

SEQ ID NO: 2132787 - RNA, 22 nt, Staphylococcus aureus subsp. aureus N315
auguguuaaucaacguauauaa

SEQ ID NO: 2132788 - RNA, 18 nt, Staphylococcus aureus subsp. aureus N315
auguguuaaaauauauuu

SEQ ID NO: 2132789 - RNA, 22 nt, Staphylococcus aureus subsp. aureus N315
augugucauaauccauucuucu

SEQ ID NO: 2132790 - RNA, 18 nt, Staphylococcus aureus subsp. aureus N315
augugucauaauccauuc

SEQ ID NO: 2132791 - RNA, 20 nt, Staphylococcus aureus subsp. aureus N315
augugucauaauccauucuu

SEQ ID NO: 2132792 - RNA, 19 nt, Staphylococcus aureus subsp. aureus N315
auguuacacaaauuaaaac

SEQ ID NO: 2132793 - RNA, 13 nt, Staphylococcus aureus subsp. aureus N315
auguguugcauua

SEQ ID NO: 2132794 - RNA, 22 nt, Staphylococcus aureus subsp. aureus N315
auguucccuuaccauuucuuca

SEQ ID NO: 2132795 - RNA, 18 nt, Staphylococcus aureus subsp. aureus N315
auguuccccauuaauuaa

SEQ ID NO: 2132796 - RNA, 20 nt, Staphylococcus aureus subsp. aureus N315
auguuccuuguuuuaaacuu

SEQ ID NO: 2132797 - RNA, 21 nt, Staphylococcus aureus subsp. aureus N315
augucagucguuguaaaacua

SEQ ID NO: 2132798 - RNA, 16 nt, Staphylococcus aureus subsp. aureus N315
augucacauaugacuu

SEQ ID NO: 2132799 - RNA, 19 nt, Staphylococcus aureus subsp. aureus N315
augucaauuuuuucaugau

SEQ ID NO: 2132800 - RNA, 14 nt, Staphylococcus aureus subsp. aureus N315
auguauuuauuacu

SEQ ID NO: 2132801 - RNA, 23 nt, Staphylococcus aureus subsp. aureus N315
augucauaucuuuauuugauucu

SEQ ID NO: 2132802 - RNA, 16 nt, Staphylococcus aureus subsp. aureus N315
augucauagccuauuu

SEQ ID NO: 2132803 - RNA, 15 nt, Staphylococcus aureus subsp. aureus N315
augucaugaaaauaa

SEQ ID NO: 2132804 - RNA, 22 nt, Staphylococcus aureus subsp. aureus N315
auguagaauuucuuuucgaaaa

SEQ ID NO: 2132805 - RNA, 22 nt, Staphylococcus aureus subsp. aureus N315
auguaccacucauaaucaaguc

SEQ ID NO: 2132806 - RNA, 20 nt, Staphylococcus aureus subsp. aureus N315
auguacacgagucauuaaau

SEQ ID NO: 2132807 - RNA, 14 nt, Staphylococcus aureus subsp. aureus N315
auguacaauuuuuu

SEQ ID NO: 2132808 - RNA, 16 nt, Staphylococcus aureus subsp. aureus N315
auguaauuauuuuucu

SEQ ID NO: 2132809 - RNA, 18 nt, Staphylococcus aureus subsp. aureus N315
auguaaaugaaauaggcg

SEQ ID NO: 2132810 - RNA, 21 nt, Staphylococcus aureus subsp. aureus N315
augguuaucacuuauuauuuu

SEQ ID NO: 2132811 - RNA, 17 nt, Staphylococcus aureus subsp. aureus N315
auguaaauaguuaguuu

SEQ ID NO: 2132812 - RNA, 19 nt, Staphylococcus aureus subsp. aureus N315
augguugauucgauaugaa

SEQ ID NO: 2132813 - RNA, 22 nt, Staphylococcus aureus subsp. aureus N315
augguaucuuuaauuucauuua

SEQ ID NO: 2132814 - RNA, 22 nt, Staphylococcus aureus subsp. aureus N315
augguauuuacccaacauauca

SEQ ID NO: 2132815 - RNA, 17 nt, Staphylococcus aureus subsp. aureus N315
auggguaaucuuuagga

SEQ ID NO: 2132816 - RNA, 18 nt, Staphylococcus aureus subsp. aureus N315
auggcuugguuauuuuca

SEQ ID NO: 2132817 - RNA, 22 nt, Staphylococcus aureus subsp. aureus N315
auggcuuagguuuaauuuuaaa

SEQ ID NO: 2132818 - RNA, 14 nt, Staphylococcus aureus subsp. aureus N315
auggauuucuuauu

SEQ ID NO: 2132819 - RNA, 20 nt, Staphylococcus aureus subsp. aureus N315
auggauuuggucaaguuuug

SEQ ID NO: 2132820 - RNA, 17 nt, Staphylococcus aureus subsp. aureus N315
auggcaaucuauauaaa

SEQ ID NO: 2132821 - RNA, 21 nt, Staphylococcus aureus subsp. aureus N315
auggcgcaauuuuuaacaaaa

SEQ ID NO: 2132822 - RNA, 20 nt, Staphylococcus aureus subsp. aureus N315
auggcugcaucaauaugacc

SEQ ID NO: 2132823 - RNA, 17 nt, Staphylococcus aureus subsp. aureus N315
auggcugcaucaauaug

SEQ ID NO: 2132824 - RNA, 14 nt, Staphylococcus aureus subsp. aureus N315
auggcugcaacaau

SEQ ID NO: 2132825 - RNA, 16 nt, Staphylococcus aureus subsp. aureus N315
augauugcauugauuu

SEQ ID NO: 2132826 - RNA, 14 nt, Staphylococcus aureus subsp. aureus N315
augauucguauuca

SEQ ID NO: 2132827 - RNA, 16 nt, Staphylococcus aureus subsp. aureus N315
augauucguauucaaa

SEQ ID NO: 2132828 - RNA, 20 nt, Staphylococcus aureus subsp. aureus N315
augcacaucauugauagaua

SEQ ID NO: 2132829 - RNA, 22 nt, Staphylococcus aureus subsp. aureus N315
augauuuuuauuauugucauca

SEQ ID NO: 2132830 - RNA, 18 nt, Staphylococcus aureus subsp. aureus N315
augauuuuuaaaaauaca

SEQ ID NO: 2132831 - RNA, 21 nt, Staphylococcus aureus subsp. aureus N315
augcauacacuugauuaucau

SEQ ID NO: 2132832 - RNA, 14 nt, Staphylococcus aureus subsp. aureus N315
augcacuuuauuaa

SEQ ID NO: 2132833 - RNA, 21 nt, Staphylococcus aureus subsp. aureus N315
augcacgcgugccaacaucuu

SEQ ID NO: 2132834 - RNA, 21 nt, Staphylococcus aureus subsp. aureus N315
augauuaaaguguuucaacau

SEQ ID NO: 2132835 - RNA, 16 nt, Staphylococcus aureus subsp. aureus N315
augauuacuuuaagau

SEQ ID NO: 2132836 - RNA, 23 nt, Staphylococcus aureus subsp. aureus N315
augauuacguugguuuaaaaauu

SEQ ID NO: 2132837 - RNA, 18 nt, Staphylococcus aureus subsp. aureus N315
augauuacaacuuauucu

SEQ ID NO: 2132838 - RNA, 14 nt, Staphylococcus aureus subsp. aureus N315
augauuaguaauga

SEQ ID NO: 2132839 - RNA, 19 nt, Staphylococcus aureus subsp. aureus N315
augauuacuccaauuacca

SEQ ID NO: 2132840 - RNA, 20 nt, Staphylococcus aureus subsp. aureus N315
augauuauguuaaugucuua

SEQ ID NO: 2132841 - RNA, 16 nt, Staphylococcus aureus subsp. aureus N315
augaugcgaaaccuuu

SEQ ID NO: 2132842 - RNA, 14 nt, Staphylococcus aureus subsp. aureus N315
augaugauuuaagu

SEQ ID NO: 2132843 - RNA, 15 nt, Staphylococcus aureus subsp. aureus N315
augaugauaaauuga

SEQ ID NO: 2132844 - RNA, 16 nt, Staphylococcus aureus subsp. aureus N315
augauauuacauauaa

SEQ ID NO: 2132845 - RNA, 16 nt, Staphylococcus aureus subsp. aureus N315
augauauugaaagugu

SEQ ID NO: 2132846 - RNA, 17 nt, Staphylococcus aureus subsp. aureus N315
augauaucuuuuccaaa

SEQ ID NO: 2132847 - RNA, 17 nt, Staphylococcus aureus subsp. aureus N315
augauauuuaacaaaau

SEQ ID NO: 2132848 - RNA, 16 nt, Staphylococcus aureus subsp. aureus N315
augauauuuaacaaaa

SEQ ID NO: 2132849 - RNA, 15 nt, Staphylococcus aureus subsp. aureus N315
augauauuuaacaaa

SEQ ID NO: 2132850 - RNA, 20 nt, Staphylococcus aureus subsp. aureus N315
augaucccaaaaucgcaaau

SEQ ID NO: 2132851 - RNA, 15 nt, Staphylococcus aureus subsp. aureus N315
augauaauuaaugcc

SEQ ID NO: 2132852 - RNA, 18 nt, Staphylococcus aureus subsp. aureus N315
augauaauuaaugccauu

SEQ ID NO: 2132853 - RNA, 12 nt, Staphylococcus aureus subsp. aureus N315
augauacauuau

SEQ ID NO: 2132854 - RNA, 14 nt, Staphylococcus aureus subsp. aureus N315
augauaauaagaau

SEQ ID NO: 2132855 - RNA, 22 nt, Staphylococcus aureus subsp. aureus N315
augauaauccaccaaauacagu

SEQ ID NO: 2132856 - RNA, 16 nt, Staphylococcus aureus subsp. aureus N315
augauagcuaaacauu

SEQ ID NO: 2132857 - RNA, 22 nt, Staphylococcus aureus subsp. aureus N315
augauaguguaugaauggcaau

SEQ ID NO: 2132858 - RNA, 21 nt, Staphylococcus aureus subsp. aureus N315
augauauacuugaagaaaagu

SEQ ID NO: 2132859 - RNA, 18 nt, Staphylococcus aureus subsp. aureus N315
augauacgugguuuuauu

SEQ ID NO: 2132860 - RNA, 19 nt, Staphylococcus aureus subsp. aureus N315
augauacguacguugaugu

SEQ ID NO: 2132861 - RNA, 21 nt, Staphylococcus aureus subsp. aureus N315
augauacgcuuuuuaaaaaau

SEQ ID NO: 2132862 - RNA, 18 nt, Staphylococcus aureus subsp. aureus N315
augauacgcuuuuuaaaa

SEQ ID NO: 2132863 - RNA, 18 nt, Staphylococcus aureus subsp. aureus N315
augauacucaauaaaauu

SEQ ID NO: 2132864 - RNA, 15 nt, Staphylococcus aureus subsp. aureus N315
augauagauuuagga

SEQ ID NO: 2132865 - RNA, 19 nt, Staphylococcus aureus subsp. aureus N315
augagcuucuuuaaauaca

SEQ ID NO: 2132866 - RNA, 14 nt, Staphylococcus aureus subsp. aureus N315
augacuaacgaaaa

SEQ ID NO: 2132867 - RNA, 14 nt, Staphylococcus aureus subsp. aureus N315
augacgugcuuuua

SEQ ID NO: 2132868 - RNA, 16 nt, Staphylococcus aureus subsp. aureus N315
augacgugcuuuuaaa

SEQ ID NO: 2132869 - RNA, 23 nt, Staphylococcus aureus subsp. aureus N315
augacuaugcaaaugaaauucuu

SEQ ID NO: 2132870 - RNA, 18 nt, Staphylococcus aureus subsp. aureus N315
augacugagaaaaauauu

SEQ ID NO: 2132871 - RNA, 20 nt, Staphylococcus aureus subsp. aureus N315
augacugagaaaaauauuuc

SEQ ID NO: 2132872 - RNA, 15 nt, Staphylococcus aureus subsp. aureus N315
augacuauuuuccau

SEQ ID NO: 2132873 - RNA, 13 nt, Staphylococcus aureus subsp. aureus N315
augacucacuaau

SEQ ID NO: 2132874 - RNA, 15 nt, Staphylococcus aureus subsp. aureus N315
augaacaacaaauug

SEQ ID NO: 2132875 - RNA, 13 nt, Staphylococcus aureus subsp. aureus N315
augaaccaaaaaa

SEQ ID NO: 2132876 - RNA, 22 nt, Staphylococcus aureus subsp. aureus N315
augaaccagcuaaccaaauaau

SEQ ID NO: 2132877 - RNA, 16 nt, Staphylococcus aureus subsp. aureus N315
augaauuuuaauauau

SEQ ID NO: 2132878 - RNA, 22 nt, Staphylococcus aureus subsp. aureus N315
augaauuuuaauauauuuggag

SEQ ID NO: 2132879 - RNA, 18 nt, Staphylococcus aureus subsp. aureus N315
augaauuuuauaaauuaa

SEQ ID NO: 2132880 - RNA, 13 nt, Staphylococcus aureus subsp. aureus N315
augaauuuuauaa

SEQ ID NO: 2132881 - RNA, 14 nt, Staphylococcus aureus subsp. aureus N315
augaauuuuauaaa

SEQ ID NO: 2132882 - RNA, 16 nt, Staphylococcus aureus subsp. aureus N315
augacaccuaauacca

SEQ ID NO: 2132883 - RNA, 15 nt, Staphylococcus aureus subsp. aureus N315
augaccauugucaug

SEQ ID NO: 2132884 - RNA, 22 nt, Staphylococcus aureus subsp. aureus N315
augaccauugucaugccuucau

SEQ ID NO: 2132885 - RNA, 14 nt, Staphylococcus aureus subsp. aureus N315
aucuuuuuaaaagg

SEQ ID NO: 2132886 - RNA, 14 nt, Staphylococcus aureus subsp. aureus N315
aucuuuuugaaauu

SEQ ID NO: 2132887 - RNA, 19 nt, Staphylococcus aureus subsp. aureus N315
aucuuuguuauauuuuuag

SEQ ID NO: 2132888 - RNA, 20 nt, Staphylococcus aureus subsp. aureus N315
aucuuuguaaccuaaaaaca

SEQ ID NO: 2132889 - RNA, 15 nt, Staphylococcus aureus subsp. aureus N315
aucuuucuuuguguu

SEQ ID NO: 2132890 - RNA, 19 nt, Staphylococcus aureus subsp. aureus N315
aucuuuauuugauucuuca

SEQ ID NO: 2132891 - RNA, 19 nt, Staphylococcus aureus subsp. aureus N315
aucuuuaucaguuuguccu

SEQ ID NO: 2132892 - RNA, 22 nt, Staphylococcus aureus subsp. aureus N315
aucuuuagagacuuauuuuaua

SEQ ID NO: 2132893 - RNA, 14 nt, Staphylococcus aureus subsp. aureus N315
augaaauucuuuug

SEQ ID NO: 2132894 - RNA, 14 nt, Staphylococcus aureus subsp. aureus N315
augaacaaaauaac

SEQ ID NO: 2132895 - RNA, 19 nt, Staphylococcus aureus subsp. aureus N315
augaacaaaaaauaaaaac

SEQ ID NO: 2132896 - RNA, 18 nt, Staphylococcus aureus subsp. aureus N315
augaacaaaauaacaugu

SEQ ID NO: 2132897 - RNA, 16 nt, Staphylococcus aureus subsp. aureus N315
augaaauuagauuuua

SEQ ID NO: 2132898 - RNA, 13 nt, Staphylococcus aureus subsp. aureus N315
augaaaaaguaaa

SEQ ID NO: 2132899 - RNA, 14 nt, Staphylococcus aureus subsp. aureus N315
aucuuuuuuuuuau

SEQ ID NO: 2132900 - RNA, 23 nt, Staphylococcus aureus subsp. aureus N315
aucuucguauaguacuaaaagua

SEQ ID NO: 2132901 - RNA, 22 nt, Staphylococcus aureus subsp. aureus N315
aucuucguauaguacuaaaagu

SEQ ID NO: 2132902 - RNA, 23 nt, Staphylococcus aureus subsp. aureus N315
aucuucgacuacaaguuuauaau

SEQ ID NO: 2132903 - RNA, 16 nt, Staphylococcus aureus subsp. aureus N315
aucuucccaucuuuua

SEQ ID NO: 2132904 - RNA, 21 nt, Staphylococcus aureus subsp. aureus N315
aucuugcuuggauaauugcau

SEQ ID NO: 2132905 - RNA, 20 nt, Staphylococcus aureus subsp. aureus N315
aucuugcuuauugauauaag

SEQ ID NO: 2132906 - RNA, 21 nt, Staphylococcus aureus subsp. aureus N315
aucuugucuaguucgauuuuu

SEQ ID NO: 2132907 - RNA, 19 nt, Staphylococcus aureus subsp. aureus N315
aucuugauuauauuuuucu

SEQ ID NO: 2132908 - RNA, 17 nt, Staphylococcus aureus subsp. aureus N315
aucuucuaguaauucuu

SEQ ID NO: 2132909 - RNA, 14 nt, Staphylococcus aureus subsp. aureus N315
aucuucucauaaaa

SEQ ID NO: 2132910 - RNA, 18 nt, Staphylococcus aureus subsp. aureus N315
aucuucuaaaucaauaua

SEQ ID NO: 2132911 - RNA, 14 nt, Staphylococcus aureus subsp. aureus N315
aucuucuaauucca

SEQ ID NO: 2132912 - RNA, 23 nt, Staphylococcus aureus subsp. aureus N315
aucuucuaauucguuuugcuaac

SEQ ID NO: 2132913 - RNA, 16 nt, Staphylococcus aureus subsp. aureus N315
aucuugauuuaaacca

SEQ ID NO: 2132914 - RNA, 13 nt, Staphylococcus aureus subsp. aureus N315
aucuaauaaauau

SEQ ID NO: 2132915 - RNA, 16 nt, Staphylococcus aureus subsp. aureus N315
aucuaacuggaaauga

SEQ ID NO: 2132916 - RNA, 16 nt, Staphylococcus aureus subsp. aureus N315
aucuaauucguaauuu

SEQ ID NO: 2132917 - RNA, 22 nt, Staphylococcus aureus subsp. aureus N315
aucuaauucuguuucaaagcug

SEQ ID NO: 2132918 - RNA, 14 nt, Staphylococcus aureus subsp. aureus N315
aucuaauucguaau

SEQ ID NO: 2132919 - RNA, 19 nt, Staphylococcus aureus subsp. aureus N315
aucuaauuauucaugaauc

SEQ ID NO: 2132920 - RNA, 20 nt, Staphylococcus aureus subsp. aureus N315
aucuaaugggucaaugacug

SEQ ID NO: 2132921 - RNA, 13 nt, Staphylococcus aureus subsp. aureus N315
aucuguaucaaaa

SEQ ID NO: 2132922 - RNA, 20 nt, Staphylococcus aureus subsp. aureus N315
aucuguccgacuuaauauug

SEQ ID NO: 2132923 - RNA, 19 nt, Staphylococcus aureus subsp. aureus N315
aucuguaccguauuuuaau

SEQ ID NO: 2132924 - RNA, 18 nt, Staphylococcus aureus subsp. aureus N315
aucuguaacauaaacaau

SEQ ID NO: 2132925 - RNA, 22 nt, Staphylococcus aureus subsp. aureus N315
aucuguaacaaagucucuagua

SEQ ID NO: 2132926 - RNA, 14 nt, Staphylococcus aureus subsp. aureus N315
aucuguaacauaaa

SEQ ID NO: 2132927 - RNA, 21 nt, Staphylococcus aureus subsp. aureus N315
aucuguaaauaacuuauggua

SEQ ID NO: 2132928 - RNA, 20 nt, Staphylococcus aureus subsp. aureus N315
aucuuacugcugcuuuuaau

SEQ ID NO: 2132929 - RNA, 20 nt, Staphylococcus aureus subsp. aureus N315
aucuuacugcuguucucuau

SEQ ID NO: 2132930 - RNA, 16 nt, Staphylococcus aureus subsp. aureus N315
aucuuacuacuuaauu

SEQ ID NO: 2132931 - RNA, 21 nt, Staphylococcus aureus subsp. aureus N315
aucuuacugcuuuuuuaaauu

SEQ ID NO: 2132932 - RNA, 20 nt, Staphylococcus aureus subsp. aureus N315
aucuuacugcuguuuuuuau

SEQ ID NO: 2132933 - RNA, 21 nt, Staphylococcus aureus subsp. aureus N315
aucuuagacgcuguuuuaaau

SEQ ID NO: 2132934 - RNA, 19 nt, Staphylococcus aureus subsp. aureus N315
aucuuagacgcuguuuuaa

SEQ ID NO: 2132935 - RNA, 20 nt, Staphylococcus aureus subsp. aureus N315
aucuuaggugucaucgcuuu

SEQ ID NO: 2132936 - RNA, 22 nt, Staphylococcus aureus subsp. aureus N315
aucuuauaacaaaaauugcuau

SEQ ID NO: 2132937 - RNA, 16 nt, Staphylococcus aureus subsp. aureus N315
aucuguugucaucaug

SEQ ID NO: 2132938 - RNA, 22 nt, Staphylococcus aureus subsp. aureus N315
aucuuaaagcauaucucaagau

SEQ ID NO: 2132939 - RNA, 13 nt, Staphylococcus aureus subsp. aureus N315
aucuuaaaacaac

SEQ ID NO: 2132940 - RNA, 18 nt, Staphylococcus aureus subsp. aureus N315
aucuuaacaacuuuaauu

SEQ ID NO: 2132941 - RNA, 23 nt, Staphylococcus aureus subsp. aureus N315
aucuuaacaacuuuaauuuuuca

SEQ ID NO: 2132942 - RNA, 14 nt, Staphylococcus aureus subsp. aureus N315
aucuucaguauaga

SEQ ID NO: 2132943 - RNA, 18 nt, Staphylococcus aureus subsp. aureus N315
aucuucacgcuuauucga

SEQ ID NO: 2132944 - RNA, 23 nt, Staphylococcus aureus subsp. aureus N315
aucuucaacauaacucaaauauc

SEQ ID NO: 2132945 - RNA, 22 nt, Staphylococcus aureus subsp. aureus N315
aucuucaacauaacucaaauau

SEQ ID NO: 2132946 - RNA, 22 nt, Staphylococcus aureus subsp. aureus N315
aucuucaacuucgauaugauua

SEQ ID NO: 2132947 - RNA, 18 nt, Staphylococcus aureus subsp. aureus N315
aucuuaugacugcuuuuu

SEQ ID NO: 2132948 - RNA, 21 nt, Staphylococcus aureus subsp. aureus N315
auaugcuuguugugaauaaaa

SEQ ID NO: 2132949 - RNA, 23 nt, Staphylococcus aureus subsp. aureus N315
auaugcuguuggcaaaacaauau

SEQ ID NO: 2132950 - RNA, 20 nt, Staphylococcus aureus subsp. aureus N315
auaugcuauauuuaguuaau

SEQ ID NO: 2132951 - RNA, 14 nt, Staphylococcus aureus subsp. aureus N315
auauggauuuugaa

SEQ ID NO: 2132952 - RNA, 23 nt, Staphylococcus aureus subsp. aureus N315
auauggcaucaucaccauacuaa

SEQ ID NO: 2132953 - RNA, 16 nt, Staphylococcus aureus subsp. aureus N315
auauggaauacuacac

SEQ ID NO: 2132954 - RNA, 15 nt, Staphylococcus aureus subsp. aureus N315
auauggaaaauguau

SEQ ID NO: 2132955 - RNA, 13 nt, Staphylococcus aureus subsp. aureus N315
auaugcaucaaca

SEQ ID NO: 2132956 - RNA, 18 nt, Staphylococcus aureus subsp. aureus N315
auaugauugcaaauuauc

SEQ ID NO: 2132957 - RNA, 15 nt, Staphylococcus aureus subsp. aureus N315
auaugauugaaugaa

SEQ ID NO: 2132958 - RNA, 17 nt, Staphylococcus aureus subsp. aureus N315
auaugauugcaaauuau

SEQ ID NO: 2132959 - RNA, 21 nt, Staphylococcus aureus subsp. aureus N315
auaugacgcgugaauuaaaaa

SEQ ID NO: 2132960 - RNA, 17 nt, Staphylococcus aureus subsp. aureus N315
auaugacgcgugaauua

SEQ ID NO: 2132961 - RNA, 13 nt, Staphylococcus aureus subsp. aureus N315
auaugaauugagu

SEQ ID NO: 2132962 - RNA, 21 nt, Staphylococcus aureus subsp. aureus N315
auaugaagcguuuuuauuaca

SEQ ID NO: 2132963 - RNA, 14 nt, Staphylococcus aureus subsp. aureus N315
auaugaauaaccau

SEQ ID NO: 2132964 - RNA, 20 nt, Staphylococcus aureus subsp. aureus N315
auaugaaucuagaauauaac

SEQ ID NO: 2132965 - RNA, 15 nt, Staphylococcus aureus subsp. aureus N315
auaucucaagauauc

SEQ ID NO: 2132966 - RNA, 12 nt, Staphylococcus aureus subsp. aureus N315
auaucucaagau

SEQ ID NO: 2132967 - RNA, 14 nt, Staphylococcus aureus subsp. aureus N315
auaucucaaagauu

SEQ ID NO: 2132968 - RNA, 14 nt, Staphylococcus aureus subsp. aureus N315
auaucuauuuuucg

SEQ ID NO: 2132969 - RNA, 14 nt, Staphylococcus aureus subsp. aureus N315
auaucucaagauau

SEQ ID NO: 2132970 - RNA, 17 nt, Staphylococcus aureus subsp. aureus N315
auaucgcgcaucaaaaa

SEQ ID NO: 2132971 - RNA, 19 nt, Staphylococcus aureus subsp. aureus N315
auauauguaacauaaagcu

SEQ ID NO: 2132972 - RNA, 18 nt, Staphylococcus aureus subsp. aureus N315
auaucauauucaaaauaa

SEQ ID NO: 2132973 - RNA, 15 nt, Staphylococcus aureus subsp. aureus N315
auauauguaacauaa

SEQ ID NO: 2132974 - RNA, 16 nt, Staphylococcus aureus subsp. aureus N315
auauauguaacauaaa

SEQ ID NO: 2132975 - RNA, 12 nt, Staphylococcus aureus subsp. aureus N315
auauaucaaaua

SEQ ID NO: 2132976 - RNA, 16 nt, Staphylococcus aureus subsp. aureus N315
auauaucaacguuaau

SEQ ID NO: 2132977 - RNA, 18 nt, Staphylococcus aureus subsp. aureus N315
auauauccugccaauaua

SEQ ID NO: 2132978 - RNA, 17 nt, Staphylococcus aureus subsp. aureus N315
auauccauuaugaugua

SEQ ID NO: 2132979 - RNA, 16 nt, Staphylococcus aureus subsp. aureus N315
auaucauauaaugguu

SEQ ID NO: 2132980 - RNA, 18 nt, Staphylococcus aureus subsp. aureus N315
auaucaucaaguuuaucu

SEQ ID NO: 2132981 - RNA, 12 nt, Staphylococcus aureus subsp. aureus N315
auaucauccaca

SEQ ID NO: 2132982 - RNA, 23 nt, Staphylococcus aureus subsp. aureus N315
auaucaugcuuaucuguaaauaa

SEQ ID NO: 2132983 - RNA, 12 nt, Staphylococcus aureus subsp. aureus N315
auagugaaauua

SEQ ID NO: 2132984 - RNA, 14 nt, Staphylococcus aureus subsp. aureus N315
auaguuaccaaaau

SEQ ID NO: 2132985 - RNA, 16 nt, Staphylococcus aureus subsp. aureus N315
auaguuaagauuuuaa

SEQ ID NO: 2132986 - RNA, 20 nt, Staphylococcus aureus subsp. aureus N315
auaguuaagauuuuaacuuc

SEQ ID NO: 2132987 - RNA, 18 nt, Staphylococcus aureus subsp. aureus N315
auaguccggggccccaac

SEQ ID NO: 2132988 - RNA, 14 nt, Staphylococcus aureus subsp. aureus N315
auaguccuucccac

SEQ ID NO: 2132989 - RNA, 19 nt, Staphylococcus aureus subsp. aureus N315
auagucuucggcuuuguaa

SEQ ID NO: 2132990 - RNA, 20 nt, Staphylococcus aureus subsp. aureus N315
auaguucuuuaaauuauaua

SEQ ID NO: 2132991 - RNA, 21 nt, Staphylococcus aureus subsp. aureus N315
auauaaaggaauagcuacaau

SEQ ID NO: 2132992 - RNA, 22 nt, Staphylococcus aureus subsp. aureus N315
auauaaagaaauaauuuaaagg

SEQ ID NO: 2132993 - RNA, 14 nt, Staphylococcus aureus subsp. aureus N315
auagccuucaaaau

SEQ ID NO: 2132994 - RNA, 20 nt, Staphylococcus aureus subsp. aureus N315
auaguccgcguguacuuuac

SEQ ID NO: 2132995 - RNA, 14 nt, Staphylococcus aureus subsp. aureus N315
auagucaucuguua

SEQ ID NO: 2132996 - RNA, 17 nt, Staphylococcus aureus subsp. aureus N315
auaguauuaacuauaaa

SEQ ID NO: 2132997 - RNA, 13 nt, Staphylococcus aureus subsp. aureus N315
auauaaauaggca

SEQ ID NO: 2132998 - RNA, 19 nt, Staphylococcus aureus subsp. aureus N315
auauaaaucaaauauacuu

SEQ ID NO: 2132999 - RNA, 16 nt, Staphylococcus aureus subsp. aureus N315
auauaaguauaaugau

SEQ ID NO: 2133000 - RNA, 14 nt, Staphylococcus aureus subsp. aureus N315
auauaauagaaaua

SEQ ID NO: 2133001 - RNA, 22 nt, Staphylococcus aureus subsp. aureus N315
auauaaugcugauaauuuuucu

SEQ ID NO: 2133002 - RNA, 15 nt, Staphylococcus aureus subsp. aureus N315
auauacgacauuuuu

SEQ ID NO: 2133003 - RNA, 20 nt, Staphylococcus aureus subsp. aureus N315
auauacgacauuuuuagaca

SEQ ID NO: 2133004 - RNA, 21 nt, Staphylococcus aureus subsp. aureus N315
auauacccagaugaauuuuua

SEQ ID NO: 2133005 - RNA, 16 nt, Staphylococcus aureus subsp. aureus N315
auauacgacaaucaca

SEQ ID NO: 2133006 - RNA, 18 nt, Staphylococcus aureus subsp. aureus N315
auauagcggugucaauau

SEQ ID NO: 2133007 - RNA, 21 nt, Staphylococcus aureus subsp. aureus N315
auauagcgcgcuuauugaaaa

SEQ ID NO: 2133008 - RNA, 15 nt, Staphylococcus aureus subsp. aureus N315
auauagcauaaaauu

SEQ ID NO: 2133009 - RNA, 14 nt, Staphylococcus aureus subsp. aureus N315
auauaguuggcaau

SEQ ID NO: 2133010 - RNA, 17 nt, Staphylococcus aureus subsp. aureus N315
auauagucuaugaauaa

SEQ ID NO: 2133011 - RNA, 15 nt, Staphylococcus aureus subsp. aureus N315
auauaguugaucaaa

SEQ ID NO: 2133012 - RNA, 19 nt, Staphylococcus aureus subsp. aureus N315
auauaguggugguacuuuu

SEQ ID NO: 2133013 - RNA, 18 nt, Staphylococcus aureus subsp. aureus N315
auauauaaggcgcucucu

SEQ ID NO: 2133014 - RNA, 11 nt, Staphylococcus aureus subsp. aureus N315
auauauaaaag

SEQ ID NO: 2133015 - RNA, 16 nt, Staphylococcus aureus subsp. aureus N315
auauauaaagaaauaa

SEQ ID NO: 2133016 - RNA, 14 nt, Staphylococcus aureus subsp. aureus N315
auauauauauuaaa

SEQ ID NO: 2133017 - RNA, 11 nt, Staphylococcus aureus subsp. aureus N315
auauauauucg

SEQ ID NO: 2133018 - RNA, 13 nt, Staphylococcus aureus subsp. aureus N315
auauauagauuaa

SEQ ID NO: 2133019 - RNA, 22 nt, Staphylococcus aureus subsp. aureus N315
auauuaaugaauauaggcacau

SEQ ID NO: 2133020 - RNA, 13 nt, Staphylococcus aureus subsp. aureus N315
auauuaauuuuac

SEQ ID NO: 2133021 - RNA, 17 nt, Staphylococcus aureus subsp. aureus N315
auauuaauauaaaauaa

SEQ ID NO: 2133022 - RNA, 15 nt, Staphylococcus aureus subsp. aureus N315
auauuaauagaaagu

SEQ ID NO: 2133023 - RNA, 13 nt, Staphylococcus aureus subsp. aureus N315
auauuaaauuucu

SEQ ID NO: 2133024 - RNA, 19 nt, Staphylococcus aureus subsp. aureus N315
auauuaacguuaguauaaa

SEQ ID NO: 2133025 - RNA, 14 nt, Staphylococcus aureus subsp. aureus N315
auauuaacaccaga

SEQ ID NO: 2133026 - RNA, 13 nt, Staphylococcus aureus subsp. aureus N315
auauuaaaguaaa

SEQ ID NO: 2133027 - RNA, 18 nt, Staphylococcus aureus subsp. aureus N315
auauuaaauuauggagcg

SEQ ID NO: 2133028 - RNA, 21 nt, Staphylococcus aureus subsp. aureus N315
auauuaauuuuacguuuauuu

SEQ ID NO: 2133029 - RNA, 14 nt, Staphylococcus aureus subsp. aureus N315
auauuaauugaaaa

SEQ ID NO: 2133030 - RNA, 19 nt, Staphylococcus aureus subsp. aureus N315
auauuacuuuggaaauuua

SEQ ID NO: 2133031 - RNA, 22 nt, Staphylococcus aureus subsp. aureus N315
auauuacuaaccuauuaaaaua

SEQ ID NO: 2133032 - RNA, 12 nt, Staphylococcus aureus subsp. aureus N315
auaugugagcaa

SEQ ID NO: 2133033 - RNA, 22 nt, Staphylococcus aureus subsp. aureus N315
auaugugcuuuuguaaauuaca

SEQ ID NO: 2133034 - RNA, 21 nt, Staphylococcus aureus subsp. aureus N315
auaugucucucuuucuuauuc

SEQ ID NO: 2133035 - RNA, 21 nt, Staphylococcus aureus subsp. aureus N315
auauguuuuaugauuuucuuu

SEQ ID NO: 2133036 - RNA, 15 nt, Staphylococcus aureus subsp. aureus N315
auauguuuuauaaua

SEQ ID NO: 2133037 - RNA, 13 nt, Staphylococcus aureus subsp. aureus N315
auauuaaaacaau

SEQ ID NO: 2133038 - RNA, 16 nt, Staphylococcus aureus subsp. aureus N315
auauuaaaaauuucaa

SEQ ID NO: 2133039 - RNA, 12 nt, Staphylococcus aureus subsp. aureus N315
auauguaaauga

SEQ ID NO: 2133040 - RNA, 16 nt, Staphylococcus aureus subsp. aureus N315
auaugguuagagaaaa

SEQ ID NO: 2133041 - RNA, 21 nt, Staphylococcus aureus subsp. aureus N315
auaugguuagagaaaaaucug

SEQ ID NO: 2133042 - RNA, 14 nt, Staphylococcus aureus subsp. aureus N315
auauugacauuuac

SEQ ID NO: 2133043 - RNA, 17 nt, Staphylococcus aureus subsp. aureus N315
auauugaaaacacguau

SEQ ID NO: 2133044 - RNA, 15 nt, Staphylococcus aureus subsp. aureus N315
auauugaaauuaaau

SEQ ID NO: 2133045 - RNA, 18 nt, Staphylococcus aureus subsp. aureus N315
auauugaacaauucuuca

SEQ ID NO: 2133046 - RNA, 13 nt, Staphylococcus aureus subsp. aureus N315
auauuagugacau

SEQ ID NO: 2133047 - RNA, 20 nt, Staphylococcus aureus subsp. aureus N315
auauuccacgcucacauuaa

SEQ ID NO: 2133048 - RNA, 16 nt, Staphylococcus aureus subsp. aureus N315
auauucaguauaugua

SEQ ID NO: 2133049 - RNA, 20 nt, Staphylococcus aureus subsp. aureus N315
auauuaucguaauuguuaaa

SEQ ID NO: 2133050 - RNA, 16 nt, Staphylococcus aureus subsp. aureus N315
auauuauauuuugaau

SEQ ID NO: 2133051 - RNA, 15 nt, Staphylococcus aureus subsp. aureus N315
auauuauauauauuc

SEQ ID NO: 2133052 - RNA, 23 nt, Staphylococcus aureus subsp. aureus N315
auauuauaacccucguaggcaua

SEQ ID NO: 2133053 - RNA, 22 nt, Staphylococcus aureus subsp. aureus N315
auauuuagauuggucaaacuua

SEQ ID NO: 2133054 - RNA, 20 nt, Staphylococcus aureus subsp. aureus N315
auauuuagaauaagaaauaa

SEQ ID NO: 2133055 - RNA, 18 nt, Staphylococcus aureus subsp. aureus N315
auauuuagaauaagaaau

SEQ ID NO: 2133056 - RNA, 22 nt, Staphylococcus aureus subsp. aureus N315
auauuuauuguuuuuaaaaucu

SEQ ID NO: 2133057 - RNA, 12 nt, Staphylococcus aureus subsp. aureus N315
auauuuauucua

SEQ ID NO: 2133058 - RNA, 13 nt, Staphylococcus aureus subsp. aureus N315
auauuuacacaga

SEQ ID NO: 2133059 - RNA, 21 nt, Staphylococcus aureus subsp. aureus N315
auauuuacacagaaugauaua

SEQ ID NO: 2133060 - RNA, 15 nt, Staphylococcus aureus subsp. aureus N315
auauuuaccacaaau

SEQ ID NO: 2133061 - RNA, 16 nt, Staphylococcus aureus subsp. aureus N315
auauuuaacaaaauua

SEQ ID NO: 2133062 - RNA, 12 nt, Staphylococcus aureus subsp. aureus N315
auauuuaacauu

SEQ ID NO: 2133063 - RNA, 14 nt, Staphylococcus aureus subsp. aureus N315
auauugcguuuaau

SEQ ID NO: 2133064 - RNA, 12 nt, Staphylococcus aureus subsp. aureus N315
auauugggacuu

SEQ ID NO: 2133065 - RNA, 22 nt, Staphylococcus aureus subsp. aureus N315
auauuggcaguguuugacugaa

SEQ ID NO: 2133066 - RNA, 15 nt, Staphylococcus aureus subsp. aureus N315
auauuguaaucacua

SEQ ID NO: 2133067 - RNA, 15 nt, Staphylococcus aureus subsp. aureus N315
auauuuaacaaaauu

SEQ ID NO: 2133068 - RNA, 17 nt, Staphylococcus aureus subsp. aureus N315
auauuuaaaugucuuuc

SEQ ID NO: 2133069 - RNA, 13 nt, Staphylococcus aureus subsp. aureus N315
aucaacuuuucua

SEQ ID NO: 2133070 - RNA, 14 nt, Staphylococcus aureus subsp. aureus N315
aucaagaaauguua

SEQ ID NO: 2133071 - RNA, 13 nt, Staphylococcus aureus subsp. aureus N315
aucaagaauauaa

SEQ ID NO: 2133072 - RNA, 16 nt, Staphylococcus aureus subsp. aureus N315
aucaagagguaaaucu

SEQ ID NO: 2133073 - RNA, 12 nt, Staphylococcus aureus subsp. aureus N315
aucaauccauca

SEQ ID NO: 2133074 - RNA, 14 nt, Staphylococcus aureus subsp. aureus N315
aucaacuauauaua

SEQ ID NO: 2133075 - RNA, 17 nt, Staphylococcus aureus subsp. aureus N315
aucaacugcuucacgau

SEQ ID NO: 2133076 - RNA, 23 nt, Staphylococcus aureus subsp. aureus N315
aucaacauauuuaucucuuucuu

SEQ ID NO: 2133077 - RNA, 14 nt, Staphylococcus aureus subsp. aureus N315
aucaacacacacag

SEQ ID NO: 2133078 - RNA, 23 nt, Staphylococcus aureus subsp. aureus N315
aucaacacacacaguuuauaaua

SEQ ID NO: 2133079 - RNA, 13 nt, Staphylococcus aureus subsp. aureus N315
aucaacaauuuaa

SEQ ID NO: 2133080 - RNA, 15 nt, Staphylococcus aureus subsp. aureus N315
aucaacaauuuaaac

SEQ ID NO: 2133081 - RNA, 12 nt, Staphylococcus aureus subsp. aureus N315
aucaacacacac

SEQ ID NO: 2133082 - RNA, 21 nt, Staphylococcus aureus subsp. aureus N315
aucaacaguuuuauuaucuuu

SEQ ID NO: 2133083 - RNA, 17 nt, Staphylococcus aureus subsp. aureus N315
aucaacauaaaauuuaa

SEQ ID NO: 2133084 - RNA, 17 nt, Staphylococcus aureus subsp. aureus N315
aucaaauacauuucaaa

SEQ ID NO: 2133085 - RNA, 19 nt, Staphylococcus aureus subsp. aureus N315
aucaaauagacaccaaaaa

SEQ ID NO: 2133086 - RNA, 14 nt, Staphylococcus aureus subsp. aureus N315
aucaaauauuugga

SEQ ID NO: 2133087 - RNA, 11 nt, Staphylococcus aureus subsp. aureus N315
aucaaauuacc

SEQ ID NO: 2133088 - RNA, 13 nt, Staphylococcus aureus subsp. aureus N315
aucaaauuaccau

SEQ ID NO: 2133089 - RNA, 16 nt, Staphylococcus aureus subsp. aureus N315
aucaaauuuaauaaua

SEQ ID NO: 2133090 - RNA, 24 nt, Staphylococcus aureus subsp. aureus N315
aucaaaguuuucaggaauuguuaa

SEQ ID NO: 2133091 - RNA, 19 nt, Staphylococcus aureus subsp. aureus N315
aucaaaguacuaacguuuu

SEQ ID NO: 2133092 - RNA, 20 nt, Staphylococcus aureus subsp. aureus N315
aucaaagaggaacagcggaa

SEQ ID NO: 2133093 - RNA, 20 nt, Staphylococcus aureus subsp. aureus N315
aucaaagaggcacagcggaa

SEQ ID NO: 2133094 - RNA, 18 nt, Staphylococcus aureus subsp. aureus N315
aucaaagaggcuuuaaaa

SEQ ID NO: 2133095 - RNA, 23 nt, Staphylococcus aureus subsp. aureus N315
aucaaagaaaaagugauaauuaa

SEQ ID NO: 2133096 - RNA, 23 nt, Staphylococcus aureus subsp. aureus N315
aucaaaauauaaaauccuaagca

SEQ ID NO: 2133097 - RNA, 22 nt, Staphylococcus aureus subsp. aureus N315
aucaaaaucgguuugauuaaaa

SEQ ID NO: 2133098 - RNA, 12 nt, Staphylococcus aureus subsp. aureus N315
aucaaaauauaa

SEQ ID NO: 2133099 - RNA, 20 nt, Staphylococcus aureus subsp. aureus N315
aucaaaauauaaaauccuaa

SEQ ID NO: 2133100 - RNA, 21 nt, Staphylococcus aureus subsp. aureus N315
auauuugaaagguaaguacuu

SEQ ID NO: 2133101 - RNA, 20 nt, Staphylococcus aureus subsp. aureus N315
auauuugaugaucccaaaau

SEQ ID NO: 2133102 - RNA, 20 nt, Staphylococcus aureus subsp. aureus N315
auauuuccaaauugaaauua

SEQ ID NO: 2133103 - RNA, 18 nt, Staphylococcus aureus subsp. aureus N315
auauuucaacuuuuuaau

SEQ ID NO: 2133104 - RNA, 14 nt, Staphylococcus aureus subsp. aureus N315
auauuuauuuuaua

SEQ ID NO: 2133105 - RNA, 21 nt, Staphylococcus aureus subsp. aureus N315
auauuucgguuagucuuaauc

SEQ ID NO: 2133106 - RNA, 22 nt, Staphylococcus aureus subsp. aureus N315
auauuucgguuagucuuaaucc

SEQ ID NO: 2133107 - RNA, 19 nt, Staphylococcus aureus subsp. aureus N315
auauuucgguauuuuaaau

SEQ ID NO: 2133108 - RNA, 20 nt, Staphylococcus aureus subsp. aureus N315
auauuucgguauuuuaaauu

SEQ ID NO: 2133109 - RNA, 21 nt, Staphylococcus aureus subsp. aureus N315
auauuucuauuccuucuaaca

SEQ ID NO: 2133110 - RNA, 16 nt, Staphylococcus aureus subsp. aureus N315
auauuucuaaaccauu

SEQ ID NO: 2133111 - RNA, 12 nt, Staphylococcus aureus subsp. aureus N315
auacauaucuuu

SEQ ID NO: 2133112 - RNA, 14 nt, Staphylococcus aureus subsp. aureus N315
auacauaucuuuug

SEQ ID NO: 2133113 - RNA, 23 nt, Staphylococcus aureus subsp. aureus N315
auacauaucggcccauaauagcu

SEQ ID NO: 2133114 - RNA, 20 nt, Staphylococcus aureus subsp. aureus N315
auacauaucggcccauaaua

SEQ ID NO: 2133115 - RNA, 14 nt, Staphylococcus aureus subsp. aureus N315
auacauauaagaau

SEQ ID NO: 2133116 - RNA, 22 nt, Staphylococcus aureus subsp. aureus N315
auacauagguucaucuuuaugc

SEQ ID NO: 2133117 - RNA, 16 nt, Staphylococcus aureus subsp. aureus N315
auacaucaucgccagc

SEQ ID NO: 2133118 - RNA, 20 nt, Staphylococcus aureus subsp. aureus N315
auacauccauacuucuauuu

SEQ ID NO: 2133119 - RNA, 14 nt, Staphylococcus aureus subsp. aureus N315
auacaucaauuucu

SEQ ID NO: 2133120 - RNA, 13 nt, Staphylococcus aureus subsp. aureus N315
auacaucaauauc

SEQ ID NO: 2133121 - RNA, 17 nt, Staphylococcus aureus subsp. aureus N315
auacaugccaauggaag

SEQ ID NO: 2133122 - RNA, 18 nt, Staphylococcus aureus subsp. aureus N315
auacauuaauauaaauau

SEQ ID NO: 2133123 - RNA, 12 nt, Staphylococcus aureus subsp. aureus N315
auacauuauuaa

SEQ ID NO: 2133124 - RNA, 16 nt, Staphylococcus aureus subsp. aureus N315
auacauguacauuauc

SEQ ID NO: 2133125 - RNA, 19 nt, Staphylococcus aureus subsp. aureus N315
auacaugugggauaucuuc

SEQ ID NO: 2133126 - RNA, 15 nt, Staphylococcus aureus subsp. aureus N315
auacauuauuaaaua

SEQ ID NO: 2133127 - RNA, 21 nt, Staphylococcus aureus subsp. aureus N315
auacauuccaaaguaccaucu

SEQ ID NO: 2133128 - RNA, 13 nt, Staphylococcus aureus subsp. aureus N315
auacauuuugaaa

SEQ ID NO: 2133129 - RNA, 19 nt, Staphylococcus aureus subsp. aureus N315
auacagaucucaauccaau

SEQ ID NO: 2133130 - RNA, 18 nt, Staphylococcus aureus subsp. aureus N315
auacaguuguuauuuuug

SEQ ID NO: 2133131 - RNA, 19 nt, Staphylococcus aureus subsp. aureus N315
auacauaccacacuuuaaa

SEQ ID NO: 2133132 - RNA, 22 nt, Staphylococcus aureus subsp. aureus N315
auaauuuucaauuagaaaauau

SEQ ID NO: 2133133 - RNA, 14 nt, Staphylococcus aureus subsp. aureus N315
auaauuuuggauuu

SEQ ID NO: 2133134 - RNA, 21 nt, Staphylococcus aureus subsp. aureus N315
auaauuuuucuucuuuuuuau

SEQ ID NO: 2133135 - RNA, 22 nt, Staphylococcus aureus subsp. aureus N315
auaauuuuuaacagcgugaaua

SEQ ID NO: 2133136 - RNA, 12 nt, Staphylococcus aureus subsp. aureus N315
auacaaauugau

SEQ ID NO: 2133137 - RNA, 16 nt, Staphylococcus aureus subsp. aureus N315
auacaaucauuuaugu

SEQ ID NO: 2133138 - RNA, 17 nt, Staphylococcus aureus subsp. aureus N315
auacaacucguuuuucc

SEQ ID NO: 2133139 - RNA, 15 nt, Staphylococcus aureus subsp. aureus N315
auacacaaauuuuuu

SEQ ID NO: 2133140 - RNA, 17 nt, Staphylococcus aureus subsp. aureus N315
auacacagauuacucug

SEQ ID NO: 2133141 - RNA, 21 nt, Staphylococcus aureus subsp. aureus N315
auacaauuucuucauuuucau

SEQ ID NO: 2133142 - RNA, 22 nt, Staphylococcus aureus subsp. aureus N315
auacaauuauggauaaaauuua

SEQ ID NO: 2133143 - RNA, 13 nt, Staphylococcus aureus subsp. aureus N315
auacaauuuuacc

SEQ ID NO: 2133144 - RNA, 19 nt, Staphylococcus aureus subsp. aureus N315
auacacuugauaaaacuaa

SEQ ID NO: 2133145 - RNA, 19 nt, Staphylococcus aureus subsp. aureus N315
auacagaaccaacaauaaa

SEQ ID NO: 2133146 - RNA, 22 nt, Staphylococcus aureus subsp. aureus N315
auacagaaccaacaauaaaucu

SEQ ID NO: 2133147 - RNA, 20 nt, Staphylococcus aureus subsp. aureus N315
auacagaacuuuaauaauga

SEQ ID NO: 2133148 - RNA, 22 nt, Staphylococcus aureus subsp. aureus N315
auacacuaucauuaucaaauaa

SEQ ID NO: 2133149 - RNA, 21 nt, Staphylococcus aureus subsp. aureus N315
auaaugauguauuuuagcuaa

SEQ ID NO: 2133150 - RNA, 14 nt, Staphylococcus aureus subsp. aureus N315
auaaugauuuuuau

SEQ ID NO: 2133151 - RNA, 20 nt, Staphylococcus aureus subsp. aureus N315
auaaugcacgcgugccaaca

SEQ ID NO: 2133152 - RNA, 17 nt, Staphylococcus aureus subsp. aureus N315
auaaugacgagaauuaa

SEQ ID NO: 2133153 - RNA, 15 nt, Staphylococcus aureus subsp. aureus N315
auaaugacuauaaca

SEQ ID NO: 2133154 - RNA, 15 nt, Staphylococcus aureus subsp. aureus N315
auaaugacugacacu

SEQ ID NO: 2133155 - RNA, 21 nt, Staphylococcus aureus subsp. aureus N315
auaaucucauucuuuaauaua

SEQ ID NO: 2133156 - RNA, 12 nt, Staphylococcus aureus subsp. aureus N315
auaaucuaucuu

SEQ ID NO: 2133157 - RNA, 18 nt, Staphylococcus aureus subsp. aureus N315
auaaucucauucuuuaau

SEQ ID NO: 2133158 - RNA, 20 nt, Staphylococcus aureus subsp. aureus N315
auaaucgaacauaaauaaac

SEQ ID NO: 2133159 - RNA, 18 nt, Staphylococcus aureus subsp. aureus N315
auaaucgaacauaaauaa

SEQ ID NO: 2133160 - RNA, 20 nt, Staphylococcus aureus subsp. aureus N315
auaaucccaaccauucuacc

SEQ ID NO: 2133161 - RNA, 17 nt, Staphylococcus aureus subsp. aureus N315
auaauccauucuucuug

SEQ ID NO: 2133162 - RNA, 19 nt, Staphylococcus aureus subsp. aureus N315
auaauccauucuucuuguu

SEQ ID NO: 2133163 - RNA, 11 nt, Staphylococcus aureus subsp. aureus N315
auaauccauuc

SEQ ID NO: 2133164 - RNA, 19 nt, Staphylococcus aureus subsp. aureus N315
auaauccagccacaccaaa

SEQ ID NO: 2133165 - RNA, 20 nt, Staphylococcus aureus subsp. aureus N315
auaauccagccacaccaaau

SEQ ID NO: 2133166 - RNA, 15 nt, Staphylococcus aureus subsp. aureus N315
auaauccaagauaua

SEQ ID NO: 2133167 - RNA, 21 nt, Staphylococcus aureus subsp. aureus N315
auaauccaagauauauaacua

SEQ ID NO: 2133168 - RNA, 12 nt, Staphylococcus aureus subsp. aureus N315
auaaucaucauu

SEQ ID NO: 2133169 - RNA, 13 nt, Staphylococcus aureus subsp. aureus N315
auaaucauccaua

SEQ ID NO: 2133170 - RNA, 18 nt, Staphylococcus aureus subsp. aureus N315
auaaucauccauauaugc

SEQ ID NO: 2133171 - RNA, 20 nt, Staphylococcus aureus subsp. aureus N315
auaauucgugauuacauucu

SEQ ID NO: 2133172 - RNA, 18 nt, Staphylococcus aureus subsp. aureus N315
auaauucgaaaucaaaua

SEQ ID NO: 2133173 - RNA, 19 nt, Staphylococcus aureus subsp. aureus N315
auaauucgaaaucaaauau

SEQ ID NO: 2133174 - RNA, 17 nt, Staphylococcus aureus subsp. aureus N315
auaauucagaugaauaa

SEQ ID NO: 2133175 - RNA, 13 nt, Staphylococcus aureus subsp. aureus N315
auaauucaacuua

SEQ ID NO: 2133176 - RNA, 14 nt, Staphylococcus aureus subsp. aureus N315
auaauucauaaaug

SEQ ID NO: 2133177 - RNA, 13 nt, Staphylococcus aureus subsp. aureus N315
auaauucaucuug

SEQ ID NO: 2133178 - RNA, 12 nt, Staphylococcus aureus subsp. aureus N315
auaauuagucau

SEQ ID NO: 2133179 - RNA, 16 nt, Staphylococcus aureus subsp. aureus N315
auaaugugaaaaaucu

SEQ ID NO: 2133180 - RNA, 19 nt, Staphylococcus aureus subsp. aureus N315
auaauguauaaaacagaau

SEQ ID NO: 2133181 - RNA, 22 nt, Staphylococcus aureus subsp. aureus N315
auaauguauaaaacagaauuuc

SEQ ID NO: 2133182 - RNA, 20 nt, Staphylococcus aureus subsp. aureus N315
auaaugguugaauaacacua

SEQ ID NO: 2133183 - RNA, 21 nt, Staphylococcus aureus subsp. aureus N315
auaauguaauuguuuuuucuu

SEQ ID NO: 2133184 - RNA, 18 nt, Staphylococcus aureus subsp. aureus N315
auaauuggaaucaucuuu

SEQ ID NO: 2133185 - RNA, 23 nt, Staphylococcus aureus subsp. aureus N315
auaauugauugucauauaaaaca

SEQ ID NO: 2133186 - RNA, 20 nt, Staphylococcus aureus subsp. aureus N315
auaauugcauagcuaaauaa

SEQ ID NO: 2133187 - RNA, 19 nt, Staphylococcus aureus subsp. aureus N315
auaauugcauguaaaauua

SEQ ID NO: 2133188 - RNA, 20 nt, Staphylococcus aureus subsp. aureus N315
auaauugcauguaaaauuaa

SEQ ID NO: 2133189 - RNA, 22 nt, Staphylococcus aureus subsp. aureus N315
auaauugcauguaaaauuaaau

SEQ ID NO: 2133190 - RNA, 12 nt, Staphylococcus aureus subsp. aureus N315
auaauuuaaaag

SEQ ID NO: 2133191 - RNA, 14 nt, Staphylococcus aureus subsp. aureus N315
auaauuuaaaagau

SEQ ID NO: 2133192 - RNA, 19 nt, Staphylococcus aureus subsp. aureus N315
auaauuguccaugccuuau

SEQ ID NO: 2133193 - RNA, 15 nt, Staphylococcus aureus subsp. aureus N315
auaauuuaauaaugu

SEQ ID NO: 2133194 - RNA, 21 nt, Staphylococcus aureus subsp. aureus N315
auaauuucaguucuuagauuu

SEQ ID NO: 2133195 - RNA, 15 nt, Staphylococcus aureus subsp. aureus N315
auaauuucucaaacg

SEQ ID NO: 2133196 - RNA, 15 nt, Staphylococcus aureus subsp. aureus N315
auaauuuccuaaaaa

SEQ ID NO: 2133197 - RNA, 20 nt, Staphylococcus aureus subsp. aureus N315
auaauuuaucugcaaaaugc

SEQ ID NO: 2133198 - RNA, 12 nt, Staphylococcus aureus subsp. aureus N315
auaauuucaauu

SEQ ID NO: 2133199 - RNA, 16 nt, Staphylococcus aureus subsp. aureus N315
auaauuucuucuucug

SEQ ID NO: 2133200 - RNA, 18 nt, Staphylococcus aureus subsp. aureus N315
auaauuuuaaaaauaaaa

SEQ ID NO: 2133201 - RNA, 14 nt, Staphylococcus aureus subsp. aureus N315
auaccaaaaacauu

SEQ ID NO: 2133202 - RNA, 16 nt, Staphylococcus aureus subsp. aureus N315
auaccaaaaacauuaa

SEQ ID NO: 2133203 - RNA, 22 nt, Staphylococcus aureus subsp. aureus N315
auaccaaccaaaaccaaaugaa

SEQ ID NO: 2133204 - RNA, 12 nt, Staphylococcus aureus subsp. aureus N315
auaccaaacugc

SEQ ID NO: 2133205 - RNA, 21 nt, Staphylococcus aureus subsp. aureus N315
auaccaacugucgguucaucu

SEQ ID NO: 2133206 - RNA, 21 nt, Staphylococcus aureus subsp. aureus N315
auaccacaucgcauaauaucu

SEQ ID NO: 2133207 - RNA, 23 nt, Staphylococcus aureus subsp. aureus N315
auaccacaucgcauaauaucuua

SEQ ID NO: 2133208 - RNA, 22 nt, Staphylococcus aureus subsp. aureus N315
auaccacuuaaucguucccauu

SEQ ID NO: 2133209 - RNA, 22 nt, Staphylococcus aureus subsp. aureus N315
auaccacuugaauacuuuuuaa

SEQ ID NO: 2133210 - RNA, 18 nt, Staphylococcus aureus subsp. aureus N315
auacccgcgauacugcca

SEQ ID NO: 2133211 - RNA, 17 nt, Staphylococcus aureus subsp. aureus N315
auacccuacuauauauc

SEQ ID NO: 2133212 - RNA, 16 nt, Staphylococcus aureus subsp. aureus N315
auaccauuccaaaaau

SEQ ID NO: 2133213 - RNA, 18 nt, Staphylococcus aureus subsp. aureus N315
auaccauuccaaaaauug

SEQ ID NO: 2133214 - RNA, 15 nt, Staphylococcus aureus subsp. aureus N315
auaccauaauuaaau

SEQ ID NO: 2133215 - RNA, 17 nt, Staphylococcus aureus subsp. aureus N315
auaccuaaaauacccau

SEQ ID NO: 2133216 - RNA, 22 nt, Staphylococcus aureus subsp. aureus N315
auaccuaucccuguaaaaccau

SEQ ID NO: 2133217 - RNA, 21 nt, Staphylococcus aureus subsp. aureus N315
auaccuuuaauaucuaauucu

SEQ ID NO: 2133218 - RNA, 15 nt, Staphylococcus aureus subsp. aureus N315
auaccuuuaauaucu

SEQ ID NO: 2133219 - RNA, 16 nt, Staphylococcus aureus subsp. aureus N315
auacgaauuaaaauaa

SEQ ID NO: 2133220 - RNA, 23 nt, Staphylococcus aureus subsp. aureus N315
auaccuuuaauuguuaaaucacc

SEQ ID NO: 2133221 - RNA, 20 nt, Staphylococcus aureus subsp. aureus N315
auaccguuaguacggcugcu

SEQ ID NO: 2133222 - RNA, 13 nt, Staphylococcus aureus subsp. aureus N315
auaccgaauaauu

SEQ ID NO: 2133223 - RNA, 21 nt, Staphylococcus aureus subsp. aureus N315
auaccgaauaauuuugauaua

SEQ ID NO: 2133224 - RNA, 16 nt, Staphylococcus aureus subsp. aureus N315
auacguuuauaucuua

SEQ ID NO: 2133225 - RNA, 21 nt, Staphylococcus aureus subsp. aureus N315
auacuaaaaguguuaugaauu

SEQ ID NO: 2133226 - RNA, 12 nt, Staphylococcus aureus subsp. aureus N315
auacuaaagcac

SEQ ID NO: 2133227 - RNA, 13 nt, Staphylococcus aureus subsp. aureus N315
auacuaaagcacc

SEQ ID NO: 2133228 - RNA, 12 nt, Staphylococcus aureus subsp. aureus N315
auacuaaaacau

SEQ ID NO: 2133229 - RNA, 13 nt, Staphylococcus aureus subsp. aureus N315
auacuaaaacaug

SEQ ID NO: 2133230 - RNA, 17 nt, Staphylococcus aureus subsp. aureus N315
auacuaaauugagaagu

SEQ ID NO: 2133231 - RNA, 13 nt, Staphylococcus aureus subsp. aureus N315
auacuaacuauau

SEQ ID NO: 2133232 - RNA, 13 nt, Staphylococcus aureus subsp. aureus N315
auacuaacaauua

SEQ ID NO: 2133233 - RNA, 16 nt, Staphylococcus aureus subsp. aureus N315
auacuaaauugagaag

SEQ ID NO: 2133234 - RNA, 22 nt, Staphylococcus aureus subsp. aureus N315
auacuaaucaaagaaaaaguga

SEQ ID NO: 2133235 - RNA, 19 nt, Staphylococcus aureus subsp. aureus N315
auacuaaucaaagaaaaag

SEQ ID NO: 2133236 - RNA, 15 nt, Staphylococcus aureus subsp. aureus N315
auacuaaucaaagaa

SEQ ID NO: 2133237 - RNA, 18 nt, Staphylococcus aureus subsp. aureus N315
auacuaauaucuucuuua

SEQ ID NO: 2133238 - RNA, 19 nt, Staphylococcus aureus subsp. aureus N315
auacuaauaucuucuuuau

SEQ ID NO: 2133239 - RNA, 21 nt, Staphylococcus aureus subsp. aureus N315
auacuaacugaagacaccuua

SEQ ID NO: 2133240 - RNA, 13 nt, Staphylococcus aureus subsp. aureus N315
auacgacaaucac

SEQ ID NO: 2133241 - RNA, 19 nt, Staphylococcus aureus subsp. aureus N315
auacgcuuuuuaaaaaauu

SEQ ID NO: 2133242 - RNA, 17 nt, Staphylococcus aureus subsp. aureus N315
auacguuuaauaauggu

SEQ ID NO: 2133243 - RNA, 21 nt, Staphylococcus aureus subsp. aureus N315
auagcauaaaaagagguuuuc

SEQ ID NO: 2133244 - RNA, 19 nt, Staphylococcus aureus subsp. aureus N315
auagcaaaauuauguaaaa

SEQ ID NO: 2133245 - RNA, 21 nt, Staphylococcus aureus subsp. aureus N315
auagcaaaauuauguaaaaaa

SEQ ID NO: 2133246 - RNA, 23 nt, Staphylococcus aureus subsp. aureus N315
auagauuuaucaccuuuaggcaa

SEQ ID NO: 2133247 - RNA, 17 nt, Staphylococcus aureus subsp. aureus N315
auagccuauuuaaaaga

SEQ ID NO: 2133248 - RNA, 19 nt, Staphylococcus aureus subsp. aureus N315
auagccguuaacaucagua

SEQ ID NO: 2133249 - RNA, 19 nt, Staphylococcus aureus subsp. aureus N315
auagauagaaauugugcuu

SEQ ID NO: 2133250 - RNA, 13 nt, Staphylococcus aureus subsp. aureus N315
auagauugaaaaa

SEQ ID NO: 2133251 - RNA, 15 nt, Staphylococcus aureus subsp. aureus N315
auagauugaaaaaau

SEQ ID NO: 2133252 - RNA, 13 nt, Staphylococcus aureus subsp. aureus N315
auagaccuaugaa

SEQ ID NO: 2133253 - RNA, 15 nt, Staphylococcus aureus subsp. aureus N315
auagacuaacuguac

SEQ ID NO: 2133254 - RNA, 17 nt, Staphylococcus aureus subsp. aureus N315
auacuucaccaucuuua

SEQ ID NO: 2133255 - RNA, 18 nt, Staphylococcus aureus subsp. aureus N315
auacuuuuggucuguuga

SEQ ID NO: 2133256 - RNA, 13 nt, Staphylococcus aureus subsp. aureus N315
auacuuuuuaaau

SEQ ID NO: 2133257 - RNA, 14 nt, Staphylococcus aureus subsp. aureus N315
auagaaaauuaacu

SEQ ID NO: 2133258 - RNA, 21 nt, Staphylococcus aureus subsp. aureus N315
auagaaaaugaguacaacaua

SEQ ID NO: 2133259 - RNA, 19 nt, Staphylococcus aureus subsp. aureus N315
auagaaagaaauuguuccu

SEQ ID NO: 2133260 - RNA, 16 nt, Staphylococcus aureus subsp. aureus N315
auagaaaaauuucaaa

SEQ ID NO: 2133261 - RNA, 18 nt, Staphylococcus aureus subsp. aureus N315
auagaaaaauuucaaaaa

SEQ ID NO: 2133262 - RNA, 19 nt, Staphylococcus aureus subsp. aureus N315
auacuacuuguuuguuuuu

SEQ ID NO: 2133263 - RNA, 17 nt, Staphylococcus aureus subsp. aureus N315
auacuacuguugacauu

SEQ ID NO: 2133264 - RNA, 17 nt, Staphylococcus aureus subsp. aureus N315
auacuacauauaaugcc

SEQ ID NO: 2133265 - RNA, 22 nt, Staphylococcus aureus subsp. aureus N315
auacuaauuucuauagaaaaag

SEQ ID NO: 2133266 - RNA, 23 nt, Staphylococcus aureus subsp. aureus N315
auacuaaucuucaacuucgauau

SEQ ID NO: 2133267 - RNA, 16 nt, Staphylococcus aureus subsp. aureus N315
auacuuaauauaguua

SEQ ID NO: 2133268 - RNA, 14 nt, Staphylococcus aureus subsp. aureus N315
auacuuaauuuaaa

SEQ ID NO: 2133269 - RNA, 15 nt, Staphylococcus aureus subsp. aureus N315
auacuuaauuuaaau

SEQ ID NO: 2133270 - RNA, 15 nt, Staphylococcus aureus subsp. aureus N315
auagaaugucgauau

SEQ ID NO: 2133271 - RNA, 12 nt, Staphylococcus aureus subsp. aureus N315
auagaauuuuuc

SEQ ID NO: 2133272 - RNA, 20 nt, Staphylococcus aureus subsp. aureus N315
auagaagguuauuuuuuaug

SEQ ID NO: 2133273 - RNA, 12 nt, Staphylococcus aureus subsp. aureus N315
auagaaggggac

SEQ ID NO: 2133274 - RNA, 16 nt, Staphylococcus aureus subsp. aureus N315
auagaaauaaucacau

SEQ ID NO: 2133275 - RNA, 19 nt, Staphylococcus aureus subsp. aureus N315
auagaaaugacgauaccuu

SEQ ID NO: 2133276 - RNA, 20 nt, Staphylococcus aureus subsp. aureus N315
auagaagaacgaagaaugau

SEQ ID NO: 2133277 - RNA, 15 nt, Staphylococcus aureus subsp. aureus N315
aguuugcguuuuaau

SEQ ID NO: 2133278 - RNA, 14 nt, Staphylococcus aureus subsp. aureus N315
aguuuguaauaauu

SEQ ID NO: 2133279 - RNA, 16 nt, Staphylococcus aureus subsp. aureus N315
aguuuauuaauauuag

SEQ ID NO: 2133280 - RNA, 13 nt, Staphylococcus aureus subsp. aureus N315
auaaaaaauuauu

SEQ ID NO: 2133281 - RNA, 12 nt, Staphylococcus aureus subsp. aureus N315
auaaaaaauaac

SEQ ID NO: 2133282 - RNA, 14 nt, Staphylococcus aureus subsp. aureus N315
auaaaaaaucuuuu

SEQ ID NO: 2133283 - RNA, 21 nt, Staphylococcus aureus subsp. aureus N315
aguuuuuuaaaauaaugauau

SEQ ID NO: 2133284 - RNA, 14 nt, Staphylococcus aureus subsp. aureus N315
aguuggcuuacugu

SEQ ID NO: 2133285 - RNA, 16 nt, Staphylococcus aureus subsp. aureus N315
aguuggggaugggccc

SEQ ID NO: 2133286 - RNA, 18 nt, Staphylococcus aureus subsp. aureus N315
aguuggggaugggcccca

SEQ ID NO: 2133287 - RNA, 14 nt, Staphylococcus aureus subsp. aureus N315
aguugguuuagaca

SEQ ID NO: 2133288 - RNA, 17 nt, Staphylococcus aureus subsp. aureus N315
aguuguccauuuuaugc

SEQ ID NO: 2133289 - RNA, 16 nt, Staphylococcus aureus subsp. aureus N315
aguuggggugagggcc

SEQ ID NO: 2133290 - RNA, 17 nt, Staphylococcus aureus subsp. aureus N315
aguuuagguugauuucu

SEQ ID NO: 2133291 - RNA, 23 nt, Staphylococcus aureus subsp. aureus N315
aguuuauugccgguuaaauuauu

SEQ ID NO: 2133292 - RNA, 16 nt, Staphylococcus aureus subsp. aureus N315
aguuaaaguacuuaca

SEQ ID NO: 2133293 - RNA, 16 nt, Staphylococcus aureus subsp. aureus N315
aguuaaaucacugcuu

SEQ ID NO: 2133294 - RNA, 15 nt, Staphylococcus aureus subsp. aureus N315
aguuaacuauaacaa

SEQ ID NO: 2133295 - RNA, 20 nt, Staphylococcus aureus subsp. aureus N315
aguuaagugucuauguugaa

SEQ ID NO: 2133296 - RNA, 13 nt, Staphylococcus aureus subsp. aureus N315
aguuaauuauuua

SEQ ID NO: 2133297 - RNA, 12 nt, Staphylococcus aureus subsp. aureus N315
aguuaauuaugu

SEQ ID NO: 2133298 - RNA, 13 nt, Staphylococcus aureus subsp. aureus N315
aguucacaugaau

SEQ ID NO: 2133299 - RNA, 14 nt, Staphylococcus aureus subsp. aureus N315
aguuauauuguuaa

SEQ ID NO: 2133300 - RNA, 15 nt, Staphylococcus aureus subsp. aureus N315
aguuauaugugcuuu

SEQ ID NO: 2133301 - RNA, 15 nt, Staphylococcus aureus subsp. aureus N315
aguuaugaaaugucu

SEQ ID NO: 2133302 - RNA, 14 nt, Staphylococcus aureus subsp. aureus N315
aguuauauuuuuag

SEQ ID NO: 2133303 - RNA, 18 nt, Staphylococcus aureus subsp. aureus N315
aguuaugcugucaaacaa

SEQ ID NO: 2133304 - RNA, 12 nt, Staphylococcus aureus subsp. aureus N315
aguucuuuaaau

SEQ ID NO: 2133305 - RNA, 18 nt, Staphylococcus aureus subsp. aureus N315
aguucaggaucaagugca

SEQ ID NO: 2133306 - RNA, 16 nt, Staphylococcus aureus subsp. aureus N315
aguucaggaucaagug

SEQ ID NO: 2133307 - RNA, 14 nt, Staphylococcus aureus subsp. aureus N315
auaaaacaaauuau

SEQ ID NO: 2133308 - RNA, 15 nt, Staphylococcus aureus subsp. aureus N315
auaaaacaucaucgu

SEQ ID NO: 2133309 - RNA, 17 nt, Staphylococcus aureus subsp. aureus N315
auaaaaaucuuggugau

SEQ ID NO: 2133310 - RNA, 15 nt, Staphylococcus aureus subsp. aureus N315
auaaaaauuuauuca

SEQ ID NO: 2133311 - RNA, 15 nt, Staphylococcus aureus subsp. aureus N315
auaaaacgauaagaa

SEQ ID NO: 2133312 - RNA, 16 nt, Staphylococcus aureus subsp. aureus N315
auaaaaccgguacuuu

SEQ ID NO: 2133313 - RNA, 15 nt, Staphylococcus aureus subsp. aureus N315
auaaaacuaucuaca

SEQ ID NO: 2133314 - RNA, 22 nt, Staphylococcus aureus subsp. aureus N315
auaaaacgugcaaauaaaaaag

SEQ ID NO: 2133315 - RNA, 17 nt, Staphylococcus aureus subsp. aureus N315
auaaaacuaauuaggua

SEQ ID NO: 2133316 - RNA, 22 nt, Staphylococcus aureus subsp. aureus N315
auaaaaggcuuuguuaaacaca

SEQ ID NO: 2133317 - RNA, 23 nt, Staphylococcus aureus subsp. aureus N315
auaaaaguacuuuaaaauuguau

SEQ ID NO: 2133318 - RNA, 16 nt, Staphylococcus aureus subsp. aureus N315
auaaaagucgauaaau

SEQ ID NO: 2133319 - RNA, 13 nt, Staphylococcus aureus subsp. aureus N315
auaaaauaaauaa

SEQ ID NO: 2133320 - RNA, 17 nt, Staphylococcus aureus subsp. aureus N315
auaaaauaaaaaaauga

SEQ ID NO: 2133321 - RNA, 23 nt, Staphylococcus aureus subsp. aureus N315
auaaaauaccagaugaaccaaaa

SEQ ID NO: 2133322 - RNA, 22 nt, Staphylococcus aureus subsp. aureus N315
auaaaauaaucgguaauuacuu

SEQ ID NO: 2133323 - RNA, 13 nt, Staphylococcus aureus subsp. aureus N315
auaaaauaaaaug

SEQ ID NO: 2133324 - RNA, 16 nt, Staphylococcus aureus subsp. aureus N315
auaaaaguuaggcgac

SEQ ID NO: 2133325 - RNA, 13 nt, Staphylococcus aureus subsp. aureus N315
auaaaauaaaaaa

SEQ ID NO: 2133326 - RNA, 13 nt, Staphylococcus aureus subsp. aureus N315
auaaaacuuacau

SEQ ID NO: 2133327 - RNA, 20 nt, Staphylococcus aureus subsp. aureus N315
auaaaacuuacauuacauau

SEQ ID NO: 2133328 - RNA, 19 nt, Staphylococcus aureus subsp. aureus N315
auaaaagccucuaaugauu

SEQ ID NO: 2133329 - RNA, 14 nt, Staphylococcus aureus subsp. aureus N315
auaaaagcaacaau

SEQ ID NO: 2133330 - RNA, 20 nt, Staphylococcus aureus subsp. aureus N315
auaaaagccaugauacgaug

SEQ ID NO: 2133331 - RNA, 14 nt, Staphylococcus aureus subsp. aureus N315
auaaaagagaagcu

SEQ ID NO: 2133332 - RNA, 20 nt, Staphylococcus aureus subsp. aureus N315
auaaaauauaucuuaugaua

SEQ ID NO: 2133333 - RNA, 16 nt, Staphylococcus aureus subsp. aureus N315
auaaaauauauuuaau

SEQ ID NO: 2133334 - RNA, 17 nt, Staphylococcus aureus subsp. aureus N315
auaaaauauauuuaauu

SEQ ID NO: 2133335 - RNA, 13 nt, Staphylococcus aureus subsp. aureus N315
auaaaauuuaaaa

SEQ ID NO: 2133336 - RNA, 16 nt, Staphylococcus aureus subsp. aureus N315
auaaaaugcuacaauu

SEQ ID NO: 2133337 - RNA, 18 nt, Staphylococcus aureus subsp. aureus N315
auaaaaugcuacaauuuc

SEQ ID NO: 2133338 - RNA, 21 nt, Staphylococcus aureus subsp. aureus N315
auaaaaugcauagcucuucuu

SEQ ID NO: 2133339 - RNA, 22 nt, Staphylococcus aureus subsp. aureus N315
auaaaaugcauagcucuucuuu

SEQ ID NO: 2133340 - RNA, 17 nt, Staphylococcus aureus subsp. aureus N315
auaaaaugcauagcucu

SEQ ID NO: 2133341 - RNA, 15 nt, Staphylococcus aureus subsp. aureus N315
auaaaaugaauaauu

SEQ ID NO: 2133342 - RNA, 15 nt, Staphylococcus aureus subsp. aureus N315
auaaaaugaaauauu

SEQ ID NO: 2133343 - RNA, 16 nt, Staphylococcus aureus subsp. aureus N315
auaaaauuaaaacagc

SEQ ID NO: 2133344 - RNA, 13 nt, Staphylococcus aureus subsp. aureus N315
auaaaauguuguu

SEQ ID NO: 2133345 - RNA, 13 nt, Staphylococcus aureus subsp. aureus N315
auaaaauuaaaac

SEQ ID NO: 2133346 - RNA, 20 nt, Staphylococcus aureus subsp. aureus N315
auaaacgacgcaagugacuu

SEQ ID NO: 2133347 - RNA, 18 nt, Staphylococcus aureus subsp. aureus N315
auaaacguccaaacacaa

SEQ ID NO: 2133348 - RNA, 12 nt, Staphylococcus aureus subsp. aureus N315
auaaacguccaa

SEQ ID NO: 2133349 - RNA, 15 nt, Staphylococcus aureus subsp. aureus N315
auaaacuuuaugaaa

SEQ ID NO: 2133350 - RNA, 19 nt, Staphylococcus aureus subsp. aureus N315
auaaaauuuaaaacaauga

SEQ ID NO: 2133351 - RNA, 18 nt, Staphylococcus aureus subsp. aureus N315
auaaaauuucauauuguu

SEQ ID NO: 2133352 - RNA, 14 nt, Staphylococcus aureus subsp. aureus N315
auaaacagggagug

SEQ ID NO: 2133353 - RNA, 16 nt, Staphylococcus aureus subsp. aureus N315
auaaagucauaugguu

SEQ ID NO: 2133354 - RNA, 16 nt, Staphylococcus aureus subsp. aureus N315
auaaagucauacuuau

SEQ ID NO: 2133355 - RNA, 15 nt, Staphylococcus aureus subsp. aureus N315
auaaagucauacuua

SEQ ID NO: 2133356 - RNA, 15 nt, Staphylococcus aureus subsp. aureus N315
auaaaguuuauuuau

SEQ ID NO: 2133357 - RNA, 17 nt, Staphylococcus aureus subsp. aureus N315
auaaaguuuguaauauu

SEQ ID NO: 2133358 - RNA, 21 nt, Staphylococcus aureus subsp. aureus N315
auaaagacaccuucaauaucu

SEQ ID NO: 2133359 - RNA, 19 nt, Staphylococcus aureus subsp. aureus N315
auaaaguaugagugauaga

SEQ ID NO: 2133360 - RNA, 14 nt, Staphylococcus aureus subsp. aureus N315
auaaauaaaagcca

SEQ ID NO: 2133361 - RNA, 23 nt, Staphylococcus aureus subsp. aureus N315
auaaauaaaaggcauucuuccaa

SEQ ID NO: 2133362 - RNA, 22 nt, Staphylococcus aureus subsp. aureus N315
auaaauaaaaauacauaauuaa

SEQ ID NO: 2133363 - RNA, 21 nt, Staphylococcus aureus subsp. aureus N315
auaaauaccgucuucucuauc

SEQ ID NO: 2133364 - RNA, 17 nt, Staphylococcus aureus subsp. aureus N315
auaaauagauaauauau

SEQ ID NO: 2133365 - RNA, 12 nt, Staphylococcus aureus subsp. aureus N315
auaaauauaaaa

SEQ ID NO: 2133366 - RNA, 17 nt, Staphylococcus aureus subsp. aureus N315
auaaaugcuaaaaguau

SEQ ID NO: 2133367 - RNA, 19 nt, Staphylococcus aureus subsp. aureus N315
auaaauucucuuggauagu

SEQ ID NO: 2133368 - RNA, 22 nt, Staphylococcus aureus subsp. aureus N315
auaaauucuaaucgcauuuuuu

SEQ ID NO: 2133369 - RNA, 13 nt, Staphylococcus aureus subsp. aureus N315
auaaaucaucauu

SEQ ID NO: 2133370 - RNA, 16 nt, Staphylococcus aureus subsp. aureus N315
auaaaucaugaaauaa

SEQ ID NO: 2133371 - RNA, 17 nt, Staphylococcus aureus subsp. aureus N315
auaaaucaagaaauguu

SEQ ID NO: 2133372 - RNA, 20 nt, Staphylococcus aureus subsp. aureus N315
auaaaucaagaaauguuaaa

SEQ ID NO: 2133373 - RNA, 22 nt, Staphylococcus aureus subsp. aureus N315
auaaaucaguaguuuuaaaagu

SEQ ID NO: 2133374 - RNA, 17 nt, Staphylococcus aureus subsp. aureus N315
auaaaugacugaauuaa

SEQ ID NO: 2133375 - RNA, 15 nt, Staphylococcus aureus subsp. aureus N315
auaaaugacauuuaa

SEQ ID NO: 2133376 - RNA, 13 nt, Staphylococcus aureus subsp. aureus N315
auaaaugauuaaa

SEQ ID NO: 2133377 - RNA, 23 nt, Staphylococcus aureus subsp. aureus N315
auaaccacaccaugcugcacauu

SEQ ID NO: 2133378 - RNA, 15 nt, Staphylococcus aureus subsp. aureus N315
auaacaucaaauaga

SEQ ID NO: 2133379 - RNA, 18 nt, Staphylococcus aureus subsp. aureus N315
auaacauagaaaagcagu

SEQ ID NO: 2133380 - RNA, 18 nt, Staphylococcus aureus subsp. aureus N315
auaacaguuaauuauacc

SEQ ID NO: 2133381 - RNA, 20 nt, Staphylococcus aureus subsp. aureus N315
auaacgagcaguauauauca

SEQ ID NO: 2133382 - RNA, 17 nt, Staphylococcus aureus subsp. aureus N315
auaaccauguaaaauua

SEQ ID NO: 2133383 - RNA, 14 nt, Staphylococcus aureus subsp. aureus N315
auaaccuguaauug

SEQ ID NO: 2133384 - RNA, 13 nt, Staphylococcus aureus subsp. aureus N315
auaaccuuuaaaa

SEQ ID NO: 2133385 - RNA, 17 nt, Staphylococcus aureus subsp. aureus N315
auaaauuguaugaauaa

SEQ ID NO: 2133386 - RNA, 20 nt, Staphylococcus aureus subsp. aureus N315
auaaauugaguuuuuuaaaa

SEQ ID NO: 2133387 - RNA, 22 nt, Staphylococcus aureus subsp. aureus N315
auaaauugaguuuuuuaaaaua

SEQ ID NO: 2133388 - RNA, 22 nt, Staphylococcus aureus subsp. aureus N315
auaaauuucaagguauacacaa

SEQ ID NO: 2133389 - RNA, 11 nt, Staphylococcus aureus subsp. aureus N315
auaacaaacau

SEQ ID NO: 2133390 - RNA, 22 nt, Staphylococcus aureus subsp. aureus N315
auaaauuuagauauuauaaaaa

SEQ ID NO: 2133391 - RNA, 20 nt, Staphylococcus aureus subsp. aureus N315
auaaauuuaacguuauucau

SEQ ID NO: 2133392 - RNA, 17 nt, Staphylococcus aureus subsp. aureus N315
auaacaagaaguaaugu

SEQ ID NO: 2133393 - RNA, 16 nt, Staphylococcus aureus subsp. aureus N315
auaacaacgauaauug

SEQ ID NO: 2133394 - RNA, 18 nt, Staphylococcus aureus subsp. aureus N315
auaacagcuacaaauaau

SEQ ID NO: 2133395 - RNA, 16 nt, Staphylococcus aureus subsp. aureus N315
auaacagcuacaaaua

SEQ ID NO: 2133396 - RNA, 17 nt, Staphylococcus aureus subsp. aureus N315
auaacagcuacaaauaa

SEQ ID NO: 2133397 - RNA, 21 nt, Staphylococcus aureus subsp. aureus N315
auaacagcuacaaauaaugag

SEQ ID NO: 2133398 - RNA, 16 nt, Staphylococcus aureus subsp. aureus N315
auaacaauuuauuaaa

SEQ ID NO: 2133399 - RNA, 22 nt, Staphylococcus aureus subsp. aureus N315
auaacaaugcagcuguauuuaa

SEQ ID NO: 2133400 - RNA, 22 nt, Staphylococcus aureus subsp. aureus N315
auaacaauagugacuuuuauaa

SEQ ID NO: 2133401 - RNA, 16 nt, Staphylococcus aureus subsp. aureus N315
agucuaugaauaaugu

SEQ ID NO: 2133402 - RNA, 14 nt, Staphylococcus aureus subsp. aureus N315
agugaaauaccucc

SEQ ID NO: 2133403 - RNA, 16 nt, Staphylococcus aureus subsp. aureus N315
agugaaaucauuuaaa

SEQ ID NO: 2133404 - RNA, 17 nt, Staphylococcus aureus subsp. aureus N315
agugaaaucauuuaaau

SEQ ID NO: 2133405 - RNA, 17 nt, Staphylococcus aureus subsp. aureus N315
agugaaaguauuagaua

SEQ ID NO: 2133406 - RNA, 22 nt, Staphylococcus aureus subsp. aureus N315
agugaaagucguuguugaaauu

SEQ ID NO: 2133407 - RNA, 15 nt, Staphylococcus aureus subsp. aureus N315
agucucguaauaaug

SEQ ID NO: 2133408 - RNA, 21 nt, Staphylococcus aureus subsp. aureus N315
agugaaucuucuaauuaagaa

SEQ ID NO: 2133409 - RNA, 16 nt, Staphylococcus aureus subsp. aureus N315
agugaaguacgacggu

SEQ ID NO: 2133410 - RNA, 21 nt, Staphylococcus aureus subsp. aureus N315
agugauaauuaaaauaagaua

SEQ ID NO: 2133411 - RNA, 15 nt, Staphylococcus aureus subsp. aureus N315
agugauuuuaaucua

SEQ ID NO: 2133412 - RNA, 15 nt, Staphylococcus aureus subsp. aureus N315
agugauuuaaaaaau

SEQ ID NO: 2133413 - RNA, 12 nt, Staphylococcus aureus subsp. aureus N315
agugauuuaaaa

SEQ ID NO: 2133414 - RNA, 14 nt, Staphylococcus aureus subsp. aureus N315
agugauuuaaaaaa

SEQ ID NO: 2133415 - RNA, 12 nt, Staphylococcus aureus subsp. aureus N315
agugauucccaa

SEQ ID NO: 2133416 - RNA, 21 nt, Staphylococcus aureus subsp. aureus N315
agugcaaguaauuuaauuggu

SEQ ID NO: 2133417 - RNA, 18 nt, Staphylococcus aureus subsp. aureus N315
agugcaaguccaaauaau

SEQ ID NO: 2133418 - RNA, 13 nt, Staphylococcus aureus subsp. aureus N315
agugcaauuauuu

SEQ ID NO: 2133419 - RNA, 14 nt, Staphylococcus aureus subsp. aureus N315
agugcaauuauuuc

SEQ ID NO: 2133420 - RNA, 22 nt, Staphylococcus aureus subsp. aureus N315
agugcaauaacaccaauugaau

SEQ ID NO: 2133421 - RNA, 21 nt, Staphylococcus aureus subsp. aureus N315
agugcuuauuuguuuauuagu

SEQ ID NO: 2133422 - RNA, 17 nt, Staphylococcus aureus subsp. aureus N315
aguggaagacaaugauu

SEQ ID NO: 2133423 - RNA, 13 nt, Staphylococcus aureus subsp. aureus N315
agucauuacaaau

SEQ ID NO: 2133424 - RNA, 13 nt, Staphylococcus aureus subsp. aureus N315
agucauuuucauu

SEQ ID NO: 2133425 - RNA, 17 nt, Staphylococcus aureus subsp. aureus N315
agucauuugauuuaaaa

SEQ ID NO: 2133426 - RNA, 15 nt, Staphylococcus aureus subsp. aureus N315
agucaugucccauaa

SEQ ID NO: 2133427 - RNA, 18 nt, Staphylococcus aureus subsp. aureus N315
agucauaggcuugccaau

SEQ ID NO: 2133428 - RNA, 14 nt, Staphylococcus aureus subsp. aureus N315
aguccauuuucuuu

SEQ ID NO: 2133429 - RNA, 15 nt, Staphylococcus aureus subsp. aureus N315
aguccauuuucuuuu

SEQ ID NO: 2133430 - RNA, 12 nt, Staphylococcus aureus subsp. aureus N315
aguccauuuucu

SEQ ID NO: 2133431 - RNA, 19 nt, Staphylococcus aureus subsp. aureus N315
aguccaauuccaauaaaca

SEQ ID NO: 2133432 - RNA, 18 nt, Staphylococcus aureus subsp. aureus N315
agucgauaaauaugaugu

SEQ ID NO: 2133433 - RNA, 18 nt, Staphylococcus aureus subsp. aureus N315
agucggggccccaacaca

SEQ ID NO: 2133434 - RNA, 21 nt, Staphylococcus aureus subsp. aureus N315
aguauuuuuugugccuuucuc

SEQ ID NO: 2133435 - RNA, 23 nt, Staphylococcus aureus subsp. aureus N315
aguauuuuuugugccuuucucua

SEQ ID NO: 2133436 - RNA, 15 nt, Staphylococcus aureus subsp. aureus N315
aguauuguuuuauau

SEQ ID NO: 2133437 - RNA, 22 nt, Staphylococcus aureus subsp. aureus N315
aguauuguuuuauauuuaaacu

SEQ ID NO: 2133438 - RNA, 21 nt, Staphylococcus aureus subsp. aureus N315
aguauugccguuauuuucaau

SEQ ID NO: 2133439 - RNA, 14 nt, Staphylococcus aureus subsp. aureus N315
aguauuaucacaua

SEQ ID NO: 2133440 - RNA, 18 nt, Staphylococcus aureus subsp. aureus N315
aguauguuuuauacauuu

SEQ ID NO: 2133441 - RNA, 15 nt, Staphylococcus aureus subsp. aureus N315
aguauuaugauugcu

SEQ ID NO: 2133442 - RNA, 18 nt, Staphylococcus aureus subsp. aureus N315
aguauggcgaaauguuuu

SEQ ID NO: 2133443 - RNA, 14 nt, Staphylococcus aureus subsp. aureus N315
aguaucucauuuuu

SEQ ID NO: 2133444 - RNA, 14 nt, Staphylococcus aureus subsp. aureus N315
aguaucuaugaaau

SEQ ID NO: 2133445 - RNA, 18 nt, Staphylococcus aureus subsp. aureus N315
aguaucugugaauaugcu

SEQ ID NO: 2133446 - RNA, 21 nt, Staphylococcus aureus subsp. aureus N315
aguaucucuuuucuauucaaa

SEQ ID NO: 2133447 - RNA, 16 nt, Staphylococcus aureus subsp. aureus N315
aguauccugauuuaau

SEQ ID NO: 2133448 - RNA, 23 nt, Staphylococcus aureus subsp. aureus N315
aguaucauuguguccauaaauau

SEQ ID NO: 2133449 - RNA, 21 nt, Staphylococcus aureus subsp. aureus N315
aguaucauguucuuauaaaaa

SEQ ID NO: 2133450 - RNA, 22 nt, Staphylococcus aureus subsp. aureus N315
aguaucauuguguccauaaaua

SEQ ID NO: 2133451 - RNA, 18 nt, Staphylococcus aureus subsp. aureus N315
agucaauguauauuuaac

SEQ ID NO: 2133452 - RNA, 17 nt, Staphylococcus aureus subsp. aureus N315
agucaauuuaaauaagu

SEQ ID NO: 2133453 - RNA, 23 nt, Staphylococcus aureus subsp. aureus N315
agucaauguauauuuaacaucaa

SEQ ID NO: 2133454 - RNA, 14 nt, Staphylococcus aureus subsp. aureus N315
agucaccauauuua

SEQ ID NO: 2133455 - RNA, 21 nt, Staphylococcus aureus subsp. aureus N315
agucaccugcuuuuuauuauu

SEQ ID NO: 2133456 - RNA, 19 nt, Staphylococcus aureus subsp. aureus N315
agucaacaucguauucuuu

SEQ ID NO: 2133457 - RNA, 22 nt, Staphylococcus aureus subsp. aureus N315
agucaacugcugcuaaaauaaa

SEQ ID NO: 2133458 - RNA, 14 nt, Staphylococcus aureus subsp. aureus N315
agucaacugcugcu

SEQ ID NO: 2133459 - RNA, 17 nt, Staphylococcus aureus subsp. aureus N315
agucaacugcugcuaaa

SEQ ID NO: 2133460 - RNA, 19 nt, Staphylococcus aureus subsp. aureus N315
agucaauaauuuuaucuaa

SEQ ID NO: 2133461 - RNA, 13 nt, Staphylococcus aureus subsp. aureus N315
agucauaaauaua

SEQ ID NO: 2133462 - RNA, 16 nt, Staphylococcus aureus subsp. aureus N315
agucauaaauauaaaa

SEQ ID NO: 2133463 - RNA, 17 nt, Staphylococcus aureus subsp. aureus N315
agucauaaauauaaaau

SEQ ID NO: 2133464 - RNA, 14 nt, Staphylococcus aureus subsp. aureus N315
agucaggggcccca

SEQ ID NO: 2133465 - RNA, 19 nt, Staphylococcus aureus subsp. aureus N315
agucaggggccccaacaca

SEQ ID NO: 2133466 - RNA, 15 nt, Staphylococcus aureus subsp. aureus N315
aguauauaucaaaua

SEQ ID NO: 2133467 - RNA, 17 nt, Staphylococcus aureus subsp. aureus N315
aguauauaucaaauaca

SEQ ID NO: 2133468 - RNA, 16 nt, Staphylococcus aureus subsp. aureus N315
aguauaaauauaaaaa

SEQ ID NO: 2133469 - RNA, 17 nt, Staphylococcus aureus subsp. aureus N315
aguauaaauauaaaaag

SEQ ID NO: 2133470 - RNA, 14 nt, Staphylococcus aureus subsp. aureus N315
aguauaaaugcagc

SEQ ID NO: 2133471 - RNA, 13 nt, Staphylococcus aureus subsp. aureus N315
aguauaauuaaac

SEQ ID NO: 2133472 - RNA, 16 nt, Staphylococcus aureus subsp. aureus N315
aguauaauuuucuguc

SEQ ID NO: 2133473 - RNA, 16 nt, Staphylococcus aureus subsp. aureus N315
aguauaaucagcaaug

SEQ ID NO: 2133474 - RNA, 15 nt, Staphylococcus aureus subsp. aureus N315
aguaguguauucauu

SEQ ID NO: 2133475 - RNA, 20 nt, Staphylococcus aureus subsp. aureus N315
aguaguuucucuacuaauau

SEQ ID NO: 2133476 - RNA, 20 nt, Staphylococcus aureus subsp. aureus N315
aguaguugacugaacgaaaa

SEQ ID NO: 2133477 - RNA, 14 nt, Staphylococcus aureus subsp. aureus N315
aguaguuggaaaau

SEQ ID NO: 2133478 - RNA, 13 nt, Staphylococcus aureus subsp. aureus N315
aguauaaauaaaa

SEQ ID NO: 2133479 - RNA, 14 nt, Staphylococcus aureus subsp. aureus N315
aguauaaauaaaaa

SEQ ID NO: 2133480 - RNA, 23 nt, Staphylococcus aureus subsp. aureus N315
aguauaaaccgccaacuaauguu

SEQ ID NO: 2133481 - RNA, 16 nt, Staphylococcus aureus subsp. aureus N315
aguauaaacguccaaa

SEQ ID NO: 2133482 - RNA, 16 nt, Staphylococcus aureus subsp. aureus N315
aguagcuagaacagau

SEQ ID NO: 2133483 - RNA, 22 nt, Staphylococcus aureus subsp. aureus N315
aguagcucaaaacaauuuaaaa

SEQ ID NO: 2133484 - RNA, 17 nt, Staphylococcus aureus subsp. aureus N315
aguagcucaaaacaauu

SEQ ID NO: 2133485 - RNA, 14 nt, Staphylococcus aureus subsp. aureus N315
aguagucacuguuu

SEQ ID NO: 2133486 - RNA, 20 nt, Staphylococcus aureus subsp. aureus N315
aguaggguauugaaauaaua

SEQ ID NO: 2133487 - RNA, 17 nt, Staphylococcus aureus subsp. aureus N315
aguagaaccuauauuaa

SEQ ID NO: 2133488 - RNA, 13 nt, Staphylococcus aureus subsp. aureus N315
aguagaauuauuu

SEQ ID NO: 2133489 - RNA, 14 nt, Staphylococcus aureus subsp. aureus N315
aguagaauuauuua

SEQ ID NO: 2133490 - RNA, 19 nt, Staphylococcus aureus subsp. aureus N315
aguagauugauauccuuaa

SEQ ID NO: 2133491 - RNA, 22 nt, Staphylococcus aureus subsp. aureus N315
aguacucaauguuaggugcuug

SEQ ID NO: 2133492 - RNA, 23 nt, Staphylococcus aureus subsp. aureus N315
aguacuaaucaauacuaaaccaa

SEQ ID NO: 2133493 - RNA, 16 nt, Staphylococcus aureus subsp. aureus N315
aguacuaaaaguauga

SEQ ID NO: 2133494 - RNA, 16 nt, Staphylococcus aureus subsp. aureus N315
aguacuuuaaaauugu

SEQ ID NO: 2133495 - RNA, 23 nt, Staphylococcus aureus subsp. aureus N315
aguacgcaauuuaauauuauaag

SEQ ID NO: 2133496 - RNA, 17 nt, Staphylococcus aureus subsp. aureus N315
agccucuugccuugaaa

SEQ ID NO: 2133497 - RNA, 19 nt, Staphylococcus aureus subsp. aureus N315
agccucuugccuugaaauc

SEQ ID NO: 2133498 - RNA, 21 nt, Staphylococcus aureus subsp. aureus N315
agccuagaacauugauuauug

SEQ ID NO: 2133499 - RNA, 22 nt, Staphylococcus aureus subsp. aureus N315
agccuauuuaaaagacaaucuc

SEQ ID NO: 2133500 - RNA, 13 nt, Staphylococcus aureus subsp. aureus N315
agccuucaaaaug

SEQ ID NO: 2133501 - RNA, 17 nt, Staphylococcus aureus subsp. aureus N315
agccuuaauaucaugca

SEQ ID NO: 2133502 - RNA, 23 nt, Staphylococcus aureus subsp. aureus N315
agccauuuguuguaaaccagcua

SEQ ID NO: 2133503 - RNA, 16 nt, Staphylococcus aureus subsp. aureus N315
agcccugacaauucau

SEQ ID NO: 2133504 - RNA, 14 nt, Staphylococcus aureus subsp. aureus N315
agcccuauuuuuaa

SEQ ID NO: 2133505 - RNA, 18 nt, Staphylococcus aureus subsp. aureus N315
agccccuuacaaccuuug

SEQ ID NO: 2133506 - RNA, 17 nt, Staphylococcus aureus subsp. aureus N315
agcgcaggcgcuccuac

SEQ ID NO: 2133507 - RNA, 20 nt, Staphylococcus aureus subsp. aureus N315
agcgaucuuuuuuauuuaau

SEQ ID NO: 2133508 - RNA, 22 nt, Staphylococcus aureus subsp. aureus N315
agcgauuuuaaagaaaaguuua

SEQ ID NO: 2133509 - RNA, 17 nt, Staphylococcus aureus subsp. aureus N315
agcgcaccaauuaucaa

SEQ ID NO: 2133510 - RNA, 21 nt, Staphylococcus aureus subsp. aureus N315
agcgccuaugugaugguaaau

SEQ ID NO: 2133511 - RNA, 22 nt, Staphylococcus aureus subsp. aureus N315
agcgcuguugugaguucauaau

SEQ ID NO: 2133512 - RNA, 12 nt, Staphylococcus aureus subsp. aureus N315
agcguaaaguuu

SEQ ID NO: 2133513 - RNA, 15 nt, Staphylococcus aureus subsp. aureus N315
agcuagaaacaaugc

SEQ ID NO: 2133514 - RNA, 14 nt, Staphylococcus aureus subsp. aureus N315
agcuaggguuaaaa

SEQ ID NO: 2133515 - RNA, 15 nt, Staphylococcus aureus subsp. aureus N315
agcuagcuacaaagu

SEQ ID NO: 2133516 - RNA, 21 nt, Staphylococcus aureus subsp. aureus N315
agcguuucuugaucuaaugua

SEQ ID NO: 2133517 - RNA, 19 nt, Staphylococcus aureus subsp. aureus N315
agcguucucuaauuucaca

SEQ ID NO: 2133518 - RNA, 13 nt, Staphylococcus aureus subsp. aureus N315
agcuauagaaaug

SEQ ID NO: 2133519 - RNA, 13 nt, Staphylococcus aureus subsp. aureus N315
agcuccagucauu

SEQ ID NO: 2133520 - RNA, 16 nt, Staphylococcus aureus subsp. aureus N315
agcucguuaaaucaca

SEQ ID NO: 2133521 - RNA, 19 nt, Staphylococcus aureus subsp. aureus N315
agcugauuucuaucaaaua

SEQ ID NO: 2133522 - RNA, 17 nt, Staphylococcus aureus subsp. aureus N315
agcugauuaaaauguua

SEQ ID NO: 2133523 - RNA, 19 nt, Staphylococcus aureus subsp. aureus N315
agcaagucuucuaaaaaau

SEQ ID NO: 2133524 - RNA, 22 nt, Staphylococcus aureus subsp. aureus N315
agcaauuaaagucaauuuaaau

SEQ ID NO: 2133525 - RNA, 21 nt, Staphylococcus aureus subsp. aureus N315
agcaaugcaugcuucucaauu

SEQ ID NO: 2133526 - RNA, 17 nt, Staphylococcus aureus subsp. aureus N315
agcaacgauaccaaaua

SEQ ID NO: 2133527 - RNA, 15 nt, Staphylococcus aureus subsp. aureus N315
agcaacgaugucacu

SEQ ID NO: 2133528 - RNA, 19 nt, Staphylococcus aureus subsp. aureus N315
agcaacgauaccaaauaua

SEQ ID NO: 2133529 - RNA, 13 nt, Staphylococcus aureus subsp. aureus N315
agcaacaaaagau

SEQ ID NO: 2133530 - RNA, 16 nt, Staphylococcus aureus subsp. aureus N315
agcaacaucggcacca

SEQ ID NO: 2133531 - RNA, 19 nt, Staphylococcus aureus subsp. aureus N315
agauuuuaugcuuuacuug

SEQ ID NO: 2133532 - RNA, 22 nt, Staphylococcus aureus subsp. aureus N315
agcaaaauuauguaaaaaauau

SEQ ID NO: 2133533 - RNA, 16 nt, Staphylococcus aureus subsp. aureus N315
agcaaauauuauuaaa

SEQ ID NO: 2133534 - RNA, 13 nt, Staphylococcus aureus subsp. aureus N315
agcaaauaaaauc

SEQ ID NO: 2133535 - RNA, 22 nt, Staphylococcus aureus subsp. aureus N315
agcaaagucuccgugauaaauu

SEQ ID NO: 2133536 - RNA, 20 nt, Staphylococcus aureus subsp. aureus N315
agcaaauuauauagaaaacu

SEQ ID NO: 2133537 - RNA, 15 nt, Staphylococcus aureus subsp. aureus N315
agcaaaugcacugua

SEQ ID NO: 2133538 - RNA, 15 nt, Staphylococcus aureus subsp. aureus N315
agcaaacaauuuugu

SEQ ID NO: 2133539 - RNA, 17 nt, Staphylococcus aureus subsp. aureus N315
agauaaguaauaauaua

SEQ ID NO: 2133540 - RNA, 23 nt, Staphylococcus aureus subsp. aureus N315
agauaaguaguggauaaucacaa

SEQ ID NO: 2133541 - RNA, 16 nt, Staphylococcus aureus subsp. aureus N315
agauaaguuacuagca

SEQ ID NO: 2133542 - RNA, 12 nt, Staphylococcus aureus subsp. aureus N315
agauaaugcacc

SEQ ID NO: 2133543 - RNA, 23 nt, Staphylococcus aureus subsp. aureus N315
agauuuaaacauccaauuauguu

SEQ ID NO: 2133544 - RNA, 23 nt, Staphylococcus aureus subsp. aureus N315
agauuguaaaaauacauaauaaa

SEQ ID NO: 2133545 - RNA, 22 nt, Staphylococcus aureus subsp. aureus N315
agauuuaccucuugauaaaaua

SEQ ID NO: 2133546 - RNA, 19 nt, Staphylococcus aureus subsp. aureus N315
agauuuaguuuuuuuaaag

SEQ ID NO: 2133547 - RNA, 19 nt, Staphylococcus aureus subsp. aureus N315
agauuuauuaaauauaugc

SEQ ID NO: 2133548 - RNA, 20 nt, Staphylococcus aureus subsp. aureus N315
agauuuauuaaauauaugcg

SEQ ID NO: 2133549 - RNA, 22 nt, Staphylococcus aureus subsp. aureus N315
agauuuaguuuuuuuaaaguuu

SEQ ID NO: 2133550 - RNA, 12 nt, Staphylococcus aureus subsp. aureus N315
agauuuuaaauc

SEQ ID NO: 2133551 - RNA, 14 nt, Staphylococcus aureus subsp. aureus N315
agauuuuaaaucaa

SEQ ID NO: 2133552 - RNA, 20 nt, Staphylococcus aureus subsp. aureus N315
agcacuauaacaagguguuc

SEQ ID NO: 2133553 - RNA, 17 nt, Staphylococcus aureus subsp. aureus N315
agcacugaaaucuagac

SEQ ID NO: 2133554 - RNA, 17 nt, Staphylococcus aureus subsp. aureus N315
agcacuaucuuuugcuu

SEQ ID NO: 2133555 - RNA, 15 nt, Staphylococcus aureus subsp. aureus N315
agcacgagaaauguc

SEQ ID NO: 2133556 - RNA, 16 nt, Staphylococcus aureus subsp. aureus N315
agcaccuuaccuacuu

SEQ ID NO: 2133557 - RNA, 18 nt, Staphylococcus aureus subsp. aureus N315
agcaccguaacauaugua

SEQ ID NO: 2133558 - RNA, 23 nt, Staphylococcus aureus subsp. aureus N315
agcaccgauuuggucagcgacau

SEQ ID NO: 2133559 - RNA, 21 nt, Staphylococcus aureus subsp. aureus N315
agcacauuuuuaguuagaaag

SEQ ID NO: 2133560 - RNA, 20 nt, Staphylococcus aureus subsp. aureus N315
agcacauuuuuaguuagaaa

SEQ ID NO: 2133561 - RNA, 19 nt, Staphylococcus aureus subsp. aureus N315
agcaauucuucaauuucau

SEQ ID NO: 2133562 - RNA, 17 nt, Staphylococcus aureus subsp. aureus N315
agcaauugaaucaaaua

SEQ ID NO: 2133563 - RNA, 18 nt, Staphylococcus aureus subsp. aureus N315
agcaguauauaucaaaua

SEQ ID NO: 2133564 - RNA, 20 nt, Staphylococcus aureus subsp. aureus N315
agcaguaaguugauuucuac

SEQ ID NO: 2133565 - RNA, 21 nt, Staphylococcus aureus subsp. aureus N315
agcauaccuuuauuauuuaau

SEQ ID NO: 2133566 - RNA, 21 nt, Staphylococcus aureus subsp. aureus N315
agcaguuguugguuuugcaac

SEQ ID NO: 2133567 - RNA, 14 nt, Staphylococcus aureus subsp. aureus N315
agcaguuucugaga

SEQ ID NO: 2133568 - RNA, 21 nt, Staphylococcus aureus subsp. aureus N315
agcaucuugucuaguucgauu

SEQ ID NO: 2133569 - RNA, 14 nt, Staphylococcus aureus subsp. aureus N315
agcaucguaaaaaa

SEQ ID NO: 2133570 - RNA, 21 nt, Staphylococcus aureus subsp. aureus N315
agcaucguaaaaaacaaaaaa

SEQ ID NO: 2133571 - RNA, 19 nt, Staphylococcus aureus subsp. aureus N315
agcaucacaguguugaauu

SEQ ID NO: 2133572 - RNA, 22 nt, Staphylococcus aureus subsp. aureus N315
agcaucaccaauggcagaugau

SEQ ID NO: 2133573 - RNA, 17 nt, Staphylococcus aureus subsp. aureus N315
agcauaucucaagauau

SEQ ID NO: 2133574 - RNA, 13 nt, Staphylococcus aureus subsp. aureus N315
agcaucaucaauu

SEQ ID NO: 2133575 - RNA, 13 nt, Staphylococcus aureus subsp. aureus N315
agccaucaauauu

SEQ ID NO: 2133576 - RNA, 22 nt, Staphylococcus aureus subsp. aureus N315
agccauuauuauuuuuuucuuu

SEQ ID NO: 2133577 - RNA, 21 nt, Staphylococcus aureus subsp. aureus N315
agcaugauaaaguauguuguc

SEQ ID NO: 2133578 - RNA, 19 nt, Staphylococcus aureus subsp. aureus N315
agcauugggacauaaaauu

SEQ ID NO: 2133579 - RNA, 20 nt, Staphylococcus aureus subsp. aureus N315
agcauugggacauaaaauua

SEQ ID NO: 2133580 - RNA, 20 nt, Staphylococcus aureus subsp. aureus N315
agcauuaaauuccaugucaa

SEQ ID NO: 2133581 - RNA, 18 nt, Staphylococcus aureus subsp. aureus N315
agcauuagcaaauauuau

SEQ ID NO: 2133582 - RNA, 17 nt, Staphylococcus aureus subsp. aureus N315
agcauuacgccaccagu

SEQ ID NO: 2133583 - RNA, 20 nt, Staphylococcus aureus subsp. aureus N315
agcauuacgccaccaguuuc

SEQ ID NO: 2133584 - RNA, 11 nt, Staphylococcus aureus subsp. aureus N315
agcauuauuau

SEQ ID NO: 2133585 - RNA, 17 nt, Staphylococcus aureus subsp. aureus N315
agccaagauaaaucauc

SEQ ID NO: 2133586 - RNA, 15 nt, Staphylococcus aureus subsp. aureus N315
acuuguaaauuuauu

SEQ ID NO: 2133587 - RNA, 16 nt, Staphylococcus aureus subsp. aureus N315
acuuguaaucauacca

SEQ ID NO: 2133588 - RNA, 21 nt, Staphylococcus aureus subsp. aureus N315
acuuggcuuaggaugaaaaua

SEQ ID NO: 2133589 - RNA, 14 nt, Staphylococcus aureus subsp. aureus N315
acuuggccuaaguu

SEQ ID NO: 2133590 - RNA, 18 nt, Staphylococcus aureus subsp. aureus N315
acuuggauucaaaugaca

SEQ ID NO: 2133591 - RNA, 21 nt, Staphylococcus aureus subsp. aureus N315
acuugcuguugcaauaaaauc

SEQ ID NO: 2133592 - RNA, 14 nt, Staphylococcus aureus subsp. aureus N315
acuugcgcaugcuu

SEQ ID NO: 2133593 - RNA, 15 nt, Staphylococcus aureus subsp. aureus N315
acuugaugaaacuga

SEQ ID NO: 2133594 - RNA, 22 nt, Staphylococcus aureus subsp. aureus N315
acuugaaaauagccauauucau

SEQ ID NO: 2133595 - RNA, 11 nt, Staphylococcus aureus subsp. aureus N315
acuugaagaaa

SEQ ID NO: 2133596 - RNA, 16 nt, Staphylococcus aureus subsp. aureus N315
acuugaagaaaaguau

SEQ ID NO: 2133597 - RNA, 21 nt, Staphylococcus aureus subsp. aureus N315
acuugaagaaaaguauaaaua

SEQ ID NO: 2133598 - RNA, 18 nt, Staphylococcus aureus subsp. aureus N315
acuugaauaccuuuuauu

SEQ ID NO: 2133599 - RNA, 17 nt, Staphylococcus aureus subsp. aureus N315
acuugaccacuuuuguu

SEQ ID NO: 2133600 - RNA, 18 nt, Staphylococcus aureus subsp. aureus N315
acuugaucauuauaaaau

SEQ ID NO: 2133601 - RNA, 17 nt, Staphylococcus aureus subsp. aureus N315
acuugauaaaaaaugaa

SEQ ID NO: 2133602 - RNA, 22 nt, Staphylococcus aureus subsp. aureus N315
acuucuuaaaauaugauuuaaa

SEQ ID NO: 2133603 - RNA, 16 nt, Staphylococcus aureus subsp. aureus N315
acuucucuaucagucc

SEQ ID NO: 2133604 - RNA, 23 nt, Staphylococcus aureus subsp. aureus N315
acuucugauucuucacuaaaaau

SEQ ID NO: 2133605 - RNA, 15 nt, Staphylococcus aureus subsp. aureus N315
acuucugauucuuca

SEQ ID NO: 2133606 - RNA, 22 nt, Staphylococcus aureus subsp. aureus N315
acuucuuuucuuugauaacaau

SEQ ID NO: 2133607 - RNA, 21 nt, Staphylococcus aureus subsp. aureus N315
acuucuuuugcaaaacgcauu

SEQ ID NO: 2133608 - RNA, 14 nt, Staphylococcus aureus subsp. aureus N315
acuucuuuugcaaa

SEQ ID NO: 2133609 - RNA, 15 nt, Staphylococcus aureus subsp. aureus N315
acuucuuuauauuua

SEQ ID NO: 2133610 - RNA, 17 nt, Staphylococcus aureus subsp. aureus N315
acuucuuguucgauaau

SEQ ID NO: 2133611 - RNA, 16 nt, Staphylococcus aureus subsp. aureus N315
acuucuuuauauuuau

SEQ ID NO: 2133612 - RNA, 16 nt, Staphylococcus aureus subsp. aureus N315
acuucuuucaaaaaca

SEQ ID NO: 2133613 - RNA, 14 nt, Staphylococcus aureus subsp. aureus N315
acuuccaucaaucc

SEQ ID NO: 2133614 - RNA, 21 nt, Staphylococcus aureus subsp. aureus N315
acuuccaauacuguugucuug

SEQ ID NO: 2133615 - RNA, 22 nt, Staphylococcus aureus subsp. aureus N315
acuucuauauuaauagaaagug

SEQ ID NO: 2133616 - RNA, 22 nt, Staphylococcus aureus subsp. aureus N315
acuucuauuuuauaauaaauuu

SEQ ID NO: 2133617 - RNA, 17 nt, Staphylococcus aureus subsp. aureus N315
acuucucaauuuaguau

SEQ ID NO: 2133618 - RNA, 16 nt, Staphylococcus aureus subsp. aureus N315
acuucucaauuuagua

SEQ ID NO: 2133619 - RNA, 15 nt, Staphylococcus aureus subsp. aureus N315
acuucuaauaguaau

SEQ ID NO: 2133620 - RNA, 15 nt, Staphylococcus aureus subsp. aureus N315
acuucuaauuugcaa

SEQ ID NO: 2133621 - RNA, 16 nt, Staphylococcus aureus subsp. aureus N315
acuucuaauuugcaaa

SEQ ID NO: 2133622 - RNA, 17 nt, Staphylococcus aureus subsp. aureus N315
acuucuaauuugcaaaa

SEQ ID NO: 2133623 - RNA, 18 nt, Staphylococcus aureus subsp. aureus N315
acuguaguggaagacaau

SEQ ID NO: 2133624 - RNA, 23 nt, Staphylococcus aureus subsp. aureus N315
acuguauaaauaaccgcacuuuc

SEQ ID NO: 2133625 - RNA, 19 nt, Staphylococcus aureus subsp. aureus N315
acuguauaaggauguacua

SEQ ID NO: 2133626 - RNA, 15 nt, Staphylococcus aureus subsp. aureus N315
acuguaguacuauag

SEQ ID NO: 2133627 - RNA, 22 nt, Staphylococcus aureus subsp. aureus N315
acuguauagcuggcuuuuuaau

SEQ ID NO: 2133628 - RNA, 22 nt, Staphylococcus aureus subsp. aureus N315
acuguauuuuaacgucauuuuu

SEQ ID NO: 2133629 - RNA, 13 nt, Staphylococcus aureus subsp. aureus N315
acuguaaaucauc

SEQ ID NO: 2133630 - RNA, 12 nt, Staphylococcus aureus subsp. aureus N315
acuguaaaucau

SEQ ID NO: 2133631 - RNA, 18 nt, Staphylococcus aureus subsp. aureus N315
acugugauucauucguac

SEQ ID NO: 2133632 - RNA, 16 nt, Staphylococcus aureus subsp. aureus N315
acuguuugcuuuauca

SEQ ID NO: 2133633 - RNA, 21 nt, Staphylococcus aureus subsp. aureus N315
acuguuucacguaaugaauca

SEQ ID NO: 2133634 - RNA, 15 nt, Staphylococcus aureus subsp. aureus N315
acuguuggaauaccu

SEQ ID NO: 2133635 - RNA, 16 nt, Staphylococcus aureus subsp. aureus N315
acuguuggaauaccuu

SEQ ID NO: 2133636 - RNA, 13 nt, Staphylococcus aureus subsp. aureus N315
acuucaucuaaau

SEQ ID NO: 2133637 - RNA, 13 nt, Staphylococcus aureus subsp. aureus N315
acuucauaaguca

SEQ ID NO: 2133638 - RNA, 17 nt, Staphylococcus aureus subsp. aureus N315
acuucauaagucacagu

SEQ ID NO: 2133639 - RNA, 18 nt, Staphylococcus aureus subsp. aureus N315
acuucauaauauauccug

SEQ ID NO: 2133640 - RNA, 15 nt, Staphylococcus aureus subsp. aureus N315
acuucauuaguugcc

SEQ ID NO: 2133641 - RNA, 17 nt, Staphylococcus aureus subsp. aureus N315
acuucaaacguuaugua

SEQ ID NO: 2133642 - RNA, 18 nt, Staphylococcus aureus subsp. aureus N315
acuuauuugaaugcaaau

SEQ ID NO: 2133643 - RNA, 14 nt, Staphylococcus aureus subsp. aureus N315
acuuauuucuuuuc

SEQ ID NO: 2133644 - RNA, 20 nt, Staphylococcus aureus subsp. aureus N315
acuuauuugccauauacaca

SEQ ID NO: 2133645 - RNA, 22 nt, Staphylococcus aureus subsp. aureus N315
acuuauuugccauauacacacu

SEQ ID NO: 2133646 - RNA, 18 nt, Staphylococcus aureus subsp. aureus N315
acuuauuugccauauaca

SEQ ID NO: 2133647 - RNA, 13 nt, Staphylococcus aureus subsp. aureus N315
acuuacuuuucua

SEQ ID NO: 2133648 - RNA, 19 nt, Staphylococcus aureus subsp. aureus N315
acuuauugacgaguagauu

SEQ ID NO: 2133649 - RNA, 15 nt, Staphylococcus aureus subsp. aureus N315
acuuauuaauuaaua

SEQ ID NO: 2133650 - RNA, 18 nt, Staphylococcus aureus subsp. aureus N315
acuuauuaauuaauagag

SEQ ID NO: 2133651 - RNA, 21 nt, Staphylococcus aureus subsp. aureus N315
acuuauuaauuaauagagaca

SEQ ID NO: 2133652 - RNA, 13 nt, Staphylococcus aureus subsp. aureus N315
acuuacauuacau

SEQ ID NO: 2133653 - RNA, 23 nt, Staphylococcus aureus subsp. aureus N315
acuuacauuuuaauaaaaucauc

SEQ ID NO: 2133654 - RNA, 15 nt, Staphylococcus aureus subsp. aureus N315
acuuaccuuucaaau

SEQ ID NO: 2133655 - RNA, 15 nt, Staphylococcus aureus subsp. aureus N315
acuuucgcuugcaaa

SEQ ID NO: 2133656 - RNA, 18 nt, Staphylococcus aureus subsp. aureus N315
acuuucguauuuuucuug

SEQ ID NO: 2133657 - RNA, 14 nt, Staphylococcus aureus subsp. aureus N315
acuuucuaauuguu

SEQ ID NO: 2133658 - RNA, 15 nt, Staphylococcus aureus subsp. aureus N315
acuuucccuacugcu

SEQ ID NO: 2133659 - RNA, 18 nt, Staphylococcus aureus subsp. aureus N315
acuuuccgccuucaaucc

SEQ ID NO: 2133660 - RNA, 23 nt, Staphylococcus aureus subsp. aureus N315
acuuugaauugguugaucaauua

SEQ ID NO: 2133661 - RNA, 14 nt, Staphylococcus aureus subsp. aureus N315
acuuugauauguuu

SEQ ID NO: 2133662 - RNA, 15 nt, Staphylococcus aureus subsp. aureus N315
acuuuggcaaaguca

SEQ ID NO: 2133663 - RNA, 17 nt, Staphylococcus aureus subsp. aureus N315
acuuuggacuuuaaagu

SEQ ID NO: 2133664 - RNA, 17 nt, Staphylococcus aureus subsp. aureus N315
acuuuggucaacuuuuu

SEQ ID NO: 2133665 - RNA, 19 nt, Staphylococcus aureus subsp. aureus N315
acuuugucuuuaaugaaag

SEQ ID NO: 2133666 - RNA, 13 nt, Staphylococcus aureus subsp. aureus N315
acuuuuagauuau

SEQ ID NO: 2133667 - RNA, 15 nt, Staphylococcus aureus subsp. aureus N315
acuuuuauagaaaau

SEQ ID NO: 2133668 - RNA, 21 nt, Staphylococcus aureus subsp. aureus N315
acuuuuaccauugugaauaau

SEQ ID NO: 2133669 - RNA, 12 nt, Staphylococcus aureus subsp. aureus N315
acuuuauauaua

SEQ ID NO: 2133670 - RNA, 20 nt, Staphylococcus aureus subsp. aureus N315
acuuuauauauaaagaaaua

SEQ ID NO: 2133671 - RNA, 14 nt, Staphylococcus aureus subsp. aureus N315
acuuuaugaaauuu

SEQ ID NO: 2133672 - RNA, 18 nt, Staphylococcus aureus subsp. aureus N315
acuuuacgauaaauagug

SEQ ID NO: 2133673 - RNA, 15 nt, Staphylococcus aureus subsp. aureus N315
acuuucacuuuuuau

SEQ ID NO: 2133674 - RNA, 16 nt, Staphylococcus aureus subsp. aureus N315
acuuucacuuuuuaua

SEQ ID NO: 2133675 - RNA, 20 nt, Staphylococcus aureus subsp. aureus N315
acuuucaaacaaaucuuuua

SEQ ID NO: 2133676 - RNA, 20 nt, Staphylococcus aureus subsp. aureus N315
acuuuaccaauaucaugcaa

SEQ ID NO: 2133677 - RNA, 21 nt, Staphylococcus aureus subsp. aureus N315
acuuuaauacuaccguuuuua

SEQ ID NO: 2133678 - RNA, 22 nt, Staphylococcus aureus subsp. aureus N315
acuuuaauacuaccguuuuuau

SEQ ID NO: 2133679 - RNA, 11 nt, Staphylococcus aureus subsp. aureus N315
acuuuaacuuc

SEQ ID NO: 2133680 - RNA, 16 nt, Staphylococcus aureus subsp. aureus N315
acuuuaacuucuuuug

SEQ ID NO: 2133681 - RNA, 22 nt, Staphylococcus aureus subsp. aureus N315
acuuuaaaguuaaaguuuuguu

SEQ ID NO: 2133682 - RNA, 16 nt, Staphylococcus aureus subsp. aureus N315
acuuguuuguuuuugu

SEQ ID NO: 2133683 - RNA, 16 nt, Staphylococcus aureus subsp. aureus N315
acuuuaaaauuguaua

SEQ ID NO: 2133684 - RNA, 15 nt, Staphylococcus aureus subsp. aureus N315
acuuguauuguuugu

SEQ ID NO: 2133685 - RNA, 18 nt, Staphylococcus aureus subsp. aureus N315
acuugugauauauaacca

SEQ ID NO: 2133686 - RNA, 20 nt, Staphylococcus aureus subsp. aureus N315
acuugugcgcgacguuuaaa

SEQ ID NO: 2133687 - RNA, 23 nt, Staphylococcus aureus subsp. aureus N315
agaaauacuaauuucuauagaaa

SEQ ID NO: 2133688 - RNA, 20 nt, Staphylococcus aureus subsp. aureus N315
agaaauacucaguuuauuga

SEQ ID NO: 2133689 - RNA, 14 nt, Staphylococcus aureus subsp. aureus N315
agaaaucuuaaaga

SEQ ID NO: 2133690 - RNA, 16 nt, Staphylococcus aureus subsp. aureus N315
agaaaucaccagauuu

SEQ ID NO: 2133691 - RNA, 17 nt, Staphylococcus aureus subsp. aureus N315
agaaagugcgguuauuu

SEQ ID NO: 2133692 - RNA, 16 nt, Staphylococcus aureus subsp. aureus N315
agaaacuuccaacaua

SEQ ID NO: 2133693 - RNA, 13 nt, Staphylococcus aureus subsp. aureus N315
agaaagaaauugu

SEQ ID NO: 2133694 - RNA, 11 nt, Staphylococcus aureus subsp. aureus N315
agaaacacuuu

SEQ ID NO: 2133695 - RNA, 22 nt, Staphylococcus aureus subsp. aureus N315
agaaacaaugcgaagaaaucau

SEQ ID NO: 2133696 - RNA, 20 nt, Staphylococcus aureus subsp. aureus N315
agaaacacaaggaauauaca

SEQ ID NO: 2133697 - RNA, 18 nt, Staphylococcus aureus subsp. aureus N315
agaaaaguauaaauauaa

SEQ ID NO: 2133698 - RNA, 20 nt, Staphylococcus aureus subsp. aureus N315
agaaaaguauaaauauaaaa

SEQ ID NO: 2133699 - RNA, 23 nt, Staphylococcus aureus subsp. aureus N315
agaaaaguauaaauauaaaaagu

SEQ ID NO: 2133700 - RNA, 16 nt, Staphylococcus aureus subsp. aureus N315
agaaaaguaaguaaaa

SEQ ID NO: 2133701 - RNA, 23 nt, Staphylococcus aureus subsp. aureus N315
agaaaaguuacuuacgccaauca

SEQ ID NO: 2133702 - RNA, 20 nt, Staphylococcus aureus subsp. aureus N315
agaaaagggcaaaaaaggau

SEQ ID NO: 2133703 - RNA, 15 nt, Staphylococcus aureus subsp. aureus N315
agaaaagcaguaaga

SEQ ID NO: 2133704 - RNA, 22 nt, Staphylococcus aureus subsp. aureus N315
agaaaagcagucgaacaaugau

SEQ ID NO: 2133705 - RNA, 17 nt, Staphylococcus aureus subsp. aureus N315
agaaaacuauuuuaaaa

SEQ ID NO: 2133706 - RNA, 16 nt, Staphylococcus aureus subsp. aureus N315
agaaaacuauuuuaaa

SEQ ID NO: 2133707 - RNA, 20 nt, Staphylococcus aureus subsp. aureus N315
acuuuuauuuguauuguaua

SEQ ID NO: 2133708 - RNA, 18 nt, Staphylococcus aureus subsp. aureus N315
agaaaacauaaauacaaa

SEQ ID NO: 2133709 - RNA, 17 nt, Staphylococcus aureus subsp. aureus N315
agaaaacauaaauacaa

SEQ ID NO: 2133710 - RNA, 16 nt, Staphylococcus aureus subsp. aureus N315
agaaaacauaaauaca

SEQ ID NO: 2133711 - RNA, 15 nt, Staphylococcus aureus subsp. aureus N315
agagccacuaaugau

SEQ ID NO: 2133712 - RNA, 17 nt, Staphylococcus aureus subsp. aureus N315
agaggacgcuuuauucu

SEQ ID NO: 2133713 - RNA, 20 nt, Staphylococcus aureus subsp. aureus N315
agagcucaaccucuuaguuc

SEQ ID NO: 2133714 - RNA, 15 nt, Staphylococcus aureus subsp. aureus N315
agauaaacaagccaa

SEQ ID NO: 2133715 - RNA, 19 nt, Staphylococcus aureus subsp. aureus N315
agauaaaucgauaaaaugu

SEQ ID NO: 2133716 - RNA, 19 nt, Staphylococcus aureus subsp. aureus N315
agauaaacucuaaauaaac

SEQ ID NO: 2133717 - RNA, 20 nt, Staphylococcus aureus subsp. aureus N315
agauaacuagaaugauuaaa

SEQ ID NO: 2133718 - RNA, 15 nt, Staphylococcus aureus subsp. aureus N315
agauaacuagcaaau

SEQ ID NO: 2133719 - RNA, 15 nt, Staphylococcus aureus subsp. aureus N315
agauaagaauauuua

SEQ ID NO: 2133720 - RNA, 16 nt, Staphylococcus aureus subsp. aureus N315
agaguuaauccucauu

SEQ ID NO: 2133721 - RNA, 12 nt, Staphylococcus aureus subsp. aureus N315
agagaacagcag

SEQ ID NO: 2133722 - RNA, 17 nt, Staphylococcus aureus subsp. aureus N315
agagaaauucgaaaaga

SEQ ID NO: 2133723 - RNA, 21 nt, Staphylococcus aureus subsp. aureus N315
agagaaauucgaaaagaaauu

SEQ ID NO: 2133724 - RNA, 20 nt, Staphylococcus aureus subsp. aureus N315
agagaauuucgaaaagaaau

SEQ ID NO: 2133725 - RNA, 16 nt, Staphylococcus aureus subsp. aureus N315
agagaaacaaaacaaa

SEQ ID NO: 2133726 - RNA, 11 nt, Staphylococcus aureus subsp. aureus N315
agagaaauucg

SEQ ID NO: 2133727 - RNA, 23 nt, Staphylococcus aureus subsp. aureus N315
agagaaagaauaaauguuaaaga

SEQ ID NO: 2133728 - RNA, 24 nt, Staphylococcus aureus subsp. aureus N315
agacuugguuacuuaguaaggaau

SEQ ID NO: 2133729 - RNA, 11 nt, Staphylococcus aureus subsp. aureus N315
agacuuucuug

SEQ ID NO: 2133730 - RNA, 17 nt, Staphylococcus aureus subsp. aureus N315
agacuccuaaauuauug

SEQ ID NO: 2133731 - RNA, 13 nt, Staphylococcus aureus subsp. aureus N315
agacuccuaaauu

SEQ ID NO: 2133732 - RNA, 17 nt, Staphylococcus aureus subsp. aureus N315
agacucuccuuuuuuaa

SEQ ID NO: 2133733 - RNA, 17 nt, Staphylococcus aureus subsp. aureus N315
agacuguuuuuuuguuu

SEQ ID NO: 2133734 - RNA, 15 nt, Staphylococcus aureus subsp. aureus N315
agacugccaauaaaa

SEQ ID NO: 2133735 - RNA, 20 nt, Staphylococcus aureus subsp. aureus N315
agacugccaauaaaaugcaa

SEQ ID NO: 2133736 - RNA, 17 nt, Staphylococcus aureus subsp. aureus N315
agacauuuuaucugaaa

SEQ ID NO: 2133737 - RNA, 12 nt, Staphylococcus aureus subsp. aureus N315
agacauuaaaaa

SEQ ID NO: 2133738 - RNA, 13 nt, Staphylococcus aureus subsp. aureus N315
agacaccaaaaaa

SEQ ID NO: 2133739 - RNA, 15 nt, Staphylococcus aureus subsp. aureus N315
agacaccuucaauau

SEQ ID NO: 2133740 - RNA, 17 nt, Staphylococcus aureus subsp. aureus N315
agacaaccgauauaauu

SEQ ID NO: 2133741 - RNA, 21 nt, Staphylococcus aureus subsp. aureus N315
agacaaugauuugugguaauc

SEQ ID NO: 2133742 - RNA, 23 nt, Staphylococcus aureus subsp. aureus N315
agaauuaauaauuuuuuuccuuu

SEQ ID NO: 2133743 - RNA, 15 nt, Staphylococcus aureus subsp. aureus N315
agaauuaaugaaaua

SEQ ID NO: 2133744 - RNA, 18 nt, Staphylococcus aureus subsp. aureus N315
agaauuauucaaguaaua

SEQ ID NO: 2133745 - RNA, 20 nt, Staphylococcus aureus subsp. aureus N315
agaauuuuucauauacuuaa

SEQ ID NO: 2133746 - RNA, 18 nt, Staphylococcus aureus subsp. aureus N315
agaagccucuugccuuga

SEQ ID NO: 2133747 - RNA, 17 nt, Staphylococcus aureus subsp. aureus N315
agaaauucuacaaacaa

SEQ ID NO: 2133748 - RNA, 23 nt, Staphylococcus aureus subsp. aureus N315
agaaauucuacagguaaugcaag

SEQ ID NO: 2133749 - RNA, 21 nt, Staphylococcus aureus subsp. aureus N315
agaaaugacgauaccuuuaau

SEQ ID NO: 2133750 - RNA, 16 nt, Staphylococcus aureus subsp. aureus N315
agaaauucgaaaagaa

SEQ ID NO: 2133751 - RNA, 21 nt, Staphylococcus aureus subsp. aureus N315
agaaauuaccguuuauuucgu

SEQ ID NO: 2133752 - RNA, 18 nt, Staphylococcus aureus subsp. aureus N315
agaaauuagaaccaucau

SEQ ID NO: 2133753 - RNA, 17 nt, Staphylococcus aureus subsp. aureus N315
agaaucagcuaaauauu

SEQ ID NO: 2133754 - RNA, 19 nt, Staphylococcus aureus subsp. aureus N315
agaaugacaccuaauacca

SEQ ID NO: 2133755 - RNA, 19 nt, Staphylococcus aureus subsp. aureus N315
agaaucauuuaaaucaaua

SEQ ID NO: 2133756 - RNA, 18 nt, Staphylococcus aureus subsp. aureus N315
agaaugcaccaacaauag

SEQ ID NO: 2133757 - RNA, 16 nt, Staphylococcus aureus subsp. aureus N315
agaaugccauaccugc

SEQ ID NO: 2133758 - RNA, 17 nt, Staphylococcus aureus subsp. aureus N315
agaaugcgauuuccuuu

SEQ ID NO: 2133759 - RNA, 13 nt, Staphylococcus aureus subsp. aureus N315
agaaguuucuaua

SEQ ID NO: 2133760 - RNA, 16 nt, Staphylococcus aureus subsp. aureus N315
agaauaaacaacauac

SEQ ID NO: 2133761 - RNA, 12 nt, Staphylococcus aureus subsp. aureus N315
agaauaacuauu

SEQ ID NO: 2133762 - RNA, 21 nt, Staphylococcus aureus subsp. aureus N315
agaauaguuaccaaaauuuga

SEQ ID NO: 2133763 - RNA, 21 nt, Staphylococcus aureus subsp. aureus N315
agaauauauguauaacauuau

SEQ ID NO: 2133764 - RNA, 14 nt, Staphylococcus aureus subsp. aureus N315
acggcugcuuuaac

SEQ ID NO: 2133765 - RNA, 16 nt, Staphylococcus aureus subsp. aureus N315
acggcugcuuuaacug

SEQ ID NO: 2133766 - RNA, 15 nt, Staphylococcus aureus subsp. aureus N315
acgcuucaauuauuu

SEQ ID NO: 2133767 - RNA, 23 nt, Staphylococcus aureus subsp. aureus N315
acgcucaugaguuucucaucuac

SEQ ID NO: 2133768 - RNA, 19 nt, Staphylococcus aureus subsp. aureus N315
acgcucaugaguuucucau

SEQ ID NO: 2133769 - RNA, 15 nt, Staphylococcus aureus subsp. aureus N315
acgcugaaauuuuuu

SEQ ID NO: 2133770 - RNA, 17 nt, Staphylococcus aureus subsp. aureus N315
acgcgugaauuaaaaaa

SEQ ID NO: 2133771 - RNA, 22 nt, Staphylococcus aureus subsp. aureus N315
acgcuaauggaugaauauauug

SEQ ID NO: 2133772 - RNA, 15 nt, Staphylococcus aureus subsp. aureus N315
acgcuaauuuuacuc

SEQ ID NO: 2133773 - RNA, 17 nt, Staphylococcus aureus subsp. aureus N315
acgcucaacuauauaua

SEQ ID NO: 2133774 - RNA, 14 nt, Staphylococcus aureus subsp. aureus N315
acgccauucaucau

SEQ ID NO: 2133775 - RNA, 21 nt, Staphylococcus aureus subsp. aureus N315
acgccaaauaucaguaauaau

SEQ ID NO: 2133776 - RNA, 18 nt, Staphylococcus aureus subsp. aureus N315
acgcauuuuaaauaaaau

SEQ ID NO: 2133777 - RNA, 23 nt, Staphylococcus aureus subsp. aureus N315
acgcauacaggaaauugaagcgu

SEQ ID NO: 2133778 - RNA, 14 nt, Staphylococcus aureus subsp. aureus N315
acgcaguugaaaaa

SEQ ID NO: 2133779 - RNA, 18 nt, Staphylococcus aureus subsp. aureus N315
acugaaugcuaauacuaa

SEQ ID NO: 2133780 - RNA, 13 nt, Staphylococcus aureus subsp. aureus N315
acugaaauuuuuc

SEQ ID NO: 2133781 - RNA, 20 nt, Staphylococcus aureus subsp. aureus N315
acugaaauuucauaaaguuu

SEQ ID NO: 2133782 - RNA, 22 nt, Staphylococcus aureus subsp. aureus N315
acugacacuuuaaccacuccuu

SEQ ID NO: 2133783 - RNA, 16 nt, Staphylococcus aureus subsp. aureus N315
acucuccuuuuuuaaa

SEQ ID NO: 2133784 - RNA, 24 nt, Staphylococcus aureus subsp. aureus N315
acucuucaguacgaacaacuaaca

SEQ ID NO: 2133785 - RNA, 24 nt, Staphylococcus aureus subsp. aureus N315
acucguaaauuuuaucuaaacauu

SEQ ID NO: 2133786 - RNA, 17 nt, Staphylococcus aureus subsp. aureus N315
acucggggaauuuuuau

SEQ ID NO: 2133787 - RNA, 16 nt, Staphylococcus aureus subsp. aureus N315
acucguugcacucuuu

SEQ ID NO: 2133788 - RNA, 19 nt, Staphylococcus aureus subsp. aureus N315
acucuaaaaguuguaauuu

SEQ ID NO: 2133789 - RNA, 14 nt, Staphylococcus aureus subsp. aureus N315
acuaucuuuugcuu

SEQ ID NO: 2133790 - RNA, 15 nt, Staphylococcus aureus subsp. aureus N315
acuaucuucaucaua

SEQ ID NO: 2133791 - RNA, 20 nt, Staphylococcus aureus subsp. aureus N315
acuaugcauaauaccaauug

SEQ ID NO: 2133792 - RNA, 21 nt, Staphylococcus aureus subsp. aureus N315
acuaugcaaaugaaauucuuu

SEQ ID NO: 2133793 - RNA, 15 nt, Staphylococcus aureus subsp. aureus N315
acucaauuucauuug

SEQ ID NO: 2133794 - RNA, 18 nt, Staphylococcus aureus subsp. aureus N315
acucaauuucauuugaaa

SEQ ID NO: 2133795 - RNA, 20 nt, Staphylococcus aureus subsp. aureus N315
acucacauucugcccugcaa

SEQ ID NO: 2133796 - RNA, 12 nt, Staphylococcus aureus subsp. aureus N315
acucacuucuua

SEQ ID NO: 2133797 - RNA, 13 nt, Staphylococcus aureus subsp. aureus N315
acucacuucaacg

SEQ ID NO: 2133798 - RNA, 20 nt, Staphylococcus aureus subsp. aureus N315
acucagaaucuuacauugau

SEQ ID NO: 2133799 - RNA, 19 nt, Staphylococcus aureus subsp. aureus N315
acucauaaccgcuucuuuu

SEQ ID NO: 2133800 - RNA, 21 nt, Staphylococcus aureus subsp. aureus N315
acucauacaaauuuuuuuuau

SEQ ID NO: 2133801 - RNA, 16 nt, Staphylococcus aureus subsp. aureus N315
acucaguuuauugagg

SEQ ID NO: 2133802 - RNA, 17 nt, Staphylococcus aureus subsp. aureus N315
acucaggcuuaauuaau

SEQ ID NO: 2133803 - RNA, 17 nt, Staphylococcus aureus subsp. aureus N315
acuccaguuuauaacug

SEQ ID NO: 2133804 - RNA, 21 nt, Staphylococcus aureus subsp. aureus N315
acucauccauugaucuuuuau

SEQ ID NO: 2133805 - RNA, 16 nt, Staphylococcus aureus subsp. aureus N315
acucauaccaaaaaca

SEQ ID NO: 2133806 - RNA, 19 nt, Staphylococcus aureus subsp. aureus N315
acucauaccaaaaacauua

SEQ ID NO: 2133807 - RNA, 14 nt, Staphylococcus aureus subsp. aureus N315
acucauaaucaagu

SEQ ID NO: 2133808 - RNA, 13 nt, Staphylococcus aureus subsp. aureus N315
acucauuauaaau

SEQ ID NO: 2133809 - RNA, 14 nt, Staphylococcus aureus subsp. aureus N315
acucauuuuucuug

SEQ ID NO: 2133810 - RNA, 12 nt, Staphylococcus aureus subsp. aureus N315
acucauuuucug

SEQ ID NO: 2133811 - RNA, 16 nt, Staphylococcus aureus subsp. aureus N315
acucauuuauaaacau

SEQ ID NO: 2133812 - RNA, 15 nt, Staphylococcus aureus subsp. aureus N315
acguugauguaauuc

SEQ ID NO: 2133813 - RNA, 16 nt, Staphylococcus aureus subsp. aureus N315
acuaaaugaauugcuu

SEQ ID NO: 2133814 - RNA, 20 nt, Staphylococcus aureus subsp. aureus N315
acuaacauguuauugcuuau

SEQ ID NO: 2133815 - RNA, 14 nt, Staphylococcus aureus subsp. aureus N315
acuaagauauauug

SEQ ID NO: 2133816 - RNA, 17 nt, Staphylococcus aureus subsp. aureus N315
acuaagaccaugagaaa

SEQ ID NO: 2133817 - RNA, 22 nt, Staphylococcus aureus subsp. aureus N315
acuaacguaaaggugauauuug

SEQ ID NO: 2133818 - RNA, 23 nt, Staphylococcus aureus subsp. aureus N315
acuaaucaauacuaaaccaauga

SEQ ID NO: 2133819 - RNA, 13 nt, Staphylococcus aureus subsp. aureus N315
acuaaucguguau

SEQ ID NO: 2133820 - RNA, 23 nt, Staphylococcus aureus subsp. aureus N315
acuaaucaacuuuuuguuaauuu

SEQ ID NO: 2133821 - RNA, 21 nt, Staphylococcus aureus subsp. aureus N315
acuaauauuucuuagauacuc

SEQ ID NO: 2133822 - RNA, 16 nt, Staphylococcus aureus subsp. aureus N315
acuaaucaaagaaaaa

SEQ ID NO: 2133823 - RNA, 15 nt, Staphylococcus aureus subsp. aureus N315
acuaauauuucuuag

SEQ ID NO: 2133824 - RNA, 18 nt, Staphylococcus aureus subsp. aureus N315
acuaauauuucuuagaua

SEQ ID NO: 2133825 - RNA, 17 nt, Staphylococcus aureus subsp. aureus N315
acuaauaugauugguuu

SEQ ID NO: 2133826 - RNA, 20 nt, Staphylococcus aureus subsp. aureus N315
acuaaguuauuuaguacaua

SEQ ID NO: 2133827 - RNA, 19 nt, Staphylococcus aureus subsp. aureus N315
acuaaguuauuuaguacau

SEQ ID NO: 2133828 - RNA, 17 nt, Staphylococcus aureus subsp. aureus N315
acuaagugaacuauuaa

SEQ ID NO: 2133829 - RNA, 23 nt, Staphylococcus aureus subsp. aureus N315
acuaagugaacuauuaaaaccaa

SEQ ID NO: 2133830 - RNA, 20 nt, Staphylococcus aureus subsp. aureus N315
acuaagugaauuaucuauau

SEQ ID NO: 2133831 - RNA, 14 nt, Staphylococcus aureus subsp. aureus N315
acuaauaauugucc

SEQ ID NO: 2133832 - RNA, 19 nt, Staphylococcus aureus subsp. aureus N315
acuagcuaaugcacgugag

SEQ ID NO: 2133833 - RNA, 14 nt, Staphylococcus aureus subsp. aureus N315
acuagggguuuuua

SEQ ID NO: 2133834 - RNA, 20 nt, Staphylococcus aureus subsp. aureus N315
acuaguaaaucaaagaugac

SEQ ID NO: 2133835 - RNA, 18 nt, Staphylococcus aureus subsp. aureus N315
acuaguacgaaaugcaau

SEQ ID NO: 2133836 - RNA, 14 nt, Staphylococcus aureus subsp. aureus N315
acuaguaauagaau

SEQ ID NO: 2133837 - RNA, 22 nt, Staphylococcus aureus subsp. aureus N315
acuauaugaaaagagaaacaaa

SEQ ID NO: 2133838 - RNA, 16 nt, Staphylococcus aureus subsp. aureus N315
acuauauucaauuuaa

SEQ ID NO: 2133839 - RNA, 17 nt, Staphylococcus aureus subsp. aureus N315
acuauauucaauuuaau

SEQ ID NO: 2133840 - RNA, 21 nt, Staphylococcus aureus subsp. aureus N315
acuauacuuuuauagaaaauu

SEQ ID NO: 2133841 - RNA, 15 nt, Staphylococcus aureus subsp. aureus N315
acuauagauaggaua

SEQ ID NO: 2133842 - RNA, 22 nt, Staphylococcus aureus subsp. aureus N315
acuauagccaaaggcaaaaugu

SEQ ID NO: 2133843 - RNA, 14 nt, Staphylococcus aureus subsp. aureus N315
acuauaaugaugua

SEQ ID NO: 2133844 - RNA, 20 nt, Staphylococcus aureus subsp. aureus N315
acuauaaugauguauuuuag

SEQ ID NO: 2133845 - RNA, 20 nt, Staphylococcus aureus subsp. aureus N315
acuagucuuuuuauuuuaau

SEQ ID NO: 2133846 - RNA, 16 nt, Staphylococcus aureus subsp. aureus N315
acuaaugauaguacau

SEQ ID NO: 2133847 - RNA, 18 nt, Staphylococcus aureus subsp. aureus N315
acuaauuucuauagaaaa

SEQ ID NO: 2133848 - RNA, 13 nt, Staphylococcus aureus subsp. aureus N315
acuacaacuuaag

SEQ ID NO: 2133849 - RNA, 23 nt, Staphylococcus aureus subsp. aureus N315
acuacaaacuugauuauguaauu

SEQ ID NO: 2133850 - RNA, 19 nt, Staphylococcus aureus subsp. aureus N315
acuacacacguagaaagau

SEQ ID NO: 2133851 - RNA, 19 nt, Staphylococcus aureus subsp. aureus N315
acuacacuccccuuaucaa

SEQ ID NO: 2133852 - RNA, 15 nt, Staphylococcus aureus subsp. aureus N315
acuacuauugauauu

SEQ ID NO: 2133853 - RNA, 21 nt, Staphylococcus aureus subsp. aureus N315
acuagcauuagcaaauauuau

SEQ ID NO: 2133854 - RNA, 19 nt, Staphylococcus aureus subsp. aureus N315
acuagauaguuuauacuuu

SEQ ID NO: 2133855 - RNA, 16 nt, Staphylococcus aureus subsp. aureus N315
acguucaucuaauuuu

SEQ ID NO: 2133856 - RNA, 16 nt, Staphylococcus aureus subsp. aureus N315
acguguaaauguuaaa

SEQ ID NO: 2133857 - RNA, 18 nt, Staphylococcus aureus subsp. aureus N315
acgugguugguuaccauc

SEQ ID NO: 2133858 - RNA, 21 nt, Staphylococcus aureus subsp. aureus N315
acguguguuuucuuuucaaaa

SEQ ID NO: 2133859 - RNA, 16 nt, Staphylococcus aureus subsp. aureus N315
acguccaaacacaaau

SEQ ID NO: 2133860 - RNA, 19 nt, Staphylococcus aureus subsp. aureus N315
acgucauauguuuuauaau

SEQ ID NO: 2133861 - RNA, 15 nt, Staphylococcus aureus subsp. aureus N315
acgucacuuuauuaa

SEQ ID NO: 2133862 - RNA, 19 nt, Staphylococcus aureus subsp. aureus N315
acgucacuuuauuaaauaa

SEQ ID NO: 2133863 - RNA, 14 nt, Staphylococcus aureus subsp. aureus N315
acgucaacagcaua

SEQ ID NO: 2133864 - RNA, 16 nt, Staphylococcus aureus subsp. aureus N315
acguaucauuuaaaau

SEQ ID NO: 2133865 - RNA, 15 nt, Staphylococcus aureus subsp. aureus N315
acguaucaaaauuuu

SEQ ID NO: 2133866 - RNA, 16 nt, Staphylococcus aureus subsp. aureus N315
acguauacaaauugau

SEQ ID NO: 2133867 - RNA, 17 nt, Staphylococcus aureus subsp. aureus N315
acguauauaaguuaaaa

SEQ ID NO: 2133868 - RNA, 18 nt, Staphylococcus aureus subsp. aureus N315
acguauauaaguuaaaau

SEQ ID NO: 2133869 - RNA, 19 nt, Staphylococcus aureus subsp. aureus N315
acguauauaaguuaaaauu

SEQ ID NO: 2133870 - RNA, 16 nt, Staphylococcus aureus subsp. aureus N315
acccuacuauauauca

SEQ ID NO: 2133871 - RNA, 21 nt, Staphylococcus aureus subsp. aureus N315
acccucauuuuuauaaauuuu

SEQ ID NO: 2133872 - RNA, 16 nt, Staphylococcus aureus subsp. aureus N315
accgaauaauuuugau

SEQ ID NO: 2133873 - RNA, 13 nt, Staphylococcus aureus subsp. aureus N315
acccauauaauuu

SEQ ID NO: 2133874 - RNA, 18 nt, Staphylococcus aureus subsp. aureus N315
acccauaauuuaaaugau

SEQ ID NO: 2133875 - RNA, 13 nt, Staphylococcus aureus subsp. aureus N315
accauuuuuuuau

SEQ ID NO: 2133876 - RNA, 14 nt, Staphylococcus aureus subsp. aureus N315
accauuuaaaaauu

SEQ ID NO: 2133877 - RNA, 13 nt, Staphylococcus aureus subsp. aureus N315
acccaaaaaauug

SEQ ID NO: 2133878 - RNA, 15 nt, Staphylococcus aureus subsp. aureus N315
accauguuuuuuaag

SEQ ID NO: 2133879 - RNA, 18 nt, Staphylococcus aureus subsp. aureus N315
accauggcgauuccaauc

SEQ ID NO: 2133880 - RNA, 19 nt, Staphylococcus aureus subsp. aureus N315
accaucaacgccauauuua

SEQ ID NO: 2133881 - RNA, 18 nt, Staphylococcus aureus subsp. aureus N315
accauauuuuuagaaaag

SEQ ID NO: 2133882 - RNA, 16 nt, Staphylococcus aureus subsp. aureus N315
accaugcaaacucauu

SEQ ID NO: 2133883 - RNA, 18 nt, Staphylococcus aureus subsp. aureus N315
accaugcaaacucauuua

SEQ ID NO: 2133884 - RNA, 20 nt, Staphylococcus aureus subsp. aureus N315
accaucuucuugauuguaaa

SEQ ID NO: 2133885 - RNA, 21 nt, Staphylococcus aureus subsp. aureus N315
accaucuucuugauuguaaau

SEQ ID NO: 2133886 - RNA, 22 nt, Staphylococcus aureus subsp. aureus N315
accaucuuuaauacgaauuuca

SEQ ID NO: 2133887 - RNA, 17 nt, Staphylococcus aureus subsp. aureus N315
accaugagaaaccgcuu

SEQ ID NO: 2133888 - RNA, 20 nt, Staphylococcus aureus subsp. aureus N315
accaucucaacuaaucgugu

SEQ ID NO: 2133889 - RNA, 14 nt, Staphylococcus aureus subsp. aureus N315
accaucucuauuuu

SEQ ID NO: 2133890 - RNA, 17 nt, Staphylococcus aureus subsp. aureus N315
accaucugaaucaguua

SEQ ID NO: 2133891 - RNA, 14 nt, Staphylococcus aureus subsp. aureus N315
accacauccccuuu

SEQ ID NO: 2133892 - RNA, 21 nt, Staphylococcus aureus subsp. aureus N315
accacuugaauacuuuuuaac

SEQ ID NO: 2133893 - RNA, 15 nt, Staphylococcus aureus subsp. aureus N315
accagcuaacaaaag

SEQ ID NO: 2133894 - RNA, 13 nt, Staphylococcus aureus subsp. aureus N315
accacacagcauu

SEQ ID NO: 2133895 - RNA, 23 nt, Staphylococcus aureus subsp. aureus N315
accacaccaugcugcacauucca

SEQ ID NO: 2133896 - RNA, 13 nt, Staphylococcus aureus subsp. aureus N315
accaauuagcaug

SEQ ID NO: 2133897 - RNA, 14 nt, Staphylococcus aureus subsp. aureus N315
accacaaccaguca

SEQ ID NO: 2133898 - RNA, 12 nt, Staphylococcus aureus subsp. aureus N315
accacaacuucu

SEQ ID NO: 2133899 - RNA, 16 nt, Staphylococcus aureus subsp. aureus N315
accaaugauuguuaau

SEQ ID NO: 2133900 - RNA, 21 nt, Staphylococcus aureus subsp. aureus N315
accaacaauagguacaacuaa

SEQ ID NO: 2133901 - RNA, 22 nt, Staphylococcus aureus subsp. aureus N315
accaacaauugcacuuggugau

SEQ ID NO: 2133902 - RNA, 22 nt, Staphylococcus aureus subsp. aureus N315
accaagcccaugcccgauaaaa

SEQ ID NO: 2133903 - RNA, 14 nt, Staphylococcus aureus subsp. aureus N315
accaagauuccauc

SEQ ID NO: 2133904 - RNA, 16 nt, Staphylococcus aureus subsp. aureus N315
accaagauuccaucac

SEQ ID NO: 2133905 - RNA, 15 nt, Staphylococcus aureus subsp. aureus N315
accaacaacuuuguu

SEQ ID NO: 2133906 - RNA, 12 nt, Staphylococcus aureus subsp. aureus N315
accaacaagguu

SEQ ID NO: 2133907 - RNA, 17 nt, Staphylococcus aureus subsp. aureus N315
accaaaccauaaguaaa

SEQ ID NO: 2133908 - RNA, 16 nt, Staphylococcus aureus subsp. aureus N315
accaaacaauacauaa

SEQ ID NO: 2133909 - RNA, 15 nt, Staphylococcus aureus subsp. aureus N315
acauuuuugaauuua

SEQ ID NO: 2133910 - RNA, 21 nt, Staphylococcus aureus subsp. aureus N315
acauuuuugaauuuaauacua

SEQ ID NO: 2133911 - RNA, 19 nt, Staphylococcus aureus subsp. aureus N315
acauuuugccccucauuca

SEQ ID NO: 2133912 - RNA, 13 nt, Staphylococcus aureus subsp. aureus N315
accaaaauuauau

SEQ ID NO: 2133913 - RNA, 22 nt, Staphylococcus aureus subsp. aureus N315
accaaaagaaauuuaauacaau

SEQ ID NO: 2133914 - RNA, 18 nt, Staphylococcus aureus subsp. aureus N315
acauuuuaucugaaaaua

SEQ ID NO: 2133915 - RNA, 17 nt, Staphylococcus aureus subsp. aureus N315
acauuuuaucugaaaau

SEQ ID NO: 2133916 - RNA, 19 nt, Staphylococcus aureus subsp. aureus N315
acauuugguggagaaccuu

SEQ ID NO: 2133917 - RNA, 15 nt, Staphylococcus aureus subsp. aureus N315
acauuuuaauaaaau

SEQ ID NO: 2133918 - RNA, 19 nt, Staphylococcus aureus subsp. aureus N315
acauuucuauacaaucauu

SEQ ID NO: 2133919 - RNA, 20 nt, Staphylococcus aureus subsp. aureus N315
acauuugaccaaguaugaga

SEQ ID NO: 2133920 - RNA, 14 nt, Staphylococcus aureus subsp. aureus N315
acauuugauaacca

SEQ ID NO: 2133921 - RNA, 12 nt, Staphylococcus aureus subsp. aureus N315
acauuuaaaaaa

SEQ ID NO: 2133922 - RNA, 12 nt, Staphylococcus aureus subsp. aureus N315
acauuucccauu

SEQ ID NO: 2133923 - RNA, 22 nt, Staphylococcus aureus subsp. aureus N315
acauugugaaaguuuuugucuu

SEQ ID NO: 2133924 - RNA, 15 nt, Staphylococcus aureus subsp. aureus N315
acauugguuuuuacu

SEQ ID NO: 2133925 - RNA, 15 nt, Staphylococcus aureus subsp. aureus N315
acauuguaaaaugcu

SEQ ID NO: 2133926 - RNA, 22 nt, Staphylococcus aureus subsp. aureus N315
acauuguaaaaugcucccuuca

SEQ ID NO: 2133927 - RNA, 20 nt, Staphylococcus aureus subsp. aureus N315
acauuguccguuuauagaua

SEQ ID NO: 2133928 - RNA, 17 nt, Staphylococcus aureus subsp. aureus N315
acauuagcaugauaaag

SEQ ID NO: 2133929 - RNA, 20 nt, Staphylococcus aureus subsp. aureus N315
acauuauuguaaguuggcuu

SEQ ID NO: 2133930 - RNA, 12 nt, Staphylococcus aureus subsp. aureus N315
acauuauuuaua

SEQ ID NO: 2133931 - RNA, 14 nt, Staphylococcus aureus subsp. aureus N315
acauucaaauaaau

SEQ ID NO: 2133932 - RNA, 22 nt, Staphylococcus aureus subsp. aureus N315
acauuccaaaguaccaucucua

SEQ ID NO: 2133933 - RNA, 20 nt, Staphylococcus aureus subsp. aureus N315
acauucauaccgaagaaacu

SEQ ID NO: 2133934 - RNA, 22 nt, Staphylococcus aureus subsp. aureus N315
acauucauaccgaagaaacuaa

SEQ ID NO: 2133935 - RNA, 13 nt, Staphylococcus aureus subsp. aureus N315
acauuccucuauu

SEQ ID NO: 2133936 - RNA, 19 nt, Staphylococcus aureus subsp. aureus N315
acauucccuuaauaauaag

SEQ ID NO: 2133937 - RNA, 15 nt, Staphylococcus aureus subsp. aureus N315
acauuccaucuuaaa

SEQ ID NO: 2133938 - RNA, 18 nt, Staphylococcus aureus subsp. aureus N315
acauucuauacuuuuaau

SEQ ID NO: 2133939 - RNA, 14 nt, Staphylococcus aureus subsp. aureus N315
acauucuucaaaaa

SEQ ID NO: 2133940 - RNA, 18 nt, Staphylococcus aureus subsp. aureus N315
acauugagauuaucuuua

SEQ ID NO: 2133941 - RNA, 19 nt, Staphylococcus aureus subsp. aureus N315
acauucuucaaaaaauaau

SEQ ID NO: 2133942 - RNA, 21 nt, Staphylococcus aureus subsp. aureus N315
acauucugcccugcaaugcaa

SEQ ID NO: 2133943 - RNA, 15 nt, Staphylococcus aureus subsp. aureus N315
acauugauaaauuuu

SEQ ID NO: 2133944 - RNA, 17 nt, Staphylococcus aureus subsp. aureus N315
acauugaugucaauuuc

SEQ ID NO: 2133945 - RNA, 20 nt, Staphylococcus aureus subsp. aureus N315
acauugaugucaauuucacg

SEQ ID NO: 2133946 - RNA, 17 nt, Staphylococcus aureus subsp. aureus N315
acauuggauuacuucca

SEQ ID NO: 2133947 - RNA, 20 nt, Staphylococcus aureus subsp. aureus N315
acauguuacugaugaacaua

SEQ ID NO: 2133948 - RNA, 21 nt, Staphylococcus aureus subsp. aureus N315
acauuaaaauguguuuucaac

SEQ ID NO: 2133949 - RNA, 12 nt, Staphylococcus aureus subsp. aureus N315
acauuaaauauu

SEQ ID NO: 2133950 - RNA, 14 nt, Staphylococcus aureus subsp. aureus N315
acauuaaguuaaac

SEQ ID NO: 2133951 - RNA, 17 nt, Staphylococcus aureus subsp. aureus N315
acauuaauuggauuaaa

SEQ ID NO: 2133952 - RNA, 15 nt, Staphylococcus aureus subsp. aureus N315
acaucuuuuugauaa

SEQ ID NO: 2133953 - RNA, 13 nt, Staphylococcus aureus subsp. aureus N315
acaucuuuuuaaa

SEQ ID NO: 2133954 - RNA, 13 nt, Staphylococcus aureus subsp. aureus N315
acaucuuuuugau

SEQ ID NO: 2133955 - RNA, 20 nt, Staphylococcus aureus subsp. aureus N315
acaugaacaaucagauaagu

SEQ ID NO: 2133956 - RNA, 12 nt, Staphylococcus aureus subsp. aureus N315
acaucuuuuguu

SEQ ID NO: 2133957 - RNA, 14 nt, Staphylococcus aureus subsp. aureus N315
acaucggaauucaa

SEQ ID NO: 2133958 - RNA, 20 nt, Staphylococcus aureus subsp. aureus N315
acauccucauaauuaucaua

SEQ ID NO: 2133959 - RNA, 17 nt, Staphylococcus aureus subsp. aureus N315
acaucaucgccagcauu

SEQ ID NO: 2133960 - RNA, 13 nt, Staphylococcus aureus subsp. aureus N315
acaucaucaaguu

SEQ ID NO: 2133961 - RNA, 16 nt, Staphylococcus aureus subsp. aureus N315
acauauaaaucauuuc

SEQ ID NO: 2133962 - RNA, 15 nt, Staphylococcus aureus subsp. aureus N315
acauaugacuuuauu

SEQ ID NO: 2133963 - RNA, 15 nt, Staphylococcus aureus subsp. aureus N315
acaucauaauaaauc

SEQ ID NO: 2133964 - RNA, 14 nt, Staphylococcus aureus subsp. aureus N315
acaucaauuacucu

SEQ ID NO: 2133965 - RNA, 15 nt, Staphylococcus aureus subsp. aureus N315
acaucaauaucuucu

SEQ ID NO: 2133966 - RNA, 17 nt, Staphylococcus aureus subsp. aureus N315
acaucaauaucuucuuc

SEQ ID NO: 2133967 - RNA, 13 nt, Staphylococcus aureus subsp. aureus N315
acaucaauaucuu

SEQ ID NO: 2133968 - RNA, 19 nt, Staphylococcus aureus subsp. aureus N315
acaguuuccauaaauaaaa

SEQ ID NO: 2133969 - RNA, 22 nt, Staphylococcus aureus subsp. aureus N315
acaguuucuuggucugcuguau

SEQ ID NO: 2133970 - RNA, 20 nt, Staphylococcus aureus subsp. aureus N315
acaguuucuuggucugcugu

SEQ ID NO: 2133971 - RNA, 19 nt, Staphylococcus aureus subsp. aureus N315
acaguuuuaaaugaaacuu

SEQ ID NO: 2133972 - RNA, 19 nt, Staphylococcus aureus subsp. aureus N315
acaguuuuuauauuaagac

SEQ ID NO: 2133973 - RNA, 22 nt, Staphylococcus aureus subsp. aureus N315
acauaccaguggaaauuaugua

SEQ ID NO: 2133974 - RNA, 19 nt, Staphylococcus aureus subsp. aureus N315
acauaaccuaauucgccau

SEQ ID NO: 2133975 - RNA, 18 nt, Staphylococcus aureus subsp. aureus N315
acauaaccgaugugauuu

SEQ ID NO: 2133976 - RNA, 14 nt, Staphylococcus aureus subsp. aureus N315
acauaaaacuuaca

SEQ ID NO: 2133977 - RNA, 14 nt, Staphylococcus aureus subsp. aureus N315
acauaacuaugcuu

SEQ ID NO: 2133978 - RNA, 20 nt, Staphylococcus aureus subsp. aureus N315
acauagcuuaauaauuaaua

SEQ ID NO: 2133979 - RNA, 19 nt, Staphylococcus aureus subsp. aureus N315
acauauaaaaaauuauuaa

SEQ ID NO: 2133980 - RNA, 22 nt, Staphylococcus aureus subsp. aureus N315
acauagguauaaucauuuaaac

SEQ ID NO: 2133981 - RNA, 17 nt, Staphylococcus aureus subsp. aureus N315
acauagaguaauuuuac

SEQ ID NO: 2133982 - RNA, 16 nt, Staphylococcus aureus subsp. aureus N315
acauagaguaauuuua

SEQ ID NO: 2133983 - RNA, 14 nt, Staphylococcus aureus subsp. aureus N315
acauacguuauuuu

SEQ ID NO: 2133984 - RNA, 16 nt, Staphylococcus aureus subsp. aureus N315
acauacuauaaaaauu

SEQ ID NO: 2133985 - RNA, 22 nt, Staphylococcus aureus subsp. aureus N315
acagauaagaauauuuaaguuu

SEQ ID NO: 2133986 - RNA, 13 nt, Staphylococcus aureus subsp. aureus N315
acagagaaauucg

SEQ ID NO: 2133987 - RNA, 17 nt, Staphylococcus aureus subsp. aureus N315
acagauaaguaauaaua

SEQ ID NO: 2133988 - RNA, 14 nt, Staphylococcus aureus subsp. aureus N315
acagcaaauaaaau

SEQ ID NO: 2133989 - RNA, 15 nt, Staphylococcus aureus subsp. aureus N315
acagcaaaaaauaaa

SEQ ID NO: 2133990 - RNA, 16 nt, Staphylococcus aureus subsp. aureus N315
acagcaaaaaauaaau

SEQ ID NO: 2133991 - RNA, 19 nt, Staphylococcus aureus subsp. aureus N315
acagcaaaaaauaaaucuc

SEQ ID NO: 2133992 - RNA, 12 nt, Staphylococcus aureus subsp. aureus N315
acagcaaauaaa

SEQ ID NO: 2133993 - RNA, 16 nt, Staphylococcus aureus subsp. aureus N315
acagcaguaagauauu

SEQ ID NO: 2133994 - RNA, 17 nt, Staphylococcus aureus subsp. aureus N315
acacguguaaaaaugau

SEQ ID NO: 2133995 - RNA, 11 nt, Staphylococcus aureus subsp. aureus N315
acagaaaaggg

SEQ ID NO: 2133996 - RNA, 22 nt, Staphylococcus aureus subsp. aureus N315
acacuaucauuaucaaauaacc

SEQ ID NO: 2133997 - RNA, 16 nt, Staphylococcus aureus subsp. aureus N315
acacuaucguuuuuau

SEQ ID NO: 2133998 - RNA, 16 nt, Staphylococcus aureus subsp. aureus N315
acacuacgcugaugaa

SEQ ID NO: 2133999 - RNA, 21 nt, Staphylococcus aureus subsp. aureus N315
acacuacgcugaugaaugauu

SEQ ID NO: 2134000 - RNA, 13 nt, Staphylococcus aureus subsp. aureus N315
acaccaacauauu

SEQ ID NO: 2134001 - RNA, 21 nt, Staphylococcus aureus subsp. aureus N315
acacauguacguuuuuuuaaa

SEQ ID NO: 2134002 - RNA, 17 nt, Staphylococcus aureus subsp. aureus N315
acacauucuuauuugaa

SEQ ID NO: 2134003 - RNA, 22 nt, Staphylococcus aureus subsp. aureus N315
acacauuauugaaauuuuuaau

SEQ ID NO: 2134004 - RNA, 13 nt, Staphylococcus aureus subsp. aureus N315
acaccagauauca

SEQ ID NO: 2134005 - RNA, 12 nt, Staphylococcus aureus subsp. aureus N315
acacccaaauuu

SEQ ID NO: 2134006 - RNA, 20 nt, Staphylococcus aureus subsp. aureus N315
acaccauuguuauagcguuu

SEQ ID NO: 2134007 - RNA, 12 nt, Staphylococcus aureus subsp. aureus N315
acaccccaacuu

SEQ ID NO: 2134008 - RNA, 19 nt, Staphylococcus aureus subsp. aureus N315
acacgcauuacuuuagaaa

SEQ ID NO: 2134009 - RNA, 17 nt, Staphylococcus aureus subsp. aureus N315
acacgcauuacuuuaga

SEQ ID NO: 2134010 - RNA, 21 nt, Staphylococcus aureus subsp. aureus N315
acacgaguauuaucacauaga

SEQ ID NO: 2134011 - RNA, 15 nt, Staphylococcus aureus subsp. aureus N315
acaccuauaccucgu

SEQ ID NO: 2134012 - RNA, 13 nt, Staphylococcus aureus subsp. aureus N315
acaccuacaaaua

SEQ ID NO: 2134013 - RNA, 15 nt, Staphylococcus aureus subsp. aureus N315
acaccuauaccucau

SEQ ID NO: 2134014 - RNA, 17 nt, Staphylococcus aureus subsp. aureus N315
acaaucggaagcauauu

SEQ ID NO: 2134015 - RNA, 20 nt, Staphylococcus aureus subsp. aureus N315
acaaucggaagcauauuucu

SEQ ID NO: 2134016 - RNA, 18 nt, Staphylococcus aureus subsp. aureus N315
acaaugaauuguuaguuu

SEQ ID NO: 2134017 - RNA, 23 nt, Staphylococcus aureus subsp. aureus N315
acaaugaauuucuaauuuaguau

SEQ ID NO: 2134018 - RNA, 15 nt, Staphylococcus aureus subsp. aureus N315
acaaugcagcuguau

SEQ ID NO: 2134019 - RNA, 16 nt, Staphylococcus aureus subsp. aureus N315
acaaugauuaaaauua

SEQ ID NO: 2134020 - RNA, 21 nt, Staphylococcus aureus subsp. aureus N315
acaaucauagauauaagaaau

SEQ ID NO: 2134021 - RNA, 19 nt, Staphylococcus aureus subsp. aureus N315
acaaucagauaaguuacua

SEQ ID NO: 2134022 - RNA, 14 nt, Staphylococcus aureus subsp. aureus N315
acaaucacgauuaa

SEQ ID NO: 2134023 - RNA, 18 nt, Staphylococcus aureus subsp. aureus N315
acaaucaacuuagaauuu

SEQ ID NO: 2134024 - RNA, 14 nt, Staphylococcus aureus subsp. aureus N315
acaauauugacuuu

SEQ ID NO: 2134025 - RNA, 18 nt, Staphylococcus aureus subsp. aureus N315
acaauauucguaaauccu

SEQ ID NO: 2134026 - RNA, 18 nt, Staphylococcus aureus subsp. aureus N315
acaauauuaaaauuaaaa

SEQ ID NO: 2134027 - RNA, 15 nt, Staphylococcus aureus subsp. aureus N315
acaauauuaaaauua

SEQ ID NO: 2134028 - RNA, 17 nt, Staphylococcus aureus subsp. aureus N315
acaauauaauauacaca

SEQ ID NO: 2134029 - RNA, 19 nt, Staphylococcus aureus subsp. aureus N315
acaauauaauuuccuaaaa

SEQ ID NO: 2134030 - RNA, 22 nt, Staphylococcus aureus subsp. aureus N315
acaauaguauuaacuauaaaua

SEQ ID NO: 2134031 - RNA, 16 nt, Staphylococcus aureus subsp. aureus N315
acaauagguacaacua

SEQ ID NO: 2134032 - RNA, 15 nt, Staphylococcus aureus subsp. aureus N315
acaauaaaaaaccaa

SEQ ID NO: 2134033 - RNA, 21 nt, Staphylococcus aureus subsp. aureus N315
acaaguuuacagguugaauaa

SEQ ID NO: 2134034 - RNA, 18 nt, Staphylococcus aureus subsp. aureus N315
acaaguugcacauuauaa

SEQ ID NO: 2134035 - RNA, 15 nt, Staphylococcus aureus subsp. aureus N315
acaaguuguucaauu

SEQ ID NO: 2134036 - RNA, 14 nt, Staphylococcus aureus subsp. aureus N315
acaauaacaccugu

SEQ ID NO: 2134037 - RNA, 20 nt, Staphylococcus aureus subsp. aureus N315
acaauaagcgcaauuaaaag

SEQ ID NO: 2134038 - RNA, 15 nt, Staphylococcus aureus subsp. aureus N315
acaauacauaauggu

SEQ ID NO: 2134039 - RNA, 16 nt, Staphylococcus aureus subsp. aureus N315
acaauacauaaugguu

SEQ ID NO: 2134040 - RNA, 14 nt, Staphylococcus aureus subsp. aureus N315
acaaggauugaaaa

SEQ ID NO: 2134041 - RNA, 20 nt, Staphylococcus aureus subsp. aureus N315
acaagguaugaaauaacaau

SEQ ID NO: 2134042 - RNA, 20 nt, Staphylococcus aureus subsp. aureus N315
acaagucuuauuuguuuaau

SEQ ID NO: 2134043 - RNA, 18 nt, Staphylococcus aureus subsp. aureus N315
acaaguacaauaauaccu

SEQ ID NO: 2134044 - RNA, 22 nt, Staphylococcus aureus subsp. aureus N315
acacagagaaauucgaaaagaa

SEQ ID NO: 2134045 - RNA, 15 nt, Staphylococcus aureus subsp. aureus N315
acacacccaaauuua

SEQ ID NO: 2134046 - RNA, 19 nt, Staphylococcus aureus subsp. aureus N315
acacacaugauaauuuuua

SEQ ID NO: 2134047 - RNA, 23 nt, Staphylococcus aureus subsp. aureus N315
acacacuauuauagcuagcuaag

SEQ ID NO: 2134048 - RNA, 21 nt, Staphylococcus aureus subsp. aureus N315
acacacuguugaaaaugacua

SEQ ID NO: 2134049 - RNA, 18 nt, Staphylococcus aureus subsp. aureus N315
acacaaugcccuuaaagc

SEQ ID NO: 2134050 - RNA, 23 nt, Staphylococcus aureus subsp. aureus N315
acacaaauaaaggcaacaaauau

SEQ ID NO: 2134051 - RNA, 14 nt, Staphylococcus aureus subsp. aureus N315
acacaacgauagau

SEQ ID NO: 2134052 - RNA, 22 nt, Staphylococcus aureus subsp. aureus N315
acacaguaauucuuaaaaagca

SEQ ID NO: 2134053 - RNA, 21 nt, Staphylococcus aureus subsp. aureus N315
acacagguaaauuuaaaauaa

SEQ ID NO: 2134054 - RNA, 14 nt, Staphylococcus aureus subsp. aureus N315
acacaguacaaaua

SEQ ID NO: 2134055 - RNA, 13 nt, Staphylococcus aureus subsp. aureus N315
acacaguacaaau

SEQ ID NO: 2134056 - RNA, 14 nt, Staphylococcus aureus subsp. aureus N315
acacagguaaauuu

SEQ ID NO: 2134057 - RNA, 21 nt, Staphylococcus aureus subsp. aureus N315
acacagcuaaacgcaauacga

SEQ ID NO: 2134058 - RNA, 22 nt, Staphylococcus aureus subsp. aureus N315
acacaucuauguggcuacuuga

SEQ ID NO: 2134059 - RNA, 12 nt, Staphylococcus aureus subsp. aureus N315
acacauacaccu

SEQ ID NO: 2134060 - RNA, 13 nt, Staphylococcus aureus subsp. aureus N315
acacauaaauuaa

SEQ ID NO: 2134061 - RNA, 20 nt, Staphylococcus aureus subsp. aureus N315
acaaugcauccaaauauuaa

SEQ ID NO: 2134062 - RNA, 20 nt, Staphylococcus aureus subsp. aureus N315
acaaugcgguaaaaacucuu

SEQ ID NO: 2134063 - RNA, 13 nt, Staphylococcus aureus subsp. aureus N315
acaaugcgcaaug

SEQ ID NO: 2134064 - RNA, 21 nt, Staphylococcus aureus subsp. aureus N315
acaaugcagcuguauuuaaua

SEQ ID NO: 2134065 - RNA, 18 nt, Staphylococcus aureus subsp. aureus N315
acaaugcauccaaauauu

SEQ ID NO: 2134066 - RNA, 13 nt, Staphylococcus aureus subsp. aureus N315
acaauguauuacc

SEQ ID NO: 2134067 - RNA, 19 nt, Staphylococcus aureus subsp. aureus N315
acaauguuauuagauacuu

SEQ ID NO: 2134068 - RNA, 16 nt, Staphylococcus aureus subsp. aureus N315
acaauucauaagaaaa

SEQ ID NO: 2134069 - RNA, 20 nt, Staphylococcus aureus subsp. aureus N315
acaauucauaagaaaaaugu

SEQ ID NO: 2134070 - RNA, 16 nt, Staphylococcus aureus subsp. aureus N315
acaauuaaagugaaua

SEQ ID NO: 2134071 - RNA, 13 nt, Staphylococcus aureus subsp. aureus N315
acaauuaauuacu

SEQ ID NO: 2134072 - RNA, 18 nt, Staphylococcus aureus subsp. aureus N315
acaauuccccaaagccuu

SEQ ID NO: 2134073 - RNA, 20 nt, Staphylococcus aureus subsp. aureus N315
acaauuuagcaaauauuucu

SEQ ID NO: 2134074 - RNA, 13 nt, Staphylococcus aureus subsp. aureus N315
acaauuucaaugu

SEQ ID NO: 2134075 - RNA, 18 nt, Staphylococcus aureus subsp. aureus N315
acaauuuaaaaagcagua

SEQ ID NO: 2134076 - RNA, 13 nt, Staphylococcus aureus subsp. aureus N315
acaauuuaaacgc

SEQ ID NO: 2134077 - RNA, 14 nt, Staphylococcus aureus subsp. aureus N315
acaauuuaaaaagc

SEQ ID NO: 2134078 - RNA, 16 nt, Staphylococcus aureus subsp. aureus N315
acaauugcuaauccau

SEQ ID NO: 2134079 - RNA, 16 nt, Staphylococcus aureus subsp. aureus N315
acaauuuuccuuccaa

SEQ ID NO: 2134080 - RNA, 15 nt, Staphylococcus aureus subsp. aureus N315
acaauuuuccuucca

SEQ ID NO: 2134081 - RNA, 22 nt, Staphylococcus aureus subsp. aureus N315
acaauuuguaacuauugaaaau

SEQ ID NO: 2134082 - RNA, 15 nt, Staphylococcus aureus subsp. aureus N315
acaauuuuuaaaaac

SEQ ID NO: 2134083 - RNA, 16 nt, Staphylococcus aureus subsp. aureus N315
acaauuuuuaaaaacc

SEQ ID NO: 2134084 - RNA, 13 nt, Staphylococcus aureus subsp. aureus N315
acaauuuuuaaaa

SEQ ID NO: 2134085 - RNA, 19 nt, Staphylococcus aureus subsp. aureus N315
acaauuuuugggaagaaua

SEQ ID NO: 2134086 - RNA, 18 nt, Staphylococcus aureus subsp. aureus N315
acacaaaggauauugaaa

SEQ ID NO: 2134087 - RNA, 22 nt, Staphylococcus aureus subsp. aureus N315
aauuaguaaacuaauccucacu

SEQ ID NO: 2134088 - RNA, 22 nt, Staphylococcus aureus subsp. aureus N315
aauuauaauaaaacuugugaua

SEQ ID NO: 2134089 - RNA, 14 nt, Staphylococcus aureus subsp. aureus N315
aauuauaauaaaac

SEQ ID NO: 2134090 - RNA, 16 nt, Staphylococcus aureus subsp. aureus N315
aauuucaucaaaucca

SEQ ID NO: 2134091 - RNA, 21 nt, Staphylococcus aureus subsp. aureus N315
aauuauacguuacuaaacuuu

SEQ ID NO: 2134092 - RNA, 21 nt, Staphylococcus aureus subsp. aureus N315
aauuuccaauaucuucuuuua

SEQ ID NO: 2134093 - RNA, 18 nt, Staphylococcus aureus subsp. aureus N315
aauuuccaauaucuucuu

SEQ ID NO: 2134094 - RNA, 14 nt, Staphylococcus aureus subsp. aureus N315
aauuuccuaaaaac

SEQ ID NO: 2134095 - RNA, 17 nt, Staphylococcus aureus subsp. aureus N315
aauuucauuuuugauaa

SEQ ID NO: 2134096 - RNA, 14 nt, Staphylococcus aureus subsp. aureus N315
aauuucaugugcaa

SEQ ID NO: 2134097 - RNA, 14 nt, Staphylococcus aureus subsp. aureus N315
aauuucuaauuaaa

SEQ ID NO: 2134098 - RNA, 19 nt, Staphylococcus aureus subsp. aureus N315
aauuucuauagaaaaagua

SEQ ID NO: 2134099 - RNA, 15 nt, Staphylococcus aureus subsp. aureus N315
aauuucgaaaagaaa

SEQ ID NO: 2134100 - RNA, 17 nt, Staphylococcus aureus subsp. aureus N315
aauuucgaaaagaaauu

SEQ ID NO: 2134101 - RNA, 19 nt, Staphylococcus aureus subsp. aureus N315
aauuucgaaaagaaauucu

SEQ ID NO: 2134102 - RNA, 21 nt, Staphylococcus aureus subsp. aureus N315
aauuucgacaucuagaugaaa

SEQ ID NO: 2134103 - RNA, 16 nt, Staphylococcus aureus subsp. aureus N315
aauuucgacaucuaga

SEQ ID NO: 2134104 - RNA, 18 nt, Staphylococcus aureus subsp. aureus N315
aauuucgauuuucaccaa

SEQ ID NO: 2134105 - RNA, 15 nt, Staphylococcus aureus subsp. aureus N315
aauuucugaacauaa

SEQ ID NO: 2134106 - RNA, 14 nt, Staphylococcus aureus subsp. aureus N315
aauuucuaugaaaa

SEQ ID NO: 2134107 - RNA, 23 nt, Staphylococcus aureus subsp. aureus N315
aauuucuguuuacgccauaagaa

SEQ ID NO: 2134108 - RNA, 16 nt, Staphylococcus aureus subsp. aureus N315
aauuuguauaaagauu

SEQ ID NO: 2134109 - RNA, 14 nt, Staphylococcus aureus subsp. aureus N315
aauuuguauuuaaa

SEQ ID NO: 2134110 - RNA, 15 nt, Staphylococcus aureus subsp. aureus N315
aauuuguauuuaaaa

SEQ ID NO: 2134111 - RNA, 16 nt, Staphylococcus aureus subsp. aureus N315
aauuuguuuuaaauac

SEQ ID NO: 2134112 - RNA, 20 nt, Staphylococcus aureus subsp. aureus N315
aauuuguguucaaaucacaa

SEQ ID NO: 2134113 - RNA, 16 nt, Staphylococcus aureus subsp. aureus N315
aauuuuaacuuauaua

SEQ ID NO: 2134114 - RNA, 14 nt, Staphylococcus aureus subsp. aureus N315
aauuuuaaguuaau

SEQ ID NO: 2134115 - RNA, 22 nt, Staphylococcus aureus subsp. aureus N315
aauuuuaauuaauuaucauaaa

SEQ ID NO: 2134116 - RNA, 20 nt, Staphylococcus aureus subsp. aureus N315
aauuuuacuaguguauauaa

SEQ ID NO: 2134117 - RNA, 12 nt, Staphylococcus aureus subsp. aureus N315
aauuuuaccaug

SEQ ID NO: 2134118 - RNA, 16 nt, Staphylococcus aureus subsp. aureus N315
aauuuuaccauguuuu

SEQ ID NO: 2134119 - RNA, 22 nt, Staphylococcus aureus subsp. aureus N315
aauuuuaccuucgcauacuuuu

SEQ ID NO: 2134120 - RNA, 13 nt, Staphylococcus aureus subsp. aureus N315
aauuuuauauauc

SEQ ID NO: 2134121 - RNA, 19 nt, Staphylococcus aureus subsp. aureus N315
aauuuuauauagacaguag

SEQ ID NO: 2134122 - RNA, 17 nt, Staphylococcus aureus subsp. aureus N315
aauuugaggauacauaa

SEQ ID NO: 2134123 - RNA, 16 nt, Staphylococcus aureus subsp. aureus N315
aauuugauuaaauucu

SEQ ID NO: 2134124 - RNA, 17 nt, Staphylococcus aureus subsp. aureus N315
aauuugauuaaauucau

SEQ ID NO: 2134125 - RNA, 12 nt, Staphylococcus aureus subsp. aureus N315
aauuugauuaaa

SEQ ID NO: 2134126 - RNA, 21 nt, Staphylococcus aureus subsp. aureus N315
aauuugaauauacuuaauuua

SEQ ID NO: 2134127 - RNA, 16 nt, Staphylococcus aureus subsp. aureus N315
aauuugaaaguaaauu

SEQ ID NO: 2134128 - RNA, 17 nt, Staphylococcus aureus subsp. aureus N315
aauuugaagauuuuguu

SEQ ID NO: 2134129 - RNA, 18 nt, Staphylococcus aureus subsp. aureus N315
aauuugaauugacuuaca

SEQ ID NO: 2134130 - RNA, 12 nt, Staphylococcus aureus subsp. aureus N315
aauuugaaauug

SEQ ID NO: 2134131 - RNA, 16 nt, Staphylococcus aureus subsp. aureus N315
aauuugaaauauacca

SEQ ID NO: 2134132 - RNA, 17 nt, Staphylococcus aureus subsp. aureus N315
aauuugaaauauaccaa

SEQ ID NO: 2134133 - RNA, 13 nt, Staphylococcus aureus subsp. aureus N315
aauuugaaauaua

SEQ ID NO: 2134134 - RNA, 16 nt, Staphylococcus aureus subsp. aureus N315
aauuugcauaacauug

SEQ ID NO: 2134135 - RNA, 21 nt, Staphylococcus aureus subsp. aureus N315
aauuuguaacuauugaaaaua

SEQ ID NO: 2134136 - RNA, 14 nt, Staphylococcus aureus subsp. aureus N315
aauuuguaauacaa

SEQ ID NO: 2134137 - RNA, 16 nt, Staphylococcus aureus subsp. aureus N315
aauuuggucauauaaa

SEQ ID NO: 2134138 - RNA, 18 nt, Staphylococcus aureus subsp. aureus N315
acaaaauuaagaagaaau

SEQ ID NO: 2134139 - RNA, 15 nt, Staphylococcus aureus subsp. aureus N315
acaaaaucaccuuuu

SEQ ID NO: 2134140 - RNA, 22 nt, Staphylococcus aureus subsp. aureus N315
acaaaaucucaacagcaaaaaa

SEQ ID NO: 2134141 - RNA, 20 nt, Staphylococcus aureus subsp. aureus N315
acaaaaaauaucuuuuuguu

SEQ ID NO: 2134142 - RNA, 14 nt, Staphylococcus aureus subsp. aureus N315
acaaaaaauuguaa

SEQ ID NO: 2134143 - RNA, 17 nt, Staphylococcus aureus subsp. aureus N315
acaaaaagacuuccaau

SEQ ID NO: 2134144 - RNA, 13 nt, Staphylococcus aureus subsp. aureus N315
acaaaaagaauuu

SEQ ID NO: 2134145 - RNA, 23 nt, Staphylococcus aureus subsp. aureus N315
acaaaagaggcgccacaacaugu

SEQ ID NO: 2134146 - RNA, 17 nt, Staphylococcus aureus subsp. aureus N315
acaaaagaaaguuaauu

SEQ ID NO: 2134147 - RNA, 10 nt, Staphylococcus aureus subsp. aureus N315
acaaaagaaa

SEQ ID NO: 2134148 - RNA, 17 nt, Staphylococcus aureus subsp. aureus N315
acaaaaauauagcuauu

SEQ ID NO: 2134149 - RNA, 22 nt, Staphylococcus aureus subsp. aureus N315
acaaaacaaauccauuaaauca

SEQ ID NO: 2134150 - RNA, 16 nt, Staphylococcus aureus subsp. aureus N315
acaaaaauaaaccaug

SEQ ID NO: 2134151 - RNA, 13 nt, Staphylococcus aureus subsp. aureus N315
acaaaaaugaaga

SEQ ID NO: 2134152 - RNA, 16 nt, Staphylococcus aureus subsp. aureus N315
acaaaaauauagcuau

SEQ ID NO: 2134153 - RNA, 21 nt, Staphylococcus aureus subsp. aureus N315
aauuuuucuucuuuuuuaucu

SEQ ID NO: 2134154 - RNA, 17 nt, Staphylococcus aureus subsp. aureus N315
aauuuuucuaaaugauu

SEQ ID NO: 2134155 - RNA, 19 nt, Staphylococcus aureus subsp. aureus N315
aauuuuucauuaauacaag

SEQ ID NO: 2134156 - RNA, 13 nt, Staphylococcus aureus subsp. aureus N315
aauuuuucauaua

SEQ ID NO: 2134157 - RNA, 15 nt, Staphylococcus aureus subsp. aureus N315
aauuuuuauuuuuag

SEQ ID NO: 2134158 - RNA, 19 nt, Staphylococcus aureus subsp. aureus N315
aauuuuuguaauacaucua

SEQ ID NO: 2134159 - RNA, 13 nt, Staphylococcus aureus subsp. aureus N315
acaaaaaaaccga

SEQ ID NO: 2134160 - RNA, 15 nt, Staphylococcus aureus subsp. aureus N315
aauuuuuuucauaau

SEQ ID NO: 2134161 - RNA, 11 nt, Staphylococcus aureus subsp. aureus N315
aauuuucagaa

SEQ ID NO: 2134162 - RNA, 18 nt, Staphylococcus aureus subsp. aureus N315
aauuuucaauuagaaaau

SEQ ID NO: 2134163 - RNA, 13 nt, Staphylococcus aureus subsp. aureus N315
aauuuucuaaaua

SEQ ID NO: 2134164 - RNA, 19 nt, Staphylococcus aureus subsp. aureus N315
aauuuucuguuuaauuaaa

SEQ ID NO: 2134165 - RNA, 21 nt, Staphylococcus aureus subsp. aureus N315
aauuuucuguuuaauuaaaau

SEQ ID NO: 2134166 - RNA, 16 nt, Staphylococcus aureus subsp. aureus N315
aauuuucuguccaaaa

SEQ ID NO: 2134167 - RNA, 21 nt, Staphylococcus aureus subsp. aureus N315
aauuuuccuuccaauaauaaa

SEQ ID NO: 2134168 - RNA, 19 nt, Staphylococcus aureus subsp. aureus N315
aauuuuuaaaucuacaaua

SEQ ID NO: 2134169 - RNA, 13 nt, Staphylococcus aureus subsp. aureus N315
aauuuuuaacaaa

SEQ ID NO: 2134170 - RNA, 17 nt, Staphylococcus aureus subsp. aureus N315
aauuuuuaacaaaauau

SEQ ID NO: 2134171 - RNA, 21 nt, Staphylococcus aureus subsp. aureus N315
aauuuuuaacaaaauauacua

SEQ ID NO: 2134172 - RNA, 12 nt, Staphylococcus aureus subsp. aureus N315
aauuuugaagaa

SEQ ID NO: 2134173 - RNA, 13 nt, Staphylococcus aureus subsp. aureus N315
aauuuugauauag

SEQ ID NO: 2134174 - RNA, 20 nt, Staphylococcus aureus subsp. aureus N315
aauuuugacgcucagguaua

SEQ ID NO: 2134175 - RNA, 20 nt, Staphylococcus aureus subsp. aureus N315
aauuuugacauaaaaaauaa

SEQ ID NO: 2134176 - RNA, 21 nt, Staphylococcus aureus subsp. aureus N315
acaacauuauuuauauuuaga

SEQ ID NO: 2134177 - RNA, 21 nt, Staphylococcus aureus subsp. aureus N315
acaacaugauuucuucuccuu

SEQ ID NO: 2134178 - RNA, 18 nt, Staphylococcus aureus subsp. aureus N315
acaacaugauuucuucuc

SEQ ID NO: 2134179 - RNA, 21 nt, Staphylococcus aureus subsp. aureus N315
acaaccucugauacuucacca

SEQ ID NO: 2134180 - RNA, 21 nt, Staphylococcus aureus subsp. aureus N315
acaaccugugauaaaaaucuu

SEQ ID NO: 2134181 - RNA, 18 nt, Staphylococcus aureus subsp. aureus N315
acaaccugugauaaaaau

SEQ ID NO: 2134182 - RNA, 16 nt, Staphylococcus aureus subsp. aureus N315
acaacucguuuuucca

SEQ ID NO: 2134183 - RNA, 17 nt, Staphylococcus aureus subsp. aureus N315
acaacucguuuuuccau

SEQ ID NO: 2134184 - RNA, 13 nt, Staphylococcus aureus subsp. aureus N315
acaacuucuucuc

SEQ ID NO: 2134185 - RNA, 21 nt, Staphylococcus aureus subsp. aureus N315
acaagaacuuagaaaugcaau

SEQ ID NO: 2134186 - RNA, 19 nt, Staphylococcus aureus subsp. aureus N315
acaacuugaacuaaaacga

SEQ ID NO: 2134187 - RNA, 17 nt, Staphylococcus aureus subsp. aureus N315
acaacuuuaauuuuuca

SEQ ID NO: 2134188 - RNA, 22 nt, Staphylococcus aureus subsp. aureus N315
acaacuuuaguuguuaggggcu

SEQ ID NO: 2134189 - RNA, 20 nt, Staphylococcus aureus subsp. aureus N315
acaacuucacgcaaaacaau

SEQ ID NO: 2134190 - RNA, 14 nt, Staphylococcus aureus subsp. aureus N315
acaagcaucaccaa

SEQ ID NO: 2134191 - RNA, 21 nt, Staphylococcus aureus subsp. aureus N315
acaagccaagauaaaucauca

SEQ ID NO: 2134192 - RNA, 19 nt, Staphylococcus aureus subsp. aureus N315
acaagauucauacacugca

SEQ ID NO: 2134193 - RNA, 13 nt, Staphylococcus aureus subsp. aureus N315
acaaagaaauuaa

SEQ ID NO: 2134194 - RNA, 21 nt, Staphylococcus aureus subsp. aureus N315
acaaagaaccacgcaucaugu

SEQ ID NO: 2134195 - RNA, 21 nt, Staphylococcus aureus subsp. aureus N315
acaaacauuacccuuuaaacu

SEQ ID NO: 2134196 - RNA, 17 nt, Staphylococcus aureus subsp. aureus N315
acaaagcuuccaaaugu

SEQ ID NO: 2134197 - RNA, 17 nt, Staphylococcus aureus subsp. aureus N315
acaaagauauguuuaua

SEQ ID NO: 2134198 - RNA, 13 nt, Staphylococcus aureus subsp. aureus N315
acaaagauauguu

SEQ ID NO: 2134199 - RNA, 19 nt, Staphylococcus aureus subsp. aureus N315
acaaagucauuuucauuca

SEQ ID NO: 2134200 - RNA, 19 nt, Staphylococcus aureus subsp. aureus N315
acaaagugauuuaaaaaau

SEQ ID NO: 2134201 - RNA, 23 nt, Staphylococcus aureus subsp. aureus N315
acaaagugauuuaaaaaauuuaa

SEQ ID NO: 2134202 - RNA, 19 nt, Staphylococcus aureus subsp. aureus N315
acaaagugcaauuauuuca

SEQ ID NO: 2134203 - RNA, 19 nt, Staphylococcus aureus subsp. aureus N315
acaaauguauaaauaauaa

SEQ ID NO: 2134204 - RNA, 15 nt, Staphylococcus aureus subsp. aureus N315
acaaauguauaaaua

SEQ ID NO: 2134205 - RNA, 11 nt, Staphylococcus aureus subsp. aureus N315
acaaauuauua

SEQ ID NO: 2134206 - RNA, 12 nt, Staphylococcus aureus subsp. aureus N315
acaaauuauuaa

SEQ ID NO: 2134207 - RNA, 15 nt, Staphylococcus aureus subsp. aureus N315
acaaauucaacuuuu

SEQ ID NO: 2134208 - RNA, 19 nt, Staphylococcus aureus subsp. aureus N315
acaaauuugaauauacuua

SEQ ID NO: 2134209 - RNA, 15 nt, Staphylococcus aureus subsp. aureus N315
acaacaaucaaauua

SEQ ID NO: 2134210 - RNA, 14 nt, Staphylococcus aureus subsp. aureus N315
acaaauaacaaaca

SEQ ID NO: 2134211 - RNA, 22 nt, Staphylococcus aureus subsp. aureus N315
acaaauauaucuagccugaaau

SEQ ID NO: 2134212 - RNA, 19 nt, Staphylococcus aureus subsp. aureus N315
acaaaucgauuaauuauaa

SEQ ID NO: 2134213 - RNA, 18 nt, Staphylococcus aureus subsp. aureus N315
acaaaucguaaacauaau

SEQ ID NO: 2134214 - RNA, 16 nt, Staphylococcus aureus subsp. aureus N315
aaggccauuuguagac

SEQ ID NO: 2134215 - RNA, 14 nt, Staphylococcus aureus subsp. aureus N315
aaggccauuuuuau

SEQ ID NO: 2134216 - RNA, 14 nt, Staphylococcus aureus subsp. aureus N315
aaggccugcaucac

SEQ ID NO: 2134217 - RNA, 19 nt, Staphylococcus aureus subsp. aureus N315
aagguguucgggaauuuuu

SEQ ID NO: 2134218 - RNA, 15 nt, Staphylococcus aureus subsp. aureus N315
aaggugauugaacaa

SEQ ID NO: 2134219 - RNA, 19 nt, Staphylococcus aureus subsp. aureus N315
aagguuauuuuuuaugguc

SEQ ID NO: 2134220 - RNA, 22 nt, Staphylococcus aureus subsp. aureus N315
aagguuguuuuucaucauuaaa

SEQ ID NO: 2134221 - RNA, 21 nt, Staphylococcus aureus subsp. aureus N315
aagguacguuguaauaguaag

SEQ ID NO: 2134222 - RNA, 22 nt, Staphylococcus aureus subsp. aureus N315
aagguacuuauuucaaaaauag

SEQ ID NO: 2134223 - RNA, 23 nt, Staphylococcus aureus subsp. aureus N315
aagcugugcugucauuuucugcu

SEQ ID NO: 2134224 - RNA, 17 nt, Staphylococcus aureus subsp. aureus N315
aagcugcaauuaugcca

SEQ ID NO: 2134225 - RNA, 14 nt, Staphylococcus aureus subsp. aureus N315
aagcugucauaccu

SEQ ID NO: 2134226 - RNA, 23 nt, Staphylococcus aureus subsp. aureus N315
aagcugucuuacugcuguuuuua

SEQ ID NO: 2134227 - RNA, 19 nt, Staphylococcus aureus subsp. aureus N315
aaggaucauguuccccauu

SEQ ID NO: 2134228 - RNA, 14 nt, Staphylococcus aureus subsp. aureus N315
aaggauauugaaaa

SEQ ID NO: 2134229 - RNA, 12 nt, Staphylococcus aureus subsp. aureus N315
aaggaucauguu

SEQ ID NO: 2134230 - RNA, 20 nt, Staphylococcus aureus subsp. aureus N315
aaggaauagcuacaauuaaa

SEQ ID NO: 2134231 - RNA, 20 nt, Staphylococcus aureus subsp. aureus N315
aaggaaucguaaagcuguug

SEQ ID NO: 2134232 - RNA, 22 nt, Staphylococcus aureus subsp. aureus N315
aaggaauguauucuaagaguug

SEQ ID NO: 2134233 - RNA, 19 nt, Staphylococcus aureus subsp. aureus N315
aagcuuuuacgccuucuuu

SEQ ID NO: 2134234 - RNA, 16 nt, Staphylococcus aureus subsp. aureus N315
aagcguaugauguugu

SEQ ID NO: 2134235 - RNA, 23 nt, Staphylococcus aureus subsp. aureus N315
aagcgucuuuuuuguaugaguuc

SEQ ID NO: 2134236 - RNA, 14 nt, Staphylococcus aureus subsp. aureus N315
aagccaagauaaau

SEQ ID NO: 2134237 - RNA, 17 nt, Staphylococcus aureus subsp. aureus N315
aagcgcuuggauuuuuu

SEQ ID NO: 2134238 - RNA, 13 nt, Staphylococcus aureus subsp. aureus N315
aagcucccauuaa

SEQ ID NO: 2134239 - RNA, 22 nt, Staphylococcus aureus subsp. aureus N315
aagcugauuucuaucaaauaau

SEQ ID NO: 2134240 - RNA, 14 nt, Staphylococcus aureus subsp. aureus N315
aagcugauuucuau

SEQ ID NO: 2134241 - RNA, 21 nt, Staphylococcus aureus subsp. aureus N315
aagcuauaaaaaaucuuuuga

SEQ ID NO: 2134242 - RNA, 15 nt, Staphylococcus aureus subsp. aureus N315
aagugcucaaauuuu

SEQ ID NO: 2134243 - RNA, 20 nt, Staphylococcus aureus subsp. aureus N315
aagugcuguuacuucucccu

SEQ ID NO: 2134244 - RNA, 16 nt, Staphylococcus aureus subsp. aureus N315
aagugcuguuacuucu

SEQ ID NO: 2134245 - RNA, 21 nt, Staphylococcus aureus subsp. aureus N315
aagugauuuaaaaaauuuaau

SEQ ID NO: 2134246 - RNA, 22 nt, Staphylococcus aureus subsp. aureus N315
aagugcagauguugguucauca

SEQ ID NO: 2134247 - RNA, 19 nt, Staphylococcus aureus subsp. aureus N315
aagugcagauguugguuca

SEQ ID NO: 2134248 - RNA, 18 nt, Staphylococcus aureus subsp. aureus N315
aagugaaaucauuuaaau

SEQ ID NO: 2134249 - RNA, 17 nt, Staphylococcus aureus subsp. aureus N315
aagugaaaucauuuaaa

SEQ ID NO: 2134250 - RNA, 15 nt, Staphylococcus aureus subsp. aureus N315
aagugaacuauuaaa

SEQ ID NO: 2134251 - RNA, 16 nt, Staphylococcus aureus subsp. aureus N315
aagugaacuauuaaaa

SEQ ID NO: 2134252 - RNA, 23 nt, Staphylococcus aureus subsp. aureus N315
aagucuuuaauagcgucaaguuu

SEQ ID NO: 2134253 - RNA, 19 nt, Staphylococcus aureus subsp. aureus N315
aagucuuuacucuacacuc

SEQ ID NO: 2134254 - RNA, 19 nt, Staphylococcus aureus subsp. aureus N315
aagucuugugauaauucuu

SEQ ID NO: 2134255 - RNA, 17 nt, Staphylococcus aureus subsp. aureus N315
aaguuaauuauguauuu

SEQ ID NO: 2134256 - RNA, 19 nt, Staphylococcus aureus subsp. aureus N315
aaguuaacuauaacaauag

SEQ ID NO: 2134257 - RNA, 20 nt, Staphylococcus aureus subsp. aureus N315
aaguguuauaaauagagaac

SEQ ID NO: 2134258 - RNA, 23 nt, Staphylococcus aureus subsp. aureus N315
aagugcuaagagguauacaguua

SEQ ID NO: 2134259 - RNA, 17 nt, Staphylococcus aureus subsp. aureus N315
aagugcuugguuaaagu

SEQ ID NO: 2134260 - RNA, 20 nt, Staphylococcus aureus subsp. aureus N315
aagugcuugguuaaaguuaa

SEQ ID NO: 2134261 - RNA, 19 nt, Staphylococcus aureus subsp. aureus N315
aaguaucgccaaucuauug

SEQ ID NO: 2134262 - RNA, 23 nt, Staphylococcus aureus subsp. aureus N315
aaguaucgccaaucuauugcaau

SEQ ID NO: 2134263 - RNA, 16 nt, Staphylococcus aureus subsp. aureus N315
aaguaucggugauuua

SEQ ID NO: 2134264 - RNA, 12 nt, Staphylococcus aureus subsp. aureus N315
aaguaaguaaaa

SEQ ID NO: 2134265 - RNA, 14 nt, Staphylococcus aureus subsp. aureus N315
aaguaaguaaaaua

SEQ ID NO: 2134266 - RNA, 13 nt, Staphylococcus aureus subsp. aureus N315
aaguaauaaaaua

SEQ ID NO: 2134267 - RNA, 14 nt, Staphylococcus aureus subsp. aureus N315
aaguaauaaaauaa

SEQ ID NO: 2134268 - RNA, 20 nt, Staphylococcus aureus subsp. aureus N315
aaguaacauacuauaaaaau

SEQ ID NO: 2134269 - RNA, 15 nt, Staphylococcus aureus subsp. aureus N315
aagucacauuuauaa

SEQ ID NO: 2134270 - RNA, 22 nt, Staphylococcus aureus subsp. aureus N315
aagucacaguaucuucaguuau

SEQ ID NO: 2134271 - RNA, 17 nt, Staphylococcus aureus subsp. aureus N315
aagucaauaauuuuauc

SEQ ID NO: 2134272 - RNA, 16 nt, Staphylococcus aureus subsp. aureus N315
aaguauggaaguuguu

SEQ ID NO: 2134273 - RNA, 19 nt, Staphylococcus aureus subsp. aureus N315
aaguauggcgaaauguuuu

SEQ ID NO: 2134274 - RNA, 12 nt, Staphylococcus aureus subsp. aureus N315
aaguaucuguga

SEQ ID NO: 2134275 - RNA, 15 nt, Staphylococcus aureus subsp. aureus N315
aaguauguugucaua

SEQ ID NO: 2134276 - RNA, 15 nt, Staphylococcus aureus subsp. aureus N315
aaguauguuuuauac

SEQ ID NO: 2134277 - RNA, 21 nt, Staphylococcus aureus subsp. aureus N315
aaguaugagacgcauugcaag

SEQ ID NO: 2134278 - RNA, 21 nt, Staphylococcus aureus subsp. aureus N315
aaguaucugugaauaugcuuu

SEQ ID NO: 2134279 - RNA, 20 nt, Staphylococcus aureus subsp. aureus N315
aaguaucuaugaaauuuuuu

SEQ ID NO: 2134280 - RNA, 18 nt, Staphylococcus aureus subsp. aureus N315
aaguaucuaugaaauuuu

SEQ ID NO: 2134281 - RNA, 22 nt, Staphylococcus aureus subsp. aureus N315
aagucaggaucacguuuuucuu

SEQ ID NO: 2134282 - RNA, 18 nt, Staphylococcus aureus subsp. aureus N315
aagucuaauguuggaaaa

SEQ ID NO: 2134283 - RNA, 19 nt, Staphylococcus aureus subsp. aureus N315
aaguuuaucugaguuauag

SEQ ID NO: 2134284 - RNA, 13 nt, Staphylococcus aureus subsp. aureus N315
aaguuugaaucau

SEQ ID NO: 2134285 - RNA, 16 nt, Staphylococcus aureus subsp. aureus N315
aaguuucggaaaaaga

SEQ ID NO: 2134286 - RNA, 13 nt, Staphylococcus aureus subsp. aureus N315
aaguuuuugaaua

SEQ ID NO: 2134287 - RNA, 23 nt, Staphylococcus aureus subsp. aureus N315
aaguuuuucaggguuuaagauuu

SEQ ID NO: 2134288 - RNA, 13 nt, Staphylococcus aureus subsp. aureus N315
aaguuuuucaggg

SEQ ID NO: 2134289 - RNA, 13 nt, Staphylococcus aureus subsp. aureus N315
aaguuuucauuuu

SEQ ID NO: 2134290 - RNA, 18 nt, Staphylococcus aureus subsp. aureus N315
aaguuuuagcuuguuguu

SEQ ID NO: 2134291 - RNA, 14 nt, Staphylococcus aureus subsp. aureus N315
aaguugaaaaccuc

SEQ ID NO: 2134292 - RNA, 13 nt, Staphylococcus aureus subsp. aureus N315
aaguucuagauua

SEQ ID NO: 2134293 - RNA, 14 nt, Staphylococcus aureus subsp. aureus N315
aaguuuaaaauacg

SEQ ID NO: 2134294 - RNA, 23 nt, Staphylococcus aureus subsp. aureus N315
aaguuuaaucguauuagccaaua

SEQ ID NO: 2134295 - RNA, 18 nt, Staphylococcus aureus subsp. aureus N315
aaguuuaagucaguccau

SEQ ID NO: 2134296 - RNA, 15 nt, Staphylococcus aureus subsp. aureus N315
aaguuguaauuuaaa

SEQ ID NO: 2134297 - RNA, 19 nt, Staphylococcus aureus subsp. aureus N315
aaguuggcggggccccaac

SEQ ID NO: 2134298 - RNA, 23 nt, Staphylococcus aureus subsp. aureus N315
aaguuggcggggccccaacacag

SEQ ID NO: 2134299 - RNA, 21 nt, Staphylococcus aureus subsp. aureus N315
aaguuggggaugggccccaac

SEQ ID NO: 2134300 - RNA, 18 nt, Staphylococcus aureus subsp. aureus N315
aaguugguccaaaucgug

SEQ ID NO: 2134301 - RNA, 14 nt, Staphylococcus aureus subsp. aureus N315
aauaaaaucaaagc

SEQ ID NO: 2134302 - RNA, 13 nt, Staphylococcus aureus subsp. aureus N315
aauaaaauauauc

SEQ ID NO: 2134303 - RNA, 16 nt, Staphylococcus aureus subsp. aureus N315
aauaaaauauaucuua

SEQ ID NO: 2134304 - RNA, 15 nt, Staphylococcus aureus subsp. aureus N315
aauaaaauucuauaa

SEQ ID NO: 2134305 - RNA, 13 nt, Staphylococcus aureus subsp. aureus N315
aauaaaauuaaaa

SEQ ID NO: 2134306 - RNA, 12 nt, Staphylococcus aureus subsp. aureus N315
aauaaaaugaug

SEQ ID NO: 2134307 - RNA, 21 nt, Staphylococcus aureus subsp. aureus N315
aauaaaccuacaauauagaaa

SEQ ID NO: 2134308 - RNA, 18 nt, Staphylococcus aureus subsp. aureus N315
aauaaacuuuaugaaauu

SEQ ID NO: 2134309 - RNA, 15 nt, Staphylococcus aureus subsp. aureus N315
aauaaaaauuauaua

SEQ ID NO: 2134310 - RNA, 12 nt, Staphylococcus aureus subsp. aureus N315
aauaaaaaugcc

SEQ ID NO: 2134311 - RNA, 20 nt, Staphylococcus aureus subsp. aureus N315
aauaaaacgugcaaauaaaa

SEQ ID NO: 2134312 - RNA, 21 nt, Staphylococcus aureus subsp. aureus N315
aauaaaacgacucauuauaaa

SEQ ID NO: 2134313 - RNA, 14 nt, Staphylococcus aureus subsp. aureus N315
aauaaaacuuauaa

SEQ ID NO: 2134314 - RNA, 13 nt, Staphylococcus aureus subsp. aureus N315
aauaaaaggcuuu

SEQ ID NO: 2134315 - RNA, 19 nt, Staphylococcus aureus subsp. aureus N315
aauaaaaggcuuuguuaaa

SEQ ID NO: 2134316 - RNA, 18 nt, Staphylococcus aureus subsp. aureus N315
aauaaaagucgauaaaua

SEQ ID NO: 2134317 - RNA, 17 nt, Staphylococcus aureus subsp. aureus N315
aauaaaaacuucuauca

SEQ ID NO: 2134318 - RNA, 18 nt, Staphylococcus aureus subsp. aureus N315
aauaaaaaccagcuaaca

SEQ ID NO: 2134319 - RNA, 17 nt, Staphylococcus aureus subsp. aureus N315
aagauuuaauaaagugu

SEQ ID NO: 2134320 - RNA, 13 nt, Staphylococcus aureus subsp. aureus N315
aagauuuguaaca

SEQ ID NO: 2134321 - RNA, 20 nt, Staphylococcus aureus subsp. aureus N315
aagauuuguagcuugaauaa

SEQ ID NO: 2134322 - RNA, 18 nt, Staphylococcus aureus subsp. aureus N315
aagauuauuauuacaaug

SEQ ID NO: 2134323 - RNA, 21 nt, Staphylococcus aureus subsp. aureus N315
aagauuaugaaaacauuauua

SEQ ID NO: 2134324 - RNA, 16 nt, Staphylococcus aureus subsp. aureus N315
aagauuaugaaaacau

SEQ ID NO: 2134325 - RNA, 21 nt, Staphylococcus aureus subsp. aureus N315
aagauguauaugaauuuuaua

SEQ ID NO: 2134326 - RNA, 22 nt, Staphylococcus aureus subsp. aureus N315
aagauuagaugauauuuaacaa

SEQ ID NO: 2134327 - RNA, 23 nt, Staphylococcus aureus subsp. aureus N315
aagauguugaguuguaaguuauu

SEQ ID NO: 2134328 - RNA, 21 nt, Staphylococcus aureus subsp. aureus N315
aagauguuugcaacauauuuu

SEQ ID NO: 2134329 - RNA, 18 nt, Staphylococcus aureus subsp. aureus N315
aagaugcuuuaauuaaag

SEQ ID NO: 2134330 - RNA, 15 nt, Staphylococcus aureus subsp. aureus N315
aagaugcuuuaauua

SEQ ID NO: 2134331 - RNA, 18 nt, Staphylococcus aureus subsp. aureus N315
aagaugccucaguuagaa

SEQ ID NO: 2134332 - RNA, 19 nt, Staphylococcus aureus subsp. aureus N315
aagaugauuauucucuuua

SEQ ID NO: 2134333 - RNA, 21 nt, Staphylococcus aureus subsp. aureus N315
aagaugauuauucucuuuauu

SEQ ID NO: 2134334 - RNA, 15 nt, Staphylococcus aureus subsp. aureus N315
aagauaauuuucaau

SEQ ID NO: 2134335 - RNA, 22 nt, Staphylococcus aureus subsp. aureus N315
aagauaauuuucaauuagaaaa

SEQ ID NO: 2134336 - RNA, 14 nt, Staphylococcus aureus subsp. aureus N315
aagauaauauuaaa

SEQ ID NO: 2134337 - RNA, 22 nt, Staphylococcus aureus subsp. aureus N315
aagauagagcccuuagcaauau

SEQ ID NO: 2134338 - RNA, 19 nt, Staphylococcus aureus subsp. aureus N315
aagauagaaugaauaauuc

SEQ ID NO: 2134339 - RNA, 20 nt, Staphylococcus aureus subsp. aureus N315
aagauaggauuuacaccuau

SEQ ID NO: 2134340 - RNA, 15 nt, Staphylococcus aureus subsp. aureus N315
aagauauauuguaag

SEQ ID NO: 2134341 - RNA, 13 nt, Staphylococcus aureus subsp. aureus N315
aagauauccauua

SEQ ID NO: 2134342 - RNA, 22 nt, Staphylococcus aureus subsp. aureus N315
aagauauuuauaagaggagaaa

SEQ ID NO: 2134343 - RNA, 15 nt, Staphylococcus aureus subsp. aureus N315
aagauauaaggaaaa

SEQ ID NO: 2134344 - RNA, 14 nt, Staphylococcus aureus subsp. aureus N315
aagauauagaauuc

SEQ ID NO: 2134345 - RNA, 20 nt, Staphylococcus aureus subsp. aureus N315
aagauagguuuauuucugac

SEQ ID NO: 2134346 - RNA, 18 nt, Staphylococcus aureus subsp. aureus N315
aagcaucguaaaaaacaa

SEQ ID NO: 2134347 - RNA, 17 nt, Staphylococcus aureus subsp. aureus N315
aagcaucguaaaaaaca

SEQ ID NO: 2134348 - RNA, 18 nt, Staphylococcus aureus subsp. aureus N315
aagcaucuucaauauuua

SEQ ID NO: 2134349 - RNA, 17 nt, Staphylococcus aureus subsp. aureus N315
aagcaucauauacauac

SEQ ID NO: 2134350 - RNA, 15 nt, Staphylococcus aureus subsp. aureus N315
aagcauaccuacaga

SEQ ID NO: 2134351 - RNA, 17 nt, Staphylococcus aureus subsp. aureus N315
aagcauaccuacagaau

SEQ ID NO: 2134352 - RNA, 20 nt, Staphylococcus aureus subsp. aureus N315
aagcaugauacucaauaaaa

SEQ ID NO: 2134353 - RNA, 23 nt, Staphylococcus aureus subsp. aureus N315
aagcacaauauuuaccacaaaua

SEQ ID NO: 2134354 - RNA, 19 nt, Staphylococcus aureus subsp. aureus N315
aagcacagaaaauuauacu

SEQ ID NO: 2134355 - RNA, 18 nt, Staphylococcus aureus subsp. aureus N315
aagauuuuguuuugaguu

SEQ ID NO: 2134356 - RNA, 15 nt, Staphylococcus aureus subsp. aureus N315
aagauaaacaagcca

SEQ ID NO: 2134357 - RNA, 23 nt, Staphylococcus aureus subsp. aureus N315
aagauaaauaaaaggcauucuuc

SEQ ID NO: 2134358 - RNA, 22 nt, Staphylococcus aureus subsp. aureus N315
aagauaagaugguuugaguaaa

SEQ ID NO: 2134359 - RNA, 17 nt, Staphylococcus aureus subsp. aureus N315
aagagccacuaaugauu

SEQ ID NO: 2134360 - RNA, 19 nt, Staphylococcus aureus subsp. aureus N315
aagagguauacaguuaugc

SEQ ID NO: 2134361 - RNA, 13 nt, Staphylococcus aureus subsp. aureus N315
aagaggucuccaa

SEQ ID NO: 2134362 - RNA, 12 nt, Staphylococcus aureus subsp. aureus N315
aagacuucccua

SEQ ID NO: 2134363 - RNA, 21 nt, Staphylococcus aureus subsp. aureus N315
aagacuucccuauauguaggg

SEQ ID NO: 2134364 - RNA, 15 nt, Staphylococcus aureus subsp. aureus N315
aagagauaagaaaau

SEQ ID NO: 2134365 - RNA, 14 nt, Staphylococcus aureus subsp. aureus N315
aagagaauuuuaau

SEQ ID NO: 2134366 - RNA, 17 nt, Staphylococcus aureus subsp. aureus N315
aagaauacaaauauuaa

SEQ ID NO: 2134367 - RNA, 13 nt, Staphylococcus aureus subsp. aureus N315
aagaauaacuauu

SEQ ID NO: 2134368 - RNA, 15 nt, Staphylococcus aureus subsp. aureus N315
aagaauaaacaacau

SEQ ID NO: 2134369 - RNA, 17 nt, Staphylococcus aureus subsp. aureus N315
aagaauacaugacucca

SEQ ID NO: 2134370 - RNA, 16 nt, Staphylococcus aureus subsp. aureus N315
aagaauaaaaaaguug

SEQ ID NO: 2134371 - RNA, 15 nt, Staphylococcus aureus subsp. aureus N315
aaauugacucaaaga

SEQ ID NO: 2134372 - RNA, 19 nt, Staphylococcus aureus subsp. aureus N315
aaauugaguauauucaaaa

SEQ ID NO: 2134373 - RNA, 18 nt, Staphylococcus aureus subsp. aureus N315
aaauucuuauaaaauaaa

SEQ ID NO: 2134374 - RNA, 19 nt, Staphylococcus aureus subsp. aureus N315
aaauucuuuuacagcaaga

SEQ ID NO: 2134375 - RNA, 18 nt, Staphylococcus aureus subsp. aureus N315
aaauucuuuucaagaaau

SEQ ID NO: 2134376 - RNA, 13 nt, Staphylococcus aureus subsp. aureus N315
aaauucuuuugua
